United States Patent 7,750,207 (ZEA MAYS RIBULOSE BISPHOSPHATE CARBOXYLASE ACTIVASE PROMOTER) - sequence listing, part 14

SEQ ID NO: 19176 - DNA, 1865 bp, Zea mays
agcgatcacctctggtgggctctccagcgagtcactgctcaccggtcaccgccatggccgggaagcagttcccctccccggcgaactcgcgctccgcctcagcctcctcccgccgactcctcgccgccgtcgccgcctccctcatactcctcacagcttcctacttcctcctcctctccccatcttcgcaccgatccgccccagccatcctcgcgaaccctagcgccaccacatccttcctcgcctccctcgaccgcttcctctccgatccgcatccctctgcctccgccgccgctcctgtagaacttgacgccgcgatccgggtccaggaggatgcccgtctctacggggaccccacatggcccgcgccggccgcggggctgctcagggtctacgtttacgagatgccgagcaagttcacgtacgatcttctgaggttgttcagggattcctaccgggacaccgacaacctcacgtccaatgggagccccgtgcaccgcctcatcgagcagcattctattgactactggctatgggcggatctcatcgcacctgattcacagagacttttgaagagtgttattagggttcagcagcaagaagaagccgacattttctatgtgccattcttcacgacaatcagttatttcttgctggagaaacaagaatgcaaggcactttatagggtctgggagcatctcttaaggaagctttgaaatgggtcacagatcagcctgcttggcaacgttcagaaggcagggatcatgtcattcctgttcatcatccatggtcatttaagtcagtccggagatctgtcaagaaagcaatatggcttctacctgatatggactccaccgggaactggtataaacctggacaagtatatctagaaaaggatgtcatccttccatatgttccaaacgttgatctttgtgatcacaagtgtgtattagaaactcaatccaaaaggagtatattgctgttctttcgaggaagactgaagagaaatgctggaggaaagatccgcagtaagcttgtagaggaacttaaaagtgcaaaagacatagttatagaagaaggttctactggagctcagggaaaagcagcagctcaggatggcatgcgcaagtctctcttttgcttgagtccggctggggataccccatcttctgctcgcctgtttgatgcaatcgttagtggttgtatcccagttataataagtgatgaactggagcttccatttgaaggaatacttgactatagggagatagcattgtttgtttcagcaagtgatgctgtgcaaccgggctggctcttgaaatacctaagaggaatcaatgccaaaagaataagagaaattcagtctaatcttgtgaagtattcaagacattttctgtattcaagtcctgcccaacctctcggaccagaagaccttacatggagaatgattgctggtaagctggtaaatatcaagttgcagattcggcgttctcaacgtttggtcaaagagtcaaggagcatatgtacatgtgaatgtagagttgggaacaccacgagaatgctttgaccaatattttcatttgtgcctttaaacttttgtagcatagccgttttttgttaccaatgaggcgagctttgagtttggcaaaatttgccgatgtatttgtaaatgcaactgagctggaaagagttgtgatactgtactaatcccgatgcttgtgtttgctttactgcccgttaggaacaaaaggaatgtaaaacagagaaatgtaaaaaaaaatcaagagcttgaagtagatatttatttcctccatttcatgaatgaaagtaagtcttttcataggaaaagaaaacttcattccact

SEQ ID NO: 19177 - DNA, 1770 bp, Zea mays
ctcgaggccgcccgggggccccccgcggccgacagcgatcacctctggtggggtctccagtgagtcactgctcaccggtcaccgccatggccgggaagcagttcccctccccggcgcactcgcgctccgcctcagcctcctcccgccgactcctcgccgccgtcgccgcctccctcatactcctcacagcttcctacttcctcctcctctccccatcctcgcaccgatccgccccagccatcctcgcgaaccctagcgccaccacatccttcctcgcctccctcgaccgcttcctctccgatccgcatccctctgcctccgccgccgctcccgtagaacttgacgccgcgatccgggtccaggaggatgcccgtctctacggggaccccacatggcccgcgccggccgcggggctgctcagggtctacgtttacgagatgccgagcaagttcacgtacgatcttctgaggttgttcagggattcctaccgggacaccgacaacctcacgtccaatgggagccccgtgcaccgcctcatcgagcagcattctattgactactggctatgggcagatctcatcgcacctgattcacagagacttttgaagagtgttattagggttcagcagcaagaagaagccgacattttctatgtgccattcttcacgacaatcagttatttcttgctggagaaacaagaatgcaaagcactttatagggaagctttgaaatgggtgacagatcagcctgcttggcaacgttcagaaggcagggatcatgtcattcctgttcatcatccatggtcatttaagtcagtccggagattcgtcaagaaagcaatatggcttctacctgatatggactccaccgggaactggtataaacctggacaagtatatctagaaaaggatgtcatccttccatatgttccaaacgttgatctttgtgatcacaagtgtgtattagaaactcaatccaaaaggagtatattgctgttctttcgaggaagactgaagagaaatgctggaggaaagatccgcagtaagcttgtagaggaacttaaaagtgcaaaagacatagttatagaagaaggttctactggagctcagggaaaagcagcagctcaggatggcatgcgcaagtctctcttttgcttgagtccggctggggataccccatcttctgctcgcctgtttgatgcaatcgttagtggttgtatcccagttataataagtgatgaactggagcttccatttgaaggaatacttgactatagggagatagcattgtttgtttcagcaagtgatgctgtgcaaccgggctggctcttgaaatacctaagaggaatcaatgccaaaagaataagagaaattcagtctaatcttgtgaagtattcaagacattttctgtattcaagtcctgcccaacctctcggaccagaagaccttacatggagaatgattgctggtaagcttgtaaatatcaagttgcagattcgccgttctcaacgtttggtcagagagtcaaggagcatatgtacatgtgaatgcagagttgggaacaccacgagaatgctttgaccaatatttttcatttgtgcctttaaacttttgtagcatagccgttttttgttaccaatgaggcgagctttgagtttggcaaaatttgccgatgtatttgtaaatgcaaccgagctggaaagagttgtgatactgtaaaacagagaaatgtaaaaaaaatcaagagcttgaagtagatatttatctccaa

SEQ ID NO: 19178 - DNA, 4617 bp, Zea mays
  misc_feature (4042)..(4042): n is a, c, g, or t
tttcataaagctgaagcttcttcttgtcttttctctaggcatcaacttggtcgaaggtgggtttcaccatccttcgagagcacctaaaacatacttagggctagtttggtaattccatttttctaagggattcctattttttcttggaaaaatgaattagtttctcttgagaaaatgaaaataccttagaaaactgtggtttccaaactagcccttaattgacaatattacactttaaagatcttcagcaataaagaccaccaataatttgggaccaagctaatacgacagtaaagatagatagaaaaagtagtgctgtataaagttttttttctcttaaaaaactacaaaagagaagtaacgcgtacaacatgttttcgctgtcgctgcaagttgaagccaagagagaatatatatgtggtttgtattgtacgtataagtatccctggacggatataggcgtatgctaaggtatttgccgtgtcctgttttgctataaaataaaaaaaaattaatggtgttatgagcggcacggttgagtctgctattgtctttggagtaccaggcaaatgagtttataaaagtagaataaaattatgtgtattgctagaaaataggctaaatttatgcgggttacttgtaacaaaaaaatctaccctttttgcaaatggatagataacgtcctattcgaattcgactcgtcaaatagaactgagattcgatatatatccaagtctgtatattcagtatcatatccgtgtactaccgctagatatttaagatatcgatatctaattagttttattcgagacaactaataatatcttttaaatttaaatagaaaatataaaaaatatatgactatagtacgattacatccgtagttccctacccaccttgtacgtttaatggtggtctcacatgatagatagaagtgctccaacatggtgatgtgatatttttgtttcgttacgcgccgaccgcgacgaggccgaccgtgccgagaagacaaaaataatatcagtcggggcggtggccagccgtgtccttgtatccgcggtccgcggacccgccgcctcggccccttggtgccttggtggtggcgtgggcgtggtccatggacctggcgcacacacgcacgcacgccccagcgggcagcgcccacccccgcgccctcgggccccgcgcatggataactcgtgggtggggcccagccaaccccccttccgcccgcagattttttgcgagacccgtcggctcggcctcggcgtgcaagaaaccagaccaacaacaaaaaccgactagcccaggcaagcagaaacccactgtctccgcttccgctcccgactcctttgtctcgtcctcatccatccaaccaggcgagccaacaagcaagcaaaagtaaacggggcgaggagctggagagacgccggcgacgcgaagcaaccgcccgatcggagccgcggctgagcaggagggagccggagatggtgggtctcgtcggcggcagcacggcgcgggcggagcacgtcgtcgccaacgccggaggggaggcagagtacgtgcgccgcatgcaccgccacgcgccgaccgagcaccagtgcacctccaccctcgtcaagcacatcaaggcgcccgtccacctcgtatgtcccccctccaccccgctctttcctaccctcaacgcggctggccccggtggttcagcggttggactgcctcgcgtctgggctgctatttctcttcggatctggagtcaggagtccttcgtccgatttccaaggccttgttgggtgtctcccccccaccgacgtgttctcgtgatgttgggttaatcgcggctggcgtcaaatcgattggaagctgacgtcaagcacgtcaaggcgccgcgtccgaccccgtgtgggagctggtgcggaggttcgaccagccgcagcggtacaagccgttcgtcaggaactgcgtcgtgcgcggggaccagctcgaggtcggcagcctgcgcgacgtcaacgtcaagaccggcctgccggcgacgaccagcaccgagcgcctcgagcagctcgacgacgacctgcacatactcggtgtcaagttcgtcggcggggaccaccgcctccaggtccgtgctgctgccgcccgtttgttgcgtccctgcaaaaatgctctgtttcacgcgccctccttgcttgtcagtgtactccaaattatttttgggggtatgcttgctttgttaccatttctcttttttttaaattaaattgctttcttgtttccatttcactgcagtcctgatcgctggatgctatgcatgaaatgcatttgctgtgcttgcgagattgggcatttactatgagctttgtgacagttaacatcttggtcctgtttggaagctgggattgggaatcaaatccttacatggtttaggagcatccagtttgaacttaaaccattgtagacatctgctgcaataaaaacaattggcttcggtgagaggcactcatcatcagttcaaacttaaaacgagataagccatcggttgattggcctaattaccttgcttcccgtgattgttcgcctcgctgaaaggatatgctcacaacccgtactgttttgacttgttatccacatactatttaagtacgaaaggacatgcgtactactttcatttgttgttcttcgtctagtcttcagactgataatataaggtgaaaaacttcgatgtttcgcgtgctgtcaagtgattgtgaagcaaagtttctgttagtgtcaatgcgtacaggctgcaatggccatctttactcctacttgaagcatatctctgatccacactgatgatgatgagttgtgtgcgccacttttttttctttttctttcagaactactcatccatcataactgtccaccccgagagcattgacgggaggccgggcaccctggtgatcgagtcgttcgtggtcgatgtgcctgatggcaacacgaaggacgagacatgctacttcgtggaggccgtgatcaagtgcaacctcaattctctcgcagaggtatcggagcagctagcagtggagtcacctacgtcgctgatcgatcagtgaagtcacctgcgtcgcccatcgatcagtgaccaccggtacaaaaaaagacgtcaatcagcaacaaataagaagaagcttcgaaggctggctggagagttcaacctttttgagaccggtggtttggccatcgtcttctgcgtgtaatgtctcttggaatatggaagtattagtcgttgtgtaggattaaacatctgtagtagcttgtatgctagggatggttgtttagccttagaaactgcacctagatacctcatggcatgtatgcatactgctagtatgtgtagagatcagggaaagcatggagcgggttttgcctcttaggtgcatggagatctgtctttttttccccctccattttgcggtggcgactctattggttggggttcttggataaatatactttcccgcgaacgcatagggccggattttggaattggttcaattctcgtaattattgtattctctagtgttattgggatttggggtttggaattgccggactgcgataagtgatgaaaatgtagacattaaagctctcgatgtcagatataatatgttctatgataatactcgatgttagataatactctatgttctgccaaggggacagctacatgtttgagtcggttatatgctttctagcataactaaggggatttgagtcggttatatactttcaagcataactaaggggatatttggtttgagtaatcacttcattcaaattgagatggagtatctatggatggtcaataagtacgagacccgcgagcccgtacgaagcctgctgtttgggcctgatccgagcccggcatggcctggttctatgcgggcccggcctagcacaaataagtggaacaaataagtggcacaaataagtgtcccataagtgtagcattcgatttcataagataaattaaatgcaaataatcaacataccgagatcgaanccacatatgcagcgattacattaatgttataccattgcacagtgcacaaatataaagagtattaaataatattaaataccattgtcttaaacatagttttaccgaaaactaaactaaggaaacgaaagataacactcctacacagacatattagttttaattaacctaagaaataaaacttctaagaattgttccatcatcatatccaaaccaaaatatatctaatcaaagagagaaaccatgccacaattaactatgatcataattgatatattagttttaattaacactctgtagaagctgtactcttcacccatgagttatgattcctatttgccacatgttgtacaaaccctttaacacttctggagtgagttggtagggtctcactatgtagtttttacaaagattcctcaaatgtatagtcgtatgttgcgtttcttcagttactaagcataggacttgtttccaaggcggtgactaacaaaaccaaatgaataaaccttagtaccttgccttggtagagttagaacgtgacctagacacccacacgatatgatgacgaagcagaatac

SEQ ID NO: 19179 - DNA, 1425 bp, Zea mays
  misc_feature (1388)..(1388): n is a, c, g, or t
attcagcccgcagatttttgtacccgccggctgggcctcggcgtcggcgtgcaagaaactagaaagaggagcagacaaacaaaatcgattagaattaaccccaggccagaaacccactctctctcccccccgattcctttcctcgtcctcgtcctcgtcctcatccgtccaggggagcaaacaagcaagcaagtaaacgggcgaggagctggatagaggccggcgacgcgaagcaaccgccgatcggagccgcggctgaggaggaggagcaagctcgagatggtgggtctcgtcggcggcagcacggcgcgggcggagcacgtcgtggccaacgccggaggagagacggagtacgtgcgccgcctgcaccgccacgcgccggccgagcaccagtgtacttccaccctcgtcaagcacatcaaggcgcccgtccacctcgtgtgggagctggtccggagcttcgaccagccgcagcggtacaagccgttcgtcagaaactgcgttgtgcgcggtgaccagctcgaggtcggtagcctgcgcgacgtcaacgtcaagaccggcctgccggcgacaacaagtaccgagcgcctcgagcagctcgacgacgacctgcacatactcggcgtcaagttcgtcggcggggaccaccgcctccagaactactcatccatcataactgtccacccggagagcattgacgggaggccaggtaccctcgtgatcgagtcgtttgtggtcgatgtgcctgacggcaacacaaaggatgagacatgctacttcgttgaggctgtgatcaaatgcaacctcaagtctctcgcagaggtatctgagcagctagcagttgagtcacctacatcgccgatcgatcagtgagtcgcctgcatccccgatcgatcagtaacaccggtacaaagacatgaatcggcaacaaataagaagtttcaaaggctggctagagggttcaacctttttgagattggtggtttcgccatcgtcttctgtgtgtatgtctcttggaatatggaaggtttagtggtatgtaggtttaaatatcttgttgtagcttgtactacctccgttctcgaatatttgtcgttgactagtttatttttaaactaaaccgcgacaaataaaaaagaacggagggagtatgttagggatgatttagccttaggaactgcacctacatacctcatggcatctatgcacactgctagtatgtgtagaaatcagggaaagcatggagcggtttttgcatcattggtgcatggagatatatgccttttttccctccacaggccgcggcggctacctcactggttggggtttatacttcaccgctgacacatagggtctggattttggattttgtttaattctcgtgatgngcagtattgtattctccagtgttactgggatttgacc

SEQ ID NO: 19180 - DNA, 1291 bp, Zea mays
  misc_feature (1261)..(1261): n is a, c, g, or t
gcacgagaccattacctagaacatcctaatcgaaaaactgtctccgctcctcccgactccttttcctctctctctctctctcgtcctcatccatccaaccaggcgagccaacaagcaagcaaaagtaaacggggcgaggagctggagagacgccggcgacgcgaagcaaccgcccgatcggagccgcggctgagcaggaggagggagccggagatggtgggtctcgtcggcggcagcacggcgcgggcggagcacgtcgtcgccaacgccggaggggaggcagagtacgtgcgccgcatgcaccgccacgcgccgaccgagcaccagtgcacctccaccctcgtcaagcacatcaaggcgcccgtccacctcgtgtggcagctcgtgcggaggttcgaccagccgcagcggtacaagccgttcgtcaggaactgcgtcgtgcgcggggaccagctcgaggtcggcagcctgcgcgacgtcaacgtcaagaccggcctgccggcgacgaccagcaccgagcgcctcgagcagctcgacgacgacctgcacatactcggcgtcaagttcgtcggcggggaccaccgcctccagaactactcatccatcataactgtccaccccgagagcattgacgggaggccgggcaccctggtgatcgagtcgttcgtggtcgatgtgcctgatggcaacacgaaggacgagacatgctacttcgtcgaggccgtgatcaagtgcaacctcaattctctcgcagaggtatcggagcagctagcagtggagtcacccacgtcgctgatcgatcagtgaagtcacctgcatcgcccatcgatcagtgaccaccggtacaaaaaagaagcttcgaaggctggctggagagttcaacctttttgagaccggtggtttcgccatcgtcttctgcgtgtaatgtctcttggaatatggaagtattagtcgttgtgtaggattaaacatctgtagtagcttgtatgctagggatggttgtttagccttagaaactgcacctagatacctcatggcatgtatgcatactgctagtatgtgtagagatcagggaaagcatggagcgggttttgcctcttaggtgcatggagatctgtctttttttctctccattttgcggtggcgactctattggttggggttcttggataaatatactttcccgcgaacgcatagggccggatcttggaattggttcttcaaagaaaaaaaggccatgagttggaattatatagatagntgaagtctttcgccctgggaagagagggga

SEQ ID NO: 19181 - DNA, 1337 bp, Zea mays
cggacgcgtgggcggacgcgtgggtcccactagtgcgtaaatgctaaactaattcaaaatttatttgagcaaactgtgagcctcggaaaggagcatggaagatcaatgcaactagctagcttgttaacccaccatgactccataaccgcatagattagagattgtttgaagaagcaggagaaactgaaactcaattgtagagtatgtaccccacgcgtccgccataattgccttctttttgtctcctttgaatgctgaggtagctactgtttagctacttgaccttttctttacctcgggaatagcagattacatatttatgatgagtgatgctttttgctaatacttctactgtgggttaacccacatacacaccaactcaaaatttgcgatttcggaagtgctaaagtattggtcagaggagagccaaacatctcctacatatgctcaaggtattatcgagcaccagagctcatatttggtgcaacggaatatactactgctattgatttgtggtcaacaggctgtgtcatggcagagctgcttctaggacaggctctgtttcctggagaaagtggagtcgaccaactagttgagatcatcaaggttttgggtactccaacaagggaagagatcaagtgcatgaacccaaactatacggagttcaagttcccacaaattaaagctcatccgtggcacaaggtttttcaaagaaggcttccacctgaagcagtggaccttgttagcaggtttctacaatactcaccaaatctacggtgcactgctttggaggcctgtatgcaccctttcttcgatgagctgagagacccaaacactcgtctacccaatggtcggcctctgccgcctctcttcaacttcagatctcaagagctaaaaggcgttcccccagaagtcatcgatcgccttgtcccagagcactcaagaaggcagagtttgttcatggcgctaaggacctagtttttgccgttctttttgcccccttttttcccaccgtttgccaccttgagggaagcttgtaaagctatagcttctcctttcccctcgtccttactttcctcccctctctttcttccgagctttgtgtggatgagagatccttgagatacactgctagagctgtgagttccaggatgtgaggttcgagtgtgtgtgatgtgcagttgtcgcctttgaggtcggagatttcagttgcagtgttgtgagaggcttgtgaagcttttttgtctacttttcagtgcttctctggcttgaagttttccttcaattctaaaaaaaaaaaaaaaaaaaaaaataaaaaaaaaaaaaaaaaagcggcc

SEQ ID NO: 19182 - DNA, 885 bp, Zea mays
cgatcgaactccaacaagggaagagatcaagtgcatgaacccaaactatacggagttcaagttcccacaaattaaagctcatccgtggcacagggtttttcaaagaaggcttccacctgaagcagtggaccttgttagcaggtttctacaatactcaccaaatctacggtgcactgctttggaggcctgtatgcaccctttcttcgatgagctgagagacccaaacactcgtctacccaatggtcggcctctgccgcctctcttcaacttcagatctcaagagctaaaaggcgttcccccagaagtcatcgatcgccttgtcccagagcactcaagaaggcagagtttgttcatggcgctaaggacctagtttttgccgttctttttgcccccttttttcccaccgtttgccaccttgagggaagcttgtaaagctatagcttctcctttcccctcgtccttactttcctcccctctctttcttccgagctttgtgtggatgagagatccttgagatacactgctagagctgtgagttccaggatgtgaggttcgagtgtgtgtgatgtgcagttgtcgcctttgaggtcggagatttcagttgcagtgttgtgagaggcttgtgaagcttttttgtctacttttcagtgcttctctggcttgaagttttccttcaattcttgtgaactggcttcaagatttggcttcgtgaaccctgtgtgcgtgtaaaagtactggttggatgctgctgcaccaattctggaaaaaaaagcttacaactaaacacctacttatgttttgtttagcccaaaaaaaaaaaaaaagggcggccgcctcgctagagaggatcgccagcgtacgcgcgcgtgcgccgtcaatgatctt

SEQ ID NO: 19183 - DNA, 4940 bp, Zea mays
ttggtcggagtgactagatctagattgctatggtcggggcgttctagctaggtcggggaagctctagtcaaggtaaccagctcaagtggctaaggtagaggtggtgctcttatcttataatgggtgtttctaggcatcctaagggaactctagtatgggtacacatcaccacctctaccaacatgatcaccatcatgtcctcctcttcctcgaaaatcaccatacgctgcagcattaatgctcatctgataattggtttgattttctagcttgacttctgtggcaagcaattgcgcaaaggtatcattgagtatggtcggatccacccttgaagtaactgactcaaccaaaggactttaatcgactagccataatgtgcatctaatggagtgtgatagttcagatgatgaatccacagatgtatataccactgagcttgtttggacgatgaaggtcgaatcttcagcatgttcttctttgcagccgattcaaaagaatcagcgagaagttaaatttacttttaatgttgccaaatgtgataaatatttgaagagcttgtagaaatggtaacactaaattatcacataatattccttctatggatgaattaaatatacgtgcttgttgcaagtggcataattccttttcccatgccaccaatgattgtaatgttttccgcaaacatatacaatcagtcttaaataagggccggttaagttttcaagagatgcaagttgacacggaaccatttcttgtcaatataatagaaccagcaaacaaaaaagtcttggttcggcctaaagtggtcgataaaggaaaaagaaaagcatcgtcattggtgatcctctcgcatcgaatatatcgtgagggaattatcggaaagctcgagacagtaacaagtctggaggcgccggggccatgcttaatcgagcagtcgggcaaagttccctgactcgagcagcatagacggtccgtcacctgcgcacgaacggtcgacgctcaatcagacggtccggctgattcagccgaacagtccgcccgtgaccagaggcatcgacctccccacaaagcaaaaaaggggacgcagtgacaaagtacatataatgcacgtggtcagttagtcaaaggcgaccatacttttgatcaattgctctccaaatatgctagcaagaaggccgttctacgcgatcgaccaataaagaaaaccggtgacctgctaaagcaaaatggacgaataaaacagtccgaaaggcgacgcagcaagcatcgccttttcattcagtgatattaggatactttccatcccccttcttgtcggatatatattgtcttgttcaaatgtataatggtacgtcgatgaacatgtggtacatgcatagttcctttacctattctggctggggccacctccattctataccttttgatccattgaacagatggtcatgaccgagaaatatgcaatccaaagcggcatttatgcattagagctctattgaatgatcaccctattggattgaaaagtcgatgacttgcattaggtttagttcttacttcgggaacaagatggcttgtgagatatattgtttctcgaagggtgctgacagtatatgtgcctttggcttgcctagctcacccaatggcaggggcatgtgttgaacaccacttttggcagggcgaacggtccggtcctgaggccagacggtttacggtccggactgtccgcgatgttggtgcgaatggtcctcccgtgcgcagaatcagttacggttactcgtttcttgcggtatttgttagtgatctccatatgattagctcgggaaccaacttgtaacgggtttagacctttccccttatatagataaggggtacgaccaattaaacctctacaatcgatcaatcaattctacttaccatttttaccttatgaattaggagtagccctaatttagccttcctctatctgaaatcttcaactctcttcagttctacgtcgactagagacgtcttagatggcctgtcgaccctaagacacaccctaggatctcacattccagaaaacgagatctagatctgccgcgaagaagacgatcctctgcatcaacgcgggtcgtccgagcctcacacggaccatccggacgtacacagagaaagagtcactactgtgctcaggtcacaaaccgtctagcccgtttatctcctgtgcttgacgtactaatcggcgtcaacatgtagtccatgtaaagcaatgttgacccttttcagggaggcggaggataactggatcgagagatgagcattgactactccaatggccatcagctctccggagctgcttcgctggcagagcatagatatcagatatgtcctcacgccgtccaaaaaaataagtgcagttgagtgacggtcgattccgaatttctgagcctgtcactgcggcaccacaaaattctacggaatactacagttctgaagtgagtacagcaaaaaaaaattgttccaatgattatcaaagacatctgcgcaaacagtttagtcagcacaagataagttgttcaaaattgccacacatttttatgacatacttgtctaaggtatctaagattagtcattcaaattatgcgtcacagttttccggattaaaaaaatctttcgcgtttttacaagtcattaatgagtgagccctacgtagtaggataaatctttttgttatacatgtggctctcaatcatatgtatacctaatttggttaaatttatctaagacgtggtaaattatggaggcaataaaccaaacagcttctgcatagtgttctttcccgtcccttcaccttgtggtgcgcgggtgatcggtgatccacgaggacgaggaccaccgaagaaaagtctcgtcacattcctgctcccgtcaccatcactccgcaggattttgtattctacagttcgtagcagcagaagatgagagaccacagacaagcagtagttgtttgttcaatcgtctgccggggttgcgggttgtcaaatctcacttgttttctcctaccaagcagagccaagcctactcttccaatccctgtcagggtggttagtctttgagctggtgggatcatggttgccaagacgaggacgaggcgacagctcgccaagctcgcgctgcttctactcgccctgctgctcctgctcgccgccatcctgctgtgcgtcttcttgatcccgcgccaccacaggaggccgctgccccccgcctcgccgccgggggcggggaacgcctcgaatcccgacgacagcatcgtggcgttcgacttctccccgtacctcatcatgtacaagagcggccgcgtgcaccggctggacggcaccgcccggtgctcggccggcgtggacgaggccacgggggtgacctccaaggacgtcgtgatcgacagcgggaccaggctcgcggcacggatgtacctgccgccggcgccccgcgggacgcaaagcaagggcctcggcaggcggcacccggtgctggtgttctaccacggcggcgcgttcgtcatcgagtcggcgttcacgccgctgtaccacgcctacctgaacggcgtggcggcgaaggcgcgcgtggtggcggtgtccgtggagtaccgcctggcgccggagcaccggctgccgacggcgtacgacgactcgtggcaggcgctcaactgggtggccaggaacgccggatccgggccggagccgtggctgcgggaccggggcaacctgtcccggctgttcgtcgccggggacagcgccggcgccaacatcgcgcacgacatggccatgcgcgcgggcacggggggcgggctggacggcggcgcggccatcgcgggcctcctgctcctggacccctacttctgggggaagaagccggtggccggggagacgacggacccggccaggcggcgccagtacgaggcgacgtggtcgttcatctgcggcgggcggtacggcatcgacgacccgctggtggacccgctgtcgatgccggcgtccgagtggcggaagctggcgtgctcgcgcgtggcggtgacgtcgtcgggcctcgacgacttccggccgcgcgggctggcgtacgtggcggcgctccgcgacagcgggtgggacggggagacggagcagtacgagacgcccggcgagcggcacgtctacttcttggataggcccaaggaccccaattccgtcaaggagctggccttcgtcaccggattcctgagccgggagtaggtaggtagccatcacggcgagggcgtacagtttaggtgcaatcgtgaggattgcttgctgatcgaggcacgtgaatacgtgattgattaatagagactattatttctaacaaaaaaaaaaaaaaaatttgtttttttgtgtttggatcttgatagggttctcgagaggtggtgatgatttggttgatgacgagctcggtgaatgaatctggctggggatgtagttgaccacacatctgacatcgtgaggaaagctgcctgcagcagtgcagcctgaaactgtggctgagaataaaagcactacacaaatataggacttgttttcagttccagaaatcctcgtaccagaagactcacgagccacgacgcaaaaatgaactgcgtcggctgttctgtgttcagacttcagcttgttgatgattgacaccttttccttttgaaacaagacaaacttcatcagacggttgtgtattagctcggattatgaacgcgatctcgctgctttcgatttttaggtgcaaaggctgcgacgggctgtactctggtagctgcccaatgcttgtggtagcggaagacggcaaagctacgacggtctcggcttcgctgctgttgaggaactgtggtagcggcagcacgctcgggataggggtagagggcgtcgagaacgaaggccctggcgtacacatccactgca

SEQ ID NO: 19184 - DNA, 1055 bp, Zea mays
ttttttttttttttttgcacggtataagaacacaacttcaatgctcatttctttttgtttctcacttctcagccgtgcatgcacgttaggggcctacgaggctacgaccggtcctgaacatgtacattaggggccgcaaattaagagccgattgccttggcccgctatgagaaagagagacgagataggaatgtcaaatgtctgcgcgcctagctcagtagctctaccactgccaccgacatgctgttcgcatatgcaatgcagtacaacatctgacaacggtagtactagcaaaaagcaaaacagaccagatagaacggccgaggaagtcataacaacatcgatcgaagtatcgaacggatcatttcaccactcccagaaacagcaggatctggaggaagatgtaggacgcgcccccgatggtggcgtactgcagcttgctctccccctccacgcctgcgaagtcgccgtccgcgcacttgctgaacccgccggcgagccacgccaggttcctgtacccgtcatcgtgcagcatcctcaccgcgatcaacgacctgaggccttcgccacaagcgacgagaagcttggcgtccttgctgccgtcgacggcggcggcgacgtcgtcgacgaagcggtcgttcatcttggtgaaggcctggccggtccagagcccgatgtagcccaagtggacccacttcttcagcagcgtcacggggcccatgtcgtcgtcccccacgaacagcggcacgtgcaccgagccccgcacgctggcgcgggcgcgctcccactccggccggacgtccagcaggcggaacccctcgccgcccagcgcctccgccgcgtccctcggccgcacggccctcaccgcgcccgaccgcaccagcgcctcggcgcctccggcccacgacgacgtcgcctgcgccctgacgcgacgtcgggccaggccaggggacgcgggcctggtgcaggtggatgcggccgccgcagcacccatagccatgcccacttccacttgctgcttgtcaattgaggcctcgctcagtcgcgttcgtttc

SEQ ID NO: 19185 - DNA, 2937 bp, Zea mays
ccgccgttttggatcatccgttctccatgaccccgcttgtaggcgcgcgcatcgttgcgtgtcgaacagcgcacggtcgagctgcactcgaccggcccttagaagcccaagtttttagaagagcagttcgcagcgtggatgctggaacacaagtgaatgacgacccagctagactcgcacgacactagaccttacatgtgatgtgacaacatgctactctcgtcctgcaagaaagctctcgaaagtcaaaccgtgtcctgcccacacatgttttgcttctacacggaaatccctgaaaacgtatagttttttttatttttgttacgctccatctcgcttccaggcgtgaagcatccattgaccgtgatccgtcccaagccccaaaatggtcccgttgttaagctccaagcgtgggatcagcaacggtaatttctgggttccaaaacgtggttatgcaggggatccgttgtgccatcaacgcccgcctcctgacgagtctctgcgggggcagggctgctgcagcggctcagagagatgccccacccccacgtgctccgcctcgtcatgggtggtccccagactgtctgcgacgaaccaggacaaaaagaaacaggcgggagtggcgctaaaaataagggcaaaggcgcagcagcggcgcccgcccggcacaagagagcaccacgccaccccttcctgtctctctgctcctccgcatccgcttgtgcgcccgtgccgctcactgcactccattcccaatctctctgcctcccctgcctgtctctccacgccagtgcgcgcagatccggcgggtgtgaagaggagctcatcacatcctctgctgcttcttctgtccaataagagctagctagctagctagctcgccgattcaacagcaagcggcggcagtgatgcgcggacttgtcctcgcatagccaagatccgtccagcagcggcagcttgagcgcagacagattcaagaatggaggagaaagcggcggacgcgacggcgacagtggcggcggcggcggcagcggcagcggatcaggacggcgcggtgtactgcagcgagcacccgtacccgccaggcgcggcagcggcggccggggcgggcgccggcggcatctgcgccttctgtctgcaggagaagctcggcatgctggtctcgtcgtccaagtccagccccttccacccgccgccgcagcagccggtctccgccgcgtcgccgtcctcgacgacgccgccgccgtccaaccgcgcctcctccgaggcgccgccgccgccactctaccctcccgcggcgtcgcgcaaggtgatgcccgcgcagagcgcgggcggcggcggcggcgggctcaagaggagtaagtcggtcgcgccgcggccggaggagccgctgccgccgcccgcggtcacggcggacagcccgcgcaagaagagcttctggtccttcctccacctctcgtcgtcgtcaggcagccacaagggcggcgcgtcatcggcttcggcgggcagcggcggcgccgcgaggaggaactccgtgtcggtggcgtcggcctcgtcggcgtcgctcgggggccggctggaggcgatcgtggagccggagagcccgggccgccggagcgagggctcctcgtcgtcgtcgttcgggcggaaggtggcgcgctcgcgctccgtgggctgcggcagccgcagcttctcgggcgacttcctggagcgcctctccaccggcttcggcgactgcgcgctccggcgcgtcgagtcccaccgcgagcccaagcccaaggccgcgctgggccacctgggcggcggcgaggagcacgagcaggaccaggaccagcaccaccgcatcaagtgcgccggcttcttcggcggcggcctgggcgccgcggccccgccttcgtcatcctactggctctcggcacccgacggcgccagcgccagcgccagcgggagcgcgaggggctccggctcgcggagccaccggagctgggcttgggcgctggcgagccccatgagggcgctcaggccgaccagctcctcgtccagcaagagcatcatggccgcgcccacagccgcgtgagtgaagggcagcggcagcatgcatgcagatgcgggggtagcttcatggggttgatgctgccgctgcgtgagcgatcaatggccggtgaatcatcatccattccatccctcgaccatatatactagtactacataaatgtctccatctttattggtgttctcgtgtccatgccttacgatttttaagcagaacctggtcctgtttatgttggaaatgttgctatggatctagctatagctactgcctttacatttgggattcctgtctccagtggccaagaaaactgtggaacttgttaatctgtttaacccctggagtatttgtctgggcaattcatcgtatgcttcatgttatgattgttatcaaaaaaaaaaaaaaaaatccgcgctcgaaactcgtcgcacttgcaccccatccatcgttccaattttttaagagtcaaaacatatccagtttttatttttttgaacagtaaaaacatatctaaatttttgaagagttaaaacgtaagtttaacaaaatttatataacaaataacaatatttgtgtaccaaataataattattaaatttttattaattatatttttatagtatatgtatttgatgctgtaattttttgcgattccctctatatatttttatatatatgatttcacttttcaaggaaattggaacatgatatggaaaggagtactgtacagttgaacgtcagccatgcatgcgttggtactgtagagtggtctggtctcccgtcgatttgatgaggcatgtcagcatgtggcgaacgcagtggccaatgggtacgtagtagccttgatgatagacttgacatattcagttagtgtctgcaggcatgca

SEQ ID NO: 19186 - DNA, 1153 bp, Zea mays
ccacgcgtccgttcagcatcggctttcccgtgtcaccctcactcagcccggcccgactcgtcaaggattcctatcttcctatggtcgtcgtcgtcgtcgtcgtcggagacgtcctcgagtccccctcccctcccctcccccccggccccgccgaagaggagcagcgcagccgcgatggaccgcgtccagctcgtgctcctcggcctccccatcctcctcttctgctccgacgtcgttaccctcttcgcgcctctcccgccgccgggccccgggcccgacaggggcccccacgcttttcagcccggcgccgaatcctcctccgccgccgacgcttccgcacatgtggagccacaggtggacggaactggctccggcaccaccgtcgacttcaagttctgcgcctcctgctcgtacaggggaactgcaatgaccatgaaacggatgctggaaacctcctttcctgggatccatgttgtcttggaaaattatcctccgccgttccccaaacgcgctctcagtaaagctgtaccccttcttcagttcggcgcgatggcaacattaatggccggtgatcagatcttccccaggtttggaatggtcccgcctccttggtactactcactccgcgctaatagatttgggaccatggcgtcaatctggctgtttggcaatttcgcccattcatttctacagagttctggtgcctttgaagtttattgcaacgggcaactggttttctccaaactgtctgagcagaggtttcctagtgaacttgagctacaggagctcattggcagtaggataccggattctcagattgtagaaaatctggaaaaagatctggtcctagaaaaagatctggtcttagatgatgttgatgccgatgatgccatgagagactagcttcgcctgtttgtttgttactaaatagacagaacttgagagtttcacaacttaattgtcaaaaacatattgccttataatttgcactttattttcctcaattatgtacatatttataccatagttatgtaatatctattgaagtcgtcaagtcagaactttcacagattgcaatagctcattaaaaagggccaaaaaaaaaaaaaaaaaaaaaaaaaaaaaaaaaaaaaactagtgcctgaggtttccc

SEQ ID NO: 19187 - DNA, 1721 bp, Zea mays
ttcgaaactacccccagggcgcccccttctcggccctcctcgccgacttcctcggccgcgggatattcaacgtcgacggcgaactcctggctcttccagcgcaaagctcgccgccgccgagctcgcctccccggcgctgcgctgcttcgcggcgggcgtcgtggcctccgagctgcggtgccggctcattcctctgcttcactctgcggccggcgacgagaagctgctcgacctccaggacgtgttccgccgcttcgccttcgactgcatatgcaggatctcgttcggccttgatcccggctgcctggagctgtcgctgcccatgtcggcgttcgcggacgcgttcgacacggcgtcgatgctctccgcgcggcgcgcgacggcgcccatgcatgtgttctggaagctgaagcggctactcaacgtcggggagggagcggcagctccgcgacgccatcggcctcgtcgacacgcttgccgctgaggtgatccggcagcgccggaagctcggtaccgccgcctcgggcgacgacctcctgtcgcgcttcatgggctccatcgacgacgacaggtacctccgggtcatcgtcgcgagcttcatgcttgccggacgtgacaccgtcgcctcggctctgacggccttcttcctgctgctctccgaccacccggacgtggccaccgcgatccgggacgaagtctcccgcgtcaccggagacggagacggccacgccgccacctcggagaagctcaaggacatgcactacgtgcacgcggcgctgcacgagtgcatgcggctgttcccgccggtgcagttcgactccaagttcgccgccggagacgacatgctcccggatggcacgttcgtcgccaggggcacccgggtgacctaccacgcgtacgccatgggccgcatggagtccgtgtggggccccgattgcgccgagttccggcctggccgctggctccacgacggccggttcgtgccggagagcccctaccggtacccggtcttccagggcggcgtgcgcgtctgcatcggcagggagctcgccatcatggagatgaagtccgtcatcgtctccgtcgtgcagagcttcgacatcgaggcggtcagccgtagctcccaccggccaaagttcgcgccagggctcaccgccacgttcgccgggggcgtgcccgtcagagtgcgacggcgagctcgtgccagcgacgagctccgaccgccaagttaacgtcaccggccacggcacgcacgtcgtattgttcccattcgaaacagcgcaagcgtccgtcgggctagttagacgcgtgacgccgcgatctatgcgttagagtattcgcgaatcgcgacgacggcacagtttggcgagtgcggtgggttcttggcctccactggagtctgaagattcctccgataaggtcagatggcccagcggacgggattagtctaatccgatgcccgacggtactagttttcgcacatgcataattacaaggggaagggggcggctcaaagtcgcctctgcatgtcaccatgtgtgctattctttccaactttcaaagcagaactgtcgaaaagaaaacttggcagattcaaagttgcagaatgcaggctcgtctagatgttctagcttcctctcgtggccattttctatgagggaacttcaattattgcaacaagatggtcgtgcagccaattagaaaaaaaaaaaaaaaaaaaa

SEQ ID NO: 19188 - DNA, 741 bp, Zea mays
tcgaggccgggactatcccgatcccgtcgaccctgcccctacagcctcgtttgagctctagactcgagagaggcggatagggagaggcagcaccgcagggagcagtgacagagaggccgagcgagagagagagatggacgtggagaggaaggtggtggaggcggacgacgacggccgcgtcagaacagggacggtgtggacggcgacgacgcacgccatcaccgccgtgataggctccggcgtgctggcgctgccctggagcgtggcgcagatgggctgggtcctcggccccgtcgccctcgtcggctgcgcctacatcacctacttcaccgccgtcctcctgtccgactgctaccgcacgccggaccccgtccacggcaaacggaaccgcacctacatggacgtcgtccgctcatgcctcgggcctagagatgtggtggtgtgtggactcgcacagtacgcgatcctctgggggacaatggtgggctacaccatcaccactgccacgagcatcatggccgtcgcgcgcacggactgccgccaccacaggggccacgacgcggcctgcgcctcgtccgggacggtgtacatggtggcgttcggcgtcgtcgaggtggtcctgtcccagttcccgagcctggagaagctcacgatcatctccgtggtcgccgccgtcatgtcgtgcacctactccttcgtcgggctggtcctgagcgccgccaagctcgcgtcgaacacggg

SEQ ID NO: 19189 - DNA, 4339 bp, Zea mays
agtccttcctcccccagttgcttgcagcaacaactgggctactcgaaagacacataatgccagtggtgacttggcagccactacctttaacatacaaagaaacaagagtgtatatagtgacaactttctactcctgaacagctccagctgtccaatactagtcctccagaattatattcaggcgtagttgcgttgcgtgtgagatcatgcgccattagatgtctgttgcaattattctcctatagatttataggaatcccgaaaagggtggagagtattattcacctcgaatcggtaatagtctatcagaaagtgttcagtgtgggccaatagtggtttgtatatgaatggatggctgcaagctatgctctctccacttccccataattctagactactagaggtctttttcatggcaccaaaatagtacataactaactgcatatggggtgcacagttgtggacttgtggccctgaagaaggcatctgtgagtgtgagtggacagttgagcagtcctgaacactggctgactggtgaagtgcaaggatatgtatggatgggactgttgttgagacttgagatgatttatcacaaccttgccaacagggtgtgttaagctgtctccagtaaccctcttatctcattttctttctcaccttctatttcaaacttcattatacaaacagtgttatctatagtacatagtgttttgcacgaccttgatctgttggacacaacattagactatctccagcaacttatccatcgccatacccatattcaaactccactctgcgaacagtgcagtttacggtgtaattaaaacactgcaaaacagtattttgggtgaccatatgggtgaggtgcagaacagagtcttatattgccttaatgggttatgatgagtttgactagttaatgactcaaagcaagtagttcctgaattctcaactgttgcaaagtttgttggatgccacatcacgctccacagatataagcaacctgtgtcgcagcttccaaaaaggcctttcatgcttacacacgttggtgaaaagggttatatatgcagctccaactggactgacatagcacgagtaacacaccaaatcttgctttactatagcctaggcaactttaatttgttaagcatgctttagactatttttagcagcttaccatcatcatacccatattcaaactctactctgcgaacaatgcagtttacggtgtaaaacagtattttgggtgaccatatgggtgagctactgaacatattcttatattgacttaatgcgttatgatgagtttgactagttaataatgactgaaagcaagtagttcctgaattctcaactgttgcaagtttgttggatgccacatcacactccacacagatataagcaacctgtgttgcagcttccaaaaaggcctttcatgcttacacacgttggtgaaaagggttatatatgcagctccaattggactgacacagcacgagtaacacaccaaatcttgctttactatagcctaggcaactttaatttgttaagcatgctttagttgtataattgccactgctttggtagtgcttagaataagccaatggagttggggttccatgacgcgatccaaacaatgggctatgcgtatgtcattggggttccatgacgatccaaataatgggctacgcatgcgtgtgtaacactggcagttcgagtcgcagctgttggttttgctttatgtaatggtatccagcgcatcagcagtagatcaatgggctagctttactcaacttgcttacgaaaattgacccaaaatggtaacgaattacctagtggaaaaaaaaggagccatgagtcgttgacgactagctgaagacgaccatgtgaaagtataatgatgacctcattcagtggtgtaatccaatagtctacttctactgaaaatgctcagagattgcaacacgcatgcaacatgatcgatggtgttctgtacaacgccggccaggtggcgagcaggtcgttaatagatgacgacctgaacactcctgttcttcgacagggacggtgtggacggcgacgacgcacgccatcaccgccgtgataggctccggcgtgctggcgctgccctggagcgtggcgcagatgggctgggtcctcggccccgtcgccctcgtcggctgcgcctacatcacctacttcaccgccgtcctcctgtccgactgctaccgcacgccggaccccgtccacggcaaacggaaccgcacctacatggacgtcgtccgctcatgcctcggtatccgcaccatgcgtgtggctttttttttctgaatttccatgggcaacgagtcaacgacagtagtagcgtgttctgatcgtgatgggcatggcaatgacaaggatgttctctctgagcatgtgtgtacgtgtgtagggcctagagatgtggtggtgtgtggactcgcacagtacgcgatcctctgggggacaatggtgggctacaccatcaccactgccacgagcatcatgtaagctctaaaaattcctgttcagtggcgcacaagacaccgcacattttttttaggtctgggctaaaaagaagttcgtcgttgggcgcgccgccgccgcgtgcgtgaatgaatggcatgcagggccgtcgcgcgcacggactgccgccaccacaggggccacgacgcggcctgcgcctcgtccgggacggtgtacatggtggcgttcggcgtcgtcgaggtggtcctgtcccagttcccgagcctggagaagctcacgatcatctccgtggtcgctgccgtcatgtcgtgcacctactccttcgtcgggctgttcctgagcgccgccaagctcgcgtcgaaccacggggcgcgcggcagcctcctcggcgtcaagatcgccgcgggcgtctccgcgtcgaccaagacgtggcactcactgcaggcactcggcaacgttgccttcgcgtacacctactccatgcttctcatagaaatccaggtacgtgcacgttgcaggcttttcagctgtcagctagcgtacagtatgtggcatgcatcatggttgcgacgactgtaatgtcattggcaatgtggctttgcccatgaacttaggacactgtgaaggcaccgccatcagagaacgtgacgatgaagagggccagcttctacggcatcagcgtgacgaccatcttctacgtctcgctcgggtgcatcggctacgcggccttcggcaacgccgcgccggggaacgtgcttaccggcttcgacgagccgttctggctcgtcgacgtcgccaacatcgccgtggtcgtccacttggttggggcatatcaggtgagaccccttcttggttcttgcagatcgcatgctctggacgctcgcagttcgtttgcatgatgaatgcgcttaattgtgtcattgtgtgtggcaggtgtacgcgcagccgatcttcgcgtgctacgagaagtggctggggtcccggtggccggactcggccttcttccaccacgagtacgcggtgcgcctgcccggctgcgcggtgcggttcacgatgtgcaagctggtgctgcgcacggcgttcgtggccgccacgacggtggtgtcgctgatgctgcccttcttcaacgccgtgctcgggctgctgggcgccatcgccttctggccgctgacggtgtacttcccggtgaccatgtacatcgcgcaggccaaggtggcgcccggcagccgcaagtgggtggcgctgcaggcgctcaacgtgggcgcgctcctggtttcgctgctcgccgccgtgggctccgtggccgacatggtgcagcgcctgggccatgtcaccatctttcagacgcagctctgaaacaagtattcagatcttatgcttggggacgcgcttgcagaggcatgcatcatacacatgcttgtgccgtatattcacctgtgatcttagtacattggttttggaagaacaactaaaaatggagcatgtaagtcattccacctagatttcgtgcattgcaagagtgctttttggggtgaaatagcagacagtgcacactccatgacacatttgaagcccagctaagcgttgggctgaattaatgattatgtttcttcaagggaaaaatagcacatcacatttttaccctttcgttggcccttgagaaatgacataaattttaatcattcgttggcccttgacaaacgacatttgaattttaacctttcgttgggccttgataaatggcaatataatggcttccgtggtcaaccgagacaccgagttaccgagcactcaaaaaaaaatgacgtctgctagtccgtaaactacatct

SEQ ID NO: 19190 - DNA, 1853 bp, Zea mays
ttgcctcattgggtacctcgcggggccggccgggaactatcccgatcccgtcgaccctgccacatacagcctcgtttgagctctagactcgagagaggcggatagggagaggcagcaccgcagggagcagtgacagagaggccgagcgagagagagagatggacgtggagaggaaggtggtggaggcggacgacgacggccgcgtcagaacagggacggtgtggacggcgacgacgcacgccatcaccgccgtgataggctccggcgtgctggcgctgccctggagcgtggcgcagatgggctgggtcctcggccccgtcgccctcgtcggctgcgcctacatcacctactacaccgccgtcctcctgtccgactgctaccgcacgccggaccccgtccacggcaaacggaaccgcacctacatggacgtcgtccgctcttgcctcgggcctagagatgtggtggtgtgtggactcgcacagtacgcgatcctctgggggacaatggtgggctacaccatcaccactgccacgagcatcatggccgtcgcgcgcacggactgccgccaccacaggggccacgacgcggcctgcgcctcgtcggggacggtgtacatggtggcgttcggcgtcgtcgaggtggtcctgtcccagttcccgagcctggagaagctcacgatcatctccgtggtggccgccgtcatgtcgtgcacctactccttcgtcgggctgttcctgagcgccgccaagctcgcgtcgaaccacggggcgcgcggcagcctcctcggcgtcaagatcgccgcgggcgtctccgcgtcgaccaagacgtggcactcactgcaggcactcggcaacgttgccttcgcgtacacctactccatgcttctcatagaaatccaggacactgtgaaggcaccgccatcagagaacgtgacgatgaagagggccagcttctacggcatcagcgtgacgaccatcttctacgtctcgctcgggtgcatcggctacgcggccttcggcaacgccgcgccggggaacgtgcttaccggcttcgacgagccgttctggctcgtcgacgtcgccaacatcgccgtggtcgtccacttggttggggcatatcaggtgtacgcgcagccgatcttcgcgtgctacgagaagtggctggggtcccggtggccggactcggccttcttccaccacgagtacgcggtgcgcctgcccggctgcgcggtgcggttcacgatgtgcaagctggtgctgcgcacggcgttcgtggccgccacgacggtggtgtcgctgatgctgcccttcttcaacgccgtgctcgggctgctgggcgccatcgccttctggccgctgacggtgtacttcccggtgaccatgtacatcgcgcaggccaaggtggcgcccggcagccgcaagtgggtggcgctgcaggcgctcaacgtgggcgcgctcctggtttcgctgctcgccgccgtgggctccgtggccgacatggtgcagcgcctgggccatgtcaccatctttcagacgcagctctaaaaaaagtattcagatcttatgcttggggacgcgcttgcagaggcatgcatcatacatatgcttgtgccgtatattcacctgtgatcttagtacattggttttggaagaacaactaaatatggagcatgtaagtcattccacctagatttcgtgcattgcaagagtgctttttggggtgaaatagcagacagtgcacactccatgacacatttgaagcccagctaagcgttgggctgaattaatgattatgtttcttcaagggaaaaatagcacttcacatttttactctttaaaaaaaaaaaaaaaaaa

SEQ ID NO: 19191 - DNA, 901 bp, Zea mays
ccaagccagctagcaactcaaaggaggaagactagaagatatatagccttctccttgtgtgacactcataaataaactgttagcagcttgcgagcactgcaagatctttctgctggcatctgaatagtcagctgctggcatctatccgggcacctctcgaccagccagaggcagatacctgatcccaaactagctggccaacatggcgaacgatgaccctgtggacgacgaaaaccccagatccaacaccactaataacagcatcaatgacaagttggctgaagtgttcgacatggtctcagtccacaaacatcagtataaaatgccgacgttcgccttccacaccaacaagacgatcaccgaagctttacatcggcctctactgcgagcacaagctagcatggtcacaacctcctagcctatatatgaactggtgttatcccgactgaacttttctttttgttgacacctttcgtcaggcctctccaccagaggttgactcgtatgtctgttttctggtttctcataccagaattaacgttcttgaccttgtaaggcctcttcttgaccttgtaaggctctcactctgtgtctgcatccttctcgcatcccttgtttccttctttcccactacatgcaggatcagtcccgatattgccgtgtttgccagccttctgcatccacctactttctgttcccttctatccctcctgagctaattgttgctcctatgtaatccgtgtttattatttcggtaccatgatgatgaaattagttttaatttattgtaagactagttcagttaatgttttcaccctgtggatgctctgcaatacatgaacatacatatgcaaacactcattcatccatttattttttattaaaaaaaaaaaaaaaaaaa

SEQ ID NO: 19192 - DNA, 2142 bp, Zea mays
  misc_feature (1424)..(1424): n is a, c, g, or t
ctctatttcgtcgaagccgccccgtcgtatttcataatgtcaaatttctccaaacattcaaaccactcctgcacaacagcacaactgctttacacaggttcaaactccgtctagaatgggatggcagatttgttattagtaggaaatccaatgggcgaagataacccaactgcctatatatacgaccacccgctccactcttgcgtcccagcacctacagcgccagccgccagcgctccccttcttcagaaggacgtggccgcacccgcctctcgtctccctcccacccacgcgattccatttcgcttacatttcatccgtgaaaaatcacggaagtgccacccgcagtggcgggacccacgctccacgctttgcacgagaccattacctagaacatcctaatcgaaaactcttctactattttcgtgtcccaccagccaccaccagtcggcgacgggcaatttctgtctctggcttagcgatgcaggcgccacgtggcggcggattcttcgggaagcggaaggagcgcgactactactacccctacccctcggtgtcgtcgtcatcagagcaggcggtgctgctccagcggcaaccgccgccgtacgctaggcccgagcccgacacgcggagcgtcaagccggatcgcccggcgatgaggtttggtgccaagccgccgctccctcagccgggggcccaggtcggctgcaacaagctgctggctgggtacctggcgcacgagttcctgcggtgcggcacgctcctcggcgagcggaggctggagctgccccgtctgaaggagaaggatccctccgcctccacctccacccctgcgccggagccgagcaggcgctacgcggaggtttcgcggctgcttatggcgggcggggctcgcatacccggcgtcgtcaacccgtcgcagctcggacgctggttccggatcaaggagtgaccgggtggccatgcgcccaggccgctggaggtcgggtgcatgcggagcatggccgcattgcctactgcttcgttccctcgtcagcggccgatcagaggaaccgttgtttttgaacaaagcaggcgggtttctcatgtctcagtctttctttcccttcgaaatttgtcgtgtagtaattagtaaatcaagtgttcttgtaaaaaaatttagggtagctgttggacgagaaattatctactgctaaaaaaaaaaaagtcggttcacattttttcccccgctgaaatcctctgcatcggcaaaatctgtgatgcatgacgtggatgaatccgcccttccaaggattttttttcaggtcccgtttggtttactgactaaatattagtccatccacatcagactaaattttagtacatccacattcacatcttaatcgtattttgatgtagttagaattattaaatataatttattnataaaactaattatatagatgtgaactaaaattataagccaacctattaaccctaattagttcataattcgcttatgtgatgctatattaaacatttactaatcataattaattaggtttaataatttatctcactatttagtctttaaccatataaattagttttataattatttaatgcttgtaataagcgttcaaacatcagatatgacatgagttaattttagtctctaaaactaaacactcactagtagttcatgttttttaatcttttagccattaaattaccaaacataccgactaaaagaggctattatttatctctagctctttaagaggtgattaaaaggaactaaattgtttctttaatggtccctgcttatcctttattgtgttgtctaggtacccgcgagaatagagtggctggttttttaataactgcttatcacttttagtctttaaaatcaaacatgactcatgaaaccaaactcgttactaaggaattgaacaatccaagtgttaatatggggtctagttgattccagtggctaaagattaatttttacattttagtctcttctagtccttgaattgctaaaccatgatactaaaggaagggctgagctgctttagtccctagtcttttaagaggtaactaaaagggactaaattatattgatttcaccggttaattatattgatttcaccggttgttcct

SEQ ID NO: 19193 - DNA, 1400 bp, Zea mays
atccgttcccgtgggtttttagtcgcggcctcacgggatttgggtggaaaccgcggggggtcctttataagcgcggggcccccccggccgggggcgcgagcccccccgcgttcacgagccagaagagaagagaggctaaccaccgcagcagctgcgacctgcgagtgcgacaacctccgcggaggagttggagccggcggcggggatatttgcttgcccggctggggttgcggcggaaggagggagagacaaccggcgatggcggcgtccgcgaggcccggggagagggcgacaagcttcgccgtcgcgtgcagcctcctcagccgctttgtccgccagaacggcgtcgcggctgccgagctaggcctcaggatcaaaggcgaggtcgagcagcagaggacgccggcgacaactagcttgctccccggagcggagggcgaggaggtcgaaaggaggaaggagaccatggagctgttcccgcagagcgtcgggttcagcatcaaggatgctgctgccccccctagggaggagcaaggagataaagagaagcctaagcagctcacaatcttctatggcgggaaggtgctggtatttgacgatttccccgccgacaaggcaaaggatctgatgcagctggccagcaagggcagcccagtggtacagaacgttgctttgcctcaaccctctgcagcagctgctgtcactactgacaaggccgtgctggacccggtcatcagcttggccgctgctaagaagcctgctcgcacaaatgcttctgatatgcctattatgaggaaggcttctcttcaccgcttccttgagaagagaaaagatcgcctcaatgcaaagacaccatatcaaactgctccttcagatgccgcaccagtcaagaaggagcctgagagccagccatggctcggattaggaccgaatgccgtggattccagcctgaacctcagctagtacacaacaacacagccataataagacggcacagcaacggcacccaccatgacctggaatttgctttgccactagatcgagttcagaaaccataaatattcttagttatcgtgttttagtgttcgcttatgtcgtggttctacgccctcttgtcgcatagttctggatgtaaagaaaagtagccagtcatgaccatcaccgggagtcggggagaagtttttggagggtgttaacacacggcgactctgaattggccatgctaaggaaaaggatagtgcaatgtgaggtatatgtattttctgaaagccagatcgtttgggtctagccctgatgtatgcagaacaagtgattattgtaatggatcctgattatcctcatcatcctattgttgttttctgatcacgacaaaaaaaaaaaactaaagcttgtacctgccc

SEQ ID NO: 19194 - DNA, 1425 bp, Zea mays
agcgaatacgaggataaacaatttcgagcaatccgttcccgtgggtttttagtcgcggcctcacgggatttgggtggaaaccgcggggggtcctttataagcgcgtgggcgcgcggcgtgctcacacgaggcccccgcgttcacgagccacaagagaagagaggctaaccaccgcagcggctgcggcctgcgagtgcgacaacctccgcggaggagttggagccggcggcggggatatttgcttgcccggctggggttgcggcggaaggagggagagacaaccggcgatggcggcgtccgcgaggtccggggagagggcgaccagcttcgccgtcgcgtgcagcctcctcagtcgcttcgtccgccagaacggcgtcgcggctgccgagctaggcctcaggatcaaaggcgaggtcgagcagcagaggacgccggcgacaactaactcgctccccggagcggagggcgaggaggtcgaaaggaggaaggagaccatggagctgttcccgcagagcgtcgggttcagcatcaaggatgctgctgcccctagggaggagcaaggagataaagagaagcctaagcagctcacaatcttctatggcgggaaggtgctggtatttgacgatttccccgccgacaaggcaaaggatctgatgcagctggccagcaagggcagcccagtggtacagaacgttgttttgcctcaaccctctgcagttgctgctgtcactactgacaaggccgtgctggacccggtcatcagcttggccgctgctaagaagcctgctcgcacaaatgcttctgatatgcctattatgaggaaggcttctcttcaccgcttccttgagaagagaaaggaccgcctcaatgcaaagacaccatatcaaactgctccttcagatgcggcaccagtcaagaaggagccggagagccagccatggctcggattaggatcgaatgccgtggattccagcctgaacctcagctagtacacaacaacacagccataataagacggcacagcaacggcacccaccatgacctggaatttgctttgccactagatcgagtttggaaaccataaatattcttagttatcgtgttttagtgttcgcttatgtcgtggttctacgccctcttgtcgcatagttctggatgtaaagaaaagtagccagtcatgaccatcactgggagtcgaagagaagtttttggggggtattaacacacggtgactctgaaattggccatgctaaggaaaatgatagtgcaaagtgaagtatatgtattttctgaaagccagccagatcgtttggctctagccttgatgtatcatgtatgcagattgcagaaccagtgattattgtaatggatcctgattatcctcatcatcctattgttgttttctgatcaaaaaaaaaaaaaaaa

SEQ ID NO: 19195 - DNA, 622 bp, Zea mays
ccccccgcaatcaaacagctaatatcgtcgttcgttcctcaagtgatcttaattaatcgtcgagaagttaccagctagcggagatcatcggcaatgtcgaacatggggcaatccttccaggccggcaaggcgcaggcccagggcgagtgccaggcggagcgcgcagcgcagtgcgtcagggacggcgccggcgccaccgcctgcgccgtgaccgacaccgccggagccgcggccgacagcgcgcagctgcaggagcaccgcgccgccggcaccgttcagcaggctgctgagcaggtggcgcagacggcggcgggcgcggcggcagccgtcaaggacacggtggcgggcgcggcggcggccgccaaggacacggtggcgggcgcggcggcaggcgccaatgacgcggtgaccggcggccactgaccgactcacgcgcgtgaaccggacggcgtaccaacaatgctgcatggccaagggttgcgcctcaagatggctactaattttcccccttttttctttatgttttttcattttaacgtgtttcattcacccatcttattgcgatcgcttgcaataaaaaggccatctttactatgacaaaaaaaaaaaaaaaaccgccccc

SEQ ID NO: 19196 - DNA, 520 bp, Zea mays
gatttgggtggaagtggaaaccgcgccgcgggggtcttttaagcgcgtggcatcctaatcgaaaaacacgaggcccgcgctcacgagccagagaagggagaggagaggagaggctaaccaccgcggcagctgcgacctgcgaccgcgaggagtggcgcacgacgaccagcgcggaggaggtggagccggcggcggggagatttgctcgcccggctggggttgcggtgggaggagggtaggaggcagagacaaccagcgatggcggcgtccgcgaggcccggggagagggcgaccagcttcgccgtcgcgtgcagcctcctcagccgcttcgtccgacagaacggcgccgcgcccgcccagctaggcctcgggatcaaaggcgaggtcgagcagcaaaggacgccggcgacaattaacttgctccccggagcggacggcgaggagaccgagaggaggaaggagaccatggagcttttcccgcagagcgccgggttcggtgtcaaggatcccgctgctgccc

SEQ ID NO: 19197 - DNA, 1922 bp, Zea mays
ttccgcgcagatgcacgtgagccgcccgggacggccggccggccggtcccagcagggccattgcccttcttctttcactagctcggccgcgcccccggggccggccggggaagtggggagcgacgaaagccatgacacaagtgaagctactctcgtctcgtgtctcgttgccgttatttaaacaccccttatctttccctcctcaggctcaaaagccttgcccttccctgctctgctcctcctcgttctctgtgatgctgaggctaaaagctctcaccttcctgctcctgctcctcctcctcgctctctgctccggcgttcatctgtgcgacgcgaggagcggcacgcgctggagtcggacgacgcgaggcggtggtagcggggcggcaccgtccgcctccgctgctgcgatcgggaggaaagggaaagcgagaagcagcggctcctcccacaggcaaagcggcgaagggagtcggagcccgaccgacggcgaccccgtgcagggcgacggaagccaggctccaccaccacaggatactacggtcttcagcgtggtggagttcggagccaagggtgacggcgttacagatgacactcaggcctttgaagcagcgtgggcagcagcgtgcaaggtggaggcgtctacggttcttgtaccatctgggctcgagtttgtcgtgggcccgatctcgttctctgggccttactgtaaaccgaacattctgttccagctagatggaactattttggcccaaaccagcgcaagagcatggggctctgctggtctgttgcagtggctggagttcacgaagctaaccggaatcgcggtccaaggcagcggtgtgataaacggcaggggccaggactggtggacgtatgcagacccaaacgatgccgacgacgagtctgtggagatgctgctgccacggactaagcccacggcgctgaggttctatggcagctccaatgtcacggtagctgggatcacgatcgtgaacagctcccagtgccacctcaagttcgacagctgcgagggcgtcatggtccacgacctgaccgtctcgtcccccgaggacagtcccaacaccgacgggatacacctgcagaactccaggggagtcgacatccaccacgcgacactggcctgcggcgatgactgcatctccatacagacggggtgcagcgacgtgaacatacacagcgtgaactgtgggccagggcacgggatcagcatcggtggtctagggaggttcaacacgaaggcgtgcgtgtccaacgtcaccgtacgagatgtcaagatgttcaggacaacgacgggtgtcagaatcaagacatggcagggcgggtcggggctggtgcagggcgtgaggttctcgaacatccaggtcacggaggtgcagacgcccatcatgatagaccagttctactgcgacagggcgacgtgcaggaaccagacgtcggcggtggccgtctcgggcgtccagtacgaggacgtcaggggcaccttcaccgtcaggcccgcgcacctggcgtgcagcgacagctcgccctgctcggggatcaccctcgccgggatacagctccagcccctgccgctgccgcagcaccgccgcctgtcgtacgaccccttctgctggcaggcgttcggggagctgtacacccccaccgtgccccccataccttgcttgcagatcggcaggccggcagcagggaacagcgtgctgtccgacggcgacctttgctgaaacgccgatcggttcatcagttaagctaaggcggtcgtcgtgatgcttccgacccctgctttgcacgatgtggattgtggagtgtcagttgatgatgcatcatgcatgcatgcgtacgtgggatacttgaggccgatttattatattgatgcgagccgatcaccactattgctatgt

SEQ ID NO: 19198 - DNA, 1179 bp, Zea mays
cgttgacagatcctgatccagtgtgatatttgggctgctcacagcacaattgggtccaataaagcccagccgggacgcagaggaagaagacccggagctgcgtcttccttccgtttcagcaccgcgcgcaatcggcctctcatcccctcttcctatcgcccgccgccgccgccgccgccgcccgtccgcttcagtacgacgtcgagcaaggggaggtaaaagttcgtttggcgtgcgccatgtttaagaagttctcttcagaagatatatctggacagaatcaagttaaggcttctgtacaacgaaagattcggcaaagtatcgctgatgagtaccccagccttgaacctttgctagatgacttgctcccaaaaaagtcacctatgattgttgttaaatgccaaaatcatcttaatcttgtagtggtgaataatgttcctctatttttcaatatacgtgatggtccttacatgccaaccctgcgtcttcttcatcagtatcctgatatcatgaaaaagttccaagtggatagaggtgctatcaaatttgttctatctggcgcaaacataatgtgtcctgggttgacttcacctggtggtgccttagacgacgaagtcgaggaggaaacaccagtggctataatggctgaaggaaaacaacacgccctggcaattggatatacaaagatgtcagcaaaagacataaggaccatcaacaaaggaattggtgttgacaatatgcactatctaaatgatggcctatggaagatggaacggctcgaatgagtagaattctctgaggggttcataacttgcggcagatcgtattgatggacatatgaaaccagcaggaccctatttgcacagctggtatcgttttaaagatgaagtactaagaagctttatttacctgaggcaacttgagcttactccgaccctttggtgtggagtgcatgtcagaaacaggattatgaatgctgtgttcagtgcttttcacaaattgttgtattttcaccagaacaatttccctcaattggaagtgaggaaatccataacgatctataagttatttgatcttaaagtttgttgtgtgtaaaaaaagaaaaaaaaaaaaaaaaaaaaaaaaaaaaaaaaaaaaaaaaaaaaaaaaaaaaaaaaaaaaaaaaaaaaaaaaaaaaaa

SEQ ID NO: 19199 - DNA, 1546 bp, Zea mays
ttaaattcgttgatcacggatcacggtccacatattcttgggtgggcctctcctctcgtttgcctgcgccgccgcgatcgccaatcggcatggctcttcccaaaccccgcccgccaacgccgacggcgtcagcggccacgggcacctcctcgtcgcgaatagactcgccatcgctaaaggccgcgctcgcaatggctctcatccactacaaccgcctccctggcaaagccaacgccaccgcgggcacatcacccccgtctctcctccactggaagcgcaaggccaaggaccggaagcgcgaaatcctccgcctccgcgaggagctcaaggtcctccaagatggggtgcgcggggaggagatggagcccccggttgcgtcgtgccggtgccacttcttcgacgggtgccgggaccttcgaccgcagcagggtggcggtggtggggagcactgggttgacgaggtgctgaggaggaggtttctcagactggtgcggtggaaggagaagcgacggcgagtggatcgatctcttccaagttctagtttgatcgatttcaacagtgaggatgagatgcagcagctcagcatgtcgactgatttcctggtggagctatcagacggcatttttgccaaaagtgaagctggccactcatttgctacattttctcaccaagcagtagatttcattttggctacactgaagaacattctttcatcggaaagggaaaaagacttagttggggagataatcgatagtttagtgactcgtttgatgaaaaggatgtgcactgttcctgaaaagcttgtcacatcagattcaggatcaactggctgctcagatgcccagttctcagtgcagcacttattccgtaagttgggaaatgatgaattcattggtcagcgggtaatccttgtagtttctcaaaagatatccaacgtatctgaaagattgttcttggctgatccgtttgctgatgctttccctgatatgcatgacaatatattcatcatgattcagttacttgagttcctcatatctgattacatgaaagtttggctatgctgtgagcatattaacaaaagactttttgaagaatgtaccagatctattctcaaggcacgcaatgatttgcaaatcctggaaaacatgaatgggctctatgtggtgtacattgagcgtgtggtcggaaggttggcaagggatgtggctcctgctgcacatcaggggaagctggacctagaagttttctccaaactgctgtgctgagagtgccttgcatatgacattccaagcctgacccggcctgttatatgcttaggttgattcaaaaccacgacaccattggtccacttagactatgcatagttacatttctgtttgaaagacaaactttagaatttggtagtggatctacttgtatggcctgttgtttcatgtcaccattgatagttgattagtttccttttgctgacttaaacccctatacactgtgagttgctgtaaaaaaaaaaaaaaaaaaactcgagactagttctctctcctcgtgc

SEQ ID NO: 19200 - DNA, 3766 bp, Zea mays
  misc_feature (364)..(364): n is a, c, g, or t
aaggattatcttataggtcttcatctagagctttggaagattgttaagattggtgtgtatgagttgtttaatcctagcaatccaactcacttgagtaccatcacattcatcttaaagctcaagccgcaagtgccatgttgagtgcattgagtggggaagaatacaacaaagttgtgggtttagagtttgccaaaaaaaatataggatactttgcatattgctcatgaaggggttgacaaagtaaggcaatcaaagattgaattattgatggcaaagctcaactaatttgtaatcatcgataatgaagggccacaagacatgtttgatagattgatggtcattgttggaagattagaggtcttcntggagataaaatcaatgatcacaaggtcattaaaatcatgttagaggcttattcaccaaggaataagactattgtgactttgattgaagacaagaagttcgagtatttcatagcaaatggtgtgcttagaagaataaaaatctttgacatgcaaagagaagaggccaagtagtatcacttgataagttgaagaccactcatatatttagggtctgtttgagactgtttagattcaagctgtgaaactatagtctataatataaattaaaatagtttgaaaaaataattttaatctaaatgccatctaaagtttcacaattctgcgctatcaactttatcaattatttctttgaaacagaggttaactcactagtaaaagccgcgttggattttaggtagctgttaccatctctgcttctctggtcccggcttcccgatcctcgctacgttaggccgccccgccctgcgaaagccacacgaaagcgacgaccaagggagaatccgtcaattccccaatccccatcctctcaccggcgcaaacccacgggatccgtcgcgatcgcgacgcagcctccaattcgcgccgatgcctgcccccgcgccgtggcccgtgtcgcaggacgtcgcggcgctcgccgatcgcgccagcgccttctcccgtgccgtcgtcgggccccgcaacgacctgggtgctctcgcggcggcgctccttcggatccaacccgtagcccgcgagctcgagcgctggaggtggctcacgcccggcgaccctgaggtgcccgacctgcacgcctggctcttcgagctcaccgacgcggtggccgacgccgagagcatcctagatgagctccaccgccggcgccagatcggccctccgctctcggcctgcgtatacgccacgttccgtggccccggacggaagctgaggcggctgacggagaggctcaaccgcgcccgcgacgattcggagcgtctgcgacctggcagcgctgcggccatctacggtgtgcggtcgccgaacagggtaaccggctccgttttcgcggagcggaaggtactcgggcgtggggaggagtgcaactccataatctccaggctcgtcgacgattgcgaggaaacatgccgtccggtatctccggttattgcagtggttggccatggaggcatcggcaaaaccacggtcgctcagtgcgtgtacaacgatgcgagggttgaagcgcggttcgatctgagagcctgggtctgcgtctgggacagatcagatgaggccgagctcaccagggagattttacagtccattggttgtgcagatgataaaccgtgtgatgacggtcttgccagtttagacagtttgcaggagaagtttgagaatctggttgcacgtaagaggttcctcctggtacttgacgatgtttggattgatgagggtaaaaccgagaaggagaataggagcatttggaacgttggtgccacttagatctgccacaactgggagcaaggtcttgttgaccactcggatgaaactagtagctgaggttctgaatgcgggttatttggtttcgcttgatggattaagaagcagtgattgttggttgctgttgaaggaagttgctttgggtggagaaaccatggattttccacctgagttgcaagaggttgcaggaactcttgttgcaatggtgaagggttcacctttagctgctaaagctattgggcaaatggcaaggagcaccaggagcacacggaaatggagaaccctggtgaacacagaaattagtaatgatatcattatctcttcatccaactcagttataaacacttgccaggtcatctccagcgctgctttgcatactgcagcatatttccatcaacttggaggttcagtcgctctcagttggtcaatatgtggatagctctcggtttcattcaatcatcagcagaagggaaagggctggaagaattagggcaaaaatactttgatgatctcctatcacgatccttctttggtactgcaaataaagaccagcaaacatattacttccttgatgacctaatgcacattttggcacagcacttctctgctcatgattgtatgaaaatcaacgagggcatccctgttgtgattccaccaacagttcgtcatctgtctgtttcaaccgattatttaccacagctgaagagcaaatacaggttgggaaggcttcaaacattgttagtcctcagaagctcgtcattatcttcaggtcatttccctagaaaacttctggccaaatttaagaacttgcgggtcctggatctgagtggatctgatattgtagaattgccagaaagcattaatcagttggtacatcttcattacctagctatctgcagtataactaacaaacttcccaagactatatacatgcttaaacatcttgaggtgtgtgatatacctatattcttatttcatgatgatcatcctagaggtgttggtaaatctgctacagttaaacgtctcaaaacatgctgtggcaagcaggcaaggtcagttaagtccttgattgatgtgcaaggactgttataggaattggattaaccttcacggcttattagtcatttgatcagccaatgtctgactttcagaatcaaactttacagtaatcccagcagcaggcatgaagtgcaatttttcttttcaattcgacaccttcaagctctagaatccatttctactcagcctgtttctgtgatttggtgtcaggataactccagtttggtggatcaagaatatggttgttcacatccatctaaacttcaaactattttgtgttggtttgtttgatagtcccaggttggtactttgcaacctttcaagccctctttattgcaggactacttggctgttttgcctatccgcaacttatgtatagttattttatttttacttttattttttttatttccatttgtaaggtattccattttggttttcactgtcaactggtgcaaacaagactgttgcaacagggaaaaaatagactatgataccataactgaaaaacggtgttgagtgtgatcttgcaacatcctgtatgtagccaactgtcactcttacatgaatcttaataaggacatgcctagcgcagtggtaagaagtctttccacagagccaaaggtcctgaatttggcgtatactctgaaaaaaaaactacaggggtaagatttatctcggttattccttcccaacacctcacccaagtgggagctgtgagcattcagtctagtttggtaactcaaatttccttcgggattggaggagatggggattagaccatttctcctttaggatgtgtttggttcggtgtcaacgagggatgggacgggatcaatcctgggttgaccccgtcccttatttttgag

SEQ ID NO: 19201 - DNA, 2128 bp, Zea mays
ggggacctgcatcttttcttatctccttcgcagcatcttttcttatctccctgtaacttccctaaacagcggcggcgggagggaattccccaaacggcggcggcgggagggacttccccaaacggcggcttcacggctccagggagacaccacctgcacgggcgacttcacctgtacgggcgacttcacctgcacgggcgcatccttcagccgatccgaagacaccatgcctccagggaggaagggaatacgaagcacaagggaacccccaccagaaatcacttctactgagtatgagaaacaaagggcagcaaatgtgatgaggaacaatcagatgttccaacggcttgggattaatcagttacgcacaatgatgactgctacaagagtaaagagcaaatatgatggtccagaggaatcagggtctttgtttgatggcgaggatagtgaaggctctgagccagaggaggattcccatgttgcacaaggtgtacgtagccacaacccaactcatgttgctgacaaacctacacaacaaacacgaggttctaaaagggttgtggcccctgatgttcatggacaacagattagattcactaggcaaaggagtgctgccataaatcaacaatcctccctaagcctaactactactacacaaagctggttcaagagccaccacaaaccaagaatccacccaaaacttggctgctgcaacacaatttacttcaagtgttgccactgagcaaagattacaccgcaggcctgactactactgcacagcccgccgcccccacacaagctgaggtcactgaccacaatagagatcatgaattggtaccaaggcaaagaagtaggggcaaacaacttgaatccttgagcagagggttaggcactaagattccaatccaaatctctaatgggaagcgaaggccagagccacctattcaggctgcaaagtttgcatcggagggtgggatcatattgaggcaacacattccaatatttccgcactggaaggagtacaagaagcaagagaacgagggtaaaattacagactacattgggaagcttgctggtcaattcaccatggatgttgagagtaatgcagtaaaagatgcatgtgttgatatgctaaagggtggacagcgccaaatgaggtataggctgaaaaaaaagtacttcactggagttcctgcaaatcaagtgaggactacatcacctgtttcatgtatgactgatgatcaatggagagagttggtacaaatgtggtctagcccaaaccacaagaacaattgtgtgaagaacaaacttaatcgtgagaaggtgcaatttccacagtgcacaggatctcaatcatatgttgcaaaagcttatgtagtgagacaagaaaaatataaagatgtcgaacctagtgcaattgatcttttcaaggagatgcattgcagcaagaaaaaaggatttagtgaagttgttcagaaagccataggtgatatggaagcaatggtggcaacaccagctgaagatggacagcttgcaaagtctgcaacagaagttgtttccaatgtactgccgggttcaagtaaatttcttcacaatgctggccttttgccctcctccaagagaagcaacacagggactgtttcagcaagaatgcaagagcttcagtctcaattggacaatgagaggcgagaaaaagatggacttcgagaagatatggataccttaaaagccaagtcacaatcatctgaggcaaccattgctaatcaatcaactgagattgcagatttaaagaagtccttagcagaaaatagcatcctacttcgacagatattaagtattagtcgtgatcagctgaatccttaagcatgcttgctaagatgctggtgtcaaccatcctgaatacacatctcacaaaactgtggacctctttttatccttatgtttgctatatggaactgcaacttacagtctattatatgtgttctcttgctatagagttttagtacttgtctggttaaagaattatgaaccatgttcctttgtgtgttggacatattatgcttgaaatatatggatgttggaaaaaaaaaaaaaaaaaaaactcgagggggggcccggtacccaatcg

SEQ ID NO: 19202 - DNA, 1581 bp, Zea mays
gaggagagagagagctcactagtcccccccccccccccccccccgatggattaagaagcagtgattgttggttgctgttgaaggaagttgctttgggtggagaaaccatggattttccacctgagttgcaagaggttgcaggaactcttgttgcaatggtgaagggttcacctttagctgctaaagctattgggcaaatggcaaggagcaccaggagcacacggaaatggagaaccctggtgaacacagaaattagtaatgatatcattatctcttcatccaactcagttataaacacttgccaggtcatctccagcgctgctttgcatactgcagcatatttccatcaacttggaggttcagtcgctctcagttggtcaatatgtggatagctctcggtttcattcaatcatcagcagaagggaaagggctggaagaattagggcaaaaatactttgatgatctcctatcacgatccttctttggtactgcaaataaagaccagcaaacatattacttccttgatgacctaatgcacattttggccacagcacttctctgctcatgattgtatgaaaatcaacgagggcatccctgttgtgattccaccaacagttcgtcatctgtctgtttcaaccgattatttaccacagctgaagagcaaatacaggttgggaaggcttcaaacattgttagtcctcagaagctcgtcattatcttcaggtcatttgcctagaaaacttctggccaaatttaagaacttgcgggtcctggatctgagtggatctgatattgtagaattgccagaaagcattaatcagttggtacatcttcattacctagctatctgcagtataactaacaaacttcccaagactatatacatgcttaaacatcttgaggtgtgtgatatacctatattcttatttcatgatgatcatcctagaggtgttggtaaatctgttacagttaaacgtctcaaaacatgctgtggcaagcaggcaagatcagttaagtccttgattgatgtgtaaggactgttataggaattggattaaccttcacgacttattagtcattcgatcagccgatgtctgactttcagaatcaaattttacagtaatcccagcagcaggcatgaagtgcaatttttcttttcaattcgacaccttcaagctctagaatccatttctactcagcctgtttatgtgatttggtgtcagaataactccagtttggtggatcaagaatctggttgtgttggtttgtttgatagtcccaggttggtactttgcaacctttcaagccctctttattgcaggactacttggctgttttgcctatccgcaacttatgtatagttattttatttttacttttattttttttatttccatttgtaaggtattccattttggttttcactgccaactggtgcaaacaagaccgttgcaacagggaaaaaatagactatgataccataactaaaaaaaaaaaaaaaaaaactcgagggggggcccggtacccaattcgcccttgttaaacacaataaagttggaacgggaggggtgaaaggtgtct

SEQ ID NO: 19203 - DNA, 1781 bp, Zea mays
  misc_feature (1750)..(1750): n is a, c, g, or t
  misc_feature (1758)..(1758): n is a, c, g, or t
cccgcacaagtcacaacagaacgtccctcccccacaagcagaaggatccgggcggccaccgagagtcactggaagaagctcgtccggcgccccgcgacgagacgacggcctcctcctccgctccgctgaagaacgacctccccgctggacagggtcgcgaatcgcaatctccttccctccttccctctctcttctcccccaaggccccaactgggtcgaccgcttttccgaacccgtgcggccagttactgttcccatcttattcttttggtgcgtgcctggctgcctgcctgccaccgccatcaccaccacgcgcggctcatgtggcgtggcgcagaggcggagcgctccgcagaggcgcagagagaggtggcgtctgccttgctgcgctgcgggtctgcggtctcctgcagattcccgcacccacaaggccagaggcgacccaccagcgccacccaaaaaaggcgcacccctttccgccgcccaaatctccctttaccccgatccccaagccccgccgctgctccctcgtacgcacgtacgcaccgcgtcgccctttatctgctcccgagggccgctggtcggctgctgaatcgtcgccgttgttgctgggactgcagcgttggcgggccttgtagcgaggagggggtgcggaggcgccgcgactgttcgcgggatgagcttcggcggcagcagctccctcgcatcaggtgcgaagaggccgttcgagtacgggagaacgcatgtggtgaggcccaagggcacgcacaaggccaccattgtctggctccatggacttggggacaatggagccagctggtctcaactactggaaactcttccccttcctaatataaaatggatatgccccactgcaccttcaagacccgtgtcagtgtttggcgggttcccctccacagcatggtttgatgttgctgatctttctgaggatgctcctgatgacattgagggaatcgatgcctcagcagcacatgttgcgaatttgttgtcaactgaacctgctgacatcaaacttggtgttggcggctttagtatgggtgctgctactgctctgtactctgcaacttgctttgcccatggaaaatatgggaatggcaaaccattccctgtgaacctaagtcttgccgttggtcttagtggctggcttccatgtgccaggaccttgaagaacagaattgaagcctcaccagagtgtgcacaaaaggcttcatcaatacctcttttgctctgtcatggaaaagctgatgatgtagttgcctacaagcacggggagagatctgctggtgccttgaaggcaaatggcttttccaatgtgctcttcaaggcatacaatagtcttgggcactacactgttccagaggagatggatgaagtttgcaaatggatcacagcaaatttggggcttggcactaagtcatcttgattggaatttgatgcgagaaagactcgcagggacggtgtccaaataataccggtatcttttccaggaggtatatggtttaatagcaaatttgggcttgggtatacggccatgttctagcttttcttaacgcagacgtgtctgcgaatgatgtatgcttataatatctatattttggtctacgtcgatttggttgtggcacggataatgtttgtttcaaatattctgctctgcgaattggaattgtgatgttttgctttcacaaaaaaaaaaaaaaaaacgagactagttctctcctcgtgccaaaanaaaaaaanaaaaaaaaaaaaaaggtaccttg

SEQ ID NO: 19204 - DNA, 1335 bp, Zea mays
  misc_feature (10)..(10): n is a, c, g, or t
gtaccctcgnagggccggccggggccggggacccgggggaccccggcgccggcggccgcccggcacaagtcacaacagaacaacctacccccacaagcagaaggatccgggcggccaccgagagtcactggaagtctggaagaagctcgtccggcgccccgcgacgagacgacggcctcctcctccgctccgctgaagaacgacctccccgctgacagcgttggcgggccttgtagcgaggagggggtgcggaggcgcggcgactgttcgcgggatgagcttcggcggcagcagctccctcgcatcaggtgcgaagaggccgttcgagtacgggagaacgcatgtggtgaggcccaagggcacgcacaaggccaccattgtctggctccatggacttggggacaatggagccagctggtctcaactactggaaactcttccccttcctaatataaaatggatatgccccactgcaccttcaagacccgtgtcagtgtttggcgggttcccctccacagcatggtttgatgttgctgatctttctgaggatgctcctgatgacattgagggaatcgatgcctcagcagcacatgttgcgaatttgttgtcaactgaacctgctgacatcaaacttggtgttggcggctttagtatgggtgctgctactgctctgtactctgcaacttgctttgcccatggaaaatatgggaatggcaaaccattccctgtgaacctaagtcttgccgttggtcttagtggctggcttccatgtgccaggaccttgaagaacagaattgaagcctcaccagagtgtgcacaaaaggcttcatcaatacctcttttgctctgtcatggaaaagctgatgatgtagttgcctacaagcacggggagagatctgctggtgccttgaaggcaaatggcttttccaatgtgctcttcaaggcatacaatagtcttgggcactacactgttccagaggagatggatgaagtttgcaaatggatcacagcaaatttggggcttggcactaagtcatcttgattggaatttgatgcgagaaagactcgcagggacggtgtccaaataataccggtatcttttccaggaggtatatggtttaatagcaaatttgggcttgggtatacggccatgttctagcttttcttaacgcagacgtgtctgcgaatgatgtatgcttataatatctatattttggtctacgtcgatttggttgtggcacggataatgtttgtttcaaatattctgctctgcgaattggaattgctggaaaaaaaaaaaaaaaaaaaaaaaagtacctcggccgcgaccacgct

SEQ ID NO: 19205 - DNA, 1248 bp, Zea mays
tggggcgcccaactgaccgaccaacccccacgatcagaaggatccggagttccggacgggcggacggccactgcaacgacctcgcctgtcgcctcgccccggcgccccgcgacaacgagacctcctcctccgctcagccgcagaagccacctcgccgccggcagcagcgttggcgggccttgtggcgaggaggaggaggagaaggagggggcgtggaggcgcggcgattgttcgcgggatgagctacggcggcagcagctccctcgcgcccggtgccaagaggccgttcgagtacgggagaacgcatgtggtgaggcccaagggcacgcacaaggccaccattgtctggctccacggacttggggacaatggaaccagctggtctcaactgctggaaacgctcccccttcctaatataaaatggatatgcccaactgcaccttcaagacctgtgtcattgtttggcgggttcccctgcacagcatggtttgatgttgctgacctttctgaggatgctcccgatgacactgaggggatggatgcctcagcagcacatgttgcaaatttgttgtcaactgaacccgctgacatcaagcttggtgttggtggctttagtatgggtgctgctactgctctgtactctgcaacttgctttgctcatggaaaatatgggaacggcaatccataccctgtgaacctaagtcttgccgttggtcttagtggctggcttccatgtgccaggaccttgaagaacagaattgaagcctcaccagaggctgcacaaagggcttcaacaatacctcttttgctctgtcatggaaaagctgatgatgtagttctctacaagcacgggcagagatctactgatgccttgaaggcaaatggcttttccaatgtgctcttcaagtcatacaatagtcttggtcactacactgttccagaggagatggatgaagtttgcaaatggctcacagcaaatttggggctcggcacttcgtcatcttgatcgcgagaaagactcgcggtgtcggtgtcttctccagggtagtaaatgggctaatagcaaatttgggcttgggtatacggccatgttctagcttttcttcacgcagacgtgtctgcgagtgctgtacgcttataatttctatattctggtctacgtcgatttggttgacacggataatgtttgtttcaaatattctgttttccggtttggaattgtgaaaaaaaaaaaaaaaaaaaaaaaaa

SEQ ID NO: 19206 - DNA, 1420 bp, Zea mays
cctcgaggccgcgccgatggccgggcccgcacaagtcacaacagaacaacctacccccacaagcagaaggatccgggcggccaccgagagtcactggaagaagctcgtccggcgccccgcgacgagacgacggcctcctcctccgctccgctgaagaacgacctccccgctgacagaggcggagcgctccgcagaggcgcagagagaggtggcgtctgccttgctgcgctgcgggtctgcggtctcctgcagattcccgcacccacaaggccagaggcgacccaccagcgccacccaaaaaaggcgcacccctttccgccgcccaaatctccctttaccccgatccccaagccccgccgctgctccctcgtacgcaccgttggcgggccttgtagcgaggagggggtgcggaggcgccgcgactgttcgcgggatgagcttcggcggcagcagctccctcgcatcaggtgcgaagaggccgttcgagtacgggagaacgcatgtggtgaggcccaagggcacgcacaaggccaccattgtctggctccatggacttggggacaatggagccagctggtctcaactactggaaactcttccccttcctaatataaaatggatatgccccactgcaccttcaagacccgtgtcagtgtttggcgggttcccctccacagcatggtttgatgttgctgatctttctgaggatgctcctgatgacattgagggaatcgatgcctcagcagcacatgttgcgaatttgttgtcaactgaacctgctgacatcaaacttggtgttggcggctttagtatgggtgctgctactgctctgtactctgcaacttgctttgcccatggaaaatatgggaatggcaaaccattccctgtgaacctaagtcttgccgttggtcttagtggctggcttccatgtgccaggaccttgaagaacagaattgaagcctcaccagagtgtgcacaaaaggcttcatcaatacctcttttgctctgtcatggaaaagctgatgatgtagttgcctacaagcacggggagagatctgctggtgccttgaaggcaaatggcttttccaatgtgctcttcaaggcatacaatagtcttgggcactacactgttccagaggagatggatgaagtttgcaaatggatcacagcaaatttggggcttggcactaagtcatcttgattggaatttgatgcgagaaagactcgcagggacggtgtccaaataataccggtatcttttccaggaggtatatggtttaatagcaaatttgggcttgggtatacggccatgttctagcttttcttaacgcagacgtgtctgcgaatgatgtatgcttataatatctatattttggtctacgtcgatttggttgtggcaaaaaaaaaaaaaaaagggtta

SEQ ID NO: 19207 - DNA, 1540 bp, Zea mays
  misc_feature (6)..(6): n is a, c, g, or t
  misc_feature (40)..(40): n is a, c, g, or t
  misc_feature (1508)..(1508): n is a, c, g, or t
cccccnctcgggtcgacccagcgtccggtcggccactgcnacgacctcgcctgtcgcctcgccccggcgccccgcgacaacgagacctcctcctccgctcagccgcagaagccacctcgccgccggcaggttcaccaacaccaacctccctagtcccccctacctctcctcactcaactggccgaccgcttttccgaacccgtgccgcccgccagtaactgttccatctttggcgcgcgcgcgtgcctggccgcctgccaccgccaccacccaataccaccacacgcgcagctcatgtggcgtggcgcagtcgcgcagaggtggagcgctctgcagtgcagagaggtggaggtggcgcatgccttcctgtgccgcggcctgcggtctcctgcagattcccccgcgcccaccgcgccatgcgaccctcaccccaccacccaaaaaggcgcacccctttcccgccgcccaaatccccacttttccccgatccccaagcacccgccgccgctccgtcgcacgcacgcgcgcgccgcgtcgcctttatctgctccccccgctgcccggaactcggacgctgagccgtcgttgtcgctgggattgcagcagcgttggcgggccttgtggcgaggaggaggaggagaaggagggggcgtggaggcgcggcgattgttcgcgggatgagctacggcggcagcagctccctcgcgcccggtgccaagaggccgttcgagtacgggagaacgcatgtggtgaggcccaagggcacgcacaaggccaccattgtctggctccacggccttggggacaatggaaccagctggtctcaactgctggaaacgctcccccttcctaatataaaatggatatgcccaactgcaccttcaagacctgtgtcattgtttggcgggttcccctgcacagcatggtttgatgttgctgacctttctgaggatgctcccgatgacactgaggggatggatgcctcagcagcacatgttgcaaatttgttgtcaactgaacccgctgacatcaagcttggtgttggtggctttagtatgggtgctgctactgctctgtactctgcaacttgctttgctcatggaaaatatgggaacggcaatccataccctgtgaacctaaagtctggccgttgggtcttagggggctggcttccatggggccaggtccggcctgtccctatgatattgcgtggtatatgttttattggaactgcttgggttttgttgatgtacatgatttctggtcatccaggaccttgaagaacagaattgaagcctcaccagaggctgcacaaagggcttcaacaatacctcttttgctctgtcatggaaaagctgatgatgtagttctctacaagcacgggcagagatctactgatgccttgaaggcaaatggcttttccaatgtgctcttcaagtcatacaatagtcttggtcactacactgttccagaggagatggatgaagtttgcaaatggctcacagcanatttggggctcggcacttcgtcatcttgatcg

SEQ ID NO: 19208 - DNA, 549 bp, Zea mays
gcagacaggccagctgaaggatattacattcgttctgggataactgtggtgctcaagaatgcagtaattctgaatggtacaaaaatttagaagattatagaattatctgcagaataccaatccctcagtgaagagcacagcattgaagcccacagcagagttctacgacgcagatgcagtcaataaaaaccccaatagcacaaagattaggagactgtcgatgcagctaaagtgtggatataggcatggagcacctgcacctgcaacacgccaacggtacggccagaccatgagcatgaggccatttcacgtcctttcataagcctcggctagtgccggcgcgcgcagggtatcttttgttccttttatcttgcagtaatttacgtgaagtatctgtacatgtagagggagagatagggtacagtacgagagagcatgttatagtacctactcttattatttgtttatttatcgttgtgccgaagaacgacccctgcatctcatgtgccaagtccatgcctaattgcctattgatgcccactttcgggg

SEQ ID NO: 19209 - DNA, 2072 bp, Zea mays
ccacgcgtccgctcccggctcccctgcctgcgcgccgtctcctccaggctccagcgcctcgcggccaccccgtacgtaccacggctgcacggccgatggcgtaccccgcggcgccgcacacgagcgcggccttcctcgccagcttcgcgacgccgctccccgcgcgctgcgcctcgcccccgacccggcgccgcgcggtgtcggccgccgccatcgccaccaccaccacctgcgtattcgccgacgccccccgggggatcaaggaggagcaggcggactcgggcgcccaggcggcggcggctgcggctgcgcggagggacgtcagcccggacaccgtggcctccatcatcctcggcggtggcgccggcacgcgcctcttcccgctcacgcgtacaagggccaagcccgcggtgcccgtcgggggatgctacaggctcatcgacatcccgatgagcaactgcataaacagcaagatcaacaagatctacgtcctcacccagttcaattcccagtctctcaatcgccacatcgcaaggacatacaactttggtgagggagttggattcagtggcgggtctgtggaggtgctggcagctacccaaacagctggggaatcaggaaagaaatggttccagggaacagcagatgctgtcaggcagttcctctggctttttgaggatgcaagactcaaatgtatagaaaacatactgattctgtctggtgatcatctgtatcggatggattacatggattttgtgcagaagcatgttgactctggtgctgatatttcagttgcgtgtgttccaatggatgaaagtcgggcatctgattttggattgatgaaggccgacaggaatgggcacatcactgatttccttgaaaagcccaagggtgcagatttggaatcaatgcaagtggacatgggattgtttggattatccccagagtttgcaagtacgtacaaatacatggcttcaatgggaatatatgtattcaaggcagatgttctcagaaagcttctgagaggccattatcctacagctaatgattttggcttagaagtgattccaatggctgcaaaagattatgatgtgcaggcttatttgtttgatggttactgggaagatattggaacaataaagtctttctttgaagcaaaccttgctctcactgatcagtctcccaacttctatttttatgatcccgtgaagcctatttttacatctcctagatttttacccccaaccaaggttttgaactctatagtttcacatggctgctttctaactgagtgcagtgttgagcactctgtcattggtatccgctcaaggttagaaccgggagtgcagctcaaggacaccatgatgatgggggcagattactaccagactgaagctgagagattatctgagctgtctgttggaaaagtcccagtcggtgttggagagaacactaaaataaggaactgtatcattgataaaaatgctcgaattggaaagaatgtagtcattatgaactctgagaatgtgcaagaagcagacaggccagctgaaggatattacattcgttctgggataactgtggtgctcaagaatgcagtaattctgaatggtacaaaaatttagaagattatagaattatctgcagaataccaatccctcagtgaagagcacagcattgaagcccacagcagagttctacgacgcagatgcagtcaataaaaaccccaatagcacaaaagattaggagactgtcgatgcagctaaagaagtgtggatataggcatggagcacctgcaacacgccaacggtacggccaaaccatgagcatgaggccatttcacgtcctttcataagcctcggctagtgccggcgcgcgcagggtatcttttgttccttttttctagcagtaatttacgtgaagtgtctgtacatgtagagggagagatagggtacaagtacgagagagcatgttatagtacctactcttattatttgtttatttatcgttgtgccgaagaacgaaaaaaaaaaaaaaaaaaaaaaaaaaaaaaaaaaaaaaaaaaaaaaaag

SEQ ID NO: 19210 - DNA, 5692 bp, Zea mays
  misc_feature (502)..(502): n is a, c, g, or t
aactgagggttgtgtgaattagcgtaatagattcttctctatttatagaccaggctcaagttttttattttaaatttttataatttttgaattcaaaatttggacgaaccaatcagaaagctctacatggcaactgcctatgcaccaagcgggacaacaatatggcgagcgatatcgaccggccacgatctcaacatgatcagcaccaacccaattgatcgactgacgacattttcgaccagatgtgtgtgtcgcccggtgctagtagcacggtggctgatatcgatagacagatttttttgcattttaacccttttataaaaaatacatttgccccttggaagatttattctcgttttggaccttcgctcggcgccacaagccacagcgccgaggtaacagggctcggcgtcgagacttatggcgccaagctatagggcgtcgtgctgcctggagcctacgtggagcctagctcgaggccatttaaagtttaatgtcattntattatgtttcatgtcttaacacgaagacctagatccgtggtgtcgaactcataaaaatggtccttaaatatatcagtgtacgcaagaagcattaatcgatcaagaagcactatcatagcatacaaatgttcattcaacaaacactccataataaaatataaatattcattcaacaaacactctatatgaataggtgtcgtgtcttccctaaggccctaacataataatatgttaatgcaaccttgatgttattttagtttttatatttttctatatagatttaggcaattaaccaaccagcctaagaagaaaaaacaatcaaagtgttaatataaaaaatagataaaagcaacaacagttgaaagttgtgcaacaattgaaattaccagtttactactatgtttcgaaatggttgtagtggtggcggtgactgtcctctcccaatcaatgtgtcatcacataaaaatccacttatatgatagccattcatacatttaaacttatggtattaaaaaatttaacatgtatataagaaaaatcactactaaagacacataaaatatgtaagaccaagagcttaaaaatatcttcttgtaaagaaaaaacattgtcatgtttaaagtactatatacgacacagttctgtatatcttttctttaacagatcgagaggttgccctcttagaacataaacgggcatatattaatgacacttcgtctaccacaacagatttatcttccttaatcaggaaggtctacaaagagaaaacaaattattattttgctaaaatctattgttaagacctgaaaaatagaattacactaaactttaaatgattattattgtatttttgcgagctcagctctataaactgtggcagcgaacttggcgccaaacgagtataagcattctaggggtataagtaattctttttacgaaaaagagttaaattgcaaaaaattggatcggccgctcgctgttggcactagcccattggcaaacgtcttcactcaaatatcgaaattgtagtaataagtttaattgacattaatttcatgtccacaaacaatatatattataaggtatttgtataaaataatattattcattaagccatgaacgatctttgtatacatatctaggatgtacatttgtataaaataatatttacggaggcgaaagctgagagcctgagatcatgtgcatactaaattaacctaccagggcgtagtgtccctaactctttttcattctgctgtaagcgagtcaatccataactagatagccgctaactcttctacctgctgtgctcccatatcacctcatcaatctggtgtgatctgcacaaattctttgctgtcagtcagtcagaatcagaagatgaactagagctgcgtgccgctgcactcctccgatctttaattgcgggcaccagctgctgtcgaggatcacggaacgacgaagaagactgcgacggttgccttccctttgatcctgatcctgccgctgatggtttcttgttattagcagcagccttggcagccgcctctttcacctctctgcacaccttgtccaggatccccaggaagtcgcggacaacgacgaacagccgtaggccctcatccttccctgtgctcccatggaagtagtctacagtagtgcgtaccagcgcccgtagcttcttttcctcctccagaagctgggtcacgcgcacctgggactgctcgatgaactcgccaagcttgcgatggaacccactgtcctcgtctaagctcttcatgcccgtgttcaagaactcgttcgccttcaccagcttgtgccccaggctcgccaccgagatggtcagcgcatcggcgtccaggattgccgccttccgcacgttctggaggtcgtctcccaggctcgaaacgacgcccaggcctagctgcttgtagtgctccgtgtcgtcgctgacatcctcggtgagatcgtcagaagtcacgctggatatgctgctgttgctctgctctttggcggcccgaacggcacgcacgccctctgaccgaatgatctcctggacaacaaagtgaagcagcgtcgtcttgccgtcgacccccttcacgtctgagagcttcaggagggtgtccagcttgaacgcctgggccccacctcgaaaggtgccatcgttcatccggttgccagtcttgagtacagcctctagcagcttcttgaatagacggctgttccgaagctcatggcaggccacctgttttcgaccaagaaaaagtacagttcaataaaacagtcagcattttttccattgttatcgacaaaaagagtacaattcaataaaactgtcagcattttttccccatttttataacaagcagtactactgctcctgaagccacaatacctccagggttttaaatgattgttctgcatttgcagcttcttccggcaaagtggacatgaaaagcaacacatccaggcgctgatagaggtaaggtatgtcaatgatggtcctcaagaattgctctgcaggacccagttgagtgagctccccggtgtataaccgaagccttagctcctcgtcgctgcttggagtccccccgtgcaaggtttgtatcagatcaatagggagttcatgccctggatcaatttatatttacccattaatttaaggtacatagtttctgctgaatatataacacagaagagacccaaaagatggtcagctttaccttccataactgcattacgtacttcgtcagctgaaacactcaatgccttcagtgatatcgctaagttctgtgcctttttagcatcgagtatcctaacaaattgaggggtatcctttgctgctaaatcctttttgccgtcagcatttttcttgtcagcagcatgacaaccaaaaaggctctcgatcatctcctcattaaacctatcaataaattagtaaccggatgagttagcatcactgattcacctgatgttaccaatctttggtgggtagcaagcaaccagtaaagagatgtgcatagtacaaatacgacaacaataattatgcaatagctagctatgttccgggaggttggcaagattgtaactggaagcataaaactactctttccacacacacaaaaaaaaacaagaaaaagaaacttactggaaggatcctgctttaatttgatcccacaccattgcttgatccggatttgcagtaactttatcccagaagaatggcttcagctttgttttattgtctgccacaggaggacctgcaacattccctgccttcttcaatggtggtggaccacgcgcttttggaccaccaggcatggctggtggtggaggtccagctccacctctacctggtgggggtggaggtccgggtccggcactacttggtgatggtggaggtccgggtccaactgcaggcctgggagcaggaggcggtgggggtcctggtgggggtggattgctcgaaccagcagctgtaggcatctttggaggtggtaccggtggtgttggtgcagatggtgcaggaggagcctttgggagaggataacctggacgtggtggtggtggtggtgctggtgctggaccagctgcaggtttacatatgctgtcgctggcattactagaaggaactgcagcaacagcagatttcacatcctgagaattagtagaggtcgccggacgtccagcaatggtagttatttcatgagaacttagtttcatcgcctgcacattgctgcgtcgctcaaactctgacttcattgacatttctctaacttctgcctttctaggaggaaatttaaattctttacgctggctcgctgatgaactggttgacaatgcccccaacctgttgacatcaattggggtagagcatgatttacgtgaagaacctgttgcattaatgaacaaggcatgaattgcccggtaccataagctgaataagaattcctgtctgtcttttggtgtgtgtgtgcaaaagcattcatgcaagagagaaattgaatgaactggaaaaaaacacaaaaaacagctttgttttcctttgtagcacctgataaatcactcatattcaaactcagcagtggtttgtcatcatatgatgattctgggtcttcgcttccacgacaagcacagcaacacagacatataagagccaccaatgcaacacaagccactgacaaaccagcaataatagtgccactgttgtccttgctcttgtttttgggctctggtttaccggaactttttcacggtagtgactagcaagtgagcctctccttcggaagaacaaaacgcttcttattgcctgttttgctttaggtcggggtggagcaatggctgaatcttcttcaagtagacgtcttcttttcatcgcaaaaggaaggttgatgctgttagagttgggaagtaagcttatggtttcctcctggcgcgcctgcagtccatgatcagagaaagggaaattatgcttctttaagcagtccagaaaagtgttggcatcttctgcaggtgataaggttgcggtgattgcttcctcaatgccaatcttttgaggatagaacttattatcattttctctatacgaattgctgatggtgttgaacagaaggctgtaatgggacctgtttctaacatcttgaggaattttcaagtccagagcacaactgtgccacagttgttccacctgtgtataagcaacgtaccagaaataacagttagcaagaaagtgatatagaattttagcttgtgaatatccggtggtaatataggcatcagttagtagaaagcaggtgttttagctctattgaaaaaataaataaatataatcatataatataagtattccaaggaaagtttatactcccaagtaacagatagacagtgaattactacttggatttagactgtgcagttcttattcgcatgatcgatgtactggtgtttcataatttcctattctccatccctgcacaatttacctacaggagacaacctacgaactgcaaaccttggcgtaaatataacattacaaggacataacacataggtgctacacgagtgcagagcatcattaacttggtcattaccgattcatccccgcttgggattgcaggagacggcagctggcaagctggtggccagaacaagctagtcctgatcgcaccagccagctgcaggagcatgca

SEQ ID NO: 19211 - DNA, 2074 bp, Zea mays
  misc_feature (13)..(27): n is a, c, g, or t
ttttttttttttnnnnnnnnnnnnnnnattttataaacaaacaatatatagaataaagtctatctatatagtatattagaaactataacaatatacaagcatctaactagtatttatttattcacttgataacccgaccggcttggcgtctcagttctccgtccagcatatattaaccgcgcaccttttgtcctctccttgttcccaaacctctgctagcttcgcttccaaccccatcgatacttcccagcaagctacactacaagctcatccgcctagtcctttcatggccgatcaccagcctcaggtcgaggtcctgaccgagtcagtgcgggtcaacggcaccaaggcggaggccacgctcgtgggaggcgagctggcgtggcgccccgccgccggcggcaacggagaggggcaggagcggcggctggagctggagtcggaggtgctcgggttccagatggacgggaggcagctcaaattcgcgacctttgccgcgagcggcggcggtaatgggaaagggggaggaggggatgggaatcggaggagaggggaggtggagatggagatggagaacgaggccaccgcggtgcggtggggggacgtaatcagtgatcgcctagcctcgctcggccggccaaagaaattgttcattatagtgaacccttatggtggaaagagaagcggaccgagtattttccagaatgaagtcctccccctcattgaagcttctggcgtgctttatacgatgcaagaaaccaagcatcgccttcatgctcaagagattgcacattcacttgatcttaggaagtatgacggcatcatttgtgtcagtggagatggtgtgatggtagaggttgtcaatggtctcctgcaaagggaggactgggaagcagcaataaaagtgccccttgggatcattccagcaggtactggaaatggaatggcacgatctctactgcatgctgctggtgaaccattctctatatctaatgctgtgttcgcaatcatcagaggtcataaacgtgcccttgatgttacttctgttgtgcagggaaaggcgaggttctttagtgtcctgatgcttacatggggtctggtggctgatgttgatattgaatcagagaagtataggtggatgggaagtgctcgccttgatttttatcttctactccgcattctgaacctgcgacggtacaatgggcgtatcctttttgttccagcaccaggatacgaagaagttggtgatcctgtggaccaagctaccggttacgaaacaaacgggtttagcacgggatttcaagacgacggaagaaccggcagtaatggtgagacgtgtggctatgtgggcccatcgtcgatcaaagaagctggtcttagatggagatcactggatgggccattcgtttcagtctggctcggcaatgttcctttcgctagcgaagatgccatggcagcaccaaaagctgagtttgcggatggctacttggatgctgctataatcaaggattgtcctcggtgggatgtcctcgggctcgtgttccagatgaaggacggcagctacgtgaactcgccatgcgtggagtacttcaaggtgaaggcgatccggatcgagccgggcctgcgcgtgggcagcagcaccgagggcggtatcatcgactcggacggggaggtgatcgcgaggggcgacgagtccgattcccgcgccggcgacgacgagccggggcacctgatggcgtacggcccgcccatccagctgacggtggaccaggggctggccaccatcttctccccgagatgacgatccttctctcagttctcctccaccgcctgcgagtaatttgcttcgtctagccctgcctgccattctctcgcgtaggatcatgtgcttctgtatgtaaatattgctcacagcccaccccagttggatgagcgatgagccaagagggacggatactggctggatctccgtctatagattgttttatttccctgcccacatggctgccgcttttagtgctagcttgagaaatgagagctgggcagttcataagcttcaaaaaaaaaaaaaaaa

SEQ ID NO: 19212 - DNA, 2860 bp, Zea mays
cccctgcgagctactcagcgaaactctgtgcaagtcccggacaggcccataaattgttcaagatcacctggatttctttaccaaaacatcatttaaaattcctacactctgaaccgttcgtataaatacaaaacaccatacacataacacatgtacacgtatactccacctgaaaggcgccagcgaaaaaactacagtatatattaaccgtcccaaccacgcaccttttgtcctcctcccctccaggctccagaactcccgaaactaccttcgcctttaaccccatcgatgcttcccagtaagctacacgctcacccccctcgtccttccatggccgatcccaacctccaggccgaggtcctgaccgcgtcagtgcgggtcaacggcaccgaggcggaggcaacgctcaggggcggcgagctgacgtggcgccccgccggcaccggcggcggcggagaggggcaggagcgggggctggagctggagtcggaggtgctcgggtcccgggtggacgggaggaagctcaaactcgcgacctttaccgcgagcggcggcggtgatgggaaagggggaggaggggatgggaatcggaggagagaggaggtcgtggtggagatggagaccgaggatgccgcgctgcgctggggggacatcatcagggatgccctcgcttcgctgggccccccccagcaattgttcattatagtgaacccttatggtggaaagagaagtggaaggagtattttccagaatgaagtcctccccctcattgaagcttctggcgtgctttatacgatgcaagaaaccaagcatcgccttcatgctcaagagatcgcacgttcacttgatcttaggaagtatgatggcatcatttgtgtcagtggagatggtgtgatggtagaggttgtcaatggtctcctgcagagggaggactgggaaacagcgataaaagtgccccttgggatcgttccggcaggtactggaaatggaatggcacgatctctattgcatgctgctggtgaaccactctctgtatctaatgctgtgtttgcaatcatcagaggtcataaacgtgcacttgatgttacttctgttgtgcagggaaacacaaggttctttagtgtcctgatgcttacatggggtctggtggctgatgttgatattgaatcagagaagtataggtggatgggaagtgctcgccttgagttttatctcctactccgcatgctgaacctgcgacggtacaatgggcgcatcctttttgttccagcaccaggatatgaagaagttggtgatcccgtggaacaaactaccggtcatgaaacaaatggggttagcggggcaactgacaataatggtgaaacgtgcggctatgtcggcccgtcgatcaaagaagccgatcgtagatggagatcgctgaacggtccgttcgtttcagtctggctcggcaatgttcctttcgctagcgaagatgccatggcagcaccaaaagcagagtttgcggatggctacttggatgctgctataatcaaggactgcccgcggtgggatgttctggggctcgtgctccagatgaaggacggcgcctacgtgaactcgccgtgcgtggagtatttcaaggtgaaggcgatccggatcgagccgggcctgcgcgtgggcagcagcaccaagggcggtatcatcgactcggacggggaggtgctcgcgaggggcgacgggtcccactcccgcgccggcgacgagccggggcacctgatggcgtacggcccgcccatccagctgacggtggaccaggggctggccaccatcttctccccgagatgacgattcttctatctgttctccaccgcctgcgaggactttgcttcgttagccctgccattttctcgagtagaaccatgtgactctatatgtaaatattagtcacacggtcacaccccactccagagtggatgagcgatgagccaaaacacaagagggacagatcctttatctccgtcaagagattgttttcttttcacggccacagcccacatggccgccgcttttagtgttagcgtgagaaaatgacaagtgggctgtgggcagctcctattctttttttcaccttgtgtgtgttgttgattgtcccttgacaaacagtggactgttttcctgcaaaattggtgtttaattaacctgaaaagcttccacttgcctctaagtcttggcttggtagtgctctggtctcttggtcctcgtcggagctcctccttctgttcatccttgtcggttctgtcggagctcctccttctgttcatccttgtcggttcgtctccgcatgaaggtgtccctccgttcctttttgtggatcctataaaagctatcctataaaagctagagccaaagctccgccaaggggttcaagtctatatatagaacagatgtttatatcgctaagtatataagtatctcacaaacactttttgtctaaaataccgtgtgtccttaaatatcaatattatcttaggactgttcctgaaaagcccttaaaacttgctcgacggaaataactataaagcgtgctcactaactatctttatcttttttaaaataattataaaacatctctatatttttagccatttcgaaaaatagaaaactaaaagctaaaaacgatctaatgtgctaaaaagaagattggactacgcgaaagcagaggagctttgtctagataatcagtttgaggttccacctttttgttggggttatgtttcttaaaagtaggaataatgtttaggtgagtttggtttagctttttttttgcacctgttcctactttaaaaagcacaagctgaattaatttttctgcaggcatgca

SEQ ID NO: 19213 - DNA, 4612 bp, Zea mays
  misc_feature (1781)..(1781): n is a, c, g, or t
ttgccaccttaaaaaaggtaatgtacaggcccaccgctttaaatatgttgcccctgtgtaaaaattggcaatttcgtttaaagaaagtgcaacgagataaaaagttttttgttcacaaaaattccattgccgggacttaaacccgggtctctcaggtgagagccaagtatcctaaccacctagactacaacggattttgctaagtttttaaatacaagtttatttatttagtaaaaccagaaacaagtcttactgtacggatgcagttggtgtgtgctactgttagcaattcatcgtgtgttggtgttcatggcaaagcgaagggaagaacttgtatccagagtttatttatttagagtgtgatctagaatgactaaagagaaaagtggtgttcatggcaaagcgaagggaagaacttgtaaccagaaaccagaaacaagtttatttatttagagtgtgatctagaatgactaaagagaaaagtggtgttcatggcaaagcgaagggaagaacttgtatccagagtttcagactagatcaagtatggcaccctctattgtcgtccttcacggtagttgctcaatcaagaataatgccaatgtcatccaccctattcatttcagcaatttacttcagttgggttaggtaacgtaatgccagcgtgatcgatgcatgctttagactctcagcatgacagcggttgctggaacaataataagcaaataagcagagacagacagacagttttggtctgcagtacagtaattgagaaaaaaaaaaacagtttggcgaaaaactggaaaattggacaagcaatctagactcaacaatggagcataagtcgtaatgaatgaactgacgaacccacaggcccgatcgagctctcattcatgttgtctatctgacagaactacgagtaaacttcaacaactgaatcgtccaataagcactagtgtgtgtgtgtgtgtgttgcattttccctgaccaaaccccaaacacactccgaataattaatctcaagaagatttattcagaagctgaaccagtgctccacgctcatgtgcttgaccccagcagtcagctcatggattcacgtccacttcgaccatgcgtcgtgatggagctcggagcagtaaaggaagcccgcgacggggaggtacgagtccgtcgagtcggcggcacgccgcacctgcacctcgatcctcgaaggaagcggcggcgaggaggtacgagtcggcggcacgctggcacctcgaaggacgacgatgtccccgcgttccgcggacgacgagccccgcgggcgtgctccaccacgctccagaggaatctagtagtctgaagattacgccttactccaatgcatttttttggcctaaatgtacgagagttgaatctagtagtctgaagattaatgttgaaaatgactttatttcaatggcatggtcatcagatcgggctctgaagaacaactgggactgccaaggcatggccgaacattctgcgctagttcatatgaccaactgaacgatctgaatacctgcgctggatccggcggattgagcagcgtggaggagcaggggcgtcggagcaaagcgggagcgtgcggcggcggcggatcgatggtgctggcggaggtccgggaggaggcggagctcgagtggtggcgacggagctcctcgtcctgtggcaaaagatggtgacgtggactcgaccttattgtgccacgtcaccgaaaaccacaaaaaggccaatgatgtaaaacggacggttttgatatttcntgagtgctgaatacctggttttgtggttgggaaaaaaatctgtactaaacgttatcttttaaagtccctcacatccaccatttggaggcctacaaacatatatcaaaattttaaaaaaaactttttagtaatttattttttcttttaattatatggatcagcagctaatatatgtgaggggctgtaaaagtgattttttacatccgccatataaagaattttttttcctgtggcaggggttgaaactcagacagcgcatgtagatgaggattgtggaatggactttttgccaggaaaaaaaaattattgcacacccttggaaacgctcaagtgtaaatgggccgggcagagatacaaatgggctcctatgtatggtccagaatgacatgacagcaaaggcccagcccaaccacaggtcctttctcctccgctcttgtgttatcattgccgccccccggcatcccctagccgccacccgccaggcgttaacgctcgacgggaccccgtcgtctttaaactccgcaagcgctgccagcggccgcccccgccgcgtgctcccgccgtcctcggtgcctcggccgcctggtccccaccggcccttccccttcctccaccggcggccggcggctcccgtagccttgccgcgcgcgttagatttttcctaccaaataccataccagtaccaagcccctagccacacagttttatagcccgatgtatattcatttttcagctattttgctcctcgtttgtcttgaatacttgaatcggtgttgattgaatgattttgtctttagaacggcagtcattcgcttgatttttcctacacacaagcgtacgcctttgttgaatcgatggcttttgttttggtttgctcgcaccattagccccctgctctcttgaggttggatgcagggaaaaatgcgagaaggttaccggtgccagattcatggaccgggcaggggctctatacttctggggaagccagtaaatttcctcagggtcatatcttctgtccacattgcatcatcttgatgctgttgacctgttgtctttgttgtattattcacatattttcgttgattcgcatgtgttcttcatcaatttcattttattgagtaattaagctctggcacatggttagaagcgacatgaggagactgaaacatctgaaagttttcatgtggataatacacatatatggtcttcaaagttctctgatcgcttcatgtccaaagcttttctttcatgtgaaagcttttgaattatgccatctgaatttggccttagtgatgcttgggtctgaactgtagccatctgaatatgaccttagtgatgcttgagtctgaactgtagtgtttaagtcgttgagaaacaacatgaggaggtcatacattctgaagtatctgatgttgatacatacattcatggtcttcaaagttctctgattgtttcctttacccactccttatccaaatgatacttggttacgttcattttttctctccttgaatcatagcttcaaatttctaagttatatgtcttgccaagtttttgagatgcaacgaagcaaaatgaggagttcatatgatctgaagtatctatgttcgttgatatatccatttgtggtcttcaaagttctctgattgctttgtccaccacttcaccccatgctgcattgtctttattcaaatcatatttctccatcttcattttttctgtgtgtattgctatagctttacagcatttcttagttatgcttgaacaaattttattggaatttaagatgtcaaaagaagcaaaatgaggaggctgtattatctgaagtatctcttgttgatacagtattcatggtcttcaaagttctctgattgtttcctttgaaatattattctattaaagcatagcagtttgtaaaaaaaaaaaaaaaatactattcaaataatttttgcacgagttctttatgaattaacatattggcatgattgcctaatgcatctcttcgtctaaagcaaaattgtggtgacacctaattgtgatggtctcgctgtcaaaatatgatcttgattcttaaaggttgtgtcctcagcctgagaggggttagtttgcaaaatcctccaccttctaactttgaatgctagaaacagaacatgatacagacttctgcagactgtaagagagtcgcggcatgggattgctggcagggcggtcacagcctcaacgagtgctcggcgtcaacggcaatgagcgagtagaggcacgctcgaataggaagctcaacacggagaaggagacaggtgctgctcagcgaggccttcggtgacggctgcgagacgtcgtggcgcgcgaagaacgatcgcggacagaaacaatggcgaggtggctgtgtgcacgttcgggcggagccagtgcgtccggctgaggggagaaaagggcgagctgccaccctacttatagggagaggagaggggaagaaatcctgctgaatcatcataaaatcacggcaaaatttgaagcttccaagttcttgccgttaatggcggagagaagaaaggaaaggaaatccgcgagcagggaaagggaaaccagagaggaagagaaggaaatcgagggtggcggcgtgctctccacgacgaagggaggacggcaacaagggaaggcgagcacgcgaccgagagtttgtcgctgcatgcggcggcggtgcacagtgctgcgagtgccgacatcgagtagcaacggtatgttgaataattagacaattttgagattaaattttgaatataaatcatgaccatatcagaagaactgaagtaaaaagtcaaatcagatga

SEQ ID NO: 19214 - DNA, 1410 bp, Zea mays
gttacgactgtccagctatacgacacgaggttctacgcgtgggaaatcaagccgtgtacgtttaggttttaccattttaccctcgcattaatagttgctagtgatgaataaaatggccttgattataattacatgctctggtaatggctgttcagataaaactggttgcaattgaaattatcgaaagaacatgaacattgcatggccgtcaaccaaccttccccagtcctaactcaagtcacctgcactgcaatgcaaggtgcaagcccatcagtggcattggtcaaaactgccaagctgcaaacaccagcaactaggaggcgagtaggagagcaagctcgaacaccacgcatggcgtggcgtgggtgcacgcgtccgtcgtgcatgtctccgacgaaccccaacctaaaccttcccatgcagcctatagcttgggatataaaaggcaccggatcgagatgccctccgcagtgcagcaccacgcgcgccgacgaaaatgccgtgccaagaaactaaagcagcctctctagcagcaacgcaacaaccggcgatgcaccaccaccaccgtggccgctgccgcctggccgcgctcgtcgccgcggcgctctgcctggtcgcggcgcacgaagggacgtgcgcggccgcggcgaggcgcctgcacgcggtggaggaggtggcggtgctcgacgtggcggcggaggcgccagatgaggccgcgaggtggccgggaggcggggacgccctcggcgaggccaagtggctgccgatgtccatgccgctgccgggcgggctgcggttcccgccggtgacgctccccctggccggcgcgtcgatgccgtggctccagggccccgtccgcggcggcggcgcgctcccggccctcgtgccgtcgttcgtgggcgccacgcggcaggagcagctcagcctgtgggcgtccctgttcaacccgtttcaggccaggccacggctgccgatctccctcggcggcgagacggcggggcacgtcgagcgcggtggggtttcggccgtcgccagtggcgggaaggccaggggagcagaccctcgacgcgcctggccgagttacttttcacgaatcttccgttgagaataagcacgagagcctctcacagtcgacaatcggagacgacgacgatctatcgacgatcggggacgacaacaatcttggatagtcgcttaatgacccaataaactttagatcatctaggtgacgacattcataaatattaacaagaatatagccaatctaaatcactcaactgtaccacaagatgcacaactatttataggtgatgcacaatgatttttctccaagtctcactcacttgatgtgtaatactcaaatttgtatacaaaggaagatagtggatttccataaaaaaaaaaaaaaaa

SEQ ID NO: 19215 - DNA, 1792 bp, Zea mays
gcacgcggtataaaaaagggtgagagatccaaatctccatgactccatcccatagccccgctcacgctgtcgctgtcacgcacatcatcgtcctcctcccttccccgcaggccccctcgcctcgcgcgtgcgcccccctaccccgtctcctccctgcctgcgcgagcgactagtagaaataggcgcgcgtgccgcctcggccgctcgctcctctggttaatcccccctcgccacgactcgcagccatcccttcacattatccgcgcgcgcgcgagcgagcggacgtagcgtgtgggtagcgtcgccgtgcggacggtctcttggtgccggtgcgggccgcgtgacggtgcgtgtgccgcccgcggggaggaggtcgttcggttggttggccctcggcgacgatggcggtccacggcggagaggcggtctccgtcgcgctcctcttctccctcgctttcttctgcgctcgcctcctgctcgaccgcctcgtctacaagccattagcagtctaccttttcaacaccaaagcttctaagttgatgaataatgaggccaggcaagcaaagattgtcaagttctcagagtccatttggaaacttacctactatgcttctgttcaagcatgggtcctcatgataataaagcaggaaccatggtcattggatatgatgcaatactttgatggctggccgaaccaacccatcgtgtcttcattgatgcttttctatatgtgccagtgtggattttatatctatagcatcggtgctcttgttgcttgggaaacccgcagaaaagattttgctgtaatgatgtctcatcatgtaataacatctactctaattggagtttcatatctgactggatttttccgaattgggaccatcattctcgctcttcatgatgcaagtgatgtgtttcttgagactgccaaattgtgcaaatacacagaaaaagagctgggtgctagcttgttttttggtctcttcgctatctcctggcttctattgcgtctgatttacttcccattttggataatcaaagcctctagctatcattccatcacattcttgaggaagctggatgaattcccaacaactttgtactacatcttgaacacaatgcttctcacattgcttgtattccatatgtactggtggaaactcatatgtttgatgataatgagacagctgaataataaaggacaagttacagacgatgtccgatctgattctgaggatgaggagtaatgggagattcattctttgacatctgcaacgtggcatttcctcgtcaatacttttctatgcctgcttccagaattgattgcttttaatcttggcaagtctcgggaacgtataggaaagtttaatctctgtatattgccttatgatatcaaacatggctagaccgggaatggatctatacatgatgacgggcatagctagcaagcttacttcaaggttccttaaaaaattttggttcacctttatttgatatggggaaagacatgagagggtgtacagctttttcctgaagcttgcagaacccccctctgtaccatgatcaatatacttcacttgtgagtagatttagttctaattgatgataataaattgattcttttgattgggaatgaatctcacctgaaccttgatgatctaaaaataaaaaaaaaaaaaaaaggcccgctacccaattttttttttgaatcaatgcattaggacgtgacttttatctatccctcgaaatgggaggagagcaagtttgaaaaaaagatcgtggagtgtctagg

SEQ ID NO: 19216 - DNA, 1166 bp, Zea mays
gcgtcccctgccccatctcctcctgcctgcgcgatccactagtagaaataggcgcgcgtgccgcctctctcgctcgctcctccggttaatcccccatcgccaggagcccaggactcgcagccagcccttcacattattcgcgcgcgcgcgaacggccgtagcgtgtgggtggcgtcgccgtgcggtctcttggtgccggtgcgggccgcgtgacggtgtgtgagtgtgtgacgcccacgcggaggaggtcgttctgttggttggttggtccgcggccatgatggcggtacgcggcggagaggcggtctccgtagcgctcctcttctccctcgttttcttctgcgcccgcttcctgctcgacctcctcgtctacaagccattggcagtctaccttttcaacactaaagcttctaagttgatgagtgatgaggccaggcaagcaaagattgtcaaattctcggagtccatttggaaacttacatactatgcttctgttcaagcatgggtcctcatgataataaagcaagaaccatggtcgttggatatggtgcagtactttgatggctggccaaatcaacccatcgtgtcctcgttgatgcttttctatatgtgccagtgtggattttatatctacagcatcggtgctcttgttgcttgggaaacccgcagaaaagattttgctgtaatgatgtctcatcatgtaataacatctactctaattggagtttcatatctgactggtcttgtagttttggacttattgctgttgccgttgcaatggcagctatcattccatcacattcttgaggaagctggatgaattcccaacaactttgtactacatcttgaacacaatgcttctcacattgcttgtattccatatgtactggtggaaactcatatgtttgatgataatgagacagctgaataataaaggacaagttacagacgatgtccgatctgattctgaggatgaggagtaatgggagattcattctttgacatctgcaacgtggcatttcctcgtcaatacttttctatgcctgcttccagaattgattgcttttaatcttggcaagtctcgggaacgtataggaaagtttaatctctgtatattgccttatgatatcaaacatggctagaccgggaatggatctatacatttt

SEQ ID NO: 19217 - DNA, 1067 bp, Zea mays
  misc_feature (1053)..(1053): n is a, c, g, or t
gcgcgcgcgatacggccgtagcgtgtgggtggcgtcgccgtgcggtctcttggtgccggtgcgggccgcgtgacggtgtgtgagtgtgtgacgcccacgcggaggaggtcgttctgttggttggttggtccgcggccatgatggcggtacgcggcggagaggcggtctccgtagcgctcctcttctccctcgttttcttctgcgcccgcttcctgctcgacctcctcgtctacaagccattggcagtctaccttttcaacactaaagcttctaagttgatgagtgatgaggccaggcaagcaaagattgtcaaattctcggagtccatttggaaacttacatactatgcttctgttcaagcatgggtcctcatgataataaagcaagaaccatggtcgttggatatggtgcagtactttgatggctggccaaatcaacccatcgtgtcctcgttgatgcttttctatatgtgccagtgtggattttatatctacagcatcggtgctcttgttgcttgggaaacccgcagaaaagattttgctgtaatgatgtctcatcatgtaataacatctactcttattggagtttcatatctgactggattatttttccgaattgggaccatcgttctcgctcttcatgatgcaagtgatgtgtttcttgagactgccaaattgtgcaaatacacagaaaaagagctgggtgctagcttgttttttggtctcttcgctatctcctggcttctattgcgtctgatttacttcccattttggataatcaaagcctctaggtttgttttttacttctctttgtgataactttctgtttctgtagtcttgtagttttggacttattgctgttgccgttgcaatggcagctatcattccatcacattcttgaggaagctggatgaattcccaacaactttgtactacatcttgaacacaatgcttctcacattgcttgtattccatatgtactggtggaaactcatatgtttgatgataatgagacagctgaataataaaggacaagttacagacgatgtccganctgattctgaggat

SEQ ID NO: 19218 - DNA, 3113 bp, Zea mays
  misc_feature (31)..(31): n is a, c, g, or t
  misc_feature (41)..(42): n is a, c, g, or t
  misc_feature (46)..(46): n is a, c, g, or t
  misc_feature (98)..(99): n is a, c, g, or t
  misc_feature (115)..(116): n is a, c, g, or t
  misc_feature (123)..(125): n is a, c, g, or t
  misc_feature (128)..(128): n is a, c, g, or t
  misc_feature (174)..(174): n is a, c, g, or t
  misc_feature (218)..(218): n is a, c, g, or t
  misc_feature (240)..(240): n is a, c, g, or t
  misc_feature (247)..(247): n is a, c, g, or t
  misc_feature (281)..(284): n is a, c, g, or t
  misc_feature (287)..(289): n is a, c, g, or t
  misc_feature (319)..(321): n is a, c, g, or t
caccccagggtttctccttttttaaaacccncccccttatnncccntccaaatttatttaattaattccaactctttaacaacccccaattttccccnncaaaaaaccccccccnnaaaaccnnnaancaaacccaaccaaaaacccacccccaccccaaaaaaaaaccacaancccccaaaaccaccaaaccccccaaaacacccccccccaaaaanaacccaaaacccctaaaaaaancccaaanccaaacccccaacaaaccaaaaaaaccccccccnnnnccnnncgggagagaagttcttagttttcccccccnnnccccccccccccaatggtacctggagttaagaaagctgcagtgggtcttgctctagaggaagccaaggtccattacgatccaaatgtcactagtcgtgatcgcataattgaagctgttgaagatgctggatttggtgccgatctcattagttctggggatgatgtgaacaaagtgcatctaaagcttgagggtgtgaattctccagaagacaccatactcatccagtctgtactggaagctgtggaaggggtgaacaatgttgaatgggacacagttgagcagacaatagaagttgcatatgatcctgatatcactggtccaagattacttattcagtgcattcaggacactgcacagccccctaaatgctttaatgttaccttgcactcaccaccaaagcaaagagaagcagagcgcaatcatgaaattaggaattacaggaaccaatttctttggagctgcctgttttcggttcctgtattcctgttctccatggttcttcctatgctttctccttttggggattggttggagtacagaatctgcaacaacatgacaataggcatgctactacggtggttgctgtgttccccagttcagtttattgttggttggagattttatgttggagcctatcatgcactcaaacgaggatactcaaacatggatgtgctggttgctttgggaacaaatgctgcttacttctattctgtgtatattgttctgaaagcacttacatcagactcatttgaaggccaggacttctttgaaactagcgctatgttgatatcttttatattgctgggaaaatatctcgagatagtggcaaagggaaagacatcagatgcgttgtcgaaattgacagagcttgcaccagaaacagcgtgccttcttactttggacaaggacggaaatgccatttcagaaacagagatcagcactcaattacttcagagaaatgatgtcatcaagattgtgcctggcaccaaagttcctgttgacggcgttgtcataaaaggtcaaagccatgtcaatgaaagtatgataactggggaagcaaggcctattgcaaagaaaccaggcgacagggttattgggggtactgtaaatgataacggttgcataattgttaaggcgactcatgttgggtcagaaacagctttgtcgcaaatagtccagttggttgaagctgctcaacttgcaagagctccagtgcagaagttagcagacaagatttcacgtttttttgttccaactgtggtggtggctgcatttcttacatggcttggctggttcatacctgggcaacttcacctctacccccagcaatggatcccaaaggccatggatagttttgagcttgctttgcagtttggaatttctgtcctagttgtcgcatgcccatgtgctttgggacttgctacaccaactgctgttatggttgcaactggtaaaggtgcttctcaaggtgttctcattaagggtggaaatgcacttgagaaagctcataagattaaggctatcatatttgataaaactggaacgctgacagttggtaaaccttctgtcgttcaaacaaaggtcttctcaaagataccacttctagaactctgtgatctggctgctggtgctgaggcaaacagcgagcatcctctatcaaaagctatcgttgagcacacaaagaagctcaaggaacaatatggatctcacagtgatcacatgatggaatctagggactttgaggtgcatccaggagcaggtgtcagtgcccatatcgaaggcaggctggttttggttggaaacaaaaggctgatgcaggaatttgaagttccgttgagtcctgaggtggaggcgtacatgtccgaaacagaagagcttgctaggacctgcgtacttgttgctatcgataagatcatctgtggggccctcgctgtttcggatcctctgaagcctaaggcaggccaagtcatttcttaccttaagtcaatgggcatctccagtatcatggtgaccggtgataattgggctaccgcaaaatcaattgcaaaggaagttgggatcagccaggtgtttgccgagatcgacccagtgggaaaagctgaaaagatcaaagacttgcagatgcaagggttgacggtggcaatggttggcgatggggtaaacgactccccagcattggcggcggcagacgtgggcatggcgatcggtgctggcacagacgtggccatcgaggctgctgacatcgttctaatgaagagcaaccttgaggacgtcatcaccgccattgatctctcgcgcaagaccctctccaggatccggctgaactacgtgtgggccctgggctacaacgtcctgggcatgccgatcgccgccggcgtcctgttccctttcacgggcatccggctgcccccttggctcgccggggcatgcatggctgcctcgtcggtgagcgtcgtctgctcctccctgctcctccagctctacaagaaaccgctgcacgttgaagacgcgcccaggcccagggaggactcagatttggtgtgactgcgagtgaggactgatccctcgatctcgatgtgtactaacgagagcttgctggcgtcactgatgcttaacgagccaacacctgatcgatccgtgtacagcaagcaacacgttttggaacagttcgccaattgattgtgcaataattcaagacaaggtttataactttatatgatactagtacaatgacagcacataatcatagattttttttcggaaattacaagaaaacatttgctcttttgcc

SEQ ID NO: 19219 - DNA, 2396 bp, Zea mays
  misc_feature (4)..(4): n is a, c, g, or t
  misc_feature (13)..(13): n is a, c, g, or t
  misc_feature (21)..(24): n is a, c, g, or t
  misc_feature (32)..(32): n is a, c, g, or t
  misc_feature (38)..(38): n is a, c, g, or t
  misc_feature (42)..(42): n is a, c, g, or t
  misc_feature (48)..(51): n is a, c, g, or t
  misc_feature (54)..(67): n is a, c, g, or t
  misc_feature (83)..(94): n is a, c, g, or t
cccnccccccggncccccccnnnnccccgggncccccncccncccccnnnnggnnnnnnnnnnnnnncccccccccccccccnnnnnnnnnnnnggctgaggtatccaccaattgtaaatttaagccctccagtttttaaaaatttcaacccccccggatgccattatacctattccttccatgaggcttagttttatggtagttctttacaagttggtacttttaaggtatgatcattctttttgggtaataagtaggatatgaagcataaggtttaaatatatttgtgtgggtaagacttgttttgactgaaacaaacctgatgtctaaatttgcttatgtcaatgtttattatagaaacttgacctaaggagggttaagaccgcccccacggcattacaattaagaaagacctcatgcagatcgagaaaaaccccgaacctccgtccccaccatatacaaccggtatcgtagccccatgtgagaacggtcgcgggccacggcccccgccggaccaaaatcctcctaattcaccaattttagaattcccattctcattttctctctctttctatttctccaaatttgcctaaagattttacattttatcttcaatccttccttgatttacgtttgaaatatttcgacccaaaactatactgatggagagaacaaacagcattgagatggatcgagagagattaacggcggagatggcgtttcgagattcatcatcggccgttataagaattcgaagacgtttgccggatttattaacgtccgttaagctcaaatacgtgaagcttggacttcacaactcttgcaacgtgaccaccattctcttcttcttaattattcttcctttaaccagaaccgtgctggttcagctaaccggtctaacgttcgatacgttctctgagctttggtctaaccaggcggttcaactcgacacggcgacgagacttacctgcttggttttcctctccttcgttttgaccctctacgtggctaaccggtctaaaccggtttacctagtggatttctcctgctacaaaccggaagacgagcgtaaaatatcagtagattcgttcttgacgatgactgaggaaaatggatcattcaccgatgacacggttcagttccagcaaagaatctcgaaccgggccggtttgggagacgagacgtatctgccacgtggcataacttcaacgcccccgaagctaaatatgtcagaggcacgtgccgaagctgaagccgttatgtttggagccttagattccctcttcgagaaaaccggaattaaaccggccgaagtcggaatcttgatagtaaactgcagcttattcaatccgacgccgtctctatcagcgatgatcgtgaaccattacaagatgagagaagacatcaaaagttacaacctcgggaggaatgggttgctccgccggattaatctcaatcgatctcgctaacaatctcctcaaagcaaaccctaattcttacgctgtcgtggtaagcacggaaaacataaccctaaactggtacttcggaaatgaccggtcaatgctcctctgcaactgcatcttccgaatgggcggagctgcgattctcctctctaaccgccgtcaagaccggaaggaagtcaaagtactcgctggtcaacgtcgttcgaacacataaaggatcagacgacaagaactacaattgcgtgtaccagaaggaagacgagagaggaacaatcggtgtctctttagctagagagctcatgtctgtcgccggagacgctctgaaaacaaacatcacgactttaggaccgatggttcttccattgtcagagcagttgatgttcttgatttccttggtcaaaaggaagatgttcaagttaaaagttaaaccgtatattccggatttcaagctagctttcgagcatttctgtattcacgcaggaggtagagcggttctagacgaagtgcagaagaatcttgatctcaaagattggcacatggaaccttctagaatgactttgcacagatttggtaacacttcgagtagctcgctttggtatgagatggcttataccgaagctaagggtcgggttaaagctggtgaccgactttggcagattgcgtttggatcgggtttcaagtgtaatagtgcggtttggaaagcgttacgaccggtttcgacggaggagatgaccggtaatgcttgggctggttcgattgatcaatatccggttaaagttgtgcaatgattggttgaaccggataatcatatatgtaattgtgttcttcttgattttattttttaattgttgatgtaagttgtcgattgaaaatcatataatttaattaatttaaaaaaaaaaaaaaaaaaaactcgagggggggcccggtac

SEQ ID NO: 19220 - DNA, 2412 bp, Zea mays
cgcctttgccacattccaaactgcaaaaattgctggatgcggctctgtcccatgtcgaacaaactgattctatatagaacgatgcggcgatccaaacagactgtcctacttactaagcaaaacaaattgatcaatgattacttgactgccaaacgagcactatgaacacataccagaataagctaaattgtactgatgcacaagatacataaaaagtcgttgcgttttagtagattgctaaccatggttgtgctctccacgtgtcattgatatattcttataatttcttcacttgtgtttttagttagttgttcatctatgcctagatttgctttggttctgttcttgtcatagctgaattcacgtgtattgaagtggactgtggtgtaacttaaaataatttacatctcaatccatctggattagagtaatctgcaaacaaaacattcagaatatttgatctaatgaacagccagttcagcctctcgccattccctttcccacgccgaggaatccgcaggcgcaggcacgcgcgagcggcgtgcacctccgcgcgatacggaactcataaatcttgcgtggccacccagccccagcggggtagtagctagcgcgccgtcagtgcgatccatcgtgaccgggtgctcgcgccttgtttaagcgacgaaccccacgcgccggcggcgtgaacgcacagtgataatacatgcatgtcgcgcgcaacgcagccacccagcaagcgcacgagcgctgcgcccgtcgcggcggtggcagcggcaggcccggcccacgcgcagggggaggagacgtcgctctgggggtccggggcgccgtgcggcgcgtgcaagttcctgcggcggcgatgcgtgccggggtgtgtcttcgcgccgcactttggcggcagcggcgggggcggggccggcgcggcgcagttcgcggccgtgcacaaggtgttcggcgccagcaatgtggcgaagatgctgtcgcaggtgcccttggcgctgtgccgggacgcggccagcaccgtctgctacgaggcgcaggcgcgcatcgccgatcccgtctacggctgcgtcggtaccatccttgcgctccagcacccaggttaatgttaccacgataccacgcatgttggcacacccaaaataacgccttctccacctgctcagttaatttgctttgcgtgctcaatattcactcataatcgctgcttacgattagtttcatggccatatttttagatgaaagtttcaaggttataattagtccaagacgacgttatatggccctaataattttaagtattattgatgtcttaacaaatttaaaaggcggaattcaaacaagtagcatagttcatatctaaacagtggtcaccaatctacttgtgcattctcactggcaacctgtttcttgtttaaagaaaaaaaaaacggtagtccattgatcttcgttctaaacagagctctgtcaacaacaggtagcactcgtccaagccgagctcaccactgcgcaaaccgagctcctcaaccgcaggatggccttggcaacggtccatccggcgtactccgttgtgtcgcccacgagccaaatggtgaactgtagcgctctttcacagaccctggatttcatagacacggagccaaaatgcttgccgttgccccctcctctcctaccatcgcagcaacagcggggagaagaacatgagaggggcagtccaacggatgttttcgcgcacatccccgagaaatagaagttctcgtaactgcatcatgttatttttcatgtatattttaagttttgttgatttaataatagttcttaacaaacaacaactacaatgccaccaattataacctctttgcgattccgccgacatgcttgatacatacgtatcaacatgtcgtaatggcttttgggtacatgggaattgactctctttagcaagtatctgtcttcaacaacgctctctatattcatcatctatatctgttatttaaaaaaaagaaaaaaaaaaaaaaaactttatatcttctttatctctaacattctctatatctcgtcattttatacataaataccgatattagagacataatttacttttaatttttgtacatacgtatttgtcatactctcaaatatattatacatattttagttttgctaaatctattgtttaaagtatgaaaatagatagagtaaaggagagagaaactatatatagaggattcaacagcgtcacctaaatttaggagaccgtttagacaacgttgttggatacgtagaggacgaccctatactctaaatttagggtatataaccctttagaggtccttgttggacttagactaaggtctgatactatatatttagaggttcgtgagctcctgtgtccatccaacaataaac

SEQ ID NO: 19221 - DNA, 529 bp, Zea mays
tctcttcctctcactggcaggctcctttcccttcagctcctgagagaaggtccgcagcaggcccataagatgctcgttcctgtgagctgtgagtatgacatcatccatcctgacggatttgcgaccggcatgctgtgcaaacaactctgcatcctttgctagctgctctgcgctcttgaacgccaagtcggcgatgcaggaaacaacggggtcggcgaccgtcattccggccttctttccttcggcggtggcgatgctgatgacggcgaggcggaatcggtcgcggaggatgtcggcctcggcttcggcggcctcgtaccgctccacctcagcctcggcctcggcggcttcgttgcgctcggcctcgccgccgctgtcgccggcgagcgtctccatatccatgtctaggtcgaggtccaggtccgggtccatggtccagccgcggagcttccacgagacacacgagcagcagcgaaggcggctggagcggtgtttgccgttgtggcgaacaggagaaatttgcgatggt

SEQ ID NO: 19222 - DNA, 1794 bp, Zea mays
cattggggccctcgaggccgcccgggtccgcccgcaaagccacgcacgcggcgcttgtcctgcgcggcgcacggaacccacctccaccgcggcaccccgtgcgtcggctgcttgctgccccagtgccgcccccgcgttcccttcgctcccgccgacaccgacgccgccactgccaccgccggcatggcgaccccgctccgcgccaccgcggtcctcgcgtggggttccggggaggacgggcagctgggcatgggcgggaacgaggagaaggactggccccacttcgttgaggcgctggggccctacgccgtcgccgccgtcgtagccggcagccgcaactccctcgccatctgcgacgacggccgcctcttcacatggggatggaaccagcgcggcacgctcgggcacccaccggagaccaagacggagagctcccctggccccgtcgacgctctcgcgggtttcaagatcgtccaggcggcgattggcgggtggcattgcctcgcagttgacgacaaggggcgcgcctacgcctggggtggaaacgagtacgggcagtgtggtgaggagcctgagaggaaggaggacgggacgagggcgctcaggagggacatcccgatcccgcagcggtgcgcgctcaagctcaaagtccggcaagtagccgctggagggacacattcagtagttttgactcaagaaggtcacgtctggacatggggacagccatggcctccgggtgatatcaagcaaatatctacacctgtacgtgtgcaaggccttgagaaagtgagggtcattgctgtaggtgcattccataatttggcactaacggaggatgtaattttgtgggcatggggtaataatgagtatggtcagctggggactggagatacccaaccaagatcacaaccgatacgtgtcgaagggctatctgatctctcactggttgacattgctgctggaggctggcattcaactgcactaactatagatggagaggtgtatgcttgggggagaggagagcacgggaggcttggatttggagatgataagagtagtcacatggtgcccctaaaggttgagcttctagctggagaggatattgttcaggtatcatgtggaggaacacattcagttgcgctagctcgagatggccgaatgttttcttacgggaggggcgaccatggccgtctaggctacggcaggaaggtgacgacgggccaccccatggaattgcccatcaacctgccgccgctcagcagcagccgcgacggtcggtggcaggcgaaatacgtggcttgtggcgggcggcacaccctcgctattgcggagtggacagaggccactgattgatcacgtaggtagtgctcgacttcctgagtcctgatctgcatgcaaatctgaggctgacaagcctgctataaaattgtagcgtttgtggaataagcacaaggccggtgccaacgggcgtaggtggggctgcagtcgatggcgctgccggccgccgcggtcggtacttaccagaagtagttcagtaccgactgccattgccatgtgtcgtcttttaattagttgatgtccaataaattcataagttttttttaaaaaagtctaagtaatctgaaaaggtatttatgaattatgtaacttttttactttttggtattatgtattttttatgttttatgagttatgtaaattttatttatgatttataaattacatactgtgtatttatattcatgaactatatacttttttatttgtttaaaaaaaaaaaaaaaaggcggccgc

SEQ ID NO: 19223 - DNA, 1663 bp, Zea mays
caaatcatagattcatagccacaaaagccacgcacgcggggcgcttgtcttgcgcgcacggaaacccacatccaccgcggcgccacaccgcgtgcgtcggctgcttgctgccccgtgttccttggctcccgccgacaccgagcgccgccactctcaccggccaccgccgccatggctgccccgccccgcgccaccgcggtcctcgcgtggggttccggggaggacgggcagcttggcatgggcgggaacgaggagaaggactgggcacactgcgtggaggcactcggttcctacgccgtcaccgccgtcgtagccggtagccgcaactccctcgccatctgcgaagacggccgcctcttcacttgggggtggaaccagcgcggcacgctcggggcacccgccgaagaccaagacggagagctcccctggccccgtccacgccctcgcgggtttgaagatcgtccaggcggcgattggtgggtggcattgccttgcagttgacgacaatgggcgcgcctacgcctgggggggaaacgagtacgggcagtgcggtgaggagcctgagaggaaggaggacgggacgagggcgctcaggagggacatcccgaccccacagcggtgcgcacccaagctcaaagtccggcaagtagctgctggagggacacattcagtggttttgactcaagaaggtcacgtttggacatggggacagccatggccgcctggtgatatcaagcaaatatcgacaccagtacgcgtgcaaggccttgagaaagtgagggtcattgctgtaggtgcattccataatttggcactcacagaggatggaattttgtgggcatggggtaataatgagtatggtcagctggggactggagatacccaaccaagatcacaccctatacgcgttgaaggactatctgatctctcactggttgacattgctgctggaggctggcattcaactgcactaactatacagggagaggtgtatgcttgggggagaggagaacacgggaggcttggatttggagatgataagagtagtcgcatggtccccctaaaggttgagcttctagctggagaggatattgttcaggtatcatgtggaggaacacattcagttgctctaactcgagatggccgaatgttttcttacgggaggggcgaccatggccgtctaggctacggcaggaaggtgacgacgggccaccccatgggattgcccatcaacctgccgccgctcagcagcagccgcgacggtcggtggcaggcgaaatacgtggcttgtggcgggcggcacaccctcgctattgcggagtggacagaggccactgattgatcacgtagcgtttgtggaataagcacaaggccggtgccaacgggcgtaggtggggctgcagtcgatggcgcttgccggccgccgcggtcgccgcggtccgtacttaccagaagtagttcagtaccgactgccattgccatgtgtcgtcttttaattagttgatgtccaataaattcataagttttttttaaaaaaggctaagtattctggaaaggtatttatggattatgaaccttttttactttttgggattatgaattttttatgccttaagaggtatgtaaattttatttatgatttataattacctaccggggattt

SEQ ID NO: 19224 - DNA, 1382 bp, Zea mays
ctggcgagtgccgacgcctggccgtatctctcatcgcctcttccccgctgggggcaaaagcacgcggcgacagaagcttccccgtttcccacgtcctcgcaaataccgcgaagatgggataggaccacgcgtgcggccacgctgtcgatcacagccgctagcggccagggtcggcgtgagaaaccatggggtttcccctattcgccgtgatccaaacgtgcggaaaggggaggccaatccgccggcaacctttcggtcgctccttctttttattcttctatttaaccctgccccacgcgtctcgcggaagcaaagcacaccagctcatttgcttcgcccgttcgccgtgcgtgcgtcgtcaaccaaagactcgtttccttctttgtgctcctgttcgttccttccttccctggaacccttcccccgtaagctcgccgctgcgctgcgttcggatggcagttggaggcggcgtgtgtgtggcgtcgccctcgccgtcgtcggtcgaggcgtggtcgtggaggacgagcggggcgcggcgccgcgcggccgttaggtgcagcgtcgttggcgaggccgggccgggcgccgccggcgggcgggtggaggacccctaccggacgctgcgtctgcgccggggggccacccgcggcgaggtcaagaaggccttccgccgcctcgcgctcatggtgcgtccgcgagcgcaacccctccctcacccagctaattctaacgggtgtcgtcgattcctctgacgggttgctttgcgtcgtgctcgtgcagtaccatccggacgttcgcaaggagagggagagggagatggaatgcgacggcgacagcggcgtccagttccagaggattaacgtggcgtatcagaggctgatgagcagcatgagggaggccgacgagcggctggagtactggcgcctcaagtacggcctcgccgacgaggatctggacaggtacaggcgccgcctcaacgaggaagacgccgacgactggttcgacatgtgaagaggaagcgaaggaactgaaagcagccggtcgatggataagggtctattattacatggccctgtttatccgcatggacccgattaattccggttgccatggcagcggcacccactctagtttttggctgcatgtgtatagactctgaatacttctcccctgttttatagtgggtgtagggataccgttaggctaaatggtatgtttggttcagtcgtgagttatcaattgtgagttatctgtaaaaataactgctgtgataaaaaaaaactaaaaattgtttgattcgaacggatgtcacttgtacaccataaataaattgtatattatttataagtactttgtttaaaaaaaaaaaaaaaaaagtccac

SEQ ID NO: 19225 - DNA, 993 bp, Zea mays
aaacgggctgcgtgcacggacatctcgcccttgtcgcggcgtcgtgcaccccagtaggccggttgtgtcgatctgtggagaggagatacatcacgttacgatccccaacttaacgccgaccggaggccggagagaccggctcagcctcgctccgccgccgccggcgaccatgtccctggcggctatcttcgtcttcctcctcgtgtccgcgctgcagctgctcgaccgctacctcgacctcgccagaaagagcggaggacttagtgatgagcagatcaaagtgcggcttgaaatcaagcaacttctcaaggaggctgatcagttgtcaacgccgtccacatttgcacaagctgctaaactcaagcgcctggctgctgccaaggagaaggaactggcaaaaatgcaggaacatgaccttaaagggaagcaatccttatacgacaaatacacaaaatttttgtcggttactaaggtcataatttatgctgtgctcgttctgtgcttttggagtactcctgtaactgcagttccacaacatcttctacagcccttcggaaaaatgttttcctggagatgtgttgatactgccaccggcaatgttgtggttggaatactcccgtggctgtttttgacctctcgggtcagcaagatgctgtgccagaaactgggcttcgtgcttgtgcgtccgtagcgcctttccatgagaaagtcagcaagttgctgcacctaaacaagactgctaactttgttcttcttctatatctttttataatcaactgtttcacttattgtccactatatactctgtccgttcttttttaattgtcgtgttttagtttaaaaattagcgggcgataaatattcgagaacggacttgtagtcatataaatttgctgtgctatgtgctcaagcggatacgtgtataagttactagtagccgtgaatgaaaaaaaaaaaaaaaaaaaaaaaaaaaaaaaaaaggcccctagggcc

SEQ ID NO: 19226 - DNA, 946 bp, Zea mays
gcacgagcggacatctcacccttgtcgcggcgtcggcctcccgcgggggccggctcccgcgttccggggagacgagacacgtcacgttacgatccccaacttaacgccgaccggaggccggagagaccggctcagcctcgctccgccgccgctggcgaacatgtccatggcggctatcttcgtcttcctcatcgtgtccgcgctgcagctgctcgatcgctacctcgacctcgccagaaagagcggaggacttagtgatgagcagatcaaagtgcggcttgaaatcaagcaacttctcaaggaggctgatcagttgtcaacgccgtccacatttgcacaagctgctaaactcaagcgcctggctgctgccaaggagaaggaactggcaaaaatgcaggaacatgaccttaaagggaagcaatccttatacgacaaatacacaaaatttttgttggttactaaggtcataatttatgctgtgctcgttctgtgcttttggagtactcctgtaactgcagttccacaacatcttctacagcccttcggaaaaatgttttcctggagaggtgttgatactgccaccggcaatgttgtggttggaatactcccgtggctgtttttgacctctcgggtcagcaagatgctgtgccagaaactcggcttcgtgcttgtgcgtccgtagcgcctttccatgagaaagtcagcaagttgctgcacctaaacaagactgctagctttgttcttctatatctttttataatcaactgtttcacttattgtcctctatatactctatccgttcttttttatttgtcacgttttagtttaaaaattagtggacgacaaatattaacggaggtttatgcatatgaatatatgatatgaatttgctctgctaaaaaaaaaaaataagagcccccgcaaaaaaaaaaaaaaaaaaaaaaaa

SEQ ID NO: 19227 - DNA, 1069 bp, Zea mays
cattggtacctcgagccggcgggttttgtgattggtgcgtccacacgagagtttacggcggcccaaaccccccaaatccagttccatcccaatcgccgagaaggggaagccaaatcgatggcggcggcggcggccggcggcgagaacagcggcgcgggcgcgggcgcgggcgagggcgagttctacctgcggtactacgtggggcacaagggcaagttcgggcacgagttcctcgagttcgagttccgccccgacggcaagctccgctacgccaacaactccaactacaagaacgacaccatgatccgcaaggaggtcttcgtctccccctccgtcctccgcgaggccaggaggatcatccaggagtccgatatcatgaaggaggacgacagcaactggcctgagcccgaccgcatcggccgacaggagctcgagatcgtcatgggcaacgaacacatttcattcaccacttccaagatcggctccctcgtcgatgtccagtccagcaaggacccggagggactccggatcttctactacctcgtccaggatctgaagtgcttcgtgttttcactcatcaacctccacttcaagatcaagccaatccagtcttgagctccatctcaagccttcatgcgactgttttggagtgttttaagagagaaccttgtaccatgttaagatgatgttgagcttgtgacgatgcgcacggtagaagtggaacctttttttttttttgcggttggattgtgcaaactgcgagcagtagtgagtgtggtatatttgtgccttcagtttcctgttgggtggagtgttcttgtcgtttggcacggcacactagtattcttctctgttatcagcgctctgttgaaggatggaatggatatccagattgtctgggacttgtggtgatgcagatccagccagtaactagtatgaatttctctagtggggttgttgggctgctaaaaaccgccggactgagcaaaggaaccttgcgtctttgtgtaaagcagcagtcgaatctgtgtgtgtgtgtttgtgattaaagtcgtcattcggtcctgac

SEQ ID NO: 19228 - DNA, 1005 bp, Zea mays
gccggccgtgatggatatttgcagattactctacacgagtcacgataggaggaagactggaagaggaggcgagcacgtttgcggtgcccaccctcaccgtccactccagaaccccaaatccagttccgttccaatcgccgagaagggcagcaaaggggagaaaaaaaaaggaaatctatggcggcggccggcggcgagaacagcggcgctggcgagggcgagggcgagttctacctgcgctactacgtgggacacaagggcaagttcgggcacgagttcctcgagttcgagttccgccccgacggcaagctccgctacgccaacaactccaactacaagaacgacaccatgatccgcaaggaggtcttcgtctcgccctccgtcctccgcgaggccaggaggatcatccaggagtccgacatcatgaaggaggacgacagcaactggcccgagcccgaccgcatcggccgccaggagctcgagatcgtcatgggcaacgagcacatttcattcaccacttccaagatcggctccctcgtcgatgtccagtccagcaaggacccggagggcctccggatcttctactaccttgtccaggatctgaagtgtttcgtgttctcgctcatcaaccttcacttcaagatcaagccaatccagtcttgagctccatcccaagccttcatgtagctggtttgtgagactgcgagtgttttgagagagaaccttttaaccatgtaagatgatgttgatattgtggacgatgcgtgcgatcggccctgtgtggtgcacttagtggaagtggaacccccctttgcatttgttttgtgcaaactgctgagtagtagtgaacgtgatatttgtgcctttttattccttccagattttttttgttgggtggggattcgttgggcacactattccgtttggacactatttctctctggttgtcatcagtgctctgctgaaggagcacatcatagtaaatatggatatgggttgcccggg

SEQ ID NO: 19229 - DNA, 1089 bp, Zea mays
gttcgatcggtttttgcagattggtgcgtccacacgagagtttacggcggcccaaaccccccaaatccagttccatcccaatcgccgagaaggggaagccaaatcgatggcggcggcggcggccggcggcgagaacagcggcgcgggcgcgggcgcgggcgagggcgagttctacctgcggtactacgtggggcacaagggcaagttcgggcacgagttcctcgagttcgagttccgccccgacggcaagctccgctacgccaacaactccaactacaagaacgacaccatgatccgcaaggaggtcttcgtatccccctccgtcctccgcgaggccaggaggatcatccaggagtccgatatcatgaaggaggacgacagcaactggcccgagcccgaccgcatcggccgacaggagctcgagatcgtcatgggcaacgagcacatttcattcaccacttccaagatcggctccctcgtcgatgtccagtccagcaaggacccggagggactccggatcttctactacctcgtccaggatctgaagtgcttcgtgttttcactcatcaacctccacttcaagatcaagccaatccagtcttgagctccatctcaagccttcatgcgactgtttttggagcgttttaagagagaaccttgtaccatgttaagatactgttgagcttgtgacgatgcgcacggtagaagaggaacctttttttttttgcggttggattgtgcaaactgcgagcagtagtgagtgtggtatatttgtgccttcagtttcctgttgggtggagtgttcttgtcgtttggcacggcacactagtattatcagcgctctgttgaaggatggatcggaatggatgcccagatagtctgggacttgtggtgatgcagatccagccagtaactagtatgaatttctttagtggggttgttgggctgctaaaaaccgccggactgagcaaaggaaccttgcgtctttgtgtaaagcagcagtcgaatctgtgtgtgtttgtgattaaagtcgtcattcggtccaaaaaaaggatacattgttatttttaaaacgttataaaatatttt

SEQ ID NO: 19230 - DNA, 6999 bp, Zea mays
gcggtccagatcgatcggtatttgcagattggtgcgtccacacgagagtttacggcggcccaaaccccccaaatccagttccatcccaatcgccgagaaggggaagccaaatcgatggcggcggcggcggccggcggcgagaacagcggcgcgggcgcgggcgcgggcgagggcgagttctacctgcggtactacgtggggcacaagggcaagttcgggcacgagttcctcgagttcgagttccgccccgacggcaagctccgctacgccaacaactccaactacaagaacgacaccatgatccgcaaggaggtcttcgtctccccctccgtcctccgcgaggccaggaggatcatccaggagtccgatatcatgaaggaggacgacagcaactggcctgagcccgaccgcatcggccgacaggagctcgagatcgtcatgggcaacgaacacatttcattcaccacttccaagatcggctccctcgtcgatgtccagtccagcaaggacccggagggactccggatcttctactacctcgtccaggatctgaagtgcttcgtgttttcactcatcaccgacactgtttgttcaccggcaaataacctctacctatgacgcattgataacaagtacacgagccataggatagaatttctctacatccaggacaacaagcagctaagaacatgctcgtttgttactgttgtgcactttatactactggtaactttcagaactagtatggccttgatgttagattgtcgcttagccagacattggttcgtattcaccacagactggggatccttctgatggctctgccatggttaaattgaattgtttagctgctgaggctagatgcagatagcatagcaggcaacatttgttcatgttttttaagcaacgctgacctgtgggcaccagaggaatatttaaattaggtttaattaccttgagttgaggtgaggtgatcgagtttctttggaggagaaagaagttacttatctgccctaggacaactgattttatactaaagctgatgaaaactgcacaatgtaaatgttcaacaagaaaagggtcgcccctctgaggtgaactgtttcttgacaacatttagttccatatggcccattgttctgtactcatcaaatctgataaaaaaaatttcccttgttggagttttagcagaaacatgtgtcatttttttgaaaaaggatcgttattttctgagtgtttttttacatgtcatactcaacagttcgaaaactgccgtatctatattatcatgtgtgtgttctttccacacggagggtggagagcattttgggaacactattatacgtctatacctgtcatatatttgctcgtcaacataatctgaacagtatcacatcgtcttgcatccaagagctttatagcacccccccgggaagtgggaaaagtatggaaaatcgttttatgtctggcactacctttcttctagaaacttagccagttgtctactttacaggtacagcctaacgatcgacttggatgtcaaagcatgatttcttttgttgtaagctcgtagttggttaagtattgttacatgtcaatacttctatctgaggaaataattttcatctaatataaacagctagtggttcaattggtttgttacatctacaatttgccagtacgtgtgctcattgaatctgataaaaaaattgttatgtgaaggctcattaccctttctttttcttataagccccttggagtttcagcagcaaaatgtatccctttgaatctgataaaaaattgttacatctacaatttgccagtacgtgtgctcattgaatctgataaaaaatttgttatgtgaaggctcattaccctttctttttcttataagccccttggagtttcagcagcaaaatgtatccctttacttttcaatagttgaaaaatatgttgtaactatattatcttgtgtttttttcgatgactcgtggttgtggtggggtggggaacactttactatacctgacatatatatgctcttcatcatcaatcaacataacaatatcccacaatttcacttcctggggggtgggggcatctaaagttcaaaccagatgcaggaaaactgtatgggcaatggttttacgtttattctagtactacctttcttcaagaaacttagcactttaaaacctaccaatcgacatagatgtcacagcatggtttcttttattgtaaataagtagagttgatggatgattgctgtttgttggaaacgtagtcaggtgtcatggtttttacacagtagatctgattgagcttatgtaggccaagcataatacatgtcaatacttaagaaacagctattggttcagtacttcagttggttgtttctgaaactagaaatgttcttttttagtgatcaggagcggttgcccctactgtaataaacgtagataaaaaaagatagcagaatacaaaagcagagtttaataaatgtaaaaagaaacaaagaaaaaataatgctattagaaaaaatagttagtacagaaaaaaaactcgacctgcgagggtaagacaacacccggttattatattaagaaaaataccttcttacacaggtcaagaaaacctctgaatccctgcctcaaccatacgcagcggcacgacaccgtaacccatgtgagaacacgaccgcgaccgggccttagacttgtgctttgatgtgggacagatgaggaggatttttttaaccatattctgaaattcgcttccatggggagttgaactcaagacctgaggagtactactcagaccacctaaccaacttggctagaggccctttcgctagttagtacagataaaaggtacctccagatatgcctccgttgatgatcattttattttttatagttacgtgcagtcttaatttggtccctgttttcaaattgaccaatgcatccttctagcgtagatgtgactacgtgaatatgtccttagacctatgctgtgctaagcttagtgaatcatgttagtttacgagtacatcataagctgggattggatcatggtctggggcttcaaacattggtccaagggcctgggatgagttggatagctgctcctgactgtttggctcaaattcttctgaaagcttgtactttattgtaaggaagaagaaaaaaaacttgtattcctgtcatgcacaggacatgtcacggtaaatgagatgtctccctaacgtccacgcttgatgctgttctggtgcaggatctgaagtgcttcgtgttttcactcatcaacctccacttcaagatcaagccaatccagtcttgagctccatctcaagccttcatgcgactgttttggagtgttttaagagagaaccttgtaccatgttaagatgatgttgagcttgtgacgatgcgcacggtagaagtggaacctttttttttttttgcggttggattgtgcaaactgcgagcagtagtgagtgtggtatatttgtgccttcagtttcctgttgggtggagtgttcttgtcgtttggcacggcacactagtattcttctctgttatcagcgctctgttgaaggatggaatggatatccagattgtctgggacttgtggtgatgcagatccagccagtaactagtatgaatttctctagtggggttgttgggctgctaaaaaccgccggactgagcaaaggaaccttgcgtctttgtgtaaagcagcagtcgaatctgtgtgtgtgtgtttgtgattaaagtcgtcattcggtcctgactgcctgccgtgtgttgtctttaatctgatgcgcgctgtctgcttaatggaacagctgagctgaggtttttttatcagctgcgtcgggcatgctagctagcaggacaagcccatgttacctcattgcactattgctatcacatccaaagactagatggtccatacagatacagcagctctacatgcactggagttggatgagcagctgagccaaaagaaagcagccagtacaatacaaagcatgcgtccaggaaagaagatgctgagatacacctttcctctccatcccatctccatgtgatgcgatcccttcccttctttttgccagtgtcttttttcttcctcgtatgagctcctaccagccagtcttatcaatctttacagaggttttgttgaagggagtgtacatctttacagtgagctagctaggttctcttgtaccaagatccgttctctgcccaacataacaacagtactgtcaagtgcacggtactcgggttgttcaaagtcagcagacagattttccaaaattaaaacatgcagtaattgttggctagcttgtaccttgcttcttaggctgttgcccgacatagtcaagtgcacggctcctgcccatactcatctacacattcatgttaacacatatttcagtgatggagtcgttgccattcgttggacgacgctgctcatttttcttgtacatatgagtgaatatacatacacctaaggctttgtactctagtattcactccaatttacatatattgaggtggattaaagtatatattagtttggctgcactggtgtgttcagttgtttttcattgttgtggctgcagctctataactatgaaacactgtaacgtgaactaaagaagctgcatccgaattctttcaaaggttgtgacaatgcaatataggttgtcttgagcagccttcttatccaactctctatagcattctctatttcaaacttcactctataaaacagtatgcacgctctattggtcacgaggatactccctcctccgggcatcaataggtgaggaggttttgaggttgtttgaaattaattattccaatcatcatggctagaaataaacatttttgcacacattgattttttttacaattgaaaatagcatgggtgtaatggtgtatatttgtgtaaaaaacagtctcatatatagaactttatattttctgtgttataaacatataacatatatactagcaactaagtgcatacatatataagtagaagacagttgtgtttcagacacttcgtggatgtctataaaacaataaaacattcatgtatcaaaagtcaaaacatgagtcagttgtgacttgtgggtagaggggttctttgctctttcgtacgtgtcattacacgtaggataacgttcgttattagctgttacgcttacacgttgtaatatacattaaatatatatgcaatttctcaagccaagaaggtggtgagacatcgtcggcgtaggcgcgcggggcttcatcgtcgtcgaggatgcatcgggcgggaaggccagtagtgtgtgtgtctcaaccctcagctggagagcagcgcgatgatgtcgagcgagacggagcagagctggccgagcgtctcctccctggcggcgagctcggccgggtactgtccgggcctctggcggcggaacagcgtgcggcacacctgcgggtactcggcggcggcgctgacgtgcacggacgcggagtcgtagtcgtcgagcgcgatggagtccccggcggcggccagcgcgtcacgggcgctggcatacttggcggcgcaggtctggaggagcgcctgcacggcgctgtcggcggcggaggtggcggtccctgcgggggccgtgccgttcgccgccagcgccgcggcggtggccgcgccgcccgaggcgttggcggccgcggccgagaccgcgatggccgacaggccccgcacgtcggccgtcgcgctcgacgggtccgccgccagcgcggacacgcacagggcgtagtacgacgtggagttgcaggtggtgcgcaccagcgccgccgcgggtggtgggggtggtggtgttaacgatgatgatggagagcggcggcggcggcgggtgcttggccgacggtctgtggccgtggccgtggtcgtggccgtggccgtggccgtggcttttgtgcgcggccggcgggccagcgcgggaggagagtgcggctatagggaggactgccaggaggaggaggaggaggaggagcggggcgttattggtcgtcggtgtggttgctgccattattgcgtgcagctgcttgccaagagagcggagagatatgctggctgagctagtagcttagcttgtggttggtctttggctatgtgtgatgtgcttgtgaatggatttttcgattaggatgttctcggggttggtctcgtgcagatgagagcaattatatataactaaataatgttaggcgtgtcaatgctgagtagtggaggagtccatgcactatgcatgcatgcccgtttcttcgagacaaagacaatgcgaacaccatttcttcagtgcttagctagctaccatgcataggctctcgtcgttacacactagtagtaggctgttaggcagacaccaacctagaaagatagacgcgctctctctttgctagactttggcaacggcgatggagtttcttcttgtcacgacgacgatgatcccgcgtctgcatgcatgctggactatttttttaaaaaaaaagatggcgaacgatgagagatgaaagggggtgaagtgataaaataataagagtctaactaagttgtggccataaataaatacaacatgttggttacttagagatttttgttttggaatatgcgcactaacggcggcactgaaaagactagccaacttttggaaaagcagcaagctcaagttgctcttgacaagtagacatcattggtccttcttcttttaattcgttccgatgttttagggttttttctcaatcaaactagcatatgcttactaaatttatagaaaagatgccaacttttatatataccactaaataagtataaatcaaatgatatttttttttaaaaaaattactctatgtacctgagaaataaatagatctctagagttgtcttaagttaaaaaaaaaaaaaactttgatcgaacccagccaggatttatgacaccacata

SEQ ID NO: 19231 - DNA, 3156 bp, Zea mays
  misc_feature (65)..(65): n is a, c, g, or t
tgcgcagctgtaggttcagtcttttgctgctgcaaaatgaaattgttgcgagtttgtgcactgtngcctggcaacggattcgtattgatttgttatgtgaagaggcagatcagggatctcaatcgttttgaacgtgttattttccatcgttttccttttttgttcatgttgaatctatgctgcttgccatttctctattaaaataaaatcagatggaaaaccttagcatcaatcgacaagtctaaaagcttgcagtagagtagggctatttgaaatctttttgagtatcaactttgtggcacctgataaaagaaactcaagtgacattcagagacgagagagagagcctggatttccttcagctccaggatgaaccagggggcaaattgcaaagtcttggactgggataatagtcgcaatcccaactttgggtatattcgcaaactgtctcctccgttaggtcaagagacgtacggcccagattgatggatatttgcagattagtctacacgagtcacgataggaggaagactggaagaggaggcgagcacgtttgcggtgcccaccctcaccgtccactccaaaaccccaaatccagttccgttccaatcgccgagaagggcagcaaaggggagaaaaaaaaggaaaacgatggcggcggccggcggcgagaacagcggcgcgggcgagggcgagggcgagttttacctgcgctactacgtgggtcacaagggcaagttcgggcacgagttcctcgagttcgagttccgccccgacggcaagctccgctacgccaacaactccaactacaagaacgacaccatgatccgcaaggaggtcttcgtctcgccctccgtcctccgcgaggccaggaggatcatccaggagtccgacatcatgaaggaggacgacagcaactggcccgagcccgaccgcatcggccgccaggagctcgagatcgtcatgggcaacgagcacatttcatgtttgattggtttgtcggttgacccccctaccccggtcgcagatcatgaaggaggacgacagcaactggcccgagcccgaccgcatcggccgccaggagctcgagatcgtcatgggcaacgagcacatttcattcaccacttccaagatcggctccctcgtcgatgtccagtccagcaaggacccggagggcctccggatcttctactaccttgtccaggttccccctcaaccatgacaaatacagatattgtttgtttcctgtggccctccagaattttcatggttctaagctctacctgacaatgtattaataacaagcacatgatcagtatgatagatattttttccgtgtctgataacttgacgctagcactaaataccttgcttgtgtgcttgtgacttgtggggacacctggattctcaaattcaggacaacaaggaacaaaaattggcttctgacttgtgacaaaggaggacaagcaactgagaatatgcttgttcgttccgttgtgcagtttatactaccggtagctttcagaactattgtttgtgaccttgatgttagattgtaccttagccagacattggttcatattcaccagacttgggatccttctgatggttccatcatcttttttttttttgtgctgatcagttcttatgctgaacttatgcgcagcagagaaataatggttaaattgaattgattagctgctgaggctagttgatgatagtaggcatcattattttatacctgtgggcaccagaggaatatcaagtttaataattttagatgaacaagtttctttggaggagaaagatgttccttagctgttctaggataattgattttatatgaaactgaaaattactgtacaatataaatgctcaacaagaaaagagtcacctctcttaggcaaactgtttcttgtcaacatttaattccatacaacccattgttttgtgctcattaaatctgacaaaaaagatctttgttatgtgaacttgtgaagacacattagcatttcccttttaaagcttccttctggggtttagcagtaaaatgtgtcattttttctttctaaaaggatcttgcttttctaggttttttgtacatgtcatactcaatggttcagaaactgttgtatctatactgtcatgtttttttaggaacaatactatatgtgtcatatacatgctcttcatcaacataatctgaataatatcccacaatcatataaatgtgattatgcgaacatgttcttaaccctatgttgggctagcttagtgaatcatgttgatgttgggcttcccctacatcgtaaggtggaaaaaaactcgtacttctgtcgtgcacaggacatggcactgtaaatgagatgcactcctgacgtccacacttaatgcaggatctgaaggggtttcgtgttctcgctcatcaaccttcacttcaagatcaagccaatccagtcttgagctccatcccaagccttcatgtagctggtttgtgagactgcgagtgttttgagagagaaccttttaaccatgtaagatgatgttgatattgtggacgatgcgtgcgatcggccctgtgtggtgcacttagtggaagtggaacccccctttgcatttgttttgtgcaaactgctgagtagtagtgaacgtgatatttgtgccttttggttccttccagtttttttttgttgggtggggattcgtttgacacactattcttctctgtttgtcatcagtgctctgctgaaggaggcacatcatagtaaatatggatatggtttgcccgggacttgtggtgatccagatcccccatccaaattgccatcataaagttcacagggtggtaactactgtgagtttctctagtgggcctggctgctgcaatttccggactcaccaaaggtagtccaaggaacctttggtcttgtttccagcagcaagaagtgaagaatctgtgtgtttgtgattagggttctgcctgccagtggtgaccatccatagatgtggatgatgctatcctccaatggctttggggatcagggtttctcgtcctgtatgaggtttcatgagtacaatttgggaccaccatatgccgttgacctccacttttgtcctgtacctgcacaaacacgttcagtttgcacctctagttta

SEQ ID NO: 19232 - DNA, 5246 bp, Zea mays
  misc_feature (4478)..(4478): n is a, c, g, or t
  misc_feature (4484)..(4484): n is a, c, g, or t
  misc_feature (4564)..(4564): n is a, c, g, or t
gctaggatcacaaactctttattaaaagagcatattttgtttttaattttatcctactcttacttaccgtagcaatattaaaaatagcgtgatgaaactaccactgaaaatatatcctcatagtttttgaaattaaacgcatgcacacaaaaaaccacatgaaaatcaccatcatcgccactcgcgagtcacccacgagtccacgaccacgagccacaagcccacactcctacagaagatttggcttcgaaattctaaaatcgtggaacaacctcgagccagacggtgaccccactgcgcagtggccagcggagcattaattgcagcggttctccactcacctcacgaaaccagcaaccccagcagcaagcgcagcagacagcagtgcatctgcgccgcgaaccgccgctccagtccaatcaatggacggacacttcccatgatctcgtcgcccacctcctcttccgccgccgccgccgcggcaatgccgactccctcccgcctcctcttccccgtcctggtcctcctcgccgcgtcggccggggcggccacggccgccaccgtgagcgacgacgtgctcgcgctggtcgtcctcaagtcgggcctcttcgacccggcgggccgcctcgcgccctggtccgaggacgccgaccgcgcctgcgcctggccgggggtctcctgcgactcgcgcacgggccgcgtcgccgcgctcgacctccccgccgcgtcgctcgcgggccgcctcccgcgggccgcgctgctccgcctcgacgcgctcgtctcgctcgcgctcccggggaaccgcctctccggcacgctccctgacgcgctgccccctcgcctccgttctctcgacctctcgggcaacgcgatctcgggcggcatccccgcctcgctcgcgtcctgcgagtcgctcgtgtcgctcaacctctctcgcaatcggctcaccggcccggtccccgatggcatctggtcactgccgtcgctcaggtcggtggacctctccgggaacctgctctccgggagcgtacccggcgggttcccgcggagcagctcgctgcgtgaggtggacctgagccgcaacctgctccaaggggagataccggcggacatcggtgaagccgggctgcttaagtcccttgacctcgggcacaactcgttcaccggcgggctgcccgagtcgctgcgtgggctgtccgggctgagttttctcggcgctggtggcaatgacctatcagaggagctccagccgtggattggggaaatggcggcgctggagagactggatttgtctgccaaccgctttaccggcaccatcccggacgccatttcaggctgcaagaacctggtcgaggtcgacctcagccggaacgcgctcactggggagctcccatggtgggtgtttggggcacccctgcagcgcgtctccgtctctggaaatgcactgtcagggtgggtcaaggttccccgtgatgctgctgccaccctggaagccctggacctttcagccaatgctttcactggtgtgatcccgcctgagatttccacccttgcaagattgcagtacctgaatttgtcctcaaattccatgtcggggcagcttcctgcaagcattgggctgatgctgatgcttgaggtgttggacgtgagtgctaacaagttggatggggttgtgccactggagatcggaggtgccgttgcgctccgacagctgctgatgggtaggaattcacttactggatggattccggtgcagattggcacatgcaaatccttgattgctttgtaagtgatccttttctctggcattacccagttcctagtgcatgtgcatgcatgcttttattggttgactagatgactactagttccatttgttttttctcttgttagtttttactagttctctgcttcctaggttgcaggtgtcacttagaaagcgatagatatgtcttatttgctgtttggaagcactaaaccgaaaacatgggtggcatctttgtcttgctgctttgctcgtatcccactgtcagattccgtgtttctcttggatacactaaaaaacacgagtcaaattctgcacggattttattgctgattaaaaaaaaactattgcaacaaacaaggcgaagcacttctgtcgattgctaggcactaattcaggtgataggttatttaattctcttctttctttgcagggatctatcacacaacaaacttgcaggatcaattcctatatccatgggtaatcttactagtcttcaaacagttgatctctcagataacttgctgaacggcagcttaccgatggagctctcaaaacttgacagcctgcgtttcttcaatgtctctcacaattcgctgtcagggagccttcccaatagtcgcttctttgacagcatcccttattctttcctctccgataatgctggcctttgcagttcacagaagaacagttcctgcaatggtgtcatgccaaagccaattgttttcaaccctaattcttcgtcagacccctggatggatgttgccccaagttccccaagcaaccggcaccagaggaagatgatattgagcatctcaacactcatcgcaattgtgggtggagcagttattgttatcggtgtggtcaccataacagtgctcaacctccgtgcccatgcaacagcttcccgctctgcacttcccacttcattgtcagatgattatcatagccaatcagctgaatctccagaaaatgaggccaagtctgggaagctagtcatgtttggcagaggcagctcggattttagtgctgatgggcatgcgttgttgaataaggattgtgaacttgggcgtggaggctttggtactgtttacaaggcagtgctcagagatggccagccagtggccatcaagaagctgacagtttcaagtatggtcaagtcagagcatgacttcaagcagcacgtcaagcttctaggcaaggtgcggcaccataacattgtcaccctcaaaggcttctactggacttcctcactgcagctccttatatatgaattcattcctgctgggagtttgcatcagcacctccatgagtgctcatacgagagctcgctttcatgggtggagaggtttgacataatcgttggcgtggcccgcgcacttgtgcacttgcatcgctacggtataatccactacaatctgaagtccagcaatgtcttgctagacacgaatggtgagcccagggttggtgattatggtcttgtgaacctgctgccgatgctggatcgctatgtgctcagcagtaagatccagagcgtgctgggatacatggcacctgagttcacttgcacaacggtcaaggtcacggagaagtgcgacatatacagcttcggagtgctagtccttgagattttgtcaggcagaaggcccgtagaatatctggaagatagtgtggttgtgctttctgatcttgtcagtgatgcactcgatgatgacaggctggaggactgcatggatccacggctatcaggtgagttctcgatggtggaggccacactgatcatcaagctgggcctggtctgtgcatctcaggtgccttctcaacgaccggaccatggctgaggtggtcagtatgcttgagatggtgaggagtcctcagggtaccccagaggatgatctggtttgagatccatttaccggagtttctcccttttctcattccttttttccattcgtctttgggtagatacatgttgaggagatggggaaagtgcggtccgaaagtatgttaggtctttgactagtgagtctagtttggttgcaatatttaggcacttctctatctcaggtgtctgaatttttagttgattttagggaacactcttgaataaccaactagtataagaaaattattgtttttatgatttgtgatttttctttgtatcgtaacaaattcaatttttatacttgcctgcctatagaaatgattgttagttatctttatatcaacacatatcatattttgtcggatttatggttttgtctaacaattttttttattctagagataaaaaaactgcaggtcgtgtttatataaattgcaacgaactaaatctataatatatatatatattataaaataaatgtaatgaaaactaacatagtctgataggcatcagaattttagcgagtcatgtaaagctgttgcctctctagttctattaatttattggtcgttggcccttttgcccgtgagaagtatgtacatgaagcatcagcggggttaatccagttttcgtctttacatgaaggtatgtgtattcgttttcggagccattttcgccaatgccctggcacttcacatctcttcatatcttgctgagattcagtacatatgcggcctgtgccctgcccactgccagagtgctcgacccatcgaccgggtccagttggctgtctggtaagacactaggcagtaggcacgtcgggagttnggccancgtggagtgctgtcgtggagtgcggactctcatacacatttgtacattcattaattatactaggtgactgcccgtgcgtngcaacggaaacatataatgttataataacttatgtacaaatgtatgttatattatgaacgcctactttgctctcttatagagtaataaagacttcacctttggatctttacctttggcttaatggagagttttacagggaccgacatgcaaaacctaaagccatatccgcttaaaaaagctagggatccgtgaatagtgtacatgtcaaaacaaaagaaagaacaaaaaaaactgcacacgacgtcaatcactctcactgcctctttccaccctgctgtagattgccctttctgtcgatatatacccaacataggatgttgcgactgattggtttcccgatctgcacacacacgagcacgcgcccggacggttcgctcgctccccacctccacacccgccgctctccacagtgctgctgtcgaggcgtctttctccgatcgtatgtgccgagctcctcctgcctgcagtctgcctcaccttctgttttgcttacacttgaatagccaccttctgcttcgcgccatgcatatatcttctcttgcggtggctttattgtacatcatgcgggccttcttgcgtggatgctcctctcttggctagttgtttgtttcttgcagaggaatgtattgctgctcagtgcttcactaccaacaacattgggtctctggcaacgacatagta

SEQ ID NO: 19233 - DNA, 2212 bp, Zea mays
tggcacacatagtagaccaagtagtaacttaagaagtcacagatatacttttgttaggctcatgaaaatttagattttgtttgtttcgtaagcttttctgaatacttatgtaaatcctacatcacgttactatctaagaagcttaggttatctggagttgaacctttggtacttgtttggaaatgtttgtgccgaaggtggttcattgctctttaatttgtaggtttcacatgctgtccgagtttgacgaggaaaaaagaagttgccggaagcgtctggatggccataataggcgtcgaagaaagccacagcatgatctgacaaatctagggggtttctttccataccaccaaggtatttacatttgaggttacatatgttgatggacttgatgccttggtattctgataatcatataatccagtttcgatagagcatcaaagttactatatgtttatcttttattgagtgatggatcaaattgtcaatgatagcagaaatccacatctgttagattgtctaatcagcttttttaggtgagcaggcgcttatcttcaatattttctgtaaactgttccttcttggttgtttgattgacaagtccaatagttctcatttctgatgtaatagattgattttctgagcaagctttacccagtttgcatatagggaaacaacgaagtagatgacagatatttttttttaatcgtcctgcagtgaatcagtttgagttctacccacaaacaattccaacagttggccagaattcggacgccgtgcacttggtgggccgtcagcagcctttctccatatcgttctcaagaacaccagacgagttccctttcccacagggtggcggtagcagtgtgctgcaccacctccatgcagcccgccctggccatcacgctgaaggcagcagccacactggaagcagcacacgcgacaacgctctctccggcacactgggccccgagtgtgctctctctcttctgtcatcgtcgctgcgtcgcccctcaactgctggcgtccccgccgttggccaaccccaggttactgcctcttcgaccactgccgtgtcgcagtcgcaggctgcaacggcagctgtggccactgctgcattcgcggccagtgctggccaccatgtgtttgttcctgatgctatgtttgaggatccatcacaggcactgccattctcttggcagtaggattgttttgttgtcctgtttttatgtgctcctgttgtgttctcgatcgatactctagtgtctgatggctgggaattcggggtacctgtgcacttgcagactcaggttgtggtccgtcagagatgtatacaagtgacacgacgactagtgctggcatctgaaaggaagtggtagctgctgtgcagagtgtttagccgttaaattcaaatgcgcccgttcaatttttttcttcgttttccttgtatatatttgtttgtttttttttgggcaaaaatatgtgcatgttatgcacttctggaatcgtcgaatcaggctgcagtcttgaaagccttcatcagggatccaaaacgccagatggctccatttgataagggtccactttgacttgattaatcattgaagggccaatttgggctgggcctattttgctttgttctaggacctatagtatccctctctaatttgccttaacctcagttctgtggaagaaaattctgtacataccggatataaacgttattttttacagcccctcacacccatcacgcggaggcccacaaacacagatcaattttttttaaaaaaaaacctttagtaatttgtttttcttttatttatatggaccagcagctggtatatgtgaggggctgtaaaagggattctttacattcggtatgtaaagaacttatgttctgtgtaaaaaatgtctagttttgacaagatttgtagaaaacacataaataactacaatactaaactagcttcattacattctacatacatgatatatgtctcgactctcgagtgcattaatttaaactagtatatgtcaatacatctaactaaaatctggtcaaagttcgatgaatgtagtatgggggtgtttgggttgagaaatgagatagttcacaatcttcttacttttcatttttttttgtttgtggaatggaatgagttgatctatcattatttcattcctcataaactaataactagtaataatgtaa

SEQ ID NO: 19234 - DNA, 1828 bp, Zea mays
gttcgctcgctccccatctccacacccgccgctctccacagtgctgctatcgagacgtctttctccgattgtatgtaccgagctcctcctgcctgcctgcctgcagtctgcctcatccccttctgttttgcttgcacttgaatagccaccttctgcttcgcgccatacgtatatcttctcttgcggtagctttattgcacatcctgcgggccttcttgcgtggatgctcctctcttggctatttgtttgtttcttgcagaggaattttttcctgaacttgtcctcgccgtcttgaaggtttcttgtttgggagcaggcggaggcgtttctttccttcttcgccggcggcggcatggactgggcagcggcgtccgggtctccgtcgtggggcgcggcggcgacggaccccggtccgaccatgctgtccttcgcaggcccgtcctcctccgccgccgacgccgaggtgcggctccaggatttcgccgcgggtcttgcccagagctcgcggccgactggggcggcgccgggagccgggaggaggtcccgcgcggccgtgggaggtgccggcgcggaggcgtgctccgtcgacggctgccgctctgatctcagccggtgccgcgagtaccaccggcggcataaggtctgtgaggcacactccaaggcgccggtggtggtcgtcggcggacaggagcggcgcttctgccagcaatgcagccggtaagggcaccgtgtcatccaatcctcgcaccaggctgtgtactgatcctatcatttacaattcttgtgctgatgtggtcattctctgtgtattggtcccccatctgcttgctaattgaggaatcgagggtggggtattagtgctttgggacaaatctaggggcaaaaacttaggtctagtttggtcccaacctggcaatctaaacaactgggttggtaatttggtggcatataggatctgatggcgtgctgataatttaatctcactgacaggatgcgtcgccggggttggtaatttggtgttgtctagggtcttgtgacccgattaatttagccccgttggtactatttaaagaaaggtgtcggtactgacttccttgggtagggttcggtttttccatggaatattcatcatcctgcagaaccctcctcatgattgatgggagttttgaacttccttcagctgcatcttcagtccgagctcttactgtacagagatgcaactttttgcaaaccattgctgtttcccagcagtcaaatatgaaaccattttgtaagatctaatcaagtttattgcttgttgctgatggcgataaaaggaggcttcaaacaagcatacacgttatttcatgggtcattcctttaggcaaaggccatctggagttgaaatcaggcggtagcattcaattttggttgatttaatattcctactgtttctgaatgcatatttcttcttctttctttgttacatactagaggattgcacaattaactgacacaagtaccaaacaaaactttaactgacaatgggtgtaactgtgttttctcagaacatttgaagttttgtttccttttcaagtaggaaactatatatagaagaaatatttttctttaaataatagacattaatcctttgatggcaccaggattgttcattactctgaaaatatgcttgatagcatgcactggtgattttgaactggatctcaaagtatagtctcactaatgtttgcaagctgacttattagtgaataagtaaaacaatctatgttatgtgatttattcctttttactttctaaattaaccaagaacatggaatgctaagtgcaa

SEQ ID NO: 19235 - DNA, 928 bp, Zea mays
gagcagactttagtgtgctcgctgacacaatagactattttgatttttgaatagtaccaattaccaaaccagccctgactccctgaggtttgacggaggttgggttggatgggtggcccttcctctccccgtcgggagaacgacggcgaggggagtggcgggagatctccggctccggcgacatggaaggagcgcccgaggtccttcgacgagaagaccaggacggcgtgttggcgtaaggcagcggtgctggcgggacggcacccggaacgctggcggcaggacgccgtgggcaacgtggtctgccgccgtttctggggctgccacggatgcctctgctacgagtacgaccacatcgtccctttctccaaaggaggagaatccactgttgagaactgccagatcctccagactagggtgaaccgttccaaatctgataaagcatgggtagcgcaagcagagatgcagggtttttcctgcgatattatgtttactgataaggagctagatataattgagatggctgtgtacggggacgtcattcgtccagggaagcaatgtcgctgcagaacagtagccgaggtgctcgggcaggtgaagccaacgaatcgcatggctgcatgtgagttaccagacaaaggtgcctcttaaaatgtataattcgaataaattggtttcgaccctcacctgtcagaatacaaccttttgtagcgcagttgattccattcaacagaggaacttgagttctttctcacaagtcataatcttgggaaatggatgcagttgatctgcagcctgtgctcattcatgatgaaaaaaaaaaaaaaaaaagttgatttttttgttgttacatattgattgatggcaacgttatcaatgaattggcccattccaataattgggcttgaaataaaaaaaaaaaaaaaaa

SEQ ID NO: 19236 - DNA, 2260 bp, Zea mays
aggaagttcacaaaaagaacatttatgcacttcatgatatgtttaagcaattctcctcatggaagctgacactaacataaatgatacctttgctaactgttgcaattaaaccacgacaccttgtttgcttaatataattacctgggctaactgttgaagttgacacaacagacaccttatttactcaatatgatagatttagattaaattgcagttttttcctggacactcctaactgaaccttcaaggcactaggtggctttatgttataaaggcaacatgcacctaaatttgcctcgatgagaacttgtaattgaacctggttggtttgggtttacacctgcaccttcaggcttcagccagctgaggctcaatttccttagatttacagttttgtttgttcatgtaaaactaggggcaccactctcaagcgaaagcccttgggtttttgcccttaaattttacagacccaacaaggtctccaaaaaaatatctaaattactgcgtctacagtgtttatgtctctatagattgcagttacaacagtccaaacaaccggctttaatccgaagcgaacagtgttatgatctggcacttttgcacaagggaccttgctgcaatttcctatttagtcatgttgaccacagtcttacttcggagcctgtacgactggtgaagctgagaaggattattgggacacaatccgcagtattcaaggaaagtacaaggatagtagaagctacaagggaagggcttcaaataaccagagaggaggaaagcgtttcaacgcgaagcgagatagaaacccagactcggagaagaattctaacaaggctcggaaggttgaagctatcgcatgaggttaatttaggtaccttagctcgactaaagaagtaacatgttatgccagcatgatcgacttcagtactctccaagtttctagaatcgacttgttttttagctatcgttttcattttggtcgttttgccaccttattcgatgttcgtcccttagctataatccttttgtaatggctttactgtgatgcgagggctcacccgatggcgtgtaatttgagcacaccaagcttaggcttcccttgcgaaagggtggaagcctttctattctttcactagcaaatatgcggctgcttgctttgggaggatgggcttctaacatagcctaaagcttaagggccgtttggatcccttgcggctgcttgctttaggaggatgggcaagaaattgtgtttggtttgtttattggctttctcaatttttgcactatcaatgtttcgtattgctaacttgggttgagatagaaatgctctccgctgctgccaaggttagtcttgctgagcggggcgaggccagttgcacaggttcaccgcaaaaaaaaaccgaacatgcccttattttctatggggattatgcatcattgttaaacattggtatttatttgcatatatttgaagcaatgctctaaaaagtgtagaatcaagctcatgacttaaactttgtttagctctaaggcccttgatttagcctgttcttaacttcctctatataaagctcaacggattatataaagctaatctgtcgggtaggctatttctatctctaaggttatcttttgttgcttttaatggcaacatgttacatgtgtatagaaaatacgatgataaaatacgcaccatttcaaagatggttatgcaacaatgattttccttttttcttttctttttgtgaatgcacataatgcatatgatcaagcaccttcccaaccagaaaatctcgtcaccaacgacaaccttcacctcctgttagaggaaatgaagtgatgaatactttgagtcttaacatagaagacgaaaaggaaatgaattggattcagtgccctttggttcacaaaatgtaacgtaaattgcaataataatgattcacacttaattaccagtggtaacaagtttgaataaaacaatattaatttctagtatgctatctaatgacggtttaatttaaacaaacatggtttaacgttatctgttactgtttaggttataaatatgtgaaacaaacaacacactagatgttatacctatgacaaaccgtacctattctgagtcgtctttaagctgggtatggattggttgagattgtatagcatgatttctatgtcacgcgcctaaagcatgtgtgaccgttgctccttgttgtctgcactcgttggggaagaacaattcgtgtcccaaaggcgattc

SEQ ID NO: 19237 - DNA, 1850 bp, Zea mays
tagcgtgctcgcggccgctctcgtctccagtctccagcagtccaggtcgatcgcgatcggaggccagaaatccatggccgctcccgccgccgcgccgctcgacgagggcaaggcgaagaaagtccttcgccaggtcgagttctacttcagcgacagcaacctcccccgcgataagttcctgcgggagacggtcgagcagagcgatgacggattggtgagcttgcccttgatatgctccttctcgcggatgaagtcccacctggggctggacgcagatgtcaagcccgagactgtgccggaggagaccgtgcttgcggttgctgaggtgctccggccttctcctgccctccgcgtatcggaggatggaaagaagattggtagagctagtgaactcttgaagccagatgagatcatagaacaagtagactctaggactattgctgtatctccgctgccttgcaatgtaaagcaggaagacgtccaatcttttttcacaaattatgcaaaggtaaacagcgtgagacttccacgcaatattgccaacaaaaaacacttctgtgggactgctttggttgagttttctgaagaagaggaagcaaaaagaattatggagactgctttagtatttgcaggggcaaatctggaaataaggccaaagaaggagtttgatgctgagcaaaagtccaaaaaagaagcatatgaaaagacacaccttaaaaaggacaaccagtatgaaggctatcaaaaaggcctaattgtggccttcaaattggagaaggccacagctgatactgtagtgcagcaagataacatagataaagagaatgactctgctacgaaattagatgtttccagttccatggaaaaaccttcaggccaggggccagaggagtctatccttgagagcgatgttattaagcaagggatgtcctcagatgacatgaccaaagagaaagatctaaacactggggaagctacagaatctgagaagtgtattagtgatgtccccatagaaagtgataaacatggtgatagtgaaccattgagcagggaaggcaaaatcatttctggcaatgtgaatgtgaagaaccaaatatcgagggaggatctaaaagaagcattcaaaaaatttggagctgtccggtatgtggacttcagcatcggagataattcaggataccttcgctttgaagattctaaggcagctgaaaaagcccgcatgtctgcagtacttgctgatggtggcttgataattaaggaccacattgttactttggagcctgtgactggtgaagctgagaaggattattgggacacaatccgcagtattcaaggaaagtacaaggatagtagaagctacaagggaagggcttcaaataaccagagaggaggaaagcgtttcaacgcgaagcgagatagaaacccagactcggagaagaattctaacaaggctcggaaggttgaagctatcgcatgaggttaatttaggtaccttagctcgactaaagaagtaacatgttatgccagcatgatcgacttcagtactctccaagtttctagaatcgacttgttttttagctatcgttttcattttggtcgttttgccaccttattcgatgttcgtcccttagctataatccttttgtaatggctttactgtgatgcgagggctcacccgatggcgtgtaatttgagcacaccaagcttaggcttcccttgcgaaagggtggaagcctttctattctttcactagcaaatatgcagttagggcttattcggttatttccatttctaaaatagcctaaagcttaagggccgtttggatccctagcggctgcgggctttaggag

SEQ ID NO: 19238 - DNA, 3366 bp, Zea mays
ctctcatccatcgacacaaacctggtttgaactttaccttcgtcatcgaccaccgcctttgtgtttcacacctacgcatcataggccaaaagacatgttgcacaacaccacactcacgctaaggttagtaaacactaaaccaaagcctcatggacacatatcaaccatgtgttcgcaatatagggtcttttagtagggacacatgtgttatggctcatggactgtagctagagtaggagatccaaaatttctggtttcattggatttgtgagaggaggcatgagagagagaaatagagaaaagagattctataaagaatacgtgaacaatatatgaatagtagttgcgttagagaaaccggagcctataacagttctattaaacatgctcttaaattgtccgttcatcagattactggcagtatggagtgtcaatcgccagatgcacagatacttacactgcatggcgccacaccatacaataataatcgagcctttcgacccgcaaatatacttgtgggcaatgacgcaatgtcccatttatctatataaaattggtcaaacttgaagacgtttgatggctcaataagcctaaaggggtgtttggttactgggactaatgtttaacccgtgtcctatcggatgtttgaatgtctattacgattattaaatatagtctaattataaaactaattacacaactatagagtctgaatgacggagcaaaattttaagtctaattaatccacgattaacaaatatttattatagcatcatatgatcgaatcatgaactaattagacttaaaagactcatcttaccattttatccttatctagttttataattaaactgtatttaatatctctaattagtattaaacattcgaggtgacgagactaaaatttagctcccgacaaccaaacaccaactagaacaccttatatttagaagaaacatgggaggtactagattgttgcagcatatctaatttcaagtaatcaccgtctaacaagctagctagctcctatgactatatatgttgtctgctcaaaattatctttatcattgtaagctattttatcttgatagggactaagaataatatgacacccacgacgggtgagatatttttatgttttatgacaatgacgcatctaataagaatatattgctgaaaatgtagcctccgtcaaattgcaaaaggttactgcctgcgatgatggataacagaaaatgttttttagtcaaatgacattatcacaacacgaatatcagatggcgaaactcccaataatatttgttcatagtacacaaccatttgtagaacagagattttatcaatccttgattatagaggacatattaacagcctgtatggaataatgcagaagaaaaatccgattcttgcacttgttctacgaaactaaaatgattcatccgaaattcccgcatgattcttgttgaattctttaagcccaaagtattaattaaagtaaataaaagcagggtcacacagtttccttggaatcaaaggagtacaagtgtacaacggtggataggaaacatagacaaatagcactgcatgcagttcctagcgctagcctacgcctacctagaccttgaagaagataatataggcacgcaacgcaacacgcttcactcaaaaaagaaaatgatttgactcacactagcttcattgtctagagtacttctacattcagaaccaagctaacatgacaaagcaaagacaaaagaaaaaggtagaaggagacagccaatgcatgggctgcatgcatgcgaagtacgtcacacgcgcagctatctatcagagtatctatcaggcgcatatgaagccacttgggaggttcttgccacagtagttgataatgaggctgagcttgacagggatgtcgacggtgatgccgagcacgttggccttgatggcggtgcagaggcagacggcggcctccaagtcggcgaggccgccgaggatgctgcagcacggctcggcgggcgggtggccgacctcggcgctgacgaggcccagcacgttggcgcacgcagcgaacttaagcgcgtgcttggggcacttgccaccggttgaaggcgacggcggcgtcggggttggcggcgttggcgtcgggcagccgccgccgcaggcgttggccaccgtgaagaggaccaggttgagggccacgaggaagaaggccttggacgatgccatggaggctgaaaaaacccaacagcactgcgcaaagcagagggatgcttgcggactggactggtgggctagggataggaggaggagagctggtgcaactggagccccacccggccgggggcggcagggcatttatagggaagaattgaaccaaaggtcaggaaaaatcctatttactgtacttcactgtaactcctcctacaccacttcctgaacttatatagaacaatatatatataccctaaagtaaagtacaacactacagcgacgtgtgtcctgtgtttattttcgtaaatgtaatcttgttttcaagaatcaagaattacgttctttactgaattgttgctgcctgctttttatcttgaatttgagtatcatattaaattttatgcaattgctactttaacttataaaatgttaatatggtaatgaaaagagatgaacaatttacttgtatatacttcaacgctacaaactgataaattgtacaacaacagtagcagcctgacagtcttggacctcttggtaaccaatccaacatgcaatacttgcaagcgaaggggcacccatgcatgtggtgtggatgtggcagtcacaaggctccaatagggcatggcggcttccgcagctcgtgggccgccccggctgtgccgccaaagtggcaatgggccacatctccccaatccccccatgccagtctgcctgccccgctgtgccggccccgagtgattcactgctcttgagtcatgataccgaaaaaaatttggtgcagccggctgcaaaccaggatacttacagcctctcacataaaaaaaattgagcctatctacagcagcaataacataactaaaacgttatctattggacctgcaggtagggtcaatcctccttttttatgaggggctgcaaatattctgatttgcagccgactgcaccaattttttttcatttgacacggggtgtgtggtcatgtggctgaggagagaaacaaatgcaagcgacgactaccaaccatgcaagctgtcctcatcaacaatagctttttgactcttatcgcgtcgatttattttcgaaataggtagtactattacgagagcaacgacatcgatactcacagatatcggtgctggatgcacatcaggc

SEQ ID NO: 19239 - DNA, 953 bp, Zea mays
gatcataaccattggaaggctgttgttgagaaatcttatctggatggattgggcattgactggtcaaatatccgtaacagcgtggtcgcggccgcggtacgcgggggatttgcagctgcactggcatctaaaaaggtttgggtcatgaatgttgttcctgtgcatgctgcagacaccctacccataatctacgagcgtggcctgatcggtgtgtatcatgattggtgtgaaccatttagtacatatccaaggtcctatgatcttttacatgctgaccatttattctcacgcctgaagatcagatgtaagcaacctgtctcaattgttgttgagatggaccgtattttgaggcctggaggttgggctatcatccgtgataaactcgagatccttgacccattggagacaatcttgaaatcactgcattgggaaattgtcatgaccttcagaaaggacaaggagggtatcatgtctgtaaagaaaacaacatggcgtccataaactgagctcagattcacaaggctccagcataccattttttgcactatactgctgtcgatttccccggattgtgagacagccattttgtgaatctggggtagatgtacaatatttgttcattcatctcatgacaatatgctcgccgcatctctgtcgggtagtttaagcccagttggatggttggttgtggttagcgttacattgatcaattctttgaagcagcatccaagacgaccagctctagtttcagaaaaagagggcccttcgattccataaacagggttgtacgagatacaagattgtttcttgttgtttaaaaatgtaacaatatagatatatgtaaaggttgtcactgaattaactgcttggtgatgttgtaagttgcaacaatccgtgaagattcaatgcatgaattttcttattgcaaattgtgaacaaaaaaaaaaaaaaaa

SEQ ID NO: 19240 - DNA, 3344 bp, Zea mays
  misc_feature (1345)..(1345): n is a, c, g, or t
ggccgctttttttttttttttttagttttttttttttttttttaaataataaaatttatgtatggctaggattacaaatagattataaaacattttcttataacaatataagacatattttgttataaaagatatattttatatataagttattatattattatatgttcccgttgttacgcacggacgctcaccttaaatttagagttgtttacatcacgatacttcgatggcggaatcgcgcgcacacacaaactatctacgggccttcggcaacaactttgctggtcggcctctcttcggcggcgtccgggcatacgaagaacatgtagaagcccgcaaggatcgtcaccgcggccatggaccagacgacggcggccacgggcgcaggcatcaacggagcaactctgccggagaacatgaccgtcagggcggtggtgacgacccatatggccgccttcacctgcaacctccggggcgatcccgggggcgttctctcgaacgcacggagcaggtggaagagaagcacgacgcagaagaagctgacggccacaaacagtatggactgggggtcgtgtctcgagccgtagatggctattgcgctgttgagcccgagaacgaacagcgcgacggccgaggtgcaggctgacgagccgccatcggaggcggctccggtgggagtagtggggttgtcgtcgccgcaaggagcaggatttagggagagtctgagctctctcttcacgaaaggtttgccacagtcgtccatcaagtatcctggcggctgccggctggtgcccagacttggcttcgcgccccggccggccccgcggtccccaccgccccttagagtcgggcgagagtttctagctttgcaaactaaattattgaaggaggttaccatgaagtttcccttgctctgtggtcagtcctggccgacgtttttgtccgcgtccacaatttcctagcactttctgctgcaaatttccgttgcattctgctgaatgcgtgattttgcatcttaagtcgtacgtggaagttacgcccgcgttgattttgcagtttgcatatgtcacgatccaaaacttcactcaactttacaaaagaaaatgaggtgcgaatgcgtgattttgaattttggagttcagtttaccgcccatgagttagccgcaaccgctccgtcctcacacccctcgcctttcttcgtagtaaggatggcaatcgataggtaggacacggatatatatagggtgtttgtttgagacatgttctcactactcttttttttagtttatgaaattgaatggattgatttatcatcatcttattccttatagttagttaatantaatataatgaatagagtcatctcaccatatttgagaaatagacacatgatgcaccaccacatttttttatggagtgattccttaaactaaacatccaatagttcgcaaacccatacccaaaagataaaactcaacacataattgtactcatctacgttcgcagatatagaaccatacccatacccatacccgctgggtatccattatacgctcgtccactataattttaacattcaacaccaaacaattatgttatcatgttttttaaaaaaattattattccagcatcatcaaacgataatttcagcacaaaacaacatgtcatgaatagaaattaaaaaaataggaatttagtatatgtattgaattcggatggctcacatattagatactcatccggtaacaggtatggatactagatatttatacccacgaaaaattatccgtgctcgtacccgtggatagcaaattccactatattcatatccattggataattatccgtggttatttactcatacgtatacgcattgtcattcctacttcggagtgagtgccctggataggagagatgagtcatctttcttttctagcagttcttaatttagtttgcttaggatttagtttaaataaacctatcgataaaattaaataatttttaatcgatatcttgtacttgtgatgacttctttggatcttaatcggatttatctatatggatcttaatgctaatctattttcacttcaatagttataaaatgcacaaaaatgtttactgttgttaaactgcaggaataggagtgtaagcgtaagtgatgtgttttttttattgtggacctttttcgcaaaaagtttaacattgaatttttgaagaaatcatttttatcttaggaccccgaatgtcggcaccatggtctatggtgtccaaattacacgtcttcgacctcgaaagttcctagttgaaggcattcaactttgcgttattgttgcctacgttgaggactcaacaagccaaagtgagtataccaatgagcttgacactattaaccctctatggtgaattgatgtcatttcatattgtaatttgctttcggtgttcttcaccaccttacaaatttgtacattaagcatgttacttaggagtcgtacatggaaccattagtgatgtaccttttcttaagatacaagtgcaatcatgatgacaatctatatagatgtgtccacttatctattttatgttgttgtgtatcacatgccacatagaattgtatggtagttttgtatgaggaaggagtggcatgtgaggccttttcacggtcgatggacttgcaagagtaagtgtcttgacttttatttctcattcatgaacaagtacttgtagttgtcatctttcatacactatcacttttcatacaatagtaattgtagttgtcacctttcatgtcatttgtagatttgatagtcagaaaaaaattactttgcatcccaccattgtatttatatagaagggtgggataacatccatacaaatgtggatgacaataatgagccacacagtaactcaattttttatgctacatatcttggcattttggtgtgacataatcaaagatggaggttccatggatgcaagcgaaatatactgacattgagtcctcataagatgaatacactcgtctagggacataactggaagctgctgaaagggaaatgcgctcttgggttatttctaagttgttttggtgattaactgctcaacggaccactatggaatagcactcttagtatgagcataagcacaggtgtagaagaaagcaaattgaagatatcaagtccaaaagagctcaactctggacccaaatgtgcaactctgtgtaaaatggtataagtgtgaggtttgcactcttaaatatgttgcatagctcctttacaatgttttctagaacttgtgtttgactctaacacgtttattagagaaaagcacttttcgggcttgag

SEQ ID NO: 19241 - DNA, 789 bp, Zea mays
  misc_feature (756)..(756): n is a, c, g, or t
accaggccccgagtaaacatagcagggcgcccctcgggcccggccggccttggattggggagctccgcctccctctcctcaagtttgaccaaccctcacccacctccctccgtcgtctagtatgcttcttgcctcccgcctgcttcctccgccgccctcctccgccgcggccggttcctcctcatcctctctgatctgcaggttctgacgaaccgaaccgttggggtttcaaatcttcttttgcagactccgatcccaactcaaaacacagagaactctgaaagctaatcggcaatggataaccacatccatagtcagccagctgctaacctctactaccagttcggcatggggactgagcagcaatacccaccaccgttcgcctcaccaccatccaccaacatcccgcacatggactggaacccggccacgatgctagacaacctcaccttcatcgaggagaagatacagcaagtgaaggacgtcatccgcacaatggtggacaacgccgggcaggtgcaggtccagtgccaccaccaagcaggcgagctgctggctcagaagcagaagcagcaggtggtcaacgcggacctgacatgccttatagttcagctcatctccaccgccggcagcctgctcccgtcactgaagaactcgtcgttcctcagccacccccaccctgctggccacgtggacatggctaaccatgttggcccaagctcgagcctagtgcctaatgcgatgaccgtttctggngactatgaggagctgttcaagggatggaccgat

SEQ ID NO: 19242 - DNA, 2393 bp, Zea mays
  misc_feature (336)..(336): n is a, c, g, or t
ttttttatattaaacttttagagatcactcaagagatagagtattaaataagattgtaacatcttaggacaaaacttaatgcacctgttgggattggtagattggtagaggacacaggagagcctcgctttatttgtatcgcggcccgacttagaagcacgaggccggaagtgcccaggctgctcacgccgcgtgccgcgtgccgctccgcgcttgtgcacgctgagacccggctcggctgcgtccgatggggcacccttcgggggcgaccgggcgaggaggttttgcaatcggcgtccgcagacgcacggccctttccttgccactgctggtccncgtcatcggcgtggcgcctatctctactactattatgtgagcactgtaggcgtccacttcgcacggtgcacgttctgcctctcccctcatgcccacggacgaacgctccgcgaagccacagccgccattcccgccgccccgccgcgcattccatcctcagcccgcggcagagtcctctgttcccagcagcgcctcgccccgccccgcatcactcccggccgcgcatcactcccgcagcgccccgccccgccggcgcatcactcccggccgccaagcccgcttcccgaggccgccaaggtttccatcccgccgctcgctcaagggttccatcccgcggccgcatccagcgcattccatcgcgcaatcaccgctcgctcaagggttccatcccgcggccgcatccagcgcattccatcgctcaagggtttccatcccgccaagcccgcatccagcgcattccatcccgaggccgcaagggtttccatcgcgcaatcaccgctcgcgcattccatcgcgcaatcaccgctaccgcatccatggcttcaatcggttgcccccgcgatccccttccatccatggcgaggtcgctggttatttttaacagtccaccgacagcactcgctcgcactaaatcctttcgctctcagatcctgcccctcgctcgccgcccaatcaatagctcagacgttgcctcggttgtcctgcaagtttgtggaccccgacaacgtcgtttcctccgctctagtggcgcgtcgcgtgcggtcagacacgatgagttgcggcagcgatgtgtgccgggacagctgcagtagtagcggcagcgaggagttcaggcggtcgtggcccagcaaagtcaccgctgatgattcagtggcgcctgcccggagctcggatgtcgcagcgccggcatcgtggattgataggaagctgcttgttgatccaaagatgatgttcgtttgggacaagattggggagggagctcatggcaaggtctacaaggggaagtaaagatgtacggtgatcaaattgtagcgataaaggttcttaaccgtggcagtacccctgaagaaaaagcaacacttgaagcccgtttcatccgagaagtaaatatgatgtgtaaagtgaaacatgagaatcttgtcaagccggaaacctgataatttattgcttacagcaaatcgcaagaagctaaaacttactgattttggacttgcacgtgaagaaactgtgactgaaatgatgactgctgaaactgggacttaccgatggatggccccagagctatacagcacagtcacacttcgacgtggtgagaaaaagcattacacaaataaagtggatgtgtacagctttggcattgttttgtgggaattattgaccaatagaatgccatttgaaggcatgtcgaatctacaagctgcatatgctgctgcttttcagcaaaagcgcccagctctccctgaggagaccccccaggagcttgtgttcatagtacaatcatgctgggttgaggatcctgccatgcgacccagtttcagccagatcatccgaatgcttgaaactttcattatgacaatacatccacctccgctttcagagccaaacgaaggcgaggaatcggaagaaacgaggtcgtcactgagcagtaggagctcctctggctcctcgctcgtttctcgcgcgacaagcaagctctcggtcgtccgccacctcttcgtctcaaagaagacaggcaatgggaaggcgtgatgcgccatgccctgagacgcttttcttcggtgctgtaaagatgctagcctaggtgatgcgcaatacaagagggaacttgttcagtgtagagtagctgttgtattgatgttacaaaaggggaaagttgaagtgcagcttttgcaagctatgtatagctcgcagctcctttactttactgaaagttgcatatgtagccgtccaaagaaccgagatatatattaaatcaaacaaccgactttaattcgaagaacagagatatatattacttcaaaaaaaccccccccccaacggctcgagtcggctcgaga

SEQ ID NO: 19243 - DNA, 1412 bp, Zea mays
cgcgccgcgtgcggcagacacgatgagctgcggcagcgacgtgtgccgggacggcggcagcagcagcggcagcgaggagtcaggcggccgcggcccagcaaggtcgccgctgatgattcggtggcgcccgcccggagctcggatgccgcggcgtcggcgtcgtggatcgacaggaagctgcttgttgatccaaagatgctgttcgttggggacaagattggggagggagctcatggcaaggtctacaaggggaagtacggtgatcaaattgtagcgataaaggttcttaaccgtggcagcacccctgaagaaaaagcaacacttgaagcccgtttcatccgagaagtaaatatgatgtgtaaagtgaaacatgagaatcttgtcaagtttattggagcttgcaaagaaccattgatggtgatcgttagtgagctactaccagggatgtcactgaaaagttacctgcatagcatacggcctagccaattagatacacacactgcaataagctatgcactggacatagctcatgcaatggactgtttacatgccaatggcataatacatagagacctgaaacctgataatttattgcttacagcaaatcgcaagaagctaaaacttactgattttggacttgcacgtgaagaaactgtgactgaaatgatgactgctgaaactgggacttaccgatggatggccccagagctatacagcacagtcacacttcgacgtggtgagaaaaagcattacacaaataaagtggatgtgtacagctttggcattgttttgtgggaattattgaccaatagaatgccatttgaaggcatgtcgaatctacaagctgcatatgctgctgcttttcagcaaaagcgcccagctctccctgaggagaccccccaggagcttgtgttcatagtacaatcatgctgggttgaggatcctgccatgcgacccagtttcagccagatcatccgaatgcttgaaactttcattatgacaatacatccacctccgctttcagagccaaacgaaggcgaggaatcggaagaaacgaggtcgtcactgagcagtaggagctcctctggctcctcgctcgtttctcgcgcgacaagcaagctctcggtcgtccgccacctcttcgtctcaaagaagacaggcaatgggaaggcgtgatgcgccatgccctgagacgcttttcttcggtgctgtaaagatgctagcctaggtgatgcgcaatacaagagggaacttgttcagtgtagagtagctgttgtattgatgttacaaaaggggaaagttgaagtgcagcttttgcaagccatgtatagctcgcagctcctttactgaaagttgcatctgtagcagtccaaacagccgactttaatccgaagcgaacagagctatatatt

SEQ ID NO: 19244 - DNA, 968 bp, Zea mays
ctgcagtagtagcggcagcgaggagttcaggcggtcgtggcccagcaaagtcaccgctgatgattcagtggcgcccgcccggagctcggatgccgcggcgccggcgtcgtggattgataggaagctgcttgttgatccaaagatgctgttcgttggggacaagattggggagggagctcatggcaaggtctacaaggggaagtaaagatgtatttgagacgtgcatacccgtgcttattttttcacatgtctttgctccaagccacagctactttatcaactgggctgattttgaagtatctgctttagttgtctcgaattaaatgtgtgttatgcaccagacccttgcaaaaaatggctattagtatgctttaaattaattagtttctcagggtgcccaaatcctccatgtgttatagtatcaagcagattcatgcctggtactcacttcaagcttccaaagttccaatattttgttgagattttagcaggcaggaggatgttttttgtcaaaacattagctatgagctgtgcgatccttgagaaccttggaggaaatgttagtcgtgatggcagtacagagtatacctccaataatctcctctctagagaaatattaatatgtcatagatgactgttggtaacatcacaagttcagatgccattgtcttcacatgaggaagcttgtgccataatactttgtatttttttttctattcttattcaccagtttctatcatttgccctttagaacatttaagtcatatctgtaatcctgtttttcttgtatgcttcaaataggtacggtgatcaaattgtagcgataaaggttcttacccgtggcagtatccctgaagaaaaacaacacttgaaggccgtttcatccgaagtaaatatgatgtgtaaagtgaaacatgagaatcttgtcaagatacttccgggtcttaatgctagcttatgtgattcgt

SEQ ID NO: 19245 - DNA, 815 bp, Zea mays
attcagttttgctgggcttgccggccctggccggcgaggcgagtaggcgacccggcgggcgtcccccgcgcccgcccgctcctcccccttttcaacggggtgcagtcgagccgaccggaacccaacttctctccctctccctcgcctgcctgccgttccgcgtttgaccaactcccccgcaccgtaaccctagcagcagatcggccatggagagctgggcgacctgggtggggacaagcgtcacctccgccttcttcgcctccctcgagcgctgctcctgcatcaacctctccaccgacgacgacgacgacgacgaggaccacgacgaggccaaggaccggcccctcatcctcgccgccgccccacgccacgactccgccgccaagcccgatccagactccgccgccgaggaccaggacgaccagaagcaagagcagccgccgctgccgcccgtatgaatcgaacccgattccttgcttgtactagctgctactgctgttatgtcgccaaataaagtcgtgtgtgcgtgtgcagtcagtactactgctctgctgctactatcctagtcctagtatattagtatattatacagtcctctctgtgaaatttgaatcgactcgaaaaccaaaccccaccaacatgagcttgttaatatttgtcctcccgaatcaaacagcgcttgttaataatggctgatgatgcatgcttctactaaaaaaaaaaaaaaaaaaccccccgcccaacttgaattttcatgtgtaggggagtgagtagtgcaaatttgttataaatgtgggcttgtgctgcttgcttgc

SEQ ID NO: 19246 - DNA, 1124 bp, Zea mays
  misc_feature (1)..(1): n is a, c, g, or t
  misc_feature (6)..(6): n is a, c, g, or t
ngcggncggggtcaatcttctctccctctccctcgcctgcctgccgttccgcgtttgaccaactcccccgcaccgtaaccctagcagcagatcggccatggagagctgggcgacctgggtggggacaagcgtcacctccgccttcttcgcctccctcgagcgctgctcctgcatcaacctctccaccgacgacgacgacgacgacgaggaccacgacgaggccaaggaccggcccctcatcctcgccgccgccccacgccacgactccgccgccaagcccgatccagactccgccgccgaggaccaggacgaccagaagcaagagcagccgccgctgccgcccgtatgaatcgaacccgattccttgcttgtactagctgctactgctgttatgtcgccaaataaagtcgtgtgtgcgtgtgcagtcagtactactgctctgctgctactatcctagtcctagtatactagtatattatacagtcctctctgtgaaatttgaatcgactcgaaaaccaaaccccaccaatatgagcttgttaatatttgtcctcccgaatcaaccagcgcttgttaataatggctgatgatgcatgcttctactatcctgcctgcactctgcaatcactttgaacttgaattttcatgtgtagtgtagtgagtagtgcagatttgtatatagatgtggcttgttgctgcttgctgcgtagtaagtaaagtaatccattcactgggaatgatcttccgatggtgttcatgaaaatagcaccatctgtactttctatccagcggtgcttgcaataataaagaacgattaaaggtttccccagttgtctggtaggagagtaccgtctctgagtagtaggaagttctagtagtatttggcagagaccaaaagcaagcattgttgtattagtgggtggatgctgaaaaggagtatttgctacgatagagtgccacatcacaagcacagggagatgacggagaggattagaataccattcgcaatagatagctgatgctttgatatattagtgagagatggagatagttatgttaaacaaggatattgcggaccatatccatttatttatgtgacacatatgttaaatggtgaatgcaaa

SEQ ID NO: 19247 - DNA, 1614 bp, Zea mays
  misc_feature (20)..(20): n is a, c, g, or t
  misc_feature (24)..(25): n is a, c, g, or t
caaatttttttttttttttnttcnnttggccgtttttttttttttttttttcttaaaagatcaacaattgatcgatgagagtcgagcaaagcacatagtcttaacaagaaacagatttgccatactaacaagaaacagttttgccatacttctataacccatacatttgagctactaagctaacaaaacttaagaaaaacctgagggaccaagttctgcagtataattgattggtggccatctcaagtgaagcctacatcatataaaccttggtcctcaacttcttgatcatgtcatctgatttctcccccttgatcttcttacagacgatcaccctttatgctcttcttcctcttctttccctcctcggtagcacgcttgcccttcactctacccttcttgccaacctcgtggccatcatcaaccatgatgctcttcgtcttcttctttttctctgtatccacctgaacttcttcctgcatcacaacaccctcctcaatctgctccttcttattcctcttcctcttggaactcacattggcaaatacctctcttccatcggcaccagcattcgccttcttttcgatgacctccccagatccaacaatgtcaggctcaggcacctcgattttcatacccaactccggcacaacctggtaaattggtagggcaactgaatccacagccttcagatgcagcgccctaacattgccccacttctttggcaccttctcgacagcctcctccaccgcggccatcacattgtccacgatatcctcctcctccatgtccagcctacccaccttaatccccgagcaggtccctgaccgcaggtacagaaaagcagagccaagaaccctgcggacctgctccggccatccgatgcgggtgaaatcgactccaatcggagccttcttggtggagtagaacgccttcccgaggacgcgcggcagcagagggaggatggcgcggtcggcgacgaagaggtcgtgggaggctgcgaggcggcgccgcgactcgtacgggcggtaatccgtgcggagcgtggagagcgggatgacctcggagacggggaaacggtggagcgacatggacgcgtggaggtcggaggcggaaggggaccgcgacttggtgcggtcgtccgagatgacgcagacggaggcgccgtcgtgcccaacaacgggatgtggcatcgggaggaggcgcggcttggtgctgcgcgaggcggggatgcggcgtagcgagagctggaggaccacgatgtcgtcgcgctcgtcggcgaggaggttcgggcgcgcctccgcagcgcgcttcttcatccacgttgtcagggaagcgacagcgctggccaccgtctctcggggcaccgggtgtggtggctgcggcggcgacatggtgggcggcggatccttcaaaaaaaacatggtgggcggcggcgcgagagggagatcagaggggtttagggtttgctggccggcctcgggggacccaatggccctttggacttcacagcatttgtccctatggcaagtgggtccaggctccgtcatttgccgatatgtctttctatggtaggtgggtccagcctgcaggtcggctgtagaggtgccccgg

SEQ ID NO: 19248 - DNA, 1775 bp, Zea mays
gcaaataatgcagcctaaaatgctggatagaaccatcattattaaggggaggtacatcgtgagggatacttccgagaagccttgtcttttttgacaacataagcatattcttagaagatcaacacacaatcgttgtgagtcaagcgaagtacatagctttagcaagaaacaattctgccatacttctataaccaataggtttgagctaccaagctcgcaaaacctgaagaaacaaattcagaagaaacctaagggaccaagttttgaggtatatctgattgatggcaaatcttggaactttaacagatgatatagttcttccagctgataacaattgactaactcaattcatcgatgatttggatatccagcctacaaatacgcagaactgaatattttaagaggcacctccaacagtgatatcaactgcaaccttatactcttatcctggtcctcaacttcttgatcttgacatctgatttctccaccttgatcttcttatctccctgcatttcctcagtaccgacttcaccatcaccgttcatgctcttcttcttcctctgctcagtcttccccatcttaaccttcttgttgtccaaactggcttcgttcaccttattttccaaaccacgtttgcccttcttttcacccttcttgccagccatctggctgtcattagcagaaatcacaatgcttttcctcttctttttctctatctccacctggacttcttcctgcatcgcaacatcatcctcaacctgccccttcttattcctcttcctcttggcactcacattggcaaatacctctcttccacgggcaccagcatcccccttcttgtcaatcttcttcccacaggtctctgcttctgcggcatcaataacctccccagatccaagacccattaattcaggcacctcgattttcatacccaactctggtacaacctggtaaattggtagggcaactgaatccacagccttcagatgcagtgccctaacgttggcccacttctttggcaccttctcgacagcctcctccaccgcggccatcacattgtccacgatcacctcttcctccatgtccagcctacccaccttgatccccgagcaggtccccgaccgcaggtacagaaaagcagagccaaggaccttgcggacctgctccggccatccgacgcggctgaaatcgactccaatcggagccttcttggtggcgtagaacgccttcccgaggacgcgcggcagaagggggacaatggcgcggtcggcgatgaagaggtcgtgggaggctgcgaggcggcgccgcgactcgtaggggcggtagtccgtgcggagcgtggagagcgggatgacgtcagagactgggaggcggtggagcgacttcgacgcgtggaggagatcggaggcggaaggggaccgcgacttggggcggtcgtccgagattacgcagacggaggcgccgtcgtgtccgatgacgggatgcgggagcgggaggaggcgcggcctggcgctggacgaggcggggatacggcggagcgagagctggaggacgacgaggtcgtcgcgctcgtcggcgaggaggtttgggcgcgtctgcgctgtgcgcttcttcatccacatcgtgagggaggcgacggcgctggccaccgtctctcggggcaccgggtgtggcagcgacatagcgggcgggcgggcgggcggcggcgcgagagcagggtttagggtttgattgatgcgcggtgggaaccgccgggaacggaacgtcccgaccgg

SEQ ID NO: 19249 - DNA, 5490 bp, Zea mays
  misc_feature (2596)..(2596): n is a, c, g, or t
  misc_feature (2685)..(2685): n is a, c, g, or t
  misc_feature (2860)..(2860): n is a, c, g, or t
  misc_feature (2889)..(2889): n is a, c, g, or t
  misc_feature (3539)..(3539): n is a, c, g, or t
  misc_feature (3656)..(3656): n is a, c, g, or t
  misc_feature (3686)..(3686): n is a, c, g, or t
  misc_feature (3779)..(3779): n is a, c, g, or t
  misc_feature (3934)..(3934): n is a, c, g, or t
  misc_feature (4041)..(4041): n is a, c, g, or t
  misc_feature (4246)..(4246): n is a, c, g, or t
  misc_feature (4299)..(4299): n is a, c, g, or t
  misc_feature (4369)..(4369): n is a, c, g, or t
gcacgagaccattacctagaacatcctaatcggacactaccggacagtgaggcgccgcttgccctccacatacggccgcggcgaggaacccaaaaggccaaaaccctcccaaaagctactacacagtacacacacggaacggaatccgggcatccgggaaagcagccctaatctcaaggccgcggctgcgagcgctgcttcccacctcccaactccagaagtcctccctagacgccgccagccgcgcgcacacccaccgagagctcctcgggctttctttctccgttcctccctcgcgcgctcagggtttcacgatggaggccgaggcggcggccaagagggcgcgggagggcggggaggacgccaccgcgccggtggcgggggccgaggcggtggtcgccggtgctggcgagcaggcgggaatctccgccgtcatcccaggatggttctccgagatcagccccatgtggcccggtgaggcgcactccttgaaggtggagaaggttctgttccagggcaagtcagactaccaaaatgtgatggtttttcagtcctccacgtacgggaaggtgcttgtcctcgacggagttattcaggtgacagagagggatgagtgcgcgtaccaagagatgattactcacctgcccctttgctccatcaaagaccccaagaaggtgttggttattggagggggggatggtggtgttttgcgtgaggtttcacggcatatctctgtggagcagattgacatctgtgaaattgataagatggtggtagatgtctccaagcaatttttccctcatctagctgttggatttgaagaccctcgtgtgtcattacacattggagatggggttgccttcttgaaaaatgctccagagggtacatatgatgcagtaattgtggattcttctgatccgataggtcctgctcaggagctttttgagaagcctttcttccagtcggtggccagagctttgcgtccaggtggagttgtatgcacccaggcagagagcatatggctacatatgcacatcattgaagatattttcgtcaattgccgccaagttttcaaaggctcagttaactatgcttggacaacagtacctacataccctagcggagttattgggttcatgctttgctccaccgaagggcctgctgttgatttccagcaccctgttttcaacatcgaggaggatgaacattctacgaaatcaaaaggaccccttaagttctacaactcggagatccacacggcatcattctgtttgccctcttttgcaaagagggtaattgagtcaaaggcaagctagacgtgaggatacttcaccaagtccagtcgattgggttaagtaccttaggcgcaacacaaaatttgttgtcgtgtgaaaatgggatgcctccctcccccaccccccacttgatgaataagcacatgagatgagatgcaacggttatcggagttgtcagtctatacgattctgtctgttgtatgtgccggctgccaggtgcagctatgaaaacgttttgcaatagctgttttcggccagtgctctgatcaggttgagttttggacatcatttattatgttcctgcatccatacctgatactccctacgttctgctttaagggctctgtcttaacatgttgaattttttgaatgctaatctgacatagtttgtttatgaggtaattaagatgagatttcttaggatccacatccttgtatactgtttaccacctaatttaatttgtagtataatattaaaattaagtgcaggtcctccatatagtttctggttctcaagtatgttattcacgcccattagtgcaaaaataaagtgaaatctggtgagtgcttgttttccatttggttcttcaccagcaccatcactaatctgtagttcagaaattgtactcggatatagtgtttcataataatatttcatgttattgcataagtaaatagtggtatattatttggctggtctgctatttgggaaaacaaaagaaaatgatactatacagggataatatgaaatttatttttaatcttatactcctacgtggttggtgcaaggtgattcttccctgcgacggcaacgccaccagcgaactgggaggtgttgcggctcctctgcaactgcacgtaccttggttagccttactcaaccttttgcatcccctcttgcttgctttctctaactgtagggatttctcgagttaggattatgtttgcttctcacggtgggcttaatcattagttagagagatctagcaatagctctaacatattgccacgggaaaacatgcacaacaaggttattattttcttacaaacatccatgatactcctgatatctctgtccttttgtgtggatccacagtatcaaccattttgcttggtgcaagtggatcaggctagggaaaatctactaacacatgaaacagaatgtcaatatggtttaaatttttttaattagattgtctaatttgcaatttcttcactccaaaagttccgatctgtaggtttctgtacaaaaatgcactccaaaagtgtttttggatcaacaaatgtttttataattcacngcgggaggataaactgaaaaacaagtattccaaatgattgtagatgctctgtaggaaacaagtattccaaattcactaaagaacagttnacgcaccttcaaagacgcacaacgacatttttcgtgcttttgttcgtgcttttgcatgctatctgtgttatggttactgatattttttcatggtgttaaagacttcgacagatacctgtttacgtgcttttgttccttccacagcgtggtccggcccgaggagattccgaaggtnttggaaatcagcggcaagcgcagcctcancgacaacttcttctcctcctaccacgtgtaataatcacggtacacctgtttacgtgcttttgcatattatatataaaagaactgcaattggataaaattctttttgttaggtgtgttcatattccatggacaatctaaaacgaacaattaatcaagttcgtatattttgtgtatctatacaatgtaactaaactctttatataacaactagaagatcaatggcaccgtctacacttaaccaacataggtcggttgcagtcctacatcacgtctctacagagtctccataagcacacatttcagttgtcgcatctatatatgtgtggacaaaagaatctaaactcacttttaatgtagactcacttgtagtggctgaaagtgtaagatgtgccagtcaggccacataggtgcctgagtggaagcttcaaaacatcactcactcaacagtgaggtaacagaagatttgtacagttctaacatgctgcttaccaaagaaagtattaatcttgaaaaatccatgtcatcacgatgggaacgcctatagcagaaattgttctagaatgcaactgccactgaaacacactatgcttgcactgataaaagaaatttgttccatgtaatgagcaatgaaaatgcagaaactgaaaccnttaatgtcatctttgagaggggaaaattcaggcaacaaataaagcaaatgcaagtcccttaggacaatcctcctcaatttgcccctaaccggacaagccctcaatctcctacgatcntcatgcaaccgaacaagatctaagggagtntgttggtttattctttgggtcggattgttgaccaggaagccttgatcagtatgggtttggggtggcaatatttttccttagggtaatcagtgnaatcagtggggctagctgctgtttgttgggctatttggcgtaccaggaatgcagtgtgcttcgacaacgaaatagcaaaatttcctactgagattgcttgcttgatatgttcctttttcttgcatattgggcaggtctactaatggagaacttgnagcagcaagttatccagggagcggagtagtgaagtctaaggccctcttttctttcacaggcaagatgtgcagtatgtgtgtatcagctaggtgcagcctgcgcactnttcgggcaggtgccctgtaactataaggaacacttagctgtgttttcagagatttttggttagttgttctgaactttgtttctaggagtggcggtagtcagttcatgcatttgttcccttggtgaacaacatcattgtgttgtttgcttcacgttgttgttaaactattaaactctgtaatttcgatgctttggtagtgaaattnggttttactggtgtggagaaaaaatgaaccaagaaataagattatatgcacanccttaactggtgaaaattctgcctagctgacccgagcggctaggcgagcggccaggctgcaacaaatcangcctgtgtagacccgagcggacaggctggaaagaaagccaccaatcatacctgtgtagacgagtttccctccacacgttatttcctgccttatgtctgtagggcgagtgcattatctatcttcataatattagtcgaggtggatccctagctcttgtttccttgaatgtgtggatctctttccttcctaaatttctccattgatggaaggtgtaaattgacagtgccctcaccggctacaaatggagcatgacccattgtatgtccttgaacctgcttgtttcttggtgggttcagtcctctaatcctgacaacagaagatttcctatacgatgcagtccttgcgcttggtccccggaaactccgctctgaccccattgtagtaggctcagctcccacatcttcattttcccaaccaggtgatggtgtgctgacctgccaagctccggagtcaccccattgctagaagcagtctcccatatcatatgatcggaaggagacactgtacttgaacaaagcaactaggtggttgtgatagtttgtcgttggatcccgcagcgacttcactcacttgagctgcaccaaggttcttgacagtggggcatccacagacacagagtggcacctcatgtccacacccccagtttctatctgctcttcctcttttcacgcctccagaatttgtcacctatcacaacagcttctcaggtaattgtgttgaatttgtgatctattttatgtttcttgtgatttttattcccttgactatgcgaggcaccatttatattcccttgactattcgctggatgataggcgatgtgtgccttccgttccgctcgcccaccacgctgtggtcgcgtggtcgtggacgtgtcggtgctattccatcgtcgtcgtgctggttttcatgcgctgctacgagcagagtacaattcacgtttgcttttttcctgcgcctcagtcgcgggggcaccacggtcatgaacgcacgagcacgacgaagagagagagatagacattttcttgtatagatgctcgatcgaattttcctccgttctgtatatatttctgcttgcttgctattgtgtcatctcgataatgtcaattgagcttgcgcgcgcg

SEQ ID NO: 19250 - DNA, 1673 bp, Zea mays
  misc_feature (5)..(5): n is a, c, g, or t
  misc_feature (31)..(31): n is a, c, g, or t
gcacnagaccattacctagaacatcctaatngaaaagaatataataaaataaaaacccagcagcatttctccgccgcccatacgacgacgacggccactcggcgcagtgatttgggcgccccgcaaagcggtggctccaccggccagcgcatcaaaggccctgtggaatatggcgccgcgccgcttgccggggccgggccctcctctttatatatggcgtggcgagcaaacccaaaaccctcgcaggcagaaggcaaacgcggctgcgagcgcggcgccccctcccactatccagccgccgccagcccgcacacccctccctcgcgcgctcagggtttcggaatggaggccgatgcggcggccaagaggacgcgggagagcggggaggacgccaccgcggcggggatctccgccgtcatcccgggatggttctccgagatcagccccatgtggcccggtgaggcgcactctttgaaggtggagaaggtgctgttccaagggaagtcagactaccaaaacgttatggtctttcagtcctctacgtacgggaaggtgctcgtccttgatggagttattcaggttacggagagggatgagtgtgcgtaccaagagatgatcactcacctgcccctttgctccatcaaagatcccaagaaggtgttggttattggagggggtgatggtggtgttctgcgtgaggtttcacggcattcctctgtggaacaaattgacatctgtgaaattgacaagatggtggtagatgtatccaaacaatttttccctcatttagctgttggatttgaagaccctcgtgtgtcattacacattggagatggggttgcctttttgaaaaatgctccagaaggtacttatgacgcagtaattgtggactcatctgatccgataggtcctgctcaagagctttttgagaagcctttcttccagttggtggccagagctttgcgtccaggtggagttgtatgcacccaagcagagagcatatggctacatatgcacattattgaagatattgttgtcaattgtcgacaagttttcaaaggctcggttaactatgcttggacaacggtgcctacataccctagcggagttattgggttcatgctttgctccaccgaagggcctgctgttgatttccagcaccctgttttcaacatcgaggaggatgaacatcctatgaaatcaaaaggaccccttaagttctacaactcggagatccacacggcatcattctgtttgccttcttttgcaaagagggtaatcgagtcaaaagcgaactagacgtgaaggtatctccaagggctaagtaccttaggcgcgcaacacagaatttgttgtagtgtgaaaagcggatgcctccctcccttttctccccctttgatgaatagtataagcacaggagatgagatgcaacagttatcggagttatcggtctacatggtcctgaccagtcgtatgtctcggctgcctggtgcagctatgaaaacgttttgcaatagcttttttcggcagtcctcacatcatcacggttgtgtttccgcttccatatctgaatggaatacatatacgtatgaaataaaactgtgtaatggctgttgctcggatcctttttaaaacaggttcagctctcgtcgagtggtttgtggttccttcaa

SEQ ID NO: 19251 - DNA, 1684 bp, Zea mays
aataaaaatccagcagcatttctccgccgcccatacgacgacgacggccactcggcgcagtgatttgggcgccccgcaaagcggtggctccaccggccagcgcatcaaaggccctgtggaatatggcgccgcgccgcttgccggggccggggccggggccgggcccgggccctcctcttatatacggcgtggcgagcaaacccaaaaccctcgcgggcagaaggcaaacgcggctgcgagcgcggcgcccctctcccactccccagcagccgccagcccgcacacccctccctcgcgcgctcagggtttcggaatggaagccgaggcggcggccaagaggacgcgggacagcggggaggacgccgccgcggcggggatctccgccgtcatcccgggatggttctccgagatcagccccatgtggcccggtgaggcgcactctttgaaggtggacaaggtgctgttccaagggaagtcagactaccaaagcgttatggtctttcagtcctctacgtacgggaaggtgctcgtcctcgatggagttattcaggtgacggagagggatgagtgtgcgtaccaagagatgatcactcacctgcccctttgctccatcaaagaccccaagaaggtgttggttattggagggggtgacggtggtgttctgcgtgaggtttcacggcattcctctgtggaacaaattgacatctgtgaaattgacaagatggtggtagatgtctccaaacaatttttccctcatttagctgttggatttgaagaccctcgtgtgtcattacacattggagatggggttgcctttttgaaaaatgctccagaaggtacttatgacgcagtaattgtggactcatctgatccgataggtcctgctcaagagctttttgagaagcctttcttccagttggtggccagagctttgcgtccaggtggagttgtatgcacccaagcagagagcatatggctacatatgcacattattgaagatattgttgtcaattgtcgacaagttttcaaaggctcggttaactatgcttggacaacggtgcctacataccctagcggagttattgggttcatgctttgctccaccgaagggcctgctgttgatttccagcaccctgttttcaacatcgaggaggatgagcatcctatgaaatcaaagggaccccttaagttctacaactcggagatccacacggcatcattctgtttgccttcttttgcaaagagggtaatcgagtcaaaagcgaactagacgtgaagggtatctccaagggctaagtaccttaggcgcgcaacacagaatttgttgtagtgtgaaaagcggatgcctccctcccttttctccccctttgatgaatagtataagcacaggagatgagatgcaacagttatcggagttatcggtctacatggtcctgaccagtcgtatgtctcggctgcctggtgcagctatgaaaacgttttgcaatagcttttttcggcagtcctcacatcatcacggttgtgtttccgcttccacatcagaatggaatacatatacgtatgaaataaaactgtgtaatggctgctgccatcggatccttttttaaaaaaaaaaaaaaaaaaaaaaaaaaataaaaaaaaaaaaaaaaaactcgagattagttctctctctctctcctcgtgc

SEQ ID NO: 19252 - DNA, 1460 bp, Zea mays
tttttgagaagcctttcttccagtcggtggccagagctttgcgtcaggtggagttgtatgcacccaggcagagagcatatggctacatatgcacatcattgaagatattttcgtcaattgccgccaagttttcaaaggctcagttaactatgcttggacaacagtacctccataccctagcggagttattgggttcatgctttgctccaccgaagggcctgctgttgatttccagcaccctgttttcaacatcgaggaggatgaacattctacgaaatcaaaaggaccccttaagttctacaactcggagatccacacggcatcattctgtttgccctcttttgcaaagagggtaattgagtcaaaggcaagctagacgtgaggatacttcaccaagtccagtcgattgggttaagtaccttaggcgcaacacaaaatttgttgtcgtgtgaaaatgggatgcctccctcccccaccccccacttgatgaataagcacatgagatgagatgcaacggttatcggagttgtcagtctatacgattctgtctgttgtatgtgccggctgccaggtgcagctatgaaaacgttttgcaatagctgttttcggcagtgctctgatcaggttgagttttggacatcatttattatgttcctgcatccatacctgatactccctccgttcttttttatttggcgcggtttagttcaaaaatgaactagtggtgataaatattcgagagaacggaggtagtaccacagatggaatatataagaaataaaactgtgtaatggttgttgccatcctatctttttgaaactggttcagctccagtcgatctgatttctttggcgccgggcccgggattttaggagggttccttggagcatggtttgtggttttatgatggttttaagagggtgttgctgaaacagattgagaaaaacacgttttcttcatcaatttgagatccacctgtcaatggctatggctaggattgcctttttgtttcccccaacttgctctttacccctctctctcggtgccctcctgttccgcctccagcataggctgcgtagtgactagggattgcatgggtagtgactagggattgcatggtgattagggatgggaaccgagaattctacatttacctcctcatagttgttcccgttgacgaaaaaatttccttggatccacacaaacgtttgtgggggataaagggatcctcatccactataattaatcgtacttcattcgttatttatgtaaaacattgtcaattatatatattattagatgtaaaaatcattatgtatacattaaaataaacatatttgtacaacgagtgatctcttgataatgtaattatttatttttattattaactattatatgaaaacatcgtcacatgtaaatttaatggatttacacggggaacggggatggggtacccgccc

SEQ ID NO: 19253 - DNA, 799 bp, Zea mays
cattcgggccccgccgcgcccggtacccccgggcctgccgggctccttctattccatcacccccagcgtgcgcgctgcactccctccctgcccctgttctctctctcgtggcgacggcgacggcgacgactgggcggccgttgctgccgccctactcgccaggcgcccaggtattcttcggccccttcgccggcgacgagtgtcaccaggttcctcgtctccggaacgcagtgcaaagcagatcgatctcggcccagcaggggcctcacgacttgactcccaaggctgactcgatctctttggtttcgtggaccgtgatcagactccagggctggatcgtgtttcttccagtgtgcaagcttggatctcgtaggtctggtttagaaaggaccgtgcttgctctttgctgccgcaatcatgcagagtgggggcgacatgaggcctgtgcacaacagtgtcgatacagttaacgctgctgctgttgccatcgtcaccgcggagagccgcacacagcctcctgctgaacagagaaggaaatgggctgaccggttgagcgtgtacttctgctttggatcacagaagaatggccggcgcatgcgtgtcaaccatgccgcacttgtcccagaacctgcacctcaaaggacagatgcgcctgcagcagaaattccaaaccacccaccgcctcctgtgttcccctttgtggcaccgccatcctctcctgcttctttccttcaatcagaacccacatcaatcgtacaatcaccaagggctggggagctccagcctttttcgccccctc

SEQ ID NO: 19254 - DNA, 937 bp, Zea mays
cattgggtacctcgaggcccggccgggctccttctattccatcacccccagcgtgcgcgctgcactccctccctgcccctgttctctctctcgtggcgacggcgacggcgacgactgggcggccgttgctgccgccctactcgccaggcgcccaggtattcttcggccccttcgccggcgacgagtgtcaccaggttcctcgtctccggaacgcagtgcaaagcagatcgatctcggcccagcaggggcctcacgacttgactcccaagggctcccaaccttgcaggctgactcgatctctttggtttcgtggaccgtgatcagactccagggctggatcgtgtttcttccagtgtgcaagcttggatctcgtaggtctggtttagaaaggaccgtgcttgctctttgctgccgcaatcatgcagagtgggggcgacatgaggcctgtgcacaacagtgtcgatacagttaacgctgctgctgttgccatcgtcaccgcggagagccgcacacagcctcctgctgaacagagaaggaaatgggctgaccggttgagcgtgtacttctgctttggatcacagaagaatggccggcgcatgcgtgtcaaccatgccgcacttgtcccagaacctgcacctcaaaggacagatgcgcctgcagcagaaattccaaaccacccaccgcctcctgtgttcccctttgtggcaccgccatcctctcctgcttctttccttcaatcagaacccacatcaatcgtacaatcaccaagggctggagctccacctttttcgcccctctcaccaaattcccaatcccccgaggggccaccatccatctttgctattgggccgtatgcacatgagacacaactcgtctcgcctccagtgttctcggccttcacaactgaaccatcaaactgcccctttcactcctcctc

SEQ ID NO: 19255 - DNA, 2214 bp, Zea mays
cattgggaccctcgaggccggccgggctccttctattccatcacccccagcgtgcgcgctgcactccctccctgcccctgttctctctctcgtggcgacggcgacggcgacgactgggcggccgttgctgccgccctactcgccaggcgcccaggtattcttcggccccttcgccggcgacgagtgtcaccaggttcctcgtctccggaacgcagtgcaaagcagatcgatctcggcccagcaggggcctcacgacttgactcccaagactccagggctggatcgtgtttcttccagtgtgcaagcttggatctcgtaggtctggtttagaaaggaccgtgcttgctctttgctgccgcaatcatgcagagtgggggcgacatgaggcctgtgcacaacagtgtcgatacagttaacgctgctgctgttgccatcgtcaccgcggagagccgcacacagcctcctgctgaacagagaaggaaatgggctgaccggttgagcgtgtacttctgctttggatcacagaagaatggccggcgcatgcgtgtcaaccatgccgcacttgtcccagaacctgcacctcaaaggacagatgcgcctgcagcagaaattccaaaccacccaccgcctcctgtgttcccctttgtggcaccgccatcctctcctgcttctttccttcaatcagaacccacatcaatcgtacaatcaccaagggctggagctccagctttttcgcccctctcaccaaattcccaatccccgacggggccaccatccatctttgctattgggccgtatgcacatgagacacaactcgtctcgcctccagtgttctcggccttcacaactgaaccatcaactgcccctttcactcctcctccggagtctgtccatctgacaaccccttcctctccagaggtcccatatgcaaagcttctgacatcgatcaacaatagcaagaatggtgaagcagggggtgatctccagtcgtatccaaactacccagacagcccaattgggcgcctgatatctccaagctcgggctgttctggcacatcctccccattccctgaccctgagatgcaggcttcttcacgcagcgctttacgcttgttcccagttcgtgagccccctaagatattggatggcgagggcgttgcgacacagaagttgatacctcgccatatgcgcaacggtgggtccctcttggatggccagatctcagcagctgtaccagttgtggacttctctgcccgacttcaacccaacgagcacgcaatggatcaccgggtgtcattcgagttgaccgtcgaagatgtcgcgcgctgccttgagaagaagactgcaatctccggggattctggcacggcatcattccaccttgcaccgaccggcagcggcgaccaccacagagaatccaacgaggcaagggcagggctctacgtcgacgaatcataccatgacttgcccgagaaagcgaggcggtccctgtccctgcgcctggccaaagagttcaatttcaacaacgtcgacgtcggtagcgtggagccgagcgtgggatccgactggtgggcgaacgagaaagtcgccgggatgacaactgagccaaaaaagaactggtctttccacccggtggtgcagcctggggtcagctaacctttgcactgaccataatgatcttatacagggatgaaggaattagcttcttctgcttctgcttctgcttcagtggtcgattccttagggatgacttgccagcttgttctaaacatgcagctagtggtaagttctggatttagatagtaataagtaatggggtgtccaccgtctaatatcgtcatgggatactaaaggtttttattctgggagatgtgacaaaccgcaaactctttggttaggggtcggtcggaactgtcctgttcgtctgttttatcctgataccggtgctgtgttgtgtatgtacataatgaagtagttttttttaaaaaaagtcaattaaaagggtagaacagtttccttcgataagttgccagatgctaccaaattgcttgtgattgttccctgcctgttcatgatattgttattacagtttttgcgagacaggattcgtcggggatttttctttttgcatccgtaccggaggttacagggtcccgcggtggctggagctcgattcaagaattgacagcgagatggtgggacccgctcaacgaa

SEQ ID NO: 19256 - DNA, 854 bp, Zea mays
cattgggtacctcgaggacggccggggaacagcttcgcagcatcgcattcttcctgctgctcgcctgctccagaatgttcccctccagctccgccaccggcccccgcttccttcgccccttcaccgccaccgcaccccgccgtgccatggcggcatgcacgggcgccccaagcgacccgccgatgcagcagtcttctcccaccaaggcggtgcgcgtggtggtgaagggacgcgtgcagggcgtcttcttccgggactggaccgtggagatggcgcgctccctggggctcgccgggtgggtccgcaaccgccgcgacggcaccgtggaggcgctactctccggggacccggacaaggtggacgagatggtgtcccggcggatccccgtcggcccgcccgccgccgtcgtcaccgctgttgtaccctcccccgctgaaccggtctcccccgacgatggcttccaccgcaagcccaccgcctgatttatggctggttcatcggccatccgtggggcgtggtcattggcgagcggcgccactcgcctgtggtaatcaatctactgaagaactctgagagaacacgtacattcttttcctggagattgctagcgctaatttatggtgttgaatcaataatctcaatcttgacgatgagctgcttcgatgagtggacaaggattgtgactgctcgatacactcggttcttgtgatcatgtcttatgcagccctgtgaactgtggtgtttctgacaactatgccgtgcctgtaattattatctactatgttccgagagaaacggttatgtatggcttatttgcgcttactctgctttaaaaaaaaaaccctcgtgccgaa

SEQ ID NO: 19257 - DNA, 1234 bp, Zea mays
atctgcagaaaggggatctccgattcgcacctccaccacctgccgcgccggccggcgagcctcttcctcttcctccggtcgctccccttcccatctccatcttgatttcgattctctggtggctgggaaagcctgcgagagcgcgataaccggaaagatctgagctgctgcaaccgatctccggcgccatggggttcctcgaggacttccaagccagtgttgaagcattgccatctatgctgcatcggaactattcattaatgcgagagttggataaaagtttgcatggtgtgcaactagaaaatgagcagcgctgtcaacaagaaatagaggacattaagcatggacttgaatctggaagtattacatatgacccagcaaaattgaaattttccgaagaagcaatggaggagcagaaacattgtgttagaattgctgacgagaaggtggctttagccactcagacttatgacttagttgatgctcacatccaacagctagatcagtttatgaggaagcttgaagaaatccggcaaggaaaagaggcagctgctgctgttactgcagggactgctgttgctactactgccactccaaccgtgaatgctggagcgacaactgctgatgctaatccgaagagtggacgatctggcgaaagaggcagagggggtcggaagaaggccaaggtacccacggagcagtcagtgccagtgccagtgccactgccacctattgacttagagttgcctgtggatcctaacgaaccgacatactgcctctgcaaccaagtcagctatggtgagatggtggcatgcgacaatcctaattgcaaaatcgagtggtatcactatggctgtgtgggcgtcaaggagcaacccaagggaaagtggtattgcccaaactgcatcggattccagaagaagcgaaaaggcaagtgatatgcagtccacaggctgctgtgctagtgtgtccttgcttgttaattgtgttgctgatgttgggtaacaaatgtagtagtagttgctgcctgtgacagtgcataccgttgtagatccagtgttctgtacatgttactcctccttcggtgctcgtagtttagggccatcaaccatttgttaacttcatggcctttttggcgattcatgccccttgtatgggtttcgcaatatcatgtctccttttcctggtaaaaaaaaaaaaaaaaatacagccggtttgtaattttccctttttt

SEQ ID NO: 19258 - DNA, 11444 bp, Zea mays
  misc_feature (4628)..(4628): n is a, c, g, or t
  misc_feature (5129)..(5129): n is a, c, g, or t
ctcctcctagtcaaaaatgactatgcggggatttaaacccctcccaatccccctctggattggtgtaaccgaacaagctctaaaggggtacaagatcagcctttggaaaaggccacgaagcaaaagcatccgtgctagcagctggctggctccgtagtagggacagtttgacaccgtgcgttttcggagccggtgcgagtgatttttgtttggtgttgtctgttgtgtggggacgtgtgcgcacggccacagtacgtaggaaaaccggccgccgaccgagaatcgaccacgtgtagtacatgtacaaggtggatctgacaggcgagaggaaacttgaggtaccgcgcggtgtgtatctctctagcttatccattcgacggcacgcaggcaattaagccacactgcaaatgcttggtcggctgatcatgtgacagtcgccgctgaaacttacgaattcagaggttcatgcatcaagctcagctcagctcagctcgccggccgggagtaagacccagatctttaatttaactagaccagctgctagctagcagataggggagccgtgcgttcatctggtcggattcacatgcatgcaccctctctctctctcttttactataccccggcccggccgaccgttcgatgattcaatactgctactactatacatcgtgtcttgcactgcagtgcaggcgtgcatggtccatgctgcacccagaacaccgctccccaagtcatttacccagcatggaccatctcatgttataatatatatatatacttggtcatgcatatctatcttggcgaataaactaaagtaaaatcttagcccctcgatcgtcacaggattccttcagcgaaacagcaactcgagaaaaaagaacatcagtaccggatttgcatgcaacgactactgatcaaaagttattaacgacaaaagacaagtgaaggactagcagtaactattaacgagacgccgtacgtcttgggagttgggagagatgttttcagctttcaccgcacccggcccccgggtggactacacgacgctacactggtgcagacgcaaccagacgagatcaggtaccgccgtaccggcggcaactccccctcccgacgaaacacacaaccaccgggctcgtacccgtcgtcggtggacggtggagcatgcaacgcgcgtgcgtgtcctgtgcgtgccggccggccgtgactttttattttttgttttttggcagcagtcgttgcttgcacagctcgtagtacaagcgtgtacacacgtacgtgtgcctgagggtaagagagagtacccgcgccgcaactgcccagcgagggaagaaagagagaggtggttgcttgtgacgtcgggcacaggcacaggcacaggcacaggcacggcacgtgtgggagcccacgcgctgggactgggactgggatgggaagcagcgcatgctgcaaccggccggggccccatgcatgcatgcaataaacaccgcgacggcgacgtgcaacttggtccgtccgtcccgtcccttgcgatcccttctctccgtcctactactacgtaccacaccgttaccacactgctgctacacgatcgagctagcgaccaacgagtagctgtacgtccgtccattgcctactacgtactgtaccggcccgactccatcgatcgtctctgcttcacgtacctgctgctgctgctgctgctgcagtgcagctttaacggtcggtcgctcgtacagtaggtccacaaatgtaggagcgcgcgcgtcgcagtcgtggtacacagtagtacgatatataactgctgctgaggcctgaaaatatcgagccctagagctagctgactagctctggctccagacgcaggcagtagcctattagagccgtgtagttgtaaaaaaatggcagatgtgttcctgccgcagcattgccttcttttttcagaacgacgacggaggcggaggcccccgcgcggacagtggatcgatcgaacatgactttgcagagggtccaggccagtccagtccagtccagtccagggggtccgggcacacacacgcaactgttcctaattgcctttgccgtaccatctgtagcctaggcccccacccgggcccccgtgggcaagcttattaaccagagactagctagctcgatgacgctcatacatactactacatgacaatgcaaatgcaatgcatgccatcatggacggacttgcatgcattgcaacggcgtcgtcgatcgtcgttgatggctttcgcctacagactacagttacacagccaccccgtgcaaaccggaaacggcagagggatagcatccagaaagcaggggtaccggcatgcaccccttacgcgcgcacgcgttatccgtgagagctgctactagcctgtgacgtacgtgagctcctctctccttgcttgtggtggtatgcatggtatgctataggcggcagagcagctgcgtgcatcgacgtcgatcactacggccagtccggccggtcgatcacttggccagtacgtagctagcacggtccacgcgcgggcatacacatgcatgcatggagtgaccgacacgtacgtcgtttcctgcatttatatatcagctggacggcatcatatcgggatcggagttactccttcccccgtgatcggccgttttctgttcggctagctggtccggtcgtcttctcacaagcagctaggccaccacacaccacacgttgttgtgtgtgtgtatagtatagtcgtagacagtagatgaattaaataaagagatagggccggcgtaccggtaagaaacgacatccatggccgcaccacccgcgcatatgagggtgtcgatcgatcgggcggggacgacgacgacggcccagccagccagccagccaggggcgacaggcgtacgtgccggtgtgacgcgatcccacgccaaggcggcatgagcggggatggaccggccagtgggtaggcgcccgacctcggtcgccgtcagcgaggcgggcacgcccctcacatgggcctcccccgcccagccacaagtggcagctgtctcgccgcgcggcccggctccaccgcggcctgcctgtcacgctagcgaagcaaaggccactaccagcgcgccccagcagcaccaactgcgcgcgcccgcccccggcgcgaccggccggccacccgcgcgccgcatgtcgtggccctgtctggttctctcacacgcgcccgaccgcgcgggcaacgtacgtagccctcagcgcccccgcgcctgctctagctagtgtgctacgccagcacacacatgcttgtttcgctctccatcgacggacgcgacggggccagcagccagagcaacaaatgaacctagctagggccgcccccggcctgtcgtgtcgcccccatcgacgacgaccccgtgacgacgtgatggccaattcttttttccccttctccccatttctttcttcgttcacgtcgatcgcatgaacgccagccagcccagctagacaccgcgcgcgggcgcggcctgagctggtgcaggaggggcaggtaacatcccatgtacgcgccacgcggctgtcacgtgaacgcgttgggggtgcctgatgcatgcatccgacatggcagcggcgcggggggttccacgtcgggtccctccgagatttgcgtgcgttcagtacagtacagtagacacgcgcgtggccagcaatcgcatcatgcatggacgtggacaaagtcgagcgttcgtgcgctagctagctacgccgatcgtcgaccgtgctccttgattatcgtattgtggcatctagctggcattagcatacaccgtacctcgatcggctccccccgtgttagttagttagttagctgaattagatgctaagacagtatcgttggcgacaacaccggagtagtctgcacgggaatggaggattgcgcacgtatgctaacagattcagggcaccggggacaggccgggggggcatcttttgagtctcccgctagctgtgtggtgtcctgttttcttcagctcatcagctagcagacaatgtaagcatggctatgttttattaagactcccgatgattagagtcgctgtcgcccacgtcaacttagcagtacagtaatacgtgctccgtgtcgcttactggcttcacgtctgctgtgtgctgtcctacatgcaacctatcagttagtagcatgccggtagtagatcctttattgcctacataaattagcagcatgggtttcgttaagaagccccgagtctagctaaccatagatccttgatcgtctaggttggagacacagaacttcacacgtcgcctgctgccgcgcgcctcccacttgcgctacatcacgtataaataattaggagttagttatcattctgatgtgttaaagctctttttatttggctaaaagaggaaagatcggagtaattaatttagaaaaaaagaaattaacaacttaaggtcaatttccatactctatcgaaatacacagattagattttacactttggattccgatcgagtaaacggcttgtcagatcactcgtgttttgctattactttattgatctctggatcggtcaacactcgacatggctgctgcctgctgcaggtngctggctcgatcaaacgagggcagagagactacaggcatgtttggttcactacctcagttgtcacaatttgcttaaactttctgcctaaggttagttattcaattcgaacgactaaccttaggcaaagtgtgatatatttaggcacaaaccaaacaggcccgcactcttcttctctttccgtttgcaatgtaaaaatacacaccgcaacccagctcgggcacgtggcaagtggcgggtggtcatagcatattatagctaccctggggcccacgggctcctgcctaccggtgggccacgcttgagaggaggagctgccgcggtgattagacagagagagagagagagagacgcggggccccgaaactcgccctctcccagtctccccagtactcccccgttctgcagtcgagcgaatcggtactaataatctactacacacacaccagcagcaccatccttgcttcgtctccgctacgcacacaatataatggagtccccgnttccgctccaacccaatctggatccacccccgccccgagccagctcgctataaaggcacccctctccctttctgtctcccgcgcagctcagttactcactccggcctccagcttttcctttgcgccccagggccggaagagcccacacaccaccaccaccactagatagccagcgacgatcgagccgcgcgccggtggacgcgcacatacacgcggtagcttccttctcaagcctagctagccccatcctgcgcgcaggcggcggcagcgagaattgacgtgcgacgacgagcttgtgcttgctagctagagagcgaggatgtcgagccggaggccgtcgtcgcgtggcaacatctccgaggacgagatcaacgagctcatctccaagctgcaggccctgctccccagctcccgccgccgcggctccggccaggtgcgtcgttgcgaacacacatgaccgctcaactaattaactcccgttcgcctgctgcgccctttttttccgttttaaaacgtctaatgcgcgcggcgcggaatgtaatgcaggcgtcgacgacgaagctgctcaaggagacctgcagctacatcaagagcctgcaccgggaggtggacgacctgagcgaccggctgtccgacctcatggccaccatggaccacaacagccccggcgcggagatcatccgcagcatcctccgctcctgatcgcccacgcgcctcctactgcggcggcgccggccggcgcgcgagagagcgaggtcggcgacgacctcgatcgccgacaacgacgaccgcgcgcgcccgcgccccccggcccatctgttctctccaccggctggccgccgggagccgagctcaattagctagggtatatctcaacctctctctctctctctctctcgctcgctctacatgtgtgtgtacctttctcttcctttcacctgcctgtctcctccctagatctgagatcatgtggctagctctcccatatcaaaatgtactagctacacgcgcacgtatggtggtctctgctaagcctaagcttcactgggtagtagggtactagtagcactaggggcttaagcaagctaagcttatcctcctcatcagaatcacattagctcgcaccgcactctctggcttctcgtcgatcgtcttcgtcgtcctcgctcctccgacccacatgatggctagctctccatgtgccgcttctcctctcgcacgtgccgcttctcctcttgtgttcgatatgttgtattgtttccatgtaaatttagtcggtggcctggatcgagttggctagctctctctacaggcaagagacaaccgaccgaccactactatcctagagcaaattgattatcgtcatgatggtgtactgttcaagcttttattaacgacttttaatttacttgctacgtacaaaaaaaaaaaaataccagaaatgcttttgtgttttttttttctttcactcagggtgccatggaccatggttaagagatgcaaccgctgtgtatgtactgtagtactagtatgcagcgaaaacgttgccctgcctttcatattggctgcttcgatcggtccacttatttggttccgtacggtggaacgtgaaacgacgcgtttacttcacagtgcctctgctacttggcaagcgtatgcatggccgtggacccggcgcgccacgccgcacgccgtgcgctgtcacactcacactcttgctgcgcgcgtacgtcgtccccggccgccaggcgtgtcgacgatcgactggtattggcgatgctacgaatgctagcgactagtgagctagtcgacgacgagctagcgtacgatcggtgcatggacgatcgatcgaggacggtggccgtacgtcggcactcggcactgcgcgctctaggtgtgcgcgcgtcgacctctcccccctcccacttggacttgtcccttcttttaattctcacgagcctgaaaggaatcggtgagcggatccggaaagggctcacgacctcgcgtcccctgagtagtagtagctagctagcgcagtcgtcgcgcgctgtcttgaaatcatcacccttttagccgatgatcgatcacccgttgcccctccgccacacgcaccccccacatgccgtggtcgatcgatcggcggcgagatgaccgacgtgagagccccgcgcccggccggggcgtccagaagtcacacgctattgcgagcttggtccagcagtcagtgccacaaacaaatggcgcgcgcgcgcggcttccttgctatatagcctatagctgtccagctctgcccgggcgggctggctagccaggcatatccatgcgtagcacaggaacgtgcgtttggccaggccacaacgtacacgactctttcgtacatgcgtgagcagttccacttctatgttatttatggacgcatgccagtgtgtcgcatattatcagcaatgaagtccgtttacgtactcgctcacatgatgatgggcgttcacgcgcacccccgcccggcaccgccatggctaaaagtctgcaaggaaacccccatgccaccaattcgacagtagtgcgcgcgtgcgtacgatctatatgtgcgctaataactagctagaacgcgcgacgggcaggccaacaaggacacgacgatcgagaagcgaaaacaagcaacactagacacccctctctacttttgaaatatacaagagattcttgatttgtctatagagactgatatgcaataatagtgacatatatcgcatctgatagatagaatataaggacatatatattttataacatatccagcttaatctatatcgtaaatattgttccaatagtagaaattattctttatttacccttataactctctgattgtcttaggtttgaccaacgtatatgactaacatctactactgtagggttctttggcatggctctttgggtagctccagctcaggctcattgttaaaccctactaaatggttaaaaatggttcctcgacgagagcactcgaagaggtagagccgttttcgtgttgggagacaacacaaaaaacgtggcttttaacgactcctccatctcactgatatatcatgtgaaagaaacactagagaagatgttttttgacaaacgaatttgcgaaacagctccgcctccttccaaagaagccagacaacatcttggttcatggacggcctcgacacgtcgtccgagctagcagcaccgggtgcaccggtcggccagggagggcacgctggccatgtaccctggtacttaattgtgacttcagatttaataaatcttgagaaagtgtttagaaaaacaataagatctaagcctggttttattggctctaaggttatatatcccccaacaggctcgctgttccacctcatatcacactctatatttccaacttgactccgtcaaaaatattatttgtaggataaaacagtattttacccggctcagcacggcccaaaagggtttagagctctcccaaatatgtattctatgatttcttttttattgcagtgttagttgaacctaggtacggtacaagctaaacctagggagtactttgcgtttggtcgatctaagcagaggctagcagcgagctagggagcggtgcagtaactagcactgcgaaaggcaggagccagaagaggtccatcctccaattcatcagtggccgtctgatccacgggcagcagtagcaggtagctgcaccagccaaccgtcgtgtgaataatactaacatactactaataataaaaatatcggtcctgcgcgcgtagtacgggcgcgcggtcaaaaaaatgcgaggacatgcactgctctttcctctgctgcaccctagtcaagatctgaccactgaaagctagctaacgactggcagaggcatcttttcacatgagaaagtggcatagtaaaatctctgtccggcactttttttaggtctggaccagcctactctactccatcataaatcatgtgttgcgcgcatcagttgccgtgtgcctccgtgaaaaaaaaatttcaggcggcccgcagaggttattttcttggtcacaggctcacagcttttatgtgatagcgagaaacgaagactggtggtgggtggtggtggccggctcgatggagacagacacccgttgttgcatgtttgcgtgttgcgtgtgcgtcatgtaccgatggatcggaatccgcttgcatccgcgcgcgaacgatattcctgacacatgcacttgtgcccaaaagtctcggcggccagctatccccctgcagctttccaactagtagaaatgattgcccgttctttgacccaacacggcactactagcaaagccactcgatcgccgcacgaatccgtcggcctccgatccctggttcgcagtgacaaaactgcgacgacctgtgtacagtgtacctggtgatcatgcatgtacgtggtatcgcagccgtgcagctgctgcatgggtgtgtcgtgtcgcgtgcccgcccgcctgtggaaaatgtgcgggggcgcgcgcggtggatcgtcgtccaccgcaccgcgcgtcacaggcgcgatatatatcctagtactccatcggagggcaaggacagcggcatgtgccgcggcagtgggtgtacgcggccgtccccccggcccgcggctgcggtttcgtggaagcggccggcccggcgctccgcaggcgcagcgtcctgggctgggactggaaggaagtgggggagaaggaccgggcgctttcggcgggcccacgccggcgggcggaggggactcgtctaacggccggcagcccctgcggccaaccagaaaccaccgccggggccctgcgccgtgtacggcagcgagcgggcgacggttaaaaaagaaaggctgcaggtagggcgaggctccaggcctccaggctcgcgtccgcgcaggtttggttgattgacaggttgaggcgcgcaatgacggggccgcccctacccggtgcggcaacagcatcggtaaaaaggctagtacgccgcactagcactccctactccctaggggcggaaccgcgaaccggagagcctgaacgaccagtggaaaacaaaaaaaaaaaaaactagcgcgcggcagtggcgctgacgcgatcgcgagcgtacctagcagcctagtgggtccgtccggtacgaaaggctacacttgataaaagttctgctgtagtagcaggaggagaaccaacgcgtacagatttgcacgtacgggccgcaccggtacggtactgctaaaaaactagctgcatgtcctgcgtgcgtacagcgagaactagaaagcgcgcaattcgtccctgcacatgcagtgtccgatgtcttctccgagaggctacggcggggtcgagcggtcaagcgctcgtcgtcgacaacagtacgctgatgagtagtagtagtagtagatgtcatgtcacgttctcttgtgcctcgcttgtcacagcaccccatgccctgcaacggcaacggtctggaagttccatgccctgctgcccgcccaaccgcagcctcggcgtgaccgcttctcgggagatccgggtgtcaggtccggcgccaggggagatcggcccgaggagggagatctttgaccgtgtcgtgctcgtgcccgagcccgacgatcggaaaacacacggcagaggactcggaggactctcgttctggaactgagcaggtgccaggcaggcaggccacagcttctctgctctctcttgcccctttcccgtgcctcgccctgggttcgcttcactgcaggctgcagcacgccgcgggggggagcgagcagccggtcatgggcggcccgcgggcagcgggctgctgcgtcctgcggctgcttccgcacgatcccttttgacttccggccggtttccccgcccgtttccatccgtagatgccgccagcagcgacatgtggcctggacgaaccaaactgtcccgcagcttctctgcgtgttttttttttcgttggccgaccgaaacagagggagtgaccaccaagacaccaaacgaaattatactgacaacagtggaagcaagagaccgagtgtgtgttttcagacccttattaggaaattaagcaaaaaaatctgactaaaaacacggttgcaaccattttggtttcagttgaaaaagaactcacagccgcgtttctgcgttctctgtctgtggggctccctccagccaaaaaatagcaaaagtttttgtcagaggtcagagccgcatccgcatgcgtcgctgaggcctcaaggtgatagcgtggccatctgcagtccgccactccatcgtcatgtgattttag

SEQ ID NO: 19259 - DNA, 1775 bp, Zea mays
ccggccgggagtaccctccgggctggccgggaatctggatccacccccgccccgagccagctcgctataaaggcacccctctccctttctgtctccctcgcagctcagttactcactccggcctccagcttttcctttgcgccccagggccggaagagcccacacaccaccaccaccactagatagccagcgacgatcgagccgcgcgccggtggacgcgcacatacacgcggtagcttccttctcaagcctagctagccccatcctgcgcgcaggcggcggcagcgagaattgacgtgcgacgacgagcttgtgcttgctagctagagagcgaggatgtcgagccggaggccgtcgtcgcgtggcaacatctccgaggacgagatcaacgagctcatctccaagctgcaggccctgctccccagctcccgccgccgcggctccggccaggcgtcgacgacgaagctgctcaaggagacctgcagctacatcaagagcctgcaccgggaggtggacgacctgagcgaccggctgtccgacctcatggccaccatggaccacaacagccccggcgcggagatcatccgcagcatcctccgctcctgatcgcccacgcgcctcctactgcggcggcgccggccggcgcgcgagagagcgaggtcggcgacgacctcgatcgccgacaacgacgaccgcgcgcgcccgcgccccccggcccatctgttctctccaccggctggccgccgggagccgagctcaattagctagggtatatctcaacctctctctctctctctctctcgctcgctctacatgtgtgtgtacctttctcttcctttcacctgcctgtctcctccctagatctgagatcatgtggctagctctcccatatcaaaatgtactagctacccacacgcgcacgtatggtggtctctgctaagcctaagcttcactgggtagtagggtactagtagcactaggggcttaagcaagctaagcttatcctcctcatcagaatcacattagctcgcaccgcactctctggcttctcgtcgatcgtcttcgtcgtcctcgctcctccgacccacatgatggctagctctccatgtgccgcttctcctctcgcacgtgccgcttctcctcttgtgttcgatatgttgtattgtttccatgtaaatttagtcggtggcctggatcgagttggctagctctctctacaggcaagagacaaccgcccggccgccccggtcctagagcaaattgattatcgtcatgatggtgtactgttcaagcttttattaacgacttttaatttacttgctacgtacagcacgtacgtcctacgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttcattccggcccggtcccgcgggaaaggggaagggagggacccccgaacaaagaaaaacgggttgcccccaagttagggccaagggcaaggggggggggaatgctcggggcccgggcccgggggttaatcggggggggggaaagcgggggtgttttggggccccaaaagggaaggggggcgaatttgggggggggccccccggggatcttaagggggcccccgcccacggggtggggttgttccaacctgggggggaaggagccgggtttttgccagaacgggggaaacccggggaaaagaagttaattaaaaagccccaaggcccgcggaaggtt

SEQ ID NO: 19260 - DNA, 1450 bp, Zea mays
gcacgagaccattacctagaacatcctaatcaaaagaaaaatcgccatcctgttcccgctgcccgcccgcccgcttgtcactggcctgctggagaaccttggattggagtgtggcgccacctgtgtgacttggagccactcgtcgacccgccgtcgagcttgcaccgttgaaccgcaccgcagcggcagcgcacaggctccagagcccgtccggaacatggcgaggaggagcaccaccaccctggaggacctccccgccgacgtgctggcctgcgcgctgcgccgcctcgacggcccgtccctggctgccgccagctgcgcgaccgcgggcctccgggcgctcgccgccgacccggacacgtggcgcgcgctctgcatcgcgcggtggccgtcgctggccgctgcgcgcccggacctcctcctcgcctcgccgcagcgcctcttcgccggacgccttcccgttcccggccgacgacagcgccacatcggcagctccccccatggcccaagccgagattgaggctgagccgctcccgagcggcatcgtctccgccgtggacgtctaccaccgcggcgagccgctgctgtcccgcgtcgtggagacgtgcgcgtcgtcctcgtggttcctcgcctcgcccttccgcgtcgacgccgtggagtgcaagggccccgccgtgcccgtcggccgcgccgccgccgccgccgccccggcggagctggagctcagctgggtcgcggtcgaccccggcagcggccgcgcggtcaacgtgtccagccgccgccccgtcgccgtcgacaggcactggtacacgggcgacacgctgctgcgctacgcgctcgtgctcgccgggtgcaagttcgaggccaccgtcacctgcgccctggagacggcgcacgtccgggagatcagccttaccgtcgaggacgccgacggcgcggcggtcagcggcgaaggcgccatgcggctgatcgcggcggccatggtggggccgaggaagggagggcaggaggagcaggaggagacggccaggcggaggtaccgagacttcgtcaggagcaagagggggaggaaggagtccaaggccaggaaggaggtgctcgtcgatctttgctgctccgctgtcagcgccgttgccgttctcagcttcatcgccgccgtcgtgctccggtagacctactggtctgccggcggtgcatcgcatcctcaacaacgttgttttaggagttcttaccatcgatcatgtaaatacaagagtacttctgggagagttctctttagtccggttcacccaaccgtaccgaggaagtacaagagtactatatatctttctttcaattaggttatactcctatttaggcacaaaaaaatgtgatacagtatctacaacaataacaatttttccaatgtaaactcaacctgtctcttctttttgcaaaaaaaaaaaaaaat

SEQ ID NO: 19261 - DNA, 1231 bp, Zea mays
ccgtaaggactgtcatttcgtctgcacctagttctgaccgaaaccgaaccccccagcctacaccacccgctgtcctgatggcgacggaccccgcgccggtgccggcgatgcgctgctactcgctgccgccggtccggctccccgcggaggacattctcttctgcgtcgacgttgacctcgaggcccgcgccgagatgaagtccgccgccgccgccgcagcagcgtcctcgggctccacctccaccgcttcgccgcagccgacgcagcccgcgggggccgggggtgccccggcggcggggccccggaccgtggtcaggcggatggacgcggtcaggcaggcgctgctgctgttcgtccacagcaagctcaccatgtgcccagagcaccgcttcgccttcgcctccctcggcgagacgttctccatggtgaagaagggcttcagcagtgatgctggtttcgcaatggaggcaatccattccttgtctgcttcagaaacaagatatgctatggctgatctgacccagctctttatgacagcttgccaggaagggaaaagagcagaatcgcaaggccggattctccgggtggtgctcatatactgccgttcctctacaaagccacagcatcagtggcccgtgaagccaaagaatttcaccctcgacataatctatctccacgacaagccaaatcctgacaactgcccacagaaggtatatgatgccttggtcgatgttcttgagcatgtcagccagtatgaggggtacattctcgagactggtcaagggcttgctcgcgtgctctttcgtcagatgtgcattcttgtatcccatcctttgcaacgttgcatgcaagatgaccttgatattcccaaacaagtcgctaagaaaatcgtggcagccgaacctgcacagaatgaagatgccgctccagtctccagccaacagtagggtcttctagttgaacggtatgcaaacatgaagttactcgcaagcggttggcattaccgttctactagatcagaatgcctgttctgtgtgatggagattccatcccagaatttgtgtactatgctttaactgtccaaggagtcatcctcttgcccccgtcccttgtttgcttgggtattcagcatgtagttgcacatgatacagataactcaaatctttggcacttgaatttcatttgtttgcgaacttcaaaaaaaaaaaaaaaagccgccgcggggggcccg

SEQ ID NO: 19262 - DNA, 727 bp, Zea mays
gcgccggctcgccttccaacgcctgcaaggcgaaacccctcaagggaaaggctagcagcaacgagcgcgcgtcgcccagccctactcagaggcagcatcagcaggacccacgcgtccgcccacgcgtccgggtgccgatggtcgtcgagcttgagcacggcgaggagtccgccggcagccacgaccaccaccaccaccacttgcagccgcagggatcgtcggaggacaccgacgtggaggccgcctcccacgtgagccaggccgaggccgagccgccggtcagcagccagagccaggcgctggtggcggaccaggagggagaggaggtcaggctggagctcacgctcggcttcgagccagtcgtcaggcagcagccgaggctgtcgtgctgcgactcgagcggcttgagcgccgcgtcgagcctcatcggcctgcggctgcagctgccagccgcctgagcagaggaggtcatctcatttcacaaggcacagtggcacaccaagtgcagttttgcaaccaatgcggtgtttgcttaaagaaaaggttttggacgccgagcagccgactatttcctaggttttgttttttcattttcttttcttggctgtaattgtaaaggctgatgaactgcacagttttagcgtcgtcataataggagttttgcaattccatatgagattataagctattaaaaagtttgattgataaaaaaaaaaaaaaaaaccgc

SEQ ID NO: 19263 - DNA, 1002 bp, Zea mays
  misc_feature (1)..(1): n is a, c, g, or t
ntccccaccctcgcctccggaatcagatcagtcgggccacacaacttcctactcgagatgtcacagacctgagtaccttgaggtcatggctgaacttcccttgggcacacacaatggaatatgaaatatacaaggccacaaattctttacgtaattactataaggtgggaagactgaaaccagagaaggctatccctgatactatacttagacaagcaaaaggtcttgctattgttactgtggtgaaggttgggatgatggttacatacaaacttggcactgggctagttattgctcgaagggtggatggctcctggtcaccaccttcagcaatctccacctgcggtattggatatggagctcaggctggaggtgagatagctgattttatcattgttctgaggaacacggatgccatcagaacattcagtgggaaggcacatctgtctgttggtgctggtgttagtgcttctgctggccatgttggacgtgcagctgaggctgacttccgtgctggtgatggtggttatgctgcatgttatacatacagctgtagcaaaggtgccttcgtgggctgtgcgttgaatggcagcatagtatcaactcgagatactgagaacgctcgattttacggaggtcctgtcaaggcatctgatatccttctaggatcaatggcgaagccgccggcagcctctcctctgtacaaagctctgtcagaattgttcgacaagattgggaaataatcctctttcttgcataccttgcctcaccttgtaaatacattcgaatttgcgtagtgaattggttggaagcaattgcataactgtacagtaaggccattcttggacacatcagaaggctccctgccttcaccagtgtttagtggataccagcaacaaaaccactctgtacatactttacattggattgacagtcgtatcaagatgcgaaaaaaaaaaaaaaaaagtatgattattgattcgaattacatgggtagtacag

SEQ ID NO: 19264 - DNA, 2193 bp, Zea mays
ataccgtggaacatcgaggcattgacccctcccccaagccacaaacaatccatctcctctgtcctctccaacacctggagaaaccactccaaattgggcacctgagcgccccatggcctcatcccggatccccgatgcactggcggcgccggcgctaactccggcgcctgcggccgtcccgctgaaggtgcaggcccaaaaccctagcattgcccccgccgacccgccgtcgcccgagatggagaccacggcggaggcgctcacgcgggaggaggtcctccggcggcgccggcgccgcgcggcccggctagccggtgtgtaccgccagctatactgggccatggccgaggaggtgcgcgcgcggcaccggcagtacgtctgggacctcgcccggagcccactggaggcagagcagccgccagcccctccaggagggcccatcccggcggccggggagcttccgaggctggcgccggtgccgaggaggaacaagtgcgggttcccagggtgcaaggtgcgggccatggccacgacccgcttctgccactcccacatcctctccgatcccaaacagcggctgtacaagccctgcgcgtacatcaacaagagtgggctacaaggtgggcttatcccctgtagtaggccgatcataaagtctgcagctccctccctctgtaatattcacttgcaaaaatgccagaaaaacattgcacaagcttataagaaggttggcttgaacccaccccttacaggcaaggtcaccctaaagttcagtgttttggttgctgaatgtgttcgtcagatccaagacaaaaggagaaatcactgaaagctacagcacgatagaaatgccctaaagacggaaatgttgtctgaaccatacttcgatgtacatgtgtgtacaagcttcataagatttttattctgaggcatccaaagcagtgataacgtactctctactctgcaagattacaacagtcagtccttgttgaatgatatgaataatggaaacttgcattgtatgcatgagttgaagattaaagtgtcattggaagaatggatctcacgggaatagttgtcagtagcatatttgaaatgaaaaattggatcgacaagcttgggggaggatcaagtatagaatcttaaggtgttctatggtctaatatttatcaggcagtctttatcatgagctttgctagttgctgaacatgcagtaagactgcatggttgatatggtggtgtttgttgaaatataatataagtgaatttaccacctcttcatatcagattaaacttttggatttaactgattggtgcatgcaacttaatatgatgttggagtcagaggtttcgaattcaaatcctaattagcgcaattaaaataaaaataattgttgctcactcttattccacatctgagaccgagaaaaagtctggacgtgagggggagtgttggaatataatataagtgaattgaccacttatttctattagctaaagtttttggattggactggttaatgcatgcaacttaatagtgttgaacacaatcagcttgtttctagtattgtacagctgcatgagaactggtgattgccaacatcaaacctacctacatgggctcgtatgaaaaacttgaccactcttaggatatcactgtccacatgttggtatggattccattttggagttacacaaatccaaattgcaacctgcatcacatgtataggtagctcggtatggaaatttgtgcatatttttggaggaaactgaatcatttcttgccaatttgagattcagtactggtgctttgcatagagatgtattaatgcaagatatgtacttccatggcaaatggactttgcacaatatgagatgctacttactgagaatgttgaacaacatgaaccaaagtaagagccttataaaacatccagctatgaggatactgcaggcctccttgctgtttagggctagtttgggaactctattttttcaagggattactatttttccaagggaaaatgaactaattttctttgcgaaaatgagaattccgtggaaaaatggggttcccaaactagctcttattgaacatttgttgctcggtactgtcataaaatttcaagatgttgcacaaaataattatccttggtggctttatggattgtagctgttaaaaaattagaatgt

SEQ ID NO: 19265 - DNA, 1016 bp, Zea mays
attgggaccctcgctatgtatatatataccaataagtgccaccaataagaagaattaaggtagaaaatgtcattaatgagaatggagagaggagacgaggagctgaagctgctgggcatgtgggcgagcccgttcgtgctacgggtgcaactcgcgcttagcctcaagggcctgagctacgagtacgtggaggtggacatcagcaacaagagcgagctcctcctccactccaaccccgtccacaacaaggtccccgtgctcatccacaacgggaaccccgtctgtgagtcgcagctcatcctgcagtacatcgacgaggccttcgccgccaccggcccgtgcctcctcccggccgacccctacgaacgcgccgtcgctcgcttctgggccgcctacatcgacgacaaggtgctggcgtcttggatgcaggcctccaggggcaagacagaggaggacagagccgagggaaggaaacagtggctcgtcgtggttgagacgctggagggagcgctgagggactgcgccgccggcaaggggatgatgatgcccttcttcggcggcgacagcgtcggctatgtggacgtggtgctcggcagcctgcttgggtgggtcagcgcaaaccaggaggtttggggcatagagtgcttccatccccgacgggctccgctgctggcagcgtgggcggaccgcttcgccgcactgcaaaccgtccacacggtggtgccccaagtcagcaggctggttgagctcggcaagatgttgagggcccgtcaatcggacggggccgctgccgaaagttaatctattaacaaaggcaatagatatgaaggtgactgtatatatagctagctatcaacgtaacgaaggtgccatcttattgtactcgcctctgtatggcagtgtttgctagaaatttactttgttttcgaggaagcggccccctaatcacccttattgacatgattctgataagaacgcaaacgcagccttagagatgaagccaacggcgggcgggc

SEQ ID NO: 19266 - DNA, 1023 bp, Zea mays
ggcgattgggttcctcgaggccccccagagaactgagccaaaagaaaaaaaaagagctactacagcaatggccggaggagacgacctgaagctgctgggcctgtgggcgagcccgtacgtgctgcgggtgaagctcgcgctcagcctcaagggcctgagctacgagaacgtggaggaggatctgagggacaagagcgagctcctgctcaagtccaaccccgtgcaccagaaggtccccgtgctgatccacggcggcaagcccatctgcgagtcgcaggtcatcctgcagtacatcgacgaggccttcgccggcaccggcccgtccctcctccccgccgacccctacgagcgcgccgtcgctcgcttctgggccgcctacatcgacgacaagatgctgcccgcctggaaccagtcgacgatgggcaagacggaggaggagagggccgaggggaagaagcagtcggtcgtgacggtggagacgctggagggcgcgctgagggactgcggcggccaagggaagcccttcttcggtggggacagcgtcgggtacgtcgacgtcgtgctcggcggcctgctcgggtgggtgcgcgcgtcggaggagctgcacggcgtcaggcccttcgaccccgagcggactccgctgctggcggcgtggtcggagcgcttcggcgcgctggatgccgtccagacggtgatgcccgacgtcggcaggctgctcgagttcggcaaggcgttgatggcacgtctggcggctgcggccgccgccggtgcaagcaataactgaaaagggcatggtgtatccgtcatgtgtttcaggttttcgtatagtgaacaaaaaaggaaaaaataatgctagctacgcatcggaacgcggctttgtgctttgccgtctcgccgttagttcagcttatgtgatgtgagtgttgccgtgcatgtgtgtgttacttcagatgtatcctgttcggttcagtgattatatggaacattttattttggttggataaaaaaaaaaaaaaaaaaaaa

SEQ ID NO: 19267 - DNA, 1861 bp, Zea mays
gcccattaacaaacccatgaatataaaattgatctaaatccatcccataatagggtaaaaacccatagagttgtccccactccgatgcctgtcggccggtttaggccagcgtgaaggtccaacgacgctcatactctaaaactagcactgccctcaatggctggaaataaaactataaataaaatatatagttgcgcacacactgtcaagaaatacgtcgataatgtttcgttgacgatggaaccaatgtcaaatttctcacttgtcagccgtcagaagtattgccagctgaccaaaaaataaaattggttgccgccctgccggcatgtgatgttgccgatttcttggatcctcgtgcaagcaataaaagccctctagattgttccaacagtctgtaaaaaaataagcgttcgagctgcatgctagaagtcaatcaaagcaagcaaaagaggtggcatctcagcagctgcagaggatgctctgcgttttttttttcatatataagaagatagactccccggcacatccctccgcagagaactgagccaacggaagaaaaaaaaaagagctactacagcaatggccggaggagacgacctgaagctgctgggcctgtgggcgagcccgtacgtgctgcgggtgaagctcgcgctcagcctcaagggcctgagctacgagaacgtggaggaggatctgagggacaagagcgagctcctgctcaagtccaaccccgtgcaccagaaggtccccgtgctgatccacggcggcaagcccgtctgcgagtcgcaggtcatcctgcagtacatcgacgaggccttcgccggcaccggcccgtccctcctccccgccgacccctacgagcgcgccgtcgctcgcttctgggccgcctacatcgacgacaaggtacgtacgcacgcatggcctcaggtccttctccaatcgattgcgtgaggcgcgcagcgcgcaggctcgggctcttgtataattgaccgaccgtgtatatacacacgcgttgcgcgcagatgctgcccgcctggaaccagtcgacgatgggcaagacggaggaggagagggccgaggggaagaagcagtcggtcgtgacggtggagacgctggagggcgcgctgagggactgcggcggccaagggaagcccttcttcggtggggacagcgtcgggtacgtcgacgtcgtgctcggcggcctgctcgggtgggtgcgcgcgtcggaggagctccacggcgtcaggcccttcgaccccgagcggactccgctgctggcggcgtggtcggagcgcttcggcgcgctggatgccgtccagacggtgatgcccgacgtcggcaggctgctcgagttcggcaaggcgttgatggcacgtctggcggctgcggccgccgccggtgcaagcaataactgaaaagggcatggtgtatccgtcatgtgtttcaggttttcgtatagtgaaaaaaaaaggaaaaaataatgctagctacgcatcggaacgcggctttgtgctttgccgtctcgccgttagttcagcttatgtgatgtgagtgttgccgtgcatgtgtgtgttacttcagatgtatcctgttcggttcagtgattatatggaacattttattttggttggatagctgagctcgtcagaagtacacgttcagtacaggcacattacttgcttggataacatggaacgatacagcagagggtgcagcagctcacatatcacaattcacaactatggcttcaaacaaaacgttgagaactggtcaaacctgtttaataaattgcgcatgtaggtagtatgagagcgaaataatgaagttcagttagcaagcgaaataaaacgattgtggcaac

SEQ ID NO: 19268 - DNA, 888 bp, Zea mays
  misc_feature (8)..(8): n is a, c, g, or t
  misc_feature (10)..(10): n is a, c, g, or t
  misc_feature (25)..(25): n is a, c, g, or t
gtaccctncnaggtcctggccgggnaaaaaaaaaaaaaaaaaaaaaaaaaaaaaaaaaaaaaaaaaaagggcacgcaccaccattggacaacagggggcgcctcgccgccggcctgcactcgcacggacgagcgaggcagccccgcaggtcgcagccacaacccaagcgcagcgatctgcctccgctccggctcagctcccgccctgcctccgccttccattccgccgcgcggcgctgccgagtgccgacgtcgtccccgccggagtttctggtttctgggttggatctctcggagtcggagcgagcgaggatgggcggcggcaacggtgaaaccacccagctgggggagccactgctggcgaagaaggcgaaggcgtaccgccctaggtgccccggctgccgggtggaccgcctcaacgcggagcgggagggggtcttccctctcaaggacctcttcctcatctggctcgtcaccatcacctgcaccctgccgatccagtctctgttccccttcttgtatttcatgataagggatctgcatattgctaaacaaacacaagacattggattttatgctggttttgttggcgcttcatatatgtgtgggagggcagtctcctcaacagtatggggaatcgtggctgataagtatggaaggaaaccagttatcgtactgacccttattgcaatagttatcttcaatactatgtttggactaagctcaaactattggatggcattaatcacacgatgcctgcttggaatcatgtgtgggtatctcgggccaatttaggcttatgctacagcttatgctacagaagtgtgccgtgaagaatacaatcatctgggctttggcagatgcttcttcctcacgacgcattggtctc

SEQ ID NO: 19269 - DNA, 2249 bp, Zea mays
cattgggtacctcgaggccggccgggactcgtccgaggcagggtgacgccctgcacgcaccgccatataacaggaggcgcctcgcggccggccggcactcggacggacgagcgaggcagacccgcaggtcgcagccacaacccaagcgcagcgctctgcctgcctccgctccggctcagctcccgccctgcctccgccttccattccaccgcgcggcgctgccgagtgccgacgtcgtccccgccgaagtttctggtttctgggttggatctctcggagtcggagcgagcgaggatgggcggcggcaacggtgaaaccacccagctgggggagccactgctggcgaagaaggcgaaggcgtatcgccctaggtgccccggctgccgggtggaccgcctcaacgcggagcgggagggggtcttccctctcaaggacctcttcctcatctggctcgtcaccatcacctgcaccctgccgatccagtctctgttccccttcttgtatttcatgataagggatctgcatattgctaaacaaacacaagacattggattttatgctggttttgttggcgcttcatatatgtgtgggagggcagtctcctcaacagtatggggaatcgtggctgataagtatggaaggaaaccagttatcgtactgacccttattgcaatagttatcttcaatactatgtttggactaagctcaaactattggatggcattaatcacacgatgcctgcttggaatcatgtgtggttatctcgggccaattaaggcttatgctacagaagtgtgccgaaaagaatacaatcatctggctttggcagttgtttcttcctcacgaggcattggtctcattattggtccagctcttggtggttatcttgcgcagcctgcagataaatatccaagtatattctctcagacgtccatatttgggaggtttccatactttcttccgtgcctgtgtatatcaatccttgcagttattgctctaattgcctgcatctggtttccggaaactttgcataaacacaatggggatgccgttgataattcagttgaaaccgtagaagaatctcttgctggcaccgacactgaagaaaatggaggtggcggatgtctaaaattatttacaaactggccgttgatgtcagctattactttatattgtatcttctctcttcaggatgtggcttatgcagagacattctctctttgggctgtcagtgacagatcgtttggtggattaagctttactaccacagatgtgggcaatgtccttgcgatgtcaggtctcttcctttttctatatcaaatgttgatctatccgttccttgccaaaacggtggaccacatcacattagtccgtgcagtggcgttattgactctaccggttcttgctagctacccattctttccttcgttgtccgggttcgggctcatggtggtagtaaattgtgcatcttttctgaagaatacattctcggtaactaccattaccgtgttcaacattttgatgaatgaagctgtgactcaggatgtaagagccgcagccaatgggatagctgtaacactaatgtccatctctaaagcggttgctccagctgttgcaggaatcatattttcgtgggcccagaggcgtcaaacagctgcatttcttccaggcgaccacttggtgttcttcatactgaacatcttcacgttcatcggtttcgtcttcaccttcagaccgtttttcgttcgaggcagtgccaagcactgaaacatggatgaagcggacgacgacccatgggtatcctatccaggggcaatcgaatatagattttcttgtggcgtggccaagggcggtgccgagcctgtaccagtacgacgactcaggccagaacacacggcgtatggtatggtacacagcaaggccgtgttgttgctgtaagttttgtaatttctgtttccttctccggcttcgcagcatgcagttgctgtatatgatggaagaacactctgttactgggcatgttgcgcggtttccacgcgtgtaagtaatgtagaagtcgctatggtaggtatttccataccgtcattagtggatcattgattttttttgtaagaaggttattgcaatgccctttttccgggcatgaataagaaaaaggaaatatgcttatatgcatggtattaaaaaaaaaaaaaaaaaaaagaaatagggcaaaaaaaaaaaaagcggccgagaactggtgacatttt

SEQ ID NO: 19270 - DNA, 2757 bp, Zea mays
tgcatgcctgcagtgcaacagtatcttgaacaggtgttttgccgtttattatacaaactgagatttaaatgcttgtgcaataatacaggaaactttgcataaacacaatggggatgccgttgataattcagttgaaaccgtagaagaatctcttgctggcaccgacactgaagaaaatggaggtggcggatgtctaaaattatttacaaactggccgttgatgtcagctattactttatattgtatcttctctcttcaggatgtggcttatgcagaggtaagatcgcaacttgtttgctgagttgcttttctgttgttgtcacatatcatgccttttcctgtataagagcatccagtgcccttgttcttactgtatctgaatcgtgaaaaacttgcagacattctctctttgggctgtcagtgacagatcgtttggtggattaagctttactaccacagatgtgggcaatgtccttgcgatgtcaggtatgtcaaaataagcacaaaaacaaaatccattgaaactggtgttgaactaggcccacatgaagccctttacaccttaccttgattgctggcaattggtgtgaaaatagcctattatgattgggcgagtggtctcagagataggttttaacatctctgtatgatggaaactagcgcttcaaaggcctgctatatttttaggagcctagttaaaagcgaggatggtcattacccatttacctcagtaccctttgttttggtttgagaaagcttggagcaagtctcagcagcaaactgctgcacatgactaatagtgcacatatgtctagtttgttgtaatataattagtaatatatgctaaaacgaagaacaatatctgaggcatgtgaatgaaaacttacttggaactcagttatttgtatattttaaggtttgatggtctattgtactgcagagcgatgctagatatacttatgtatatgtattttgacaggtctcttcctttttctatatcaaatgttgatctatccgttccttgccaaaacggtggaccacatcacattagtccgtgcagtggcggtaaggcaatagattacctgttctgttttaaccatattctgacgcttcaattaactaaaacactcttatgtgcagttattgactctaccggttcttgctagctacccattctttccttcgttgtccgggttcgggctcatggtggtagtaaattgtgcatcttttctgaagaatacattctcggtgagtgcaccttttctgtttagagacacggcagggtttcactctgtgatgcctaagcaagccaggcttcctgtacagaacatgttgttcaaacaaattttccaagctttgcccaagaacttcacagggaagcttggagccaatggcagatgcttcatgcatgggcactatttgtgtcaatgattgttgagcatgccatggacttatttcaacttactgcaggcattgtcagttcaaaatctaagctgtgttcttctaaactgttttcaggtaactaccattaccgtgttcaacattttgatgaatgaagctgtggtaagttcttactgctgggtaatttggtttgttctatgaaaagtggttagatcttgttttctaacatcagtatgccatatgccacgaacagactcaggatgtaagagccgcagccaatgggatagctgtaacactaatgtccatctctaaagcggttgctccagctgttgcaggaatcatgtgagtattcacttttcacgtctcagtatttgacaaaatctactgctgtttctttgctgaattatcccttgatcgtggctgttgttctttttttcctctgtagattttcgtgggcccagaggcgtcaaacagctgcatttcttccaggtaccacaccagaaacctttctttcactttatcccctactggctattatcgcgcacctctgctaaacatctggtccgaatcttgcaggcgaccacttggtgttcttcatactgaacatcttcacgttcatcggtttcgtcttcaccttcagaccgtttttcgttcgaggcagtgccaagcactgaaacatggatgaaccggacgacgacccatggtatcctatccaggggcaatcgaatataaattttcttccggcgtggccaagggaggtgccgagtctgtaccagtacgacgactcaggccagaacacacggcgtatggtatggtacacagcaaggccgtgttgttgctgtaagttttgtaatttctgtttccttctcggcttcgcagcatgcagttgctgtatatgatggaagaacactctgttactgggcatgttgcgcggtttccacgcgtgtaagtaatgtagaagtcgctatggtaggtatttccataccgtcattagtggatcattgattttttttttgtaagaaggttattgcaatgccctttttccgggcatgaataagaaaaaggaaatatgcttatatgcatggtatgaataagtgagcaatagacttgtactgtgttcttgatttatttaaaatcagactaagagaactggtgacattttaaaccattcgtacaagaaccttgtactacctcagcacgttctcatttgaccatgcaattctggtcggtgaaattcttttcagccttgtgttggcgccaaattggggctaaacactatcatgaaccacgctatgttctccgcaggagtgtggatggttcgtggctctgcgctggacggtgcacgtacttgctgca

SEQ ID NO: 19271 - DNA, 1679 bp, Zea mays
  misc_feature (1671)..(1671): n is a, c, g, or t
acacacgatccttcctaccggtcgaatcctagctctgatctagcagtgctccactttcatttcagtccggaaccacgaattctgccaaactacgagaatgtaccgagaatgaaggagtgtatactagtctagcaccaaagcgaccgagccgcggatttcacccctgcctttccttctccccgtgtccaggccctggtgcccgcgcgttcccgtgcggcaactggccgccgccgccgcactacgccaggtgcccaattcctcgtcgggtcctccgccggcgacgagcacccaccagaaaactggagtggactctacatgtcaagacagtatggcgccaggaagcaaggcggagaggaaagcagcactagacgctggcgcatggatgttcaatgtcgtcacatccgttggtatcatcatggtcaacaaggccttaatggcgacgcatggttttagtttcgctacaacgttgactggacttcatttcgcgatgacgaccttgatgacattagtaatgaaatggctgggatatattcagccgtcctatctaccgttacctgaactagtaaaattcgccttttttgcgaacctgtctattgttgggatgaatgtaagcttgatgtggaactctgttggattctatcagatcgcaaagctgtgtatcattccagtcttatgcattctggaaatcatgttcgacaaagtccgttactctagagatacaaagctcagtatagtgcttgtccttgtaggtgttgctgtatgcacagtcactgatgttagtgtgaactctcaagggttactagctgcagtaatagctgtttggagcacagcactacagcagcattatgttcaccaccttcaatggaagtactcgcttggctcattcaacctcttaggccatactgctccagcccaggcagcatcattgttagtattgggcccttttgtggacttctggctgaccaacaaaagagttgatgcttttaactacacatcaatagttacgttctttatcgtgttgtcgtgcataattgctgtcgggaccaacctaagccagttcatatgcatcggaagattcacggccgtctcgttccaagtcctaggccacatgaagacggttctcgtgttgaccctggggttctttttctttgggaaagagggtctcaatttccacgtcgcccttggcatgtttctggcagtgatcggcatgatctggtatgggaatgcctcctcgaaacctggaggcaaagagcgccaggtttactccacaccgagtgagaaaactcagaagcatggggtgctgtcatcccaatccgagctcgatcagaaggtctgaaatgagacacgcaaaggaatccggtgcttgttgaacattgatcgacctggtttttttatatatacttcttttttttttgagggagatgtttgtttctatagaattgtaggccatagcagaaaatgggtacccagcggcctgcgcctgacattagcagccgggaaccggccacgttccacgatacaaggaactgtttcgttgtaattgctctcccagagtgtgaaattctccaaaggtatcgtatcaccttctttattccaaaaaaaaaaaaaaaaaaaaaaaaaaaaaaaaaaaaaaaaaaaaaaaaaaaaaaaaaaaaaaaaaaaaaaaaaaanaccccccc

SEQ ID NO: 19272 - DNA, 1631 bp, Zea mays
accctcggggccccccgcggtataccagtctagcaccgaactaccaaaaccgaccgagccgcgaacttcacccctgccttctctcccttctccgtccaggccctggtgcccgcgcgttctcgtgcggcaagtgggcgccgccgccggactacgccaggtgcccagttcctcgtcgggtccttcgtcgacgacgagcacccaccaaaaattcgagtattagactctacatgtcaagaaagtatggcgccaggaagcaaggcggagcggaaagcagcactagatgctggcgcatggatgttcaatgtcgtcacatctgttggtatcatcatggtcaacaaaggcttaatggcgactcatggctttagttttgctacaacactgactggacttcattttgcaatgacaaccttgatgacgttagtaatgaaatggctgggatatattcagccatcttatttaccattaccagaactagtaaagtttgccttttttgcaaacctgtcgatcgtcggaatgaacgttagtttgatgtggaactctgttggattctatcagatcgcgaagttgtgtatcattccagtcttatgcattctggaaatcatattcgacaaagttcgttactcaagagatacaaagctcagtatagtgcttgtcctcataggtgttgctgtgtgtactgtgactgatgttagcgtgaactctcaagggctattagctgcagtaatagctgtttggagcacagcactacaacaacattatgttcaccaccttcaatggaagtactcgcttggctcattcaatctcttaggccatactgctccagcgcaggcagcatcattgttaatagtggggccttttgtggacttctggctgactaacaaaagagttgatgcttttaactacacatcaatagttacgttctttatcgtgttgtcgtgcataattgccgttgggacgaatctaagccaattcatatgcatcggaagattcacagccgtctcgttccaagtcctaggccacatgaagacagttctggtgttgaccttggggttccttttctttgggaaagaggggctcaacttccatgtcgcccttggcatgcttctggctgtgatcggcatgatctggtacgggaacgcgtcgtcgaaatctggaggcaaagagcgccaggtctaccccacaccgagcgagaagactcagaagcatggggcgctgtcatcgcagtccgagctcgatcagaaggtctaaacgagacacacaaaggcatccgatgcttgttgagcaccggtcgacctggctttattttttagtacttatttttgagggatgagatgtttctataggattgtaggtggggccatagcagaaagagggtgcctgggtaaaatgcccacgagtttacttttgcagtgagtatgtcaatctaagctggcagatacttgatttgtaatagtctttgtgtgtgtttcgctcttcatgtggcatgttcagtttgatctatagttgtatctttcactttcacactgaaattgaaaagtaaagcgcaaatttccttgtatatgtattacaagtaattaatttggtgctatatatcgcatctgtccggtttttaatcaaaaaaaaaaaaaaaa

SEQ ID NO: 19273 - DNA, 1760 bp, Zea mays
gcgtccgcggacgcgtgggttgacactgggcgcctcccgggccggcaccgaactaccaaaaccgaccgagccgcgaacttcacccctgccttctctcccttctccgtccaggccctggtgcccgcgcgttctcgtgcggcaagtgggcgccgccgccggactacgccaggtgcccagttcctcgtcgggtccttcgtcgacgacgagcacccaccagttatgccctttctcttcccttcttgctgtgcgaaacccagcaccatccgaaccctaacttgagctatctggctatttgcatccggatctgatctaattaccaagcgtgtacatacatactactaacttcgaatttttttttgggaaaaatattggaacatccgtgtcctttaccgggttcccccctatagaaaattcgagtattagactctacatgtcaagaaagtatggcgccaggaagcaaggcggagcggaaagcagcactagatgctggcgcatggatgttcaatgtcgtcacatctgttggtatcatcatggtcaacaaaggcttaatggcgactcatggctttagttttgctacaacactgactggacttcattttgcaatgacaaccttgatgacgttagtaatgaaatggctgggatatattcagccatcttatttaccattaccagaactagtaaagtttgccttttttgcaaacctgtcgatcgtcggaatgaacgttagtttgatgtggaactctgttggattctatcagatcgcgaagttgtgtatcattccagtcttatgcattctggaaatcatattcgacaaagttcgttactcaagagatacaaagctcagtatagtgcttgtcctcataggtgttgctgtgtgtactgtgactgatgttagcgtgaactctcaagggctattagctgcagtaatagctgtttggagcacagcactacaacaacattatgttcaccaccttcaatggaagtactcgcttggctcattcaatctcttaggccatactgctccagcgcaggcagcatcattgttaatagtggggccttttgtggacttctggctgactaacaaaagagttgatgcttttaactacacatcaatagttacgttctttatcgtgttgtcgtgcataattgccgttgggacgaatctaagccaattcatatgcatcggaagattcacagccgtctcgttccaagtcctaggccacatgaagacagttctggtgttgaccttggggttccttttctttgggaaagaggggctcaacttccatgtcgcccttggcatgcttctggctgtgatcggcatgatctggtacgggaacgcgtcgtcgaaatctggaggcaaagagcgccaggtctaccccacaccgagcgagaagactcagaagcatggggcgctgtcatcgcagtccgagctcgatcagaaggtctaaacgagacacacaaaggcatccgatgcttgttgagcaccggtcgacctggctttattttttagtacttatttttgagggatgagatgtttctataggattgtaggtggggccatagcagaaagagggtgcctgggtaaaatgcccacgagtttacttttgcagtgagtatgtcaatctaagctggcagatacttgatttgtaatagtctttgtgtgtgtttcgctcttcatgtggcatgttcagtttgatctatagttgtatctttcactttcacactgaaattgaaaagtaaagcgcaaatttccttgt

SEQ ID NO: 19274 - DNA, 4085 bp, Zea mays
  misc_feature (1221)..(1221): n is a, c, g, or t
accgtaggagtgtctttcgatttagtatttcaatttagctagcggtgttttatatagacaacacactagcttttggacgaatcttatttggttattagtttcacgatcgaacatcaataatggttacatcaacaagcttcagattcagattcgtgcctactccagtccgacccctccgcccgtggctccgttacgtcaagggccatgggacgacaacgtcaccaacggcaacaacgacgacgaagccaggagtggagttcaacggtgatgtatactgaaaagagtatgggcaaaaccgtctcagatttttgagtgtgaaccctaaatgagtgactggtgcttaaacagaggtagttgtcgaaggaacacacgaatcaaagaattgaggagaagtgttaaattctgaaagcttatgttgacagacaaataaattgagtcccatattctgaaatttctcgataatagtgagtagtttttcgtaaagttggtagcgggtttttttacaaataagattagataaatattggttgagcattttattagattatgatttttgactcgttatatcttaaaatattagtcgttttagctcttaatttttatgtctaaatttaaatggacttaaatggatgatgataaatttaaacatacatataaaagaaatatattaattattgtatgatcaactaaaaaggtaaaataaattttattttgggatggatggaacaatttatataatcttgtataacaatatgttttttcttatatagattaagattatataatctagatagatcaaaccttaatcacatagcagtatttttctatcccggcggctctggtttgcaaaattccaaaatgtgtatagacaaaatcacaaatgaccggtaaacacttggaagcacgaaaatgagctctctctggactgaactagtgagaatacttgagaaagagcgtataccagtctagcaccgaactaccaaaaccgaccgagccgcgaacttcacccctgccttctctcccttctccgtccaggccctggtgcccgagcgttctcgtgcggcaagtgggcgccgccgccggactacgccaggtgcccagttcctcgtcgggtccttcgtcgacgacgagcacccaccagttatgccctttctcttcccttcttgctgtgcgaaacccagcaccatccgaaccctaacttgagctatctggctatttgcntccggatctgatctaattaccaagcgtgtacatacatactactaacttcgattttttttttgggaaaaatattggaacatccgtgtcctttaccgggttcccccctatagaaaattcgagtattagactctacatgtcaagaaagtatggcgccaggaagcaaggcggagcggaaagcagcactagatgctggcgcatggatgttcaatgtcgtcacatctgttggtatcatcatggtcaacaaaggcttaatggcgactcatggctttagttttggtaagagcatgcccaatcttcattcctaactgcatgcgatgcctgattcacgcgcgccttcttttctatctaaaagtaaactactattgtgcagaaaaattcagtctgcttgtcttgtgctaatttgttcactaccttttgctcctacagctacaacactgactggacttcattttgcaatgacaaccttgatgacgttagtaatgaaatggctgggatatattcagccatcttatttaccattaccagaactagtaaagtttgccttttttgcaaacctgtcgatcgtcggaatgaacgttagtttgatgtggaactctgttggattctatcaggtgagggcagaaactttggtattctataagtatattggagttaaacgtatatactaatgctgtgtatcttgcccttttcagatcgcgaagttgtgtatcattccagtcttatgcattctggaaatcatattcgacaaagttcgttacccagcggccgccaagctcagtatagtgcttgtcctcataggtgttgctgtgtgtactgtgactgatgttagcgtgaactctcaagggctattagctgcagtaatagctgtttggagcacagcactacaacaacatgtgagtattgttatatcaaagcctgtccattgttcatatatctgtatattacatcttttcctaatttgtgctatctttctttagcacacctatttttgtagcttggcttctaatctagaagttatcggctatgaatttcctataaaaacatcttgcacagaatcttagtaacattctggtgagtactgagtacactgaaatccaaaattcctcttttatttgggcggacttggcgcagtggtagagcctgtctacttgtggcctgaggccctaaattcgaagtttgaaccaggcttcttgcaaaattatgcaagggtaggctttctagaatatgagtgcattgagaacaactatctatgtgcctgaaccttgacttgtggtttctgtttggtttcaactgtagcctatcccaactcgtttgggactaaaatgttttgttgttgttgttgttgtaggctttctagaaattgccttccccagaccacaccttgtgtgggagctctcaacattagccaccaatgttttcagacggcctaatcgtttctgatcgccagaggatcaatcagcccgttcagatcgattaatcggacgatcagcccgattaatcacttctgagtccatgctaacaattctcagtttctcatcgccaagtggtcaagcccatcatgtagcaaacaacaaggtacaagaaatcgcgaagccacattcatgcttgcaggcttgcagcagcagcactcagtggacaggccctggaccgtacctgcaggctggcaccgccgcgccggggatggaggaggggccgagggggacgatgcgtcattttccgccgtcgccggtagcgcgccggcgttgcctgcatagtgctccgctaggttcctcgacagccagttcgtgtcgtgtctcgcgtgtgctccagcctgggcgttgttcactgttggctacttggttgtgttcatgtgggaggaaaaaggaagcctgggctgggctgctgggccgaattcgttgacgaaaaacaattgaagtggtccaaaatttcaaagcatacagccgtctgattgtccctgcgctaatcggacgatcagaaacctgatcgccctgatcggctccgaagctgcgatcagtcgattaatcgctgatttatggcgactaatctgacgttctgaaaatgctgttggccacccaaccatttttttcctttccgaaatacagtaagcaaaagaatccagcactctgttgctgctttgatcaccgcaagttcaaagccttctggatcttgttaatctttatttaactagtgttgtccatgtgacctcccacagtcccacccctcctacacctttcacgatagcctaatgggtcatattatcactatgttttatttgatttcctcttcttttctacagtatgttcaccatcttcaatggaagtactcgcttggctcattcaatctcttaggccatactgctccagcgcaggcagcatcattgttaatagtggggccttttgtggacttctggctgactaacaaaagagttgatgcttttaactacacatcaatagttacgttctttatcgtgttgtcgtgcataattgccgttgggacgaatctaagccaattcatatgcatcggaagattcacagccgtctcgttccaagtcctaggccacatgaagacagttctggtgttgaccttggggttccttttctttgggaaagaggggctcaacttccatgtcgcccttggcatgcttctggctgtgatcggcatgatctggtatgggaatgcctcctcgaaacctggaggcaaagagcgccaggtttactccacaccgagtgagaaaactcagaagcatggggtgctgtcatcccaatccgagcaacattgatcgacctggtttatttttatatacttcttttttttgagggagatgtttgtttctatagaattgtaggccatagcagaaaatgggt

SEQ ID NO: 19275 - DNA, 1976 bp, Zea mays
cttcaattttttctttgcagccaacctagcactagatctcttgccaatagaagatgggatcacacccacctcataaacagactgcgctgaccctccctcaaccaagaaatttggcactaagctagtaagaagactaaaatcaaatattgtttactctcttgatcagattacgagataaaagtcgaactcgatcctctgtactttacatatatatataacagcacgtccactgtccacagcactgagtgatcactgatcagacatcagactatcagaggggccaatttgctattggagcctcggagggacggggagaaaaatggccgtaaagctcaacaagccgcccaaggcgaagagcctgtggatcctcgtgcggcgcctcctccgcaggagtcgcaacccgccgccgtcagcctcggccgcgctggtggacggcgagggggagaagagcggcctcctcagccgaagctccttggagcagctgttcgtgatgacggacgactgcgcccctggcaacgacggcgacgtcgacggcgacgtctgttggtgcgccaagaagccgcacggccagccggtggccgtgctgctgccggcgctggcccggccagaggcgtcggccgctgcggtgccgttggcagcaggtgccgcgcaccggaggttcgtgttcggcgggttccggcggcggctgctcattcgcaggccgtggcggccgatgctggtcgccatcccggagtgaccgatcgattaatcgcgtgtccggtgagtcggtggcgtgaattagagacgctgggggtatatgattcggcattcgagtgcgtgagtcagtccgatcaactccgaagcaattgggggtatatgattcggcatttttctgggggtgcgcttgtgccctctctgtaactttgcgtgctcgctggttcttccctgttccttcctaagtcctaatcctaactagaaggttccgttcttttttctttctcaccattgaacatacaaagttatttgatccgaaaaggaatttatagcggaggatcggagtatgtttcatgttggtgtagtgaaacgcggtctgcaacgacctcggtccccgatacagcaaacccaatgttggttggtgtagtgaaacggtctgcagcttccctgccaatatttcagttcaaatttgtaaaatttctcaaacggtgtgactgagcttctttgcagtatctctggatagccgcgcccaagcttatcggtaaaggcaaagctgctttgcttttacttttgcactagttgccaaatgttcattgaaaccggggtcacgtctgttttggatcttcgccatcctatgtaggagtcactatagattaaatgggaaaaatatgtataagagatagaagagacagtgaaaaaaatgagagagaaaatagaacaggaagagttttgatttagatcttcggggttcatactgaagggtttgtctctgcatattgtccgcgaagagttcatctctactaattgtccctcaactgtaccatcccattatataataaaatttcatcccaatatattaattatatagagtccgttcttaggtctattgtgtttagagcattaggtggtacatgccctcacgcggctatttgccatgctgggctatgcattggactgaagattgacccatctatcccatataatcttgaggaattgggttttatatccgaaacgggcctaataaaggcctgtatgtgtattggcttaaggatcatctttatttgggttatagactggacctataactagggcttgagcttgcgacgactcgactcagctctgccacccgcgagttgactcgatccaacaataatttattaaataaaatcctaattaacctacaatataagatattaacttatattaaatagacaagacgactagctaagttattttttatattatattaataatatatttattttagtaatctaaaatagttt

SEQ ID NO: 19276 - DNA, 1703 bp, Zea mays
tttgatggtgcactgcttgagtatctggttagtgagttcaagaagtcagacaacattgatctgagcaaggacaagttagcactgcaaaggctcagggaagctgctgagaaggccaaggttgagctttcgtccactatgcagactgaaatcaacctcccatttatcactgctgatgcatctggtgcaaagcacttcaacattaccttgaccagatctaagtttgagtctcttgtgagcaatctcattgagaggactcgcatcccttgtgtgaactgcctcaaggatgctggcatctctgctaaggagattgatgaggtcctactggttggtggtatgactagagtaccaaaggtccaggaggttgtttctcagatattcaataagccaccaagcaagggtgtcaatcctgatgaggctgttgccatgggagctgcaatccagggtggcattttgaggggtgatgtgaaggagctccttttgctggatgtcacacctctctcccttggtattgagacccttggtggcatcttcacaaggctaattaacaggaacaccacaattccaaccaagaagagccaggtcttctctaccgctgcagataaccagacacaggttggagttaaggtgcttcagggtgagagggagatggctacagataataagctccttggtgagttccagcttgaaggcattccaccagccccaagaggcatgccccagatcgaggttacctttgacattgatgccaatggcattgtaaaggtgtcagctagggacaaagccacaggcaaagaacaagaaatcaccatcaagtcttctggtggtttgtcagaggtcgaaattgagaagatggtgaaggaggccgagctacattctcagaaggaccaggaaaggaagtctcttattgatctcaagaactctgcagataccacgatctacagcattgagaagagtgtcagcgagtacaaggacaaggtccctgctgaagtcaccaaggagatcgagtctgctgtctctgatctgagggcagctatggctgaggacgatctggacaagatcaagcagaagctggaagcagcaaacaaggctgtttcaaagattggagagcacatgcaacaaggtggcggcagcggcagcgctggcggcagcggcagcagcagtggaggagaccagactccagaagctgagtaccaggacgcaaaggaagccaagatgtaggtcgaacctccatcaagtctctagtttttgcatgtgcccatttaggaagtaaacttacctacctccgatttcttagttttctgtgagggttaagaggactgtaatttttgttgccaaattttgggtcacggataagataaattgaggggaacggacccatacgttaattgaaccatttatatactccagacggcctctcaaaaaaaaaaaaaaaaacatggttgtgtcgataataggaattatttatatggttaacatactttgctagttcagtgttctacctgcacattgcagcaatgcatatgcactggacactgcagttatccgttgcttcatttgagcaacgaagtccaggagaaatattgctcgcatctttgcgtttttattcatgtctataatgtaaaaaatagaataacatatggatcctacggaatcattttacagcaaaaaagaagaagcgtgcagtatctatctgttatgtagaa

SEQ ID NO: 19277 - DNA, 2620 bp, Zea mays
ggcggcggcgccgttcactagggtttttcctgatctcgcctcctacttcccgagccacacacgctgccgccgtgagccgccgcccacaaggctaagcaccaaccatggccttcggagctctcgtcacgtcgaggctggccaggtccggccgcacccttgcatctgccgttgcccagggtcccgttgcccagcggatagcacctcctctgttctccaggtttggagcagtagctcgtcttctcagcacaaagccagccgcaacagatgtcataggtatcgatctaggcacaacgaattcctgcgtctccgtcatggaaggaaagacaccacgggtgattgaaaacgcagaaggcgcgaggacaacaccctccattgttgccaagaatcagaatggtgacctgttgattggtatcacagctagccggcaggcagtaaccaatgcccagaacacaatccgtgggtcaaagcgtctgatcggtaggacttttgatgacccacagacccagaaggagatgaagatggtgccttacaagattgtcaaggcgccaaatggtgatgcctgggtcgagatgggtggccagcagtactcccctagtcagattggcgcatttgttctcactaagatgaaggaaactgcagaggcttaccttggcaagacagtctcgaaggctgttattactgtcccagcttattttaatgatgctcaacgccaggctaccaaggatgctggtaggattgctggactggaagttatgaggattatcaatgagcccactgctgcagctttgtcctatggaatgaacaacaaggagggccttattgcagtgtttgacctgggtggtggcacatttgatgtgtcaatccttgagatatcaaatggggttttcgaggtcaaggcaaccaatggtgatactttccttggtggtgaggattttgatggtgcactgcttgaatatctggttagcgagttcaagaagtcagacaacattgatctgagcaaggacaagttagcactgcaaaggctcagggaagctgctgagaaggccaaggttgagctttcgtccactatgcagactgaaatcaacctcccatttatcactgctgatgcatctggtgcaaagcacttcaacattaccttgaccagatctaagtttgagtctcttgtgagcaatctcattgagaggactcgcatcccttgtgtgaactgcctcaaggatgctggcatctctgctaaggagattgatgaggtcctactggttggtggtatgactagagtaccaaaggtccaggaggttgtttctcagatattcaacaagccaccaagcaagggtgtcaatcctgatgaggctgttgccatgggagctgcaatccagggtggcattttgaggggtgatgtgaaggagctccttttgctggatgtcacacctctctcccttggtattgagacccttggtggcatcttcacaaggctaattaacaggaacaccacaattccaaccaagaagagccaggtcttctctaccgctgcagataaccagacacaggttggagttaaggtgcttcagggtgagagggagatggctacagataataagctccttggcgaattccagcttgaaggcattccaccagccccaagaggcatgccccagatcgaggttacctttgacattgatgccaatggcattgtaaaggtgtcagctagggacaaagccacaggcaaagaacaagaaatcaccatcaagtcttctggtggtttgtcagaggtcgaaattgagaagatggtgaaggaggcagagctacattctcagaaggaccaggaaaggaagtctcttattgatctcaagaactctgcagataccacgatctacagcattgagaagagtgtcagcgagtacaaggacaaggtccctgctgaagtcaccaaggagatcgagtctgctgtctctgatctgagggcagctatggctgaggacgatctggacaagatcaagcagaagctggaagcagcaaacaaggctgtttcaaagattggagagcacatgcaacaaggtggtggtggcggcagcgctggcggcagcggcagtggaggagaccagactccagaagctgagtaccaggacgcaaaggaagccaagatgtaggtcgaacctccatcaagtctctagtttttgcatgtgcccatttaggaagtaaacttacctacctccgatttcttatttttctgtgagggttaagaggactgtaactgttgttgccaaattttgggtcacggataaattgaggggaacggactcatacgttaattgaaccatttatatactcctgacggcctctcaactattgtttgttgatcttggttgtgtcgtcaataggaattatttatatggttaacatacttgtgctagttcagtgttctacctgcacattgcagcaatgcatatgcactggacactgcagttatccgttgcttcatatgagcaacgaagtccaggagaaatattgctcgcatctttgcgtttgtattcatgtttataatgtaaaaaaatagaataacatatggatcctacgaaatcattttacagccaaaaaatgtgtgcagtatctatctgttatatag

SEQ ID NO: 19278 - DNA, 820 bp, Zea mays
  misc_feature (687)..(687): n is a, c, g, or t
gggggccgcttcttttttttttttttttgaaggaaaatcaacagggtattatacagatggaggaacggaagccacaacaccaccgggcccacccaaccagccagccagccaaaccaatctgtccaagccacgatcctacactgtagtaacacgaacagatatgccagtcctactgaatcgaatgccgaatggaatatggatgaaagggaagaacaacaaaaaaaaaggaatcaacggctcagcacggatagcgataaattacagcaggggacggcgcagatctcccgctctctcagtagaaggcggcggcggcggcggccacggctgcggcggcggcgaaccacttggcggagggggaggcgccggcgacggcggcgctgggggctgggggagcctccgcggagggcgtcggagcggggccctccgtgggcatcggcggggagctcacgtcgggagtgggagcctcggccgtgggcgccggggtgggggcctcgggcgccggggccggggccttgggggcgggcgcgggcgccggaggaggcatggtcgggggcggcacgggcggagacaccggcgcgggggtcggcggcggcgtcgccggcgggggggacgccttgggagccggcgtcggggtggcggtcggggcctgcgccgccgccgcggcgaagagcatggccatggccacgngctgcgagctggaagcgcgccattggagcagagagagagagaaggctggcttgagcttgttgtgggagcgagggccgaggggcgcttctgctgctgggctggtgcgtgcgtgcgtgcggtctgggttggtttt

SEQ ID NO: 19279 - DNA, 1110 bp, Zea mays
cctcgaggccggccgggccgggaggcatgagcacccctctcctccgccgtcccatggccgcgccctgttcctgggacacttccttccacgaaaaaaagcagcagcagcagcataagctctagctacctctactaccgacctggatccactcaacccgctacgctaagctcccctttcccgttcgacaagagaagagaagaggttattcatccatctgcgctgcagcctgcaaagaaggagaaggaggagacaggcgcttgacatgggcaagtacgtggagctgctggacatgggcgtgcgcatcgccgcgcgcttccactcccactgcccgcagaccgcgcgcctctactaccacccgcccgccggcgggccggcggccgcgggggacggccgcaagggcgactccgccaccgccgccgccgccgccgccgtgatgctgaagcagcaggcgcacaggttcgacgcctccgagatcatcctccacaccgtcgtctaggccggctgggtggggtgggatgctcgacggagccgtcggcggggcggcggcgatctatcgatttttatcaccattcattgccgggggagccagagtgtgttgtgctgagatgtgatgtaatgtgatgcgcactcccgtttttattttattttttttaccatgagttcaaaatcgaatgcatttcggttcgtcgaaccattgttctgtttcttttttgcccgcgttccaaaccttctcggaggtgaagagtcgaagccgagcgtgtgtgcctcctgccgtcttttgatctggctacgagttaaaaggcttgttcattgtaatctcaggatttggggaggatactactcccttctaattcccatgatatgaatactatacgtccaattcccatttggagacaacaaataaaataaggaatcaacggctcagcacggatagcgataaattacagcaggggacggcgcagatctcccgctctctcagtagaaggcggcggcggcggcggccacggctgcggcggcggcgaaccacttggcggagggggaggcgccggcgacggcggcgctgggggctgggggagcctccgcggagggcgtcggagcggggccctccgt

SEQ ID NO: 19280 - DNA, 772 bp, Zea mays
  misc_feature (25)..(26): n is a, c, g, or t
  misc_feature (276)..(276): n is a, c, g, or t
  misc_feature (286)..(286): n is a, c, g, or t
  misc_feature (379)..(379): n is a, c, g, or t
  misc_feature (451)..(451): n is a, c, g, or t
  misc_feature (475)..(475): n is a, c, g, or t
gcacgagaccattacctagaacatnntaatcaaaaaaagagaagagaagaggttcgcaaatagacatatagagagagaggttattcatccatctgcgctgcagcctgcaaaggagaaggagagacaggcgctcgacatgggcaagtacgtggagctgctggacatgggcgtgcgcatcgccgcgcgcttccactcccactgcccgcagaccgcgcgcctctactaccacccgcccgccggcgccggcgccggcggtccggcggccgcgggcgacgnccgcaagggngattccgccaccgccgccgccgccgccgccgtgatgctgaagcagcaggcgcacaggttcgacgcctccgagatcatcctccacaccgtcgtntaggccggctgcgtgggtgggatgctcgccggagccgtcgacggggcggcggcgatctatcgatttttatcnccattcattgacggggggatccanagtgtgttgtgctgagaagcctgagatgtgatgtgatgcgcatgcgcctcccgtttttatttttaccatgagttcaaatgcatttcggttcgtcgaaccattgttctgttattgcttttttttttttttttgcccgcgttccaaaccttcacgggggtgaagagtcgaagccgagcgtgtgtgcctcctgccgtcttttgatctggctacgagttaaaggcttgttcattgtaatctcaggatttggagaggatactcccttctaattcccatgataaaataaaaaaaaaaaaaaaa

SEQ ID NO: 19281 - DNA, 490 bp, Zea mays
taaatacagcagcggccgctgtttccgcgttttttgaaggagacgctgaaggaaaatcaacagggtattatacagatggaggaacggaagccacaacaccaccgggcccacccaaccagccagccagccaaaccaatctgtccaagccacgatcctacactgtagtaacacgaacagatatgccagtcctactgaatcgaatgccgaatgaaatatggatgaaagggaagaaccaaaataaaaaaaggaatcaacggctcagcacggatagcgataaattacagcaggggacggcgcagatctcccgctctctcagtagaaggcggcgaagagcatggccatggccacggctgcgagctggaagcgcgccattggagcagagagagagagaaggctggcttgagcttgttgtgggagcgagggccgaggggcgcttctgctgctgggctggtgcgtgcgtgcgtactgtgatggtcccggaccggccggc

SEQ ID NO: 19282 - DNA, 787 bp, Zea mays
attaaaaggtgatgaagtaactgggaagcaggtcgctgctggaactggtgagtttgaagacctaaaatgtggtctggtcttgaaaagtattggttacaaatccttgcctgtacaaggtttgcctttcgacaaaaacagaggagttgtgccaaatttaagaggaagagtcctgagcagcgaatcagagattgcgacagtagaaagaggcctgtatgtggtaggatggttaaagagaggaccaactgggattgttgcaacaaatctccactgtgctgaagaaacagtggctagcatccttgaagatgataagaagggtgtattaaggcccccatctgattcgacgaagcatggaagggcaggactccttgagatcctagagcgaaagaatgtccgctttgtgccattcagtggctgggagaagattaattccgtggaaaagatggcaggggagctgagaaataaacctagagagaagatcacaacctgggatgggctccagaaagttgcacacgagtaaaaggacgggcctcggacctccacaagattttgtcaacgtattttttgtatcaaaagaatcacattaacgagagagaaccctgtacttagcaataaaagattatatcaacatatcttgctcatgttaaggggccgaattttttgtattttaatccttttttcgaaacaatttcacgtttagatcctagataatttaaaaaaaaaaaaaaatttaaaaaaaaaaaaaaaaaaaaaaaataaaaaaaaaaaaaaaaaaaaaaaaaaaaaaaaa

SEQ ID NO: 19283 - DNA, 2311 bp, Zea mays
  misc_feature (49)..(49): n is a, c, g, or t
actaaaaattagcccctctaacaaacaggcctcgatgccggcagagcancccagccgccgccgcgacccgccaagagaccggcccggagaatcgcgccgtatcgtgttcgatgtggacgcactcctggccttcgcgcggcacggcgatggcggcgccaacctacccagagaggcatcgggttcgtcggcacctccagcccggcgaccaaatcgtcgccgcgctggcccccttccttggctttgccgatcacctcgtccatcgcatcgtctgccgcgcctggcgccgctcctgccgcatcctcggccgggcaccgccgcccttcccgtggctcatgctccctccgccgctgccacctgcgggtggacctggcccggcccccggcaccgcgcagcgccgagtcttctacgacatccccggcgggagatcatacgcgtacccgatccccgcgtcctaccgccacgtcacgagccgcagcggttggctcgtcctgatcgcctcggactcaccgcgacggctcctggtgcttaaccctatcaccggtgggcaggtggttgtgtcgtggccgttcaaggaggacaccgacggcttcctcgctgtgctgacggcaccgctcggcgacccggggtgcttcctcgcggtcgccacggataggctcatcaagtactgccaccccgccggcggtggggagtgggccacgctgcgcgccctggggttccgctacgacgcggccctcagcgacctcgtgtccgtcggcgacacggtgtacctcgtggacgagcggaggaagatctggcgcgcagacctcgccgccgcgcagcccaaggtggagcgcaaggacacggcgttcgcgctcccgcaaggggagtggtggcgccactacctcgtggagtcgctcggccatatcctcctcgtggtctcggacccgcaccacaagcgcctcgggctctacagactcagatgggacgtcaatctatgggtgtcgatgcccgcgagcggtctcggcgacagcgtgctgctgctgggccgcggttgttcggcggccgtgccagcgtcggccgccgcgggccgcttgcctggcacagttctggtggcgcaccagccgttcagatgtagcttcctgcatgtgggcattgggtggttaaactttcccggcggcggtggtgaccaaccttggttctggacggagtcgcggttgggcgcggggctgggtgatgatcagctggtggtgaggaagtcggtgccgcattggccgctttggtcgggcgggttcacaatcggtgattcattctggttcttccccggcattgatgaaagtgattgcccataggcgtgtcaacatgcataacttcggactcctttggaacaaagaacggtaaaggaactttaaagaattgaaatcctatagaaaattttcctatgcgatcctttaggacaaagaattgtcttcctacaaatcctataaattttttatggaataggtaggtccaacctcttaaaattttcctataaaattgcaagtgttatgcctatatttttttatcctatattttactaatcctgcatgaggccttcgagttttttttcctgttgccaagaagcagcacaaaagcacacctgccaggtgaagataggtatggggtgtgtgagattagcatgatctacctgaactgtgttattcagttatggcctagctgcagtggacaaatcgtggggcagatgacttaatagtttttgttttgttcagtttgcttgtaataattagtttcaaacataaatgatttccaattcagcctgtggtaacagtttaataacagactatagtagtagacaaaccacaacggaagcccggccgtgtatatctgttaacataggaaataacaaaattaagtattgtcattctctaacaaatctcctttgataactttccaaacaattttatattataaaatcggaatgtttctaactaactaaatcttttgttaccattttatttgtctcttaccactttctcgtgtgtaatcatttcttttcttaatttattcatgcgtccgatttacttcaaactttaaaaaattggcgaacggaaagtagatagagttcctctcaactgctcacgagttagagaggatatttagcaagtatttatctgtgaaaggctcttttaccaatgttggaaggtgttttttcctttttactaaaatatgaacatagacctttgtttacaaagctctcggagatgctcatctgcaccggacatccggttcacatctagttcatgtgctcaggtttggtcataatagatgtcctatg

SEQ ID NO: 19284 - DNA, 851 bp, Zea mays
cgaacaagccatggcgctgagtgccgcggctcggtggccgaggaccccataaggagagtcatgttcttggctctctggggtcacgccattgggtacctcgaggccggccgagatctgggcatgcaagcttgcatggccatgtcttggtcagtcagatctgcaaacaaccaaactgtaaaaaagaactggagcctgtcttgtaaatcatggagcttgctgctgcttgcacccatgaaaaacatgaacgcatggagagctggttaactagctaggtagatagatatatcatatatgggtatgatggtgtggatgagaataaaaaaacaaggtacgtagtccatgtctctggtcttggggagtggctgtgagcctgtgagatcctgggaagttcatgcatggcatggctcaagagggagatctgaaacttgtgtagccactacgaacttgttttccagaaatcttgtaagtaggggagcctgtgaataatctagaaaacaaatcttcctgcaaaaaaaaaaaaaaaaaaaaaaaaaaagcaagcatactcctcctcctccctcgagcttcgttcggtcgctcccactgcttgttcgtcgtcgcagcgccctatatcgctccaaatcgtcggctagccggccaacgccaccgagaagctgacccgagtgtccgctcgtccggtgaactagaaatgaaacctactctgcagcttaaaacctcaagatatgttggcaaccattaaagtacaagtttcaaggaaatgggaattctgtggaaacatagacattgggccctattacacatcgatattgttttggctgacaaatatttgcgctattaggccaatccttgga

SEQ ID NO: 19285 - DNA, 718 bp, Zea mays
gggtccctcggaggccggccggcgaacaagccatggcgctgagtgccgcggctcggtggccgaggaccccataaggagagtcatgttcttggctccctggggtcacacataagaacacaaaccggccgaccgagatctgggcatgcaagcgagcatggccatgtcttggtcagtcagatctgcaaacaaccgaactgtaaaaaagaactggagcctgtcttgtaaatcatggagcttgctgctgcttgcacccatgaaaaacatgaacgcatggagagctggttaactagctaggtagatagatatatcatatatgggtatgatggtgtggatgagaataaaaaaacaaggtacgtagtccatgtctctggtcttggggagtggctgtgagcctgtgagatcctgggaagttcatgcatggcatggctcaagagggagatctgaaacttgtgtagccactacgaacttgttttccagaaatcttgtaagtaggggagcctgtgaataatctagaaaacaaatcttcctgctctgcgtgtccacctttgcttccaggttcagaagattcttcttctagtggtgatgctttatctcgaaaaaaaaaaaaaaacttctttactgccttcttgatcttttcagaaaaaaaaaaaaaaaaaaaaaaaaaaaaaaaaaaaaaaaaaaaaaaaaaaaaaaaaaaaaaggggcggcgcgttttaaa

SEQ ID NO: 19286 - DNA, 2755 bp, Zea mays
gccctttggaacccgatcccgggcgcaccagctggcaggggaattccctttttgcccctcactccgcctataaattacccctcaccggccgggccggccgatgaatctactcccatttctctgcacgcagctcagtctcgtccatccagtgctgtagaattttctttggtctgttggcaaggcagccatgaaaccccctcagctgccggcaggggagggggcctcctgggctcacgaggtcaagcaggccctccgtgagaaactccggcgctcctacggcgccggagctgcctccgccacaccggaggccaggccggccggcgaaccaagccgtggcgctgagtgccgcggctcggcggccgaggaccccataaggagagtcatgttcttggctccctggggtcacacataagaacacaaaccggccggccgagatctgggcatgcaagcttgcatggccatgtcttggtcagtcagatctgcaaacaaccaaactgtaaaaaagaactggagcctgtcttgtaaatcatggagcttgctgctgcttgcacccatgaaaaacatgaacgcatggagagctggttaactagctaggtagatagatatatcatatatgggtatgatggtgtggatgagaataaaaaacaaggtacgtagtccatgtctctggtcttggggagtggctgtgagcctgtgagatcctgggaagttcatgcatggcatgagtcatgggtgtggtgggctcaagagggagatctgaaacttgtgtagccactacgaacttgttttccagaaatcttgtaagtaggggagcctgtgaataatctagaaaacaaatcttcctgctctgcgtgtccaccttcgcttccaggttcagaagattcttcttctagtggtgatgttttatctctatgctctgtccaaaacttctttactgccttcttgatcttttcagctgttgggtggtttaatcctacagccatgagaggccaacatgctcatgaactgaattcgtgttttcttcttgcaaagaaacgtctagaaactgacatggctggcaaaataatgcaacggctttgcatgtcaaggtgatttgattcagttggttgtgaagaaaggccattttcatttccttatgatctgctgggattttaggaaccatgaatccaaccagctacgtgcccacggaagattaatgatctcaacacttgcaaatttgaagcaacaaacctcaaaagatctcgggagttcagtgaagatcaaagacaaaacctattaaaagctgcaccctgcgataaagctgagagcttcttttccaaatatatctttgcactatcatatggtttgctatatgtgcagtatcatttcgttgctataatttggacagaacacagaagtcacccaggaaaaaagaagaataaaaggagaccctttataaaactggactcctcttttcctatggattaatggcctaagaatcctattctaaacaataatgcaaaagactgtctcccacttgcaggggcaagccaaacccagtgggggccagtccccttgcttactttctcgagcaccttatcttatctccagatatacacaaagaaatcactacgatattagcagaaacaaaagacttcgccaatctgatatgctgcaaaattatcacgtaaatcatgacagcgtattgccagcctaaagaaaagctatcagaaactaatttttaggggccacacatttctggttagaagagatgaaactgcttaatgaaagggaggctcaaaggacagcaatttttgggggcattatggacctgtttggttccctacctaacttatcatagtttgcctaactttttctgtcaaggttagtttaatttgactgactagcattagtcttgttgtggctcttttagccgagaaccatcagacgtgttactaattacatttttgacaaaatatgtgatgataaccatgaagttggccaccaactgcgcactggatggaaaaaagaaagaaacggcagcacagctacacttatcttgattcttgacagatagcgatggttcaacttccattcctagcaagttgcaagagtgtacagtttacagctacttccagttcttgaatcacaagctgggtgcacaaatgatgtgcttgccaacctgtgactgcttggatcttgggagtcctgaatacaccagtgctagtcatcattagaatctgctcgtgccgattaagacagatctaagtaaaagctttgagaactcctttgaacaacgatccaatgaaatatggacaatgctattgaactgagcaaactattcaagtcgtttgttcgataaccaaacaccccagtcaagatttccatggcataaatgccaaggcaattataatcaagtttgacattttttacccagtctttactgaaaattttcaaagctcaaaatacatgtcaccagctattgctgctaatactataagagtactgacaaggatgtaacttttctatatatggctttgcttattgtaacaaggactcatgcaacactaattgtaacagtttctcaagcagaaaagataaagataccagataagactgcaatctattaacagaaatacaatacaatctaaagtctgaagcttagaaagtggattcggaaaagagtagtctggtactctggaagccattagcccaatatacttagcgtttgtttcgtaagtagacatttagcccagcacggttccttagccagggg

SEQ ID NO: 19287 - DNA, 2061 bp, Zea mays
caaaagagatcgaattcggcacgacgataaggacctagacttgcgaaagtgcaacccactacatttgcgcgctgttcttgcaggcacgaaagatttgctaagtgccaaattgttcttttacatgcttcttatccatctttctaaggaagcatcctatcttgcatctgtttactcccaggtttaccttgattttggcttggcgattccaaaacttagtgttcatggaatgacatcgtccctgaaagagcttctggagctagctcccataaagaaggtcatgttcagtacagatgggtatgcttttccagagacatattacctaggtgcaaaaagggcacgggatgttgtttaccgtgtcctatctgctgcatgtgaagatggtgaccttagcattcaggaagctatcgaagctattgaggacatctttagaagaaatgcattgaatttgtacaagttaaatgttgtcaaatggatcaataaatcatgaaactgccatagttggtaaaagggtgtcattggtcttctgttgaggaagatgtgctctttgttcgaataatctggtgcgatgcttctggtcaacatagatgccgcgtcgtgccagctggacgattttatgagattacgaggaataagggtgttggtctgacttttgcagcaatgggaatgacctcattttgtgatggcccagcggatgggtcgaaccttactggtgtaggcgagatcagaccggacgcgtgggtgccaacactcgttaggctaccatggtcaaggcacgaggaaatggtgatggctgacatgcaaataaggcctggagaaggctgggaatactgtcctagaaataccttgaggaaagtcacaaaagttctgttagatgagttcaatgtgacaatgaaggcaggttttgaaaatgaatttttccttcgcagaaaattagtaagtaatggagttgagatgtggattccatatgataataccaattactgctcaacttcagcatttgatggtgcatcatccatattacaagaagtatattcttccctcaaagattcaggcattgttgttgaacagttgcatgctgaagctggaaaagggcagtttgagattaccttgaagtatatcttgtgcactgttgcggctgacaaactcatatatgctcgtgagacttttaagtcgattgctcgaaagcatggactggtagcaacatttcttccaaagtttttttcttctgcttggacacttctaggcctgatttggatgattttggatctggttctcacgtgcatctgagcttgtgggagaacgatcagaatgtttttatggggtcaagtaaagataactttcatggaatgtcaaaaactggagaacagttccttgctggagtgtatcatcaccttccgtcaatattggcatttaccgctcctcacccaaacagctacgaccggattcagccagatacttggagtggagcttatctatgctgggggaaagagaacagggaggctccattaagaaccgcatgcccacctggtgtgcctcttgatttagtcagcaacttcgagatcaaatccttcgatggttgcgcaaatccgcacttgggtcttgctgctatcgtagctgctggcatcgatgggctaagaagacaccttaagttacctgagccaattgaatcaaacccttctgatcactcttcaaaactgaaaaggctaccgcagaacctgcaggaatctgtagaatcgctttctgcagataaggttttgcatgagttaattggtgataaacttgtcacaactgctatagctatacggaaggctgagatcaatcactttgcgaagaatccgggtgcacttaaggatctcatcgaccgttactagggcaaaagaacggaatgagaagctacatcttcttggacgtggcaaggggtttcactgtatgaccaaccgagagactggaagaataaattttgttccaacggttaacttcggattctcatcctgtgactgaacttttgatacccagtgtttctcttatcaaataataaaggttctttaaatttttaaaatg

SEQ ID NO: 19288 - DNA, 761 bp, Zea mays
catagatgccgcgtcgtgccagctggacgattttatgagattacgaggaataagggtgttggtctgccttttgcagcaatgggaatgacctcattttgtgatggcccagcggatgggtcgaaccttactggtgtaggcgagatcagacttgtaccagatatgccaacactcgttaggctaccatggtcaaggcacgaggaaatggtgatggctgacatgcaaataaggcctggagaaggctgggaatactgtcctagaaataccttgaggaaagtcacaaaagttctgttagatgagttcaatgtgacaatgaaggcaggttttgaaaatgaatttttccttcgcagaaaattagtaagtaatggagttgagatgtgggttccatatgataataccaattactgctcaacttcagcatttgatggtgcatcatccatattacaagaagtatattcttccctcaaagattcaggcattgttgttgaacagttgcatgctgaagctggaaaagggcagtttgagatagccttgaagtatatcttgtgcactgttgcggctgacaaactcatatatgctcgtgagactattaagtcgattgctcgaaagcatggactggtagcaacatttcttccaaagcctgatttggatgattttggatctggttctcacgtgcatctgagcttgtgggagaacgatcagaatgtttttatggggtcaagtaaagataactttcatggaatgtcaaaaactggagaacagtt

SEQ ID NO: 19289 - DNA, 1799 bp, Zea mays
  misc_feature (1491)..(1491): n is a, c, g, or t
agacgagttcttcacgaagagcctgtatttacacaactctctatatatattttgtctagaacgtatttacgatttagagacttaaagattgtaccatataattttttagctatctctgagttgtacatagcctgtttagtttcacccaactagtaaagtttaatctatgttacatcaaatatttaaatgatgatgacagatattaaatacaatataatctaattataaaataaattacatagataaagactaaaagagactagataaatttattaaacctaattgaatttaaatttaataattaaaattgatatttaaatatttaatgtgactaaattgattttagtgaccaaacaccctcgaacgaattgccttggactttgactcgcggcagtcaattgttctgatttcctcgtcggctcatcctttccccgaacccctcgtccgagtctcgccatgcgctcgacccacctcgtcgacggcgaccttgcttcggcctcggcgatgggaggccactccgaccgtctgttcagggcgctggctgtcgcttccctctacattcttatccgccggtggcgcgcctttggggtcggcctcagcgagcggccggcgccggcggagatcgctgccgtggctgcgctctgcacctccgtggcgtggctgtacgtgctcccagcccttggtctccgccggagcacgcaccgacgtcggcaccaagattagttgacaagtggctgttgttgcgttgctggtaaccatccctattctccctcttttttaaggtttggatttggaatccaatttgtcaaacacagcccgaggaaatgtatgtgtaagtacggatacgaatggttgaaatattagtcactaagaatgatcatgtaagtacggatctaacggtccagttcaagattgggctgatcccaactgttcaatgatttactggttcatatgtcagtgtatagacatggtaacctcaaaccagttacctgtatggtcaccagtgactggacaaagagaatttctcaaggttgtttgttaataaaaaaaaaaaaaaaaaatgcccacggccaacttacagttcaaatactttgcctaggacctttaagtcgctaaacagtctcaactcttaacacaacttacacaggttgacaggtagttatcataatcatgatgattatgcccaagcccattcaagagcgtccacttccacacccttgtcgtgcaaagtgacacctctctctccctctctctcaccaggaagctaagccctaagcatcctatagttgttcacaatttactacaaaaaatgaagtataaagtataaacatgactatttgatacttcacatctcgctggtagatggttcaatcacaatgtgatttcgcacaattacttagactctatgcttccatgcctcactctggttttgttccacttgattctgatataactgaagtttccaatgctgcctatccccaagcacttacncgtttcacagaaggaatatgtttctttattttattcataaattatgcacaaagaactccagaagggggagtgaaaaagcatattctttcttctttcccatgccgtttgcacttcactggtacatgttttggctcacattatgttttttttctcagaccaacaactagactagaaaagttgaaggaagaatgatgcgtaaaactacataggtggtgtggtttcgcatttcgcagagtttcaggaaaaataaagcatacttggttgtgttgctgacccatttttcagctctaaattattggttttggaag

SEQ ID NO: 19290 - DNA, 2190 bp, Zea mays
aatcgtaattgtgtgttgctatatatatatatatatatatatataattctgaagctgaactaaccgttccctttctattatgcagcatagacgtgatttccaaggcatttgagggaaaatctgctgtaaacaggcagagaatggtctacaaggctatatgggaggagcttcagagcactgtgcatgctgtggaccagatgactaccaaaacgcctgatgaagctgctgccaacaagtaatcgatagatgcacaatacctgtgaaagcacagattatctgtgcttcgaagatcaggccattgcttggaccaaattttttctcttgggtggtattactttgcgtgtcagctgaatggtcaataatctgcggtatggatagcgcatggcttaaaaattatattttttccttttttttttttgcattggtgtgtgtgtgtgtgtgtatgtgtgtgtgtgtgtgtgtgtgtgtgtgtgtgttgggtgggggacttgaacgctgcattggtgcccgaaggcgtgcttcatgtacgacattgctcgctcttcgaactctcagtttccaaagcggacccgggactgagccgtgcttgaagcagatgtggtgcgtatgggagatggcggtgtagacttccctactgcatggttggtccatgtcgggggcagagcggcggcgtgggactgacccgtcggatttttgtgtcatcccagctaggactggataatcggttaaaatcgaaactttggcttctcagcctcactagccgatcttcttcagaccagcaaatcgacaactccgtcgtcggtttcttactttttttgttgttgtaaccacaaaaaaaaaacgagctacccagactcccgtcgtcgccatgaccagccggccgctgcttcctattcgacttcgcgtcgctccgtgcgtccgcgctgccgctcggacttcgcacgcgctggcgctgctgctcgttgctcgccggtaactccttaggggccagtttaggaaccacattttttcaagggttttctatttttccaaaaaaaaatagttcattttcttatgtgaatatagaaatcacatgaaaaaatatagttctcaaactagcacttagagttctagcctaaagttttcggtcgccgcgactccttacagttctagtccaaagtttctatagcctctaagtcatttagaaattactaccagctacttctctaatgcaaccatactcctcttctctcattatgttttagatattgtgttgaaaccaaatcttatataaaacctagtttctcactcattcttcatctaactgcttgcaatatcctgttttagcttatgtagcagctgaattaaagctatagaaactgaatgacgtggagagttgggacttcacttagcacacttccatgtagacgcttccgcttgcatggtcgcgctggtacgctgtgctcgcacctctacgcggcgtcggccgctcccactcccatagctctgactcgcgaggtgccactggtcacccagtggcgaagccagagcggaatagagggatgtatagtagccttttcgtttctagctatgcttgatgaattccacgcgcattgtcgtgagaattagaaacttatttttaagatgaaggtatgatgtcaaaaaagagaggagaatagcatccgtgtagttaataaaaaaatttagtgactactccttctatccatatgatttagtcatttttgtttattctaagtcaaactattttaaatttgaccaacaatatatatatatatatatatatatatatatatatatatatatatatatatatatatataagactaaagtattttaaactacaagaattatggtagtttaaggtacgataaatttagtaactttacttttatattgtaaaatattataaaatatccagtgtaatcggtcaaagttgataatgattgacttagaataaatctaaaataactatatcatatgaatggagggagtagacaagaccatcgtataaaaataattaatagaacagcatgaaaatagacggtcaatcatgtttgttggctttgtgcactgccgtttcattagtacttttaaaacaaatccattcggattttagaaggatgacgtgacttgatgtggtactagatataatttacactgcagatttgttttatgagagatacagatata

SEQ ID NO: 19291 - DNA, 1911 bp, Zea mays
ttcgtatatatattttatatatatatcatattgtttgtcgtttcgtatttatatttcatacaattttttagttgcgattgctagtcccagtcccaccgctaggcacatacctaattttaacttatagattcagctgtttctagttttaacatatagattcagctgtttcttgtgtgacaacagaaacagataagcttttttcaacaatgagcagctgtgcctaaagccgcaagcaccacagccggagaaatcctctcgtgtggtctcttcagctctcagacggcaagacgatgctgccgccgaggtccgccgccgccgcgccgtgctcggttgcaggacttctgttccaccgattctcatcctactcgtcctcttctgtctattctgtccgccaccacgcctcgtctgctctctcctcccagccctccacccgccccaccaccacctggtcctcttccccccattccagcagccgcaggatcagggggtttgcggcctgggcttcggcgccggggccggcggggtctgcggattccctcgctacaaaggcgctagaggctaaggtaccttgcttgcctccctggtttagctttctgattctaatctttgttcagatgctagggtaagcgttcctacgctgtcgtttgccatggagactgacagattcgtttctgtttctatggtttcttggcagatcaaggagcagctggaggcggacacagtcacggttgtggatacctctggagatggccgccatgtttggtgagtaacaaaacccccaccccacttaatttacaaacattgatattctgtttttttacatttactgggatgcgaagaaacaaatgtgctacatgctcagtagatctttgaaactcacacttacatggtgaatgtgtctgcattctgtagtcggtatcaaagaaaacagggtcgtttttagatgtatcaatttgtggtgtatagttcacaacttatttgtttagaaatgttcctatgtgaagcattgtaggtgattgatatggagatgatagcgtttttttttttgcttaaagatttgagaaatgtttgttttggcattgtagtgctactactaccagaacaaaaaaaaatgtagtgctgaaaatatttacatggattgaagtttgtttaagatatttctattccataagtgggagggtttttttggcaacccattttatcatgaagtctatgtaatcaaaagtaaccaaagtattggcttctagtttagttgtcacatgtaagtttgacagaaagttaaccaaagacaaactgggaccttttctcaaaaagttcgcttttatatgctataatagagtattttccaattaaatttacctgttataagccagtttagtatggcatgggattagttattgtctttaaagaagtttattttagctgttctgaatggaattggtgcaaagttgatagctattcagccttttagaataaaatgaaatagttggaacagaaactccccagatggccaatcacaatatatcaccaatgatcaacactgaagaaaattcctatactgaagtgagtgattagtagtattgattgttccatcaatttaaataaaacaaacaattcaacagatatacttttattgatatttccaatgaaagtatgccaatatatttgctatagtattgatgtataagatattaacatgtgtgtgtgtgtgtgtgtgtggtaagggttcttgccccacttgttggctggctttgttaattcaccgctcacacaactggaggtagaagtaaaggggagatcggagcacatacacatgaactgatgaacactagttaatgctgctccttgagctaaggatgcagctggtccacatgcttgcatatatacatggtcttcacttttacaagatgt

SEQ ID NO: 19292 - DNA, 1241 bp, Zea mays
atttcatacaattttttagttgcgatttttagtcccattgcaacgataggcacatacctaattttaacttatagattcagctgtttctagttttaacatataggtcccgcggggccggccgggccaacagaaacagataagcttttttcaacaatgagcagctgtgcctaaagccgcaagcaccacagccggagaaatcctctcgtgtggtctcttcagctctcagacggcaagacgatgctgccgccgaggtccgccgccgccgcgccgtgctcggttgcaggacttctgttccaccgattctcatcctactcgtcctcttctgtctattctgtccgccaccacgcctcgtctgctctctcctcccagccctccacccgccccaccaccacctggtcctcttccccccattccagcagccgcaggatcagggggtttgcggcctgggcttcggcgccggggccggcggggtctgcggattccctcgctacaaaggcgctagaggctaagatcaaggagcagctggaggcggacacagtcacggttgtggatacctctggagatggccgccatgtttgcatagacgtgatttccaaggcatttgagggaaaatctgctgtaaacaggcagagaatggtctacaaggctatatgggaggagcttcagagcactgtgcatgctgtggaccagatgactaccaaaacgcctgatgaagctgctgccaacaagtaatcgatagatgcacaatacctgtgaaagcacagattatctgtgcttcgaagatcaggccattgcttggaccaaattttttctcttgggtggtattactttgcgtgtcagctgaatggtcaataatctgcggtatggatagcgcatggcttaaaaattatattttttccttttaaaaaaaaaaaatgaagcgcccgggggtgatgtgtgtgtgtgtgtgttgggtgggggacttgaacgctgcattggtgcctgaaggcgtgcttcatgtacgacattgctcgctcttcgaactccagtttccaaagcggacgccggacgccgtgcttgaagcagatgtggtgcggatgggagatggcggtgtagacttccctactgcatgggtggtccatgtcgggggcagagcggcggcgtgggactgagccgtcggatttttgtgtcatcccagcttgtttggtttaaatcggttaaaatcgaaagtttgtttggtttaaacaaaaaaaaaaaaaaaa

SEQ ID NO: 19293 - DNA, 971 bp, Zea mays
cccacgcgtccgcccccgcccccgccctcgcgtccgcccaaccgccccaaactattctctctttgcggccggtctctgctttcagattcatttctaaccagggttcctccagcccagccgccgccactgttgaggagctcacatcgcctcgacacaacacggtctctggtttcaacgtataataactgggctgcgagcactatatggatgatggcttcacgaggcaccagtgccgtgctttcaagggctgctcggatgaggcaaaaactgcagtctgccttggaggccagtgccctagatattgaagacgtttcttaccaacatgccgggcatgcagccgtcaaggacaatgcgaacgagacgcacttcaacatcaaggttgtttcaccaaaatttgaggggcagaaccttgtgaagcgtcacaggatggtgtatgatcttctgagggatgagcttagctcaggcctccatgctgtctccattgttgcgaaaaccccgaaagagttagggtcttgattgtataacaatgttgaataagcactgtcctatgtttcgaaataagtctgtcgtagcagccatgacactgattgccaaaacaatgtcaccggcatgctcttcttattaagatctggtactcttcttattaagatctggtattcggattagattggagtgaagaatttatttcagctattttttgatttgacaagtaatgaccatgctaatcatgtcagatgcaaggcttattgttttttgggcccctgtgatggttcaggctgcggagccagtttacctgcatttgctatgtggactttctgagctgaaagggaagcagaatatgggaggaaaatcgttgccagccatgagccatgtcgctgttgtacttgcatcgttgggtgggcaaaacgcaaaacatgtgaaatttttttaaaaaaaccttttgcccccatgcaggatcgaactacagacct

SEQ ID NO: 19294 - DNA, 741 bp, Zea mays
  misc_feature (724)..(724): n is a, c, g, or t
cgacccacgcgccttctcggctttcagattcgtttctaaccagggttcctccagcccagccgccgccgccaccgttgcggagctcacatcgcctcgacacaacacggtctccggtttcaacattcatttctaaccagggttcctccagcccagccgccgccactgttgcggagctcacatcgcctcgacacaacacggtctctggtttcaacgtataataactgggctgcgagcactatatggatgatggcttcacgaggcaccagtgccgtgctttcaagggctgctcggatgaggcaaaaactgcagtctgccttggaggccagtgccctagatattgaagacgtttcttaccaacatgccgggcatgcagccgtcaaggacaatgcgaacgagacgcacttcaacatcaaggttgtttcaccaaaatttgaggggcagaaccttgtgaagcgtcacaggatggtgtatgatcttctgagggatgagcttagctcaggcctccatgctgtctccattgttgcgaaaaccccgaaagagttagggtcttgattgtataacaatgttgaataagcactgtcctatgtttcgaaataagtctgtcgtagcagtgtcatgtaaccatgaactgattgccaaaacaatgtcaccggcatgctcttcttattaagatctggtattcggattagattggagtgaagaatgaaaaaaaaaaaaaaaaaangaaaaaaaaaaaaaaaa

SEQ ID NO: 19295 - DNA, 1358 bp, Zea mays
gcacgagaccattacctagaacatcctaatcgaaaaacgaacgaagaggtgaaagcgacggctaggaagtaggaaccgtggccgcgaacgcagacggcctcgagctctccctcaacccccgccgcgggctcttcctctgccccccaggcgtacgctcttcgcccccctgtccgcgcccggtgcccagggctcccgcctcagccagtccccccgccccgtgcgtcgcgcagtcgctagaggtggtggtttcaggggattatggaatgcttaacaacaagttttccaagaaatgttggaaaagagtacagctgttcaagcaagttggtgtccagaaaccaatggacccccaaaaggatttgctgctacgtctcttgttcgacaaactccagtcgatgccacaagttcactgatgtggcatgccccatgagcccagttattcgaaaaaggttacgctggagatgctttgctgcaagtttgaacttagaagatggccctgcaccctctgactcgacgtcatcttcatcagagcagactactgatgctgatggaactactaatggtgatgtatctgaaaatctgctttctcgaaagccgagctctgatgagttaaaggctcttttggctgattcggaacgaagtaagcttttgagaagactcagtgaagcaaatcaatataaccgattcctcaagagacagttgcaaataaaggatgatgcagtcgtaaaattcaaaggtgaacttgctgttttggaactagaactgcaggctctggttggcctagctgaagaggttgctaattttgatgttccgttagggtctaggaagataaacggaaaatatattcaatctcatcttctctccagattagaagctgtccatgataagattatggaacaggtaaagagtgttgacgctttaaagacccaagaaattcctgtctactggattggcatggctgagaatgtgcagatcatgggttcattcgatggatggtcacagggcgaggcgatgtccatggagtattcaggtgactacggaagattctctgcgactctgaagctaagacctggaaggtacgagatcaagtttttggttgatggggaatggagattgtcgcctgaatatcccactgctggagatggactgacgcagaacaatattcttgttgtggagtaatacaacttcctcatttaccatttcagtcatccaaacaatgccgaagtgcacctacatgtcttcttccatctgtaatactatgcttactatgtggacatgtggttgcctcacagaaatcgaataaattagcctatcctggcatatgatcctttcgtatttaaatatatgaagaataaattaac

SEQ ID NO: 19296 - DNA, 1273 bp, Zea mays
  misc_feature (444)..(444): n is a, c, g, or t
  misc_feature (446)..(446): n is a, c, g, or t
  misc_feature (451)..(451): n is a, c, g, or t
  misc_feature (462)..(462): n is a, c, g, or t
  misc_feature (487)..(487): n is a, c, g, or t
  misc_feature (500)..(500): n is a, c, g, or t
  misc_feature (507)..(507): n is a, c, g, or t
  misc_feature (520)..(520): n is a, c, g, or t
  misc_feature (579)..(579): n is a, c, g, or t
  misc_feature (651)..(651): n is a, c, g, or t
ccattattgtgttcacagtttaccatgattaattaattaactaattaaatataagtttaaccggagaagtacgtacatatgtacgtgcagccgtggtggagtccatcggggtgtcctacggcatgagcggcgacaacctgccgccggcgagcaccgtcatcggcatgtacaaggacaacggcatcccgctgatgcggatctacgcgccggaccaggcggccctccaggccgtgggcggcacgggcatccgcgtcgtggtcggcgcgcccaatgacgtgctgtccagcctcgccgccagccccgccgcggtcgcgtcgtgggtccgcaacaacatccaggcctaccccaaggtctccttccgctgcgtctgcgtgggcaacgaggtgaaggcggcgcggcgcagagcctggtcccggccatggagaacgtccgcgccgcgctgtngnctgcngggctgacggnatcaaggtcaccacgtccgtgttgnaggccatctcttngcgctanaagccgccgtccnccgccgagttcacggacgaggcgcaggggttcatgggccccgtcctcaggttccttggngcgccggcgcgcctctcatggccagcgtctacccctacttcacctacgccaccaacccggctgccatggacnctcagctacgcgctcttcaccgctccgggcaccgtcctccaggacggcgcctacgagtaccagaacctcttcgacgccaccgtcgactccttctacgtggcgatggccaaccacgggggctccggcgtcacccttgtggtgtcggagagcgggtggccgtccgctggcggcgtcgcggcgtcacccgagaatgcggccatctacaaccagaacctgatcaaccacgtcggccggggaacgccgcgccacccgggcgccatcgagaccatcctcttctccatgttcaacgagaacctcaagcagagcggcgtggagcagaactgggggctcttctaccccaacatgcagcgcgtctaccccatcaagttcaactgaagctagctcgatcgaggcgatcatgtattgctttgcgaccaccactgggagtgtctaaggaggctactctcagatgagtatgccatgaggattcttatacgtcgaagtcgtcgagagaccaacgcatgggcaacgcgtgtgaagtgtgatcaatatttttctttgattttttttttggtgttttcactgaaattgaacttcgaataaaaaagccagctcttcggacgccgaagggttgtctctccct

SEQ ID NO: 19297 - DNA, 1662 bp, Zea mays
  misc_feature (8)..(8): n is a, c, g, or t
  misc_feature (28)..(28): n is a, c, g, or t
gcggtggncggcacgggcatcagcgtgnccgtgggcgcccccaacgacgtgctgtccaacatcgcggctagccccgcggcggccgcgtcgtgggtgcgcaacaacatccaggcgtacccgtccgtgtcgttccgctacgtgtgcgtgggcaacgaggtggccggcggcgcggcgcaggacctggcgccggccatggagaacgtgcacgcggcgctggcggcggccgggctgggccacatcaaggtgacgacgtcggtgtcgcaggccatcctgggcgtgtacagcccgccgtccgccgcggagttcaccggcgaggcgcgcgggtacatgggccccgtgctgcagttcctggcccgcaccgggtcgccgctcatggccaacatctacccgtacctggcctgggcatacaaccccagcgccatggacatgagctacgcgctcttcacctcctccggcaccgtcgtgcaggacggcgcctacgggtaccagaacctcttcgacaccaccgtcgacgccttctacgtcgccatgggcaagaacggcggctccggcgtgccgctcgtggtgtcggagagcgggtggccgtccggcggcggcgtccaggccacgccggccaacgcgagggtgtacaaccagtacctcatcaaccacgtcggccgcgggacgccgcgccaccccggcgccatcgagacctacctcttctccatgttcaacgagaaccagaaggagagcggcgtggagcagaactgggggctcttctaccccaacatgcagcacgtctaccccatcagcttctgaagaaccgttaaccgtaccgatccaagctagctgctagctggccctggtggtggctccgaccgacgacggacgacgacgatcgacctgcagccgtatgtgtcgatccggccgtatacagatgatagtacgtagcatgtatgtatatatatggtatatgtgggcttgctttgcgaccgctgggagtgagtatccgatccaattggtacggtagctactcccagatgcgtacgccgtgagtgatgctgagtacgtattttatatgtatatgttatacacatcgaaagggatctttcggagacgacgcgcgcgcgcggttaccgtatatattgataaatacggtaacgtcgtcgtcaattggtcgatgatctcccttcgtagctatagtagtatacagagagagaggttggtgatggataagatacacatgcatgtacattatcacgcaccgtataaattaatatacggtttttaattaaaaaaaaataaatgtacgcgtacttcaaaaaaaaaaaaaaaacatttccctggttccaaaaaaatagaatacaactttcgtttttaagaaatcatcaaatgcttctaagttagattaagggtttacaaaaaatattaatatttatgatctaaacatatattagatgaaaagatgtactttttctataataaatcgatttggagatgtagatatgaatactactgtttattacaataaatttagtcaagtttcaactactttaacagaccgcggggccgcgggggtgaacgtttgcatgcatgggctcggcgccgacgtcatggtacgcgggcggatgtgccggccccgcccgatgacaccgggccataccggcgcatgcatcgccgtgc

SEQ ID NO: 19298 - DNA, 1455 bp, Zea mays
aatcgaagcaaatacaagcagagagttttttttggagaggcgtgtaagcataggcagaagatacacagtagcctcttgttgaacacggggatggcaaggcagagtgcagcctccatgttggctactacgacgccgttgcttctcagcgtcttggccaacatcgccgtggtggagtccatcggggtgtcctacggcatgagcggcgacaacctgccgccggcgagcaccgtcatcggcatgtacaaggacaacggcatcccgctgatgcggatctacgcgccggaccaggcggctctccaggccgtgggcggcacgggcatccgcgtcgtggccggcgcgcccaatgacgtgctgtccagcctcgccgccagccccgccgcggccgcgtcgtgggtccgcaacaacatccaggcctaccccaaggtcgccttccgctgcgtctgcgtgggcaacgaggtggaaggcggcgcggcgcagagcctggtcccggccatggagaacgtccgcgccgcgctggtcgccgccgggctggacggcatcaaggtcaccacgtccgtgtcgcaggccatcctcggcggctacaagccgccgtccgccgccgagttcacggacgaggcgcaggggttcatgggccccgtcctcaggttcctggcgcgcaccggcgcgcctctcatggccagcgtctacccctacttcacctacgccaccaacccggctgccatggacctcagctacgcgctcttcaccgctccgggcaccgttctccaggacggcgcctacgagtaccagaacctcttcgacgccaccgtcgactccttctacgtggcgatggccaaccacgggggctccggcgtcacccttgtggtgtcggagagcgggtggccgtccgctggcggcgtcgcggcgtcacccgagaatgcggccatctacaaccagaacctgatcaaccacgtcggccggggaacgccgcgccacccgggcgccatcgagaccatcctcttctccatgttcaacgagaacctcaagcagagcggcgtggagcagaactgggggctcttctaccctaacatgcagcgcgtctaccccatcaagttcaactgaagctagctcaatcgaggtgcacgtccacgtaccctacagtctacacacatcaatcaataggtatatatgtatcactgcatgcaacctgtatacttatgcatcccagctgcaggcgatcatgtattgctttgcgaccaccaccgggagtgtctaaggaggctactctcagatgagtatgccatgaggattcttatacgtcgagtcgtcgagagaccaacgcatgggcaacgcgtgtgaagtgtgatcaatatttttctttgatttttttttgtgttttcactgaaattgaacttcgaataaaaaaaggcagctcttcggagggctgagggatttgtcacaaaaaaaaaaaaaaaa

SEQ ID NO: 19299 - DNA, 1961 bp, Zea mays
  misc_feature (1)..(2): n is a, c, g, or t
  misc_feature (18)..(18): n is a, c, g, or t
nngggccccgtgctgcanttcctggcccgccccccgtccccgccctgggccaacatctacccgtacctggcctgggcatacaaccccagcgccatggacatgagctacgcgctcttcacctcctccggcaccgtcgtgcaggacggcgcctacgggtaccagaacctcttcgacaccaccgtcgacgccttctacgtcgccatgggaaagaacggcggctccggcgtgccgctcgtggtgtcggagagcgggtggccgtccggcggcggcgtccaggccacgccggccaacgcgagggtgtacaaccagtacctcatcaaccacgtcggccgcgggacgccgcgccaccccggcgccatcgagacctacctcttctccatgttcaacgagaaccagaaggagagcggcgtggagcagaactgggggctcttctaccccaacatgcagcacgtctaccccatcagcttctgaagaaccgttaaccgtaccgatccaagctagctgctagctggccctggaccctggtggtggctccgaccgacgacggacgacgacgatcgacctgcagccgtatgtgtcgatccggccggccgtatacggatagtacgtagcatgtatgtatatatatggtatatgtgggcttgctttgcgaccgctgggagtgagtatccgatccaatggtacggtagctactcccagatgcgtacgccgtgagtgatgctgagtacgtatcttttatatgtatatgctatacacatcgaaagggatctttcggagacgacgcgcaaaagcggttaccggccatattgataaatacggtaacatcgtacgtcgtcaattgatcgatgatctcccttcgtagctctagtagtatacagagagagaggttggtgatggataagatacacatgcatgtacattatcacgcgccgtataaattaatatacgggttttaattaaattgagataattgtacgcgtacttcaatcaatctatcatccatttccctactttaacagacacgggtgaacgtttgcattgcatgcatggctcggcgccgacgtcatggtacgcgggcggatgtgccggccccgcccgatgacaccgggccataccggcgcatgcatcgccgtgctctcgcgtgcgaggagcgacagcggccggaggcggacggcgacgcgagccggaaagctagcgccacttttctggaggaattatatatgcagggagacgacgatgcggtccgatccactcgaacgtacggcgagagagatagggctgtctctctgtacgccgtggtcgtccgcgcgcgtcatccatccgtttgtggatatgtatacttacatgcacatctctcgtccagctagggctgactcatcacctgcgcactcaaccatatgcatcctatcgccccgcccgctatatatgtgccatgagatcccacttgcacgtaccgcgcgctttctagtatatatgcgacgaattgagaatacgattccttcatgtggacaagttgaaactagagctagggtatacaactatacatgcacgcacgctgatgaacaaattgagccgcttcttaatttcagttccgtcaggctaccagatgatgatcttgacaggattcgttttaaaatggttcctaccggatgcgcggcaggtacgtagtagtagcctcttagtatgctttaattaggctcatcacctaaaccttaaccaaacgacgtaggacactgcagtactgctgaccgaggtggacgccgcgccacacgttctgcttctgcaccggtccatccatccatccatccattcatccgtctcgtctcggattggttctgctgactgttcatgcccggccggccggccgtgtggaaatgttgggactgcgtctggctcaactgtctaaaagactgacgacctgtgtcctgtgactttggtcaaagcaaggaccgagccgaatc

SEQ ID NO: 19300 - DNA, 2287 bp, Zea mays
ggggaccgttacgcgtgacgtaagcaatgacgaaactgacgggtacttttcgagagtcgcttcaaggtgctcgaacgtttcttggccacagacgaggcggagtagtaacgatcagataaacgctttcgttctcatctgaacttctggagcataccttacgaaagcacactgcagcgtattgctcactcgtggtcgtggaatacatcgaaatcacagctggtcagctctaggtttacgaaagcactgtgtacaattaagcacttgcagaggctgttcaaaatttgcgaatgaagctacacacttggagcacacaccaagtaactggaccatttgagccttggaggcttgctgggatggagatcaccaagtcatacaagtctacctgcattcttcctcgatggttctgttctgtcaaggcatcaggcagaggtagtacaatagaaaactgcaaatataagtctctccagtcatcatgcatcctacaaatacacgtcggccccccgagccggccgggaaatctcttgctactccgctttctagctacacccttccttataaaatacgcaagagtgcagctgcgcagccgccgtcgcgcagccagccatggccatcaaagatgagccgcagccgctgcacatcctcttcttcccgttcctcgcgccggggcacctcatcccgatcgccgacatggccgcgctcttcgctgcccgaggcgtcaggtgcaccatcctcaccacaccggtgaacgcccaactcatccgctcggcggtagaccgcgccaacgacgcctcccgcggaaccgagggcgccctggccatcgacatcgcggtcgtgcctttccccgacgtcggcctgccccccggcgtcgagtgcgccccggcgcttaacaccatggacgaccgcgaaaagttcttccacggggcccagttactccgcgagccgttcgaccggttcttggcggagaaccgcccggacgccgccgtgaccgacagcttcttcgactggtccgccgacgccgccgcggagcacggcgtcccgcggatagcgttcctcggcagcagcttgttctcgcgggcctgcagcgagtctacgctgcgcaacaaccccgtggaggccgcccccgacgacccggacgcgctcgtgctgcttccggggctgccgcgccgcgtcgagctgaggcgcagccagatgatggagcccaagaagcggccggagcgctgggccttcttccagcgcatgaacgctgcggaccagaggagctacggcgaggtgttcaacagcttccacgagctggagccggacttcatggagcactacaccacgacgctggggcgccgcgcatggctcgtcgggccggtggcgctcgccagcaaggacgtggcgacgaggggcgccaacaacgggctctcgcgggacgcgggcgcctgccagcagtggctggacgcgaaaccagagggctcggtggtgtacgtgtccttcggcacgctgacccatttctcgccgcccgagatgcgcgagctcgcgcgcggcctcgacctgtccggcaagaacttcgtctgggtcgtcggcggcgcggacaccgaggagtcggaatggatgcccgatgggttcgcggagctggtggcgcgcggcgaccgcggctttatcatccggggctgggcgccgcagatgctcatcttgacccacccggcggtgggcgggttcgtcacgcactgcgggtggaactccacgctggaggccgtgagcgccggcgtgcctatggtgacgtggccgcggtacgccgaccagttctacaacgagaagctggtagtggagctgctcaaggtcggtgtcgccgtgggatccacggactacgcgtccatgctggagacccggcgcgccgtgatcggtggtgaggtgatcgcgaaggccatcgggagagtgatgggcgacggcgaggacgcggaggcaatacgggagatggccaaggagctcggggagaaggccaggcgcgcggtggccaacggtgggtcatcttacgatgatgtcggacgcttagtggacgagctgatggctcgtaggagatccgtcaaagtctgattgcagcatgttcgtcttcgtgtgcacaatattaatctggaactcgtatacataaatttaatctcgatttttgttcaacatccttagtgtcgatgtttttttttcaaatatgcagctcgatcgacatgaagacgagcatgaaaaaacatattttgtaaacacattagccaaaagatgatatactatgagcctagattaactttatgtg

SEQ ID NO: 19301 - DNA, 707 bp, Zea mays
cacttccaccctcgcggccaccgcgccctaaccaagaatccgacccggcgctagacgattcggacggaaggaagacgagaaggccccgaggcgagcgggggatcaaagaagaagatgaaggtccgtgcggcggtgaagcgcctgtgccggttctgcaaggtggtgaagcgccggggaatcgtcttcgtccaatgcacggccaatgccaagcacaagcagcgccagggcttctccaccatcgccgaagcagccgccgtctcgtgcgttcacctgcctccgccgccgcccgctagcggttccgcctccgccgcagcgttcgcagagacttcgaaggtggcgaggcaagagatgtctatgaagttcaattggcggctgggtttagctgccctgttcaagaatggagaaaaataatatatcaggccttctaccatacgctgacatttttaagcagatgttgaatagggccagttggtacgatgatatcaagagaagcatgtagcaaaaactggaaactgcaccatcatgtatttgcagtggaataatatgagcagatattgttactttctcttaaaatgttcgattcttgattgtttaaatgtaatagcacttgcacaaagctgttgtgcttaactctgttttttacatcttgctgcgtggcccatttatcttattgggtggcaccgaaaaaaaaaaaaaaaaaatgaggc

SEQ ID NO: 19302 - DNA, 1203 bp, Zea mays
accgaacagcctcgcgtgtggcgccaccccgcagctgtgcacacgacacgatcagtgcgcacgaaactgcgcatggcgcgagacccagtccgcctggtcccgtgacaagcagcacgcaagacacacacgcgcgcgaacacgaacagggacacgaggccgcggcggccatggcaagaggcggcggcgatcggagtcgggaggatgatcccttctccgacggcggcaccaccgaaaccgactcggacgagtcctctccgcgtggggtgggggcccgcggtcccggctccacctccaacccgatcctgacacgcctcgcggtgtcgcggaactcgagcccgctggccgcggccaccgcggccccaggggtctgcctcctccgcttcgcctgggagtccgccgcgggctccctcgtcggcgccgtcgttggctacggtaaaggtttggttatgatgaaggggattaaaggatcatttgctgatgctgcgtcatctgctaagatatttgctgttcttgctggtgttcaaagtttagtagcctgctctttgagaaaactacgtggaaaagatgatggaatcaatgcaggagtcgcaggctgttgcactggccttgctctgagctttccaggtgcaccacaaactctgattcagagctgcttgacctttgggactttctcttacatcattgagaagctaaacaagcagcaacctgcgctggcgctcctgcctgcgacaggtgtgatggatccgaaggctggacaaagcgttcttcctcccttcacacttcctcctctggataccatggacgaattttctaagttccaaaactttttgtcatccaaatttcggggaaactgagttatcctggtggagtgacgcctagttatctactctggaacgtgtccttgtaaatgcgtcaatggtcaatctgagttttttttccccttgtttattcttcgccaatgtatgtttccaaattccaaggtagtgttttggtagtgttgatgattctaccttgacatatcgaacacaatttgtaaataaggcgagcagcttgtcctttgttcaactgattggatcttcggaggtttacccacagaccgtgccccgtaagaaggaagaacatgcaccttgattcttacgagtgtgtcctttgtcatcttgccataggggatcttcagaacattgtttcttaactgtcttttgc

SEQ ID NO: 19303 - DNA, 1555 bp, Zea mays
gccaaatttcaaactaaataagttactttattgagtgaatttcaattactttaaaatgaagggatccaaacggcccgtaaaaaaattgagctgctaaactagccgttcgacttcgctgcagccccccgcctgccgccggctgctagtaaatgctacagtaaaaaaagagacgaacatctgtagccgcagtctacctctccgatccctacgtaaccgaacagcctcgcgtgtggcgccaccccgcaggctgtgcacacgacacgatcagtgcgcagcgaactgcgcatggcggtgcacccaatccacctggtcccgtgacaagcagcactcaagacacacacgcgcgcgaacacgaacagggacacgagacagcggcggccatggcgagaggcggcggcgatcggagtcgggaggatgaccccttctccgacggcggcaccaccggaaccgactcggacgagtcctctccgcgtggggtgggggcccgcggccccggctccacctccaacccgatcctgacacgcctcgcggtgtcgcggaacccgagcccgctggctgcggccaccgcggccccaggggtctgcctcctccgcttcgcctgggagtccgccgcgggctccctcgtcggcgccgccgttggctacggtaaacccacgccgcccgtcgtttccgctatcccttgcctctccgttcgaatggaacctcaacctcgtgctagggtttatggctcaccgatgcgaggtaacgtgtggctgtggcgccatttcgatgacctcaggggcggacttgggacgatggggctgggactccgtgcggctataggttatgttcccccgattctagcgtcccaatttgtttgataagtattgttttgctatggacattgttctgttgttcaccctgggggtagccaaattatttgtgcctggtctaatttgtagtctttatgtacagttcaggatctgctcttggaactgcttacatttttttggtctataattgcaccatttagaactttcttttgttagattaatgctatgttatctaagtttctacagattgtgcagaagattctgattcgggtgggacattttaagttacatgcatgtgcgttttcggctctattttaaccatgggaacgggactatttggtttcaataaatgtctggatttgaaatgtgggggtgaaaatttctctgatatattcactttattttggcactggctcctgactcctgatttctgaccatgtaaccacacagaggtttagtactaaacatgactaaaccttgattcctacagtcagactgctaatctgctgtattgggctgagactctaagcctgaaaaagcttcacttgcatgggtatttgtgttatctttatagctaatatatctttaatctgttttcaaatttatgtatgcccatagttgattagttagttggtgatttggatggttctggagtatttggcttgtagcatatctgtttttttaatgaaagagaaggtatggtggtgtgtttgggacaattacctgcctttcatgggtgagga

SEQ ID NO: 19304 - DNA, 2122 bp, Zea mays
  misc_feature (29)..(36): n is a, c, g, or t
ctcgaggggccggccgggaaaaaaatccnnnnnnnnaaaaaaaaaaaaaaaaaaaaaaaaagattggcaacctcgaggccggccgggaccccgcccccgcccccgattcgccgggccgggatccgcccaccgagccaccggagcaccagccaccagtgcaccaccatcgcagggagttagggacacacaccggctgccgcggcccgccatgtctcactgctgcccctgcgcgagtgcctcctcctccaccgcgcccttcttcctcccttccatccccgactcctcttcctgcaggagcggcagcggtggcgccttcagcgctgctgttggtcggagcaagctgcggtgcggcggcgggccgaggcgcgggcaagcgacagtcgcggcaggcagcaaggacggcgggagcggcggcacggctggaggggagaagggagaagacgacgccccggcgttcaatccgttcgggttcgtgacggacaacccctccagccgcagcgccatccagctgcccgcggttcccgccgaggacggcaatgtcggccagatgctctacaggatcgaagacaagggcagggaatacggctcgtatgtcagagcaggagagtttcgatggttcgtcagggaaacagggtcacctgatgcacgacgtgggactattgtgttccttcacggagctcctactcagtcatttagttaccgggtggttatggctcagatggcagatgctggctaccactgctttgcacctgactggatcggatttgggttcagtgaaatgccacaacctggatatggattcgactttaaagaggacgaatttcacaaggcatttgatgatcttcttggtactctaaatatcaccgagcccttcttcttagttgtccagggctttcttgttggttcttatgggctgacgtgggcactcaataactcaagcaaagtccttaaattagcaatccttaacagtcctcttacagtttcttctccagtccctggattgtttcagcagctaaaatggccactctttggtgaatttacttgtcaaaatgctgttttggctgagcgtttcattgaagcaggtagcgcatatatgctgaaattggaaaaggctgatgtatacaggttaccgtatctatccagtggcgctcctggattcgctttgcttgaagctgccaggaagatcaatttccaagatgtactaagtagaatttccgccggattttcgtccaacggttgggaaaaaccaatactgcttgcatggggaatatctgacaagtacttaccgctctcgatagctgaggaattcaagcaagctaatcctggcgttgtaaaactagaggcgatagaaggagctggtcacatgccgcaagaggactggccggagaaggttgtgaaggcgctgacatccttcctgtaaacatgtgcaaagatcattatgtcatccgcacgggaactttcaaacatgcatgatgactgtcgtggcttcattacgtcctcctgtctaatttaattatgccttggattgcttagatttgtgactgtacaggtcaagatgtatattagcaaacgctttgcatttgtaaattgcgacgtggacgatatcagcgacgtgttagctcacgtcagagatggataacatgttgtagataatggaaaccaagttccggatttgtccccaaaataagggtacaaccagacatatgttgggggccttcgtcctccgaaggtcctcaaaaacatgatttgacaatgttttccaagtgaattatatgaacaggtattttcggattcagaattatggatatggagcacgaccaggacgaaggctgagccagacgaaggtcgggggcagccgaagctgtacgcagggaagcttcggcgcgatggcacaagggggaaccgaccttaagatgaaaagacttcggggtcctcaatagatttccataaaccgttaacaaatgtaatggacatgaatgtaattttacgtgggctgcgtcccgcgtctataaatagatgaacagtactcccgtactgttcacgcgcacttggcattttgcttttggcattacgctcgtacttttcaccttctcttaggaccgaaagtacatttgtaatttgg

SEQ ID NO: 19305 - DNA, 4359 bp, Zea mays
ggccgactcgcgactaatcgcgattagtcggacgactttaaaaccttgcttcagtagctcaacccctgctgctctgtaattatatgctgcacaattcattgtggattgcatttcttgtagatttcggaaggctacaagatttccacttaataattccaatcataccggttcttttgatgatcttactgtggatgcaccttagcctcctttccatgttgttttcttctttctatgccgatgcggtacccctagctccctctgtaggcttagagtgcacctgtctatagattgtctgtccatttatttattgaaaacaactttattattgttattgtctttctgtacagctaggcggtgttgagttgtgacatttgtatcacatgaatgaactcagagcatctcattgttaaaactgtgagcatatcaattcccctcctttaagcaatatgggagctaattgctgcattgctgcaaaggagaggacacaaccatgcattactccattagaagtatcagcgtacaggaatgtgagacattcaccatcatggagctttcggtgggacaatcgcacacatatagaagacataatggaaatccctactctgttttccaaccatagtagtggaagcattcggcctgatacaaagagtggttccattgccccgaccgaagggttttctaatggaaatagccttggaactagcccttccaatgtgtctcatggaacaaagtggcacaaatctgacaaaaaaatggaagcatctaaggttacaatggctgatcctcgaggtaatgaataaattgatgctatggtctatatgctttcaatgagcaaccctttattctccctccttttcaaattataagatgttttggttttttatagattcatagtttttgctatgcactttgatatacactatgtatagaacatagataactcgatacatcgtaaaagcactgtatctgaaaaaaccagaacatcttataatttggaagggagggtgtgttattgtagtctcccaaactgatgaactttgtttactgatttgtacttattttcagctgaccaccccactgcaagtaactcttcccttgaggtttgcatcattaagctacctgccaagaagttattaccttctaggttccatgcagttgtaataccaccacatttgttgtctgacattttttaatatgttgtgtaggcaaagcttttcaggaaatcactggacatgtcaagtgttgcttcagatttgaagacatcagggtctgttccttcaacaccacccttagtatccagagcagatccatcatcctccagggggcattctcaacctacagattcagattcgatgaagaaagcacggcggtcaccagggtatcaattatacagacaagtttcggacagcaaaattccatctctcagatctctcaatgagataagctctcctgaaggaaggccttcgtcttccatgctatcagtctgcagcaatgacttgtcagcagcaggatcctatgctgagtcatctgatggttggtcaatgcgcacattttctgaaatggtcgcaacatcccaaagagagaggtggtcacttgatagcgaactcttgggatccatttctagtaaagtgacaagaactagtgcttcaaattctactacacttccccctgaccaagaggtgtgcaagctgtgcttgaagctgttgaaggagagatcaacatggaatgctcaggagctggccgttgttgctgttctgttgtgtggacatgtgtaccatgctgactgtctggacagcataactacagaagctgacaaatacgatccgccatgccctgtatgcacgcatggtgagaaatgtacagtgaagctatttgggaagctggaatccaaggttaagaacaagataccaaaaaatgtggcagctgatatcaatccagatgggaacagtaataagcaccagaagaaaggtagaagagagcccaggttaggtacaagctcaagcatgaaggtcccattcagtcgcccgtttttgaggagacatttcttccattgggtctcgaccgcctcggtcagtctcagaaaccgatttcgacgagaaagaagggattctgggcaagacattggagggagtagaatagcctccaattgccattaggtgggctggtttccattagtgtgttttggtaagttcaatttcatatagcaggttactagttctattcatttcgtcatcatggccttcatggggatgaattcgaatgtgttgaatttggaatttctcgtgtcatccctgaacattttgaaatggacaacaacacttattaattgaatgtcttttcacaggaagggtcttcgagaggaggtgaactccccacgcatgcaagctcacggagttcagactggcacaagggctgccgtcctggcgggcaaccaacatatttgtgaagtttctcccagccataatattcggatactggtgcagagcgcacgctagcgccggtcccagcagatccattatagtagaataacaaggtcttttataccatgcgagatacggttgttgtaggccctggttgcagcttagtaatagtagcaatctaacagaaacggtgtggccttcatggatgtaaggcccaatgctgggttacacaaccagcttgctagattattttttgtactcgatgttttttaatgatgattgactaaggtacttcgtattgttggatggaatgcgtttaagttgaagtcttcagtggtagaagcggccgatgagagattggatgaaccgagtatccgtttgtgcatatatggtcacatcttagaaaaaaattgccagtaaatgtgagctccatttctgcctgtttgcagaagatttgacctgaactcgtacaagtttgcgatgcaagcaaagttgtgtctagtgccctcggcgggtaaggtaccagctagcgtttagtgtcatgaagccacacccacggtatcaaatggattactggagtgcttacaaactcttagacagcagaaatcaaatggattgctggagtacaattctgtagtttagcgagagatcatcttcacttgttcaaaaagatgctataataaaagagaatgcagacaatgcagtggccgctccactatgtagtgtactgtacaaacatggttcagatttacaaagctaaggatagtagtaacagtctgaagctacatcttttttgttcatacgaccaacccttttccctctttttttctttttcgattttcgataggcacccgttggtagcaactagacgatcaaaagaagagagaaaaaacttaatatgtacagcaccacaaaaaaaacaagtggagataactgggaatcagtggtcgcaaaaatgtatttccagtaatcccagtgagataagctgaggaactcgatttctattccagtccaatgcaagcaaagctggcgaactactccaaggacgaagccaatgctgccactgaccactagagctacaattaagcatgctgatgttccatgattcaaattcataggttggcattggagcggtgataatgcagcactagagcagcaactccaaccacaagaagggcaacaaatatgtatgccctgaatccagctgatgaacatcttttgaagccctcgagataaccttggttgctgtgggcttcatgattggctgcatcagactgcttggcagaaatgacacccgtttgccggcctcgtctggttcccgctcaacatcagtcctgagatcaagacgacgaccactgttatctgtaaacttcatagtctggttgatagattctgaattactcgtaaccatcctcttaattccaacctgcattttaatcttgccagctgctagtgaaatgttagcgggaggcgcagttgctctgcgccttcgtattgtaattccggtgtcattattttcatttgacatatccatcttgttattttcatgatctaactgcaattcggcattcggagtttcattctcaaagttgtttggaagaacatatgaaccaatccccatcatgtagtttgtctgattgttattaccttcctggccagtttgttccaaaaatatgctatcattgaactggtcagtaccaggatacaacatactgtaaagatcctcgggaagatcatctgtgaataggtagtctgtggcatctgttccatcctggatagggctagcatggcctggtctgatattcggagccatggaaccaggattctgcaaattctgaaaggaaaacaaatgcaaagggtgttagaccaatgcaaacaagcacacaatttctaaaagtagtgaataaaaactccacgtcaaaatataataaacatggac

SEQ ID NO: 19306 - DNA, 2195 bp, Zea mays
ccggcccggtcccatccgcaccgggttttgcccacgcgcccgcacagccacactgcccttctctccccttcctctctcctctgcgtcgcttccacctctcaatctcaccccacgcctgccccgagctccaaccctaaaggaacacacccctgcttgcggcggcggggagcggtcttgggcgtccgccgttgctgtggcccagccgtgacagatccgggccccgcgccgttaggtcggtgtttcttcggcgacggtgcagccgctggatgttagtctggcggatcggggcccgttgttcgcgtgattcgagctaggcggtgttgagttgtaacatttgtatcacatgaatgaactcagagcatctcagtgttaaaactgtgagcatatcaattcccctcctttaagcaatatgggagctaattgctgcattgctgcaaaggagaggacacaaccatgcattactccattagaagtatcagcgtacaggaatgtgagacattcaccatcatggagctttcggtgggacaatcgcacacatatagaagacataatggaaatccctactctgttctccaaccatagtagtggaagcattcggcctgatacaaagagtggttccattgccccgactgaagggttttctaatggaaatagccttggaactagcccttccaatgtgtctcacggaacaaagtggcacaaatctgacaaaaaaatggaagcatctaaggttacaatggctgatcctcgagctgaccaccccactgcaagtaactcttcccttgaggcaaagcttttcaggaaatcactggacatgtcaagtgttgcttcagatttgaagacatcagggtctgttccttcacaccacccttagtatccagagcagatccatcatcctccagggggcattctcaacctacagattcagattcgatgaagaaagcacggcggtcaccagggtatcaattatacagacaagtttcggacagcaaaattccatctctcagatctctcaatgagataagctcccctgaaggaaggccttcgtcttccatgctatcagtctgcagcaatgacttgtcagcagcaggatcctatgctgagtcatctgatggttggtcaatgcgcacattttctgaaatggtcgcaacatcccaaagagagaggtggtcacttgatagcgaactcttgggatccatttctagtaaagtgacaagaactagtgcttcaaattctactacacttccccctgagcaagaggtgtgcaagctgtgcttgaagctgttgaaggagagatcaacatggaatgctcaggagctggccgttgttgctgttctgttgtgtggacatgtgtaccatgctgactgtctggacagcataactacagaagctgacaaatacgatccgccatgccctgtatgcacgcatggtgagaaatgtacagtgaagctatttgggaagctggaatccaaggttaagaacaagataccaaaaaatgtggcagctgatatcaatccagatgggaacagtaataagcaccagaagaaaggtagaagagagcccaggttaggtacaagctcaagcatgaaggtcccattcagtcgcccgtttttgaggagacatttctccattgggtctcgaccgcctcggtcagtctcagaaaccgattcgacgagaaagaagggattctgggcaagacactggagggagtagaatagcctccaattgccattaggtgggctggtttccattagtgtgttttggaagggtcttcgagaggaggtgaactctccagcatgcaagctcacggagttcagactggcacaagggctgccgtcctggcgggcaaccaacatatttggaagtttctcccagccataatattcggatactggtgcagagcgcacgctagcgccggtcccagcagatccattatagtagaataacaaggttttttataccatgcgagatacggttgttgtaggccctggttgcagcttagtaatagtagcaatctaacagaaacggtgtggccttcatggatgtaaggcccaatgctgggttacacaaccagcttgctagattatttattgtactcgatgttttttttaatgacgattgactaaggtacttcgtattgttggatggttgcgtggaatgcgtttaagttgaaggcttcagtggtagaattttcc

SEQ ID NO: 19307 - DNA, 1179 bp, Zea mays
gagtcatccgatggttggtcaatgcgcacattttctgaaatggtctcaacatcccaaagagagaggtggtcacttgacagtgagctcgtgggatccatttctagtaaaatgacaagatcaagtgcttggagttctactacatgcccccctgaccaagacgggtgcaagctgtgtttaaagctgctaaaggagagatcgacatggaacgctcaggagctggctgttgttgctgttttgttgtgccggcatgcataccatgctgactgtctggacagcataactacagaagctgacaaatatgatcctccatgccctgtgtgcacgcatggtgagaaatgtacagtgaagctatttgggaagctggaatcaaagatcaagaacaagataccaaaaaatgtggcagttgatattaatctagatgggaatagtagtaataagcaccagaagaaaggtagaagagagcccaggttaggtacaagttcaagcatgaaggtgccatttagtcgtccatttttgaggagacatttctccattggatctcgaccacctcggtcggtctcagaaactgattccacgagaaagaagggattctgggcaaggcactgggagagagtagaatagaatccaattgtcgttaggtgggttggtctcaattattatgttttggaaggatctttaagaagagttgaactccccagcatacaagggctgccgagcaaccaacatatttggaagtttctctcagccatcgtattctgatactggtgcagagcgcacaacaaggtttcttataccatgcgaggcagggtcgttgtaggccccgcttgcatctaagtaatagtagtatcgatctaacagaaacggtgtggccttcctggatttaaggcacaatgctgggttataagattacacaaccagcatgctagattattcgccttcctggatttaaggcccaatgctgggttataagattacacaaccagcatgctagattatttactgtacctgcagtttttttaatgattggctaaggtatttgttgttgattgatggaatgcgtttaagttgaaggcttcagtggtactgtagaacttttcgatcagattggctgaactgatcatccttccgttcacatatactaaatatagacacatttacagggtgtttggtttgaggagt

SEQ ID NO: 19308 - DNA, 3188 bp, Zea mays
  misc_feature (2775)..(2775): n is a, c, g, or t
tattcggcacgaggaacgaagatgtcttataatttggaacctagggaatagattcctaaaggctacaagattatcatgtgcatttctattcgacaaataataataattccaatcatactggttcttttgatgatcttgttgtggatgccccttagcttcctctttgggggtgttttcttctgtctatgtggtacccctagctccctctgtaggcttagagtgcacatgtctatactacatactatcgtgtttaactttatactaagtttttgctcatttctttattgaagacgaccttattattgttattgtatccctgtacagctaggcagtgttgggttgtaaaatttgtatcgcgtgaatgaactcagagcatctcaatgttaaaactgtaaaaggggcagacctggtgccagaggctcccacatgagtgggttctagggaagggataatccgaagcaagcctcccccctgcaaatgcagagatgtggctttgaacccgtgacctggtgactcagtgagacacctctcaccactgcaacgggcgtgtccttcctcagcgttaaaactgagcatattaattcccctgcttaagcaatatgggagctaattgctgcgttgctgcaaaggagaggacacagccgtgcatcactcctatagaagtatcgacatacaggaatgtgaggcgctcgccatcatggaacattcgatgggacaatcgcacacatatagaagacataatggatattcctactctgttctccaaccatagtagtggaagcattcatcctgatacaaagagtggttccattgctccaactgaagggttctctaatggaaatagccttggaactagcccttccaatgtgttccatggagcaaagtggcacaaatctgataaaaaaatggaagcacgcaaggttacaaagtctgattctcgaggtagtgcacagtttgatgctatggcttatgctttcattaagcaaaatcctttatactccattactccctccattccaattataagatgtttcgttttttctagatacatagcttttgctatgcacataaatatacactatgtctagatacattgtagaaacaatgtatctaaaaaattcaaaatgtctcataatttggaacagagggagtataattgtaatcccctaacctgatggactttgtttactgatttttacttattttcagctgatcgctccacagcaagtaactcttctcctgaggtatgcaacattaagctacctgccaagttgttaccttctaggttccatgcaatggtaataccgatgcatttgttgtctgacatcttttttgtaatatgtgcagacaaagctttccaggaaatcactggacatatcaagtgttgcttcagatttgaagacttcagtgtctgttccttcaacgccacccttagtatccagagcagatccgtcatcctccaaggggcattctcaacctacagattcagatttgatgaagaaagcatggcggtcaccagggtatcaattatacagacaggtttcggacagtaaaattccatctctcagatctctcaatgagataaggtctcctgaaggaaggcctccctcttccatgttatcagcctgcagcaacgacttgtcagcagcaggatcctatggtgagtcatccgatggttggtcaatgcgcacattttctgaaatggtctcaacatcccaaagagagaggtggtcacttgacagtgagctcttgggatccatttctagtaaaatgacaagatcaagtgcttcgagttctactacacgcccccctgaccaagacgtgtgcaagctgtgtttaaagctgctaaaggagagatcgacatggaacgcgcaggagctggctgttgttgctgttttgttgtgtggacatgcataccatgctgactgtctggacagcataactacagaagctgacaaatatgatcctccatgccctgtgtgcacgcacggtgagaaatgtacagtgaagctatttgggaagctggaatcaaagatcaagaacaagataccaaaaaatgtggcagttgatattaatctagatgggaatagtagtaataagcaccagaagaaaggtagaagagagcccaggttaggtacaagttcaagcatgaaggtcccatttagtcgtccatttttgaggagacatttctccattggatctcgaccacctcggtcggtctcagaaactgattccacaagaaagaagggattctgggcaagacactgggagagagtagaatagaatccaattgtcgttaggtgggttggtctcaattattatgttttggtaagttcaatttcatatagcagattactagtcctattccttttgtcatcatggaacagtttaaagcaggttactaaaattcaaactagtgtcgaatttggaatgtcatgtcatctctgaacagtttaaagccgacaatagcatgattaattgaatttgtgttctttccacaggaaggatctttaagaagaggtgaactccccagcatgcaagctagtggaggtgaactccccagtatacaagggctgccgagcaaccaacatatttggaagtttctctcagccatcgtattctgatactggtgcagagcgcacaacaaggtttcttataccatgcgaggcagggtcgttgtaggccccgcttgcatctaagtaatagtagtatcgatctaacagaaacggtgtggccttcctggatttaaggcccaatgctgggttataagattanacaaccagcatgctagattatttactgtacccgcagtttttttaattattggctaaggtatttgttggtggttgatggaatgcgtttaatttgaaggctttagtggtactgtagaacttttcaatcagattggctgaactgatcatccttgcgttcacatatactaaatatagacgcacttatagggtgtttggtttgaggagtgagttagtctcatctttttattccgtattttttgtttggtttgtggaatagaatgagctgattcatcatcaacttatttctcatagttagttaatactaatataataattctcatagttagttaatactaataatgattctcatagttagttaaaactaatataatgaatgtgatcatctaaccaaatttgaaaaatagatctatgatg

SEQ ID NO: 19309 - DNA, 1300 bp, Zea mays
gggaccctccccgccggcccggccggggtttccgctcgcaggcaggcacagcgccaagcggcgaccgagagtccgagacccattcccatccacgcgaccacgctgccgttctctccccttcctccccgtcgcttccattcccgtccctcacaatctcacccccgccagccgagccccaaccctaacgaaatttacacctgcttcgttggcgtgagcggtcttaggcgtcgggcgtcgctgctgtccagcggtgtcggatccgggtcccgcgccgttaggtcgaggtttcttcggcgacggtgcagccgctggatgttagtctggcagatcggggccgagctaggcagtgttgggttgtaacatttgtatcgcatgaatgaactcagagcatctcaatgttaaaactgttaaggggcagacctggtgccagaggctcccacatgagtgggttctagggaagggataatccgaagcaagccttccccctgcaaatgcagagatgcggctttgaacccgtgacctggtgactcagtgagacacctctcaccactgcaacaggcctgtccttcctcatcgttaaaactgagcatattaattcttcttcttaagcaatatgggagctaattgctgcattgctgcaaaggagaggacacagccgtgcatcactcctatagaagtatcggcatataggaatgtgaggcgctcgccatcatggaacattcgatgggacaatcgcacacatatagaagacataatggacattcctactctgttctccaatcatagtagtggaagcattcatcctcatacaaagagtggttccgttgctccaactgaagggttctctaatgggaatagccttggaactagcccttccaatgtgttccatggagcaaagtggcacaaatctgataaaaaaatggaagcacgcaaggttacaaagtctgattctcgagctaaccgctccacagcaagtaactcttctcctgagacaaagctttccaggaaatcactggacatatcaagtgttgcttcagatttgaagacttcagtgtctgttccttcaacgccacccttagtatccagagcagatccatcatcctccaaggggcattctcaacctacagattcagattcgatgaagaaagcatggcggtcaccagggtatcaattatacagacaggtttcggacagtaaaattccatctctcagatctctcaatgagataaggtctcctgaaggaaggcctccctcttccatgttatcagcctgcagcaatgacttgtcagcagcaggatcc

SEQ ID NO: 19310 - DNA, 2157 bp, Zea mays
  misc_feature (530)..(530): n is a, c, g, or t
  misc_feature (1995)..(1995): n is a, c, g, or t
  misc_feature (2006)..(2006): n is a, c, g, or t
actataaataagatccataaaagttttaaacatttttcacctatacgccgttagatacatcttgattttaagaaaataataaaattagtttcatatttttctaagttaagacaaatgtattataaagttacaaatatatatcagatttaatattttttaaaaaaattactgaatttattaccgacagtaaaataccgaataaatacgttaattttcgaaaacggtcgggagagtcccaaactgttttcgtttccgattttttctaccgattttgtttccgtattttcggtaactacttcctagtaaccaaaaactacagttccgttttcaccccgtgtccacacggtatcgatcctagttcatttttgaactaaccaaattagcgtaacttgtttcctcaatttcaccgaaattgcagctcttgcatgcaattatgcaagtaggcatcagcaatcggcgtatgccagccagaaatgcagcatatgaaacaaacgatacattcataggaaattctgaaatctgtacttacngaactcttcgacagcagaattcaaatgaactactggagtacaattctgtagtcaagccgcttgactcaagcgagagaccatcttcacttgttcaaacagatgctataacaaaagagatgcagacaatgcagtggtctctaggttaataatggagtcatccactatcatttataaacatggttcagctttacaaatctagggataacctaaagtacatctttctttcttttcttttcttttgttcatatgcccccaccaattttccctctttttttcgtttttttaaataggcacccattagcaactagacgatcaaaacgagaaaaaaacttaatatgtacagcaccacaaaaaacatgtggagataactgggaatcagtggttgcacaaatgtatctccattgtccaggccagtaacccccgtggtataagctgaggaactcaactactactccagtccaatgcaagtaagtaaagccgacgaactactgcaaggatgaatccgggaagatacctgccctcaagccaatgctgccgctgaccactagaactacaactaagcatgctggtgtttggtgattcaaatttataggttggcacaggagcggtggtgatgcagcactgcagcagcagcgactccaaccacaaaaaaggcaaaagatatgtatgccttgaatccagctgatgaacatctgaatgtatttttgaagcccttgaggtagccttgactactgtggccttcaggattggctgccctagactgcttggcagaaatggcactgtttgtagttttcttctggtgctcaacatcatcagtcttgagatcaagacgtcggccactgttatctgtaaaccgcatggtctggttgatggatacggaactacttgtggccatcctattaattccaacctgcattttaatcttgccagctgctagtgaaatgttagcaggagatgtggttgctctgcggctttgtattgtaactccagtgtcagtatttccatttgccagattcgtcgtgttattttcctggtctgactgcaattcagcattcagagttccgttcaagttggttggaagagcataggattccattcccatcatgtagtacgcttggttggtaggaaaagcaataccttcctggccagcttgttccaagaacatactatcatagaactggtcagtaccaggatacaacatactgtaaagatcctcgggaagatcatcagttaataggtagtctgtagcatctgttccatcctggatagggctagcatggcctggtccaatattccgagacacagaaccaggattctgcaaattctacaaggaaaacaaatgcaaagggtgttggatcagtaaaaacaagcacactatttttgaaagcagcgaataaaaaatctcagtcaaaataccaaagagcacgggcaatacaacaacagagaaataattgacaatgtgcanaaatagaaaanaagtactgattgttaggggcaagggaaacagaaagcgtagttataggttttgtttaataaatgacaaaaaaaccagaaatctctgaacatcaaacaaactaaactcttcatatttttgcagagatttattttatttattttagaactttcc

SEQ ID NO: 19311 - DNA, 3126 bp, Zea mays
aaaaaccgattcgacgaaaaaaaaggaattttgggcatcactttgaagggagtagaatagcctcctattgccattaggaagggtcttcgagaggaggtgaactccccagcatgcaagctcacggagttcagactggcacaagggctgccgtcctggcgggcaaccaacatatttggaagtttctcccagccataatattcggatactggtgcagagcgcacgctagcgccggtcccagcagatccattatagtagaataacaaggttttttataccatgcgagatacggttgttgtaggccctggttgcagcttagtaatagtagcaatctaacagaaacggtgtggccttcatggatgtaaggcccaatgctgggttacacaaccagcttgctagattatttattgtactcgatgttttttaatgatgattgactaaggtacttcgtattgttggatggaatgcgtttaagctgaagtcttcagtggtagaattttccgatgagagattggatgaaccgagtatccgtttgtgcatatatggtcacatcttagaaaaaaattgccagtaaatgtgagctccatttctgcctgtttgcagaagatttgacctgaactcgtacaagtttgcgatgcaagcaaagttgtgtctagtgccctcggcgggtaaggtaccagctagcgtttagtgtcatgaagccacacccacggtatcaaatggattactggagtgcttacaaactcttagacagcagaaatcaaatggattgctggagtacaattctgtagtttagcgagagatcatcttcacttgttcttttttttctttttttaaaagagaatgcagacaatgcagtggccgctccactatgtagtgtactgtacaaacatggttcagatttacaaagctaaggatagtagtaacagtctgaagctacatcttttttgttcatacgaccaacccttttccctctttttttctttttcgattttcgataggcacccgttggtagcaactagacgatcaaaagaagagagaaaaaacattaatatgtacagcaccacaaaaaaaacaagtggagataactgggaatcagtggtcgcaaaaatgtatttccagtaatcccagtgagataagctgaggaactcgatttctattccatttccaatgcaagcaaagctagcgaactactccaaggacgaagccaatgctgccactgaccactagagctacaattaagcatgctgatgttccatgattcaaattcataggttggcattggagcggtgataatgcagcactagagcagcaactccaaccacaaaaagggcaacaaatatgtatgccctgaatccagctgatgaacatcttttgaagccctcgagataaccttggttgctgtgggcttcatgattggctgcatcagactgcttggcagaaatgacattgtttgcatttttcttctggtgctcaacatcagtcctgagatcaagacgacgaccactgttatctgtaaacttcatagtctggttgatagattctgaattactcgtaaccatcctcttaattccaacctgcattttaatcttgccagctgctagtgaaatgttagcgggaggcgcagttgctctgcgccttcgtattgaaattccggtgtcaatattttcatttgacatattcatcttgttattttcatgatctaactgcaattcggcattcggagtttcattctcaaagttgtttggaagaacatatgaaccaatccccatcatgtagtttgtctgattgttattaccttcctggccagtttgttccaaaaatatgctatcattgaactggtcagtaccaggatacaacatactgtaaagatcctcgggaagatcatctgtgaataggtagtctgtggcatctgttccatcctggatagggctagcatggcctggtctgatattcggagccatggaaccaggattctgcaaatttgatgattcagcatattgttcagtcggacacacgtcagcagaaccagtatcagctacaaggttaaatggaggtgaaggatccaacagttcttgcagccatgtttccagttcattaccaccatttggagttgttgaatcaggagtgatagctgcaggagtgatagctgcctgagcaacatcattagatagttcagcactgccaattggtgtagttgcatggttcgattcttctggacagatgactgaggcagcaacatcttctggctttacagtgctgacaactgatgtagcagcatctggttgttccagatgagagctcctgttgcccacctcattatcattatctaatgaccagtcatttcttttagtaacacggcagaggacaaaggcatccttcatatcagggctgactttacatccattctcgtcgatgtagtactcatgcataatccactcagtgcgtctgccagagggaggtcggccttcatgaaaaactaacgtcttttttgttcctagagttagcttgttcagctttatggctcggtccttcccagttgatttccagtaaccagctagtgttgccctgtttgacctagagccagtagggtacttcctgtcacgagaggcaaagaaatgccacttgttgtccttgattggaagattgcactttgcaggtaaatcccatggttcatgcttgtatatatccacctctggtataagatcatattcaattttctgaccaagtattttcctcttgagatagtgagaaacaagttctatatccgaaggatggaatccaaatcctggtggcaggtgcatatcacgcagtacttccattttacaatgtctctccggagcccaggtgcccgcacggccgatcgcgcccgaccggcgccccgcgtaaccaccaggacggcgccgccgtgcggggaagaggagcctggagggggcacagcgaagagctcgagggcggtgttcggcccagcggacgagtcaaggctgggagtggcggcactgggtgggggaagcgtcagaggtagggtggtgacgagcgagtagcaggggagggcgattgggcgagatggacgaagcagccaggaagctgtgggtgcactgcttcccgccggccccccgcggggtcccc

SEQ ID NO: 19312 - DNA, 1464 bp, Zea mays
ggcgaaacggcggcatagtacttcctacatctacgtataaaaaaacaattctcacttcgtatgacagttgtccattagtgttaacggaaaataccgatagtgtaatactatactttaatgttttaaattaattaaagtatggttaaactttgtattgtaattgcacttaccccgtttggatctttaatgtcaagtggcgatctgaacggatgtacccaccacgcggcccccttccgtcactcaacctactgtcgcaagcttgacgacgggctggagtgcatccggaagcaaagccacggccgaattgctccgcaaaaacaccagccccgttcggccgtttctcgtgtaagcaaccacaagctcccccgatttgtttgttgatgggcctcccggggttcctgtaacttgcaagccaagtgccgatcagaacgaaatggctggctgacacgtcggcgcaggcgaacccgtcatgcactgcacgcgttctcgttcccgcggcctttaggcgattgggtctctcgaggccggccgaaaaaggctaattaaccggccgcgccatcggttacatgcgcgcgccattatcgccggtcgatcaccgaggaggcgaagacgatctggtgcggacgggtcgatggcggcggcgacaacgacacagcggcatgacgacgacaacaacgacgtggagtctcagcgggagcacgatgacgacggtagtagcagccgccgtgagcagcaagagcagcggcggcctctgctggtgaagcggcgctccctggcggacgacggcggcgggatgagcccggtgcagcgggccatcagccagacgtaccagagcacggcgcacctggcgaagctgctgccgacgggcaccgtgctggcgttccagctgctgtccccggtggtgacggcgcagggccactgcgtgcgcgctaaccgcgccatggccggcgctctcctggcgctctgcgcgctgtcctgcttcgcgctcagcttcaccgacagcttccgggacgccgccacgggggccgtccgctacggcttctccaccccgtgggggatctgggccatacggcggcgcgccgccggacgacctgcgcgccgcggccgcgtaccgggtccggttcctcgacctggtgcacgccgtggtgtccgtcttgatcttcgccgccgtcgcgctgctcgaccagaacctcgtggcgtgcttctaccccgtgccgtcggaggacgcgaagcaggtgctcaccgtgctgcccgtcgccatcggcgtcgtcgggagcatgctgttcgtcaccttcccgaccacccgccacggcatcgggtttccgctatcacagcgctaattcagtaacttactgccaggaggatggattcatggctaacgctacctgattgtaacttatattatcaacagatggttgttttcgtatacttcattcatgctaccacttgatgagctttgaatgc

SEQ ID NO: 19313 - DNA, 751 bp, Zea mays
ccggccgggctctcctccgtccctccgccggttcgcccccgtcgcccttcccgacgcgccgcccgaaaccctagctccaccgatctatctctctccagcccaggcagggggaggagatggcggcggcgccagcggcgggagggcagggaggcgggggtatggacgccgcgctcctcgacgacatcatccgccgcctgctcgaggtgcggaccgcgcgccccgggaagcaggtgcagctctccgagtcggagatccgccagctctgcaccgtctcccgcgagatcttcctcaaccaacccaaccttctcgagctcgaggcgcccatcaagatctgcggtgacatccatggtcaatacagtgatcttctaaggctttttgaatatggaggctttcctcctgaagccaattatctattcttaggtgattatgttgatcgaggcaaacaaagtttggagactatatgccttcttcttgcttacaaaatcaagtaccctgagaacttttttcttctgaggggcaatcatgaatgcgcctcaataaacagaatatatggattctatgatgaatgcaagcgtcgatttaatgtgcggctatggaaggtcttcacagaatgttttaacactctacctgtggctgctcttatcgatgataaaatattatgtatgcacggtggactctctcctgatctagcacacttggatgagataaagaaactgcagcgtccaactgatgtaccagatcaaggtctact

SEQ ID NO: 19314 - DNA, 2215 bp, Zea mays
  misc_feature (2026)..(2027): n is a, c, g, or t
  misc_feature (2030)..(2031): n is a, c, g, or t
  misc_feature (2033)..(2035): n is a, c, g, or t
  misc_feature (2038)..(2041): n is a, c, g, or t
  misc_feature (2044)..(2045): n is a, c, g, or t
  misc_feature (2049)..(2051): n is a, c, g, or t
  misc_feature (2053)..(2053): n is a, c, g, or t
  misc_feature (2056)..(2056): n is a, c, g, or t
  misc_feature (2072)..(2072): n is a, c, g, or t
  misc_feature (2074)..(2074): n is a, c, g, or t
  misc_feature (2080)..(2081): n is a, c, g, or t
  misc_feature (2085)..(2087): n is a, c, g, or t
  misc_feature (2108)..(2108): n is a, c, g, or t
  misc_feature (2111)..(2111): n is a, c, g, or t
  misc_feature (2113)..(2114): n is a, c, g, or t
  misc_feature (2120)..(2120): n is a, c, g, or t
  misc_feature (2126)..(2126): n is a, c, g, or t
  misc_feature (2128)..(2128): n is a, c, g, or t
  misc_feature (2130)..(2130): n is a, c, g, or t
  misc_feature (2137)..(2137): n is a, c, g, or t
  misc_feature (2144)..(2144): n is a, c, g, or t
  misc_feature (2152)..(2152): n is a, c, g, or t
  misc_feature (2157)..(2157): n is a, c, g, or t
  misc_feature (2159)..(2161): n is a, c, g, or t
  misc_feature (2163)..(2163): n is a, c, g, or t
  misc_feature (2166)..(2166): n is a, c, g, or t
  misc_feature (2170)..(2170): n is a, c, g, or t
  misc_feature (2174)..(2174): n is a, c, g, or t
  misc_feature (2177)..(2177): n is a, c, g, or t
  misc_feature (2179)..(2180): n is a, c, g, or t
  misc_feature (2182)..(2183): n is a, c, g, or t
  misc_feature (2192)..(2192): n is a, c, g, or t
  misc_feature (2194)..(2194): n is a, c, g, or t
  misc_feature (2197)..(2197): n is a, c, g, or t
  misc_feature (2204)..(2204): n is a, c, g, or t
  misc_feature (2213)..(2213): n is a, c, g, or t
  misc_feature (2215)..(2215): n is a, c, g, or t
acatgatattattgaaaaaaagacgctagaaagggacattcgtttggatcgaaaaagatgcgatgacaaaagagacagaaagcgcgtacgtctcggcatgtccgctgtccgccacatcgccgttgcagaccccccagggtaggtcccctcgaacgaacgcgtcgcgtatacggcgcccccccatggcactagcgggaaaatttcagtgaccgaataaacgaaacacctcagtcgagacgcgagagtttatctacctatctggtgtccgctttaatttctttcctcggtccctccaccccccttcgccctttccgacgcgccgcccgaaaccctagccccactgattctctccagcccagcccagccaaggggaggggatgtcggcggcgccagcggcgggagggcagggtggcgggggcattgacgccgcgctcctcgacgacatcatccgccgcctgctcgaggtgcggaccgcgcgcccagggaagcaggtgcagctctctgagtcggagatccgccagctgtgcaccgtctcccgcgccatcttcctcagccagcccaacctcctcgagctcgaggcgcccatcaagatctgcggtgacatccatggtcaatacagtgatcttctaaggctttttgaatatggaggttttcctcctgaagccaattatctattcttaggtgattatgttgatcgaggcaaacaaagtttggagactatatgccttcttcttgcttacaaaatcaagtaccctgagaacttttttcttctgaggggcaatcatgaatgtgcctcaataaacagaatatatggattttatgatgaatgcaagcgtcgatttaatgtgcggctatggaaggtcttcacagaatgttttaacactctacctgtggctgctcttatcgatgataaaatattatgtatgcacggtggactttctcccgatctagcacacttggatgagataaagaacttgcaacgtccaaccgatgtaccagatcaaggtctactgtgtgacttactttggtcagatccaggaaaagatgttcaagggtggggcatgaatgatagaggggtctcatatacctttggtgctgacaaggtttcagaattcctgcaaaggcatgatcttgatcttatttgtcgtgctcatcaggttgtcgaggatgggtatgaattctttgctgacagacagcttgtcaccatattctcggctcccaattattgtggtgaatttgataatgctggcgcaatgatgagcgttgacgaaactttgatgtgttccttccaaattctgaaacctgctgagagaaaacaaatttatggggccaaacaaaatgtgagatagtgaacccattttgcttccagcagctctgaggctctcctgtggatgcatcaagacaacagcatgatggcgccaaacttgaggtcagcattgggcaagggcaactaccagagcagagaaaccaaataatataccatacctaactgttcgcctggaagttactcttcatggcaagtgtttgaattttctcttgttactgcgtgtcgaacaatcatgtagctgtagatatagtgattgtggaaggatgaagttgccaaattgacccgtggcgatttccttctccagacaggaaaaattctgaacatcaaggagtttctgtttgcaagtttcactatttaaaagcaggtcgtgtcacttgtgcggagttaaggactggaccgaggcagtattatcagtttctggatatggattgttgtgctagtttcgatgcaggtgtcaaacaacaattaggctgaagaggtgagcaacatttaaggaggtgctgatgcttgctgataacctatgaaaaggcgttgctgtagctgactacttggtttgtggtcagataattctggacgtgaattttgatatgttggccagattagctgccaaataggtatttcgtatctcttgatttatgggattcacattaactgattcttggttgccattcaaaagaaatataggccctacggcttatnnttnntnnnttnnnnttnntttnnntnttnccggttccgggttccntntttaanngccnnncttgtttcccccccggggacnttntnnaatccncccggngncnccttttncccttgnggtttccnctcgntnnnanaancggngganaananncnnctccccaantnacnaaataantccccgggntn

SEQ ID NO: 19315 - DNA, 1465 bp, Zea mays
  misc_feature (1455)..(1455): n is a, c, g, or t
ccgggatggaggctttcctcctgaagccattatctattcttaggtgattatgttgatcgaggcaaacaaagtttggagactatttgccttcctcgtgcccgcccgacccagtaccctgagaacttttttcttctgaggggcaatcatgaatgcgcctcaataaacagaatatatggattctatgatgaatgcaagcgtcgatttaatgtgcggctatggaaggtcttcacagaatgttttaacactctacctgtggctgctcttatcgatgataaaatattatgtatgcacggcggactctctcctgatctagcacacttggatgagataaagaacttgcagcgtccaactgatgtaccagatcaaggtctactgtgtgacttgctttggtcagatccaggaaaagatgctcaagggtggggcatgaatgatagaggggtctcatatacctttggtgctgacaaggtttcagaattcttgcaaaagcatgatcttgatcttatctgtcgtgctcaccaggttgtcgaggatgggtatgaattttttgctgacagacagcttgtcaccatattctcggcccccaattattgtggtgaatttgataatgctggtgcaatgatgagtgtcgatgaaactttgatgtgctcattccaaattctgaaacctgctgagagaaaaaacaaatttatggggtccaacaaaatgtgatagtgaaagccattttgcttccagcagctctagcctcttaaggttctcctgtggatgcatcgagacaacagcatgctggcgccaagtttgagggcagcattgggctactatcagagaaaccaaataatcccatacctaactgttcatctggaagttactcatcatgacaagtgcctgaaatttttcctctttcctgttaccttgtgtcagaacattatgtagctgtagatatattgattatggaaggatgaagttgccaaattgacctgaggagattcctttctccagccaggaaaaattctgaacatcaaggagtttctgtttgcaagtttcactatttaaaagcagttatgttgcttgtgcggaggtaagtactggaccgaggcagtattatcagtttcatggatatggactgttgtgatagtttcgatagaggtgtcaaacatcaattagggtgaagtggtgagcaacatttcaaggaggtgctgatgcttgctgacaacctatgaaaaggcgtttctgtagctgactacttggtttgtccgtcagacaattctagacgtgaattttgatctgttggctagattagctgccaagtaggtatttcgtatctctagatttatgggattcacattcactcgttcttgttgctattcacttgcctttgttatgttgctacatgggtgccaaacgcggtctgcaaagcagtcgtttcggtttgtttggtaatgcattttgcgcaaaaanaactcgaggg

SEQ ID NO: 19316 - DNA, 1487 bp, Zea mays
gcacgagaccattacctagaagtacctcgaggcggaaaccgcgagcgcctccgcatttcgaaccaaagggggcagaactgagagatcgagagaaataataaaaaaaaatccgtcttcttgtggtcttctccaaaccctagcgcccccggccccggtctccgcccccccgccttcgccgtcgcggtcgcgccccatggcggggaagtcgcgaccgcccaagcggatcctcgagtcctataccatcaagggttcggacagagtcatcaagcctggcgattgcgtgctaatgagggcatctgatgcttcaaagccaccttatgtggcaagagttgaggcaattgaagcagcaggatctcgaggcaccaatgtgagagtacgagtgcggtggtattatcgaccagaggagtccataggtggtcggcggccatttcatggttccaaggaggttttcctctctgaccactatgatgtacaaagtgctgacaccattgaggggaaatgcaatgtccacagcttccgtagctatacaaagcttgattctgtcaatgctgaggatttcttctgccgcttcgagtataaatcagctactggcagctttgtaccagatcgtatagcagtgttttgcaagtgcgagatgccatacaatccagatgaccttatgatccaatgcgaggaatgttctgactggtttcaccctgcttgcattgggatgacaatcaaagaagcaaagaaactcgagcattttttctgccagacctgtacagctgaaaatggtaagatggttgagaattcacatgaagctacagcgcaatcagaagaaaagccggtggagtcaaaaaggcggcgaaggtgatggccgtgctgattaaatttatgaaatctatgctcggttgtacaaagccttcccacgtttcacgtttgagaactgtaattttattgttcgtcgcagtttgtggtcctgggctggggtccctctaatgtcaggcacactgtatatagcttgtaacctggtcagattgttgtattagagcacactagggtttgtgtgatagcacggaagttcggactactgagtatgtgtagagtatggcattataatgccagcatcaggtgatcaggcttcttctgggcattaggactcctgcatgatccagcaataatacttccatgcagctggacctggttagtcactagtaagttgtcaggaaacttagtactgccatgtgaactttttttgaaaccctctatgtaatgtaagcatctgtgtcctacttgcaaactgttgcacgaaattgggcacccaccctggcccattggctgcggctgcataattgcggcaaccaacttgtgttttaagtttggaggaacaataataaagtttaggctcattgaactggtctggttcaacgaaacaaaccctcactttttgcttgtattttgagttaatgtgatgtttattcaaattatgggctaataaattgctgtcc

SEQ ID NO: 19317 - DNA, 737 bp, Zea mays
  misc_feature (703)..(729): n is a, c, g, or t
cattgggcccctcgaggccggccgggggacatactatgtctaccagagaatagaaagaccttccttccatccatcccacagtcagtcgttgacacaaagagaaattccacagccggggggcaaggctttaattgccccctctccctccctcgcctccttcaccgtccccatccatcccaccgagctttgcagcagctaagctagtagcatgggcaagctgtgctgcagccaggaagacgacgagccggcgttcaacctcctggggctgctcgtcaccgtcgtcctcgccctgctgctgctcatgctgtgcacgccgccccgccgcaggcgctgcgtcgcctactacccccgttactgctaggacaggacggacgcggtggcggtggcacacgccgtcgagcttcagccttcttcgaggtagggaggaaaggatcaatcttctgctctgctctgcgatgggcgccgaggtaggcatcagacgtggagttcaattcgagtccgagttgtggagtatataataaatcatgctggattgtttgtttgtatgtaaaagcgttctgttattattggtaaatcaatgtgcctactgcataaggctggtcggtctgtaacctgatccgagagtctgtctgttggtaaaaaatttattgactactggaatttgttgacttggtatctgaaaaaatttaattttgaccggccnnnnnnnnnnnnnnnnnnnnnnnnnnnaaaacatg

SEQ ID NO: 19318 - DNA, 783 bp, Zea mays
gccggccgggttgtctatataaatagtcggtccctcgaggccggccgggaaaaaaaaaggaagcctgaaagcacccagaagattcatatcaatcggacataccatgtctaccagagaatagaaagaccttccttccatccatcccacagtcagtcgttgacacaaagagaaattccacagccggggggcaaggctttaattgccccctctccctccctcgcctccttcaccatcccaccgagctttgcaacagctagtagcatgggcaagctgtgctgcagccaggaagacgacgagccggcgttcaacctcctggggctgctcgtcaccgtcgtcctcgccctgctcctgctcatgctgtgcacgccgccccgccgcaggcgctgcgtcgcctactacccccgttactgctaggacaggacggacgcggtggcggtggcacacgccgtcgagcttcagccttcttcgaggtagggaggaaaggatcaatcttctgctctgctctgcgatgggcgccgaggtaggcatcagacgtggagttcaattcgagtccgagttgtggagtatacaataaatcatgctggattgtttgtttgtatgtaaaagcgttctgttattattggtaaatcaatgtgactactgcataaggctggtcggtctgtaacctgatccgagagtctgtctgttggtaaaaaattaattgactactggaatttgttgaaaaaaaaaaaaaaaaaaaaaaaaaaacccccggcccccgacccgccccctgttaccactgct

SEQ ID NO: 19319 - DNA, 639 bp, Zea mays
  misc_feature (21)..(21): n is a, c, g, or t
  misc_feature (625)..(637): n is a, c, g, or t
tcactgtaagtttcttggaanagctggtagagtcggcatcagattctaggcaaaatcagctggccttacatcagcgggcgtgcgccagagtgcgccccctctccctccctccctccctcgcctccttcaccatccccatccatcccaccgagctttgcagcagcgctagtatagcatgggcaagctgtgctgcagccaggaagacgacgagccggcgttcaacctcctggggctgctcgtcaccgtcgtcctcgccctgctgctgctcatgctgtgcacgccgccccgccgcaggcgctgcgtcgcctactacccccgttactgctaggacgggacggacgcggtggcggtggcacacgccgtcgagcttcagccttcttcgaggtagggtcagggaggaaaggatcaatcttctgctctgagctgtggagtaataaatcatgctggattgtttgtttgtatgtaaaagcgctctgttattattggtaaatcaatgtgactactgcataaggctggtcggtctgtaacctgatccgagagtctgtctgttggtaaaaaattaattgactactggaatttgttgacttggtaaaaaaaaaaaaaaatataactcgcgggggggccnnnnnnnnnnnnncc

SEQ ID NO: 19320 - DNA, 1913 bp, Zea mays
caccaaatgaaactgtccactgacaatgaaaagtctcatacatgcatggttgcattcgttccatgatgatgtggcacttaggaaacataaatatgaaatctttcattgagaagggcctgataagcattccaggagtacctaagggtatttttataacggtaaatgtaggaaatctaggcgccggttaggtattaactacatctttttatttttttcctcgtaaatagtagttatgtatgttttagatacagtacgttcctaggttattttagactattttcatcatcgcaaaggcgtgattaggagtgtatacaaaggttaacgggttacattatatcagtagtggtttagactttgaaaataggcaactactgaatttaaccaaacccatatatatcgatgtgttatctatggccctattgacttcattccaagctttgccagtaaaggagaagatcaatatatattccagtcttgtgtttctgccactttgcctggtacgtacgtgtctgtcctctattcttgtaaagaattacataatttctgcgaggttttataaaaaaaatagacaatttatgtgtgtgaatgcaccgggcacacgcgccacacagcattttattgatcgatcgacctgacacaaagcgtgtcaacaccaagtcaagaacacagcgaggaacaaaagttctcgagagagtgggctagccatcatagctagctttaccatacacgaagcaacatccactggtcggccggccggtggcattcatgcaatatgcacttggacctttgtgtcagattttcatagagcattatattccatttaaactaaaaaatatactagtgcgtatactatataacaatccaccactgcgtgcaagtgcaacctcctacaccactatcgtgcacacacaattgtgaaagaaagaaaaaaaaaacttgtgatcttgttctttccaacttacaagaacagctagagagagcttcagaactcttgccacaattctctataggtcgtgcgcgtgtgtgtagctcctttgcagccacctcttcgaccagctagctagccatcatcatgggaaactgcctggtgattcaagacaggaaggagatcaagatcatgagcgtgggcggcggcggcggcgaggtcctcaagatgccatccccgacgggcagcctgagtaaggcggccgacgccgtcgtcgtcgacgccgacgctgctgcagctggcgccgctgccgtcgtcagggtgaagctggtgatcagcaagcaggagctgaagaagatgctcgacagggagggcgtgtcgctggacgacgtggtgtcgtctctcgtgctgcgcaatcgagaactggaggaggtctgctgcggagggtggcggccggcgctcgagaacataccggaaggcagcgatctctaggctctagcatgcacgtacgacagcgcctggcatcggtcgttcagatgtctagctctagcttgtggaagtcactggatcagtgacggtcgtgcctagactacactggagtacacaagatactttttgggaataagcgtaagcaaaacatgtgtgtgctgggtataacattatatacacatatatatagagagaaagatagtattggtaggagttttgagatagggattctcttcatcttttcttgctgcctacgtgtgcttgtaaagaagaggtaaagatgatcctggaaatcaagcaagtcctttatgcatgtaaaaaaaaaaaaaaaagtcctaatcagtgattcagtcatcacagttacaatcccaagggatccatatatatatataagctgcttcttatatatttggtgtttactaattctcagtcctatctttaagacggcgagagttttattgtattttagaaaagatgattgaattcataagaaatcgga

SEQ ID NO: 19321 - DNA, 1429 bp, Zea mays
ccgggggataaaatggataagatgctaagggagcatacgtctgcgcttttaaactgtatcgattcagcattgaggtcaaatcgtgatgccttagagggcctagctggaactgtaaattccggcgatagggttgaaagggatgtgaacctgaagcaaattattgacctcgaaacactggctgacctctgtattcaagcagggcaggcaataactttccgtcggctgttggttgaggccgtcggagcagttcttgaagagaaagtgcctctgatatattctctgctcaaaggattagccttgcagttgccagacgaggtacctgataaaaatgagataattagattgagaaaggttgcgagcagtgttggtgttggcgacaaacatgatgctgagtgggtacactctattctggcagacgctggtgcagctaatgataattcttggatcctacttccatacctttgtgctgcattcatggtgtccaacatttggaacggtgctgtttatgatgtcaatataggtggactcagtaacaatttgcactgcctagcaaggtgtgtaagtgctgtgattgggggaagcgaatacactcgggtcgaaagggagcagcgaataaactctctttcaaatgtgcatacagatgagctgcaagaggccgagttaccgagccgtgtctcagcagaagcaaatatcaaatcttgtatgcagatctacgtcaaactgtctgcagggatcgtcctggattcatggaacgacacaagcaggcagcacatcgtcccgaagctgacattcctggaccagctctgcgagctgtccccgtacgtgccaaggagcaccttagaagctcacatcccatacaccatcctgcgctcgatataccaccagctgtacggaggctctctgctggcctcggaaccggcggagcagtccccaaggcagtcgcctctcatctctctggcacacgcgtccccgtcgtccgcaaggcagaaccgaccagagacaacacccaggtcccacaccttcgacccaggctactacagctcgtcggggtcccagcacgacgatggctacgacgcagataggagggccggacggctgctgcggagcttgaggcgctctggaccgctcgacttcggtgcgagcagaaaggcgaagaagttcgtcgagggctccagctccgggagcggccatggagctggctcgctgcagaggttcgcagtgtccagatctggccctctatcgtacagatagggggccgcatgtaatgtaaactctagagcagtagatcttgctatgcgttgtgctgtaagtaaaacccattaattgcttaatttgtgttgactgtcgttaggcaagtgatttgaattagctgttgctcgtaaaaaaaaaaaaaaaacaatactattattcgttgatttttcttgatagc

SEQ ID NO: 19322 - DNA, 4110 bp, Zea mays
ctggtatattgagaatgtagtaaaggacgcttctcgcattggagttgcttttgatgcaatccaaaattgcttcaggagctcacagcctattggtggtggatgtttggctgaatcatttacagataaaagagaaatgaaatcacttgttcgtctttttggtggctatggaatagataaaatggataagatgctaagggagcatacgtctgcgcttttaaactgtatcgattcagcattgaggtcaaatcgtgatgccttagagggcctagctggaactgtaaattccggcgataggattgaaagggatgtgaacctgaaacaaattattgacctcgaaacactggctgacctctgtattcaagcagggcaggcaataactttccgtcggctgttggttgaggccgtcggagcagtccttgaagagaaagtgcctctgatatattctctgctcaaaggattagccttgcagttgccagacgaggtacctgataaaaatgagataattagattgagaaaggttgcgagcagtgttggtgttggcgacaaacatgatgctgagtgggtacactctattctggcagacgctggtgcagctaatgataattcttggatcctacttccatacctttgtgctgcattcatggtgtccaacatttggaacggtgctgtttatgatgtcaatataggtggactcagtaacaatttgcactgcctagcaaggtatggactgactctatgtttgatgtcaaaaatcgttagttgtgggtatgtaagtgctgtgattgtatttgtgcaggtgtgtaagtgctgtgattgggggaagcgaatacactcgggtcgaaagggagcagcgaataaattctctttcaaatgtgcatacagatgagctgcaagaggccgagttaccgagccgtgtctcagcagaagcaaatatcaaatcttgtatgcagatctacgtcaaactgtctgcagggatcgtcctggattcatggaacgacacaagcaggtaggtacctggtgcactgactgcattttgtttgctggcttaaattttatacatgacaccaaatgcaggcagcacatcgtcccgaagctgacattcctggaccagctctgcgagctgtccccgtacgtgccaaggagcaccttagaagctcacatcccatacaccatcctgcgctcgatataccaccagctgtacggaggctctctgctggcctcggaaccggcggagcagtccccaaggcagtcgcctctcatctctctggcacacgcgtccccgtccgcaaggcagatgcagaaccgaccagagacaacacccaggtcccacaccttcgacccaggctactacagctcgtcggggtcccagcacgacgatggctacgacgcggataggaggaccggacggctgctgcggagcttgaggcgctctggaccgctcgacttcggtgcgagcagaaaggcgaagaagttcgtcgagggctccagctccgggagcagccatggagctggctcgctgcagaggttcgcagtgtccagatctggccctctatcgtacagatagggccgcatgtaatgtaaactctagagagcagtagatcttcctatgcgtgctggtttacgtagctagcagtagcaacagcagcagctagttgtgctgtaagtaaaacccattaattgcttaatttgtgttgactgtcgttaggcaagtgatttgaattagctgttgctcgtttggtttgtgtatcaacaatacaattgttcgttgatttttcttgatagcaaagtaaagtaaaccaaccttctcttgaaagaaagaaatagagagaaagattagacggaggccgattaagcagagatgaattggttctgagtgtagatagaccaaaattccagattagcacacggaggcccatttgaccccttacgcttaaagatattatctattcttgacataaaagtttttttactcaaactcgctctgaactaaaaactgaaagactagaaatctaaagctaaagagataggctagttgggacagcctaccctcctatatttacagacctacacacaatcctcagacttgccattagatattttggttgaaaccattaatcccaggggaaaactagtccaacttttgatcggtgcatctcacgatcatgagttcttcaccgtttggcttcgcctcgatacatgcttcgcgatgacgtgacaccccaaacttcatcctgaacgccaaccggattttgaggcccagcgtcaaaatcggtcattgatgattttaaggcccaaaccactaaactcctacggagaagcgtatctgctacgtgtcctccataatctcgacgcgtgtcaccgttcgtctttgaccgcctgatcgctaagtcctttctagcgcccgtgtttgacatggttagtcgtcgtctaaacttggtcaatatggtctactcttccgcatgtacatttgattgttgatatccttaggtgtcaactactcacagtcggtcttgcagccacctccgtctcttagccctttatcgctcctagtccattgaaaagaatctgtatgactttcaccattactgtcgaccgtctgtgtgcttcacacacaaaaatcaacacggccaacagacatgttgcgcaataccatactcacgtcaaagtcatagactcacagtcatagtcatcgtcactcattgaaatcaaccacagcttactctccaaatccaaccaaagtctcatcatcttctggcaatcattcatcaccacccgatacatatgaacacatatcaactatgtattcgtagcccgtgctgccaactcattaaaaaaggtcaatggcacataaacataatggacattcagctccgttcatgatattttagttgtcttaggccattgtttggagtcttcttggccgagctttaagtggagctgaagaaatctgtgtgaacctaacaactcatcttttttttttttgtttctgatcttttcccttgtgtcactttgagtaagcctaaagatttcgtagcttgtgactaccttgttgcgaacttaattattcatgactaggaattacataaagggagtacagtacaattaaaaaccaattaagactgctactctggtaaccaaccgaaacgatggtacaacatctaaatcatttaaatcagcatgctacaagaactaagcttttcaccatgcacaaaattccttccagttatatctcgcttgatcctttgcgtttcctgtattattgaatgaagaactcgaaattgtagcgatcctatacggcggggaagaagaagaaaaagaaaaatgtagagagcgtccgtactacagcatgtccagtgctcgatcggatcatcaaattttgtggtcgccggcgccgtccttgctgtccggcggcagcagccgcgtgcctgcctccgtgtcatcgtccgtattggccgccgccttcctctcggcctccttggccttgagcccctgcagcttggcgtggttgtagtaggcgacgccgaggaaggcgatgccgtagccggcgaggttgacgggcgtgacggtgtccttgatgaccgtccacgagaaggcgatgagcagccagtccttgacgacgccggcgacgttcatggtgagcgcggaggtcttgccgaccagcaggaacacggcgaggttgagcgcgaaggcgcagagcgagttggtggcgaagacgaagacgtcggggcgggcgagcgcggcggcgcgcagcctgggcagctcgacggcgtaccaggggacggcgaggaacgcgaggcagcagggcgcgacgtagtagagcgaggtgatggggttgagcgcgacgccccgggaggtgaggaggatctggatgagcacgagcctggtggcctcggcggcgacggcgagcagctgcagcgcgacgccgaacgcgtcgaagcgcgcctcgccgtaggcggcgacggcgacgcccgcggagatggcgagcatgttgagcatggaggcgcggcggaaggcgtcggtgcggagcgcgacggcgagggagtagacggcgacgggcatcagcgccttgagcatctggatgaaggagacggagaggtagattaggcggag

SEQ ID NO: 19323 - DNA, 1848 bp, Zea mays
tgcctctgcttctccccacgccaccgaggcagtccaggccaggacagggtgccacaaaaccaaaaccaaaccccaccaccactccgcacgagatcatttcgccagctcatcgccaccgccctcctccgctcccgcgtctccttcccctcgtcgtcgtcgggttggtgggtccacctctcgccgtgccccgccgtcgacccgcctcagaatcaaagataagtcaaaggaaaggtcggtatgcgccggtggttttgctgcacgaggtttaatgcttcataccgtgaacatgaaaatgaacgtcccatcactccagaggagaaagaaggaaatggtttttctgttaaaagtgatcccatcaaggcaccaccttccattgaagtccctgaattatcatttgaagaattgaaagaaaagaccgacaattttggttcaatggctttgattggtgaggggtcatatggaagagtatattatgctattctggacagcggaaaacatgttgctgttaaaaagcttgacgcttcaacagaccctgaacttgataatgagtttttgacacaggtatccattgcctcaaaactaaaacatgataattttgtggagatgcttggatattgtgtggaaggaaatcagcgtctagtggtctatgaatttgcgacaatgggttctctgcatgatatcttgcatggaagaaagggtgttccaggtgcacagcctggcccagcacttgattggatgcagcgggttaagattgctattgatgctgctaaagggctagagtatcttcatgaaaaggtgcagccttcaatagtccaccgggacatacggtctagcaatattcttctgtttgaggactacagagcgaaaattgcagatttcaatctttcgaatcagtctccagatatggctgctcgtttgcattctactcgtgtccttggaaccttcggctaccatgctcccgagtatgccatgactggccagctaactcagaagagtgatgtatatagctttggggttgttcttttagagcttctaacaggaaggaaaccagtagatcatacaatgcctagaggtcagcagagtctggttacatgggcaacacctagattgactgaggacacagttaaacaatgtgttgatccaagattgaagggagaatatcctccaaagggagttgccaagcttgcggctgtggcggcactgtgtgtgcaatatgaatctgaatttagacccagcatgagcatcgtagttaaggcactctctccccttcttcaacataaaccgcaaccaccggcagccactactgacgctacagcaccgtcagatgcctgactttctgaaggagctatgaatcatgaatgttaagagaaccattttctcttcggtgcgtgcgctgttctagatcactatcgtgtgcctatgaagtgatcagtgtcacacaagcaacggcattgtgggctaaagcatatctccacctttacttagcttggtacaggcaggagacttcccattgtcattaccgtgttctatgctgagtcatgtgctgctttcgttggccgggtgaggtgtgcttgttggccagcggtcgtgaccacctaattaccgtgttatggtcatcactgtaacatgcgaaggttctaatttttttttcatggtttgtttttcctcgtttttttgatggatcgtttttccttattttgtttgcctgtcgtctgattttgaactggcgcctccactgtacaacccactctgaatcgcgagactactcgtgtgcatgtttatgcgtgagaattgtgatgagatcatgcgcattgattaactactcgtgtgcatgtttcggcgtgaaaa

SEQ ID NO: 19324 - DNA, 814 bp, Zea mays
ctaaagctctaaacgattttccatgctttattggttttgatctctctgcagaatatgcagcgcacgctgagccatctcaaggacatcaatcgtggtctgcgcacagagattaggcaaaggatgggcgaggatctggacagtctggacttcgacgagctgcgcggcctcgagcaaaacgtcgacgcggctctcaaggaggttcgccataggaagtaccatgtgatcagcacgcagactgatacctacaagaaaaaggtgaagcactcgcacgaggcgtacaagaacctgcagcaggagctaggcatgcgggaggacccggcgttcgggtacgtggacaacacgggcgccggcgtcgcctgggacggcgcggcggcggcgctgggcggcgccccgccggacatgtacgccttccgcgtggtgcccagccagcccaacctgcacggcatggcctacggcttccacgacctccgcctgggctagcgcatccatcaccatgctgggtggtgctgctcgatcatcctactgcatggcaatgcaagctggttggttggttcgctcatgcttcgtccgtcaacaaagcaagtaagcaatgcaatgcaaccgaggtactgtaatagccaataaaatctactgcatactgcaaacccaattactggtagcttagctaccgcgtgtgtacgaatcaaccgattaattaccgcgcccttgcatgtcgtcgtcgtccgtgcttttggcgttggtagacatgtgtgtattgtatgggtcctgttcatctgcatccatgcatgttgtttatgattgtaattgttgtgtg

SEQ ID NO: 19325 - DNA, 6651 bp, Zea mays
  misc_feature (21)..(21): n is a, c, g, or t
  misc_feature (36)..(36): n is a, c, g, or t
  misc_feature (3574)..(3574): n is a, c, g, or t
  misc_feature (3616)..(3616): n is a, c, g, or t
ggcttatctcttgcagctacnttctactagttctanccatctagtcatacacgtttctcaactgaagaaagcggttggtcacaaccaagtgttagttccttcattgcctgatgatctcaggctagttcaggtgcccatctgagtgctgcagcgcaggatgattgagtgcgggggtgagctggtagcacacatcaaagtggtctggtccggtatggatgactctttagcaacttgggaagatgttgtggctctctgttctcggtttcctgaagcaccggcttgggggcaagcagtcttccaaggcggggggggggggaaatgtggacagcggagcggcgcaggctgatgaaactgaaggcaaccacaacctgaatactgatgaagagaaagcgcgggaagtttgagtttaagtgaacaggctgaggcgtgtgaataagctgaacccaaaatatcttgagccaacttaggtcgtgtaatagttgctgtggcgtttacaattgggccatgtgccgtgtaatagaacggcgtcgttgccatataaggagaaagtcagaccggaagaggtaacgaagaacataaacctgattccttcgcccaactcttccctcttctagttcttcttcttcaatccaccttctctctacccgctaacttaacagtggagtacatctaaactagcttgtcagttgtcacttggagtagaaccaaacagactttgatcatgcatgtaatcatggcccggtaattaatgcatggttgtgtagagcgaccgagcgagcggtttgatttgatgccggtgaggtgacgtgacgacgctaggtagctaacaaggaggtagacgatagctgctacctgctagcaggaggtgtgtgatcgagagttgacagccggtgcaaaaggaggaggccaagagaagaagagaaagcaaaggaggagggagtgtgccggagaagaggatccggaagccaaaaccgtgctaaccgttgtgccaaaagccgccaccacggctgaccgacggacggcacggtggattgattggaaacgcgccgagatcgacccagccggccggcgcttacacccacgccgcgtcagatcacaggggccgggcgcgggcgggcactgcacggcacccacaatacggcacgcgggcgggcgggcgggcacggtgccccacgcctttcacggatcgggcagctgtccccgtccacgccgcgcaccgcgccccgtcctcgccaccccgaaatgcacacgcacacgccttgtccttgcttgcttccttggcaccaccgcctcccctcctctcctccttattaccaccacctagctagcagcggcagcggcagcaccggcctgttgtgctgctcgctcagacagctctgctagctgcatcctcctaactctccaggtctctctctcctctcccaactcccaagtcccatccggatcgagacgctggaggcggagcgcccccccgggacggcggcggcgacgatggggcgcggcaagatcgagatcaagcggatcgagaacgccaccaaccgccaggtgacctactccaagcgccggacggggatcatgaagaaggcgcgcgagctcaccgtgctctgcgacgcccaggtcgccatcatcatgttctcctccaccggcaagtaccacgagttctgcagccccggaaccgagtcagtactctactcagtagtgcactagtgcctgctcttcctcttccatctcccctccctcctcctggcctccgcgcgctgcttcaattcgctggctgatcgatctgcgtgtgtgttggttggttggttcaatcgcagcatcaagaccatctttgaccggtaccagcaggccatcgggaccagcctatggatcgagcagtatgaggtccgtccgtcagccatattcgtttccccggccccttgtgtctttcctttcctttcctttccttgcttgctgctggccgccgcctcctctcttttgcttcgctcgctgctttatccacatgtccatgagatgatgagatctaaagctctaaacgattttccatgctttattggttttgatctctctgcagaatatgcagcgcacgctgagccatctcaaggacatcaatcgtggtctgcgcacagagattaggtcaacacagcacggacgaacaaccgccactttcctcttcctgtgcttattcctcatatgcatgtggattttctgagcgagatgtccccgtatactacgagggatggatccgcgagtttacatgaattagctccgagcacacaggcttgctgatttgtgtgctgctgtgctcatcaatcaggcaaaggatgggcgaggatctggacagtctggacttcgacgagctgcgcggcctcgagcaaaacgtcgacgcggctctcaaggaggttcgccataggaaggcacgtacaaaccctaatctcttgcgttttttttttctgactcccctagctagtcctagctagttaggtatagatctgtcatattatctcttctgcgggctgatgatgcgctcttcagatctgttcatatttcatgctccttgctgctggtagatctttgttcatgccttctgattcggctttgaatcttgtttttgaagccgtcattagatagatctctctggcgtgttgttcgcagttaaaaaaaaggagatttaggattctttactgggagagatagattcatctcttgtacactaattcagtcccagtgtcaatgcatctaattaagtcctgtcaaataaaagtttctttctttttttaccttaaacaaaaacatttagccctgattcaatatttttctattggtctactagaattagatcttgttctcaaaagaaaattaaaggtggggaaaaagaaaattgttgctactagtaatttttttagaatcttgaataatttcatctcatcatgtccatgttttagtcttacttacctacctcttttgctgatcccttctctcgtttgatttttcagtaccatgtgatcagcacgcagactgatacctacaagaaaaaggtaagaaaatctagcattatcggctagagaccgtatcttatgcgcaaggagcgctagtgctcccatgagcaaaatcaatccataccacaccctccacatccaacggtgctgcgtcagggggttttataaaatattctttgcaactctgtacattttacaaaaaccccctctgacgcagcaccgttggatgtagagagtgtgatctagattgattttgctcatgggagcagcagggctccttgctcataagatacggtctctatcggctaagtacatagattttcttatacgtcaattgggcaagtttgagagctagcttagctgcccccaatttggtacagaacagaaatttatttacctgcatatcgatctatatataataatgggtttaataataatatacctagttcctcctttagttctttacctttcacatgtgaccagtttcttgatttgatatgttggtcatagaaacgtttccaaaacagctctcacaacactagccaatgcatagttttatgttcatcatccttttntctctctctttttaggctattatatccagcttttcttatgtnttatttaagcatggattcttttaaaataagatagaaacagctgataatttgcttacaaataaataaatatccctgccaacacttctcttaacacaatatagcaacagaaccgagcagacacttgaaaaattatccttgcacgtttgttgactcttcaagtagtgatgaaagcaaatatccgacaggcaccaccacgcctcaaaccgaaaatcagcaacctatctagctgttgtccagtgtacattaccatgcatgtctgtgcatttccacactcaactactcctttcccccatgtcaatcagcatctgaggcgctctactgaaggtagctccacgttgtagtagagaaccggccgctagatctcttggcccatctcatgtgctcgatgcactcgtccacacatgtatatatgcaaagcgctagctgtatccaatcagtaggcgcattggcctctgtcttttagaagctaggatgaattgagcacgagcaaggactctgtagtgtgttggagcatccatgcatacgacgcatgcgtcgtcgtctgcgtgtctagctagctagctagctaaggctgcatgccgcctacagatcatgacatgctagcttatttggtccccgtgctactagctatcagctgggagtagcatgttaagcgctgatttttatggtgttgcaccgtggcatgatatgcacccacagatgaggaccgagggtgtaggctttatgatttgcagaggtatggaaatgggactcattaattagtgtggaagtacttttgcttgattgttactgaatgtatgtagtctgtcaatacgtacacagccatgtgtactgtgtatattgactgaaacatgtacgttgcatccagctcatctccaaatcacccaaatatttctttctctctctatatatatcactgaaatgttgtccatgagatatatgcaaatagctagctgcttaccctttcttttgagctatcagtttcatagtatgcctgttcttccactcccacaatcataactagtatgtaatatacattgctgcgtgttatacaccgcgccctatatatatatatatatatatatatatatatatatgtttgttcaaaaacaaaatgcagtaagaatgtctgagcaaacgaagaggacctttttttaatcaatttctcatgaattgagccacttcagggcctgttacttatcttaatacatgtggattgggtaagtttaaatccataacaagttaaaatctctactgttttgtttccaattttatcctatctatgtggtgtagtaataaccgaataaggcctcatgcatggtttatttgttgtgtttaatatacatgtattctatagagcggctttttcctttgatacgattcaatcgatcgaccttgcagttgttgctgaattacactgctcgtatgtgctgtgcgcgcatacgtacattgcaggtgaagcactcgcacgaggcgtacaagaacctgcagcaggagctagtgcgtttttcattacatactgatgatagatctccgctaataagcttagcgctggtcgatcgatgtgtacgtctaattaatccacgagcttcttggactcctttaggccaggcggcggggcccccgcgttcgggtacgtggacaacacgggcgccggcgtcgcctgggacggcgcggcggcggcgctgggcggcgccccgccggacatgtacgccttccgcgtggtgcccagccagcccaacctgcacggcatggcctacggcttccacgacctccgcctgggctagcgcatccatcaccatgctgggtggtgctgctcgatcctactgcatggcaatgcaagctggttggttagttcgctcatgcatcgtccgtcaacaaagcaagtaagcaatgcaatgcaaccgaggtactgtaatagccaataaaatctactgcatactgcaaacccaattactggtagcttagctaccgcgtgtgtacgaatcaaccgattaattaccgcgcccttagcttgcatgtcgtcgtcgtctgtgcttttggcgttcgtagacatgtgtgtattgtatgcatgggtcctgttcatctgcatccatgcatgttgtttatgattgtaattgttgtgtgaaatggctgtactttgttatgatcacgtgaaattatatctacattcgtgagacttaaccagtgttcacatagtacatttttagataatagttaagatagtatcacatgttgatgcctataaaattaggggctgtctatacagcacatgggcaatttttgcccgaaaaacacacgtgtgtttttagctgaaaaaacacgcagatttcttttaaggaaaatatgtgtgttttgcaaacacaaaacacacacatctcatattcactagatcaagatctaatggtcataataaacacgcagattttttctctaaaaatagagagaaaaaactaatatacaaaaaaacaatacaagttgttgtgttaatatttaacatgttgtcttgtgaaaaatagatgtagaacaacaaaaatgacctctaacacaaaaaaaaacactgttatgtgctcagataacagtagttgcctgcatgaggccaaacacttttgaaaaatttgctactcagacacaaatctagaaaaaaatgatgaagcaaaaactcacaaaacagatcatacatcacatgaaaatagcgtacattgcaagggaagtggatacttagtacttcaactttttcagcttcatgatccctaggcttttctccacctagcaaagacaaaaataaaaaatatataacattgaaaaaaactaaaacaaatcataaagtcaaaaatcacgatagacattacaaatgatgcgaaccaaaatcaaaggagcaggggaagtgatgcctagtacttcatcatctcttcaacttgctccctttcctcgtcacttgattccttaagaacctagaaaaacaaactaaaacaaaatcatacatagaacaaaaaacatagtaccatacaatactttacatcaaaaaaacatca

SEQ ID NO: 19326 - DNA, 1514 bp, Zea mays
acggcacccacaatacggcacgcgggctgggcgggcgggcgggcacggtgccccacgcctttcacggatcgggcagctgtccccgtccacgccgcgcaccgcgccccgtcctcgccaccccgaaatgcacacgcacacgccttgtccttgcttgcttccttggcaccaccgcctcccctcctctcctccttattaccaccacctagctagcagcggcagcggcagcgccggcctgttgtgctgctcgctcagacagctctgctagctgcatcctcctaactctccaggtctctctctcctctcccaactcccaagtcccatccggatcgagacgctggaggcggagcgcccccccgggacggcggcggcgacgatggggcgcggcaagatcgagatcaagcggatcgagaacgccaccaaccgccaggtgacctactccaagcgccggacggggatcatgaagaaggcgcgcgagctcaccgtgctctgcgacgcccaggtcgccatcatcatgttctcctccaccggcaagtaccacgagttctgcagccccggaaccgacatcaagaccatctttgaccggtaccagcaggccatcgggaccagcctatggatcgagcagtatgagaatatgcagcgcacgctgagccatctcaaggacatcaatcgtggtctgcgcacagagattaggcaaaggatgggcgaggatctggacagtctggacttcgacgagctgcgcggcctcgagcaaaacgtcgacgcggctctcaaggaggttcgccataggaagtaccatgtgatcagcacgcagactgatacctacaagaaaaaggtgaagcactcgcacgaggcgtacaagaacctgcagcaggagctaggcatgcgggaggacccggcgttcgggtacgtggacaacacgggcgccggcgtcgcctgggacggcgcggcggcggcgctgggcggcgccccgccggacatgtacgccttccgcgtggtgcccagccagcccaacctgcacggcatggcctacggcttccacgacctccgcctgggctagcgcatccatcaccatgctgggtggtgctgctcgatcctactgcatggcaatgcaagctggttggttagttcgctcatgcatcgtccgtcaacaaagcaagtaagcaatgcaatgcaaccgaggtactgtaatagccaataaaatctactgcatactgcaaacccaattactggtagcttagctaccgcgtgtgtacgaatcaaccgattaattaccgcgcccttagcttgcatgtcgtcgtcgtctgtgcttttggcgttcgtagacatgtgtgtattgtatgcatgggtcctgttcatctgcatccatgcatgttgtttatgattgtaattgttgtgtgaaatggctgtactttgttatgatcacgtgaaattatatctacattcgtgagacttaaaaaaaaaaaaaaaaaaaaaaaaaaaaaaaaaaaaaaaaaaaaagaaaaaaaaaaaaaaag

SEQ ID NO: 19327 - DNA, 8916 bp, Zea mays
  misc_feature (2139)..(2139): n is a, c, g, or t
tgcatggcagcgttgaggtaagcgacacgatgttaggaattttgccatttttatgtttaatttaatctagaaataacgtaagtgataacaatgtgtgtacaaaaaaactcatattgatatatagggttgatgatcaatgattctatatgcctgctaggagcaactataggggtttgagagacgaggtgttacaaatgatattatagccgaccctcacgtttttatgggcatgtgtgggatatggattcagccatatgacgcttggcgcatgtggacttagagcggtcatatagcaatgttatatgacgatactagacacacaaatgtgtccaggtggagaagtttctggtttgggattgatcgacgagatcgttgttcttctaatgggagtggcttgtgatattgtggaccaagtcttaacaagattgatagaatacttatatcaataatgtgtgccttcttttttagaaacctataggttaagtgtgctttatcagagcaattttaggattagaagttttttagacgtgaacgagtgaagacaaagtacacctaaaggactcgtgagacatgatttaatttatataagaaatttaagattaacctcactcatctctcttagacgtattgacccttttagctaaaaaatggctcaatgagtggtcgagttttagcgttaatctgtttgaatccactcttactaaatgttttttttcggaacctgaactatgaagctcctgccaagcattcaactgaatttaggcgcatgtaaaatccaacgccgatgcctgggataggcatctcaggcaaaaagtgataaattaagcaaaccctaactgagtataaacgtggtctagttttcagtcttttagcttttacaatcgcactagatcatgtcgaagtgcagtcatgcagatatgagcgcttggattacaagttaagcccatatctcggatttaagagcattaattcgaggttacaattaggaacaaagtagtaaaggtcatgacaacgttagttctttaatcttgtcaagtaaggtaagtttgggttctaccgcacgccaatatttatccgacagtgccttcttaacggtaatgccttgacaattaattatttgaacacttaattcttgtttgtttccctacgcgagagagtagcatttagtcgataccaaaaataaccttgcagttatcattaatcactatagtaacttccatcgtccttatattacaaaaggcatggttaatggttgtcgacgacgaatttcagtaataacaaccgcccacagtcccacctttggctactactgtaggtacgtacacctatagtgaagtatattacaagtttcgtgttgtaacataacaatagtaacttattcatgaatagtaacttttttctatcttcatttttagcattgacagccgcatttggtcgtggcgaagtgcggacatgggcttcgattatggcttttgtcaccacatatcttcaatcttgttaaccaagctaagattgatctccactgccaacgtttttccagcacaaccttctttcacaccaagttgttgtttaaaccgtttaattaatccttttttgttcacctaagtcaaaatgtatttagtccctaccaaaataaatttgtagtaatcaatagtcaatattgttgtccttgctaaagaaaagcaacggttaatggttcttgctgaaattaagtaataattaatggcccttccccgttaactacacaccaacaggtgagtatctaacaagtttcttgtgataagaataataaggccatatttatcatagcttctccaacaattttatagttgttgcccgccggggcacagtcgccagcagcgtggcaaaagagacaaattgttttcatgacactccatgccttcaattttgttaacaaacttagggctgatttgctggttagggatcccgaggggatctatggggtagtaattcccttgttattcaaaattaaattgcaagggaatttctccccatggatccactcgggatcactgatcaccaaatcagtccttaggctatgtacggttgtttgccaccaggcgatatttttcctccacgacctttctgacatcttgatgagtattattttttcccacnaccagatatacaatatggaattttcagttgttctaaatcaaaagttttttcagttgctctaacagttcaaattagctactgttctattctagcacaaaaattctaataatgtaaaggcaagtattgaatgttcaaatatatactcaaagtaaagaagggttagaaacacgacaatatttgcttgaggtatgagaatcgacactcccactaatccttgttagagcacccgcgcaagattgtcgccccttaatctgtgcaaggatttggtgccgccacgtattcggtgtggaacatgtactatgctcctgcagcaccaccacattgtttcaggagacgcctaatgcaacgcgaaagaaggttgcatccgcagcctggctcacacacacaatcgtgtcactgaaaaaacaaattcatcttgagcagcatgcgcatgcaagtagaataagaagagaaaaataccagcaaccgaaccgatacagataaaagataaagcatagtaattaagggcacttttttttacatccgtatccgtgctcagttgcagatgtgtacagtgattaaggacactttttttccgtatggaggccacgataggggcgactgggcgttgtatgtacgtacatacgtacgtactggcgtagtatgcaaaagagaacgattacttgacctagaaactagaaaagagaagccattgaagattctttgcagggccactccattatgtcttcacgctcataatcaatgcactgattatctgtacacattttaaatcggaatagtggttgaattgactttaagccggtggttgtacgtgtatatatatacactcccctccatctatagcctgcaacgatgacgaataacgaagacaacgaccggcaaataggaagcatttgtttatatttgtggcagcgtcgtggcagaatactgtactctagttcacataaaaaaaaggttctacggctggcaatcagcatccgatcgatgaaaagaaattgaaaggatacgtggcatgtgtttgtttgttaacttgcattgctaatacctgaacaagttatatatataaccggccggtcgtcaaccaccttttcagtccgattttgtgtcgagggtagggagtaaaactgggacaacctcatgtcatgagcgaaaaattaaatctagatcttaaaattcattgcagcatgaatctgaaatccatcgtgagaggcagggcagtggcggggcacggactctgacggatgagggagaggacgcgatcggtcgagggaggatccatggagagagagagagagagagggaagagattcatagagttggtgaagtatcatttgaagagttttaatctgatcattattatattcatcaatttgatgaatctagatttcatggagttattctgtttgaccattttttttaaataaaggtcggctgtttttggtgaacgtaagtaaagtcgatgggggctgtacagtgcgagagcgcagcagaagatgcgaagggcagagtaatccacgtcagcctcaggtgagctgggacggtggccgctcctgcccttttctatttctgagccctgcgcggcttccgacgagccaaaacagacggacgcacacaaaagcgaaagggaggagagagaggggcagggcagggcagagcaggagagagaaattcgatagggttcccatgccccttccccaccggccaccacttgccaagcgaaagcgggagtgaaggaggggagagtcccatttccccaagccctacacgagagaaagagagagaggggggagcagaggagcacgctacgagagagggaggtcgagggagacagcagaggctgcagcagaggccagaagcattagaagcggcagttgtaaccaagtggcatcagaagatagagccagccatccgtctatccatctatctagctctacaggtataaatcctcgcgcatcggtagggggcgaggggaggaccgggaaccggaggggatttctcgggggtggagtggcggccaggacctctgattgggctccagtgcgcgatctttgaacgcagatttggtgcccgcaatctgccatggatttggtttaagatttggtgagatccgtcgggttcgcgctgcatattttggcgtcttgcttggctggcccggattcctgtcatccgacttatcgccgagctgagaaagagattttggttttttttttttgttttcttcttcacagatttggtgagatcggtcgggttcgcgctgcaagattagatttttgtgcctgttttattcacgaggttcgtgctccccagatctcacgtcttcacctgttcttgatccctttgttcccgttgatatcatccccgcttatttttttttctattcgattatgtcgcctgcagatcgcaacaacgatattgctaagcaagataagatttcaactttttttcccctggatcgatctcagattaggaggagcaaataaagcaagaatagaaagatttttgggggagaaggcatgatgctggaagggaagtcctaccttgtgtcacgctccgtgccgagctcctgcgagccggaggcggagtgggagtacctcgcccacgcggtcctcagcggcaagcgcccggcgccggaagatgacgtcgaggtcgaagacccggacgaaactggcagcggcggcaagcgcagcaagccgccgtctccgcagccgcacacgccggacatctgcgagggccacggctccaaccgccacgcaaccggttccggagagcagcggatcaccgggagcaaccccatgacttcgatcggtcgtgacctgaccctcaattgcctcctccggctatctcggtccgactacggctcggtggcctccctcagccgggacttccgctccatggtccgcagcggggagatctaccggctgcggcgccagaacggggtggccgagcattgggtctacttctcctgcaacgttctcgaatgggatgcctacgacccataccgggagcgctggatccaagtgcccaagatgccgcctgatgaatgcttcaagtgctccgacaaggaatcgcttgcggtgggcactgagctgcttgtgttcgggatggcgcgtatcgtcttccgatacagcatcctgaccaactcatggagcagggctgatccgatgaactctccgcggtgcctgttcgggtcaacgagtgtcggtgggaaggccttcgtcgccggaggcactgattgtgtcggcaacatactgagctctgcagagatgtatgactctgagacacatacctggacgcccctcccgagcatgaacacggcgaggaagatgtgttctggggtgttcatggatggcaagttctacgtgataggtggtgtggccaacagcaacagagtgctgacctgcggggaggagtacgacttgaagaggggttcttggaggacaatcgagaacatgtctggaggcctcaatggagtgaccggtgctcctccccttattgcggttgtcagcaacgagctctacgccgccgattacggcgagaaggatctcaagaagtatgacaagaagaacaacaggtggatcaccctcggaaaactgcctgagcggtccgtgtcaatgaatgggtgggggcttgccttccgagcgtgcggtgaccgcttgattgtcatcggaggtccgaggacctataccggtggtaccatcgagctcaactcgtggatcccagatgagcggccgcccgtgtggaatttgattgccaggcggccatctgggaacttcgtgtataactgcgccgtgatgggttgctgagtccactgaataaagatacaagtgaagtggacttcctcgtatttatgaaggatgctatctatgcacagaggcagcagcctgtccaattgcttcagcccttattcttcttcatagcgatttctgccgtctgcgcggttccggaattaactggacatcggctgattgtcagcagtctcatgtaaccattacgttctaatactcctgtttccctgctaatccattcctacattttgcattttcatcagctgatcgtgattccaaagatacgagactgtgcaaaaaaaatgtcatattaataatctagaaacaacctcgaggtggtttttatctattgatgaggaacctgtcaagaaatgctactacttcttttccgttcatcttgcatgttccaaactgtgcatatctttcgtgatgttatgagccactaagctggtgctgaagccatgttgcaatagcctgtatttcttcagctggagtctatggttctactcttgatgtttatagtttataatggttacccaccatcgcttaacgtgccacaaaatgatccgtgaaaaccatgatgaagctgtttgatttcgcgcgctccgtttttagcaatttcgcatgctagatgtcattctgaagtagtggatgcaaagagttcatcaggagcttgctaactcctacgattgtgctcttctgcagttctccttttctgagacggtccgaatttggatgtgtgagctatacagatttctttgggatgggtaaattcaaatggtagcgcttgccgtataaaaataaaagtatggttatgttaccaaatgaacactttccggattaatctagctacttgtagacgggaagcagttgcctgactaaagaacatttgtggggagtaagatgcctttttttcattcattctgggggcttatgccagtaacacgggacgttcaaatatggcgcagatcgagatctcctgcacatactagaattacgagtgacccattttttcattcattctgagtgcgtgccgtcctgctgcctatctagggtctagtagcaagtgtgatttgcttgaagcaaagcttgctctttttttttgtcgcgagcagagttggatgctaagacgcttagcctggccccgattggtagctttgcttcttgtgatgcccggcaccgattgctaagaagcttgcttacgttcgcttatgaaggtcaacacagccttgcttaaatctggcgccttttccataacaggttgccgagcgttattaaactctctgaccgaaaatttctagtgcatgctgcttggaacgagggggcggggcgacggatccggcagcgactgcactcacagtcccccgtctacataggaccggtaaaagtgtgctgtgcgtggagaaagtgctcctagcagctagcagcggattgttcttggtgtgttgcgttgcgtgaagccttgttcctttgactcgtggagccgggtgccccgtctttctatctatctatccatccatccatctatctacgcgtcagcctcacgcacaggatggacatgcccagtctggcaaaaggggggaatggatgcgttgcgttgggaataggatcgcaataatttgcgtgtacgtcgctgctgtgctgcggtgcggctctggtgtcgagtcgagtctgttccgtgcggccactgcgctggcgtagacttggcacagccgtcgttctctctgcctttccgtctgctgctggtatcttcttcttgctctgagcagcgggttcctgtgtgtgccaggacatgttcttcactcttgtgctctgctcccgcctccagcagttatgacttacgagttgcttgtaatagtccaaaaatgattagttttggagcagatttggttgttgtgtgtgctatacgacatgatgagctgattggcaatttccgaaactggcgagcgaagtcgtatagagtagcatttccccatgttggtgtcatggttattgccagcaagaatcaaacgagcctttttttttttgccatgagcatacacatatgaggctcttcaataattttcaaccgaatctccaatcagaacactgccccccgattgccggtttagacgctgcacatccagcagccgggtagaatatttttatctctctccgttgcatcaaggtaaatgctcagtgcacggagtattattgttgttgttgttgttgttattattattattattattattattattattattattattattattattattattattattattatgcctaatctccttcctttattcgcgagcacgcaccctggcctcattctacgccttttcccccgctcggttcggggcgatgcatggacggcaggaaacactcgaatcattgcggctgccgaagcgtccacgcaacgccgcagcgcagcttcccgtccgttccttcagtacccttcccccgccagcggtcatcgataacgcacgcacctgcgtcgccccaatcgagagaccgtatggtcgcggcacgccacgccgtccacgccgcgtcaacacgtttgaccggcccagtcctcgtttacggctcctgacggcccagtccgcacgtgcggtatcagtacgtgcctcgtccgtcgttctccgccacatccaaatcgcccaaattgatgtgaccgcttgcttttgctctcatcagcgtgggctgattcacatgacacgtcctccggtttgacgggctcagatcgcttccctttaatgggctcagttcggtccggaggttgatgggctcctgacgctgaaaaatgtggcacaatttagctggaggagcttataaaacatcagtgctccaataaacagcgagtaaaggtgttgtgaatgttgagaaaccctaacgaagggttatgtggctaaataccaaatatgcccttcaagacaatcacgtctatatatataaaacatgtatccctcatatgaaatagagaagagaaagaggccagaga

SEQ ID NO: 19328 - DNA, 2333 bp, Zea mays
gccggcccggccggggagccaaaccagacggacgcacacaaaagcgaaagggaggagagagaggggcagggcagagcaggagagagaaattcgatagggttcccatgccccttccccaccggccaccacttgccaagcgaaagcgggagtgaaggaggggagagtcccatttccccaagccctacacgagagaaagagagagaggggggagcagaggagcacgctacgagagagggaggtcgagggagacagcagaggctgcagcagaggccagaagcattagaagcggcagttgtaaccaagtggcatcagaagatagagccagccatccgtctatccatctatctagctctacaggtataaatcctcgcgcatcggtagggggcgaggggaggaccgggaaccggaggggatttctcgggggtggagtggcggccaggacctctgattgggctccagtgcgcgatctttgaacgcagatttggtgcccgcaatctgccatggatttggtttaagatttggtgagatcggtcgggttcgcgctgcaagattagatttttgtgcctgttttattcacgagatcgcaacaacgatattgctaagcaagataagatttcaactttttttcccctggatcgatctcagattaggaggagcaaataaagcaagaatagaaagatttttgggggagaaggcatgatgctggaagggaagtcctaccttgtgtcacgctccgtgccgagctcctgcgagccggaggcggagtgggagtacctcgcccacgcggtcctcagcggcaagcgcccggcgccggaagatgacgtcgaggtcgaagacccggacgaaactggcagcggcggcaagcgcagcaagccgccgtctccgcagccgcacacgccggacatctgcgagggccacggctccaaccgccacgccaccggttccggagagcagcggatcaccgggagcaaccccatgacttcgatcggtcgtgacctgaccctcaattgcctcctccggctatctcggtccgactacggctcggtggcctccctcagccgggacttccgctccatggtccgcagcggggagatctaccggctgcggcgccagaacggggtggccgagcattgggtctacttctcctgcaacgttctcgaatgggatgcctacgacccataccgggagcgctggatccaagtgcccaagatgccgcctgatgaatgcttcaagtgctccgacaaggaatcgcttgcggtgggcactgagctgcttgtgttcgggatggcgcgtatcgtcttccgatacagcatcctgaccaactcatggagcagggctgatccgatgaactctccgcggtgcctgttcgggtcaacgagtgtcggcgggaaggccttcgtcgccggaggcactgattgtgtcggcaacatactgagctctgcagagatgtatgactctgagacacatacctggacgcccctcccgagcatgaacacggcgaggaagatgtgttctggggtgttcatggatggcaagttctacgtgataggtggtgtggccaacagcaacagagtgctgacctgcggggaggagtacgacttgaagaggggttcttggaggacaatcgagaacatgtctggaggcctcaatggagtgaccggtgctcctccccttattgcggttgtcagcaacgagctctacgccgccgattacggcgagaaggatctcaagaagtatgacaagaagaacaacaggtggatcaccctcggaaaactgcctgagcggtccgtgtcaatgaatgggtgggggcttgccttccgagcgtgcggtgaccgcttgattgtcatcggaggtccgaggacctataccggtggtaccatcgagctcaactcgtggatcccagatgagcggccgcccgtgtggaatttgattgccaggcggccatctgggaacttcgtgtataactgcgccgtgatgggttgctgagtccactgaataaagatacaagtgaagtggtggacttcctcgtatttatgaaggatgctatatctatgcacagaggcagcagcctgtccaattgcttcagcccttattcttcttcatagcgatttctgccgtctgcgcggttccggaattaactggacatcggctgattgtcagcagtctcatgtaaccattacgttctaatactcctgtttccctgctaatccattcctacattttgcattttcatcagctgatcgtgattccaaagatacgagactgtgcaaaaaaaaaaaaaacaaatgtcatattaataatctagaaacaacctcgaggtggtttttatctat

SEQ ID NO: 19329 - DNA, 2147 bp, Zea mays
cattgggtaccgccggcccggccggggagccaaaacagacggacgcacacaaaagcgaaagggaggagagagaggggcagggcagagcaggagagagaaattcgatagggttcccatgccccttccccaccggcaaacacttgccaagcgaaagcgggagtgaaggaggggagagtcccatttccccaagccctacacgagagaaagagagagaggggggagcagaggagcacgctacgagagagggaggtcgagggagacagcagaggctgcagcagaggccagaagcattagaagcggcagttgtaaccaagtggcatcagaagatagagccagccatccgtctatccatctatctagctctacaggtataaatcctcgcgcatcggtagggggcgaggggaggaccgggaaccggaggggatttctcgggggtggagtggcggccaggacctctgattgggctccagtgcgcgatctttgaacgcagatttggtgcccgcaatctgccatggatttggtttaagatttggtgagatcggtcgggttcgcgctgcaagattagatttttgtgcctgttttattcacgagattaggaggagcaaataaagcaagaatagaaagatttttgggggagaaggcatgatgctggaagggaagtcctaccttgtgtcacgctccgtgccgagctcctgcgagccggaggcggagtgggagtacctcgcccacgcggtcctcagcggcaagcgcccggcgccggaagatgacgtcgaggtcgaagacccggacgaaactggcagcggcggcaagcgcagcaagccgccatctccgcagccgcacacgccggacatctgcgagggccacggctccaaccgccacgcaaccggttccggagagcagcggatcaccgggagcaaccccatgacttcgatcggtcgtgacctgaccctcaattgcctcctccggctatctcggtccgactacggctcggtggcctccctcagccgggacttccgctccatggtccgcagcggggagatctaccggctgcggcgccagaacggggtggccgagcattgggtctacttctcctgcaacgttctcgaatgggatgcctacgacccataccgggagcggtggatccaagtgcccaagatgccgcctgatgaatgcttcaagtgctccgacaaggaatcgcttgcggtgggcactgagctgcttgtgttcgggatggcgcgtatcgtcttccgatacagcatcctgaccaactcatggagcagggctgatccgatgaactctccgcggtgcctgttcgggtcaacgagtgtcggcgggaaggccttcgtcgccggaggcactgattgtgtcggcaacatactgagctctgcagagatgtatgactctgagacacatacctggacgcccctcccgagcatgaacacggcgaggaagatgtgttctggggtgttcatggatggcaagttctacgtgataggtggtgtggccaacagcaacagagtgctgacctgcggggaggagtacgacttgaagaggggttcttggaggacaatcgagaacatgtctggaggcctcaatggagtgaccggtgctcctccccttattgcggttgtcagcaacgacctctacgccgccgattacggcgagaaggatctcaagaagtatgacaagaagaacaacaggtggatcaccctcggaaaactgcctgagcggtccgtgtcaatgaatgggtgggggcttgccttccgagcgtgcggtgaccgcttgattgtcatcggaggtccgaggacctataccggtggtaccatcgagctcaactcgtggatcccagatgagcggccgcccgtgtggaatttgattgccaggcggccatctgggaacttcgtgtataactgcgccgtgatgggttgctgagtccactgaataaagatacaagtgaagtggacttcctcgtatttatgaaggatgctatctatgcacagaggcagcagcctgtccaattgcttcagcccttattcttcttcatagcgatttctgccgtctgcgcggttccggaattaactggacatcggctgattgtcagcagtctcatgtaaccattacgttctaatactcctgtttccctgctg

SEQ ID NO: 19330 - DNA, 2225 bp, Zea mays
gccggccgggtcggaattccgacgagccaaaacagacggacgcacacaaaagcgaaagggaggagagagaggggcagggcagagcaggagagagaaattcgatagggttcccatgccccttccccaccgggcaccacttgccaagcgaaagcgggagtgaggccggcgggagtcccatttccccaagccctacacgagagaaagagagagaggggggagcagaggagcacgctacgagagagggaggtcgagggagacagcagaggctgcagcagaggccagaagcattagaagcggcagttgtaaccaagtggcatcagaagatagagccagccatccgtctatccatctatctagctctacaggtataaatcctcgcgcatcggtagggggcgaggggaggaccgggaaccggaggagatttctcgggggtggagtggcggccaggacctctgattgggctccagtgcccgatctttgaacgcagatttggtgcccgcaatctgccatggatttggtttaagatttggggagatcggtcgggttcgcgctgcaagattcggtctctgtgcctgttttattcacgagatcgcaacaacgatattgctaagcaagataagatttcaacttttttcctggatcgatctcagattaggaggagcaaataaagcaagaatagaaagatttttggggggagaaggcatgatgctggaagggaagtcctaccttgtgtcgcgctccgtgccgagctcctgcgagccggagacggagtgggagtacctcgcccacgcggtcctcagcggcaagcgcccggcgccggaagatgacgtcgaggtcgaagacccggacgaaactggcagcggcggcaagcgcagcaaaccggcgtctccgcagccgcacacgccggacatctgcgagggccacggctccaaccgccacgccaccggttccggagagcagcggatcaccgggagcaacccatgacttcaatcggtcgtgacctgaccctcaattggctcctccggctatctcggtccgactacggctcggtggcctccctcagccgggacttccgctccatggtccgcagcggggagatctaccgcctgcggcgccagaacggggtggccgagcattgggtctacttctcctgcaacgttctcgaatgggatgcctacgacccataccgggagcgctggatccaagtgcccaagatgccgcctgatgaatgcttcaagtgctccgacaaggaatcgcttgcggtgggcactgagctgcttgtgttcgggatggcgcgcattgtcttccgatacagcatcctgaccaactcatggagcagggctgatccgatgaactctccgcggtgcttgttcgggtcaacgagtgtcggtgggaaggccttcgtcgccggaggcactgattgtgtcggcaacatactgagctctgcagagatgtatgactctgagacacatacctggacgcccctcccgagcatgaacacggcgaggaagatgtgttctggggtgttcatggatggcaagttctacgtgataggtggtgtggccaacagcaacagagtgctgacctgcggggaggagtacgacttgaagaggggttcttggaggacaatcgagaacatgtctggaggcctcaatggagtgaccggtgctcctccccttattgcggttgtcagcaacgagctctacgccgccgattacggcgagaaggatctcaagaagtatgacaagaagaacaacaggtggatcaccctcggaaaactgcctgagcggtccgtgtcaatgaatgggtgggggcttgccttccgagcgtgcggtgaccgcttgattgtcatcggaggtccgaggacctataccggtggtaccattgagctccactcgtggatcccagatgaacggccgcccgtgtggaatttgattgccagggggccatttgggaacttggggtaaatctgcgccgtgatgggttgcttagtcccctgaataaagatccaagtgaagtggccttcctcgtatttatgaaggatgctatctatgcccaagggcagcaccctgtccaattggttcagcccttattttttttcatagcgattttttccgtttgcacggttccggaattaactggacatcgggtaattgtcagcagtttcatgtaacctttacgttttaatactcctgtttccctggtaaaccattcatcccttttgc

SEQ ID NO: 19331 - DNA, 1441 bp, Zea mays
gtggccgcctgccagcaggccaactaccgagtgggggaggaccgggaaaccggaggaggggatttctcggggagccgcacggtcggccaggacatctccgagggtcgcggctccagccgcatggcctccggttgcggagagcagcagggcactgggagcaaccccatgaattcaatcggccgtgacctgaccctcaattgcctcctccggctatctcggtccgactacggctcggtggcctccctcagccgggacttccgatccatggtccgcagcggggagatctaccgcctgcggcgccagaatggggtggccgagcattgggtctacttctcctgcaacgttcttgaatgggatgcctatgacccatatcgagagcgctggatccaagtgcccaagatgccgcctgatgaatgcttcatgtgctctgacaaggaatcacttgcagtgggcactgaactgcttgtgtttgggatggcacgtattgtcttcagatacagcatcctaaccaattcatggaccagggctcatccaatgaactctccgcggtgcctgtttggttcaacaagtgttggggaaaaggccttcgttgctggaggcactgattctattggcaacatactgagctctgcagagatgtatgactctgagacacatacctggacgcccctcccaagcatgaatagggcaaggaagatgtgttctggggttttcatggatggcaagttctatgtgataggtggtgtggctaacaacaacaaattgctgacttgtggggaggagtatgacttgaagaggcgttcctggaggataatcgagaacatgtctgaaggcctcaacggagtgactggtgctcctccccttattgcagttgtcagcaacgagctctacgccgctgattacagcgagaatgacctcaagaagtatgacaagaagaacaacaggtggatcacccttggaaaactgcctgaacggtctgtgtcaatgaatggttggggccttgctttccgagcctgcggtgactgcctgattgtcatcggaggtccgaggacctacactggccgtactattgagctcaactcatggaccccaaacgagcggccgcctgtgtggaatttgattgccaggcggccatctgggaacttcgtgtacaactgcgccgtgatgggttgctgagttccactgaataaaagataagtgcagtggatatttatgaaggatggtatgcacagaggtagcctgtcccaattgcttcggcccttattcttcgtagtagcggtttctgccgtctggcccagttccggaattatgtggacatcagctgattgtcagcagtctcatgtaacccttgagttctgatactcctgtttccctgctaatccatttctacatttgcatttgaatcaaaaaaaaaaaaaaagggcagccgctcgcgatctag

SEQ ID NO: 19332 - DNA, 2843 bp, Zea mays
cctcgaggccggccgggttcccccccccgccatttttctcctcccactgattttgcattttagcccctcaggaagctccgatttcggccccgctccggcggaccgcttccgttcgtgctctgctccgaccgagcttgccgcgccgtgggggacagctgcgaggactctcgttcggcggctctggttctcggcttggtcccgtttcttccccaacaaatctcgtgatttttggttcagatttggcttctcggcgcccgtctgggtctttctcgtgcgtttcgcctttggtttcgccgatttggtgccggattcggtgggttgcggccgagtagcctggatctcgggcgccggtctagcgctaggagccctcacactgtggatttcctgccggaggaagcttttcaagggagctagtagctagtagctagctgcctttgggagcagtagctcttctagtctctgaaggtttcaccatacgcggtggagagcgctattagcttgaggagtagatttcgtgtagcggtgagcaaagtttgggtgtcaagtctggtggtggaagccttcaggcttgagattttctccctcacgacaccgaaggagcacgccggctctggaaggaatttcctgccatcccagaggctgccgatttcctccctcccgggaagcaagcaagggctttcttctagacgagctcttctggttccttaagtttgtgggccgtggctatttaatctccaactgcatccccagatattcaccaaattctgtgagactgggaactccgggattggtttggataaggtgttctgggaatggggaaccaatgcccaaacgggacccttgggagtgactactacaaccgccccgcttccaggttcgctgatggttgccttgaggacgatcgctactctgacttgaagaagtttgacaagccatggcctgaggtgaactcgtttaagcccactgctgttggtattttgaagaggggattggatccaacgtcaatcactgtccttgaaaggaagacggccgacgtaagggaacattatatcatcggtcggaggcttggtcaaggccagtttggcacaacattcctctgcaccgagatcagtacagggtgtgagtatgcatgcaagacaatcccaaagcgaaagctcatcaccaaggaggatgttgaggatgtgcgccgtgagatccagataatgcaccatttgtcaggccacaagaatgttgtttccatcaaggatgtatacgaggatgggcaggcggtgtatattgtgatggagctctgcgccggtggggagctctttgatcgaattcaggagaaagggcattacagcgaacagaaggctgcagatctcataagaatcattattagccttgtggctatgtgccattcacttggggttatgcaccgtgatctaaagccagaaaacttcctcctttgggataaagaagatgacctgtcaataaaagcaatcgattttggtctatctgtgttcttcaaaccaggtcaggttttcactgagctggttggaagtccatactacgttgctcctgaggtactacacaaacggtacggaccagaagcggatgtgtggtcagctggagtgatactgtatgttttgcttagcggggtgccacctttttgggcagagacgcaacaaggtatatttgatgctgtcttgaaggggcacattgattttgactcggacccatggcctaagatatctgaaagtgcaaagaatctcataaggaagatgctctgcccttgtccttcagagcgtctgaaagcccatgaagtactacgccatccttggatctgtgaaaatggagtggctactgatcaggctcttgatcccggtgttctctctcgtctcaaacaattctccgcaatgaacaaattaaagaagttggctctgagagtgatagctgaacgactttctgaggaggagattgctgggttaagacaaatgttcaaggcagttgacgttcaaaatagaggcgtaattacttttggtgaacttagacaaggtttaaaaagatatggtagcgaattggagaatagagaaattagtgatataatggaagtggctgataatgacaataatgtgaccatcaattatgaagaatttatcgctgcaactgtgcctcttaacaaaatagaacgtgaggagcacctgatggcagcttttacctacttcgacaaagatggaagtggttatatcacagtcgacaagctgcaacgagcttgtggagaacatgacatggatgacactttccttgaagagataattttagaagttgaccaaaacaatgacggtcagattgactacgccgaattcgtagccatgatgcaaggcaacaaagttggacttgggtggcaacaaatggaaaccactttgaatgtaaccttgagagatgcacctcaagtacactgtcactgacgcgctcgccatgtacagattttgttctcttctcgtgttcatcgtttctccacacgacctgagagttccggtcgacatgacatgtatcacgaggagagagcaaatcaatcgattcatttagtggtatttatcccaaataaagtgtgggctggcaggcagaatatggtttgtcatgagagacactagtatgggtttatatgtataaatatatagtagtggtggtatattggtttatggtagcgggtgatcctgtcaagcgattcaatcgaaataccaaaagaagtgcgttcagtttgcccgttttgttacgggtttcatgaagatgaaggtgattatgttttctcatgtcgagatttgcacttccttaaaacgcagctgattccccaattctttttt

SEQ ID NO: 19333 - DNA, 5747 bp, Zea mays
  misc_feature (4926)..(4926): n is a, c, g, or t
gtgcatactcttgttgtggggagagagaggtaggagtgagtatatataggtgggggccaaaactagtcattaggctgaactttcctgcgcagggccgattgaaccgcctccagggccgattcaaccgtctggtggtcagactgacagtcaaactgacagactgtaggtcagactgatcaggtgactctaacaccggttgaacctccccaaggccagttcaactggttttgaccagagaggttcaggaaaaaccctcggttgaacctgctctgaacaccggttgaagttaagtttaatcgagctgaagttaaagctcaaccgagctgaaaaagcttaactcaaattaaaaaaaatttaactcagctgaaaaaaacccaacctacattaaaaaaaactctaactcagttgaaatcaactcagcagcgcgttgtcgccaagcggagcggactgcggacccgtagttgtcaacccagcagcgcgtccgtcgcagttaccgacccaccacgccaccccccttcggcccttccccacgcgccgctcgcccgccctctccaaatcccaaatccaacccaccggccaccgcaccaccgccgcctatcgtccccacccgcagccccccgcccccgatcgcggcggcacccataatggccgcctcgtcgtcaccgcgcgccgcggggctccgcgggccctccctgaccgtcctcctctttctcgtcgccgcgatggtgtcggttccccccgcggcggccgagatccgggagaccgcgatccgggccgacccgcggagcatcatcccgctggacgagttcggcttctcccactcgggcgtgctggagctcaacgtctccggcatcgctttcgatccgcaggcctccgcggagctggacctctcccagctcggcttcttcctctccacgctcgacgcctgggttcacgtcctccgccagcttcaggacctagacgtcacctgcgcgctccagtcggagctcgtcaagctcgccttctcctttgaccgcctccgcccgccctccaaccctgccggcgtcgaggtagcccgctcttcctccttctctaccgccttccgcgtgtcggagccagggcagtacacgctcgttttcgccaactgcctcggcggcggcctcaaggtcgacatggacgtccgctccgccatgtacaacgtcgacccggccaccggggagcgccagtacctctccgcgggagcctcggcgctgccctccttctacttcctcttctgcctcgcttacgctggcctcgccgccgcctgggtttccatcctcctccgcaagcgggccgccgtcttccggatccactacttcatgctcgccgtgctcgtgctcaaggctctcaacctcctcgccgaggccgaggacaagtcatgcatcgagcgcaccggcacggcccacggatgggacgtgctcttctacatcttcagcttcctcaaggggatctcgctcttcacgctcatagtgctcatcggcaccggctggtccttcctcaagccctacctggccgaccgagagaagaaggtgcttatggtggtcatccccctgcaggtcgtagctaacatcgcgcaggtggtgattgacgaatctggaccctatgcccgggactgggtcacctggaagcagattttcttgctggtcgatgtggtctgctgctgtgctgtgctcttcccgattgtgtggtccatcaagaacctccgggaggctgctcgctcggatgggaaggccgctgtgaacctcatgaagctcaccctcttccgccagtactatgtggtcgtcatctgctacatttacttcacgcgtgttgtggtgtatgcgctacagaccatcacctcataccggtacctgtggactagcgtcgtggccggggagctcgcgacgctcgcgttctatgtctttactgggtacaagttccggcctgaggtgcataacccatactttgccattgatgatgaggaagaggaggctgcagctgaggcgctaaagttggatgatgaattcgagctatgattgaggggttaggaattggcatctcctccatgccagtggtgatattggtgttgtatgtcccagcagaggacaagtggcatagactggtacctagtccatatccttttgtttctccttttgagttggttacattttatcttaatgtaattgggtagtgacaacaaccctgtgtctgttaagcaatgcagcttggctttgccttaaattttatacacaaccattgagatgaggtgtttccattctagatgttcattttgttcacatagttaaaactgaccgtatgatactgaatgcacttctgagttctgacggcccctagttcatctgtctagtttcactttgctcttacactataggaacccctattggcggaaaacatgctgattttaatattcaagtgtaacgtttcctatatttgctatgtcactcaaaaaaaaaactaagattctgttgccacagaatcgcctacaaggagttgcagatgctgtctacttgtgtaatttgcattagggcctgtttggaacgatggggattgctctacaaacttttaggattcacaaggacttgaaatttggatcccagttccccaattccaaattattttattattattcttttccattcattgctgacttgaagctgatatgggctttgtataaaagcatctcatattgtacacatgaatgttccaaatccttctcttcttgaccttgtgattgtgacactggaattctccttcatccttctatttagtggtcaggtatctcttcaatacctaatcatttgactgggtgccctcttttacactgtctgagattgtaagtcactactctactcactttatagtttgaggattccgttgaaggattgtatattggaaggaagggccaagttgcattactgtttgaactgggatgttttttcaaattggagttagaactgttgagaagagggagggagaagcaggggcacatttggcaatggtagattgttattagcaggggtgaatctaggccagatgatcatcaaagtcttgtctgaaaataggtggggtcatttggaagtattagcactatatgcactaattttccattggaattctcaaaatccatcgggggtcgactgacccgggtggccgggtgacaaactgtagctctaccctggttaatagaacggtgttccatgttgttttgactagtttatcctagtttaacataatatacaaggtagctcttttcatcatcaaatatgccattaagttctgtcagctgccagactccaacttcagaattctggaataaggactgagaacctttgaatatcttcctaatttggttctttattttggattggatttaattgataggttgcttaagtttttctatcagccactcttaattttgttgtctttttttttctctatctgcaaggaaatttttacaaattttcctttcgtgattaatggacaaaaaacttggtagttactatttgggtttatgagcttttccattccatctcccatttgtgaaactggatttggtatttaatttggtgtgccttgccagtaagttcctttcctctctcttcacatattcaatgggcttatccactggtactgccatgggcccatggcctggcctatgatcggacgttaaacaagtactgaagcctgattgataagatgttaagccactgcttttagttacaccgactgaacaaggaaacttgtactttaccttttgtttttaatatgtttcagttctgtgttgcttagttagttgctgtttgtgtgcataatgaccataatagacatctgcagctgagtgctaatgttaagataactaatgctagctggtattgctttggatctacaaaagatgacatagaaacaagtgaaggcagagtcatggaagtcaactgaatggttgtacgattcatattctatcgtgcaaattggaaggcatttttttaatttcgaaaggccaacagactgctactgtagtaactcctcaggatagggagaaacagtgtaactatgacccgaaagggctctggttttgagccatggcagtcaccttcgtactttgccattgatgatgaggaagaggaggctgccgctgcagctgaggcgctaaagttggatggtgaattcgagctatgaggggttaggagttggcatctccttcgtgccagtggtgatatcggcgttgtatgtcccaccagaggacaagtgtcatagactggtatatagtccatatccttttgtttttccttttgagttggctacattttgtcttactgtaattgggtattgacaacaaccatatgtgtgttaagcaatgcagtttggttttgccttaaattttatacacaatcattgagatgaggtcgttctagatgttcattttctttacatagttaaaactgagcttatgatactgaatgtacttctgagttctgacttgctgaagttcatctgtatactttcactttgctcttacgctataggaacccctacttttaagggtccgaatacatgttggcttaatattcaaatgtgacttctcctatattttctatgtcactcagggaaaaaacaaagattctgttgccacagaatcgcctacaaggatttgtagatgctgtttagttgtgtaatttgcattagtgcctgtttggaacaatggggattgctccacaaacttttatgattcacaaggacttaaaatttggatcccagttccccaattccaaactgggttattattattctttttcaactattgctgacttgaaagtgggtctgggctttgtataaaaatcatctcaatattgtaccatatggtgggggttgttggttccgtttccttctcttttgaccctatgaccctgnaattctccttcatccttctattagtggtcaggtactcaggtatctcttcagtacctgatcatttgactggatgcctcttttacaatgtctgagattgtaagtcactatcctcctaactttgtagtttgaaaattctgttgaagtattgcatattagaagaaagagccaagttgcattaatgtttgaaatgggagtgttagaattgttgagaggagggaggagggagggagaagcagggacacacttggcaatgatagattgttactagcaggggcgagtctaggccagacgatcatcagagtcttgtccgaaaataggtggggtcattaggaagtattagcactatattcactaattttccattggattcctcaaaatctgttggggtcgactgtccctgatgacaaactgaagctctaccccaggttgctagaacaatcttccgtgttgttttgactaatttatcctagtttacatataatatacaaggtagctcttttcatcgtttatgccattaagttctgccagcttccaccttcagaattctggaatgaggactgagaacctttgaatatcttactaattttgtcctttgttttggattggatttaattgataggtcgcttcagttttttttatcagcaacttttttttcctgtatcggcaaggccattttagaagttttgcccttaaatattcattttcgtgattaattgaaacaaaacttggtagttactatttgggtctatgagctttttcatctcccatttgtgaaactggatttggtatttaagttggtgtggattgccagcaagttcatc

SEQ ID NO: 19334 - DNA, 1814 bp, Zea mays
ttgggtacctcgaggccggccgggagcagtgtgcccgtcgccttccccgtgggaccccgcgaccgcccggcccggacgcccaccaaatcccgaatcccaccaccgccttctatcgcccccaccccggctcccagatcgcggcggcacacataatggccgcctcgccgtcgctgcacgccgtggcgcaccgggggccctccctgaccgccctcctcttcctcgtcgccgcgatggtgttggttccccctgcggcggccgagatccgggagaccgcaatccgggccgacccgcggagcatcatcccgctggacgagttcggcttctcccactcgggcgtgctggagctcaacgtctccggcatcgccttcgacccgcaggcctccgcggagctggacctctcccagctcggcttcttcctctccacgctcgacgcctgggtccacgtcctccgccagctccaggacctcgacgttacctgcgcgctccagtccgagctcgtcaagctcgccttctctttcgaccgcctccgcccgccctccaaccccgccggcgtcgaggtcgctcgctcctcctccttctccaccgccttccgcgtctccgagcccggccagtacacgctcgtcttcgctaactgcctcggcggcggcctcaaggttgacatggacgtccgctccgccatgtacaacgtcgacccggcaaccggggagcgccagtacctctccgcgggggcctccgcgctgccctccttctacttcctcttctgcctcgcctacgctggcctcgccgctgcctgggtcgccatcctcctccgcaagcgggccgccgtattccggatccactacttcatgctcgccgtgctcgtgctcaaggcgctcaacctcctcgccgaggccgaggacaagtcatgcatcgagcgcaccggcaccgcccacggctgggacgtgctattctacatcttcagcttcctcaaggggatctcgctcttcacgctcatagtgctcatcggcaccggctggtccttcctcaagccctacctggccgaccgagagaagaaggtgcttatggtggtcatccccctgcaggtcgtagctaacatcgcgcaggtggtgattgacgaatctggaccctatgcccgggactgggtcacctggaagcagattttcttgctggtcgatgtggtctgctgctgtgctgtgctcttcccgattgtgtggtccattaagaacctccgggaggctgctcgcttggacgggaaggctgcggtgaacctcatgaagctcaccctcttccgccagtactatgtggtggtcatctgctacatttacttcacgcgggtcgtggtgtatgccctacagaccatcacctcgtaccggtacctgtggactagcgtcgtggccggggagcttgtgacgctcgcgttctatgtctttactgggtacaagttccggcctgaggtgcataacccatactttgccattgacgatgaggaagaggaggctgcagctgagacgctaaagttgaatgatgaattcgagctatgaggggttaggaattggaatcgactccatggcagttttaatattggtgttgtatgccccccagcacaggacaagtggcataaactggtatctagtccgtatccttttgtttctccttttgagttggctacacttggtcttactgtaattgggtatggacaagaatcctgtgtgtgttcagcaatacagcttggctttgccttaaattttgtacacaatcactgagatgagcagattcggttctagatgttcaaaaaaaaaaaaaaaaaagcggcc

SEQ ID NO: 19335 - DNA, 1894 bp, Zea mays
ttgggtacctcgaggccggccgggaccacgccaccccacttcggcccttccccacgcgccgctcgcccgccctctccaaatcccaaatccaacccaccggccaccgcaccaccgccgcctatcgtccccacccgcagcccccgcccccgatcgcggcggtacccataatggccgcctcgtcgtcaccgcgcgccgcggggctccgcgggccctccctgaccgccctcctctttctcgtcgccgcgatggtgtcggttccccccgcggcggccgagatccgggagaccgcgatccgggccgacccgcggagcatcatcccgctggacgagttcggcttctcccactcgggcgtgctggagctcaacgtctccggcatcgctttcgatccgcaggcctccgcggagctggacctctcccagctcggcttcttcctctccacgctcgacgcctgggttcacgtcctccgccagcttcaggacctagacgtcacctgcgcgctccagtcggagctcgtcaagctcgccttctcctttgaccgcctccgcccgccctccaaccctgccggcgtcgaggtagcccgctcttcctccttcgggctaccgccttccgcgtgtcggagccaggccagtactcgctcgtcttcgccaactgcctcggcggcggcctcaaggtcgacatggacgtccgctccgccatgtacaacgtcgacccggccaccggggagcgccagtacctctccgcgggagcctcggcgctgccccccttctactttctcttctgcctcgcttacgctggcctcgccgccgcctgggtttccatcctcctccgcaagcgggccgccgtcttccggatccactactttatgctcgccgtgctcgtgctcaaggctctcaacctcctcgccgaggccgaggacaagttatgcatcgagcgcaccggcacggcccacggatgggacgtgctcttctgcatcttcagctttctcaaggggatctggctcttcacgctcatagtgctcatcggtaccggctggtctttcctcaagccctacctggccgaccgagagaagaaggtgcttatggcgtacatacccctgcaggtcgaagtcaacatcgcgcaggcggggatagacgaatgtggaccctatgctcgagactggggcacctggaagcagattttcttgctggtcgatgtggtctgctgctgtgctgtgctcttcccgattgtgtggtccattaagaacctccgggaggctgctcgcttggacgggaaggctgcggtgaacctcatgaagctcaccctcttccgccagtactatgtggtggtcatctgctacatttacttcacgcgggtcgtggtgtatgccctacagaccatcacctcgtaccggtacctgtggactagcgtcgtggccggggagcttgtgacgctcgcgttctatgtctttactgggtacaagttccggcctgaggtgcataacccatactttgccattgacgatgaggaagaggaggctgcagctgagacgctaaagttgaatgatgaattcgagctatgaggggttaggaattggaatcgactccatggcagttttaatattggtgttgtatgccccccagcacaggacaagtggcataaactggtatctagtccgtatccttttgtttctccttttgagttggctacacttggtcttactgtaattgggtatggacaagaatcctgtgtgtgttcccccccccagcttggctttgccttaaattttgtacccaatcactgagatgagcagattcggttctagatgttcactttgtttacacacttaaaagtgatcttatgacactgaatgtacttctgcctaaaaaaaaaaaaaaaaaaaaaaccacaccaacac

SEQ ID NO: 19336 - DNA, 1467 bp, Zea mays
cttgcatgcctgcagtcttcactgattcactctaactgtccagaccttaaacccctcctgtcctccaattcctctcgcgctctctatatctacgtgccacacgccgtgcggtaccagtgcttgcgcgtgtgcatacgtacgtgtatcggcgcacgcatgatggctcctaccacctccttgctcgcgctcgtgttcctcttcctcctgcccgccgccgccgtcgccgcgccaccggctaccggcgacgccgccgccttcaacgtgacggagatcctcagccggtacccggagttcaagctcttcaacctcctcctcagcaagacccgcgtcgcgcgcgaggtgaaccgccggagcgccgtcaccgtgctggtcccggacaactcggccgtggactggctcctgcgccgcagcgccaggctgccgcgcgccgcgctcgtggagctcgtctccgtccacgtcgcgctcgactacatcgacgcggccaagctggccgcgatgccccggagcggccagcccgccgtggtcaccacgctgttccagaccacgggggccgcgctgaaccgcacggggttcctgaacgtcaccgcagtggggcgcgccggcgctgtcttcgtctcggccgcgcccgggtcgctggtcagcgccacgctcaggagggcggtgaccgcccggccgtacaacatatcggtgctccagatcagcaacttcgtcgtgccgccgggcgtcatcaccaggccgcggctgccgctgtcgtcgccgtcgccgcccgcgccgaggatgaggcagatggccatcgcgcccagccctgcgccgaccttagcttcgttgaggccatctccgacgacgctaccgacctcggagggcgttgccgcggaggctccggacactactgctgaagcgccggcgccgtcgcatggtcatgtggcggaagtgaccaattggtggattggtgcggcagtgggggtggcatgcacgctcgggtacttgtagattgctccatctgcctgcaactgatagatcgggagggaatcgtcacatgcatttttgtaatagctcatgttgggtaccctagtaattcttatgtcgccttttctttagtcgatatttccacatttttttttgttttcttatattattaggcttcttggaattatagagagtagaaatctctactaaaaaaaaaaaaaaaaagtcgagtatgtcgaccgaaggactccgtctgcatgtcatttctgatccatggattccctatcacaccaacacacgattcacttgggtccgtgtgtcacttggtttgcccgtaacgtcgcgcaccacattattgacatttggtttgagcaaatccagttttaaacaattttgcataaaccgatcatattttaggattcatttttacttgtttctggggaccaggtatgacatataatgctaagttggagaaccactattatattctactacttttta

SEQ ID NO: 19337 - DNA, 1512 bp, Zea mays
aactcacgagcaaagcaaaggctccaaacttactcgccgcccgcgaaaaccacgctaatcagtgccaaaacgcaaataacgcgagggagaagaagagacagaaacagtaagggtttgactgtttggctaacgtcatggcgtcgacctctccgcgccgctcctctggcggggactcagcttccccgtccgcacccctcatcccctcgccgccgacctccccggcatccggcccctccggtggcccgctagggcggctcacgagcctccgcggcgcggcgcggttcatccgccgcacggggagccggcgcctgatgagggagccctccgtggcggtgcgggagacggccgccgagcacctcgaggagcgccagaccgactgggcctactcgaagcccgtcgtcgtgctcgacatgctctggaacctcgccttcgtcgccgtcgccgcggccgtactcgccgcatcggtgggcgagcggcccaccgtgccgctccgtgtctggatcgtaggctacgtgctccagtgcctcctccacgtactcagcgtcaccgtcgagtacaggcgtcgacgcaggaacgcggaccaggagggagcgggtgatgaggatttaaagctcagtattgtgaagcacttggagtctgcaaacacgatgttttccttcatatggtggattgttgggttctattgggtgtctgcaggtggtaaagctttatcacatgatgctcctcagctttattggctgtcaattgtttttctggcgtttgatgttttctttgtggtcttctgtgttgccttggcttgtgtgattggaatcgctgtttgttgctgccttccctgcattattgctatcttatatgctgtaactgatcaggtatcccaggagggagcatctgaagatgacataaacaacctatccaaattcaaatttcagacaatgagtgatgcagacaagctagctgctggcattgcagcacctgtgggtggagtgatgacagagtgtggtaccaatcctcctgtcgaacatattctctcagctgaggatgcagagtgctgtatctgcctatgcccgtatgaagatggcgtggaactacgtgagcttccttgcaaccaccattttcactgcagctgcattgacaagtggcttcacataaatgctacatgcccattgtgcaagttcgacatcatcaagagcaaccgtgacatagaagaggtctaggtcactaaggaaaaaacgccgcaaaacttttcgtcatgtctctgctgtgttcttcagtactaccgctaccacatttgcgatcctgagttgtgattaccggtcctttaggtgatgcacaaatggtactcgtgaatattctttttattagcagttttctgcagggcctgtacattctctttctgctcgatccgattgcattgcagattgatttgtaaatgagtacatggtcacgttgaaccttgaaagcagtcaatcatttcaaaaatggtttatgaaaaaaaaaaaaaaaaaaccgccc

SEQ ID NO: 19338 - DNA, 1487 bp, Zea mays
  misc_feature (514)..(514): n is a, c, g, or t
ccggccgggaaagcgaactcgccgccccccaaagcagtgccagggtctggctgactggctcccaccatggcatcgacctctccgcaccgctcctccggcggggatccaccttcctcgtccacgcccctcatctcctcgccgacctccccggcgtccggctcccccggcggcccgctagggcggctcacgagcctccgcggcgcagcgcgggtcatccggcgcacggggagccggagtttgatgagggagccctccgtggcggtgcgggagacggccgccgagcacctagaggagcgtcagaccgactgggcctactctaagcctgtcgtcgtggtcgacatgctctggaacgtcgccttcgtcgcaatcgccgcggccgtcctcgccgcgtcgctgggcgagagtcccgctgtgcctctccgcgtctggatcgcgggctacgtgctccagtgcctcctccacatcctctgcgtcacagtcgaatacaggcgtcgacgcaggacccaggagggangcgggtgttgaggacttcaagttcagtattgtgaagcacttggagtctgcaaacacgatgttttcctttatttggtggatccttgggttctattgggtgtctgcaggtggtcaagctttatcacatgatgctcctcagctttattggctgacaattgtttttctggcatttgatgttttctttgtgggcttctgtattgctttggcttgtgtgattggaatcgctgtttgttgctgccttccgtgcattattggtatcttgtatgctgtaactgatcaggaggagggagcatctgaagatgacgtaaacaacctttccaaattcaaatttcggacaatgagtgatgcagacaagctagctgccggcattgcagcacctgtgggtggagtgatgacagagtgcggtaccaatcctcctgtcgaacatattctttcggctgaggatgcagagtgctgtatctgcctatgcccgtatgaagatggcgtggaactgcgtgagctcccttgcaaccaccattttcactgcagctgtatagacaagtggcttcacataaatgctacatgcccattgtgcaagttcaacatcgtcaagagcaatctccacagagaagaggtctaggtcaataaggaaaaaaataataatcatggcagcacatttcggcatgtcccatcccagctgtgctcgtcagtattgccacatttgccaactggagttgtgattacctgtcttgtagtcaagtcataaaagtcactggtgatgcgcaggtggttgcaatgtcggttctcgtgaatattccttgtaacagtttgctgcaggggctgtacattctcgttctgctcgatctgattgcattgcgatttatttgtacatgaacacgtgaccatgttggatcatgaaagcggtcagtcgtttgtaaaatgattcatgaatcggaggctagtatgcaggctgctattagccaaatcctctctat

SEQ ID NO: 19339 - DNA, 803 bp, Zea mays
cctcctccgtctctgcgccacccgctccctcggcggaagccctcaggaagccacgcgcacaccgcaactggtcgacgacgacttcctcgtctctctcctccggcctcgagtcgcctccgatccgtccgagaaaacaaaacaaaccgaaagaagaaaggcgacgaggaagagaaggctctccgcgagatctgggggagctcccattctcaagatgcacgacttctgcttcaccatcccctacgggttcgccgtgctggccggcggcgtgctgggctacctccgccgcggcagcaccgcctccctggcggggggcgccggcgccggcgcgctgctcctcctcgcgggcttcgtcagcctgaaggccttcgagaagagacgcaactcctacgtcgccctcgcgctcgagacgctttgtgcattagccttaactttcgttatggggcaaagattcctcgagacttcgaagattatgccagctggtgtcgttgctggcctcagtgctgtgatgtccgcgttttatctgttcaaaattgcaagcggcggcaaccacatcccaccaaagaaagagtaaactggactctaacttgtaaagtatgttcgattgaactcggaagactacgagccactgcgttatctagttgcatggtaacttcaggtactagcatcttgttctccatttgtggtgtggctagagtgtaccatggtttgtgaacattgtaaaagaaataagtatgcggttcacggaaatgaatatgaacttccctgtggccgcaggccgcaggcccgaaaaaaaaaaagcggcc

SEQ ID NO: 19340 - DNA, 761 bp, Zea mays
gacgacgactttctagtctctctcctcccgcctccgagtccgacccgtccgagaaaacaaaacaaaccaaaagaagaaaagaaaggcgacgacgagggagggaaggctcgccgcgagatctgggggagctcccattcccaggatgcacgacttctgcttcaccatcccctacgggttcgccgtgctggccggcggcgtgctgggctacctccgccgcggcagcaccgcctccctggcggggggcgccggcgccggcgcgctcctcctcctcgcgggcttcgtcagcctcaaggccttccagaagcgccgcaactcctacgtcgccctcgcgctcgagacgctttgtgcattagccttaacttacgttatggggcaaagattcctcgagacttcgaagattatgccagctggtgccgttgctggtctcagtgccgtgatgtccgcattttatctgttcaaaattgcaacgggcggcaaccacatcccaccaccaaagaaagagtaaaccaggctttaacttgtaaattatgtttgattgatctcgaagaagactacgagcgatttgtgttgtctagttgcatggtaacttcagggactaacatcttcttccccatttgtaattcggttagaatgtaccatggtttgtgaacaatgtaaaagaaataaagatgtgattcacggaaatgaatatgatgtttactgaggtaaaaaaaaaaaaaaaaaaaaaaaaaaaaaaaaaaaaaataaaaaaaaaaaaaaaa

SEQ ID NO: 19341 - DNA, 4560 bp, Zea mays
ttttttttttttttttattgagaaaagagtcggatctgatcatagaaggtgaaaccaacagtgatatgctctgccctccagaaaatgagataaagctcaaatgtaaaacatcatctaactacaaaaccttggcattaaaaaaattctgagtatgaattaacgtatatatgtcatctggactgaaaaatgcatccagaggtcatcatgaagttaggtaacagactgatgatgataagaccttttttatgattaggagttgagcttttgcttcacattctcatccttgcatcgtcgctgatcagcaatcatcgactcaaaaacatccaagagatcatccagtccctttgaatcctctcccagtttcctcatggcaacaactatactctcaatggtagacaagcacccagccttcggctcatgcctcacctcactatacaagctaaccctatctgactccagcttcacgtgtggcagaagttgcagccatggattctcatggtacatcctctgtgcttttgcccaagtgccatccaacacaatcaaatgctgtacctgacaacctgaagcatcaatgctgatcgcccgctggcacggaaatagcaaagcagattttggcggtatggtgattgagaattcctcaaacattgttatttctccagtgagtttacacttcttcatctgtatctttgtgacaagaaagccatttgagacagctgcttcacctagcgggcctcttgataaccatctgattttgggtttcactccacgctcaataccaatccttagttccttctctgtgtacgcaatagtgcacttatccatgcttttcctggtccagtcctgtccaatagcagcgctaacttcatctatttcttttcccacaccgttgcagccattgactatcccattaacttcatctgagtctgagtcatttgtaactacagaatgagacagattaccatttacattatacgccacatcgacctcgcttctatggttgctttcacctgtagttgcttcatcaacagagttctctatctgctttgcagcggagctaggcctttcaagtccagcaggctgttcatcactattcgtcttcttgatgaatctgacacgcccaccatcgttgtggcagcaactaagagaaccaacctctccagcaagatcgcagaagatcccaccattgacgtccccaagatccaacatttcacaagaaccaccaaaactgaggtcttcagcgcccagataaccacaggcactcaatccggactcgtcaaaatcacaggtcgcactatgctttccatccgatttggcaccacaaatcccagcacgaggaaacgcaaggccaccgccatcctgcaactcgatctcctcaggcccgtcagaccggtcgtggtttccaaaacgagcagccacaggaccgcctgcaggacccgaagccgccgccgcgccgccgcaggcatcaagcgtggtgaggatgaagcgggcacggtggttgacgtcggtgacctgagcgacggcgaggtttcggaggccgaggcgtgccacgcgcgtggagttgagcgggtggtgggcctccatcgcgtgctgcagaacggtgactccgacggcgttgtccaccggcgaggagcggaggcggccgcagaggcagaggcggaggggcttcgtgcatacggcgcacatgggacgacgctgccccggctgccggtgaggaacatcgctctggctcgccgccgccgccgccgccatgggtggactgaggccggctagtgtgggagaggtttgggcgtttggccgagtttagggtttggactggagggggtgcttctctttccccttgtgttcgaaatgtttggattggacatggagggggatgtagattaaggacatcattgagatgcagatggcagtggtttttttatctgtccaaacaggactggttcatatgttcagtacaagggaccactatcactgagctaaactcgaaaaactgaaataaaattcagatatgaaccaaattgatcataactattgtttttgttcctaatctaaaaataatcaacaagcaataatctaaaaataaactggggtgatctggatccatctgttcaggcgagtccaagtccaacacaccggatctagtagtaggccttccattgtttcagcattctgaaaataaactgctaattttctctgtatgtgtttatacgaacacatcaagatgtcttccaaaaggacttctctttctttgtgctggaatagatgtctcggaagtagtttgtgcaaaactggcctattgctgcaccaagttactgccttcattttcgaatatcgccgccgcagatccatggatgaggctgtgcgcttgcgggaagagggcagcagccgcagaaggggtgatattcgtatgcaagaaatttaggagcacagctagagaactgtgtttttcatttttttcccctaaaatgaaaattgggatcaaggttttaagaagctataggagatgctttatggtctgtttaattgcacaagacaactttttttatttagcgcctgtttaattgcacaagacaatttttatgtagcctgggctaccatatcaacgttatacatttttttgttaaaaaaaatcgttcgaggtgggcacgcttttttctggtcacctacactcggcaaatgacgtcactgcccctcctccccgcctctgccagtgcgccacccgctcgctgggccgttgcccgttgggcggaagaaagccacgcgcgcaccgcaactggtcgacgacgactttctagtctctctcctcccgcctccgagtccgacccgtccgagaaaacaaaacaaaccaaaagaagaaaagaaaggcgacgacgagggagggaaggctcgccgcgagatctgggggagctcccattcccaggatgcacgacttctgcttcaccatcccctacgggttcgccgtgctggccggcggcgtgctgggctacctccgccgcggcagcaccgcctccctggcggggggcgccggcgccggcgcgctcctcctcctcgcgggcttcgtcagcctcaaggccttccagaagcgccgcaactcctacgtcgccctcgcgctcgagacgcgtaagcgcccgcgcccctttctcattcttttctccttacatttgggaacaaatagaaatgaaactacctgatttgtagacgggccgggtggttgatcgccgcctggatcataggaaatgagctggaattgtggtaacgtagtctatctatcaatatggtaaagttggtgactgcatgtacgtcttgcgagggcattgtgtagcaatttgatttggttgcgggttcaggattctccgcgtttccaacgaacttgctgtgctgtgtttcagtgtttggaaagccagcatttcacgtcccattttgcccaagctcaaatttctaaccatttagaaatttagaaatgcggcagtctgttgagcccatgcaaacacgtactagttccagtgccataacctcttcgtcactgtggtctgtattgcttcctgtcgggccctcttgcatgttgtcttatgcgggacatgagtacaaggcatgaggagggcactagtttgatatttttggcacaaagttagtaatggctggttaatgactagttttgtgaccatctgaaacatcaaggcaaatggtctgctagtagtggtgcgaatagttatagatctctgttctggcatgtactcttgtagtagtagatgaggcgcttgtgggggcaagtcatcaccaacacctagccaaaataggggaggatagagctcctgccatttgtttcaaaaaaaataggggaggatagagaggcatgagaatacccagtacatgtaaagcttgtggtagtcttgtgtgaatagacataggtctgtacatcagtacatgtactcttctagtactagacacaattcagtaccaggcaacccagtcattttatgcatatccaggaattagggctgtttggatagtagcagtccaacaggaattttcaggtacatgtaggaaccaatacatatactgatggattcttttttggaggggttgtgtgatccaaactggagaaaattgttggttgttggatttgtttagatgcctttactcaatatgcatgtagtagaatttcatttccattttagctttcaacagcttgatcaccttgattggttttcagtcctaagagtacaccagctataatgtggagtggggactgtcccttcttctatggtgggctcttcattccaggtcttttggcacactaacagcttgtcggcacttcacaactcttatacactaaatttgcatgaacattttgatcttgagctcgtaactgtttgtttaggattttttggttctgtttgtttaggaaattctgatggagaacttagttctttcatctgtttgcaattaagtgatggaatggcttcttgcattctttcatcttttcataaacctttaggccccgtttgtttcctttcatttcgaggaaattggatcttactaattgaataggctattttt

SEQ ID NO: 19342 - DNA, 751 bp, Zea mays
cctggggtcccccgcggcacctttgcaccgcccgggccttgctctccttcgacttgccttccctttccttgcacacaccaccagacgaaatcacccaagtcgcgtgcttccattcccagcccaaccgaagcgaagcacgccaccggcctcgaagggatcagcttctctagcactcatcctcgtggccttgttcctcctcttctataagggactgcgtcggagtggagatccgtgccgacatagtccgactttatcgctcgctgcctacgattgatggcctcaccttcaccaaccgagttcagtagggaagcagctcgtcagtctctcatcgcaatctcccagaccattccggagacaccttcacccgagacggtgaaggcaccgatctccattgcagaaaacgggaagctgggcgatggggcggataagttcagatcaaagctgatgtccatcacagacctgtcttctgatgcccaacctgcgcagtgccctcccgaggatattgctgcttgatcgtgtgattttcctgctcgacttgcggacataatgtatcagtgcttgctgatgctctgggcatttaactgtcgtgcattaaactgaacgtccttgtgttactagtcgtttttctttgttaaaatattcagggaaaccggtggaaatatattgtgcaagttttcttaccgttgataaggaaaaaaaaacccagaacaaaaaaaaaagcacaccggccaaaaaaaaaaaaaggccccta

SEQ ID NO: 19343 - DNA, 1770 bp, Zea mays
  misc_feature (1253)..(1253): n is a, c, g, or t
  misc_feature (1278)..(1278): n is a, c, g, or t
ccccattcagtgttgcttgctgggtagacgaacaacgctttgtgcagtcctgggaggtaaggcataagcacaatgtgattgttttatttattttgttgtactttgcagtctatagggacatacttaaattgtttttctatatttcacttagatgttggattatttatcgtgggttcattaattaggtagaccatgtgagcattttcttggagttgttcatgtagataatactacttctttgtcacttaagaaagcaattgaggatttacttgtaatgaatggtttgactatgactcaaattcgtgggcaaggttacgatggtgctagcaacatgaagggagaggttaaagggctcaaaacattgatcatgcaagagtcaccatctgcttattatattcattgttttgctcatcaacttcaattagttcttgttgctgttgccaaggggaatagtgactgtgtttggttttttgaccaagtgtctcttttgctgaatattgttggtgtttcttgtaaacgtcatggcatgattcgagatgcaagacttgataatgtcatgaaagcaattgattgtggtgaacttcaaactggaagtggattaaatcaagagatgggattgcctaggccaggcgagactcgttggggatctcactacaaaactgttgtcaacattattggtatgtccatgttcctatcatggagaataattatgtgcctttatggaagatcagctcggtttgccaaaaaccaaacaaatgatgatcactttagaagagaagtatatattggggttattgatcaaattagtcaagagcttgacagtcgctttgatgaggttaatatggagttactttcttgtatgtcggcattcaatcctaaagactcatttgcttcttttgatgcacagaagttacgcagacttgctgatttttatccaaaggacatatttggtaccgatttactaaagcttgaattgcacttgggtaactttattgctgacataaaaaaagatgttttatttgaaggcctagaaaatcttgttgatctctcattgaagcttgttcaaacgaagagacataaagtttatgacttagtatacacgcttctcaaattagtattacttctacctgtggcaacagcaggtgttgatagggcattttctgcgatgacattcatcaaaagtaagttgagaaataagatgggtgatagccttttggatgattgtctactcacatatattgagcgagatgttntctttcaactggatgaagaagatgntaatcaagactttttttaccattagaaaccgcaggccaaagaaaaacaagtaattttctagtacatactcccatgacctacgattgatggcctcaccttcaccaaccgagttcagtagggaagcagcttgtcagtctctcatcgcaatctcccagaccattccggagacaccttcacccgagacggtgaaggcaccgatctccattgcagaaaacgggaagctgggcgatggggcggataagttcagatcaaagctgatgtccatcacagacctgtcttctgatgcccaacctgcgcagtgccctcccgaggatattgctgcttgatcgtgtgattttcctgctcgacttgcggacataatgtatcagtgcttgctgatgctctgggcatttaactgtcgtgcattaaactgaacgtccttgtgttactagtcgtttttctttgttaaaatattcagggaaaccggtggaaatatattgtgcaagttttctt

SEQ ID NO: 19344 - DNA, 847 bp, Zea mays
gcacgagaccattacctagaacatcctggccggccctcttcttcgcattgcctttcccttcagttgcaccgacctccagacgaaaccacccaagacgcgtgcttccattcctagcccaacagaagcgaagcacgccaccgaccaccggcctcgaagggatcatcttctctacaactcgtcctcgtggccttgttcctcctcttgtataggggactgcggcggagtggagatccgtgccgacatagtccgacttcttcgctcgctgcctacgattgatggcctcaccttcaccaaccgaagagttcagcagggaagcagctcgtcagtctctgatcgcgatctccgagtccactccggagacaccttcaccgcagacggtgaggacaccgccgatctccagcgcagagaacgggaagccgggcgatggggcggacaagttcagatcgaagctgatgtccatcacagacctgtcttctgatgcccaacctgcgcagtgccctcccgaggatgtcgctgcttaatcaatcgtgtgattctctgctcgacttgcggacacgatgtatcagtgcttgccgatcctctgaactggacatttggctgtcgtgctttaaactggacgtccttatggcttatgttattactggtcgtttttatttgataaataaatattcaggggaacgggtggaaaatatactgtacaagtttcctgacttgttgatgaggaaccggtttgtctgaacatgctgtcatgcactcatgctcggacaacctctttgttcccgtgtcaagtttgtgatagaccttgtgttgagaggatcgccccaaaaggccgaaaaagttttaatgc

SEQ ID NO: 19345 - DNA, 1926 bp, Zea mays
cattgggtacctcgaggatatcctccactgtccactgtgctgtacctgtaccaccgtgacagttctattaacttgacgagacaaaaggggggaaagttctcctcctacaatcctacctccagtgatgtcagtaccaccgccggccggcggcggcgccatcatcaacgaggtcctcaccgacgacgagctccgcgcagtgctcaggcggctggggcccgaggcggagcgggacgcgttcgggctcgtgtgccgccgctggctccggatccagagctccgagcggcggcgcctgcgcgcgcgcgccggcccggacatgctgcgccgcctcgctgcacgcttccctggtgtcctggatctcgacctctctcagtcgccctcccgctccttctaccctggggtcatcgacgacgacctcaacgttatcgccagcagcttccgcaacctgcgtgtcctcgcgctgcagaactgcaaaggtatctctgatgtcggagttgccaaattgggagatggactgccatctctacagtcccttgatgtttctcgctgcataaagctgagtgacaaaggtttgaaggcggttgcactagggtgcaaaaaattgagtcagctgcaaatcatgggatgcaaattagtaacagataatttattgactgctctatcaaagagctgcctgcaattggtagaacttggagctgcgggatgtaacagcataacagatgctggtatatctgctctggctgatggctgtcatcacataaaatcactagacataagcaaatgcaacaaagttagtgatcctggagtctgtaagatcgctgaggtttcttcatcatgcttggtgtcaataaagctattggactgcagcaaggtgggagataagtccatctattcgttagctaagttttgcagtaacctagagactcttgtcattggtggatgtcggaacattagcgatggctccatacaagcacttgctcttgcctgctccagtagcttaaggagcctgagaatggactggtgcttgaaaataacagacacatcattgcaaagcctgctgtctaactgtaaacttcttgtagccattgatgtcggatgttgtgaccagataaccgacaatgcattcatggacggggaaggatacgggtttcagtctgaactgagagttttgaagatcagcagctgtgttcggctcacagttgcaggggtcggcagagtgattgaatccttcaaggctcttgagtacttggatgttcggtcatgccctcaggttacaagggacagctgcgagcaagctggagtgcagtttcctgctggctgtaaggtgaatttcgatggcagtttgctggaatctgatccatctgctgagatgttcttctaaaatgtgatctcggttgaaatcagatttagtgtgaactgcaaaactaagatttgaagagctcggtcatggaggcgagtgcttgacattgctgctgatctttcactgtcaaaatctatgcaagaacctgagaccacaacggatgcaagccatgatcatattcagtacccaattcaatatgcatgtgatttaatctgtagaaagtagcgcaaaagaccatgaaataagttgtctgaccaaagaacgtatttgcattatgtattgtgccagtgcagcgggtgtattaaaaaaatgtgcattttaatagactggtttcagtggattgtacgcagttctgttttttatctgcatcgctggtatagatctttgttttggcgttatgccaaacagggaaacagtgttcggtctgttgtcttatgctcaaacactgctcccacctgccagaattggtgggatgtaagccgcatattttacgatactatataaaagtattcgatattaagggtctatttggtttgatatctaacttgtcatactttgtctaatttttc

SEQ ID NO: 19346 - DNA, 671 bp, Zea mays
actcctatgggcgattgggacccgcgaccggccgggatcgcagtcgcaacgaagccccccacacacaaaaaagcaaaagcatcatcacaataatggcccgcgcgtgcgtgttcctcgtggtgctcctcctggccgccgtcgcggtggcgccgtttgcgggggctgcgcgtgtggacgtcgtggagggcaggtccatggcgtccgccgacgcgcctgaggcggcggctgacgcgcccgctcccggtcccgactccgcctcatccccggactcgtcgtcggaggcgccctccagcagcagctcatccgactagccgcgcacaacgcagttcttgtcatgatctatctagcaaataaaaagatcatatgtctcgtttgattctctggaataactaatagtatatatgctgcgcccggatgatatataaatatgtgcatgaaatgcgtgcggcaaacgcatggaatgtgcttgcctagctaattgttgttgttattgttgttgttgttgttttttctttacttttcttcatatctgtctctctctctctcggttgtttaatttttcttcatgcatgtaatataatgtgatatacctaatatatacaacgcgctttaattctgtggtaaaaaaaaaaaaaaaaaagcggccgccccctcgagcccccagctttttg

SEQ ID NO: 19347 - DNA, 608 bp, Zea mays
cccacggatcgcagtcgcaacgaagccccacacacacaaaagcaaaaagcatcatcacaataatggcccgcgcgtgtgtgttcctcgtggtgctcctcctggccgccgtcgcggtggcgccgtttgcgggggctgcgcgtgtggatgtcgtggagggcaggtccatggcgtccgccgacgcgcctgaggcggcggctgacgcgcccgctcccggtcccgactccgcctcatccccggactcgccgtcggaggcgccctccagcagcagctcatccgactagccgcgcacaacgcagttcttgtcatgatctatctagcaaataaaaagatcatatgtctcgtttgattctctggaataactaatagtatatatgctgcgcccggatgatatataaatatgtgcatcaaatgcgtgcggcaaacgcatggaatgtgcttgcctagctagctaattgttgttttttttttctttacttttcttcatacctgtctctctctctcggttgtttaatttttcttcatgcatgtaatataatgtgatatacccaatatatacaacgcgctttaattctgtggtgacgatgacaccattttctcggtttattttc

SEQ ID NO: 19348 - DNA, 2997 bp, Zea mays
ccatgccagagaggaaatcaaggctatgaagaggcagcgtgaggccgctcttgatgatgcagtggagcctgttaagatccctaaagctacatggatggctgatggcactcactggcctggtacttggattcaaccttctgctgagcatacccgtggtgatcatgctggaattattcaggtgatgctgaaacctcccagtgacgatcccttgtacggcagcaccggggatgaaggcagacctcttgatttcaccgaggtcgacatccgtttgccaatgctggtgtatgtgtcccgagagaagcggcctggttatgatcacaacaagaaggctggagcgatgaatgctctggtccgttcatctgctgtcatgtcaaatggctccttcatcctcaacctcggccgcgtgcgcggccgcgtcggctcgcaagctttccgcgaagggatgtgcttcatgatggaccgtggtggcgaccgcattggttatgtccagttcccgcagcggtttgagggcatcgatccatcagatcgctatgccaaccacaacaccgtcttcttcgacgtcaacatgcgcgcgctggatggtctcatgggaccagtctatgttggcactggctgccttttccgccgtgttgccctatatggatttgaccctccgcgctccaaggagcacggtggctgctgcagctgttgcttcccccagagacgcaagatcaaagcttcagccgctgcaccggaggagacccgggctctaaggatggcagacttcgacgaggatgaaatgaacatgtcgtcgttccccaagaagtttggtaactcgagcttcctcatcgactccattccgattgctgagttccaagggcgcccgcttgctgatcaccctggtgtcaagaacggccgccctcccggtgctctcactgtcccccgtgaccttctggatgcatccacagtcgctgaggccgtcagtgtcatctcatgctggtacgaagacaagaccgagtggggccaccgtgttggttggatctatggctcggtgacggaggatgtggtcactgggtaccggatgcacaaccggggttggaagtcggtgtactgtgtcaccaagcgtgacgccttccgcggcaccgcgcccatcaacctgactgaccgtctccaccaggtgctccggtgggctactggatcagtggagatcttcttctcccgcaacaacgcgctgctggcgagccgcagaatgaagttcttgcagaggatcgcgtacctgaacgtgggtatctacccgttcacgtccatcttcctgatcgtctactgcttcctgccggcgctgtcgctgttctcggggcagttcatcgtgaagacgctgaacgtgacgttcctgacgtacctgctggtgatcacgctgacgctgtgcctgctggcggtgctggagatcaagtggtcggggatcagtctggaggagtggtggcggaacgagcagttctggctgatcggcggcacgagcgcgcacctggcggccgtgctgcagggcctgctgaaggtggtggcgggcatcgagatctccttcacgctgacgtccaagtcgggcggcgacgacgtggacgacgagttcgcggacctgtacatcgtcaagtggacgtcgctgatgatcccgcccatcgtgatcatgatggtgaacctgatcggcatcgcggtcgggttcagccgcaccatctacagcgagatcccgcagtggagcaagctgctgggcggcgtcttcttcagcttctgggtgctggcgcacctgtacccgttcgccaagggcctgatggggcggaggggccgcacgccgaccatcgtcttcgtctgggcgggcctcctctccatcaccatctcgctgctgtgggtggccatcaacccgccgtcccagaaccagcagattggtgggtcgttcacattcccgtgaaagctctctgggccaatggcggattcatgcatgcttcgtcgcagtgggatccttgcgttgctctgcatcagttcctggttgcagcggttcactatctgaggacgaagctgctgggggaatgtgggatcctgactgtcgaactggctacttttttgttgtcgaagctgataatactcttatgatgagctatagtagtagttcttttgttcttttgtttttgctatatataaaatacatgttctggtcccataatttggttatgttggacaattaaacgtggagccccaaatttccagtctaagaaaaaaaaaagctgcgcgcccttgaaatgtctcatcatgctgggtgcagtaggtgaggtaagcgagtagtcttttttttttggccgttgctggtgctgggtctgcaagacctggcaactggcgctccacgcggagttgcctgaccggcatccacatggagtcgtgccgtgcaccgccaccgccatgatcaagaaaaggtcaggctgtctctgtccatgacccattcaccgcactcaccattcgttggtttctcgtgggtttggtaccaccgatccattgaggttttctaaggccacatgtgccagcggtcgtttgtaatgcctgctatgatgtcatcaagaacagcgactgcttttttgacgtgtttgtagatgcaagttgccaacgatttattttcgtgtatttttacacttttctttttattttccgagaggaatgcattctcaatttatttcccctttgttaatccatcgtatcgtatcctctagggctggtaacgcggcgtggggacgctccaggatgacaaccgaaaattttctcgtcacgaaatagcttctcatctccgtcctacgaaaatattttatcatccacaagaaatttcttgtcaggatagctttccatctccgtcccatgagatgattttctcacgggattcctacgaatgctcgcgcgtaacgtttttccactatcttcgttgctcacgggaataaattcccgatgggaatgtccctcaccacttaaattataattaaggtttac

SEQ ID NO: 19349 - DNA, 768 bp, Zea mays
  misc_feature (688)..(688): n is a, c, g, or t
ccggaccggacgggtcggctcgcctgcccacctccctcgccatcgctagtctcaaaccacaaccctagagaagaagaagagagagagaaagggagatggtggggctgcagtacgatctcgtcgggaacccattgggcgcggtgcgcgccaccttcgagaggacggccgccgccgctgcagcgcagtctggaggagctgaccctgtggcggcgttccgtggcaaagactggggcgccggtgacctcttccgctccttcctcttcgagcaagacggtcttggcaaggttccggtgttggattcgtcaaatcttggattgatcaaaccgaacaccctggtccggtatcggggaatggttcaggatatgcttgggaatgagtactacattggtgctttcaaggatgggtcaacttggaggacaaacaagtacactgacttctcaccgtactcaatgccgcatccttgtgattcacatctttgggagcgccatctcttccactgtgtgcctgcacctggacaaaattcttggacactggagtcttcaccaggacctgatgtctgcaggatgtcgaactgtttggcacctgaactaagagagaaaaggaagagagatggagatgacgatgccatggatgtttcagaaaatggccatggccattcttcattctgcaagaagccgaaggaaggtgnatgtcatgtctcttccagttcaactgaaagtgcaggggacatttccagagatgaatggaggcgatcatcatatacctgga

SEQ ID NO: 19350 - DNA, 1600 bp, Zea mays
aacgattctcgcaatcgacaagcagccccaccaaaccaggaaactgcaaacctacccccggtcgccgactcgccggcctcgactctccggtctccgcccagactacaaatggagctctgcacctgcgtggcccgcagttctgcgcccccctcttctagctgccgcgcggtgccattcccgcgagttctctcccatcgcatttggagccgatcgggatactgcactgtctgctttaccccgtcaagccctgttgctaggagtcgattctctactctaatgacgactgcacacaacacagggaccccagatctagttgacttcaattgggatgatcttgggtttcaactgatcccaacggacttcatgtatttaatgagctgttcttcagatggggtgtttatgaatggtaaattagtgccatatgggtcaattgagctgaatccagcagccgccgtgctgaattatggtcagggattgcttgaaggtctacgagcacatagaaaagaggatggatcaatccttctttttcgtccacatgaaaatgcacggcggatggaaattggtgcagaccggttatgcatgcctgcaccaagtgtagagcaattcctagaagctgtgaaactaactgttctggcaaacaagcattgggtgcctccttttggtaaaggttctttgtatatcagaccgcagctaattggaagtggggctatccttggtgtggcacctgccccacagtacacattcattgtgtttgtttgcccagttgggcattatttcaagggtggtctagctccaatcagcttgttaactgaggaagaataccaccgtgctgcacctggtggaactggtgaaataaaaactattgggaactatgcttcggttgtcagtgctcagagaagagccaaggaaaaaggccattctgatgttttatacttagatccagtccataataagtttgttgaggaagtttcttcttgtaatatattcatggtgaagggcaatattatttctactccactgttaacggggacaattcttcctggaatcacaaggagaagtgtgattgaaatttctcagaatcttggatttcaggttgaggagcgtcttatcacaatagatgaactgcttggggctgatgaagtcttttgtacaggaacagctgttgtattgtcacctgttgggagcatcacttaccgtggaagaagagtggagtatgggaagaaccaggaggccggagtcgtgtcccaacaactctatgccgcactcacagctatccagaaaggtctcacggaggacagcatgggatggacgttgcagctaacttagcagctttttttcacatgatcgagctctacaactcttatttccgttttctcgataagtctcacttctatcaacttgttcttctgttgaaacagagtactttaaaaggaatccccaataatgactttccctgtatattgctgatatgttggcactaaaaaaaaaaaaaaaatctatttaaagcacagtgttttgcaccaaaaaaaaaaaaaaagggcggccgccgactagtgagctcgtcgacccgggaattaattccggaccggtacctgcaggc

SEQ ID NO: 19351 - DNA, 2084 bp, Zea mays
  misc_feature (2059)..(2059): n is a, c, g, or t
cattgggtacctcgaggccggccgggctgtcgtctgctccaggcgttcggttccggctcctgcttccctctcccttctccggttctccccctccgccgcggagatggaggccaccgcgctcgcgtcccacccgttcgccgtccaccgctcgatagggaagccagccttcgcctacccccaccgtggagggccctcgatggtctcctctgtccacctccgcacgtcccggacccccgcccgctctgcggcatggagaaggcggaggagggggaccgggctggttgtgcgcgcggagatgttcggccagctcaccaccggcctcgagtccgcctggaacaagctgcgcggcgttggcgtgctaacaaaggaaaatattgccgaaccaatgcgggacattagacgagcacttctggaagcagatgttagtttgcctgttgtgagacggtttgtttcatctgttagtgataaggctttaggtgcaaatgctatcagaggagtccgaccagaccagcaattagtgaagattgtgcatgacgaactggtacaactgatgggtggagaggtatcggatattgtatttgcaaaaagtggcccgacagttatcttgcttgcaggtctacagggtgttgggaagactactgtctgtgcaaagcttgcgttctatttgaagaaactggggaagagttgtatgctggttgctgcagacatttacaggcctgcagccattgatcaactcactatactgggtaaacaggtgggtgtaccagtttactcagaaggaacagaagccaaacctacacaaataactaagaatgctatggaagaggcaaaaagcaagaatattgatgctattgtagtggatactgctggaaggctgcagattgatagatcaatgatggatgaattgaaagaagtgaagaaggctgttaatcctacagaagttctgcttgtcgttgatgccatgactggccaagaagcagcagcactagtcaccaccttcaatattgagattggtataactggtgcaatactgactaaattggatggtgactccaggggcggagccgcactaagcgttaaagaggtctctgggaggcccataaaatttgttgggcgtggggagcgattagaggaccttgagcttttctaccctgatcgcatggcacagcgagttctgggaatgggagacgtgctttcatttgtcgaaaagacacaagaagtgatgaggcaagaagaagctatagaattacagaagaagatcatgagtgcaaaattcgacttcaacgatttcttaaaacaatctcaaaacgttgcgaaaatgggttccatgagccgcattattgaatgatgccagtcatgaacaaggtacatgagcatgtggagttaaacatgttctctccaactttaccagtatttcattacaagcatactttaagtttgatacgctaaacagataactcccgcacaaatccgagaagctgagaaaagacttgcattcgtggagtcaatgatcaatgccatgactgctgaggaaagggagaagccagagttactggctgaatcacgtgagaggaggataagagtggctgaggagtctggaaaaactgaacaagaggtgagtcaattggttgcccagcttttccaaatgcgtgctcagatgcagaagttgatgggtatggtgcaaggacaagaagctatagctggcatgggagatctcaaggactcgcttaaacctgaagagaaggcacctcctggcaccgcgcggcggaagagaaggaataacacgtctaagcagagggacctggacgcagtgctgagctagtgagtagtggcctagtgtgctgtattatgaaaatgcataggtgggcactgacccctgtgtaattgcggttaattcggcacacatttttttgttgtacataacgtttagtcccatgagggaagatatgttggtcgctcttgaaattggagtatgttgtcatacagggcccagaagaactcaggtcttgcaccggaggcctggagcccaggcatctttcagttgcaacacttgatgtanaaaaataagaaaaaacattttacct

SEQ ID NO: 19352 - DNA, 1859 bp, Zea mays
ctatcgagaggtatggagcaacaacttctaatatattttcctgtttgtgtaaaaaaaagtatagtcactgtgtttgaaaattatttttttaataatatgcaagcagattttggagtatcatccacagatgctggaggagcacatgcaaggtggagaacagattagcttcctctacccgaggtgcagtactacattagtttttttttccttctaagttctaagcttttactaccatacaacagggaatagtttacttcaacatcaaacaaagctgcctatatactatgttttacttgcatcctactcaatcctttgtcaagttgcttgtctttcagtatgatcgttcactcaaatcttacctacttcacacttttgccaggaaaggattggtatataggaaacaataatcatccattttaaaaatttaagggcgaaatacagtttttatttctgttgcgaggagttgctgggtctgataaagcatgtatctagtattcttcttttatctagaaggattggtatcgttggtaatactactatcttttgctgcagtggagttgatcggttcaaacggcagtttgcacatcttgaggagcattatagcaagggagaaagaggttctccactgcaaagaaagcatgcttctttaccaaggtatacatgattcaggagtgcagaacccctgttgctttgatctcagccgtgctaaatcctgcgtgtctctgcgtatgacagggaaagagtggttgtatcgaaggacggtgatactgatcaacatattaatgaccaggagagaagtgcagattctgtcgcccgcaccactgtgagccctccaaggtcagaagacgacgacatgagcgatgtgaaatccacaagcttaagctctcggagctacctgaagagtgcgagcataagtgcttccaagtgtgtcgttgccacgaagaaacacccggaggtaatgctgaattcaactggtgtggcaagtaggcagggcggcacacttgtgcactatcagtgtcttcctctttttgatggcatgcatgcacactgtcaatatcaaggacggacgtggaaaaggacatctttgattgatctgttacatgcaagctgtaccttttccttgattccttcgtccactttagggactaggttgggcctccgccgccgctcccgccacgcgtcccccggaggacgatggaatcgctgaggaaatggaaggcgccgtcaatggattgtctgaaaaggtctccaggatgcactcgtaagcaggactgcccctggcaacagcaaccttgttgcaaggtttctgtctctggtacactgtattccgacgacagccttggaaaggcaaacactgtatgtcacacagcagtacagcacactgtgctgcgaggttgggttttgcttgcgtacatccatccacagctagttcgactttacctgggtggaagaggaacacaccaccgcctgatggccctttcttcatcgtctgcatttccaccgtgtcatgccagcgctgcgtggcacctctagaaggtagaagccctgcatggattcatgaagaattcctaagatgtagcactagtcagtgcatggaggaaacatagtcggcctgtcgaccatgagatgttttcttgcaaatggagtctggacctatggttttcagttttattacaacggcttctgccgtaggaagtgtcagcagtgtatcatccctgtaatacccaatttataagagaccatataaaaggagaaaaatcatttgctttatgtatgtgtataacatatccacttatcatcacatgtgaatgccatatttaaagataaataactaataaaaagttataccactaaaatat

SEQ ID NO: 19353 - DNA, 1147 bp, Zea mays
  misc_feature (1)..(1): n is a, c, g, or t
  misc_feature (80)..(80): n is a, c, g, or t
ngatttatatgaaaaaaaggattgaactttccacggattcattccataagtaaacgattgaatgggattcgcttgggcanacgaaatcaagtgcgagtccccttttcttttttattgaattaactaattcatttccttttgacttttggatttttggatattttttttgatttggcattattcaaacaagaaaaaaaatttcgacaaattcctttttttttgaaaattatgtgataattatgagaaccaatcctactacttcgcgtcccgggatttccacaattgaagaaaaagcgtagggcgtattgatcaaattattggacccgtgctggatatcacttttcccccgggcaagttgccttatatttataatgctttgatagtcaagagtcgagacactgccgataagctcgtgcggccgcccgggcaggtacaacaattattaggaaataatcgagttagagctgtggctatgagtgctacagaggggttgatgagaggaatggaagtgattgacacgggaactcctctcagtgttccagtcggtggagctactctcggacgaatttttaacgttcttggggagcctattgacaatttgggtcctgtggatactagtgcaacatttcctattcatagatctgcgcctgcctttatcgagttagatacgaaattatctatctttgaaacaggtattaaggtggtcgatcttttagctccctatcgacgtggaggaaaaatcggactgtttgggggggcaggagtaggtaaaacagtaccccgcccgcgaccacgctataacattactaaagctcatggaggcgtatccgtatttggcggagtaggggaacggactcgtgaaggaaatgatctttatatggaaatgaaggaatccggagtaattaatgaaaaaaatattgaggaatcaaaggtagctctagtctatggccaaatgaatgaaccgccgggagctcgtatgagagttggtttaactgccctaactatggcagaatatttccgagatgttaataagcaagacgtgcttttattcatcgataatatctttcgttttgttcaagcaggatcggaagtatccgccttattaggcagaatgccctccgcagtgggttatcaacctacccttagt

SEQ ID NO: 19354 - DNA, 525 bp, Zea mays
  misc_feature (513)..(513): n is a, c, g, or t
acacatctatcggtcccccgcctctatcctttctctccgcacaaggtgcccctgccgcccagccgccatgaggaagccgacccgacgacgaggaacctcagcgaaaggcagctccggcggcggtatcagtaaggcggcaacactgccggcgaagcagatggtcttgtccggctaccgtggcaccgtagacgcgtttgactgcctccccgacgacctcgtgctcgccgtgttagccggcatcgcggcgcgcgcccggtgccccgccgacctcgctgcggcggcgctaccgtgcaggaggttccgggacctcgcggcgcaccccgccgtgctgtcgcgtgcgtcggcggcggccgtcgccgtgcccgcgggaaggtggtcggatgcggcgcaccggttcttgcggcggtgcgcggcctccggcaacctccacgcctgctacctactcggcatggtgctgttctactgtatcgggggcagagcgacggggcggcgctactggcgcgctcggcggcngggcgggcacgc

SEQ ID NO: 19355 - DNA, 2650 bp, Zea mays
  misc_feature (2377)..(2377): n is a, c, g, or t
taagcaagaaagatttttttaaaaaaagtaagaactgctaagaaccattcgagcagggtagtccttgttaatttgcttcttttgtaagcatggactctacttgattgttgattacatagtaaggtcgtgaatctgagtagcaggtgtcacagtgtagtgtgaaatccaatagagcacatcaatgacagaataatgttatatgtaccactactatagtataacattgaattacaggtcttaatgcattgtcgggggctatcttacaccccacggatcagagttttttttagggaaaaaggattttcatcctcccttaagaatttattcgatatcaacataacaagatctacaaacaatctcattatgataagctcaaaagttaagcatacactccaacgtaatagcagcaacaaaagcttccactttaacagataagatcagtgatcttgaattacttatttgaatccatggaacatgtcagataaggtcaatgatcgtttgtcgacggccatagcgccccacgcgcgtcctcctccttgatcgccgtcgtcgcgtcgccacagtcgcatcccacgacgaataggcgagtagcagagagggatggggaccgggcaacttttcgtgacatgcgagatttcacgaggttgggaacacgaacgcaagcgtctcgttccgtcaaatccaataaaaatttcgtgggcagctactttttgcgtcgacaagccgtagactcgagtacgtgcgaagtgcggggaggagcccaaatccgagtgtcttttaagacttagatatttttctatgaaacttgtggtcgtctcgccagaagcttgaagcccaccaaaacagctagcttcgtggccagattttcccgaccgcgcagcggcctatagctgcttcggttagcagcccgcgtccacaagaagttggacgacttctcgccttaagcatgcacgagagcaaactatttgggagataaaatcaaattagttgtaatgaacatcacatgtgttatttgtggagtaaactaactactagcttttttctatagccagcttatcaatcatttagattcttatcagctaacttctctctaccgtcagtttatccttataaccatcatatcagaaaagctcataagaaaaaatccgattcaaacagccttttgtttccgttggcatgttttctttttagaaaaaacaaatctgaagctggtactagcatgtttagaagtttcccgaatcctgtttttgaagtcctcgagctggaagcctgaggtccaaacactggcacgtccatgcatgcctctggatcagcagctcaccaaccattcttttacacacttgaatacctgacgaagaaataaattaatagcaaaggccgctcaaatgtgtacagatctgcagtcgttgcattagtcaaatgaatgaatgcatacacaaagcaacaaacgcgagcaaacgcacggggaaaagtcggaaaggttaacgagaaccggacggggcgaggccagcatctatcaggattggaccggtctgcctgccattcgtccgggttccggctgccacccactcgtggcgtcccactcgtggcgtcgcccgtcgcccgctgctcgctagcctactacgacttggaacttggaccccttccccttcctcctcctcgtgtcctcttccgttgccgtgccaaccaccaccctcaattgtcaaatcaggcctcctcctcccggttccggttccaccaacgaccaagcacccatctctactcgagtctctgcgaatccgttgccggtagcctctctgcggtgagagttccgctgccgcctgctggagatgatggacgacggaggaggaggggtgcagtcgcagggcgtcaacccggactgccccaacgccgccaaccccttccaccgctgcgccgcgtactgccccgtccccgccccggcccccaccaaagccgccgccgccgccgccgtgcgcagcaagccgtctccgcctcgtccgagggcgacggcggtggcggcgcagaacgggacagccaagcacggagacggcgctgcgcgtgtcgctcccgcctccgacgcggaggacgacgacgacgacggaggcgagagggaggagtcgcgggctgtcaacccgggctacccggcgtctccgcctcgtccggggccgaggccgacccacgcggcgcagaacgggaccgcgcgccgcgacgaggttgaggaggagtgcgagatcaccgtcgtcgacgagtcggaggagcacggcgagagcgtcgaggaccacggagggcaggagcagggaggaggaggtcagcggcggcggcaggacgagggcgagcgcccggtcgcaggccacggacgaacgggggggaggccggncggagagacgccgcggcagcaggcggtcaacccggactgccccaacgccgccaaccccttccaccgctgcgccgagtactgccccgtccccgtccccaaggctccgccgctgccgcggccacgtgggtacgaggggagcacgcacagcgaccccggcgagctgcaccccaggccgcgccgccgcgacaagggcggcggctccggcggcggcctcccgctctacgtttttctgcgcgaaggctccgacggcgacggcaagaaggtggatccccg

SEQ ID NO: 19356 - DNA, 1227 bp, Zea mays
agcagggtgtgtgacacacgcgcttactgccgaacgccaaagcccccctggccgaaaaggatagagatgtccaaagccatatagacagggacagctgctatactgctatagggtaggccaggccggtgacgtcaccacggcatagctatccattcctcctttaaaaagctagtagtcccacacaagctgcactgcgatgtggtcctctcctcctatcacctgacctccacacacacacacagacagacaggcacgcgcaagcaaaaattcattcatatatgcacgctcgttcgttgtcgatctcccccatcactgcacggcgcggcgcaacaagagcgagggattggagctcagctagtcgtctaatcagctagtaggtacgtgtagctaggctgcgctgcaccagctgccgtgcatgcagtgcatggcgcaggagggctctgaggcctccgtcgccagctccccgccgccccagccgccgccgtcggcctcctcctggtggcgcgacatgcagcacccggctgcctacggcgcgtggcctccgtcccccgcggcgaggtggccgcccccggtatcgatggcgccggcagcgacgcagcagcagcagcagcacggcggccgggcgacgacgtcctccgacggtctctcggcctccaacgccaccgtagcgtccttcaccaaccactccgggtccgggctcagcctggactccgcgggtggagctgaggccgccgccgctgccgccgccgccgccgagagccacctctggaaccaagtcctcatcatgtgagtacgccgagacacacgcagcacgaacgtatctccgtgcgcacatgcatgcatgcctacatgtctctgatccatccatgaacacaatcaaataaattaaaatactccagatttgcatgcatattcattcgattcggagccggccggccgggcgggtgatgatgaaatgaatgaatgcaaataataagagggggccgggcatgcgtccactaccctttgtcctccgatatgatcgatcgagtgccttccaaagcggcctcgctttgcctgctagctagtagtagatattctagcatctaataagtttcctttacctgctagtagctagtggcgccgatcgatttccggcaggttaatctttttatttgcttcttaattaattattagaacaagaacatgtgctgctagctgcaaagttaactagcctctactatatac

SEQ ID NO: 19357 - DNA, 4670 bp, Zea mays
caaacctgctgctgcacgtaaggctattgtaaaaatactcatccagacacacatgaagagttgaagcttgataagaggatggactcttctgggcagagagctgcaccgagtattgcacaacaatctcagcctggtgttaattatgctcctcatttgggcttctttcatcagccaccgaattcctacaaccagtcaggaatgtattactctactacagctagtgtgaaccaggttgctactggatcatcgggtcctagatataattatcctgtcactcagtctgcgcaagcgatgacatatatcagtccatctgcagcgcctccggtatctggtcagtcacaatatacagttaagccgcaccctatggggttgctgtctgaaaaatcaggtactcatgtcacaataagtgctccaccagcaaaatctgatccacctaagttacatgctgctggggatgctgcgtcaagtctgaaaaaggataatgaagttgtttctgggatcactgttttaaataaaccaacccttgagagggagagtaacgatcctttagtcacagtgaagcattccactgtgataagcccgtccttgccaattcatggtgaaaaaccacaaactttggtgacatcgtcgcctgttgctaattcagtctcacctgtgactggagctgatgggaaaagcaaagaacccattcaaaggtctggatcatttaaagatagtaagaaaaatgtcactaaaaaggatgtcaggaattcatatgaaccaccaaatccagcttcatttgttgaggataaggttcaaactgtaaaggttggagatgtcgatctccaggaaactaaaaagctgaacaatgagttggatttgaccaactcatcttcagctccaacggttccactggcagttagtacagagaatgccgacagcacagcagtaaccactgctgatgttcctgggacagatacaagctcaagaagaccatcttctgagggtactggtgagcctggagtggaaagcttcactgtttctgctgttgaatgtgacgaaagcaagaggactcacaaagttgtgaaagatcctagcaaggataatatttcttctgatgctaccaaacatgaattgcctaaggaatgtgcagtggactctactgaacaagcatcagcagtgacttctaacactgatgattcatatgcagcacctctagtaactaatcaggagcagttgctgaaagggtctgcttctgagaaacaagctgtgatgaataactcatccaagaattccgatacttcagcacatttttttgatggcaatgatgtgggcgtgacaacttctggaacttcagagcctactgctcaaacttccaatgatgaaggtgactcagatattagtccagaaacagacctagctgtttataatgtccctctaggttcatctgagctacaactgaaatctgagagtagggcaaatgatcaacagcctgctgcaccaacagtatcagttcgaccggtatccagggaaaagcctagtacaaagtccacagctgggaagaagaagaagaaaaaggaaatgcttgctaaggctgatgctgctgggtcttcagatctttataatgcatacaaaggaccagaagagaagtctgaagttgttggtaccgtggagggtgctgataattcttcaacagttgatacaactcatgtactgtctgacgaattagaaaaggatcctagtacatctgcagatgattgtaagaaaaaagttgagcttgatgattgggaagatgctgcagacatgtctactccaaagcagccatcagattctgggaatcaggctagcatcacccaagtgttggattcagacgtaactgaagcaaacagcaggaagaaatactcacgggattttctgttaactttgcaacatcactataccggtcttccttttggatttcagatgaatgaagctgtcaatgctataatgaataatttggcaggaaagtcttatgttgctgactgggaacctcaccctagtcctggaaggggtttggaccgcccaacttctcgtgaccgccgtggtgctgccatggctgacgacaggtggactagggcgggtgttcctctcagtcctggtcgtgatgttcacatggacctgccaaatggaccatcagttatcaactaccgtggcggcccaggaggtaatcatggtgttttaaggaatccacgcagtcaatcatcaaatcagtatggtggtgggcttcttgcaggacccatgcagtccgttggaccgcaggtacctcgcagcggctctgatgctgatagatggcagcaaaagggtctcatgccttctcctggcacacctgtacaagcaatgcacaaagcagagaggaagtatgttattgggaaagtttctgatgaggaagaggcgaaacagaggcagttgaaagctattcttaacaaactgactccacagaacttcgaaaaactttttgaacaagttaaggaagtcaacattgacagtgtagcaacacttactggggtcatttcacagatatttgacaaagctttgatggaaccaactttctgtgaaatgtatgctaatttttgcttccatctggctggtgccttgcctgacttcagtgaagacaatgaaaaaatcacattcaaaagattacttttgaataaatgccaagaggagtttgagaggggtgaaagagaagaagctgaagctgataaaacagaagaggaaggcgagattaaacagaccaaagaagaaagggaggaaaagaggatccgtgctcgaaggcgcatgctgggaaacattaggttaattggagagttgtacaaaaagaggatgttgacggaaaggattatgcatgaatgcattaaaaaattgtttggaaatcatgatgatcctgatgaggagaacattgaagcattatgcaaattgatgagtacaattggtgatatgattgatcatgtaaaggcaaaggagcacatggatgcctattttagtatgatgcagataatgtcaacaaatcagaagttgtcttctcgtgtaaggtttatgttgagagattcaatcgacctcaggagaaataaatggcagcaaaggcgtaaagtcgaaggtcccaagaagattgaggaggttcacagagatgcagcacaagaaagacatgcccagtcgagtaggttgggacgtggtccagctgttagttctgttccaagaagagcacatcctatggattatggccctcgtggaccatctgcatcagcatcctcaagttcccaacaagggagcattcgaggaatgcctccacattcgcgtggttcacaagacatccgacatgacgaaaggcaccagtttgacaatagaactgttcttccccagcgggtagtcaaagatgaagccatcactcttgggccacaaggtggccttgctaggggtatgtctataagagggcagccaccagtatcaaatactgaaattccttctgttattgaccaccggaggatagtatctagttctaatggctataactctgcggctgattggacatcatcatctggaagagaagattctaattcaagacttccagatcgaacctctggccgaattcctgcttctagtcaatctgctgtaacttcgcagaggcctgccagccaggaaggccgttcaagaagtaaatcatattctgaggatgagttgagagaaaaatctgttttgaccattcgagaatattacagtgcaaaagatgaaaaggaggttgttttgtgtattgaggagctgaatgctccaaatttctatccatttcttgtgtcactttgggtaaatgattcctttgagagaaaagacatggaaagagagttgttggctaaacttctcgtcagcctttgcagtggtcgacataatttgttgagcaagcaacaactcagtgatggcctttcaaatgttcttgcctcattagaagataatctaagtgatgctccaagagccactgagtaccttggacgacttcttgcaaggtttgtggaggaaagcatattgctcttgcaagaggtaggtaaattgattcaagaaagtggagaagaaccagggtacctaatacaaggcggtattgcggctgacatcctaggtgcagtcctggattccataaaatcagacaaagggaattcattcttggatgagatcaagacaacttcaagtttaaagttggttgatttcagaccacaacatcttaagcgatcaaagttggacgccttcatgtaggcacataagttattgttacctggtaagtctgttctagtccaggtgtaaatattgttcttgggtagttatttgttctgaagacatacacttgatttaaatactctgaactattctgatgacagattaccaatgggtgcggtcaccaagcagtttagtttcttcgcacctaaatacccaacggcctttttgatgtactgtaaaacctctctgctcctacttgctgtccctgaccgtacactatttataagatggaaggcgatcggccacctatgtagcacggacggatacaccaattaggtgcggacgtgcggaggtgcggtatcctgtatcggatacttaacagatagggataccccatgatacgtacgaataaaaaaagaaaaaaaaaaaaaaaagagaaaaagaagaaaaaacaa

SEQ ID NO: 19358 - DNA, 5096 bp, Zea mays
  misc_feature (195)..(195): n is a, c, g, or t
atttgactgctagaacttgaaaaaatattgaatgttacatgactaatttgccttgcggagcacacagccagttatttttgcatgtgttgttggtattgatttgatacatgtcctgaatatgccagtgttctaaaagattctattttatgtataccttatccaggtgcttgtggaggaacttaaggttacacctanccctgtgcaaccaactccaaaacagcagctgttgcagcagcatccgcatccgctgcagaagcaacagcatcagctgccgcagctgtcgcatcagccacagcagccacagcagcagtcaacaagaaaggaaactgttggttccagccaacctaactccatcaatccccatactacatcacaactgaaaagagatgtgcacccatctccgtcggtccccaatgttacatctgttagacctaccgttcaacaaatgcctggtgttcagatgccgatccccttccaccaccagccggcacaagtttccttgcagtttggtggccatggtgcacagctgcagccacaagttgtgcccagctcatttcaaatgtcaatgggattgacaggcagtagtacaccgcaagtcccacagcagctgtatgccccgactctgcagcatcatcaattgcaacagcaagcaatgatgcatcctggccagggtatgggttatgttccttcagttgctcaccaattcccacagttgggcagcattcctatgaacattgcatcgcaatatcctcagcaacagccaaacacgcctgctgctgcacgtaaggctactgtaaaaattactcatccagacactcatgaagagttgaagctcgataagaggatggactcttctgggcagagagctgcaccgagtattgacacaacaatcccagcccggtggtaattatgctcctcatttgggcttctttcatcagccaccgaattcctacaaccagtcaggaatgtattactctactacagctagtgtgaaccaggttgctactggatcatcgggtcctagatataattatcctgtcactcagtctgcgcaagcgatgacatatatcagtccatctgcagtgcctccggtatctgctcagtcccaatatacagttaaaccgcaccctattgggttggtgactgaaaaatctagtactcatgtcacaataagtgctccaccagctaaatctgagcctcctaagttacgtgctgctgaggattctgcgtcaagtcggcaaaaggataatgaaattgtttctgggatcgctgtttctagtaaatcaatccttgagaaggaggagagtaacgatcctttagtcacagtgaagcattcgactgtaataagcccgtccttgccaattcatggtgcaaaatcacaaacttcagtgacatcatctcctgttgtgaattcagtctcacctgtggcaggagttgatggaaaaagcatagaatctattcaaaggactggatcatttaatgataacaagaaaattgtcactaaaaaggatgtcaggatttcatctgaaccaccgaaagtacgttgttgtcagcctctttgccatgctatgtttgcgtttttcgtagtttagcatttgcttttgttcacatgtttgtatgttgtatgtttttccagtcagcttcatctgttgaagataaggtgcaaactgtaaaggctggaggcagtgatcaccaggatactaacaacctgaacaatgagttggatttggccagctcatcttcatgctcaacggttccactggcagtaagtaggatctttccagggaccgtttcagtgaatgctaacagcacagcagtaactggtgagatcttgaaacttttagaattgtacagggatgcctcttatttttttctaactcatttacgttggcagctgctgatgttcctgggacagatagaagctcaagaagaccatctcccgagggtactggtgagcctgcagtagaaagcttcactgttttggctgttgaatgtgacaaaaggaagcgggctgatgaagttgcgacagatcctagcaaggataatatttcttctgatgctaccaaacatgaattgcctgatgcatgtgcagtggaccctactgaacaggcatcagcagtgacttctaatactgatgattcatatgcatcccctatagtaaataatcaggagcagttgctgaaagagtctgctccatctgcttctgaggaacaagctatgatgaataacttttccaagaattctgagacttcacattttcttgatagcaatgctgtggaagtgagaactggaacttcagagcctactgttcaaagttccaatgacgaaggtgactcggatattagtccagaaacagacctagctgtttgcaatgttcctctagtttcatctgagggacaactgaaatctgagagtagggctgatgatcaacaggctgctgaaccaacagtttcagttcgatcagtatccagggaaaagcctagtgttgagatcgccaggtcaaagtccgcagctgggaagaggaagaagaaaaaggaaatgcttgctaaggctgatgctgctgggtcttcagatctttataatgcatacaagggaccagaagagaagtctgaaatggttggtactgcagatggtgctgatagttcttcaatagttgacacaacacatgtgctgcttgatgaagcagaaagggatgttagtacgtttgcagatgattgtaagaaaaaagttgagcttgatgattgggaagatgctgcagacatgtctactccaaagctggcaccagattctggaaatcaggctggcaccacccaagtgctagattcagatacaagtgaagcaaacagcaggaagaaatattcacgggattttctgttgaccttgcaacaccactgtactggtcttcctgttggatttcagatgaatgaagctgtcaatgcaataatgaataatttggttggaaagtcttatgttgttgaccgggaaccttaccctagtcctggaaggggtttggaccgcccaacttctcgtggtgaccgccgtggtgctgccatgactgacgacaggtggactaagacgggtgttcctctcagtcctggtcgtgatgttcacatggacctgccaaatggaacatcagttgtcaactaccgtagctcaggaggtaatcatggtgttttaaggaatccacgtggccaaccatcaaatcaatatggtggtggtcttcttgcaggacctgtgcattctgttgggcctcaagtacctcgcagcggctctgattctgatagatggcagcaaaagggtctcatgccttcccctgtcacacccatgcaaacaatgcacaaagcagagaggaagtatgttgttgggaaagtttctgatgaggaggaggcgaaacagaggcagttgaaaggcattcttaacaagctgactccacaaaactttgaaaaactgtttgaacaagttaaggaagtcaacattgacagtgtagcaactcttactggggtcatttcacagatatttgacaaagctttgatggaaccaactttttgtgaaatgtatgctaatttttgcttccatctggctggtgccttgcctgacttcagtgaagacaatgaaaagatcacattcaaaagattgcttttgaataaatgccaagaggagtttgagagaggtgaaagggaagaagctgaagctgataaaacagaagaggaaggtgagatcaaacagaccaaagaagaaagagaggaaaagagaatccgtgctcgaaggcgcatgctgggaaacattaggttaatcggagagttgttcaaaaagaaaatgttgacagaaaggattatgcatgagtgcattaaaaaattgtttggaaattgtgatgatcccgatgaggagaacattgaagcactatgcaaattgatgagtacaattggtgagatgattgatcgtgcaaaggcaaaggagcacatggatgcatattttggtatgatgcataagatgtcaacaagtcagaagttgtcttctcgtgtaaggtttatgttgagagattcaattgacctcaggagaaataaatggcaacagaggcgtaaagttgaaggccccaagaagattgaggaggtgcacagagatgcagctcaagaaagacatgctcagtcaagtaggctaggacgtggtccagctgttagttctgtttcaagaagaggagcaccttctatggattatggctctcgtggctcatctgcgttagcatcctcaagttcccaacaagggagcattcgtggaatgcctccacactcgcgtggttcacaagacatccgatatgaggagaggaaccagtttgacaatagaactgttcttccccagcgtgtagtcaaggatgaagctatcactcttgggccacaaggtggccttgctaggggtatgtctataagagggctgtcaccagcatcaaatactgaacttccttctgttattgaccaccggagaatattatctggttctaatggttataactctgtgactgattggacatcatcatctggaagagaagattctagctcaataattccagatcgaacctctggccgaacttctgcttctagtcaatctgctggaccttcacagaggcctgccagccaggaaggccgtccaggaagtaaatcatattctgaggatgaattgagagaaaaatctgttttggccattcgggaatattacagtgcaaaagatgaaaaggaggttgctttgtgtattgaggagctgaatgctccgagtttctatccttctgttgtatcactttgggtaaatgattccttcgagagaaaagacatggaaagagagttgttggctaaacttctcgtcagcctttgcagtggtcgacataatttgttgagcaagcaacaactcagtgatggcctttcatctgttcttaccttattggaagatactctaagtgatgctccaagggccaccgagtaccttggacgactttttgcaaggtttgtggaggaaagcatattgctcttggaagaggtaggtaaattgattcaagaagttggagaacaaccagggtatccaatacgagatggcatcgccgctgacat

SEQ ID NO: 19359 - DNA, 2087 bp, Zea mays
ttcttatgtacgatggttccaacagtgacaccctagggcactctgatgcatgggttagggttgctgacgaaatttgtggcacgcgcatttgctggcgagcctcgtgtggcgaaatgcccatgtactaggtgtcgaaatctgatccgactggacaagtttgacctctccattcatatttgcaaatatagctttaagctagacaatctggtgtggcgtgagcatggaaaggtggatgctcctccggagtcgaatatagacgaggtcgtagaccgaatagaggacatgctagatgacatctgacatgagtatccatcactagagaccgactgacacccgtcggtggaagtgcagtagttgctcacgaaggcaccaaagtaactgtacttcatatcgtaatacggcttatggagatgaagtccaagcataacttctcaaataactgctacaacgatatcgtgacaacggatatttatattacacgtttatccgataatgaggttggataatttggatatccatttctattttccatcgctagctataagcctataataagtttaattcaatttgtcctatttcctgcttcttcacctcaagtcctcaaactacatgttgtaaagatgaggaagtcgaacactccacgcggtgcccacctcttttcatgcactcaccaactgatcatttgttcatggttttcatcaccacgcgtgcatcaaaaaaaacctagctgataagctcaagccgcatctcacagaaggttcaagaaattatactgaaatcactgccagcgcccaaacaagtgtcagccgttcttgccatttgcatgccacgcgtgctgcaggcttacgtggcagaaacgttgcacggacatgctggcacagttgtcactcgccccatgaattgcttgccttgtgttgcatgcatggtcgctcacacacatgaatgatttcatgttattcgtcttgtatgctatataactgcagtttgtgttgacctccattttgattatctctatcctgtacgtgccgagagtccttcaaagccgacgacgagacgacgatgcagtcgtcgtcgtcatcagcctcgacgccggctgccgcttccggcctcgtcttcgatctcgggtctgcggcgggcgtgccggagacacacgcgtggccgggggtgaacgagtacccgtcggtggagtccgctggccgcgacgtggtcccggtggtggacatgggggtggcctgcccggacgcgacgcgggcgttggcgcgcgccgcagacgagtggggcgtgtttctgctcgtcggccacggcgtgccccgggaagtggcggcgcgtgccgaggagcaggtcgcgcgcctgttcgtgctcccggctcctgacaaggcctgcgcggggcgccgccccggggagcccacggccaccggctacggcaggccgcccctggcactccgcttctccaagctcatgtggtccgaggggtacacgttccgcgccgccaccgtccgcgaagagttccgccgcgtctggcccgacggcggcgacgactacctccgcttctggtacgtacgagcgccatgtcacgtgcttgtgctttcatgcctcgtaccgtcgtcgtgctgtacgtgttatgtttatcggccggtacgtcacgcgtgctacactggttaacgacgtgagcgtgcccacgttgactgcatgcatgtgcatgcgcgcgcccagcgacgtgatggaggagtacgacagagagatgagggctctcggtggcaggctgctcgacctcttcttcatggcgctcggcctcaccgacgtccagttcgccaccggcgagacggagcggaggatccgcgagacctggacggcgacgatgcacccaatcctgtacgtacgtcaaaaacgaatatctgaccaatgcaaacgtttttctgcaatgccagtcatccactcatcctgtacgtacctctggactctgcttgtccatctactgatgacacgtatggtaggtaccccaggtgtccggaaccggagcgcgccatcgggctgacggcgcacacggactcgggcttcatcacgctcatcatgcagagccccgggcc

SEQ ID NO: 19360 - DNA, 2008 bp, Zea mays
gaagcagtctataggatttaggatctaagaagtaacagattctacattccatggattattctatgcaagcaaggaacgaaggaaacatgggtttgtaccctcgtggaagctcaatgtttgctagattgcactccatgggtgagctattgatatgtacacatgcatgcatgttgaaagaaaatggttttttgtcgatctatataatctttgctctcactttaacaagtgctaatttagcttaacagttgcttttcaaggaactaaaacaaaataaggcatgcaagatagagtttagctaaagaattggaagatcttaaagcgaagattagctattgagcggcttgttgggcgagaggcctgacaataatcttggacttgaaagatggagatgacatatcctttccattttccgacctggcagggtatttgtcgtccaacaatgcaaccgcatcattagaagtttccatgcccctgaaacctgaactcttgctgtgagcaacctagaaagccgtgaccctcctttcaccttactgtcttgcacgtcctttcttgttccacgtacgcactccggtccgcgtccaagtccaatccatatatgcacccccacggcattacctagaacctcactctccgttcctctccgttccgtcccctccaccccgcactgcagccgcgggatgaccggcggcggccgcggcgcgtgcgcggtgtgcaagcaccagcggcgcaagtgcgagcccaactgcgagctggccgcctacttcccggcgcacaggatgaacgacttccgcgcgctgcacctcgtcttcggggtggccaacctcaccaagctcatcaaggccaacgccagcgaggccggccggcgccgcgccgccgagacgctcacctgggaggcccgctggagggagtgcgacccctcggacgggtgctaccgcgaggtggcctgcctgcgccgcgacaacgccgtgctgcgcgccgagaacgccgcgctgcggcggcagctggccgagcagcagttgctctggtccagcgcctgcagcactggcggcagcgcgcttctggccgagcggcagctgctgccgccgtgtgggggcaataataatgggcttctgacggcgagtagcagagctcatcatgcaccggcagcagctccggcggcaacgcacaccgcgctggcctgctaccgtggcagcatgccggtgtgtactattactatgacagcggacgacggcagcggcaggaggccggcgtcggatgctgccgccatcgccgggagagggggtggtggtgctcaggtcgacgcttctagggataacaagagcagcgcctgcaggtgatgctagctggccggctatactgctaattaacaactgcaaagaaaggaagatacccataccctaccgtcgtcctaaagtgtagatttttggttactcgtgtactgatgacagcaagggcaaggcggctcaatatatagaaatatatcgacgacgagagctagactacttctatatgtatattggttgctacttcagttatatgatcctagaaattacatgaaccacaagatcatcaaatcgatcgagcagcatatgacgacccagcccctcagcaaagtttttttttcatccagcatcactcagcggctgctatatacagtgcttcccggccgcttacaggttgtatcatcatctgtctcatcggttgttgtgtcatttcaccaagcagatagtttcgcataggaaagaaggggtggatataaaacttgtctttctttgctagaatcagagatccaatacacttgtaggccttggtgtttcatccccgtgaatacggtcctacactctgctggtgggtcgtgattttagggtctgtttggttgggctgtggctgtgaaaaaagttgctgtgggttgtgagctgtgggaaaagctgctgtaggctgtaagctgttaaaaagctaaaaactgtttggtggaaaccattaaaagtcgtgaaaaaaaaaaaaaaaa

SEQ ID NO: 19361 - DNA, 789 bp, Zea mays
  misc_feature (595)..(595): n is a, c, g, or t
  misc_feature (601)..(601): n is a, c, g, or t
  misc_feature (624)..(624): n is a, c, g, or t
  misc_feature (630)..(630): n is a, c, g, or t
  misc_feature (637)..(637): n is a, c, g, or t
  misc_feature (644)..(644): n is a, c, g, or t
  misc_feature (667)..(667): n is a, c, g, or t
  misc_feature (678)..(678): n is a, c, g, or t
  misc_feature (680)..(680): n is a, c, g, or t
  misc_feature (686)..(686): n is a, c, g, or t
  misc_feature (697)..(697): n is a, c, g, or t
  misc_feature (729)..(729): n is a, c, g, or t
  misc_feature (754)..(754): n is a, c, g, or t
  misc_feature (762)..(762): n is a, c, g, or t
  misc_feature (771)..(772): n is a, c, g, or t
  misc_feature (777)..(778): n is a, c, g, or t
  misc_feature (780)..(780): n is a, c, g, or t
  misc_feature (785)..(785): n is a, c, g, or t
  misc_feature (788)..(788): n is a, c, g, or t
ttcctcttcttttctcttctccttccacttccacttcttctatctctcacaattcagcaatggcttctgatatagttacctctagcttgaagcctttagccatggccgattcttcctcttctaccattttctcccatccttccatctcctctaccatctcttcctccagaattcgcagctccagtgtttccctccttaccggacgcattaacctgcccctctctttctctcgcgtctctctatctcttaaaaccaaaacccaccttaaaaaatccccctttgtctccttcgttgcccagacttcggattgggctgaagaaggtggagaaggaagcgtcgctgttgaggagaccgagaacagtttagagtcacaagatgtgagcgaaggagatgagagcgaaggagatgtgagcgaaggagatgtgagcgaaggagatgagagcgaaggagatgtgagcgaaggagctgtgagcgaaagagctgagttcccggagccatcggaagaagccaagcttttcgtcggaaatttggcttatgatgttaatagccaagctttggctatgctctttgacaagccggtctggtgaaatcgccnaggttntatacaataggggaactgaccanagtcgnggggttnggattgngacaatgagttctggggacaaanctgaaacactngnggaaanttcaaccggtntgatcttaacggacgttacctaccgggaacanggcagctccaaaaggacccgtccanaacgggcnctcgggttnngaccnncntccangtnt

SEQ ID NO: 19362 - DNA, 845 bp, Zea mays
  misc_feature (19)..(19): n is a, c, g, or t
  misc_feature (547)..(547): n is a, c, g, or t
  misc_feature (659)..(659): n is a, c, g, or t
  misc_feature (685)..(685): n is a, c, g, or t
  misc_feature (695)..(695): n is a, c, g, or t
  misc_feature (700)..(700): n is a, c, g, or t
  misc_feature (703)..(703): n is a, c, g, or t
  misc_feature (707)..(707): n is a, c, g, or t
  misc_feature (718)..(718): n is a, c, g, or t
  misc_feature (725)..(725): n is a, c, g, or t
  misc_feature (734)..(734): n is a, c, g, or t
  misc_feature (786)..(786): n is a, c, g, or t
  misc_feature (809)..(809): n is a, c, g, or t
  misc_feature (822)..(822): n is a, c, g, or t
  misc_feature (826)..(826): n is a, c, g, or t
  misc_feature (832)..(832): n is a, c, g, or t
  misc_feature (840)..(840): n is a, c, g, or t
gagagagagagagagttcnctagtccccccccccccaaaacatttccataaccaaaaaacctcaaaataaaaaaatgagaactctcttaccttcccatactccggcaacggtaacaacggcggcgagaagaagacacgtcatacattgcgccggtaagagatctgactctttctccattaattccagtagctccgattggcaaagctcctgcgccattctctcaagcaaagttaactcacaagaacaatctgaatccttatcttccaattccaatggatcatcatcctaccacgtttccgccgtcaacggtcacaacaacggcgccggagtctcagatttgaatctagttccattcaacaacaaccaatcgattcaatcgaagaagcctttaagtatttcagatctatctccagctccgatgcatggatctaacctccgtgtagcttatcaaggtgttcccggagcttactccgaagccgccgctggtaaagcttatcctaactgtcaagcgattccttgcgatcaattcgaaagttgcgtttcaancggtggagctttggatcgccgatcgcgctgttttacccgtcgaaaactcactcggcggtcgattcatcgtaattacgatcttctcctccgtcaccgtcttcacatcgtcggngaagttcagcttccggtcattattgnctcatggggntcttnccngggnaccggaaagangttcttnactcggggngatccctcatcctaaaggactagctcaatgcgaacacacgttggctaactcnggcttaacgtaacttgggaactngtgatgataccgncggngcgggnggagtttntcgtg

SEQ ID NO: 19363 - DNA, 644 bp, Zea mays
aagcagtagctgcaatctaagttcgtctcatctcatctccacacgaacacttacgagcttgagccatggccgccgccgttgagattgacgctgagattcagcaacagcttaccaacgaggtcaagctcttcaaccgatggagctttgatgacgtttcggtcacagacattagtcttgttgactacattggtgttcagcctgctaagcacgcgacctttgtcccccacactgctggaagatactctgtgaagaggttcaggaaggctcagtgcccaatcgttgagaggctcacaaactctctcatgatgcacggaaggaacaacggtaagaagctgatggctgtgaggatcatcaagcacgccatggagatcatccatctcttgactgacttgaaccctattcaggttatcattgatgccattgttaacagtggtccacgtgaggatgctactaggattggatctgctggtgtggtgaggaggcaggctgttgatatctctcctctaagacgtgtgaatcaagccatcttcttgctcaccactggtgcacgtgaagctgcgtttagaaacatcaagacaatcgctgagtgtcttgctgatgagctcatcaatgctgccaggggatcttccaacagctatgccatc

SEQ ID NO: 19364 - DNA, 713 bp, Zea mays
  misc_feature (566)..(567): n is a, c, g, or t
  misc_feature (569)..(569): n is a, c, g, or t
  misc_feature (586)..(586): n is a, c, g, or t
  misc_feature (589)..(589): n is a, c, g, or t
  misc_feature (594)..(594): n is a, c, g, or t
  misc_feature (596)..(596): n is a, c, g, or t
  misc_feature (603)..(603): n is a, c, g, or t
  misc_feature (618)..(618): n is a, c, g, or t
  misc_feature (629)..(633): n is a, c, g, or t
  misc_feature (639)..(639): n is a, c, g, or t
  misc_feature (648)..(648): n is a, c, g, or t
  misc_feature (651)..(651): n is a, c, g, or t
  misc_feature (676)..(676): n is a, c, g, or t
  misc_feature (686)..(686): n is a, c, g, or t
  misc_feature (691)..(691): n is a, c, g, or t
  misc_feature (698)..(698): n is a, c, g, or t
  misc_feature (700)..(700): n is a, c, g, or t
  misc_feature (708)..(708): n is a, c, g, or t
aaaatctcctctctttgattctttctgctccgaaaaacagagagagagaacaacaaccaaacactcatttctccacatcttgagagaaaaaaacagagcaagtatattagagatctcatggcgatggcggtctccggagctgtcctcagtgggcttggttcttcgttcctcaccggaggcaagaggagtgccaccgcattgggaagcggcgtaggcactggagctcagagagttggcaggaaaactcttattgtcgctgctgcggctgctcagcctaagaaatcttggatccctgccgttaaaggtggtggcaacttccttgaccctgaatggctcgatggctcgctaccaggagatttcgggttcgacccattgggtttggggaaagacccggcttttctgaaatggtacagagaggctgagctgatccatggccgatgggcgatggcagcggttcttgggatcttcgtcggccaggcctggagcggtgtggcatggtttgaagctggagcccagccagacgcgatcgctcccttctcgttcgggtcgcttcttggaacccaatnntnttaatggatggggtggngancaaangnggggtantttcttaaacccgantttaattggtnnnnnggcaanccatggtgnaancccgcgaaatttcagaacatccggnaatagggtancccgnggaaatntntaccttgngcccg

SEQ ID NO: 19365 - DNA, 590 bp, Zea mays
  misc_feature (1)..(4): n is a, c, g, or t
  misc_feature (8)..(10): n is a, c, g, or t
  misc_feature (12)..(12): n is a, c, g, or t
  misc_feature (15)..(18): n is a, c, g, or t
  misc_feature (20)..(20): n is a, c, g, or t
  misc_feature (28)..(31): n is a, c, g, or t
  misc_feature (33)..(36): n is a, c, g, or t
  misc_feature (39)..(40): n is a, c, g, or t
  misc_feature (42)..(42): n is a, c, g, or t
  misc_feature (45)..(45): n is a, c, g, or t
  misc_feature (53)..(54): n is a, c, g, or t
  misc_feature (571)..(571): n is a, c, g, or t
nnnntctnnnantannnngntccccccnnnntnnnngannanagntcactaannccccccccccccccccttacttaattcattatattttttaagcttcactgactaattttagtgtttttcttagcataaaaaacacttctaaaagaggatccaatgatgtctagtttgacatttttttctgcacagagttcttgttataaataatctgattatattgaaactgtttttgtgttcctagtatcaaacggttgtgagatgtgatgggagcaggggtggggtttggattggtgctcctatattgtggccaagccaagccgccaaagttactccatggcagtgttgggagttacgggcactgtttttgggttgatctggttagtgtgtccactctaacattataggaggtagaagactgcaagatctgcattcaaatggatgttgcagacgctctggactactgcacctccacctgacctgcctagcgcatatgggcggggtataacaagtcttccaacatgccatgtctgttgtgcccggtgaataatctcaccgcctcgctacgacctanacgtctggtctcatcactt

SEQ ID NO: 19366 - DNA, 2085 bp, Zea mays
ccggcccgggaccgaccattgaaaaaaaccctaacaacgcatttcgctccccacagcggctcggccacaacccacagccagacggtctcgagctggatctctaccgttcgtccgttccagcagacagcagtgcgcgctctctctctccctcgtggcgacgactgggcgaccgctgccgctgcccttgtgccccggtctccgtcggtccgttcgccaggtctcctgcgggctctttgtcgtcgacaagctccgccaggttgctgtgtgaagtccaaggttgtcacatggattcagcacaagatttccaacccaggacattctctataaagttgtggccaccaagtgaaagcacacggatcatgcttgttgacaggatgacaaacaatctgtccacagagtccattttctctcgcaaatatcgccttttgggaaagcaagaggctcatgagaatgcaaaaacgattgaagaactttgctttgccttggctgatgagcatttcagagaggagccagatggtgatgggagttctgctgtccagctatatgcaaaggaaacgagcaagatgatgttggaagttctgaaaaaaggcccaaggactactgcagaactggaggcacctgtagctgacacacctcttgtgtctgctgatactgtactagatatatctggtggcaagcgtgcttttattgaggcagatgaagcaaaggaactgctgagtccacttaccaaaccaggaaattcatataaaagaatttgctttagcaacaggagctttggtattggtgctgctaatgttgctgggccaattcttgagtcagttaagaatcagctcacagaggttgatatctcagattttgtggcaggaaggtctgaggatgaagcccttgatgtgatgcgcatattctccaaagcattagatggttctgtcctgagatatctgaacatctctgacaatgctttgggcgagaagggtgtcagggcattcagtgagctcctgaaatcacaagaatccctggaagaactttatgtgatgaatgatggcatatcagaggaagctgcaaaagctctatctgagcttattcctgcaactgagaagcttaaggttcttcacttccacaacaatatgactggagatgaaggtgctatgtatattgctgaaatggttaagcgttctccaaatgtagagagtttcaggtgctcagcaacaaggataggatctgatggtggagtcgcattgtctgaggcattggggacatgcactcgtctgaagaaacttgatcttagggacaacttgtttggtgttgatgcagggttagctctcagcgaaacccttccaaaactacctgatcttgttgagctttatctcagtgatctcaatcttgagaacaagggtactatagcaattgcaaaagccctcaaacagtcagcactgcagttggaggtccttgaaattgctggaaatgaaataaatgccaaagcagccccagatttggctgaatgtctagcagtaatgcagtcactcaagaagctgaccttggctgaaaatgaactgaaggacaatggtgctgtgataattgcaaaatcattggaagatggccactcagatctcaaggaacttgatgtgagcacgaacatgctgcagagggttggagctcggtgctttgcgcgggcagtcgcaaataaaccagattttgtgcagctgaacatcaatggaaattttatctccgatgaaggggttgatgaggtgaaggaaattctgaaggctggtaagaaatctctggatgtgctgggcccactagacgagaatgaacctgatggagagcctgatgatgaggatgccgaggacgatgaggacgagctggatttgaatctgcagagtgtgaaggttgagcaggatgaggatgattgacgatccttaggttaaatatctttagctactcagtaatcatttggatatccatgagctacgcaaacttttaattaaaaagaatgtactgagccttttgcattgtcctgagccttttgcaagggccaaaaaaaaaaaaaaaaaaaaaaaaaaagtactctgcgttgttaccactgct

SEQ ID NO: 19367 - DNA, 2528 bp, Zea mays
cattgggtacctcgaggccggccgggaaccctaacaacgcatttcgctccccacagcggctcggccacaacccacagccagaaggtctcgagctggatctctaccgttccagcagacagcagtgcgcgctctctctctccctcgtggcgacgactgggcgaccgctgccgctgccgctgccgctgccgctgcccttgtgccccggtctccgtcggtccgttcgccaggtctcctgcgggctcttcgtcgtcgacaagctccgcctggttgctgtgtgaagtccaaggttgtcacatggattcagcacaagatttccaacccaggacattctctataaagttgtggccaccaagtgaaagcacacggatcatgcttgttgacaggatgacaaacaatctgtccacagagtccattttctctcgcaaatatcgccttttgggaaagcaagaggctcatgagaatgcaaaaacgattgaagaactttgctttgccttggctgatgagcatttcagagaggagccagatggtgatgggagttctgctgtccagctatatgcaaaggaaacgagcaagatgatgttggaagttctgaaaaaaggcccaaggactactgcagaactggaggcacctgtagctgacacacctcttgtgtctgctgatactgtactagatatatctggtggcaagcgtgcttttattgaggcagatgaagcaaaggaactgctgagtccacttaccaaaccaggaaattcatataaaagaatttgctttagcaacaggagctttggtattggtgctgctaatgttgctgggccaattcttgagtcagttaagaatcagctcacagaggttgatatctcagattttgtggcaggaaggtctgaggatgaagcccttgatgtgatgcgcatattctccaaagcattaggtggttctgtcctgagatatctgaacatctctgacaatgctttgggcgagaagggtgtcagggcattctgtgagctcctgaaatcgcaagaatccctggaagaactttatgtgatgaatgatggcatatcagaggaagctgcaaaagctctatctgagcttattcctgcaactgagaagcttaaggttcttcacttccacaacaatatgactggagatgaaggtgctatgtatattgctgaaatggttaagcgttctccaaatgtagagagtttcaggtgctcagcaacaaggataggatctgatggtggagtcgcattgtctgaggcattggggacatgcactcgtctgaagaaacttgatcttagggacaacttgtttggtgttgatgcagggttagctctcagcgaaacccttccaaaactacctgatcttgttgagctttatctcagtgatctcaatcttgagaacaagggtactatagcaattgcaaaagccctcaaacagtcagcactgcagttggaggtccttgaaattgctggaaatgaaataaatgccaaagcagccccagatttggctgaatgtctagcagtaatgcagtcactcaagaagctgaccttggctgaaaatgaactgaaggacaatggtgctgtgataattgcaaaatcattggaagatggccactcagatctcaaggaacttgatgtgagcacgaacatgctgcagagggttggagctcggtgctttacgcgggcagtcgcaaataaaccagattttgtgcagctgaacatcaatggaaattttatctctgatgaaggggttgatgaggtgaaggaaattctgaaggctggtaagaaatctctggatgtgctgggcccactagacgagaatgaacctgatggagagcctgatgatgaggatgccgaggacgatgaggacgagctggatttgaagctgcagagtgtgaaggttgagcaggatgaggatgattgacgatccttaggttaaatatctttagctactcagtaatcatttggatgtccatgagctacgcaaacttttaattaaaaagaatgtactgaggcttttgcattgtcctgagccttttgcaagggtcatacttacattgtctgtagccttttgggtccccggtaaagaggatgttttgacctctcgttgatagataaccccccctgtttaattgataaatatgttgtggcgaaggcgtaacgcaacgtcccctcgctcgattgtctccccagcagaagcagaacataacggagggaaagcaagagcaagcgaagactggaagagcgagagagcaagtgaagactggaagagcgagagccccctgacggagggagcgtatggaaccggcgaaagctttggcattcctgtcgcaaccgggaatggcgaaggcctctacggctaccggcgaaggcctctacggctaccgaaggctgggcgcatggagtgcgaagtctacgtgtcgttacctgagtgttgtaatggggggctcgtgtgaaaccgactcgtgcttcagggtcccccttgtaagcccctgtgtgttggtcctttgttctcgaatgctgtcaatcaag

SEQ ID NO: 19368 - DNA, 2203 bp, Zea mays
gtgcggcgctcaggcggcgggctcacgtatatcctccaaacctaaccctatgcaacaaatttcgctccccacagcggcggcggccacagccacacgttctcgcgcgggatctaattccaaacagcactgccccttgcttctaccgttccccaagtgcgctccctctctcgccatccatctcgtgcacgactgggcaaccgttgccgctgtcgaggtgcccaggtcttcatcggtccctcgtcagttcttctccggcccttcgccgccgacaagctccgccaggttgctgtgttaagtccaagcttatcacatggattcaacacaagattttcaacccaggacattttctataaagttgtggccaccaagtgaaagcacacggctcatgcttgttgagaggatgacaaagactatgtccacagagtccattttctctcgcaaatatggtcttttgggcaagcaagaggctcatgagaatgcaaaaaggattgaagaactttgctttgcatcggctgatgagcatttcaaaaatgagccagatggtgatgggagttctgctgtccagctatatgcaaaggaatcaagcaagatgatgttggaagttctgagaaaaggcccaaggactactgcagaattggaggcacctgtagatgatacatctcttgtgtctgctgatgcacctcgtgtgcttgctgatactgtactggatatatctggtggggagcgtgcttttattgaggcagatgaagcaaaggaactgcttagtccacttaccaaaccagggaattcatataaaagaatttgctttagcaacaggagctttggtattggtgctgctaatgttgctggtccaattcttgagtcagttaagaatcagctcacagaggttgacatctcagattttgtggcaggaaggcctgaggatgaagcccttgatgtgatgcgcatattctccaaagcattagagggttctgtcctgagatatctgaacatctctgacaatgctttgggtgagaagggtgtcagggcattcagtgagctcctgaaatcacaggaatccctcgaagaactatatgtgatgaatgatggcatatcagaggaagctgcgaaagctctatctgagcttattcctgcaactgagaagcttaaggttctccacttccacaacaacatgacgggagatgaaggtgctatgtatattgctgagatggttaagcgttctccgaatgtagagagtttcaggtgctcagcaacaaggataggatctgatggtggagtcgcattgtctgaggcattagggacatgcactcgcctgaagaaacttgatctcagggacaacttgtttggtgttgatgcagggttagctctcagcaaaacccttccaaagcttcctgatcttgttgagctttatctcagtgatctcaatctagaaaacaagggtactatagcaattgccaaagccctcgaacagtcagcaccacagttggaggtccttgaaattgctggaaatgaaataaatgccaaagcagccccagatttggccaagtgcctagcggcaatgcagtcactcaagaagctgactttggctgaaaatgaactgaaggatgatggtgccgtgataatcgcaaaatcattggaagatggccacatagatctcaaggagcttgatgttagcgtgaacatgctgcagagggttggagctcggtgctttgcgcgggcagtcgctaataaaccggcttttgagctgctgaacatcaatggaaatttcatctctggtgaagggatcgatgaggtggaggaaatcttgaaggctggtaagaaacccctgaaagtgctgggcccactagatgagaatgagcctgatggagagcctgatgatgacgatgaagaggttgaggataatgaggacgagctgaattcgaagctgcagagtgtgaaggttgagcaggatgattgaccgagttggtatcgagatataagcctgtcgcagggtcttgataactgagttatctacaatgctgttgatctttggttttgtagtcggtttttgttatgaaaaaccagaaccagctatcttgtgacttgtgcaatctgattatagattagaactgctcttatttattcgtttatattaatgacatcgttccattacaaatggcctgatatatagatgctacctattttcccaccaaaaaagaacgga

SEQ ID NO: 19369 - DNA, 1266 bp, Zea mays
gggccggcccccatccacctcgctgtctttttcttcacttccccctcgccttctcctgccctcccctcctgatcggagtctcagccgcggcagccatggcgaagacctaccccgttgtcagcgccgagtaccaggaggccgtcgagaaggccaggcaaaagctccgcgccctcatcgccgagaagaactgctccccgctcatgctccgcctcgcgtggcactccgctgggaccttcgacgtgtcgtccaagacaggcggcccgttcgggacgatgaagaagccggcggagcaggcgcacgccgccaacgcgggcctggacatcgccgtgcggatgctcgagcccatcaaggaggagatccccaccatctcctacgctgatctctaccagcttgcgggagttgtcgcggtggaggtgtccggtgggcccgtgatccccttccacccagggagggaggacaagcctcagcccccacctgagggtcgcctccctgatgctaccaagggttctgaccacctaaggcaagtcttcggcaagcagatgggcttgagtgatcaggatattgttgccctctctggtggccacaccctgggaaggtgccacaaggagaggtctggctttgagggaccctggacaaggaaccctttgaagtttgaccactcttacttcacggagcttctgagtggtgacaaagaggggcttcttcagcttccaagtgacaaaaccctgctgactgaccctgtctttcgccctcttgtggagaaatatgctgcggacgagaaggctttctttgaggactacaaggaggcacacctcaggctctccgaactggggtacgctgaagcataagaggcgtgtctactactgctgctactatgtgcgatcagagtgatcttgttctgcgtctagactaggggtcagtatggaccagcagactgctaagtaatcttctccgtaataatgtcccgttggcttgagggcataccttgtacgctgtcagtgggattggtgtggccgttgcactcggtggcctttggccccagatctaatcgaatgaaaatgccagaagttgacttttgaatgcaaaaaaaaaaaaaaaaaaaggggcccctaggggccctcgaaggcggccgccacttcccggaacccatccccccctaaatcaaaggtttttttgggggggggcgggggggggcccgggaaaaaagacccttaaaattccggaaaacccccccaaaggggggagagccccccccccccaaatttt

SEQ ID NO: 19370 - DNA, 1984 bp, Zea mays
  misc_feature (848)..(852): n is a, c, g, or t
taagggattttacggtttttgtttttttttttatctgcaaatgacttaggacaatttggatatatctgtagattatgaacaaaagctatctagattgataagcaacatacaggctcaatcgcaggaaaacaaaaacaggagtataacacagcatgatacaggccacaagtcactctagtagacaagcacaacatcacacaaagataaggcacaccatccatcacaaatcacttggcttggccaccgagatcttcactgagcgacactctgttcactgagcgacactctgttcatcagggttagctccagcttgagttgcgctctgaacagaatctgtttccgtctcacttccttgtacctgccctgtagctgatcctgtctcctgagcattaacttcatccagtttgttgttcttcagctgccttgaggtggcatcaagcggacaagtttcttcagatggcagcctggggagtgactttctctggggcttctttgctgaactcgacggggttggttttttcacaccgttttgagaaaccttttcgtcaaggctcagacgggcaggttggtccgtagtagtattttcttcagtctctgatatggacttgtttttagaccgaccaagctttggtgatttagctctggttggggggatctttttcaattcaaccttggcaggggttggttccttataaaagcttggcattggtgttgccttgaaattcaaactctttctcagcattttgagttcagcttcttcagtttcctttgattttgcctgcaagttgcttttctctagttcctgtgcatgaatcttctcctcgagctttgagtagaactctcttcgnnnnncagctctctcatcacacttaaaactaaatccatacgaaggagtgctgcccaccctttgaggtttcacactttcatttgattcttcgtcaatatcgtttttggcagaacgttggtttgatgccttctgagttttattcttctcatttgagtcctcaagtgatggggtctccttggcaactgggcggaaactgctcttttcagtcgccgacttactggcaccagtatcaccattgctcaaagagcaatcaactagatctggatcagaaacccgtgcaatgggcgccttaggataagaaggactaaaagagcttttcctagtttgactcttatccccgcccccgagggctctgtcgcggagatttagtaccaacccttcggtgaatggccttgaaccccctcaggaactcggggctttatgtcctgggattgcgaggtggcttccatttccacttcttcagacgggttgatcacctcgctctcacccgaatgggttccatcagccagcacgtcgtgttcttctgcgtgcccctctacactatcacggggcggcaacttccccgttggcccattgtcaatgcccactgcagcaatagcatcagtaacctccgtacttgcatccatgtgacgctaccgcctcaggatttctttaggccagattagaaagataactcccaagccaacagcttgcacaagctatccgcgaccgcaatcaccgcaggatcatgctatgccggtcagcgaatgaatccgcatcaaactagactacgagagaaggaatcagctcctggcggatccgatctccgctccaccccggcggcgcccagtaggaacgaagacggcgaagaatccgagcggagggaaaggcaggcgcggtctgggtcaaaggacacctggatctggaattctgaccaggcgaaagcgatggggagtggagcgactgaagcgcgggggaggcaaggaggggagttggcacggtgaaggcgggagagcaacgacggtggcgagagactccggcagtagcggtggcggcggggacggcgggagggagacagcggggcgtgcgtggctcgtgctttgtctgggtttccgggtcgctcggtttcgcgtttctgcgtgcctccaaagcgtatct

SEQ ID NO: 19371 - DNA, 2092 bp, Zea mays
gttttttttttttttttgaatcacaaagctttgcaaaatcgtgtacatatcttacttggacggcaacttaattgactggtagccctggagaataatatgaaattctgcctgtctgccaactacaaatacctggtatgtcaacagaaactaagataaagaatacacggtgtcacttgccactcttcaagctcctggtgctgagactaattctaatacataataccagccagcagtttactgcagaaatagcaaaatgtgataaaggaagctggggcacaactccctcctttcataggagtcggcttgataggttcctatgcagtaagtccaggttcgtcaggtgtaatttgagcgcggatcggctctcgatcaagacccttcgtcggcgacttgttttctagctcttctgcagatggaacagatggtgcaatgtcaactttggttgtttgctctgaaggcagtttaggtagagatttccgttggggcttcttcactgcatttgcagcaggtgctttcttgacaccattttgggagaccctttcatcgagactcagtcgagctgaacgagctggaggatttggattcccttctgtccctcctgaggatgtgttcttggagcgaccaagctttggtgacctagctcttgttgtaggtatcttcttcaactcaaccttggggggaggtggttccttataaaagctgggcattggtgttgccttgaaatttaaactctttctcagcattttgagttcagcttcttcagtttcctttgattttgcctgcaagttgcttttctctagttcctgtgcatgaatcttctcctcgagctttgagtagaactctcttcgtttttcagctctctcatcacacttaaaactaaatccatatgaaggagtgctgccaaccctttgaggtttcacactttcatttgattcttcttcaatatcctttttgacagaatgttggtttgatgccttctgagtttttttcttctcatttgagtcctcaagtgatggggtctccttggcaactgggcggaaactgctcttttcggcctttttcttactggaaccagcatcaccattgctcaaagagcaatcaactagatctggatcagaaacccgtgcaatgggcgccttaggataagaaggactaaaagagcttttcctagtttgactcttatccccgcctcgagggctctgtcgctgagatttagtaccaaccttcattgaatggccttgaaccccctcaggaactcgaggctttatgtcctgggactgcgaggtggcttccatttctacttcttcagatgggttgatcacctcgctctcgcccgaatgggctccatcagccagcacatcgtgttcttctgcgtgcccctctacactatcactgggcggcaacttccccgcggcctcattgtcaaagcccaccgcaccaatagcatcagtaacctctgtactagcatccatgtgacgctaccgtctcaggatatctttaggccagattaaaaagacaacacccaagccaccagcttgcacaagctatccgcaatcaccgtaggatcatgctatgccgaccagcaaatgaatccgcgtcaaactagactgaacgcaacgaaagaaacattcgattcagcgttcacagcaaaactgagaattgcagaataacacgagcagtccatcgaagaaagtaagggcatccagcctgcgagagaaggaatcagctcccggcggatccgatctccgctccaccccagcggtgcccagtggggacaaggacggcgaagaatccgaccggaggcgtaaggcaggcgaggtctcggtcaaggaaacctggatctggccaggcgaaaacgatggggagtgaagaggctgaagcgcgcgggggaggcaaggattggagttgggcgcggtgaaggcgggagagcagcgacggtggcgcgccgccggcggcggcggcggcggaagggaggcagcgggggccgtgcgtggctcgtgctttgtctgggtttccaggtggtggtgtggtttcgaatttctacggggacctttctggggcggttggggggggcggggtaatggtctcgtgc

SEQ ID NO: 19372 - DNA, 1986 bp, Zea mays
gcactgaatcacaaagctttgcaaaatcgtgtacatatcttacttggacggcaacttaattgactggtagccctggagaataatatgaaattctgcctgtctgccaactacaaatacctggtatgtcaacagaaactaagataaagaatacacggtgtcacttgccactcttcaagctcctggtgctgagactaattctaatacataataccagccagcagtttactgcagaaatagcaaaatgtgataaaaggaagctggggcacaactccctcctttcataggagtcggcttgataggttcctatgcagtaagtccaggttcgtcaggtgtaatttgagcgcggatcggctctcgatcaagacccttcgtcggcgacttgttttctagctcttctgcagatggaacagatggtgcaatgtcaactttggttgtttgctctgaaggcagtttaggtagagatttccgttggggcttcttcactgcatttgcagcaggtgctttcttgacaccattttgggagaccctttcatcgagactcagtcgacctgaacgagctggaggatttggattcccttctgtccctcctgaggatgtgttcttggagcgaccaagctttggtgacctagctcttgttgtaggtatcttcttcaactcaaccttggggggaggtggttccttataaaagctgggcattggtgttgccttgaaatttaaactctttctcagcattttgagttcagcttcttcagtttcctttgattttgcctgcaagttgcttttctctagttcctgtgcatgaatcttctcctcgagctttgagtagaactctcttcgtttttcagctctctcatcacacttaaaactaaatccatatgaaggagtgctgccaaccctttgaggtttcacactttcatttgattcttcttcaatatcctttttgacagaatgttggtttgatgccttctgagtttttttcttctcatttgagtcctcaagtgatggggtctccttggcaactgggcggaaactgctcttttcggcctttttcttactggaaccagcatcaccattgctcaaagagcaatcaactagatctggatcagaaaccccggccattgggcgccttaggataagaaggactaaaagagcttttcctagtttgactcttatccccgcctcgagggctctgtcgctgagatttagtaccaaccttcattgaatggccttgaaccccctcaggaactcgaggctttatgtcctgggactgcgaggtggcttccatttctacttcttcagatgggttgatcacctcgctctcgcccgaatgggctccatcagccagcacatcgtgttcttctgcgtgcccctctacactatcactgggcggcaacttccccgcggccccattgtcaaagcccaccgcaccaatagcatcagtaacctctgtactagcatccatgtgacgctaccgtctcaggatatctttaggccagattaaaaagacaacacccaagccaccagcttgcacaagctatccgcaatcaccgcaggatcatgctatgccgaccagcaaatgaatccgcgtcaaactagactgcgagagaaggaatcagctcccggcggatccgatctccgctccaccccagcggtgcccagtggggacaaggacggcgaagaatccgaccggaggcgtaaggcaggcgaggtctcggtcaaggaaacctggatctggccaggcgaaaacgatggggagtgaagaggctgaagcgcgcgggggaggcaaggattggagttgggcgcggtgaaggcgggagagcagcgacggtggcgcgccgccggcggcggcggcggcggaagggaggcagcgggggccgtgcgtggctcgtgctttgtctgggtttccagggtggtggtgtggtttcgattctctacggggcctttctcatttctgcgcccggcccggccggcctcgaggtacccaat

SEQ ID NO: 19373 - DNA, 4564 bp, Zea mays
  misc_feature (17)..(17): n is a, c, g, or t
ttttgtttttttttttnttttttttctttttttttttttttttttttttttttgttttcttgttttttggctccgtgccctggagataggagacatgataatctgaaaaaatttgccaactacaaacacttcgtatgtcaacagaaactagcataaacaatacacggggggtcacttgccattctccaaactcccaactccatcctggtgatgagactaattttagtacataataccagccagcagttaatgcagaaatagcaaagtgtgataaaggaagctgaggcacaactctcttctttcatgagtcggcttgataggttcctttcctacacgctgagtccaggttcatcaggtgtaagttgcgcgcggattggctctcgaacaagacccatcaacgatggcttgttccccagctcttctccagatggaacagacgctgcaatgtcaacaactttggctgtttgctccgaaggcaatttagggagagatttccgttggggcttcttcgccgcatttgcagcaggtgctttcttggcaccattttgggggaccctttgatcgaggctcagtcgagctgaacgagctggggggttcgaatttccttctgtccctcctgagggtgtgttcttggagcgaccaagctttggtgatcgagctcttgttgttgggatcttcttcaactcaaccttgggaggaggtggttccttataaaagctgggcattggtgttgccttgaactttaaactctttctcagcattttgagttcagcttcttcagttccccccgctcttgcagcagtaacatacagataaaatcaaacaatatattcaatgttgcatcaagcaatatcacttccatagtaatatgaaaatagaataagagcacaaacctttgattttgcctgcaagttgcttttctctagttcctgtgcatgaatcttctcctcgagctttgagtagaactatatcattgcaggatagtgtaagcaaaggaatgatgcccataagttcttaaactaaaccagtgctaagttatctataatgagttacctctcttcgtttttcagctctctcatcacacttaaaactaaatccatatgaaggagtgctgccaaccctttgaggtttcacactttcatttgattcttcttcaatatcctttttgacagaatgttggtttgatgccttctgagtttttttcttctcactgtatttgaatgaagcacattatatatttatattgcaagaaactcttttatatctaagtgtgctaggtaagagataaatttacgagaaaaaagtatttaggatatgacttggttgaaaaaaaatatgtgtagaaactaatgttaaggttggtttcacagtgcagtttcaattatcacaagatggaagccaaagcaaacatagtttccaaaatggtaaatgcaaagaacaaattaaaaaatactttgtaactaaaaaatgtttgtggcacaaacaacaatgaatgttcaaataaataagatggacccaaggaggaaacactcttttgcatatttaacagaacagacactttaaaaatcattaaatcatgctatacctatactcttatgctaccaaaaaaatgtagcaaacatagttgtgccagtaattcatagaattttcacactcaaggcaatctgggtaatcaaaaaactcgaccaacctagaaggaactagttgtctttttaattaagaaatagacacacaaattcaccccaacgaagacttgacttaggtggtctgggcatatgtccacaccgacaaccaactgagctaggatcagttccttacaatttgagtaattagtaggcctggcttaattggatgcttagagcaccgattttaagtccagaatggcagaatccaaatgagaaacagaagccatgaagcaacacactaacacaggatcaaaagtgtaaaacaaagaaacaagcagcttactttgagtcctcaagtgatggggtctccttggcaactgggcggaaactgctcttttcggccttctaatgaaagcaccaccaacaaaagtgtataaggttcaaactcaaactgcaaggtgcataaacattgctacaagtaatatagtagcaatcatgcatataactgtaagcgttgtaaaagaatatagatgggcacattgtaactcataagctataacaaaaaatcaacttactttcttactggaaccagcatcaccattgctcaaagagcaatcaactagatctggatcagaaacccgtgcaatgggcgccttaggataagaaggactaaaagagcttttcctagtttgactcttatccccgcctcgagggctctgtcgctgagatttagtaccaaccttcattgaatggccttgaaccccctacaaatgaaaatgccaaaaaaaaaaacacttggctgtcagcagaccaccgattgaagtcaacagaactgacaatctgtaaccgtgaaaaaccttacctcaggaactcgaggctttatgtcctgggactgcgaggtggcttccatttctacttcttcagatgggttgatcacctcgctctcgcccgaatgggctccatcagccagcacatcgtgttcttctgcgtgcccctctacactatcactgggcggcaacttccccgcggccccattgtcaaagcccaccgcaccaatagcatcagtaacctctgtactagcatccatgtgacgctaccgtctcaggatatctttaggccagattaaaaagacaacacccaagccaccagcttgcacaagctatccgcaatcaccgcaggatcatgctatgccgaccagcaaatgaatccgcgtcaaactagactgaacgcaacgaaagaaacatttgattcagcgttcacagcaaaactgagaattgcagaataacacgagcagtcaatcgaagaaagtaaaggcatctaacctgcgagagaaggaatcagctcccggcggatccgatctccgctccaccccagcggtgcccagtggggacaaggacggcgaagaatccgaccggaggcgtaaggcaggcgaggtctgggtcaaggaaacctggatctggatcgagccgtggctcttgagcgcatgaaaggaaatggtgaaggaaagcaaaggtggcggctttacctggccaggcgaaaacgatggggagtgaagaggctgaagcgcgcgggggaggcaaggattggagttgggcgcggtgaaggcgggagagcagcgacggtggcgcgccgccggcggcggcggcggcggaagggaggcagcgggggccgtgcgtggctcgtgctttgtctgggtttccaggtggtggtgtggtttcgaatttctacggggacctttctggtttctgcgttcctccaaagctaactttattccccatatttacattgagcgattaatgtacgtgacctaatttttactataatcacactaagttaagaacagatagtgcaagatgagaaatataaagggtgcatataaagggtgctacgataaatttgaagaggtctaagctgccgtctctcagtcaactatggttacggaggatcattatcgtcatatgatatatttatttaattatttcgtatataacttctattatataataaagatgtgatattaatttctataacatgagtaattatatgtgtgaaacttgatcttatcacacatgtaagatacacccaagtttgtattagaatacacccaagtttgtattagaacctaggtctgacagttactctaaatctggctaccaaataagctaagttgcactcccaaggattggataggagcttgggaagcctaccaaacacaccctatatgattcactatgatagtgcatgagaagagtggagtgaatcaggagagatgaaagggtcaaacgatggatgatagagtttgaaaaagaagaaagagtatggtcgtctgaactatgtaaggtcttgttcggttattcctatatcacatggattggatgggattagtaaaaaattagtaaagattttgacttgctatggattgaaactcaccaaatcccctctaatacatatggattggagggaaaaccgaatggaccctaaaatataactagttagcccctgatagaaaaaatccatactactcaattaaaaacctaatgtgggcacctggtgctaccatggcttcaccctccgtgttgacactctaggtccgcccgccacaccatgcaaaaaaaatagtgtacaccgagcactcaaactcatgccccgtacttatagtaatttgaggttaccaccaaactacatataccttagtgtttagaaataaacaataattatatttgaatatatatatatatatataacaactgtagcaaaacacgtgcaacttactagtaaaatactaactatggatgacaaagttaaaagacaaaagagtggtttgaaccatataactgattagatctgagataaatttccaaaaaaatattggttcattcttgtaattgatccatagaacacatttctcgatataatattgagcgttaacatggttttca

SEQ ID NO: 19374 - DNA, 1905 bp, Zea mays
  misc_feature (109)..(109): n is a, c, g, or t
gttccgggccccccctcgaggttttttttttttttttttcttttttttttttttttttttttttttttttttttttttttttttttttttttttttttttttttttttntgcaccgaatcacaaggcttctctacgacggcaagaaaattggctccgagccctggagataggagacatgataatctgaaaaaatttgccaactacaaacacttcgtatgtcaacagaaactagcataaacaatacacgggggtcacttgccattctccaaactcccaactccatcctggtgatgagactaattttagtacataataccagccagcagttaatgcagaaatagcaaagtgtgataaaggaagctgaggcacaactctcttctttcatgagtcggcttgataggttcctttcctacacgctgagtccaggttcatcaggcgtaacttgcgcgcggattggctctcgaacaagacccatcaacgatggcttgttccccagctcttctccagatggaacagacgctgcaatgtcaacaactttggctgtttgctccgaaggcaatttagggagagatttccgttggggcttcttcgccgcatttgcagcaggtgctttcttggcaccattttgggggaccctttgatcgagactcagtcgagctgaacgagctggggggttcgaatttccttctgtccctcctgagggtgtgttcttggagcgaccaagctttggtgatcgagctcttgttgttgggatcttcttcaactcaaccttgggaggaggtggttccttataaaagctgggcattggtgttgccttgaactttaaactctttctcagcattttgagttcagcttcttcagtttcctttgattttgcctgcaagttgcttttctccagttcctgtgcatgaatcttctcctcgagctttgagtagaactctcttcttttttcagctctctcatcacacttaaaactaaatccatatgaaggagtgctgcccaccctttgaggtttcacactttcatttgattcttcgtcaatatcgtttttggcagagcgttggtttgatgccttctgagttttattcttctcttttgagtcctcaagtgacaggctctccttggcaattgggcggaaactgctcttttcagtctttttcttactggcaccagtatcaccattgctcgaagagctatcaactatatctagatcagaaacccgtgcgatgggcaccttaggataaggactgggagagattttcctggcttcactcttatccccgccccgagggctctgtcgcggagatttagtaacaaccttcggtgaatggccttgaaccccctcaggaactcggggctttatgtcctgggattgcgaggtggcttccatttccacttcttcagacgggttgatcacctcgctctcacccgaatgtgttccatcagccagcacgtcgtgttcttctgcgtgcccccctacactatcacggggcggcaacttccccgttggcccattgtcaatgcccactgcagcaatagcatcagtaacctccgtacttgcatccatgtgacgctaccgcctcaggatttctttaggccagattagaaagataactcccaagccaacagcttgcacaagctatccgcgaccgcaatcaccgcaggatcatgctatgccggtcagcgaatgaatccgcatcaaactagactacgagagaaggaatcagctcctggcggatccgatctccgctccaccccggcggcgcccagtaggaacgaagacggcgaagaatccgagcggagggaaaggcaggcgcggtctgggtcaaaggacacctggatctggaattctggatcgagccgtgttggctcttgagcgcatgaaagaaaatggtaagggaaaa

SEQ ID NO: 19375 - DNA, 1641 bp, Zea mays
aataaatacctcaatatatatttacatgatataaaacaaccatatcaaagcaggacaaccggctagtctatgattaagtttgtggcgtgagactggtttatacggttataccacttcatcacaaagagctgagcttgagtgatatagatgccactctctctcaagtctcaactccatagccccaaatcaacaagggctaccaattatcagctgtaagtttctaaaactcagaattagttacgacaccacttactcacaatcactccgcaccacacatactaagccataaagactccaacaaagttcagttcaatgggtgtccttagagcttataccacttctcacacagcaggtcgagctggacaggaaagaagaggttttttttttttttttcaggaagcatcacataagagttttcactttccagcttgcttatgtcaaaaaacacatacatcctagatagtaaaggtgcggagggaagtaatagatctgagcacgttattttgtgctatgaagctacagtgtcgtaaatcgaaaagggaataaccgcaattttttttgattgtgtcggaaaacatatatctgctagcacttgcagctcaaaaccaagcatggcaatcgacaactacaggctatggctttgcaacgatgtggaaccagacaatgcaattctcagggctgcaaccgttgcgcttcagaaaccgtgctgatccgcacggcgaaattccttgaaacaagctgaaagactcattttctaagtgcgttcatcctgtccctcaggtaatacagcttagctctcctgactttcttcctgtccaataccttgatttctttgatgtttggcgagtaaagtggaaagacagactcgactccgacaccagccactaatctacgcaatctgaaggttgtattgatcccggcgttgcgccttcctatcacaatccccttcagcgtcgactcacgccgtttgttctcaggaacttgcaatctcatctgaatgatgcatccaggctgcacatcaggaatctccctttccgagcggaccttttcgaccgcctctttgtttaggatattcataatgtgcctggcggtcttgtcgggcctcttgaacttgatgcgcggggggtgctcaaccgcaggggaggtggaatcgtccgaatcagaagcgacctcggccgcactccccaccgtcgacagacccctcatcgcgacgataacttgtgcgcagagaccaaaaccggaggtggccgcggcaggaacgaggccatcacgcgaaacggcccggctctgcacacgtacgggttgaactaccccgatcggacgtgtgaactcgtaaggcggcctgaggagtttgacggccacggatggctgcgtcgcacccggaccagccgcggcaagctccaggagcctcgccgccgctccacggcttccggctcggcagacattccggaccaaacattgcatcctggttggtgctcgtctccggcgaagagaccacaagcctcagcgtctggcttagggcggcggcggggtctggagccctggagtgccacgcggaggcgagggttgccagcggacgggaagggtcgttgggcagcggaagggggaatgcagcgacggccggcccagttcagggttgtt

SEQ ID NO: 19376 - DNA, 1246 bp, Zea mays
cagaacaggatgcccagaacatttttcagaacaggaggtttctgtgaataaagactaaatgatttgacatctaaaaccggatagcatgaatcatcatacaatagtttcgctttgatgagtaaagtgttccagcttgttcatgtcagacgcacatactaaaaaaagattgggaaagtaacgtaatagacctgagcacatgaattttcgcactaatgttacagcgcatcaaatcaaaagaaagaagatcggagcatggcaactgacaaccccaaactatgatttttttcaaagatggaacaccaaacaatgtgattgcatcttgagaaaccatgctgatccgcgcggcaaaaagaaatcctagaaacaagttgaaatcctcatcttttaagtgcgttcatcctgtccctcaggtaatacagcttagctctcctgactttcttcctgtccaagaccttgatttctttgatgtttggtgagtaaagtggaaagacagactcgactcccacgccagccactaatctacgcaatctgaaggttgtattgatcccagcgttgcgccttcctatgacaatccctttcagtgtcgactcgcgccgtttgttctcaggaacttgcaatctcatctgaatgatacatccaggctgcacatcaggaatcgccctctccgagcggaccttttcgaccgcctctttgttcaggatattcataatgtgtctagcggtcttgtcaggcctcttgaacttgatgcgcggggggtgctcaaccgcaggagaggtggaatcgtccgaatcagaggcaacctcagcagcatttcccgccgtcgacagacccctcgtcgcaacgagaactttcgcgcagagaccgaatccggaggcggcagccggaacgcggccgccatcacgcaaaatggtccggcgctgcacaggcttgggttgatctaccccgatcggacgagcgaacccgcaaggatgcctgaggtgtctgacggccgaggacggctgcgccgcccccggatgaaccgcggcggcctccaggagcctcgccgccgctccacggcttccggctcggcagacattccggaccaaggactgcatcctgaggcccgtgccctggtgggtgctcgtcgccggcgaagagaccaacgaaagcctcagcacctggcttgggcggcggtggcggcggagggatgcagcggacggaagggggggaatgcagtgcagcgacggccggcccagtcagtgttgtt

SEQ ID NO: 19377 - DNA, 2870 bp, Zea mays
gatattcccccaccacccacaccgagccaccgaggcgcggcaggaaggaaaacagcgctgcggcctgcgggaatagagtgtgtcgctgtaaaaacaggggagggggacgcgcccgctgccagtgcctgccgcacacgcgtgacgcgtttagcctttaagtcccactcctcgccgccccagatctccgccctcctcaccactgcccccccattccccggcgcccagcacccggcgccgcaaccgccgcagtccggagcaagatcggtgggtagacggacgggcgacaggcgggcgggcgcggctctgtctgtatctatctgttggtgggagaccggttgtgtcggttaggcggcggcgggtgggaaggaagaatggcggcgggcggcagatccatcgcgtgctttgccgccgtgctgctcgcggccgcgctgctcctctccgcaccgaccaccacagaggcctacgattcgctggatccaaacggcaacatcactataaaatgggatatcatgcagtggactcctgacggatatgtcgctgttgtcacaatgttcaattatcaacaatttcggcacatcggggcacctggatggcagcttgggtggacatgggcaaaaaaggaggttatatggtcaatggttggggctcagaccactgaacagggtgactgctcaaagttcaagggcaacaccccccattgctgcaagaaagatccaacaattgttgatttacttccaggcactccatacaacatgcaaattgccaattgctgcaaggcaggagttataaatacctttaaccaggacccagcaaatgctgcttcctccttccagatcagtgttggtcttgctggaactaccaataaaactgttaaggtgccgaagaacttcactcttaagactccaggccctgggtacacatgtgggcgtgctattgttggcaggccaacaaagtttttcactgcggatgggcgcagggtaacccaagctctaatgacatggaatgtgacctgcacatattcccaatttcttgctcagaagactccgtcctgctgtgtatctctctcatcattttataatgacacaattgtgaactgcccgacatgctcatgtggctgccagaacccaagtgggtcaaactgtgtgaacgaggattcacctaatctacaagccgcaattgatggtcctggtaaatggactggccagcctcttgtacaatgcacttctcacatgtgcccaataagaatccactggcatgtgaagctcaactacaaggaatactggagagtgaaaatcactatcacgaacttcaacttccgcatgaattacacacagtggaacttagtcgctcagcatccaaactttgataatatcactcagttgttcagcttcaactacaaaccacttactccatatgggggtggcataaatgatacggcaatgttctggggtgtaaaattctacaatgatttgctgatgcaagccggcaaacttgggaatgtgcaatcagaactgcttctccgcaaggactcacggactttcaccttcgaaaagggatgggccttcccacgccgagtgtacttcaatggtgataattgtgtcatgccatctcctgaaaattatccatggctgccgaatgcaagccctctaacaaaacaagcattgacactcccactcttgatattctgggttgccttggctgttctgttggcttatgcatgatgagtgggatcaagatgtttagcaagcttcaagttgatgtcggattccatgaggtgcactgcaacgggatatttattcattcaattccatagcggcacaggagagatgaggcgaagccaagaaaaagtggatgtgtgtgtgtgtgtgtttgtaagttaaagggccaaaatgtatttcttgtctggtagtatatagcagctctacaacactttggtgaacttagttactgcaaattaggcaattacagttgcaccttttgtattttatagcaaacccagacttctattggattctatgactgcccctcttgtagtaaacgcaaggcttcactggtactcctgtttaaagattggtcaaatagaagagacgacggtgattgtctgattgagataactaagttctggtgtcttgatccatttgaccattctgctgcaaagattattgagctaaattgctaataacaagtgttaactgttgactgaaccaaaattacgtgtgcaaaagaaacaacgaaccacaataagactgtctgcagtagataagataaaggagacgcaggcactgtttacatagtagagtttaaaatattacaattatatgtctcatgttttactctgtttattatagatagtctgagtccggcagcgggtaccggaaacgtgtcgtggatgcgtattattcgcggcgtgtggccctgtggatgcatccagcaggtgaggccatggacgtgcctgctatagaaagagagtgcggtaacatccgcatcctctctcctctgtccattcacatcttccctgttttcgtcggtacagacatgctgacgcgcagtccgaatacggtagctactggatgacgggcctcctatccgcgctcgctgatgggtcccactgcagaacgaggtgttttccgcgttggggctgtctccaccaagggccctaatgccgactccagcaagaatcgctgcatggttctgaacctcagctaaaatagagtacgagcagcgcatgcaacgatacgattcttgtttcgctattatttattaagagaatatagtatgttaatatagttggtatattatagaggataaaatttagaatacgctgctggagatggtaaagatatagaagacgatttttttagagtgaactg

SEQ ID NO: 19378 - DNA, 1538 bp, Zea mays
ttgggaccctcgaggccggccggggtaattccgttttcattgctcacactgctgtctccgttccatcccctacgagatctgccccctcgccctcgccctgctccaatccccatctccttgcggcccgatccaccctgctccaatcccccggcgatggtcgtgtgcaaatgccgaaaggcgacgagggtttactgcttcgtccatcaggtccccgtctgtggcgtgtgcatatgcttcccggaacatcagctatgtgtggtgaagaactatgctgaatgggttgttaattctgagtatgactggccacaacactgttcgtcttgcaattctgttctcgaaggtggaactgaagaaacaacacgattgggttgcttgcatgtggtacacaccaaatgcttgatatcacatatccaaagttttcctacccaaacagcaccagatggatacgtctgcccctcctgttctgcacccatatggccaccttctagcattaaagatacaggttcgcgccttcacactgaactgaaagaagcgatagtccagactggaatggagaaaaatgtatttggaaatcattatgtgacaatagctaaagctgatactcagacacctcctgcttttgcatcagatcctctcaaaactttatccaatcgtgatgatagagaatttaatagtgcaaatgcagctaaagatgctgctttgccatcaacattacattctgggatgtactcttctgctgtaggatctgagacaactattcatgttgatccagaaattgttgaaatagagggttctagtcctgtatcgacccaattttcagtgcaggactccaacttcatcaggagtccaagcccacatgggcctggtgctatgacaagaaaaggcgctaatactgttgatagacaaaattctgagatttcttattatgctgatgatgaagatggaaataggaaaaagtatactaaaaggggtacatttcgtcacaaatttctaaggatgctgctgccgttctggtccagtgcactgccaacgctaccagtcacagcaccatcaaaaaaagagagtgatgctctagaggggagtcgatcacgccatcagagatcatcaagaatggatcccactaagatcttacttgcaatggctatcatggcatgtatagcaactatgggaatactctattaccggttgtcacagcgaggtctttctgaaaccttcctagaggacgagactcagtaatcttgccttcctgtattgcgttgttgctgattcaaaggattttaccctctgtattttttttcgtttaccctttgtgggcctttttggtggtttgaaggtggggtagtggttagtagactctttctatattccgattcatgctcatgtttatgtgactactataatggtatatacaatattgtattatctacagctgagatcatagaaaatttaacccatggacagttcaaaaaaaaaaaaaaattctaatgtagtatttcctagtttctgtttaaaaaaaaaaaggaaagagctaacaagtt

SEQ ID NO: 19379 - DNA, 3255 bp, Zea mays
gggaccctcgaggccggccgggccgggagcgctgcggaagggggtctcgtgctgctgcttccgctgcagtaaaatacggggaagaggaggggagggagacgcggccgctgcctgccgcacatgctttaagtcccactccccaccaccccagatctccgccctcctccccaccgccccccattcctcccctcggccgcaacgtagtcgccgcactacggagcaagatcgtcgggtagacggacggacgggagggcgggcgggcgcggctctgtatctatctgtcggtgggagaccgcgtgtgtcggttaggcggcgggtggcaaggaagaatggcggtgggcggcagatccgtcgcgtgctgtgccgccgcgctgctcgcggccgcgctcctcctctccgcaccgactgcaacagaggcttatgattcgctggatccaaacggcaacatcactataaaatgggatatcatgcagtggactcctgatggatatgtcgctgttgtcacaatgtttaattatcaacaatttcggcatatcggcgcacctggttggcagcttgggtggacatgggcaaagaaggaggttatatggtcaatggttggggctcagaccactgaacagggcgactgctcaaagttcaagagcagcccaccccattgctgcaagaaagatccaacaattgtcgatttacttccaggcactccatacaacatgcaaattgccaattgctgcaaggcaggagttgtaaatacctttaaccaggacccagcaaatgctgcttcctccttccagatcagtgttggtcttgctggaactaccaataaaactgttaaggtgccaaggaacttcactcttaagactccaggccctgggtacacatgtgggcgtgccattgttggcaggcctacaaagtttttcaccgcggatgggcgcagggcaacccaagctctaagtaagttgcccatgtactgaatttttacattttacttgctatcagttgcttatgtatgttctggaggtgaggtacagctacatcatattatttagtgtgttcctgttccttgaccatgattccaaattttcaggttacattagttgccaggctagtaaaaatggaaacaatctaacaagaggaatttgttcacaaaggattaatgctaattgatatttgctgacaataagttactactaggatcaacaaaaaatgcagtctcttttcttcttttttgtttgttcttcacaaaataatatattctaatcgcagatagtcctaggaagaattccatacaagttgcacttttgtctagattttatagcagagagggttcttaacagagacattctttatctgcagtgacatggaatgtgacctgcacatattcccaatttcttgctcagaagactccatcctgctgtgtatctctatcatcgttttataatgacacaattgtgaactgcccaacatgctcatgtggctgccagaacccaagtgggtcaaactgtgtgaagtgagttgatctgccttttgctcttaattcatgtcctattagggttctattttttatctaaagtttttaaatgaattctattgcattttgcagtgaggattcacctaatctacaagctgcaattgatggccctggcaaatggactggtcagccccttgtacaatgcacttcccacatgtgcccgataagaatccactggcatgtgaagctcaactacaaggattactggagagtgaaaatcactatcacaaacttcaacttccgcatgaattacacgcagtggaacttagtagctcagcatccaaactttgataatatcactcagttgttcagcttcaactacaaaccacttactccatatggtggtggcataagtaagtaaacttgccatccttatagaaaagaacaaaaataaagcaacctacctcctgatgtaatttgtctgtcccatttcagatgatacggcaatgttctggggtgtaaaattctacaatgatctgctgatgcaagccggcaaacttgggaatgtgcaatcagagctgcttctccgcaaggactcccggactttcactttcgaaaagggatgggccttcccacgccgagtttacttcaatggtgataattgtgtcatgccatctcctgaaaattatccatggctgccgaatgcaagccctctaacaaaaccattggcactcccattcttggtattctgggttgccttggctgctctgttggcttatgcatgattagtgggatcaagaggtttagcaagtttcaagttgatgtcagattccatgaggtgcactgcaacaagtcatttgttcattcaattccatggttgcacagaaaagatgaggcgatgccaagaaaaagtcgatatgtctatgtgtttaagttaaagggccaaaatgtatttcttgtttggtatataacagccctacaacactttggtgaacttagttactgcagattaggtaattacagttgcaccttttgtattttatagcaaacccagaatttttcattggattctacgactgcccctcttgtagtaaatgcaaggcttccctgatactcctgtttaaagatttgtggattgggtgagacaatggtgattgagataactaagttctggggtcttgatccattttgctgtaaagattattgatctaaattgctaataactacacgtgttcactgttgactgaaccaacagaaacttcaataataatcaggtcacagaaaatagaaaccacaaacattaccttgcagtttcaattaagatttaaatctatcattaccctagcaacaagaatatgacataaatcctagatggcttgagaactctaggagcctaattggttacatgatgtcatataataacattactagtacaatgatcgtgtgttttgacacacacaatcatatttgatggtattgatttagtggctagaccctaccccaacagtgcaacggctgaatgacatgtaaggaccttaataagctagtatggagtatggtggaccatcttaaaaataaccataaaaataaattaataagctagtatggtgggccatcttaaaaataaccataaaaataaattaataagctagtatagtggaccatcttaaaaataaccataaaaataaatttaatattaaaatgaacatagagtcaatatatcatatattaaaccgacaagaataaatattaaaattatcttaaacaaaaggtcaaagaaaagtatg

SEQ ID NO: 19380 - DNA, 2715 bp, Zea mays
  misc_feature (16)..(23): n is a, c, g, or t
  misc_feature (2170)..(2196): n is a, c, g, or t
  misc_feature (2289)..(2295): n is a, c, g, or t
  misc_feature (2607)..(2607): n is a, c, g, or t
gccggccgggccgggnnnnnnnngccggccgggtcggcgctgcggagagtgtctcgtgctgctgcttccgctgcagtaaaatacggggaagaggaggggagggagacgcggccgctgcctgccgcacatgctttaagtcccactccccacctccccagatctccgccctcctccccaccgcccccattcctcccctcggccgcaaccgtagccgccgcactacggagcaagatcgtcgggtagacggacgggcgggcgggcgggcgcggctctgtatctatctgtcggtgggagaccgcgtgtgtcggttaggcggcgggtggcaaggaagaatggcggcgagcggcagatccgtcgcgtgctgtgccgccgcgctgctcgcggccgcgttgctcctctccgcaccgactgcaacagaggcttatgattcgctggatccaaatggcaacatcaccataaaatgggatatcatgcagtggactcctgatggatatgtcgctgttgtcacaatgtttaattatcaacaatttcggcatatcggcgcacctggttggcagcttgggtggacatgggcaaagaaggaggttatatggtcaatggttggggctcagaccactgaacagggcgactgctcaaagttcaagagcagcccaccccattgctgcaagaaagatccaacaattgtcgatttacttccaggcactccatacaacatgcaaattgccaattgctgcaaggcaggagttgtaaatacctttaaccaggacccagcaaatgctgcttcctccttccagatcagtgttggtcttgctggaactaccaataaaactgttaaggtgcccaggaacttcactcttaagactccaggccctgggtacacatgtgggcgtgccattgttggcaggcctacgaagtttttcaccgcggacgggcgcagggcaacccaagctctaatgacatggaatgtgacctgcacatattcccaatttcttgctcagaagactccatcctgctgtgtatctctctcatcgttttataatgacacaattgtgaactgcccaacatgctcatgtggctgccagaacccaagtgggtcaaactgtgtgaatgaggattcacctaatctacaagctgcaattgatggtcctggcaaatggactggtcagccccttgtacaatgcacttcccacatgtgcccgataagaatccactggcatgtgaagctcaactacaaggattactggagagtgaaaatcactatcacaaacttcaacttccgcatgaattacacgcagtggaacttagtagcccagcatccaaactttgataatatcactcagttgttcagcttcaactacaaaccacttactccatatggtggtggcataaatgatacggcaatgttctggggtgtaaaattctacaatgatctgctgatgcaagccggcaaacttgggaatgtgcaatcagagctgcttctccgcaaggactcccggactttcactttcgaaaagggatgggccttcccacgccgagtttacttcaatggtgataattgtgtcatgccatctcctgaaaattatccatggctgccgaatgcaagccctctaacaaaaccattggcactcccattcttggtattctgggttgccttggctgctctgttggcttatgcatgattagtgggatcaagaggtttagcaagtttcaagttgatgtcagattccatgaggtgcactgcaacaagtcatttgttcattcaattccatggttgcacagaaaagatgaggcgatgccaagaaaaagtcgatatgtctatgtgtttaagttaaagggccaaaatgtatttcttgtttggtatatagcagccctacaacactttggtgaacttagttactgcagattaggtaattacagttgcaccttttgtattttatagcaaacccagaatttttcattggattctacgactgcccctcttgtagtaaatgcaagcttccctgacccctgtttactaaaaaaataggggcttgcccgggatcgacccaattttcagtgcaggactccaacttcatcaggagtccaagcccacatgggcctggtgctatgacaagaaaaggcgctaatactgttgatagacaaaattctgagatttcttattatgctgatnnnnnnnnnnnnnnnnnnnnnnnnnnnactaaaaggggtacatttcgtcacaaatttctaaggatgctgctgccgttctggtccagtgcactgccaacgctaccagtcacagcaccatcnnnnnnngagagtgatgctctagaggggagtcgatcacgccatcagagatcatcaagaggtttagcaagtttcaagttgatgtcagattccatgaggtgcactgcaacaagtcatttgttcattcaattccatggttgcacagaaaagatgaggcgatgccaagaaaaagtcgatatgtctatgtgtttaagttaaagggccaaaatgtatttcttgtttggtatataacagccctacaacactttggtgaacttagttactgcagattaggtaattacagttgcaccttttgtattttatagcaaacccagacttctncattggattctatgactgcccctcttgtagtaaacgcaaggcttcactggtactcctgtttaaagattggtcaaatagaagagacgacggtgattgtctgattgaggt

SEQ ID NO: 19381 - DNA, 1951 bp, Zea mays
  misc_feature (1028)..(1034): n is a, c, g, or t
ccggccgggatggatagacagaccatccgcggcgccgaggcaggggcccggcaagcgtgagcgatcccggcgctttccccaaaaaatccttcgcttttcgggaaagaaccccagcgccgagaggaagaggagggatctcgtcgacacgccgtcgggaacgcgtcccccgttccctcgccgctgccccgacacggtgccgttctcgcccgaatcggcgaatccctcccaccgcttcgcctataaatctccccctctgtggccctgatcctcccgtacaacagtgcccagtgcccaccgcggcagatcttcgacgcctccgagggcgatggaggaggacggcggctccggcagcgatagcatggagttcgtcgcgggagcggagactagcgctggcgcaggcacaaacgccggcaggaaccgcggcgtgggtgcagggaccagcgtaggcggtggcggcggcacgaagctgccgcatgtgctgcaaaagagtttcggcgaggtgcaagggattctggagcacaaccgcgtcctgattcaggagatcagccagaaccaggagacgcgcgacgcggacggtctcagccgcaacgtggcgctaatccgggagctcaacactaatatcgcccgcgtcgtggacctctacggcgacatgtcagggtccttcgcccgcgccgtcgccgccaagaaagacgccgcaggcgacaagtcgggccctaagaggccccgctccgccggcgctggagggcagcagcagtagagccggcgtcttatccagttaatccatcagaggaggctccgtcgtgattgacggcgggggtcaggaaacttcggggttggggtgggtgcactgcattggaaacctcctcttttttttttctccgtccggtgaaaggtgacttgaatgatgtactgctggattaactagtttggtgttgagaattgagatggacatggcgtggacaccttcttgttgtcagtcggtgttgattgctgaatcaaagatgcagctaaaaaactgattcaggttnnnnnnnaccatcattgttggcgccagcatcactgtcgtaaggccctaggtgttttttttttttttttttttttttgaatcaaataaatcatctcattgataaccagaaaacgcagcagggtagtacatgatcgccgcgacaaacagtggcgcgtcgaagcacgtaccacccaccacgcgcacacctcctcctccgccgccgccgcggccgactccatacatacacacacgcccgccgacacctcacacagagacacgcacgacacacgagctggactcacgcgcgccagaccagacgaatcatattttggagcaggaaccacgtatccagcgcggatctagcagaagaggtagccgaaggcggcggcggcgagggaggccgcggcgaggggtacggcggccgcggcgtcggacgcgggagccggggcgggggcctcggcggctgcggcggacgccacgagcgcggcggccatggcggcgacggcgacgaacttcatcctgaggccggccatctgcgagtctgtagtaagccgggtgtttattgggccgcgccggatctctcttcgagggtacgaagctctagagagatggcgcccaagcggcttgctggctggctggctggctcgagtggggaggtcccggacccgccggcgcaggggcgagggttttatagagcgggaaggggcggaggctggagggccccccgcgcggcgcggccaggtaggttgcgtgaggcagtggggctggggcgaccgggcaagggccgcacgacgcgcacggctggctggccatttgttgggttccgccgcgtttggtggcgcgccggtcaggcagcctggagttgccgttgggatcgtttctgctctgctgacccacgcgcgcgtctgagcgcgtcgccggccgcctcgcccgcccgccccggct

SEQ ID NO: 19382 - DNA, 3161 bp, Zea mays
gggattatgtgcagaagaagttgaaaagatccatagagtttaggatctagaaagtgacagattcatactattgcaacaacttagtcgatttcgtgtttatgttgattttagatagtttttaccaaatcgatttttatagaagttgactgaaaaactgatcgtttgatcgtccgcagcagtttttgatggctagaagctgaaacaaatagtgcatttattggtttttacgtacatgattattatatcgggtgttaaaatatagtacatttttttattgtgtacctctatttgtatctatatataaaaggaatattttgatctatataaagctaaaaaacacaagatatgaatagttatgatcatttacagtaatgtttttatagttggcttaactatttttaggcgagttatacagttcgatgggcattttacggaagccagacgccggcatatctccacgccaacggcaccaccaccgtggcctgaatcacgaggcatagcgacaaacggtagtagaaggaaaagccgagaccggggcgtgctggtgaagagccgggggtccccacggcacaaaaaaaaaaaaaaaaaaaaactccgtggacggcaggatccacatggatagacagaccatccgcggcgccgaggcaggggcccggcaagcgtgagcgatcccggcgctttccccaaaaaatccttcgcttttcgggaaagaaccccagcgccgagaggaagaggagggatctcgtcgacacgccgtcgggaacgcgtcccccgttccctcgccgctgccccgacacggtgccgttctcgcccgaatcggcgaatccctcccaccgcttcgcctataaatctccccctctgtggccctgatcctcccgtacaacagtgcccagtgcccaccgcggcagatcttcgacgcctccgaggtacattccgtgctcccccaccgcccccttcccaccagaatattttctctgaaccatggctgccgcgtgatcttttttcgagcctcgctctctctctcgttttcttttctttttccgggatagagtaaggattttcggaacttctcttgaaaaattcgtgggcggacagggcgatggaggaggacggcggctccggcagcgatagcatggagttcgtcgcgggagcggagactagcgctggcgcaggcacaaacgccggcaggaaccgcggcgtgggtgcagggaccagcgtaggcggtggcggcggcacgaagctgccgcatgtgctgcaaaagagtttcggcgaggtgcaagggattctggagcacaaccgcgtcctgattcaggagatcagccagaaccaggagacgcgcgacgcggacggtctcagccgcaacgtggcgctaatccgggagctcaacactaatatcgcccgcgtcgtggacctctacggcgacatgtcagggtccttcgcccgcgccgtcgccgccaagaaagacgccgcaggcgacaagtcgggccctaagaggccccgctccgccggcgctggagggcagcagcagtagagccggcgtcttatccagttaatccatcagaggaggctccgtcgtgattgacggcgggggtcaggaaacttcggggttggggtgggtgcactgcattggaaacctcctctttttttttctccgtccggtgaaaggtgacttgaatgatgtactgctggattaactagtttggtgttgagaattgagatggacatggcgtggacaccttcttgttgtcagtcggtgttgattgctgaatcacagatgcagctaaaaaaaactgattcaggttctggtgagcgtgtgcatggacgacggtgcagagcacctccggcggccaagccacgaggcatgagcggatcaggtggacagcatcttgtgtgaaggttcagacggcacggcaccgtggccactaccatgatggccgaacgaagggctgaagaaacaatcaggtatcctggattctaagtagcgtgcagtactgtcctttctgtgtgctctgcagtcccgccgtaccgtacgttcgtgcactgcgagtcgatgggcaggtacaatcggatcacaaatccggcctgcaagcaatagttgggaaaggcggctccttgtttttcttctgaaacctgcttgccgtctcgaaaccagcggcggtgttccctttactaagaacagattgcgccccactgtcgaaacgcaaaaaattagcaattcataaatatacaaactcttgattcagctattttaattcattataataatatcgatcttatttagaataaacattacagtgggaactaaaagtgttttgtcgccaactcacgactgttataaactcacgactatataacaggagtgccaatgaaaggaacaaccttcacgatgaagtacaatttagtgcttcatgtcaaggcaaggtaacttgattaatagttcttatttgaagctgtcaaaagggcagggtgagaagtacaaatcatgtgccaatgttgcaacatattgaaaggaacataatctaacttagaaacagagcttcactttgtgaataccgtgtgaagtccccaacaagattgattttttacatttggtttcaaataaggtacatattcagtcagaccctcatctttatcctcagattcttttattctcctgcaaatcaaatatggatattgttagcttggaagataaaagcaaatacaataagttggtagttcgcatactgagcgacaaaggatgaaaataacaaccttggatggtgctcgctctacaggctcttctgaatctccaagcaagctcttttttttatcagcctttgattttggcaggaatgccacaacagctaaatggcatgtgtattgtaattagtattacatacgtacatgggatcttatgaagatcatgtacggtacaactaatgcaggttatcacatcaaataaactggtgggagagtggaatagttgtttaccaaaatgcacacacgacctatcatagaagaaaatatccatgagtaccagctcttctccttttcacacgctagtgagtagatagagaaaacgaggaaaaggacatagggaaggcacttcattgcaatggcatagactaaaagcaaagttagctagctctcaagaagtctatgaaaattgtaaaatgaaaccc

SEQ ID NO: 19383 - DNA, 1307 bp, Zea mays
ttttgtttcattgtattactgcattttttttcctttcacctcactgaacttggatgaacggattgaagggcttgcaggggaaaaaaaaggctaggtaggcttcgttggtcgcagataaaatcaaacctcagattgaaggctagatacgcatacagtcccgtaaaattgtgcgcgcttatatttgtgcccaggctgaaaagaatcaaataaatcatctcattgataaccagaaaacgcagcagggtagtacatgatcgccgcgacaaacagtggcgcgtcgaagcacgtaccaccaccaccacgcgcacacctcctccgccgccgcggccgactccatacatacacacgcccgccgacacctcacacagagacacacacgacacgagctggactcacgcacgccagaccagacgaatcatattttggagcaggaaccacgtatccagcgcggatctagcagaagaggtagccgaaggcggcggcggcgagggaggccgcggcgaggggtacggcggccgcggcgtcggacgcgggagccggggcgggggcctcggcggctgcggcggacgccacgagcgcggcggccatggcggcgacggcgacgaacttcatcctgaggccggccatctgcgagtctgtagtgagccgggtgtttattgggccgcgccggatctctcttcgagggtacgaagctctagagagatggcgcccaagcggctggctggctggctggctggctcgagtggggaggtcccggcccgcccggcgcaggggcgagggttttatagagcgggaaggggcggaggctggagggccccccgcgcggcgcggccaggtaggttgcgtgaggcagtggggctggggcgaccgggcaagggccgcacgacgcgcacggctggctggccatttgttgggttccgccgcgtttggtggcgcgccggtcaggcagcctggagttgccgttgggatcgtttctgctctgctgacccacgcgcgcgtctgagcgcgtcgccggccgcctcgcccgcccgccccggctgctgagtcatcaggacgaaccttcgtttcgtgtgcatattgctagtgccactaggcagcgcacgcgattctggcctggctatacttggggaaaaaaagttgcttggagacgtttcatggcaccgaaccgagttcggatcctgcggtggagtgattttggcccgttgttttcggacatggtgcgtttgcacgaattcgtgtgcgctggtgcaagtatagaacgcgtcgagtcgagaggcaatgaggcgtcatgagccccacgaggggcg

SEQ ID NO: 19384 - DNA, 4753 bp, Zea mays
  misc_feature (4060)..(4060): n is a, c, g, or t
  misc_feature (4691)..(4691): n is a, c, g, or t
agttttgttctgtttggaaaggcggagtggccggcaggggagaacttctcgcctgcttggagagaagtcgccatccgctttccaccactcggcgatttgcagctttgggtccgatacagtgctcaccaaggctcactaaatggagtctcacaatggcgaggccaatgacttgcctccaccacctcctctgattgctggggttgaaccacttaaagctgatgaaacaaagatgccattgaaacctaggagtctggtccagagaaatggatttggcagaaaggggcagccaataaagctgataacaaatcacttcaaagtttctcttgtgaatgctgaagaatttttctaccattactatgtcaatttgatgtatgaagatgatacaccggttgatcgcaaagggtcaggaaggaaagtgattgaaaaactgcagcaaacttatgctgctgaacttgcaaataaagattttgcctatcgatggtgagaagagcctgttcacaattggtgctcttcctcaagttaaaaatgagtttactgtcgtggttgaagatttttcaactggaaagactcctgcaaacggcagtccaggaaatgacagtcctcctggaagtgacaggaaagggctcagaaggccttacaatacaaagacctataaggtcgagctctcttttgcagcaaaaattcctatgagtgcaatctcacaggccttaagaggtcaggaatcagagcacactcaggaagcaattcgagtgattgacattattctgaggcagcactcagctaagcagggttgcctattagtaaggcaatcattcttccacaacaatccttccaattttgttgacctgggtggtggtgtagtgggctgtagaggttttcattctagttttcgagcaacccagagtggactttcactcaatatcgatgtgtcgactacaatgatagtgaaacctggtcctgtcattgattttctgcttgacaatcagaaagttggtgatccaagcatgattgattgggctaaggccaagcgtgcactgaagaacttgaggataaaaataagtccagcgaaccaagaacagaagattgttggtctcagcgaaagaacttgtcgtgagcaattattcacactgaaacataaaaatggtaacaatggtgactctgaagagatcactgtttatgattacttcgtaaagcagcgtggcatagtgctgcaatactctggtgatcttccttgcatcaatgtgggaaaactaaagcggccaacatattttccaattgagttatgcagtcttgtgcctttacaaagatacactaaagctttgaacacacttcagaggtcatcactcgtggagaaatctaggcagaaaccgcaggaaaggatgtctgttttatctgatgtgctgcaaagaagcaactatgatgcagagcccatgttgaaggcatgcgggattacaattgctagaaatttcacagaagttgatggtagggtattgcagccacctaagcttaaagctgggaatggtgaagacatttttacacgcaatggtagatggaacttcaacaataagaggctcattagagcttgtagtgtcgagaaatgggcggtggtaaacttttctgcacgatgcaatgtcagggatcttgtccgggatctcatcaagtgtggaggcatgaagggcattatggttgatgctccttttgctgtatttgatgagaatccttcaatgagacggtcacctgctataagaagggttgaagacatgtttgaacaagtgaaaactaagcttcctggagcacctaagtttcttttgtgtgttctagctgaaaggaagaattctgatatttatgggccttggaagaagaaatgccttgctgaatttgggatcgttacacaatgtgtggcaccaactagagtgaacgaccagtatcttacaaatgtcctacttaagataaatgcaaagctgggtggcatgaattcgttgctccaaattgaaacatccccagcaattcctcttgtatccaaggtcccaactataatcttgggaatggatgtgtcacacggttctcctggacattctgatgtaccatctattgctgctgtaagtatatttttcgtaattttctgtgatatttaataaacagtagctactgtgacagttttattttgttttacttaggttgttagttctcgtgaatggcctcttatctcgaaatacagagcttctgtccgcacccaatcacctaaaatggaaatgattgactcattgtttagcccacgggaagctgaagatgatggtctgatccgggaggggttctttgcctgctttacatttgttaagttatgtacttagacatgatttctcccattacctgttggattttgatgtttctttagggagtgtctgattgacttctacaccagttctgggaagagaaagcctgaccaagttatcatattcaggtttgttattttttatgcatctgagttagttaacttctttgcgtccaagtaactgtttggtcgataaaattggttgtctatctctcgtttcctctgttttgttataagcacaaagctgatttgtgtctaattatagggacggtgttagcgaaagtcagtttaatcaggtgctgaacattgagttgcaacaaatcatcgaggtatttttttctttttgttagcaactgtatgtgcacgctctattggttgtgttgtcatggttccttttatccaagtatcctgtactgtgtggttgtccacattaacatggtcctattacctcttcaggcttgcaaatttcttgatgagaaatggaatcccaagttcacgttgattattgcccagaagaatcatcacactaaatttttcattcctggaaagccagataatgtcccaccaggtaatcttcatcacctgccagcctgcagtggcaaccgtgtaggctcaatttttggcgaccttgttatattctctaatattctcgatggctttacctgcaggaactgtggcggacaacaaagtctgccatccaaagaactgcgatttctacatgtgtgcgcatgctggaatgatcgtaagcatcatctgcctttggatttggtctgtggtcatgtgtcattgtgggactgtcaggtggccctgaaatgagaaatgtcctgcatttataaccccccgcacaaaagcaactgtgtccacatttaaattgctccagtggatggcaaaatgctggaatgattgcatgttttttttttgccaggggactacgaggccaactcactaccacatcctgcatgatgagataggcttcagtcctgatgatctgcaggagctggtgcattcgctctcttatgtgtaagtaccaagcagaagctcttgtcttgttaagaaagttgcttgctcacaagcgattttctgggactttatttcaggtaccaaaggagcacaacagccatatcagtcggtaagttaccttcatttctgtgtcaaaccgttaacaccacccccagcagcgggaagtgatttcccttgtttgcctttctgcagttgctcccatctgctacgcacatctggcagctgctcaggttggccagttcataaagttcgatgagatgtcggagacgtcctccagtcatggcgggcatacttcggcgggcagcggtccggtccaggagctgccgcgcctgcatgagaaagtgaggagctcgatgttcctttgctgagccgtggttttacctttttggtggatggtggacccctctagttatgtcggtagacgctcttggatgacgctctagttgtggtccaggaaggctcgagctggtacgatgttaaatgttagttttttaagcgtcgctgcggctatgttggtgcctcaggaagacttggaacctggttaggatgtcgttaaatctaccccctatcgttcctggttcgttgggctgttgttcttattgtccgtcctggtgtctgatttctgctttgttgcatgcaagtgtgaggcccagcttgatattggaaagtttggcgtacatgtcgttcatttggcactctggactactnggtgggttttgctgtttttgatgacctgcagtagccaggacgcgcctctggtggtttctactgctcagtatttatgcgagtcgaccacctctgtttgcttcctacacgttgaatcacattgagctgtgaacaaccaagcttggaagttaaaacatgaaacccatctctgaccgtgtccagcagccgaattatgggtcataggtgaggctcgctcattgtcccagtccaaaaaatagactgggatcgccatttgggcgttccggtacaatgcaaggccgtgattgtagtttactaactcataaaaattccatttatgcattccgtgatatttgtagtttactaactcagaaagtcagaattgcctggaatccatagttgtggatgactgtagaaggtttactgtgctcaaagccatatccatccaaattttatttgaatcatactagatttgctctaaccctgtcaattgcatgtatattgattcaatttatagagtgaaatttaataaataaataaactcatactaaaccagagccgagttggacttgatctcctcccggttgtggactcctactacccctcgacaccttggcctttctaagtccttgattttttttctctaaagtctttnatcattaaaacatctatgacaccaagcgtaagctctaaaacacaattgactaggttagaatg

SEQ ID NO: 19385 - DNA, 1710 bp, Zea mays
gaacccatgctgaaggcttgtgggattacaattgctagaaatttcagcgtggtcgcggccggggtactgcagccccctaagcttaaagctgggaacggagaagacatttttacgcgcaatggcagatggaatttcaataataagaagctcattagagctagcagtgtcgagaaatgggcagtagtaaacttttctgcacgatgcaatgtccgggatcttgtccgtgatctcatcaagtgtggaggcatgaagggcattatggttgatgcaccatttgctgtatttgatgagaatccttcaatgagacggtcacctgctgtaagaagggttgaagacatgtttgaacaagtgaaaactaagcttcctggagcacccaagtttcttttatgtgttctagcggaaagaaagaattctgatatttatgggccttggaagaagaaatgccttgctgaatttgggatcgttacacagtgtgtggcaccaactagagtcaatgatcagtatcttacaaatgtcttgttaaagattaacgcaaagttgggtggcttgaattcgttgctccaaattgaaacatccccagcaattcctctcgtatccaaggtcccaactataatcttgggtatggacgtatcacacggatctcctggacattctgatataccgtctgttgctgctgttgttagttctcgtgaatggcctcttatctcaaaatacagagcatctgtccgcacccaatcaccaaaaatggaaatgattgactcgttgtttaagccacgggaaactgatgacgatggtctgattcgggagtgtctgattgacttctacaccagttcagggaagagaaagcccgaccaagtcatcatcttcagggacggtgttagtgaaagtcagtttaaccaggtgctgaacattgagttgcaacaaatcattgaggcttgcaaatttcttgatgagaaatggaatcccaagttcacattgatcattgcccagaagaatcaccacactaaatttttcattcctggaaagccagataatgttccagccggcactgttgttgacaacaaagtctgtcatccaaggaacttcgatttctacatgtgttcacatgctggaatgattggaactaccaggccaactcactatcacatcctgcatgacgagataggcttcaatcctgatgacctgcaggagctggtgcactcgctctcttacgtgtaccaaaggagcacaacagccatatcagttgttgctcccatctgctacgcccaccttgcagccgcccaggttgggcagttcataaagttcgacgagatgtcggagacttcatctagccatggggggcatacctcggcgggcagcgtccctgtccaggagctgccccgtctgcatgagaaagtgaggagctccatgttcttctgctgagcagcagggaatgtgtcccttggtttttaccgttttgggtgtatggtcgggggttatgaacccatgaacttgttgcgtcacttggttccagcctcaggaagaactttgtaggatttttaagcatcgttgcagttgtgctgggtggcacgctgcaaccattttggctagcttgttgcagcacttggtgccttcctgagaggaagtagacttggaacctggtagcacgccgttaaaccatccttttaagcgttgctggttcggcctcaaaaaaaaaaaaaaaaaaaaaaa

SEQ ID NO: 19386 - DNA, 892 bp, Zea mays
ccggccgggccggggtatcctacaccagttcagggaagagaaagcctgaccaagtcatcatcttcagggacggtgttagtgaaagtcagtttaaccaggtgctgaacattgagttgcaacaaatcattgaggcttgcaaatttcttgatgagaaatggaatcccaagttcacattgatcattgcccagaagaatcaccacactaaatttttcattcctggaaagccagataatgttccagccggcactgttgttgacaacaaagtctgtcatccaaggaacttcgatttctacatgtgttcacatgctggaatgattgggactaccaggccaactcactatcacatcctgcatgacgagataggcttcaatcctgatgacctgcaggagctggtgcactcgctctcttatgtgtaccaaaggagcacaacagccatatcagttgttgctcccatctgctacgcacaccttgcagccgcccaggttgggcagttcataaagttcgacgagatgtcggagacttcatctagccatggggggcatacctcggcgggcagcgtccctgtccaggagctgccccgtctgcatgagaaagtgaggagctccatgttcttctgctgagcagcagggaatgtgtcccttggttttaccgttttgggtgtatggttctgaacccattgcgtcacttggttccagcctcaggaagaacttaacctggttgtaggatgctgaatggtaggatttttaagcatcgttgcagttgtgctgggtggcacgctgcaaccattttggctagcttgttgcagcaacttggtgccttcctgagaggaagtagacttggaacctggtagcacgtcgttaaaccatccttttaagcgtgttgctgattcgcc

SEQ ID NO: 19387 - DNA, 5004 bp, Zea mays
tgagaaatggaatcccaagttcacatggatcattgcccagaagaatcaccacactaaatttttcattcctggaaagccagataatgttccagctggtaatcttcaccttccaagtctgctgttggtgctgtgtgtaggctcatgtatcggtggccttagtatattctctaaccatctgaatggctttatctgtaggcactgttgttgacaacaaagtctgtcatccaaggaacttcgatttctacatgtgttcacatgctggaatgattgtaagcgttatctgcctttgtgtttggtctgtgcagtgcagtcaattggtgtcgttttgggtctgttatagtttgccctgaaatgaggaatttcctgtgtttataaccccacaaaagctactgtgtcccgaattaaactgtcaatgggccttcgcagcatcggtggtaaacttagttgtattgctccagtaggtggccaaatttgatgtcgttttatttgtgtactcgtgctgtcatcatctcgtctcattgtgtatccttgggtttcactggtactttggttctgtactgctgctgccgtaagtttgcctaggaagacatggtttcttcctgtgaatcgatagagctaagtgccgtgttttcttttgccagggaactaccaggccaactcactatcacatcctgcatgacgagataggcttcaatcctgatgacctgcaggagctggtgcactcgctctcttatgtgtaagtaccaaacagagtctcagggaaaaaaaaaacttttgctgacttgtcctgttaccaaactttcctgctcacaaggggttttctggcacttcaattccaggtgccaaaggagcacaacagccatatcagttggtaagtttatcttggcaccgtttttcgtttatgtcaaactcttatcacctgcatcgtgtgccaaaggagcacatcagccatatcagttgttgctcccatctgctacgcccaccttgcagccgcccaggttgggcagttcataaagttcgacgagatgtcggagacttcatctagccatggggggcatacctcggcgggcagcgtccctgtacaggagctgccccgtctgcatgagaaagtgaggagctccatgttcttctgctgagcagcagggaatgtgtcccttggttttacctttttgggtgtatggtcgggggttctgaacccatgaacttgttgcctcacttggttccagcctcaggaagaactttgtaggatgctgaatggtaggatttttaagcatcgttgcagttgtgctgggtggcacgctgcaaccattttggctagcttgttgcagcacttggtgccttcctgagaggaagtagacttggaacctggtagcacgtccttaaaccatccttttaagcgttgctggttcggcctcaaaaaaaaaattgtcgtgctttgttggctgtgcttgtgggtgatttttgttttattgcaagggtagcgtgcaatgccttttccgttagactacttgcgctctggttgtgcgtgcaaggatggagagcaacgcccgagagcaaccgtttctcgaggtactccctctagaggcccctaggaacggagttctgtagcccgttcagttattacggattggctggctagaattatccctagccaacttgtttctctaatttatataaaaactttgatcagctggaagggtggagtaatcccgcataaacgaacaagggtcctgctgggagttgctctcgctagcttggttcaaaattcaatcaaattgaccaacagaagcatccgagcatgagaagaatatactacgatgtacgaagctatggttctattaccagatcattcaatacagaaggtgtaaactcccttttctttgtacgggccgagtcaagaatggaaaaaatggcgaaccacggctctgacaagctcataagttgactttacgtttgtatatcttcgtgataatatttgtccagctatgattccttcgactacttgcttatctcccccgcattaggacctcaggagctaaattaaaagtgactgaaatttagtcattttaaagctaaagatccaaacatgaagaattaagagggactaaattgatacttttttttaccattttagtcacttttagctcattttgtttagatctttagctcctaagtaattaagctttagtcgctttttcttgagctcatgatacaaacaggttctaaataatttaaactaattaaccaatgttatctatagtctctatactggtaaaagtagtcaccgcatccacttcaataaaccaaaaaaagttagatgtatttaccttaaatgcccacaaaggctaaggccctactggggacgtaagatcctcttgtacgatgtattcatgtacctaatcgggagcttttagctctatgctacaaacaaatctgcgaaaaagttaagtgcatatttccttgggtgatgtacacacctaacctaaacctccgctgacccacaacagcttgacatatgccacacacgcacgtcatgctcggccgcgtctccatgtgctcgattgctgaagctggaggaacagacagacacgccactcattaagaatcattatcttaacaaaaaaaaaatgctgaagaacaatgacatctgtcaaccagtcctaagctttctatatatttggcaaaacaaaagacatgataaccatgaccaagatataagaaaatgtatgaacataaattacataaaaacgatgctatttacatcattattgagaaacaattgcaaaagatgatcaagcggttacctgcagggcggtatgcctctgttctggctcagagaggaattaacacatccaggttttctgtcatctgccactccttcggatatacaagatgtttatcttctaggcgaagattaacattcataatttttgaacaaccagttggtatgccctccatatgagtttcatcttctacaagctgctctataaatgttgttgcctgtatgtatcattgctaatttcaatcagaaggagcacagttattacttatgtgaacgataggtataaatagaatttagtttcagaataaaatatatggggatgacttaggaagaatgttatctactgtattaatctcagtagctatgtgcaagaaaaacatccataatcgctttctgcaatctttcacaatagacaacagagagggactacatgctgaagtactccatgtccctatcagaatacaataacgcaatgaagacattgtgccatgtggattcactctaaagatttgtctggtataaggtggagaggcatcaagtggccaaaacaagtctatacagatgtgactaacactgaaactattgagaagtatgacactattcaaattaagggcgtcttcttagcaaaatgcacgagggttgtcttaccgttcgaggattttttatttattaaatttcactctatgaattgaatcaatatacaggtaattgccagggttagagcaaatttagtatgattcacacaaaatttggatggatatggctttgagcacggtaaatcttatacaatcatgcgcaactatggaaggcctgactttctgagttagtaaactacaaatatcagggaatgcaaaaaaaaaaaggagcaattcagtcagggcgcaggcgcgtattctaagcaggcaaaaacaaaatggcgatcccaatctgctgcacttgtcaccaaagaaaattgaccaggctattttatgagcaaacgcgtataaatggaacttctcgacagggacataagcaggagccttacctgaaacccatctctgaccgtgtccagcagccggatgtaattccacgcctgacgagccctcttgtcggcgtcccagagcatactgctattgaaagcaaagcccgaagtattgacatgaaaccttcgttgcctcttggtcctctcgttcgtgtgccatcccactacctggctgttgtcacaaaccggcccttccacaagtgtcttgctcttccccacgcccagcattgcgactggccaggtgccaaaactcctatgtaacgcaacatcgatcataatgggtttcaaattccagtacagaattgacccaatcaattccaatcggaaacagggtcgcgaatgcgtgtacgtaaacgcgagtggggggaaactaagagaggtacgatgtgcgcctttaccttatgccgcgaagctggtcgaagaggtcaagggagtacacgttgtcctcgtcggcgaagtagacgaggccgtggatgcggtggtgctcgatgtggtcgagcgccgcgttcctctggcgcaggccgcgcgccgccgggtgctcgggcctcgtccggcgagcaccgggcgcgtcgcggtgggactgggagggcaggtggcggtacatgaggccgcagccgcggagcagcgcggcggtctcgcgcgtggcggcgccgcggtcgacgacgagccagagcagcggctgcgggacgaggcggagggtgtgcgcgaggcggtgcaggtagtacgcctgcagcgggcgcgcgcgggtcggcgtcacgacgatcagggtcgtcgtcggtggcggccggactagggcccgctgggtcggcgcagcgggaggagggtccgcgagcgggaggtggcggaggtcgaggtcgaggtggaggtggcggtgcgcgaaggggaagaggccggcgacgaagccgaggaggaagcagaggatgaagcacggcgacgagaagggccgccgcgtcgagaacggcagagccgccatggttttttgctgccgcgtcactcgcggtgcggtgtctgccgctgtgctgcgtgggatgggggtggggaggggtgtgggcaccttctggggactagctggcagaaggtgctatggcttccggcttttggtggggaaaagccggggaggacgatgatggaatcagcgacgggagacggggagagacgacagcctcgtgccctgccgcgcagaggcagaggtggacggact

SEQ ID NO: 19388 - DNA, 3350 bp, Zea mays
  misc_feature (738)..(742): n is a, c, g, or t
  misc_feature (908)..(930): n is a, c, g, or t
  misc_feature (3235)..(3236): n is a, c, g, or t
aattcggcacgaggctccgctccgctcctcactcccgctcccccgctcgctgttggtggaaatctagggtttcggtggggttcttgccgctgcggttgttcgtgcggcgcggatttagggagggttctgaggcgagggcttttgccccctcgagcgatttgcagctttgggtccgatacagtgctcatcaaggctcactaaatggagtctcacaatggcgaggccaatgacttgcctccaccacctcctctgattgctggtgttgaaccacttaaagctgatgaaacaaagatgccattgaaacctaggagtctggtccagagaaatggatttggcagaaaggggcagccaataaagctgataacaaatcacttcaaagtttctcttgtgaatgctgaagaatttttctaccattactatgtcaatttgaagtatgaagatgatacaccggttgatcgcaaagggtcaggaaggaaagtgattgaaaaactgcagcaaacttatgctgctgaacttgcaaataaagattttgcctatgatggtgagaagagcctgttcacaattggtgctcttcctcaagttaaaattgagtttactgtcgtggttgaagacgtttcaactggaaagactcctgcaaacggcagtccaggcaatgacagtcctcccggaagtgacaggaaaagggtccgaaggccttacaatacaaagacctataaggtcgagctctcttttgcggcnnnnntccctatgagtgcaatctcacaggctttgaggggtcaggagtcagagcacactcaggaagcaattcgagtgattgacattattctgaggcagcactcagctaagcagggttgcctattagtaaggcaatcattcttccacaacaatccttccaattttgttgaccnnnnnnnnnnnnnnnnnnnnnnnagaggttttcattctagttttcgagcaacccagagtggactttcactcaagcccgccgggtcggctacaatgatagtgaaacctggtcctgtcattgactttctgcttgccaatcagaaagttggtgatccaagcatgattgattgggctaaggccaagcgtgcactgaagaacttgaggataaaaataagtccagcgaaccaagaacagaagattgttggtctcagcgaaagaacttgtcgtgagcaattattcacactgaaacataaaaatggtaacaatggtgactctgaagagatcactgtttatgattacttcgtaaagcagcgtggcatagtgctgcaatactctggtgatcttccttgcatcaatgtgggaaaactaaagcggccaacatattttccaattgagttatgcagtcttgtgcctttacaaagatacactaaagctttgaacacgcttcagaggtcatcactcgtggagaaatctaggcagaaaccgcaggaaaggatgtctgttttatctgatgtgctgcaaagaagcaactatgatgcagagcccatgttgaaggcatgcgggattacaattgctagaaatttcacagaagttgatggtagggtattgcagccacctaagcttaaagctgggaatggtgaagacatttttacacgcaatggtagatggaacttcaacaataagaggctcattagagcttgtagtgtcgagaaatgggcggtggtaaacttttctgcacgatgcaatgtcagggatcttgtccgggatctcatcaagtgtggaggcatgaagggcattatggttgatgctccttttgctgtatttgatgagaatccttcaatgagacggtcacctgctataagaagggttgaagacatgtttgaacaagtgaaaactaagcttcctggagcaccaaagtttcttttgtgtgttctagctgaaaggaagaattctgatatttatgggccttggaagaagaaatgccttgctgaatttgggatcgttacacaatgtgtggcaccaactagagtgaacgaccagtatcttacaaatgtcctacttaagataaatgcaaagctgggtggcatgaattcgttgctccaaattgaaacatccccagcaattcctcttgtatccaaggtcccaactataatcttgggaatggatgtgtcacacggttctcctggacattctgatgtaccatctattgctgctgttgttagttctcgtgaatggcctcttatctcgaaatacagagcttctgtccgcacccaatcacctaaaatggaaatgattgactcattgtttaagccacgggaagctgaagatgatggtctgatccgggagtgtctgattgacttctacaccagttctgggaagagaaagcctgaccaagtcatcatattcagggacggtgttagcgaaagtcagtttaatcaggtgctgaacattgagttgcaacaaatcatcgaggcttgcaaatttcttgatgagaaatggaatcccaagttcacgttgattattgcccagaagaatcatcacactaaatttttcattcctggaaagccagataatgtcccaccaggaactgtggtggacaacaaagtctgccatccaaagaacttcgatttctacatgtgtgcgcatgctggaatgatcgggactacgaggccaactcactaccacatcctgcatgatgagataggcttcagtcctgatgatctgcaggagctggtgcattcgctctcttatgtgtaccaaaggagcacaacagccatatcagtcgttgctcccatctgctacgcacatctggcagctgctcaggttggccagttcataaagttcgatgagatgtcggagacgtcctccagtcatggcgggcatacttcggcgggcagcgttccggtccaggagctgccgcgcctgcatgagaaagtgaggagctcgatgttcttttgctgagccgtggttttacttttttggtggatggtgaacccctctagttatgtcggtagacgcttttggatgacgctctagttgtggtccaggaaggctcgagctggtacgatgttaaatgttagttttttaagcgtcgctgcggctatgttggtgcctcaggaagacttggaacctggttaggatgtcgtaatctaccccttatcgttcctggttcgttgggctgttgttcttattgtccgtcctggtgtctgatttctgctttgttgcatgcaagtgtgaggcccagcttgatattaaaaaaaaaaaaaaaaatctcgttcctttggcaaannaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcggcccc

SEQ ID NO: 19389 - DNA, 1734 bp, Zea mays
  misc_feature (6)..(9): n is a, c, g, or t
  misc_feature (1695)..(1695): n is a, c, g, or t
  misc_feature (1700)..(1700): n is a, c, g, or t
  misc_feature (1728)..(1728): n is a, c, g, or t
  misc_feature (1731)..(1731): n is a, c, g, or t
cggccnnnnctagatcgcaggccgcttttttttttttttttttcagtccaaaagatgacggttcctgtgatattgatattaaatgcaaaaatttagtcagctccagaattacactgattatcatgttacaaggtcattgcaacttccaggtctctcaactgggaaactagatggttaccgacacaatctcagagtagtagatttcaatattggggtaaaccctaaaccaaacaaaggcagtctaatcgctaaagatgtatcacgccacagcagcactcatttgctcaaatctcactaatgtactctaaaagagattcaacctcctgcctcagggcagcaattttctgctgctgcaaagcaatcctgttctctacatcttgcccgcgcagcttcttctcaaagctgtcgacaacggtggaatgccttgtcatgagcttctcctgcatctctctctcctttacgatcaagtcctctacctttggcaatatctgataagactggggagatgactgtagagtcgccaacagtggcttcagatctttcgatagctccttaaactgcgtgtcagcagctttacgagctgccttgcaagactgaatgtctcctgtcctagacaaatcccgcaatgaggcctccagtttatcatgaactgctaagcattgctcaaagataccctggattttctgaacagttgcttgcacctcatcccattgcagcttggccaagtaggaaggagagctcttggatattgacatatcagtacgcatgtaaacaatacaggccacaaacaggaggaagaaaccagtaatcagcatcaacggctctctgagcaaggatatgttgttgaatctgtagtaaacctggaaatacaaattatgctctggaataacatcaggtttctccaagacaacaactggtcttccgacaatgtcaaggtgtgaatacttaacctcttgctgctgctgtgttggaaagggagctgaaacttcgatatcctttgacccttcaggtagaacaacctttacgataagcttttcaatgagaatttcctccaatggagaaccaaatgtgatattgagaaatctctttccatcagaatagaaaacaaagtcttcaagtggtaaaccataaccaacagtgaaggttgtttgccacccaccaaacaatggaaaccttggttctatttccagttgggtcttcatagaatcactccacaaatgtgatgtggaaatattaccaatctcatctcggtaataaatagagtgtgcccttggaggcagttttgcaataagatgtctaaaagatgaaacaccccttacgtaaggtctagattgataatcaatcctggaaaattcacccttgagtctggcaccaccatgagcaatgttgtagtgttccgtaatctgtacatttccccagtgagatatctcaatctcccttataacttcctttgcaactgcaaaaggattgttgttctcaaaatgcacaatcacaggtaagtaggagaacgggggaaggtcatgaaatggtccatatttcagttctgaatccacaagttttgcgtttggatgccttgtgtatgattcaacccttccaccaggcaatctgatagcaagtgtctgagccccggccggcctcggggtcccctagggagcactatcctgatagacaacaagttgtgcttcggcttgagtnatttnttctgggaatggttgaagagagtgtgtnacncgg

SEQ ID NO: 19390 - DNA, 826 bp, Zea mays
ctttgctccacaatcaatgtgattgatcaattctatctcttcaatgtacatataccatatcgacatggtacctacgatgtttcaggttacaaatccgtgcgcatcatctcagctccacaatcgcatgctgaagatacctgaatgacttctcgtagctgacaaagcccatgaaccaaaaatcgaagccgtcaacagtaactacatcaatgtacttctcgtctggattgtatagatttccccgcaccgacgcactctttatcctcttcgtggggatcaacaccttgtaaggcacccttgtcctgcctcctttgggagacaatagattcaaaggcctatcgctgtggaaagcgatcttcttagttgagatgaaaagcattccggctatcggaccggctgtggtcgaaagatagcactggaaggccttcagtagcttctcatcttcctcgactgtgaagtattctctgaaaactttatcgatgccgccggcttggagaaccttcgcaccgaagctcagtttcccctttatagtttctgaaacttttggtcccagagacaagtgttctttgaacccttgcatgtagttatctgttttgtggctcagtttgttcatccagcaaatgaaggaacccttcttatttttcttatgaaccatggcggaacaggaaggttttcctcgtctttcctcatcggcgtatgcaaatgaagtcaatggaactccaacgacatgcttctggacgaaactctccattgcttggacttggagaaggtctgtgtctacaaatctgctttgacgcctgctgctactgctagtcccccggcctcgagg

SEQ ID NO: 19391 - DNA, 1881 bp, Zea mays
gcgtccgcccacccgtccgcccaccgcttcactcgtttccttccgatccatacacaccgcgcacgtacgcgtactccatcgtcccggtgcaggcgggttcacgtacgagctcgatcggccgagacgagatggcgacgccgaacgggcttgctcggatcgagacgaacggggcgacgaagcccgacaacggcgtgtgccacgacgacagctcggcgccggtgcgcgcgcagaccatcgacgagctgcactcgctgcagcggaagcggtcggcgccaaccacgcccatcaaggacggcgccgcctcgaccttcgccgccgcgctctccgaggaggagcgccacaggcagcagctgcagtccatcagcgcgtcgttggcgtctctgacacgtgaaaccgggccgaaagtggtcaagggcgacccggcccggaggggcgaggcccccgcgacgggtgcaccgccgacgccacaggcgcaccaccagcaccaccaccccgccgcccccaccatcgccgtcagcgacagctccctcaagttcacccatgtcctctacaacctctcgcctgctgagctgtacgagcaggccatcaagtacgagaaggggtcgttcatcacgtctaccggcgcgctggcgacgctgtccggcgccaagaccgggcggtcgcccagggacaagcgcgtcgtcaaggacgaggtcgcggcgcgggacctgtggtggggcaagggctcgcccaacatcgagatggacgagcacacgttcctgaccaacagggagagggccgtggactacctcaactccctggacaaggtgttcgtgaacgaccagttcctcaactgggaccccgagaaccggatcaaggtccgcatcatctccgccagggcgtaccactccctcttcatgcacaatatgtgcatccggcccacggacgaggagctggagagcttcggcacgccggacttcaccatctacaacgccggccagttcccctgtaaccgctacacgcactacatgacgtcgtccaccagcgtagacatcaacctcgccaggagggagatggtgatcctgggcacgcagtacgccggcgagatgaagaaggggctgttcggcgtcatgcactacctcatgcccaagcgcggcatcctctcgctgcactccggctgcaatatgggcaaggacggcgacgtcgccctcttctttggcctctcaggtaccgggaagacgacgctgtcgacggatcacaacaggcttctgatcggcgacgacgagcactgctggagcgagaatggcgtgtccaacatcgagggcggctgctatgccaagtgcatagacctgtcgcaggagaaagagcctgatatctggaacgccatcaagttcggagccgtgctggagaacgttgtcttcgatgagcatactcgtgaagttgactacgccgacaaatctgtcaccgagaacactcgggctgcctacccgatcgagtacatccccaacgccaagataccatgcgtcggcccacaccccaagaacgtgatcctgctggcgtgcgacgccttcggcgtgctcccgccggtgagcaagctggacctggcgcagaccatgtaccacttcatcagcggatacaccgccctggtcgccggcacggaggacggcatcaaggagccacaggccaccttctccgcctgcttcggcgcggccttcatcatgctccacccgaccaagtacgccgccatgctcgccgagaagatgcagaagtacggcgccacagggtggctcgtcaacaccggctggtctggcggcaggtaccgtgtgggcaaagaggatccggcttccctacaccaggaagatcatcgacgccatccactccggcgagcttctcaccgccaac

SEQ ID NO: 19392 - DNA, 2597 bp, Zea mays
ccggccggggatcgatgattgaaacgctcagtgacacattgggtcgtcacaacatgtcatcttcccattgggtacctcgaggccggccgggacgaccgcttggcgcttcatcactcgtttcctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggcgcccactcgcccttcgccgtcgcgatctccgaggaggagcgccacacgcagcagatgcagtccatcagtgcgtcgttggcgtctctgacgcgtgaaaccgggccgaaagtggtcaagggcgacccggccgcgaagggagaggccgccgcgcagggcgcgccatcgacgccgagggcgcaccagcagcaccgccaccccgccgcccccgccatcgccgtcagcgacagctccctcaagttcactcatgtgctcaacaacctctcgcctgctgagctgtacgagcaggccatcaagtacgagaaggggtcgttcatcacgtccaccggcgcgctggcgacgctgtctggtgccaagaccgggcggtctcccagggacaagcgcgtcgtcaaggacgaggtcaccgcgcaggacctgtggtggggcaagggctcgcccaacatcgagatggacgagaagacgttcctgatcaacagggagagggccgtcgactacctcaactccctggagaaggtgttcgtcaacgaccagtacctcaactgggaccccgagaaccggatcaaggtccgcatcatctccgccagggcgtaccactccctcttcatgcacaacatgtgcatccgccccacggacgaggagctggaggacttcggcacgccggacttcaccatctacaacgcagggcagttcccctgcaaccgctacacccactacatgacgtcgtccacgagcatagacctcaacctcgccaggagggagatggtcatcatgggcacgcagtacgccggcgagatgaagaaggggctcttcggcgtcatgcactacctcatgcccaagcgcggcatcctctcgctgcactccggctgcaatatgggcaaggacggcgacgtcgccctcttctttggcctctcaggtaccgggaagacgacgctgtcgacggatcacaacaggcttctgatcggcgacgacgagcactgctggagcgacaatggcgtgtccaacatcgagggcggctgctacgccaagtgcatcgacctggcacaggagaaagaacctgatatttggaacgccatcaagtttggaactgtgctggagaacgtggtctttgatgagcatactcgtgaagtcgactacgccgacaactctgtcaccgagaacactcgggctgcctacccgatcgagtacatccccaacgccaagataccatgcgtcggcccgcaccccaagaacgtgatcctcctggcgtgcgacgccttcggcgtgctcccgccggtgagcaagctgaacctggcgcagaccatgtaccacttcatcagcggctacaccgctctggtcgccggcacggaggacggcatcaaggagccgcaggccaccttctccgcctgcttcggcgcggccttcatcatgctccacccgaccaagtacgccgccatgctcgccgagaagatgcagaagtacggcgccaccgggtggctcgtcaacaccggctggtcgggtggcaggtacggcgtgggcaagaggatcaggcttccctacaccagaaagatcatcgacgccatccactccggcgagctcctcaccgccaactaccagaagaccgaggtgtttggcctggagatccccactgagatcaacggcgtgccgtcggaaatcctcgacccgatcaacacctggacggacaaggccgcgtacaaggagaatctcctgaggctcggcgggctcttcaagaagaacttcgaggtgttcgccagctacaagatcggggacgacagcagcctgactgacgagatcctcgcagcaggccccaacttctgaactaaagcaatggatccggatgaataaaacgatggtgtgtgtgcgtgggtgcgtgtgaagatgattacgacgacgacgaaaaaaaaggtgttggatcgatgagccaacatagtaatagattagctgggtatattgtcatgggtgcgtctggtctctggtcttgttatctataaagctgtctcaagcagctatcatattctatttcaaattctattctgtaagcgtgtagttcaaaacaatgctttacacaaccatatgcacagtctatctaaggttggtctgttctatcagcttgttgggaaaagtttgcgtgtgcttgtatcttgccccctgtactctctctggtttctgaatttgaatacggaacagcttgatcgcgatcaaaaaaaaaaaaaaagcggcccctcgagctca

SEQ ID NO: 19393 - DNA, 2510 bp, Zea mays
  misc_feature (476)..(476): n is a, c, g, or t
  misc_feature (479)..(480): n is a, c, g, or t
  misc_feature (494)..(494): n is a, c, g, or t
  misc_feature (507)..(513): n is a, c, g, or t
  misc_feature (1235)..(1235): n is a, c, g, or t
  misc_feature (1290)..(1290): n is a, c, g, or t
ttcccgggccgacccacgcgtcagcggacgcgtgggctcgtttcctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggcgcccactcgcccttcgccgtcgcgatctccgaggaggagcgccacacgcagcagatgcagtccatcagtgcgtcgttggcgtctctgacgcgtgaaaccgggccgaaagtggtcaagggcgacccggccgcgatgggagaggccgccgcgcatggtttgccttcgacgccgtgggcgcaccnatnncagtaccgtcaccnctgtcgaccccgnnnnnnncagcgacagctccctcaagttcactcatgtgctcaacaacctctcgcctgctgagctgtacgagcaggccatcaagtacgagaaggggtcgttcatcacgtccaccggcgcgctggcgacgctgtctggtgccaagaccgggcggtctcccagggacaagcgcgtcgtcaaggacgaggtcaccgcgcaggacctgtggtggggcaagggctcgcccaacatcgagatggacgagaagacgttcctgatcaacagggagagggccgtcgactacctcaactccctgaaggtagttcgtcaacgacagctactcaactgggaccccgagaaccggatcaaggtccgcatcatctccgccagggcgtaccactccctcttcatgcacaacatgtgcatccgccccacggacgaggagctggaggactttggcacgccggacttcaccatctacaacgcagggcagttcccctgcaaccgctacacccactacatgacgtcgtccacgcgcgccgacctcaacgcgtcagcccacgcggccgatggtcatcatgggcacgcagtacgccggcgagatgaagaaggggctcttcggcgtcatgcactacctcatgcccaagcgcggcatcctctcgctgcactccggctgcaatatgggcaaggacggcgacgtcgccctcttctttggcctcccaaggtaccgggaagaccaagctgtccaacgnattaaaacaagcttctgatcggcgacgacgagcactgctggagcgacaatggcgntgtccaacatcgagggaggctgctacgccaagtgcatcgacctggcgcaggagaaagagcctgatatttggaacgccatcaagtttggaactgtgctggagaacgtggtctttgatgagcatactcgtgaagtcgactacgccgactactctgtcaccgagaacactcgggctgcctacccgatcgagtacatccccatcgccaagataccatgcgtcgggccgcaccccaagaacgtgatcctcctggcgtgcgacgccttcggcgtgctcccgccggtgagcaagctgatactgccccgggccatgtaccacttcatcagcggctacaccgctctggtcgccggcacggaggacggcatcaaggagccgcaggccaccttctccgcctgcttcggcgcggccttcatcatgctccacccgaccaagtacgccgccatgctcgccgagaagatgcagaagtacggcgccaccgggtggctcgtcaacaccggctggtctggtggcaggtacggcgtgggcaagaggatcaggcttccctacaccagaaagatcatcgacgccatccactccggcgagctcctcaccgccaactaccagaagaccgaggtgtttggcctggagatccccactgagatcaacggcgtgccgtcggaaatcctcgacccgatcaacacctggacggacaaggccgcgtacaaggagaatctcctgaggctcggcgggctcttcaagaagaacttcgaggtgttcgccagctacaagatcggggacgacagcagcctgactgacgagatcctcgccgcaggccccaacttctgaactaaagcaatggatccggatgaataaaacgatggtgtgtgtgcgtgcgtgcgtgtgaagatgattacgacgacgacgacgaaaaaaaggtgttggatcgatgagccaacatagtaatagattagctgggtattgtcatgggtgcgtctggtgttgttatctataaggctgtctgcctgtcccaagcagctatcatattctatttcaaattctattctgtaagcgtgtagttcaaaacaatgctttacacaaccatatgcacagtcttatctcaggttggtctgttctatcagcttgttgggaaaagtttgcgtgtgcttgtatcttgccccctgtactctctctggtttctgaatttgaatacgaaacagcttgatcgcgatcatatttataaaaaaa

SEQ ID NO: 19394 - DNA, 1215 bp, Zea mays
  misc_feature (155)..(155): n is a, c, g, or t
ctcaggtaccgggaagacgacgctgtcgacggatcacaacaggcttctgatcggcgacgacgagcactgctggagcgagaatggcgtgtccaacagcgcccgcggcgccggccccgagggcttagacctgtcgcaggagaaagagcctgatatcntggaacgccatcaagttcggagccgtgctggagaacgttgtcttcgatgagcatactcgtgaagttgactacgccgacaaatctgtcaccgagaacactcgggctgcctacccgatcgagtacatccccaacgccaagataccatgcgtcggcccacaccccaagaacgtgatcctgctggcgtgcgacgccttcggcgtgctcccgccggtgagcaagctggacctggcgcagaccatgtaccacttcatcagcggatacaccgccctggtcgccggcacggaggacggcatcaaggagccacaggccaccttctccgcctgcttcggcgcggccttcatcatgctccacccgaccaagtacgccgccatgctcgccgagaagatgcagaagtacggcgccaccgggtggctcgtcaacaccggctggtctggcggcaggtacggtgtgggcaagaggatccggcttccctacaccaggaagatcatcgacgccatccactccggcgagcttctcaccgccaactaccagaagaccgaggtctttggcctggagatcccgactgagatcaagggcgtgccgtcggaaatcctcgacccaatcaacacctggacggacaaggccgcgtacaaggagacgctcctgaggcttgccgggctcttcaagaagaacttcgaggtgttcgccagctacaagatcggggacgacagcaacctgaccgacgagatcctcgccgcaggccccaacttctgaactaaagcagtgggtccggatgaataaaacggtggtatgcgtgtgaagaagaagatgatgacgacgaaaatagtgtgttggatcgatgggccagcacagtgtagactagcttttgtatattatctcgggttggaaatctggtgttgttacctaaaatgttggtctgttctatcggcttgttgaaaacagtttgcgcgtgcttgcatcttggcccccctgtattctctgtggtttcagaatttgaacacgaaacagcttggtctcgggatcatgttggtttcattatgtcaaaaaaaaaaaaggtctt

SEQ ID NO: 19395 - DNA, 2935 bp, Zea mays
cccacgcgtccggaaaaaaaaaagaaacatttcctctctctctctgacgtcttaactcggatcacgagttgaaatttgtgtcggggacaagccatgaacaacgcaaccaccagttgttaactaaccctcttttaaacttcaagcaaccaaagccaagagcagaaatggttttccaaaagaggtcgtcgtcgtcagagatggagtcgtgcggtggaggccaagtcccggagatgccacgcgttcccaagtccgcgaggggcaagagatcggtcaggaagaaggaggcccagagcccggcccagatgtctgcattcgaccttctcgcgaccgtggcagggaagctgtttgacgagggggcggggtcgctggggaacacgagcgccggtgccccggccttggctgcgtgcgcaaaggatgccctggtgaagcaggagcagtgtgatgagcaaatgaagctgttcaagcatgaggcgacggatcaggatagctgcaatgagagtgcaatcctcccccacattgtgctccagcgggtggtgaataatgctaggaatgaggatcctaaggcgaagtctgaggtccaggacaaggaatcctccatgatcagctatacgaaggctgaattgggttgtaattttggtgtgatcgcagacaggtggtcgcctgaatccgtggaatcaggagcctgcacaggagatgcagtggcgagactgatgatgacggccccggcaggatttcataagaatgcacccgaaatgtatagtttgcttgattcaatggatgtggatgtcaagccgcctcctttggtcagctctgacagcaccggcgagatgccattgcatggcgataaaattcaccgctcaacctccttaccgaggggcccaaagggggtggggttttttgctgtagatagagatgatgacgacgacaagtcctcagggtgcactcatccgagcaccgccactaacaaggatttcacatccaattgtaaagctgagtataatagggtaaggaagctgctcactagtaagcacaggaaagttgctccagcgaggattcacaaatctgatctttcctatagtgatgtcgagcggaagccttctttccggtacaaaaaaatgcatacacgacagaggacacaaaggagtacattcaagcggaggaagctctttgatcgccatttagctctagcatctgaatttggtacagcaaatggaaagggaaacacaaaggttgccggaagaaactccaatgctgtgtctttggaagcaaacaaggggactaattcaatgccattccagaaatcttgtgggtcaaatgattgccatgtgaaacttagaattaagtcttttaacgtgcctgaacttcttgttgaaatcccagacagtgcaactgttggctcactaaagaaaactgttctcgaggcagtgactgcgattcttggaggtggcctacgtgttggtgttcttcaccatggaaagaaagtcagagatgatagtaaaacgttaattcaggctgggattggtcaggatgatatgctggacaaccttggcttttcacttgaacccaactgtactcaaaacccacaagtccaagctcctgaagatgtcaatttcctcgaaaacattgatactaccgaacccctcgcaaggatcacacctgctgactcgtcttctaagcttggtgaagttgacgtatcacaggagcttgcattaaccccattagcaatgaactaccagggcagtgatcatgattccgtgcactcccctggggctgtctcgtcgcgcgataaagactcgcgagccttatttctggttccagctgcagatcccaatgcaggagctgtagttccagcaaataagactaagaggtcaccagagcagggacaccgcagaatcaggcggccgttctctgttgctgaagtagaagcacttgtgctcgcagtcgaaaagcttggaaccggaaggtggcgagatgttaaacttcgcgcttttgacaatgcaaagcaccgtacctacgttgaccttaaggacaaatggaagacgctggtacacacagcgagcatctcgccgcagcagcggcgtggcgagccggtgcctcaggagctgctcgaccgggtcctggcggcccaggcctactggtcccagcagcaagccaagctccagccgaagacgccctcgctggctgaggctcgcttgctcacccaataattcgatgatcccggctgatggcctcctctgaggccgttgcagcctttgtataaagtcagtaagtcaagtcagtcccttcacaggaggtttaatgaaaatataatattaggggaaaaaaagaatgcatatataaggtacaagaagcattgaccgatttgttgtaatatctactcaccaccggttattctttaagccaggattctctctccttgtgaatttaaccaaaggaaagggcatttctttggcaattgtacattttgatgatggaagaagaagatgatccatgaactgagatctcgagtgtctcctactaatggctacacaatttttgcaaattgtgattaagaaattcaaggtgctgcttgaccagctcggctccggcttccagtttttggattctcttgtgaagaagttgctgcctctcttttatacagcagaagctgagagccgaacagtgtatatggcttgaattgagcctatatagtttcatccactcatacagacggccacaaatgccgtaaaaggagggtagcttcttttgctgagtctagtcttgggagcaaagctcaggaccgaagtctagacttgagacggagcgggggccaaagcggcacccgaatgaaagcttcagattcttttgttcagttaaattcattctttttttttttttgacacaacacaggtactttaaaatttaaggagatatcattgtcgattacacacgataa

SEQ ID NO: 19396 - DNA, 2500 bp, Zea mays
  misc_feature (1162)..(1162): n is a, c, g, or t
  misc_feature (1184)..(1184): n is a, c, g, or t
ggatcctaaggcgaagtctgaggtccaggacaaggaatcctccatgatcagctatacgaaggctgaattgggttgtaattttggtgtgatcgcagacaggtggtcgcctgaatccgtggaatcaggagccttcacaggagatgcagtggcgagactgatgatgacggccccggcaggatttcataagaatgcacccgaaatgtatagtttgcttgattcaatggatgtggatgtcaagccgcctcctttggtcagctctgacagcaccggcgagatgccattgcatggcgataaaattcaccgctcaacctccttaccgaggggcccaaagggggtggggttttttgctgtagatagagatgatgacgacgacaagtcctcagggtgcactcatccgagcaccgccactaacaaggatttcacatccaattgtaaagctgagtataatagggtaaggaagctgctcactagtaagcacaggaaagttgctccagcgaggattcacaaatctgatctttcctatagtgatgtcgagcggaagccttctttccggtacaaaaaaatgcatacacgacagaggacacaaaggagtacattcaagcggaggaagctctttgatcgccatttagctctagcatctgaatttggtacagcaaatggaaagggaaacacaaaggttgccggaagaaactccaatgctgtgtctttggaagcaaacaaggggactaattcaatgccattccagaaatcttgtgggtcaaatgattgctatgtgaaacttagaattaagtcttttaacgtgcctgaacttcttgttgaaatcccagacagtgcaactgttggctcactaaagaaaactgttctcgaggcagtgactgcgattcttggaggtggcctacgtgttggtgttcttcaccatggaaagaaagtcagagatgatagtaaaacgttaattcaggctgggattggtcaggatgatatgctggacaaccttggcttttcacttgaacccaactgtactcaaaacccacaagtccaagctcctgaagatgtcaatttcctcgaaaacattgatactaccgaacccctcgcaaggatcacacctgctgactcgtcttctaagcttggtgaagttgacgtatcacaggagcttgcattaacncccattagcaatgaactaccangggcagtgatcatgattccgtgcactcccctggggctgtctcgtcgcgcgataaagactcgcgagccttatttctggttccagctgcagatcccaatgcaggagctgtagttccagcaaataagactaagaggtcaccagagcagggacaccgcagaatcaggcggccgttctctgttgctgaagtagaagcacttgtgctcgcagtcgaaaagcttggaaccggaaggtggcgagatgttaaacttcgcgcttttgacaatgcaaagcaccgtacctacgttgaccttaaggacaaatggaagacgctggtacacacagcgagcatctcgccgcagcagcggcgtggcgagccggtgcctcaggagctgctcgaccgggtcctggcggcccaggcctactggtcccagcagcaagccaagctccagcctaagacgccctcgctggctgaggctcgcttgctcacccaataattcgatgatcccggctgatggcctcctctgaggccgttgcagcctttgtataaagtcagtaagtcccttcacaggaggtttaatgaaaatataatattaggggaaaaaatgaatgcatatataaggtacaagaagcattgaccgatttgttgtaacatctactcaccaccggttattctttaagccaggattctctctccttgtgaatttaaccaaaggaaagggcatttctttggcaattgtacattttgatgatgatggaagaagaagatgatccatgaactgagatctgcagtgtctacctactaatggctactcatggctcgcaatttgtggttaagaaattcgaggtgctgcttgaccaagctcggctccggcttccagtttttggattctcttgtgaagaagttgctgcctctcttctatacagaagctgagagccgaacagtgtatttggcttgaattgcagcctatatagtttcatccactcatacagacggccacaaatgccgtaaaaggagggtgtagcttcttttgctgagtctagccttgggagcaaagctcaggaccgaagcctagacttgagacggagcgggggccaaagcggcacccgaatgaaagcttcagattcttttgttcagttaaattcattctttggtagtggagactgacggaaggataggagattaggtggggtggatctttggttccctttttcttttttcttcttctattattacattattagttgtattaatgtactatattattttaccaatcttgtagttaccctcaaatttgtaattggtgaaattaacaaaattgaaggagatacatttctacc

SEQ ID NO: 19397 - DNA, 3184 bp, Zea mays
aattcggcacgagggaaaaaaccaggcggagggcggtgaggagcgcatggagggtgaaagggggaaatgggtaataaaaataaaagaggagaggagaagcaagacgaggaggaagagggagcacccagaggtaggggagggggaataattccgcaggggctgagggatctcggcgagtccggccgcggagcagcgcagcgaggcggcgatccgagggcgatcggaggcgggcgggcgtagacgccggcgagatttgtgttggtgacaagccatgaacagcgcaaccaccagttgttaagtaaccctcctgtaaacttgaagcaaccgaagcggagagcagaaatggtgttccaaaagaggtcctcgtcagagttggaggcgtccggtggaggccaagtcgcggagatgccgcgcgttcccaagtctgcgaggggcaagagatcggtcaggaagaaggaggcccagaacccgccccagatgtcagcattcgaccttctcgcgacggtggcagggaagctgcttgatgagggggtgggctcgctggggaacatgagcgctggtgccccagctttgactgcatgcgcgaaggatgtccgtgtgaagaaggagcagtgtgacgaggaaatgaagcagttcaagcatgaggtgacagatcaggatagctgcaatgagagtgcaattctcccgcacattgtgttccagcgggcggtgaataatgctcggaatgaggatcctaaggcgaagtctgaggcccaggacaaggaatcctccatgatcagctgtaccaagcccctacgggggcgcggttttggtgtgattgcagataggtggtcgcctgaatccgtggaatcaggagccttcacaggagatgcagtggcgagcctgatgccacctgccccagcaggatttcataagaatgcacccgaaatgtataatttgcttgattcaatggatgtggatgtcaagcctcctcctttggtcagctctgacagcaccggcgagatgccattgtatggcgataaagttcaccgctcaacctccttaccaagggtctcgaagggagtggggttttttgctgtagatagagatgatgacgacgataagtcctctgggtgcactcatcccagcaccaccactaacaaggatttcaggtccaattgtacagctgagtatagtagggtaaggaagttgctcaccagtaagtacaggaaagttgctccagcgagggtttacaaatctgatctttcctatagtgatgttgatcggaaaccttctttccggaacaaaaaaatgcattatacacgacagaggacacaaaggagtacattcaagcgtaggaagctctttgatcgccattcagttctagcatctgaatttggtaccgcacatggaaagggaaacacgaagaaggttaccggaagagactcccatgctgtctcttcggaagcaaacaaggggactagttcaacgccattccagaaatctcgtgggtcaaatgattgccatgtgaaacttaaaattaagtcttttaaggtgcctgaacttcttgttgaaatcccagaaagtgcaactgttggctcactaaagaaaactgttctcgaggcagtgactgcgattctcggaggtggtctacgtgttggtgttcttcaccatggaaagaaagttagagatgataataaaacgttgattcaggctggtattggtcaggaggatatgctggacaaccttggcttttcacttgaacccaactgtacacaaaacccacaagtccaagctcctgaagatatcagtttcctggaaaccattgatactgctgaacccctcgcaaggattgcacctgctgactcgtcttctaagcatggtgaagttgacctatcacaggagtttgcattaaccccattagcaatgaactaccagggcagtgatcatgattctgtgcactcccctgggggcgtctcatcgcccgataaagtctccacaaactcgcgagctttagttccagttccagctgcagatcccaatgcaggagctatagttccagcgaataagtctaagaggtcaccagagcaggggcaacgcagaatcaggcgcccgttctctgttgctgaagtagaagcacttgtgctcgcagtcgaaaagcttggaaccggaaggtggcgagatgttaaacttcgcgcgtttgacaatgcgaagcaccgtacctatgttgatcttaaggacaaatggaagacgctggtgcacaccgcgagcatctcgccgcagcagcggcgtggcgagccggtgcctcaggagctgctcgaccgggtcctggcggcccaggcctactggtcccagcagcaagccaagctccagcctaagacgcccccgctgctggctgaggctcgcttgctcacctaataaattcgatgatcctggctgatggcctcctccgaggccgttgcagcccttgtataaagtcagtaagtcagtcagtcccttcacaggaggtttaaggaagatatattaggaaaaaaaaagaatacacatataaggtacaagaagcattgaccgatttgttgtaatatctactcaccaacagatattctttaagccaggattctctctccttgtgaatttaaccaaaggaaagggtatttctttggcaaattgtacatgttgatggtggaagaagaagatgatccatgaactgagatctggggtgccattgctcacaatttttgcagttgtgactgagaaattgaaggtcctgcttgaccaagctcggctccggctccggcttttggattctcctgcgaagaagttgttgcctcctcgcagaagctgagagccgaacagtgtatttggtttgaattgcagcctatagtataatttgattcacccgtacagacggccacaaaaagccgtaaagggagggtagcttcttttgttgagtctaggcttgcgagctgggccaaagcggcaccgaaagaaagcttcagattcttttgttcaattaaattcattcttttgttagtggacagtgacggaaggataggccattaggagggatggatctttggttctcttttccttttttttcttctattaaattagttgtactatgttatgtcaccaatcttgtagttaccctcaaatttgtaattgatgaaattaagaaattggaaggaaatgctttcgtacccaa

SEQ ID NO: 19398 - DNA, 2778 bp, Zea mays
ggctgcagccccattcccgcgccccgacctttcctgtaccatccccgctggcccgctcgctctcttccggcctcgcgttccgtctccgaagccgcaggcagccatggacgtaaacgaggaggcaatggcggcgcacaagcgcgccttcctcgacttcctcgaccaagacgtcgggaagggggtttacatgcaggccgtccgcgacatggtccagaacaagcgccaccggctcatcatcggcatggacgacctccgcaatcacaacctcgatctcgcccgcagggtgattcggagccccggggagtatatgcagccggcgtcggatgcggtttcggaggtagcgaggaatctggatcccaaatttttgaaggaaggtgagcgggtgatggtgggcttctcgggtccgttcgggttccacagggtcacgccctgccccccccccccccccttcatcggcaccatggtctgcgttgagggcatcgtcaccaaatgttcattggtaaggccaaaagttgttaagagtgttcacttttgccctgtgactggggcctttctctcgcgtgaatatagagacatcacttcttttgtaggcttgcctactggctctgtttatccaacaagggatgacaacggcaacttgttggtcaccgagtatggaatgtgtgaatataaggatcaccagacattgtccatgcaagaagtgcctgaaaattctgcacctggacagcttccaaggactgttgatgttattgtagaagatgatcttgtagattgttgcaaacctggcgaccgtgtctcaattgttggtgtgtacaaggctctaccagggaaaagcaagggaagtgttagtggtgtgttcagaactgtccttattgcaaataatgtgtcgcttcttaacaaagaggcaaatgcacctgtgtatactcgggaagatttgaagcgtatgaaagaaatatcaaggagaaatgacacctttgacttactgggaaactcacttgctccgtccatttatggccatctatggataaagaaggcagtagtactattgatgcttggtggtgttgaaaagaatctaaaaaatggaactcacttgagaggagatataaacatgatgatggtgggagatccttcagttgccaagtcccagctcctaagagctgtcatgaacattgctcctttggctatatcaacaactggcagaggttcatctggcgttggattgactgctgctgtgacttctgatcaagagactggggaaagaaggcttgaagctggtgccatggttcttgctgatcgtggtgtcgtctgcattgatgagtttgataaaatgaatgatcaagaccgagttgctattcatgaagttatggaacagcaaactgtaaccattgcaaaggcaggaatacatgcctcgctaaatgcgagatgtagtgtgattgctgcagcaaatccaatcccacgcgtccgtgatcgttcattgactccaacaaagaatattgggcttcctgattcactgctttcccgttttgatttactttttattgttcttgatcaaatggatcctgagattgaccggcaaatttcagaacatgttgcacgaatgcatagatattgcactgatgatggaggagcaaggtctcttgataaacagggatatgctgaggaagatgatggtgatgctaatgcagccatctttgttaagtatgatagaatgctccatggtcaggatagaagaagaggaaagaaagccaagcaggacaggctaactgtcaaatttttgaagaaatatattcattatgcgaagaaccttattcaaccaaagctcactgatgaggcatctgatcatattgcgacttcatatgctgagctcagggatggtagtgcaaatgcaaagtctggtggaggtacacttccaattacagcaaggacattggaaaccataattcggctatcgacagctcataccaagatgaaactgaggcatgaggtactgaaatctgatgttgaggctgcattgcaagttctaaattttgcaatataccacaaggaattgactgagatggaagagcgagaacagagagaagcggagatgaaacagcaagctgatcacgatgcagatgcaactggtggcactgtggatggacatggaagctccggaaatgatccaatggatgtggatgttgggaacacttcaaacgatcagaatgttcctttagcgagaatggaagcatttgaagcatttctgggtcagcatgtgttggcaaaccatatagatcaaatgtcaatcgatgaaatcgagcaggtggttaatagggaatcaactgcaccttacaccagaagccaagtagagtttattttggagaggatgcaggatgcaaacagggtaatgatacgagatggtgttgttcgaatcatataactgccagtctaccgggacgtttacctgtggattccctggtcatgctggatcaagttggctgtctgtctgtaaccaacttacctgttgaagtatttgtttgttaatttttgtcaacaaaggattgggacaatcattggtccccttggtacttctagttcatctaatgtattgcttacctgacctagtgatattagtacctagtcatatctatttgtgttcgagttaatttgcaactcgtctggagtggcattctgatgaggaaaattcacatattgagggctcatttggcagagcttcggtctatgattctctaactccgagagtcgaatctctaataaagtgattctgagtggttttctagt

SEQ ID NO: 19399 - DNA, 710 bp, Zea mays
tgggggccctttctctcttttcacattcaaacaagcacataaatagtttacagtggcgcgttctaataaggcatgcccattggtccaatggatttggcgatttgcgaattattattagctgcgtctggctgctaacatgcgattatttttagagtaaatcggacaccggtacagagagtcacagaccacgaagccagtcatccagagcaaaacaccattgcagccagtcatcccgcccgtacagcgcctgttcttctacaacagggccgatctgctcgacgtctccgacttcacgctgggcgagctgccacggttcagggactccctcgccgccgcgctacaccacttctacccgttggcggggaagctaacgtgcgagctggtcgacgaggagggcgccgcaccgccggagggaccgagggaccaggagcgccgggaggaggagggatcgagggagcagggagcgccgggtggatggagcagccgagcagggagccagccagccagggaccaccgggatgagggagcagccgagcagggagcaccgggaggagggagcagccgagtgccgcgcccgagaccgagtcgccgacgccgcgagacagagagccgcggccgccgcacgaagacgcaggtgggagggaggagagtgcgttagggttagggttcccgcgcccgccggcgcgagccccgcgccttatacgggattt

SEQ ID NO: 19400 - DNA, 2742 bp, Zea mays
ccggccgggaaatccaaatccgcccgcctgccgcagcccccattctcgcgccccgccttcttcctccagcagccccgctcgttcttccggcctcgcgttccgtctccgaagccgcaggcagccatggaaatcaacgaggaggcaatggcggcgcataagcgcgccttcctcgacttcctcgaccaagacgtcgggaagggggtttacatgcaggccgtccgcgacatggtccagaacaagcgccaccgcctcatcatcggcatggacgacctccgcaatcacaatctcgatctcgcccgcagggtgatccggacccccggggagtatatgcagccggcgtcggacgcggtgtcggaggtggcgaggaacctggatcccaaatttttgaaggaaggggagcgcgtgatggtgggcttctcgggtccgttcgggttccacagggtcacgcccagggatctcatgtcctccttcatcggcaccatggtctgcgttgagggcatcgtcaccaaatgctcgttggttaggccaaaagttgttaagagtgtccacttctgccctgtgactggggactttctctcgcgtgaatacagggacatcacatcttttgtaggcttgcctactggctcggtttatccaacaagggatgacaatggtaacttgttggttaccgagtatggaatgtgtgaatacaaggatcaccagacattgtccatgcaagaagtgcctgaaaattctgcacctggacagctcccaagaactgtcgatgttattgtagaagatgatcttgtagattgttgcaaacctggcgaccgtgtctcaattgtcggtgtgtacaaggctctaccagggaaaagcaagggaagtgttagtggtgtcttcagaactgtccttatcgcaaataatgtgtcgcttcttaacaaagaggcaaatgcacctgtctacactcgggaagatctgaagcggatgaaagaaatatcaaggagaaatgacacctttgacttactgggaaattctcttgctccatccatatatggtcatctatggataaagaaggcagtagtactgttgatgctaggtggtgtcgagaagaatctaaaaaatggaactcacttgagaggagatataaacatgatgatggtgggagatccttcagttgccaagtcccagctcctaagagctgtcatgaacattgcccctttggctatctcaacaactggcaggggttcatctggtgttggtttgactgctgctgtgacttctgatcaagagactggggagcgaaggcttgaagctggtgccatggttcttgctgatcgtggtgttgtctgcattgatgagtttgataaaatgaatgatcaagatcgagttgctattcatgaagttatggaacagcaaactgtaaccattgcaaaggcaggaatacatgcctcactaaatgcaagatgtagtgtaattgctgcagcaaatccaatatatggaacttatgatcgttcattgacaccaacaaagaatatcgggcttccggattcactgctttcccgttttgatttactttttattgttcttgatcaaatggaccctgagattgaccggcaaatctcagaacatgttgcccgaatgcatagatattgcactgacgatggaggagcaaggtctcttgataaagagggatatgctgaagaagatgatggtgatgctaatgcagccatttttgtcaagtatgatagaatgctccatggtcaggatagaagaagaggaaagaaatccaagcaggacaggctaactgtcaaatttctgaagaaatatattcattatgcgaagaaccttattcaaccaaggctcactgatgaggcatctgatcatattgcaacctcatatgctgagctcagggatggtagtgcaaatgcaaagtccggtggaggtacacttccaattacagcaaggacactggaaaccataattcgtctatcgacagctcatgccaagatgaaactgaggcatgaggttctgaaatccgatgttgaggctgcattgcaagttctaaattttgcaatataccacaaggaattgactgagatggaagagagagaacagagagaaatggagatgaaacagcaagctgatcatgatgcaggtgcaaccggtggcactgtggatgggcatggaagctctggcaatgatccaatggatgtggatgtaggatcaaatgatcagaatgtttccgcagagagaattgaagcatttgaagcacttctgggtcagcatgtgttggcaaaccatatagatcaaatgtcaattgatgatatcgagcagatggttaatagggagtcaactgcaccttacaccagaagccaagtagagtttattttggagaggatgcaagatgcaaacagggtaatgatacgagatggtgttgttcgaatcatataactaccagtctaccaggacgtttacctgtggatcccatggtcatgctgtgtcatggtgcctgtctgtctgtctgtaaccaacttatatgtcgaagtatttgtttcttagtgtttgtccacaaaggattgaggcaatcattgccccccttggtacttttagttcatgtgatgtattgcttacttacctgacctagtgatatctagtactcagtcacgtctggttgtgttcgagttaatttgcaaatgcagttgcattctgacgagtaaaattcacacgtgctgacctcccgggagtacgaaaaaaaaaaaaaaa

SEQ ID NO: 19401 - DNA, 639 bp, Zea mays
acaaatcgataaacaaatttctcaactcttatctctctcgcgaactacggttcaagatgcagatcttcgtgaagactctcaccggaaagaccatcacccttgaggtggaaagctcggacaccatcgacaacgtcaaggccaagatccaggacaaggagggaatcccaccggatcagcaaaggcttatcttcgccgggaagcaactcgaggatggacgtactctcgctgattacaacatccagaaggagtcgacccttcatctcgtcctcaggctccgcggtggtatgcagatcttcgttaagactctcaccggaaagactatcacactcgaggtggagagctccgacaccatcgacaacgtgaaagctaagatccaagacaaggagggtattcctcccgaccagcagcgtttgatcttcgccggcaagcagctcgaggatggtcgtaccttggctgactacaacattcagaaagagtcgacccttcacttggtgttgcgtctccgtggtggcatgcagatctttgtgaagactcttaccggaaagacgatcaccctcgaagttgagagctccgacaccattgacaacgtcaaggctaagattcaggacaaggagggaatcccaccagaccagcagcgtc

SEQ ID NO: 19402 - DNA, 651 bp, Zea mays
acaaatcgataaaccaatcattctcaattctatagctctctctctctctcgcgaatttacgaatcaaagatgcagatcttcgttaagactctcaccggaaagaccatcacccttgaggtggaaagctccgacaccatcgacaacgttaaagccaagattcaggacaaggagggaatccccccggatcagcaaaggcttatcttcgccggaaagcaactcgaggatggacgtactctcgctgattacaacatccagaaggagtcgacccttcatctcgtcctcaggctccgtggtggtatgcagatcttcgttaagactcttactggaaagacgatcacactcgaggtggagagctccgacaccatcgacaacgttaaagctaagatccaagacaaggagggtattcctcccgaccagcagcgtttgatctttgccggcaagcagctcgaggacggcagaaccctcgctgattacaatatccagaaggagtccactctccacttggtgttgcgtctacgtggaggtatgcagatctttgtcaagacccttaccggcaagaccattactctagaggtggagagttccgacaccattgacaacgtcaaggctaagatcagggacagggaaggcatcctcccggccagcagtagt

SEQ ID NO: 19403 - DNA, 3155 bp, Zea mays
aattcggcagaggctttaaggctggcgcccttcccccccgcctccgcccccccttcctcctgctcccgcccctcaatcaatcacgacgccacagccgcacccccgcgaaccctagctcgcagtcgcaccgcgcgccggacgctgaccaggtgcctgctctatctcctgcggtggccgtcgcgctgccgccgccagacccgatccgtccgaccgtgccaagcgccccccctccggcgatcgatgcgaggcgccgcgggaggcggctcgggctcgggcaggctgtgagctggagcctgtccgctcgctgcgtcgtgcgcctgccttccctctcacggtcggcctcgccgcgcgtttgctttcccgcccacgcagggatcttcgcgggcggggagttgaagcgcgagatttgcgcggctacgattctgcgttgccgagggagcaagggaaccaatggctgcagcggtggcgatgcgagggggaagcagcgacagcggaggatttgacaaggttcccgggatggactcggggaaatacgtgcgctacaccccggagcaagttgaggtgctcgagcggctctacatcgattgccccaagccaagctcctcacggcgccagcaactgctgcgcgagtgtcctatactctccaacattgagccgaagcagatcaaggtctggttccagaaccgaaggtgccgcgataagcagcggaaggagtcttcgcggcttcaggctgtcaacagaaagctgacggcaatgaacaagcttcttatggaagagaatgagcgtcttcagaagcaagtctctcagttggttcatgaaaatgcgcacatgcggcagcagctgcagaacacttcattggccaatgatacaagctgtgaatcaaatgtcactgcccctccaaacgctataagggatgcaagtaacccttctggactccttgcgattgcggaggagaccttcacagagttcctctcaaaggctactgggacagctattgattgggtccagatgcctgggatgaagcctggtccggattcggttggtattgtggccatttcgcatggttgccgtggcgttgctgcccgcgcctgtggtttggtgaatctagaaccaacaaaagtcatagaaatcttgaaagatcgtccctcttggttccgtgattgtcgaagtctggaagtgtttacaatgtttccagctggaaatgggggaacaattgaacttatctacatgcagatgtacgccccaacaactttagttcctgcacgtgacttttggacgttgcgatacacgacaacaatggaagatggcagccttgtggtctgtgagagatccttgactggttctggaggcggtccaaatgcagcttctgcacagcaatttgttagggctgagatgcttccaagtgggtatttagtgcgcccatgcgaaggtggaggttcgattgtgcatatagtggaccatctagatctcgaggcatggagtgttcctgaagtgcttcgaccactatatgagtcttctagagtagttgctcagaaaatgactactgtggcactgcgccaccttagacaaattgctcaagaaacaagtggagaagtagtgtatgccttgggaaggcaacctgcagttctacggacctttagtcaaagactaagcagggggtttaatgatgccattagtggtttcaacgatgatggttggtctgtaatggggggagatggcattgaagacgttgttgttgcttgcaactcaaccaagaaaattaggaataatagcaatgctgggattacatttggagcgcctggaggcattatttgtgcgaaggcatccatgttactgcagagcgtcccaccggcagtactggtccgatttctgagggagcatagatctgaatgggccgattacaatattgatgtgtatttggcttcatcactgaagaccagtgcgtgctcacttcctgggttgcgacccatgagattttctggggggcagatgatcatgccacttgctcacacagtggagaacgaggagattcttgaagttgtccgccttgaaggacaacctcttactcatgatgaagcccttctttcaagggacatccaccttctccagctttgcactggaatagatgagaaatctgtgggttcctccttccagcttgtgtttgcaccaattgatgagcattttccggatgatgctccattgatttcctctggctttcgtgtcataccacttgatatgaaaacagatggtgtatcctctggtaggacgctagatttggcatctagtcttgatgtgggttctgctgcaccccaagcctcaggggatgcacctccagatgactgtaatttgagatctgtgctgacaatcgcctttcaattcccttatgagatgcaccttcaggacagtgttgctactatggcccgtcaatatgtgcgtagtgttgtttctgctgtgcaaagggtgtcgatggctatatctccctcccaatctggtctaaatgctgggcagaggatgctttccggcttccctgaagctgccacacttgctagatgggtttgccagagttatcactaccatctaggtgtggaattactcaaccaatcagatgaagctggtgaagcattgttgaaaatgctctggcatcatccagatgctattctgtgctgctcttttaaggagaaacctatgtttacgtttgcaaacaaggcagggctcgacatgttagaaacatctcttattgcgctgcaagacctgacgctagacaagatcttcgacgagtcaggaaggaaagcaatattctcagatatctcaaaactaatggaacagggctacgcgtacctgccgtcgggcgtgtgcatgtcaggaatgggtcggcatgtctcattcgaccaagctgtagcgtggaaggtgctcggcgaggacagcagcgtccactgcctggcgttctgcttcgtcaactggtccttcgtttgacacgccatcccatggcctgtgtgatgagcaggccaatttttttgtatggtgatcccaatatggggaaaccatcagctgtgacagaaggctttatgttgcatgcactagttgtacgtcttgaatcgagtgtatttatgaagaaattggatactgcgcaaaaaaaaaaaaaaaaaagcggccgc

SEQ ID NO: 19404 - DNA, 1544 bp, Zea mays
gcacgagaccattacctagaacatcctaatcgaaaaaaattaggaataccagcaatgctgggattacatttggagccccaggaggcattatttgtgcgaaggcatccatgttactgcagagcgtcccaccagcagtactggtacgatttctgagggagcatagatccgaatgggctgattacaatattgatgcatatttggcttcatcattgaagaccagtgcgtgctcacttcctgggttgcgacccatgagattttctgaggggcagatgatcatgccacttgctcacacagtggagaacgaggagattcttgaagttgtccgccttgaaggtcaacctcttactcatgatgaagctcttctttcaagggacatccaccttctccagctttgcactggaatagatgagaaatctgtgggttcctccttccagcttgtgtttgcaccaattgatgagcatttcccagatgatgctccattgatttcttctggctttcgtgtcataccacttgatgtgaaaacagatggtgtatcctctggtaggacgctagatttggcatctagtcttgatgtgggctctgctgcaccccaagcctcaggggatgcatctccagatgactgcaatttgagatctgtgctgacaatcgcctttcaattcccgtatgagatgcaccttcaggacagcgttgcagcaatggcccgtcaatatgttcgtagtgtcatttctgctgtgcaaagagtgtcgatggctatatctccctcccaatctggtctaaatgctgggcataggatgctttctggcttccctgaagctgccacacttgctagatgggtttgccagagttatcactaccatctaggtatggaattacttaatcaatcagatggagctggtgaagcattgttgaaaatgctctggcatcatccagatgctgttctgtgctgctcctttaaggagaaacctatgtttacgtttgcaaacaaggcagggctggacatgttagaaacatctcttgttgcgctgcaagacctgacgctagacaagatcttcgacgagtcaggaaggaaagcactattctcagacatctcgaaactaatggaacagggctacgcgtacctgccgtcaggcgtgtgcatgtcaggaatgggccgccatgtttctttcgaccaagctgtagcgtggaaggtgctcggcgaggatagcaacatccactgcctggcgttctgcttcgtcaactggtccttcgtgtgactgaagcccaacccgtcgggtggttatggcgagctgacccatttttttttgtatggaaaatcatcagctgtgacaaaaggcatatgttgctaggtgtcatagtgatgcacggctacacatgatccagcattaaccaaacaaccgcgtcgccagtttctttctattcgatcagggagatgcattttctggcaaaaatcttatatttttcttgctgcaaatttggtctgtatatggaactgctgctggacgccgagaaagcccacatatgcggaaactaactatggctcgagg

SEQ ID NO: 19405 - DNA, 1105 bp, Zea mays
  misc_feature (34)..(109): n is a, c, g, or t
acgaggtggtaggacgctagatttggcatctagnnnnnnnnnnnnnnnnnnnnnnnnnnnnnnnnnnnnnnnnnnnnnnnnnnnnnnnnnnnnnnnnnnnnnnnnnnnnacaatcgcctttcaattcccgtatgagatgcaccttcaggacagcgttgcagcaatggcccgtcaatatgttcggggtgcctcgtcgccggcccggagagtgtcgatggctatatctccctcccaatctggtctaaatgctgggcataggatgctttctggcttccctgaagctgccacacttgctagatgggtttgccagagttatcactaccatctaggtatggaattacttaatcaatcagatggagctggtgaagcattgttgaaaatgctctggcatcatccagatgctgttctgtgctgctcctttaaggagaaacctatgtttacgtttgcaaacaaggcagggctggacatgttagaaacatctcttgttgcgctgcaagacctgacgctagacaagatcttcgacgagtcaggaaggaaagcactattctcagacatctcgaaactaatggaacagggctacgcgtacctgccgtcaggcgtgtgcatgtcaggaatgggccgccatgtttctttcgaccaagctgtagcgtggaaggtgctcggcgaggatagcaacatccactgcctggcgttctgcttcgtcaactggtccttcgtgtgactgaagtccaacccgtcgggtggttatggcgagctgacccatttttttttgtatggaaaatcatcagctgtgacaaaaggcatatgttgcatgcactagttgaagaaactggtccaattgcttttttggtctgtcattccattcagatgttgctaggtgtggagtggaaatggggcaatagtgatgcacggctacacatgacccagcattaaccaaacaaccgcgtcgccagtttctttctattcgatcagggagatgcattttctggcaaaaaatcttctatttttttgttgcaaatttggtctgtatatggaactgctgctggacgccgagaaagcaaaacatatgcggaaactcactatggctcgagagtcttctagacgg

SEQ ID NO: 19406 - DNA, 3070 bp, Zea mays
cggccgggccggggcgccctcctgcactctccccactcaacaatcaaccacggcgtcacaaccgaaccctagctagcaccgcgcgccggagccccggagtaggtgcctgcttgccctcctgcggtggccgtcgcgctgccgccgcctgatccgattcgtctagccgtgtcaagcgccaccaccggtgatcgatgcgaggcgccgcgggaggcggctcgggctcgggcaggctgtgaggagaggctgtccgctcgctgcgtcgtgcgcctgtctgcgcgcgcgtctgctccgccgtccgcgccaagccgtccctcgccgaggggggctgcctctcacggccgctcggcctcgccgcgcgtctgcttcccaccacccacgcagggaccctcgcgggctggaggtcgaagcgcgagcggagagctaagagcaacaaggcgacgagatttgtgtggctacgattttgcgttgccgacggaacatgggaacaatggttgcagcggtggcgttgcgagggggaagcagcgatagcggaggatttgataaggttcccgggatggactcgggaaaatacgtgcgctacaccccggagcaagttgaggtgctcgagcggctctacatagattgccccaagccaagctcctcacggcggcagcaactgctgcgcgagtgtcctatactctccaacattgagccaaagcagatccaggtctggttccagaaccggaggtgccgcgataagcagcggaaggagtcttcgcggcttcaggctgtgaacagaaagttgacggcaatgaacaagcttctcatggaagagaatgagcggcttcagaagcaagtctctcagttggttcatgaaaacgcgcacatgcggcagcagctgcagaatacttcattggccaatgacacaagctgtgaatcaaatgtcactacccctccaaaccctataagggacgcaagtaacccttctggactccttgcgattgcagaggagaccttcacagagttcctctcaaaggctactgggacagctattgattgggtccagatgcctgggatgaagcctggtccggattcagttggtatcgtggccatttcgcatggttgccgtggcgttgctgcccgcgcctgtggtttggtgaatctagaaccaacaaaaggcatagagatcttgaaagatcgtccctcttggttccgtgattgccgaagtcttgaagtgtttacaaggtttccagctggaaatgggggaacaattgaacttatttacatgcagatgtatgccccaacaactttagtccctgcacgtgatttttggacactacgatacacgacaacaatggaagatggcagccttgtggtctgtgagagatccttgagtggttctggtggtggtccaaatgcagcctctacacaacaatttgttagggctgagatgcttccaagtgggtatttagttcgcccatgcgaaggtggaggatcaattgtgcatatagtggaccatctagatctcgaagcatggagtgttcctgaagtgcttcgaccactgtatgagtcttctagagttgttgctcagaaaatgactactgtggcactgcgccaccttagacaaattgctcaagaaacaagtggagaagtagtgtacgccttgggaaggcaacctgcagtcctacggacctttagtcaaagactaagcagggggtttaatgatgccattagcggtttcaatgatgatggctggtctgtaatggggggagatggcattgaagacgttgttattgcttgcaactcaaccaagaaaattaggaataccagcaatgctgggattacatttggagccccaggaggcattatttgtgcgaaggcatccatgttactgcagagcgtcccaccggcagtactggtacgatttctgagggagcatagatctgaatgggctgattacaatattgatgcgtatttggcttcatcattgaagaccagtgcgtgctcacttcctgggttgcgacccatgagattttctgaggggcagatgatcatgccacttgctcacacagttgagaacgaggagattcttgaagttgtccgccttgaaggtcagcctcttactcatgatgaagctcttctttcaagggacatccaccttctccagctttgcactggaatagatgagaaatctgtgggttcctccttccagcttgtgtttgcaccaattgatgagcatttcccagatgatgctccattgatttcttctggctttcgtgtcataccacttgatgtgaaaacagatggtgtatcctctggtaggacgctagatttggcatctagtcttgatgtgggctctgctgcaccccaagcctcaggggatgcatctccagatgactgcagtttgagatctgtgctgacaatcgcctttcaattcccgtatgagatgcaccttcaggacagcgttgcagcaatggcccgtcaatatgttcgtagtgtcatttctgctgtgcaaagagtgtcgatggctatatctccctcccaatctggtctaaatgctgggcataggatgctttctggcttccctgaagctgccacacttgctagatgggtttgccagagttatcagtaatttccttcccgtgctgtttctgatacctcacctaaatggtttggttcttttttattgtaatctcatagctattcttttgggccccaatacagctaccatctaggtatggaattacttaatcaatcagatggagctggtgaagcattgttgaaaatgctctggcatcatccagatgctgttctgtgctgctcctttaaggtatcagaagagttttactcaagtctgcaatattccaatcttctaaagtagaggcagacccctccacccatgttttaatgctttcacaacgaaattttcgtgctgccttttgtaccctataatagatatctatatatggattatgcatgggagcagatgagcctgcacccttcctacctttgtgaatgatgcaatgcaatctagtatgcccttttcctgtatcttgttaaagccatgtatgaatgctttgagatacctttt

SEQ ID NO: 19407 - DNA, 575 bp, Zea mays
cctcgcgcgcacgttctgccgcgcgcatacgcccgcatcccgcagccgcggcagcgccgcagccgctccttccatcctccgccctccttccatcctccgcggatcccagctctccctcccgcgcccgcccgcagccgcaccgcatcccgcagccggcgtcggcgcaacggctgatgctcaaggggtgtgagtcgctgctacagcggcagtgccggccgcgcacccccgcggggtacatggagcccacgccgctaccggttggcggtgaagagcaaggggacagataagcccaaaggcagcaaggggaacgtcgacaaggaccccaacaagcctgactcccaacacttttttgttcgctggtgctgcggcgacggtgctggcgagctctcccgtgctgggctctgggatgctcccaggcaccgggttcggcgagacgtggagtcaccacacggcggatgcgccgccgctgctgccttgcagttcctcgatcgattcaagggaatattgtcagtggaagagactggtgaatcaaaggcagtcaacgctagatggggaggcgaagtgcctgctgattg

SEQ ID NO: 19408 - DNA, 1633 bp, Zea mays
tttgggtccctcgggccggccggcccgcgccactttcatcctctcccagtatccacgggctcgcacgcagtcgccgccgccctgcccgtctccttcctgtcgtctccccttctccaatcgcttcccgatcccagccaatatctcagacggaatcgatccaaagctatcctagggttccgccgtcccgtcccgtccagatccgggctcgtcgatggggaaggagggcgtggcggcggggccggcggcggaggggagtaaatcgcggtctgagtgtatcaactcgtccaacccgtaccacgagtgctccgactactgcctccgcaagatcgccgaggccaggcagcgcctcgacgacgagctccctgactcgtggaagcgcccgcccgagcagcgcaccgtccacccggactgcatcaacgcctccaacccctaccacgagtgctccgactactgcttcaagcgcatcgccgacgctaaatcccctgcctgcgggctggagcgtgaggagcgaccgccaccagctgatgtgtttgccgccgccggcttgtctgatgccgtggagcagcatcggcctgtagattacgattccgacgaacaggagggcgcagacccggatgacggctacccgcagatgacggagaagcagaagaagctgttcgagctgcggcttaagatgaatgaagcacggaaagcgaatcagcaggcgatggttgccgagaagaaaaggatggagcctcgtggcgagagccgaggtgtttcgaagcagaagtggctagacgacaggaagaagaagatcgggaagctgctggactcaaatgggcttgatatgaaaatggcgtacatgctcgacacgcaggagtctgcagaagccaagtacaagaagtgggagaaggaacctgctccatatgggtgggatggtgagtgagctcaatcctctaacgtccactgatgactgattggtagaaagcactgttttgtagagacagcagaaaatgcatacattggctatgtttactggacagcttctatgcttttctcaagtcaaatgttatggttaagtactgtttcatttttttccatttacacagcatgtcatacatcttgaagtcgaaatgttcctttatttgtttgagtcacatctgtggttttaaatagcccgctatagcttagttatagctctttagaagatctaccgctacgctattatcatttgttcttctattgccgctaatgaacttttagctcagctaaacactgttatttgatttagacatgatatatttttagctaatcctaattgaggtagatacaatatttagtctagaggattataatctatgtctctcctttagattttttacttcataaatgatgtaataaaccattgaataattattgaactgttgaatgttgagtgttgatcgcaatagtgtgttgatcgatatgatgaacattgattaatggacttggaaatgtattctcctagatattctaagtatttatcttcataaagaatttgcctagttaaatgtttctgtgcatgattcatgaagaattttcatgttttctataaaaccactaaatggatagctttctttattgcacgttgtttaaaacattggtcgcatctgaa

SEQ ID NO: 19409 - DNA, 2371 bp, Zea mays
ggaatctgcgcagaacattatcccgtgacaatctagacctatcatctccttccagtcgagagaactttatcatcaaacattttaaaggaaatggcgatgccttccgtggccttcggttgaaaaagaagctgcgagattttaacaagtatgccaaggtaagacctttgaagtggggatggattgtctattacaacgaccccacgtcgtcccccataggcagagccaaggcgacgaggttggtacctcccccctcccgctccccagcctcaccgtcgccagagcgtcctgccgagaggctcacatgggcatgaggatggcggcaacggggagctgctctgctcttccctctcgcacacatgcaccccctccacggccctcatcctatctcgactgtggcttcgccagcacattgaggttcgacggatctaggccccatcggcttagatcttgccctccctcgccggatctacaccatggaggtggtggtccttctggggaggagagctgaaacctgcttgtgcgttaggaggctacatggatagagagatgatgtaggtaatttagccttttcgccccaattatgctccagtatttgctgatgtaccaccaaatgtttttgaggagcatgcctcaccatcacctgagcagatattgcaacgcgggctggtgaaataggggaactaggcaattgtttagattctggtaaaatggaatgagctaccagcagaaatggcttcctgggaagactaccatgttctcaaggctaaatttcctacatcaccgatctggagaccaggcggttcttcagcggggtattgtcactacggtgactacggatagtcagatggctaaagagtaacggatttgatgcttgaaggttcaatgtctggcttgctgtgttgggccgtgtggccttgtaatctggtgtgtgtgctagcccattgtagaggcatatatagggcaaggatgtgccttgtaaaggaactatgaaaatagaaataacagaatatcaaattccccataccccaaaaaaaaaaaaaaaagccttccgccctcttctcttttggaattcatctcgccgccgccgccgactcgtcgggacgtaacaactggtattggattcaatctgggcgcgcgccgcctcgtctgcaaggagttttcagttgctgcgtacctctccgaagacttcgcacttccctcaaggcgtcgccacggctcctccaagcaagcgcagcacacacggcaggtgatggcgggtatctcagagatggaacaacgtctagcagagaagttcgacgccaccatcaaactgttggcagatactacgcttaaagaactttcagagaagttgactcgattggatgatgtctccaccaagttgatcaacatcaagaagaaacaagatgaacatcgacaaatccatgagttacattcaggccaagttcgacatcttgatgaagtcgttggcgcacatgcagcaagagcagaccaaactgtcaggtatgatgcgtcatcctacaacgcctgctcccgtccgaatggttcttctgcaaacacatcaaccaaccaggatacaaattctctgctgaatttaacaacagagaatgaatcttctgttcctcgctcatgcttgccgaaaatggattttcctcgtttcgatggatcggatgtgcgagtttgattggatcagtgtgaatcctattttacactgtattcgattcctgattatttcagagtttttgctgtttctcttcatttgtcaggcaaagctagtcactggtatcaatcttataaggagatgtttggccaactcgattggactttgttcaagaaagcagtgactgaggagtttgatatttctacccatcgagataagatgttagaactactcacacttcgaccgacaaattcagtgggggacttcaaacaacagtttgaagacttggtctatcatattaggttgtttgacaagtcgattagtgacacatttttggtcactcagtttatattgggtttgaaacatgaaattaggatgctggtagaaccctattttcctgattctgtacccaaagcagcagggttggctcttcttcaagagaagatgttagcgaagaatactaatgccaaaccctccaatttcaggcaacatgtttctggtaaatctgacacagccacaacacctggaaagttgtggaaagcaaagcagctgaagaatatagacgtgctagtgctaatggactgtgttacaagtgtggtgataaatatacacccggtcataagtgtcagtattggaatgtggaatgcttgttgtattgcataggagatggggtacaatatatagactcacaggaaaccctaaccataatgggcc

SEQ ID NO: 19410 - DNA, 1497 bp, Zea mays
cactttcatccgctccctcgagccccgcccgcgcacgcagtcgccgccgccctgcccgtccccctcctgtcgcctccccttctccaatcgcttcccgatcccagccaatatctcagacggaatcgatccaaagctatcctagggttccgccgtcccgtccagatccgggctcgtcgatggggaaggagggcgtggcggcggggccggcggcggaggggagtaaatcgcggtcggagtgtatcaactcgtccaacccgtaccacgagtgctccgactactgcctccgcaagatcgccgaggccaggcagcgcctcgacgacgagctccctgactcgtggaagcgcccgcccgagcagcgcaccgtccacccggactgcatcaatgcctccaacccttaccacgagtgctccgactactgcttcaagcgcatcgccgacgctaaatcccctgcctgcgggctggagcgtgaggagcgacagccaccagctgatgtgtttgccgccgccggcatgtctgatgccgtggagcagcatcggcctatagataacgattccgacgaacaggagggcgcaggtccggatgacggctacccgcagatgacggagaagcagaagaagttgttcgagctgcggcttaagatgaatgaagcacggaaagcgaaccagcaggcgatggttgccgagaagaaaaggatggagcctcgtggcgagagccgaggtgtttctaagcagaagtggttagacgacaggaagaagaagattgggaagctgctggactcgaatgggcttgatatgaaaatggcgtacatgctcgacacgcaggagactgcagaagccaagtacaagaagtgggagaaggaacctgctccatatgggtgggatgttttcaatcaaaagaccttgtatgacgcatacaagaagaggaccaagaacatagaagttgacatggagtcttacaataaagccaaagaagctgatcctgaattctaccgcgacgcctcaagtctccagtatgggaaggtgtccaatgtcccagaagaaaacatcgacaagatggtaaaggaactcagggagcgggaagagaagcggaaatcgttcagcaggaggcgcaagttcaacgaagacaaggacattgactccatcaatgaccggaacgagcacttcaacaagaaggttgagcgtgccttcggcaagtacacgctcgagatcaagaacaacctcgaaagaggtactgcgctgccggactaataaaaccttacacggcagctatcttcgaccgtttttcaagctaaccagtcgactagaggcgtgtgtccctgctgctgttttccttttcgcacggttacttgtatgcttgtaacttaacttgaggccacagttccattgtgacttgtaacaaaacctggactgggttgtgtaatgacgcgaggctgaagcaaacatttgtgtatgcatatgagttgtcaaaaagcggccaaggccggtcggcgactagtga

SEQ ID NO: 19411 - DNA, 1581 bp, Zea mays
aggaaatatctcacgtagacggactcgccgccgccccgtctccggtccccttccccgatcccagccaatatcccagacggaatcgatctacggctaacctagggttcccgtcccgtccggatccgtcgatggggaaggagggcgtggtggcagggccggcggcggatgggagtaaatcgcggccggagtgcatcaactcgtccaacccgtaccacgagtgcactgactactgcctccgcaagatcgccgaggccaggcagcgcctcgacgacgagctccccgactcgtggaagcgcccgcccgagcaccgcaccgtccaccgggactgcatcaacgcctgcaacccctaccacgagtgctccgactactgcttcaagcgcatcgccgacgccaagtcagggcttgagcgtggggagcaacagccaccagctgacgtggccaccgctgccggcacgtctgatgccgtggagcagcagcaacttgaagataacgatgccgacggacaggagggcgcagccgcggatgacggctacccgcagatgacggaaaagcagaagaagctgttcgagctgcgccttaagatgaatgaagcgcggaaagcgaatcagcaggcaatggttgccgagaagaaaaggatggaaccgcggggcgagagccgaggtgtttctaagcagaagtggctggacgacaggaagaagaagatcgggaagctgctggactcaaatggccttgatatgtccaaggcgtacatgctcgatacgcaggagactgcagaagccaagtacaagaaatgggagaaggaacctgctccatatgggtgggatgttttcaatcaaaagaccttgtatgatgcatacaaaaagaggaccaaggatatagaagttgacatggaggcgtacaataaagccaaggaagctgatcctgaattctaccgtgacgcctccagtctccagtacgggaaggtgtccaatgtccctgaagaaaacattgacaagatggtcaaggaactcaaggagcgggaagagaagcggaaatcgttcagcaggaggcgcaagttcaacgaagacaaggacattgattcgatcaacgaccggaatgagcacttcaacaagaaggttgagcgcgcgttcggcaagtacacgctcgagatcaagaacaacctcgaaagaggtactgccttgccggactaaaactgtacacagcagctcggtatcaagaacagcatgggaagagaggtaaggtactggcttgccggactaaggaccttacacagcagctatcttatggcgctcaagctaaccactcgcctagaggcgggtgtccctggtgttttccttttcgcatggttacttcttgcctgtatgctcggaactcgtggccacggttccattttgatttgtaagaaaccggggactgggttgtcatgacgttaggttgaagtaatgtacagaccaagttgtgcctgaatggaatggttgatttgtaatggtgtatatgccgcgacgaggtttatgtaatttaaaatcaattctgagacattgagaccaaagcggccaaaaaaaaaaaaaaaactcgagagtg

SEQ ID NO: 19412 - DNA, 633 bp, Zea mays
atatcatcttctagatatagtttctcttcttcttataaacttcgtatactccattttaaggaaacgggagagtacacgtagtgtgtcagagggtgagaatcccaatgaggatcttacccgagcctctaggttcggttccatgcctcattctcctcgtgtcgtcggttctattttcagcgactctatccctcgctcgtgtcgtcgaagttgttggttacgccgagagcaaaatcaaaaatccccatgcattcacaggactccgagtgacgattgaatgtaagggggagaaagggcattttgttacaaaaggttctggaaacattgatgaggaaggaaagttcggtctgaaagttcttcctcatgacattatctctgacgacggagccttaaaggaggagtgttatgcccagcttcacagtgcggcgggagcaccttgtccggctcacgacggccttgagtcaaacaagatcgtgtttctatacacatccggagacaaacacgttttgggcctcaaacaaaacctgaggtttacacctgaactttgtgtttccaaattcttttggcctatgcctaagttcccttcctgttaagggatttgaacatcatttccctttacccccaccggtcccctaa

SEQ ID NO: 19413 - DNA, 5023 bp, Zea mays
accgacgatgcagccgtaggccaggggccccaggtcttcctctggtccttctccggcgaattcggcacgagagcagttactgtggacgatgttcgtttgtgtttatcattttcttggtcttgttcggggcaacaacgacattgggaataagtgtatggcagacaaacagtaacatgggaaggaaaggctcagaaatgtcaccaagtaaaaggtatcccttgaggtctccacatagtagtggtagagttcttcgctctgccttagccaatgataataaggacagtgagcctctgaatgctgctgctgctacccaagccgctgtgaaaaaaagaagtggcagtcagttggatagtcctaatagcagtgtcaggttgcttcactctacatcaaaaaataagaacgaggcatgtagcgggcctctaaatgacaggatccctgataagccagctgcaaataaaagaaaacgtgccagtccttcacaggtgggaagttccagcaacagtgtcagggtgcttcgctctgcaataaaaaataaagatgaggcatgcagtaaatctctaagtgacaggaccgctggtgagccagctgcaaataaaagaaaaaacgtcaatcgctcaaagacggggagtctgagctgtggtgtcagggtgcttctatctgcttcaaaagctaaggatgagacatctaccaagcctttaaatgatagtgctgctgttgaaccagcttcaggtaaaaggaaaggcaccagtccgtcaaaggtgggaagtgccagcaatagtgtcagggtgcttcgatctacttcaaaatataagaatgagacatgtactgagcctttaaatgatagtggtgctgttgaaccagctgcaaataaaaggaaaggtgtcagtcgttcaaaggagagaagtctcaatagcagtgtcagggtgcttcgctctgcctcaaataataagattgaggtatctattaagcctctaggtaatagtactgctggccaaccagctgcgaaaagaagaaaaagcggcagttccttcgaggcaggaagccctgtgagcagtgccagggtgcttcgctctacctcagaaaggaagaatgaggcatctaagcctttaaatgaaagtactgctgctcaaccagctgcgaggaaaaaaaaagctggggtaatttcaaagaccgacaatccaaagattggtctcagggttcttcgctctgcctcaggaaagaagaatgaagcatgtattgggcatgtaaatgatagtacttctgctgaaccaactgtgacaaaaagaaaccgcaagccttcaatggatcgcagtcccaagaaggactacttaaaaatttgtcaaagagttagatatattttgaatcgaatgaactatcaacaaacctttattcaagcttatgcaagtgaaggttggaaaggccaaagtttggaaaaaataagacctgaaaaggagcttgaacgagccaaggcagaaatcctccaatgcaagttaagaatccgtgaagcttttcgaaatatggactctcttttatccaaggggaagcttgaagaatctttgtttgattccgcaggagaaatttcaagcgaagatatattttgtgctgtatgtggctcaaaggatgttactttacaaaatgacatcattctttgtgatggagcctgtgacagaggattccaccagaactgtttgaaccctcctttgctaactgaagatatacctccgggggatcaaagatggctttgccctgcatgtgtctgcaaagcagactctatagatgcactaaatgaacttcaagggagcaagctctccattcatgactcatgggagaaagttttccctgaggcagcttcaattgccaacggttctaaacaagttgatacttctgatctgctgccagatcatataaagcacagtgacaaccctgcattggttgaagggctgatggtggatgaagtcaggctttctgcagaggatgacagcaaagcggatgaccttcgcttgtcttcggaggactcaggggatggtgacttcgatccgtcaggtccagattctagtgaagaccaaaaagatggattgaactcagaagagtcagatttcacatctgactctgatgatttttgtgctgagattgccaaatcttgtggccaggatgaagtctcggcatctccattatcaaatgtgataaaccatacttatagaatgaaactcagggccagcaacaaccgctctaatgaagaaaaccatgatcatgtatttatggacatggagctagggcaagacatggtgctaccagtttcaagcaggcggcaggtggaacggttggattacaaaaaactatatgatgaggcatatgggaaagaatcatctaattcaagtgatgacaaagagtggtctggaaaagaactattagaaggcagtgaaacagattcacttagtgagcgacctcatcctgtaaaacggtgctctagaagagcacaagcagagcagcagaataatgaacatacaccacagagggagcgccttcatggttctgaaagtgagcagaaaactggaattcttcgatccaatggcagcagtagcacaggacggaagtttggtcctgtagctacccagaaattgaaggtacattttgagaaagatccatatcctagccgtgaaacgaaagagaatatatcagaagaactaggcttgacatttaatcaggtctccagatggttctctagcactcgtcactattcaagggttgcttctgccagaaaagaaatgcatcctgacggccatactagcgagaataatgataccacgactgtagatagcatgcaagcaaggcaacccaacactgtggtgatggaaaagttgactgggaatagaaatgacattgtttctgagaaaccgatggtgcagaacaatcttaaccaaggggtggcagaaaagttgactagggatagaaatgacattgttcctgagaaacaggtggtgcagagcaatcttaaccaatgtaataatgaagatatcccgctttctggaacagaaattgagatggagtcttacgaacaagaatcatctgaaagcagtgatgaagagtggtccacacttagcacaccacgaaaaacaaaattacaaggcaacgaaaaagtatcacttactgaatcactacgttctgcaaaacggtgttctagaagagcaccagctagggagcagaataatgaacatactcagagtgagcaacttcatggttctgtaagtaaacagcaaactgaagttcttcgctccaatgtcagcagtggcgatgcctcaaaatgtcattttggccctatagttactcagaagctgaaggaacattttgaaaaagatccatatccttgccgtgcaacaaaagagggtctggcacaagagctaggactgacatttaatcagatcagtaagtggttctctgccacccatcattattcaagagatgctgttgccaagaaccaaaaatacccaggagaaaatactactgagaataatagtagcacaatctttgatggtatacaagtaatagaacccaattttggtttgatagataaaccagatgcagatacaaatgacatgatttctgaaaagttgatggtacaaattaatcttaacgaaggcattgaagaggatatcccaccgagccaatatactaccaggtgtgaagagaaattaactatgactcaagctgccatctcaagggaagctggacctccaggttatggtcctggagaaaactttcttcaggtcagttcaaggattactagctgtgagcagagtgtgataatggctcctagcgctatcgcaagaggagttggtccaccaggatatacgcctggagaacaccagggcaatggggctccatggaatacaagctatgagcgaagaccgtttacgagtcctgcgactagctcaagagaagtcggacctccaggatatgggcctgaagaaaaccaaggcagtggcatttcctgtaatacaagcagagagcaaatattgtttatgagccctacaaccatctcgagagaacttggtccaccaggatatttgcccagagaaaaccagcgcagtgacacttcatggaatacaagctgcgagtcgggactatttatgagtcctgcgaccacctcaatagaacatggtccaccaggatatgggcctggagaaaaccaggagaatgacagtacaagctgcgagttgagaatgtttacaagtcctacaatcgtctccagagaagttggcccaccaggataccagcagggagtgtttatgagtcctaaaaccatctcaagagaagtctgtcctccaggatttgggtctggagagaaccagggcaacgacactacatggtacaaacagagcgcgtttacaagtcctacaaccatctcgagagaagtcggtccgccagggtatggacaggaagatcagggcaatggtggttcttggaacacgagttgtgagcagggagtgtttacgagtcctactagaggcatctcaagagaagtcggtccgccaggatacgggcccggggaaagtcagggcaataccacttcgtggatttcgacctgccagcagagaatgcttgcaggaatccagagaactggtggctcaaggagtatggacttggaagcctttccaccgggatacggacctggtggtgcttcagggagtgtcataagcccccaagctcggtctgcagagaatgtagaattttcggacgaggctagaaaaaaggctatacagcgggagctgagacggcggcagaagttcaggtgaaggcaatatatccagtcttcaagacaagacaatatatccagtcttgatggctgaatgagtgggcgaccttagttgccatcaagcaaaacccttgttgtatcagctgcttatcttccttttacagacttgcttggtttgtcaaggatttcttatgtgaaccctcttgaacctgaagtattcaatgcgctgtgaatttgtgcagttgcctttctcagccatgatagtaaaaa

SEQ ID NO: 19414 - DNA, 5316 bp, Zea mays
  misc_feature (5251)..(5311): n is a, c, g, or t
gactgcctacagatgcaaatcagtaccaggcgtgctctccgtgagctctacgcctctacctgtgtcttggcgacgactgggcgaccgacgacgcagccgtaggacaggcgaccgacgacgcagccgtaggataggcgaccaggtcttcctgttggctcttgcccttcgccggcgacgagcacccgccaggccacaacgacattgggaacaagtgtatgacatacaaacagtaaaatgggaaggaaagggtcagaagtatcaccaagcaaaaggtatcccttgaggtctgcacacagtagtggtagagttcttcgctctgccttagccaataataataaggacagtgagcctctgaatgcggctgctgctacccaagcagctgtgaaaaaaagaagtggcaaccagctagatagtcctaatagcactgtcaggctacttcgttctacgtcaaaaaataaggacgaggcacatagcgggcctcttaatgacaggatcattgataagccagctgcaaataaaagaaaacatgccaatccctcacaggttggaagtcccagcagcagtgtcagggtgcttcgctctgcaataaaaaataaagatatggcgcgcagtgagcctcaaagtgacaggaccgctggtgaggcagctacaaataaaagaaaaaacgccaattcctcaaaggtggggagtctgagctctggtctcagtgtgcttcggtctgcttcaaaagctaaggatgagacatgtatcaaacctttaaatgatagtcctgctgttgaaccagcttcaagtaaaagaaaatgcaccagtccgtcaaaggtgggaagtcccagcaacagtgtcagggtgcttcgatctacttcaaaatataagaatgagacatgtaccgagcctttaaatgatagtggtgctgttgaaccagctgcaaatagaaggaaaggtgtcagtcgttcaaaggagggaagtcccaatagcagtgtcagggtgcttcgctctgcctcaaataataagattgatgtatctattgagccactgaataatagtactactggtcaaccggctgcgaaaagaagaaaaaatggcagttcctttaagagcagtgccagggtgctttgctctacctcagaaaggaaaaatgaggcatctagtgagcctttaaatgatagtactgctgctcagccagctgcgaggaaaaagaaaggtggtgcaatgccaaagactgataacccaaagattggtgtcagggttcttcgctctgcctcaggaaagaagaatgagacatgtactgagcctgtaaatcggagtacttctcgtgaaccaactgtgacaaaaaaaagaaattgcaagccttcaaaggatcgcggtcccaagaaggactacttaaaaatttgtcaaagaattaaatatattttgaatcgaatgaagtatgaacaagcctttattcaggcttatgcaagtgaaggttggaaaggccaaagtttggaaaaaataagacccgagaaggagcttgaacgagccaaggcagaaatccttcaatgcaagttaagaatccgggaagcttttcgaaatatggactctcttttatcgaaggggaagcttgaagaatctttgtttgattcagcaggacaaatttcaagcgaagatatattttgtgccatatgtggctcaaaggatgttacttcacaaaatgacatcattctttgtgatggagcctgtgacagaggattccaccagaattgtttgagccctcctttgctaactgaagaaattcctccgggggatgaaggatggctttgccctgcatgtgtgtgcaaagcagactatatagatgcgttaaatgaacttcaaggaagcaaactctccattcatgactcatgggtgaaagttttccctgaggcagcttcaactgccaatggttctaaacaagttgatgcttctgatctgctgccagatcatataaaggacagtgctaaccttgcattggttggaacgcacatggtgaatgaaatcaggttttctgaagaggatgatagcaaagcggatgacctcggcttgccttcggaggactcaggggatggtgacttcgatccagcaggtccagattctagtgaagaccaaaatgatggattgaactcagaagagtcagatttcacatctgactctgattatttttgtgctgagattgctaaatcttgcggccaggatgaagtctcggcatctccattatcaaatgtgataaaccgtactgatagaatgaaactcagggcctacagtagacgctctaatgaagaaaaccacaatcatgcatttatggacatggagctagagcaagacatagtgctaccagttccaagcaggcggcaggttgaacggttggattacaaaaaactatacgatgaggcatatgaggaagaatcatctaattcaagtgatgaagaagagtggtctggaaaagaactcttagaaggcagtggaacagattcacttgatgagcgacttcgtcctgtaaaacggtgctctagaagagcaccagcagggcagcagaataatgaacttacaccacagagccggcctcatggttctaacagtgagcagaaaactgaagttcttcgctccaatggcagtagtagcacaggacggaagtatgatcctgaagttacccagaaattgaaggtgcattttgagaaagatccatatcctagccgtgaaacaaaagaaaatctatcagaagaactaggcttgacatttaatcaggtctccaaatggttctctagtactcgtcactattcaagggttgcttctgccaaaaaagaaatgcatcctgacagccatacttgtgagaataatgatgagacaactgtagacagcatgcaagcaaaacaacccaatgctggggtgatggaaaagttgacgggggatagaaatggcattgttcctgagaaaccgatggtgcaggacaatcttaaccaaggagcgatggaaaagttaactagggataaaaatgacattgttcctgagaaaccggtgatgcagagcagtcttaaccaatgtaataatgaagatataccgctttctggaacagaaattgagatggagtcttacgaacaagaatcatctgactcaagtgatgaagagtggtccatacttagcacaccacgaaaaacaagattacaagaccatggaaaatcatcagttactgaatcacttcgttctgcaaaacggtgttccagaagagcaccagctagggagcagaataatgaacgtattcagagtgagcagcttcatggttctgcaagtgagcagcaaactgaatttcttcgctccaatgtcagcagtggcaaggtctcaaaatatcattttggccctatagttagtcagaagcttaaggaacattttgaaaaagatccatatccttgccgtgcaacaaaagagagtctggcacaagagctaggactgacatttaatcagatcagtaagtggttctctggcactcgtcattattcaagagatgctgttgccaagaatcagaaacgcccgggagaaaatactactgtgaataataatagcacaacctttgatgacatacaagtaatagaacccaatgttgggttgatagataaaccagctgcagatgtaaatgacatgatttctgaaaagttgatggtccaaataaatcttaacgaaggcattgaagaagatatcccaccgagccaatatgccaggtgtgaagagaaaataactatgactccagctgccatctcaagggaagctggtcttccaggatatggtcctggtcctggagaaaactttcttcaggtcagttcaaggaatactagctgtgagcagagtgtgatactggctcctaccgctatcgcaagagaagttggtccaccaggatatgcgactggagaaaaccagggcaatggggctccatggaatacaagttatgagcgaagactatttatgaatcctgtgaccagctcaagagcagtcagtcctccaggatatgggcctgaagaaagccgaggcagtggcatttcctggaatacaagcagtgaacaaatattgtttatgagtcctacaaccatctcaagagaacttggtccaccaggatatgggcctagagaagaccagtgcagtggcacttcatggaatgcaagctgcgagttgggagtatttatgagtcctgtgaccacctcaagagaagacagtccgccaggatatgggcctcgagaaaaccaggagaatgacaatatgagatgcgagttgagaatgtttacaagtcctacaaccatctccagagaagttggcccaccaggatatgagcttactggaaaaaacaagggcaacggcgcttcatgtactacgaattaccagcagggagcgtttacgagtcctgaagccttcccaagagaagcctgtcctccaggatttgtgtctggagagaaccagggtaacgacactccatggtatatgagcagcaaacagatggcgtttacgagtcctacgaccaaccctagagtaggtccgccagggtatggacaggaaaaccagggcagtcgtgtttcttggaatacgagttatgagcagggagtgtttatgagttctacaaacatctcaagagaagccggtccgccaggttatgggcctggggaaagtcagggcaatatcacttcatggatttcgacaggcgggcagagaatgtttacaggtccttcaactatcccgaacgaagtcgggcagcaaggatatggcccttcaggaatcccgggaacggatggctcaaggagtatggacttgaaagcctttccaccaggatatggacctgctggagaaaaccagggcggtggtgcttcagggagcgtcataagcccccaagctcggtctgcagagaacgtagagttttcagacgacgctagaaaaaaggctatacagcgggagctgagacggcggcagaagttcaggtgatggccgtgatgcgaacttctgatcctgctcatcgaattttgactacggattactactttttaagactacatatccagtcttgatggctgaatgagtgacgaccctagttatcgagacgcaaaaccttttgttgtatgtgttccttttacagacttccttggcttgtcatgaatttctaatgtgaacttgtgctgtgaacttgttgcaaaacctcttgaacctgaagcattcaacatgctgtgaacttgtgcagccgctctagaggaaaaatgagagaatgttnnnnnnnnnnnnnnnnnnnnnnnnnnnnnnnnnnnnnnnnnnnnnnnnnnnnnnnnnnnnncccgg

SEQ ID NO: 19415 - DNA, 3514 bp, Zea mays
attcggctcgagatcctgaagttacccagaaattgaaggtgcatacttccgtcctgtgctactactgccattggagcgaagtatgatcctgaagttacccagaaattgaaggtgcattttgagaaagatccatatcctagccgtgaaacaaaagaaaatctatcagaagaactaggcttgacatttaatcaggtctccaaatggttctctagtactcgtcactattcaagggttgcttctgccaaaaaagaaatgcatcctgacagccatacttgtgagaataatgatgagacaactgtagacagcatgcaagcaaaacaacccaatgctggggtgatggaaaagttgacgggggatagaaatggcattgttcctgagaaaccgatggtgcaggacaatcttaaccaaggagcgatggaaaagttaactagggataaaaatgacattgttcctgagaaaaccggtgatgcagagcagtcttaaccaatgtaataatgaagatataccgctttctggaacagaaattgagatggagtcttacgaacaagaatcatctgactcaagtgatgaagagtggtccatacttagcacaccacgaaaaacaagattacaagaccatggaaaatcatcagttactgaatcacttcgttctgcaaaacggtgttccagaagagcaccagctagggagcagaataatgaacgtattcagagtgagcagcttcatggttctgcaagtgagcagcaaactgaatttcttcgctccaatgtcagcagtggcaaggtctcaaaatatcattttggccctatagttagtcagaagcttaaggaacattttgaaaaagatccatatccttgccgtgcaacaaaagagagtctggcacaagagctaggactgacatttaatcagatcagtaagtggttctctggcactcgtcattattcaagagatgctgttgccaagaatcagaaacgcccgggagaaaatactactgtgaataataatagcacaacctttgatgacatacaagtaatagaacccaatgttgggttgatagataaaccagctgcagatgtaaatgacatgatttctgaaaagttgatggtccaaataaatcttaacgaaggcattgaagaagatatcccaccgagccaatatgccaggtgtgaagagaaaataactatgactccagctgccatctcaagggaagctggtcttccaggatatggtcctggtcctggagaaaactttcttcaggtcagttcaaggaatactagctgtgagcagagtgtgatactggctcctaccgctatcgcaagagaagttggtccaccaggatatgcgactggagaaaaccagggcaatggggctccatggaatacaagttatgagcgaagactatttatgaatcctgtgaccagctcaagagcagtcagtcctccaggatatgggcctgaagaaagccgaggcagtggcatttcctggaatacaagcagtgaacaaatattgtttatgagtcctacaaccatctcaagagaacttggtccaccaggatatgggcctagagaagaccagtgcagtggcacttcatggaatgcaagctgcgagttgggagtatttatgagtcctgtgaccacctcaagagaagacagtccgccaggatatgggcctcgagaaaaccaggagaatgacaatatgagatgcgagttgagaatgtttacaagtcctacaaccatctccagagaagttggcccaccaggatatgagcttactggaaaaaacaagggcaacggcgcttcatgtactacgaattaccagcagggagcgtttacgagtcctgaagccttcccaagagaagcctgtcctccaggatttgtgtctggagagaaccagggtaacgacactccatggtatatgagcagcaaacagatggcgtttacgagtcctacgaccaaccctagagtaggtccgccagggtatggacaggaaaaccagggcagtcgtgtttcttggaatacgagttatgagcagggagtgtttatgagttctacaaacatctcaagagaagccggtccgccaggttatgggcctggggaaagtcagggcaatatcacttcatggatttcgacaggcgggcagagaatgtttacaggtccttcaactatcccgaacgaagtcgggcagcaaggatatggcccttcaggaatcccgggaacggatggctcaaggagtatggacttgaaagcctttccaccaggatatggacctgctggagaaaaccagggcggtggtgcttcagggagcgtcataagcccccatgctcggtctgcagagaacgtagagttttcagacgacgctagaaaaaaggctatacagcgggagctgagacggcggcagaagttcaggtgatggccgtgatgcgaacttctgatcctgctcatcgaattttgactacggattactactttttaagactacatatccagtcttgatggctgaatgagtgacgaccctagttgtcgagacgcaaaaccttttgttgtatgtgttccttttacagacttccttggcttgtcatgaatttctaatgtgaacttgtgctgtgaacttgttgcaaaacctcttgaacctgaagcattcaacatgctgtgaacttgtgcagctgctcttcttctgcatgagttcatgttatctgggttgcacggcatgcaatttcccattgctagaagggtcagataacactgactcgggaactgctctatttaaggtgcctggattttttttatagaaattttgaggcaacagtcttacacaagcagcaaatacaacaaccttgagtacaggagatatgaaagagatttcatgatatagctctgaacctctagattataaatgtagttaagaaataatatgtacaatcatgatatagctctgaacctctagattataaatgtagttaagaaataatatgtacaaagagtagagtggtgtagagacaaaaaaaattcaattaagagaatccaaattaagacatgccctaaaagaacaagctcacaagaggtaatttatattttttcctatagctaaacaattataaaattgaatgttgctcgcaggcacctcagatatagaaaaactatcgccagttctatccggccgttttgaacttctgaagccgcattattaccaatgggggctagttgggctgtacaactccctgccagcccagcccatctgatccattaatataacggccatcccgaacccgaacggctcccatcccatctgatccctcgccgcatttcaaattcaaatcccctcttcacccaagtgctgccttcgcatcgcatggcggccagttccctctcgtccccggcggccagccggacgccgaacctgaaatcggccgtggctccgtcaccatctccatccactcgccgggcaccagcagatgcggcgtcggcgtcgatcacggcggagtcgaaggcacggttcgaggcttacaaccggctgcag

SEQ ID NO: 19416 - DNA, 1688 bp, Zea mays
gtagccacattatatcatactccaatataccactgttaattgtagcttcttctaaccatatatcacccatgacgaataaagaatcacaagtccagaacaatgtgtgaaaagataaaactacagattgccaaggaacaagactaatgtcaataataatggtattacgcctcaagccctcaaatatgttactgagtctagtacttaaaattagtcaattggcaagggcaaccacatggtcataacaattccaagcctgtaagttacttctagactgcacaacgtggcaacattcttcccctgagtgatctatggctttagataacccattatcgtttcttccactccacttctcaacaaaaagatatgtgaccacttaaaaaggctcttcaatagctacggatgtgcagctttatacttcttatgttacaaactatatcagtgaaccctgataacaatgctagaaggccatttcctgaagaattttgagtgttgtctgatgtacccattccagatgttgagctgtaataccagatgtgttacttgcatatacgccacccaggaccttgtaaacagtctcaaggaacattccagggcggactggtcgtggcttgtggccagatacacttccccttcctaatactcctgttagactctcctgttcagaatgtgaatcagcacttggttgttcaacgttatcagcaccttcccctctgccattcataacatcctttatcatcctttccaatgccttcccaggtttaagagcaacgagcttgctcaaaaagtttacctctgcctcagggagggtagtcaaaccacgatcatttctctcatctaacaggccacctcccatcatattccgagcttcttctcttactataactaatcttgcaagaagttttcgatcaggaatggtgtccctagattccattgactctactagatcatctgcctgatttgcaatgtcattaagatttgccccaggaatttggcacttaagacctttatcgttcttaaaaacacctccaccagcagctacgcggcgcaacaattcatgtctgctctctttcttttcagtctggcaaagtagcccaacaacctggacatgtggaggacatttcttcgtcagatggtctagcactgtctgcttaattacctcaagaatagacttacgctcatcatctgtgtccttctgtgcaagttgtatcatgtaatcaagtgccataagaaaacctgactccatctcatccaccctcttcccaataactccttgtgccaccagctccacagcaaccggctcaaatgcaccatccatctccatgtcctccatcagcgtgaccatctcctgcagcacggaggcgacctgctccccgccgcggaggagagcgtcgcactcggcgggatcccacttgctagggtcgtccccgagggaggccggcgaggcgatggggaggggcactttgggcaccgctgcgtggcatgcgagggtgcagcgggaggggacccgcgggatgagttgggacgaggacctccatgggaaggagacgacggcgcaggcaggcgactgggcaagggagagaaacattctcctcttggaaacgaagcgatgggaagcaaagtcagaggttctgggaggggttgctgcagatctaccgacgcgtgggcggacgtgtgggcggacgcggact

SEQ ID NO: 19417 - DNA, 4105 bp, Zea mays
aactggaatcattaaatttggatttatagatttcaagttatgaatttcctaagatttaatgtgattgaaataggattatatgagaaattaattttcttactgtttttatgacaaaacagagactcttaagtgatagagaatattattacaaaattttagaaattggaatggttcaatttagatcaaaaatggaatttctatgaattttacaagtttctagatttgtttttgtattaaaaatgaatttctataaatatttctctgtttttaaacatctctggactcggcctcattttccagaaaactcaggggcctaggtgtaactaatcctaagactcagacgacccaccaggtggactgcgggttgatactagtatagtagggggtctcttttgcaaaatcgctatccgaaggggtatctggcaattgggaccgttcgatcaaacacagacgcgcgagattagacttctgcccaaaacaaaccgatatctcacgatcgccctcggatctgaatccaacggcacctcgtgttataaaaacaggatcaaaacccgaccgcacgatctagagttagcggccaggatttaatcatgcgtgaaggggtacacacatctaatcgcggtcgtttgctacatgatcgacggacgagggccatcctatgccaaatctaatcctaggcgctcatcaaccaacggacgagccgcattcttctcctacaccgcagctggccacagcggtacagctccccgtcaccacggcccacggcggcgcgccatcataggagatcaccagattccgattccccgtgactcatttccgatctagggcgcgcacatgtggagaattgtatggagaacacaagggagttaaacataccgcggattgtggcacaggttgtcatggccacggtagcaggcggtcccgcggcgcaactccctctccggcgaggaattccaccacccccagcgagcgctcctagcccgccgaagccccaatgagcacccacacgcaccggcgagtggtcctgacccatccgtgggtgccgggcaacatccaaggcacagggcgacggtgatggccatcacgctccctagcggcggagcttctctctctctctgcccctttctctcgcgttccccgatggccatggccatcaaccggtcgttcccgagctcaattggaacatgaattagactccacaaccgccagcgaacctccgtgacttgattctagcctccaattgcaaacactggtggagtctcatggtggcggccgccctgcactctcggttctgtaacaccacgttccgttgagaaatcccctagaggacccaattttatctccaggcgctgacgggctcgacggtcgtggggacccggtccagctgctcctccggccatatcgctcggagcggttgcaaccgccctgaccaacggggaggacggggtcgcgtttgactagcagttcgggcccagcgcccagagagaattcccatcgtgtgcgcggaatggataagtgggccgcgcatatggcttcccctagtgggccaaaatgtggtaagccggcccaggtaaactctccccctttttattttctgttttaattctttttttgtttttttatactttcaaccctagaatttgaattccaattcctcctcaaaatttgtactaagttcaaatattcaaattgatcattttagtgaactgaatttggtcatggctttattttgtgttctataatatctctaccttctcttctctaaattatagaatttcttttagattttaaattcctctctggacttttaatatatttcttgtcacattattattttatattgtcacaaaatgcacaccaaatgaaacctcagcatgatgcacaatttaatggcatgacttttattaatcctttgtttttttttaaatgaggtgttcacatgtgataataaatagatacaacacacacatataaataaaggaaaatattttttttcttttataatattttttacaaattgggtattacacagagcatctgtttttaaaaagtcctttgagaactgtgctgcatgttcgtagactaacatactaattaaatgatgcaactaaacatcatgttcatatactaacatactaaaactaaacaacgtgttcatatactaacatactaattaaacgatgcaactaaacagccaatagaaaacagtaaaatatgtgaagataaaacacattactctcaatagagatttcacatgatttctaagaccttggaaacgagttacatggtttcgtccacataaaaccaatttcatcccataaaacttatttatcttaaatatcattccatatcatttaaaatagtgacgtgatacactattaaatatacatgaaactaccattgtgagtagcctaatttagacagccgagctgtggttactgctccaatgtatcaccattatggctgcagagaacactcctccgctccgtagcagtagcttgtaggagctacacatgcaatccaaattcaaacacggattcaggattctgacccaaaactgggaaaacacctcgtcacctgccgctaccaggccctcgaggaatcccccgcacgccgccttctccacgcgctcgccacactcgcctccacggtctgcgcgcgcgcaccccggacctcggcctaggccgccgcggcctgtgggatcgctgcctccgacctcctggtggccactgcgctcatcgggaggcatgccgaggccggggacatgggcgacgcgtgcagggtgttcgacggaatgccgcaccgggacgccgtggcgtgggacgccgttattggtgggtatgcgcgggcggggctcctggccgaggctgtggagctgtttggcatgatgaggtctgcagatggagcgtggccgaccgaggcgacgcttgtgagcttggtttccggttatgcctggttcggttcttcgaagggtcgttgtacgatgcacgcgcgctgtggttaagtctggcttccagcacagcctcttcgtttccaatgctctcccagagatgtatgcagagttgggttgtttgagtgaggcattgttggtgttccggcagatggagatgaaggattctgtgacttggagttcgatgattggttagatgtgacgtggttgcatggaatgccctgatcaaagcctatggacagctaggactagcggaaaaagcaatcaggtttgcgatagaaatgcataggacaggcattgacccagacaatgttacattcttggagattctacatatgatctcactgattccatcactgaattaggggatggaagtacatcctcacattgtttccagaatgaacaggcgattgctaattcacttatttacatgtatggtcgatgtgggagtctcagtctttcagttggtgcctttattattgggattatggataaggatgcaatatcttggacttctatgatgcaggtatatgcatggagtggacttgcaaccgaagttgttaagctttttgagatgatgaagaaaacaaaagtacaacccaagcactacactttaattgctgtgttgactacctataaaaacataggccttgttgaggagggaatgggcctacttaagtgcataaaagagcagtatggtctggagccagttatagagcacgtttcatgtgctgttgatatgctttgtcgtactggacgcttgagtgatgcatatcacctgatccagagttcccactctgaacatgcaagaaaccctatattgtgggggacattactaagtagttcacgttactggggggagttggtgattggtgaagcagaaactagaaatctcttgtccttggatccaggaagcaaagctaactataagatgctagctgatatttatgtttcaattgggagaagggacaaagctgacgatgtcctgagaatgtcgttgtcaaaaagaactggacttgaaaccaggctgtagctggactgaaggtggctaaagattgcaatacatgctagaaggtatgattttcgcatgtttgcatgttctttaaaaaatgattacatcaataagtgtgaatcaacatttgaattacaaaaaaa

SEQ ID NO: 19418 - DNA, 1633 bp, Zea mays
ggcgagtcaaaaatacatttggtcatcttccctgcttggagttggagttgagacgccgacgcggcgcccgagaagaatttgcggatggattcgctgcgcagcgtgttggagtcgattcaggcgatgcagatccgccccgtggtcgcccaaatcatcaccctagggatgatcctaacttcggcattgatcctatggaaaggattggtcgtcgtaacagggagtgagtcgccggttgtggtggttctatctggaagcatggagcctgggtttcgaaagggtgatgtcctgtttctgcacatgaataaggaccctgtccgcacaggagacataattgttttcaatgtcgagggccgtgatattccaattgtccatcgtgtgatcaaggttcatgagcgccatgatacggtggactctgacattctcacgaaaggtgacaataatcccggggatgaccgagtcctgtacgcacatgggcagctttggctgcagcgacagcacatcattggacgggctgttggctatctgccttatgctgggtggcttacaatcatcatgacggagaaaccagtcctcaagtatctgctaattggtgcactggggctgctggtggtagcatccaaggagtgacgttaaaaggaagggcatgaggtacgaggccatgtgtgcgcgggactgcatggacaaggaggggatacgagcggacactgtcacatggaaccccttgatccatggcctgttcaaggatgccagggtgaaggaggcggctcagctcttcacggagatggtagcgacacaggtgatgccggacaatgtgacctagaccacactgattgatgggcagcagttcaatcagttcacttacaaggctctcatccatggattctgcaagccaaggagctagatgaagccaaggaaaccttctttcacatggttgatgaaggtgctttgaatgcatcttatatcttatggttccagttagtaaaaaaagcgacctagtgctggagattcccatatgagtggagtggggtctgtctgatatggttccagttagtaccactagctaattgcaaggaccgcatttggcagttgaaatggcactaagatcattgtgtcgctatcgtaggcaaccagtttgcaatctcactgattatcttgcgagaatatcatagactatatcttctgatgacgtggttgcttttgctgtatgctgggttttcacccaattatatcatattttcatggcttgtcgatggtttctgcaagaagaacaatgcagatgcagtgctagccacccctgatgaacttacggaaagaggccttccaccagataaagcggtatatagatatctgattccaaggctttgcagaaaagggctggttgatcaggcacaataaccatgtgtttggtttcccgatgcagacatgcagccctatccaagcctgcatggtgggatacgggacctcacccacatctccgtggatgcaacccatgtctcctaaggctattcacaatggaggtttcatggagtgtttcatgtattaattagactgccaaatcagctattttgatgacatgtcacatcatttaagaaggaagagtttcatggggatgaaaccatgttaactcgtttcc

SEQ ID NO: 19419 - DNA, 5863 bp, Zea mays
  misc_feature (5727)..(5727): n is a, c, g, or t
tgcaacgaaatactctatgatggatgtagctaaagataccaagagcataattattgagatatggtgcgacgtaccaagctacacagtaatttctcctttacctaaaatcttttggcatgtacttaattttcatgcatattaattatatatataattctatactataacaataggatacttgcaaacgtcggaccacatcaccgttcattttagctcatatcatcacactacgcatcggcggaagagtggttggttttttacaatatagttaaaaattagactgaaatgatataatataaagtaatcatgtgcttacaaatcttttactaaatgaagcaattcggcgtcattgactcaattcaaaaacttatttaatcaacgaatttctagagaggagataggcttatattggcaacagcgagacgtttttttagtttgtttaaaacaatttttacgtactcccgtggcacagtgcacatacctcgctattgattaataaggctaatcacaatggagatttcatgaggtgttttatatattaattagtctgccatatcagctattttaatgacatgtcacataatttaagaaggaagagtttcatagagtttcacgaggataaaaccatgttaactcgtttctaaggtcttggaaactgtgtgaaacctccactgagagtgttttgtttcatcttcgtataattgagtaaatcctattggttatttatatacagtatttatgaagtatgttgacatatgaaatagtgagatgaaactctctatcgagagacagggtgtttcattcatcctcactgtgattagcctaagctgttaggtacagtaggcgctaacccaggggacggccggagtgccatagctttcatagtcggaccaatgggacagcgatacgaggaccaatgggaaggtagtcttttgcgcgagggcgtgggtggccacaccgagagggctgcaagatcgatatgatatatgctgtagcatctatatcctgtaagctcggttctgagcctgcatgattaattagttagcggtcgcgcgactccccaaaaccagcctgtctgagagctaattaaggtccgcgctgccgctgcctgttggcgtgcaactaccgggaaaaggggggccggggagagaaatgccggcctaaagaaagagtagggggaaaaggaagtagcttgtagctatagcctttgctagtttagttatagatacataccctaaaatcagctgagaatttggtggttgacatgagaagtgccttgcctcctccctcctagctcgcagctttgtctggtacagggtagtagcggtggtggtggtgtggcgtccctctcctccctctcccacctatcattcttctaatcgagcggcagagcgtggtgagctagagcgagccagaaaagaagggggcaggacgctgtcttcctttctccatcggatccatggtctcttttctcagccctctcagtctcacacaccacaccagagcagcgcagccgagcatgcactcatcacatcagctcctcgtctcctagctttcctattcctgccttgataattggccaattgttcgatctccttctttactaccccctttgctttcgttgctgctactactactgttccatctcctaggtttcgttgttgtccctgcaggccgccactgagtgatttgttagcagataagatttagatctcccagataaaaaaaagaggttgagaggagagctagcactaggcactagcaagcctgctgtgaggtgaatatggatccagtcgcagcatccatacacggtcatcatcttcctccaccgttcaacacccgggacttccatcaccatctccagcaacagcagcagcagctcaagaccgaggacgaccacggcagcggcgcgccaggactgttcggcagccgcggcaccaagggcgaccacgagaataatgaccagaacagtggaaacagcaacggaagtggcggaggaggaggcgacgagctggcgctggttccaccatccggcgccgggccagagggtggagagcccaccctacgccgcccgaaaggccggccggcggggtccaagaacaagccgaagccgcccatcatcatcacgagggacagcgccaacacgctccggacgcacgtcatggaggtggccagcggctgcgacatctccgagagcatcacggccttcgcgcgccgcaggcagcgcggggtctgcgtcctcagcggcgccggcaccgtgaccaacgtcaccctgcggcagccggcctcccagggcgcggtcgtcgccctccacggccttcgagatcctgtccctctccggctcctttctcccgccgcccgcgccgcccgaagccacggggctcaccgtctaccttgccggcggccaggggcaggtggtgggcggcagcgtcgtcggcgcgctgacagcagccggggccggtggtgataatggcggcatctttcgccaacgcggtgtacgagcggttgccgttggaggaggatgacatgctcgctgcgcaagcacaggccgacagtgcaggaattctcgcgggtgcgcagctcgccggcgctgtggatccaagcctcttccagggactgccaccgaacctgatgtgcaacgtgcagatgccgccagaagcagcctacggatggagcccgggcgccgccggtggccgtccggcgccgttctaataactgataagagcgcgcacgcggcttagatatggttaagtgatttagctttcttcttcgatcttttgcttgaatttttatcgtggagaatttccgtgggaattgcatatgatttcgcatgttaattagtaagctatcttaatactgtttcagaatatgtagctcgatttctgccatttcgtttcgctattccttgtgtcgtcgtaactcttgttcaaaaaaaaaaaaaaaagccgggttttgttccttatcaaaatcatctcctttttcatgtactcagtagctcaattggtatttttttccgtgtagaacacctagaatatatatagtactttcgttctcgaatatttatcgttcgttaatttatttttaaactaaacaacgacaaataaaaaagaacgatgaatacttaacaagaaagccaagtgaggaaactgggaacgaattgaagaataataaaaaggcgcaaatctctgtataccagggtaatctcgctattttctaattccttctacgtgtcacggcctgtggtataacgataattaggagatgcaatttttttaccctcctatatcaatagtgatgacatgagatggtaaaaaattatatccgagtgacataaaagtgattaaaacagttgcaataacagataaacaaattgaagaataataaaaggcgcaattccctgtatataccattgtagttttgttcaataatgccttacttattaatgcaatgttctaatttcttctctgtgtcaccgcctgtgttataaaaataattagaagatgcaattttttacctttctatgtcactgatgatgacataaaatggtaaaaaattgcattcaagtgtcatattagtgattaaaacagttgcaataaaaaaagatatttgacaaaaacaattctatgataaaattctatgtattccctctattatatatatcacaatatgttgattctaaatcaaatattattatcttgatcgttccattaaaaaatgtaatgttatgatatatgaattatatatcgtagacatatttttgtctaaagtataaactattttggattttctagatttagggcttctaccgtacacacttagatactactatcggaaacatattctttgccgagtgctcagatgtttgccgagtgcaaaatatcgagcactcggcaaagaattattatttgctaagtgttactctcgacgaagaatgacacttgtcatacatagactctcgggaaagagcgatttgccgagtgtctaactctcggaaatacttagcacttggcaaagcaccgtcaacaattgtctgcatctgacgatcgttacctataccgagcgtccaaggaagacactcgacagagaattgttttgttttgtcgagtgcctttttttacacacggcaaattttatttgtcttttttttcttttggcctccaacttttttgtggtgtgtttgtacagtctctaggcatacatgttcaattttggcacatttcacaaagtgtttgatatagctattagatttagtttatttaattgaatttcttcagaaaatttaaatttgaactgcaaatcacttgaaaaatggaaaacaacgaatgcaaaatggtattcctattattgagcacaagttacgacatatttcaagaacagaccagaaattttgaacatcatgtccatgaaacatgaccgagaacttgcgaccttgttgttttaacgttgtataaaacacaaccaaagttagaaaattatgaaacttgtcgaaatatcatgatatcatatgcagaggctgtgataaaaaaaatgacagtgtttcgtgaaaattgtcacgtgcgatgtgtacaaacctagtcgtcctccatataagttttatgatttcatgtaaaaggtcagtttggttttatacacatagtgcgtgacaactttcacgaaatagtgtcaaattttatcatcgcctctacatatgatatcatgatatctcaacaagttttataattttttaactttgtttgtgttttatacaattttaaaataattggatcgcaagttaggggttatgttcgtgaacattgtgttcgaaattttttgtctgttcctgaattaggccgtaacatgtgctcaataataagaatatcaattttgcattcattgttttaaattatttgagttacttgcaattcaaatttgaattatccaaaaaattgaattaaatgtactaaatctaatacacttggagaaatgtgccagagtttgtaggaacacaacaacaaaaattggaggggaaagaagaaaaaacaaatacacatatcgacaattattctttgctgagtgttagcaaaagacattcggcaaagaacctcaacttaaaataaccgtgtgcgtgaagctttatttatcgagtgcctatcagatgccactcggcaaagcaaatttttttttaaaaaaaaatatcgattgccagatatgtgacacttggtaaagtatttttaaaaaattaaaaaattatttgttaagtgcaagacctgatgcacttgttaaagtaatttaaaaaaaattgcggagcgccaaatctagagcactcgaccaaaaacaaggacttacaccataaccggtcgtggctcgacctcacaggctcacacacgcgcacacatcgctcgccttcgtgccgctgagtcgctgacgcctccgtgccctcgcaggcgcctcctcagccaactggccctcgctgacgcttcccctggctcttggcccctcgccggcgcctcctcggtcctggcccctcgccggggaaccatcatgcgcggccagcaagcagcaggcaagtctctcgcggtaactaagcaaagcacttatataattttaaactaattactagtccatcaacctgtgctaccgtagacatcgctaattttaaagatacaagtattgaatacgtacatatttagggattagagtcatttagatccctaattcggttcggttccactgaataattattgtgantaacttgtgtttcacagaggtaatatgacaataatgattagtaactactacatcaatgattttcatgctccaatcgatataattcgtttagttttttcaaaaggatggacaacaaggataataataaactagttta

SEQ ID NO: 19420 - DNA, 2190 bp, Zea mays
tcttagtgcaattcgatctgaatgcccctcgtgacctatcgctaccaggccctcaaggaatccctcgccgccgccatcacctcctccccgcacgccgccgcccctcgacgacctcacgcgctcgccgtcgtctctggtctcgccgccaatggctacctcgcgtccctcctcgtcgcccgctacgcccgcctcggcgaacccgatgccgcgcgcggggtcttcaacgccgcctcctcctccccctacgcgacgccgcccaagccgctcctctacaacgccatgctccgtggctacctctccctgggcctcccgcgcgaggccgttgcgctcctccgcgccatgcttgcgtccggctcctgcgcgcccgaccgccacacgtaccacctcgccgccacggcctgcgcgcgcgccccggaccttggcctaggccgccgcttcgaggctgccgccgcggcctgtgggctcgcggcgtccgacctcctggtggccactgcactcatcgggatgcatgccgaggccggggacatgggcgccgcgcgcagggtgttcgacggaatgccttgccgggacgctgtggcgtggaacgccgtgattggtgggtatgcgcgcgcagggcacctgtccgaggctgtggagctgtttggcatgatgaggtctgcggttggagcgtgcccaactgaggctacgcttgtgagcttggtttctggttatgccacgttcggttcttggaagggccatggcttgatgcacgccgctgtgattaagtctggcttccagcgcagcctcttcgtttccaatgctctcctgagatgtacacagagttgggttgtttgagtgaggcattgttggtgttccggcagatggaggtgaaggattctgtgacttggagttcgatgattggtggacttgtgcggtgtaacaaaccgggttatgctgtcaaaaaaaaaaaaaaaatgctctcgaaatcggaggtgttggtcacacggtctatcttgctcaatgtgatcttggcctgctccgagttgggggactggagagaaggaaaatggattgaagaaaactttgtcatgtgtaatggcagtgaattcaagagagatccctctgtagtaaccagactgatatatatgtacgcaaagtgtggacagttaggttcgtctgagactcttctacatgaatccacagaggttagatgcgatgtggttgcatggaatgccctgatcaaagcctgtggagagcttggactagtggaaaaagcaatcgggtttgcgatacaaatgcataggacaggcatttacccagacaacgttacattcttggagattctacatatgatctcattaattccatcactgaaaaaggggatggaagttcatgctcacattgttaaaagaggtttccagaatgaacgggcgattgctaattcacttatttacatgtatggtcgatgcgggagtctcagtctttcagttaatgcctttactgggattatggataaggatgcaatctcttgggcttctatgatgcaggtttatgcatggagtggacttgcaccagaagttgttaagctttttgagatgatgaagaaaacaaaagtccaacccacccactacactttaattgctgtgttgactgcctataaaaactcaggtcttgttgaggagggaatgggcctgcttaagtgcatgaaagagcagtatggtctggagccatttatagagcatgtttcatgtgttgttgatatgctctgtcgtactggacgcttgagtgatgcatatcacctgatccagagttcccactctgaacatgcaagaaaccctatattgtgggggacattactaagtggttcccgttactggggggatttggtgattggagaagcagcagctaggcatctctcgtctttggatccaggaagcaacgctaactataagatgctggctgatatttatgtttcaactgggagaagggacagagctgaggatgttctgagaatgtcgatgtcaaaagaactggacttgagaccaggctgtagctggactgaaggtggctaaagattgcaatacatgctagaagtagagggtatgattttagtatgtttgcatgtcctttagttctttaaaaaatgattacatcaataagcgtaatcaacatttgaatctcatttgggatttcttggactatataaagatc

SEQ ID NO: 19421 - DNA, 3032 bp, Zea mays
  misc_feature (782)..(782): n is a, c, g, or t
ctagcactagctttaacatgaataaatataaacaagtttggatacactagtaataatatttaatttctctgttaaagttgaagaaacatcgatatgctttattggtataaaaatagttacaatgtggcaaaagaaaaatacatagctcaattatgctttttagtaaagataggcaaatgagtggtaacgcctagtgaagaataaataagctgttatgcaaacaggtacttggtggagttaggcaatgactaccaagtacctcatcatctgtgtccttctgtgcaagttgtatcatgtaatcaagtgccataagaaaacctgactccatctcatccaccctcttcccaataactccttgtgccaccagctccacagcaacctgctcaaatgcaccatccatctccatgtcctccatctacaaacaccaatagaaaatcacatacaagaacaatatcagtaatacaattataaggtagaggcatttagtcagaccacatgaataacggttatattctgcacaactacatgagattaacagtttaccacattcagcattcaagactcccaaatggtagtttttgaaccattttagtgcgaattataatatagaacaaactaataagccgtagaggaaagaaaatggaggataaattgacgatgggctaagccgtagccatgggctaagcgttcacaactctttgccaattagtccaagagggccaaactccactagcatactacctggcaacgaaagaaactagtggaacagttcattgcggaanagcttaaccttttttataatataaataacgacctaataagtttgaaaatccgaaaaactgcgcaattttatgaagcactgtgttcatttcaaaaattcatactagtaatctccgtcagtgattcagtgaagcaacccaagaaacggtggaagggcatcctgaccagcgtgaccatctcctgcagcacggaggcgacctgctccccgccgcggaggagagcgtcgcactcggcggggtcccacttgctagggtcgtccccgagggaggccggcgaggcgatggggaggggcactttgggcaccgctgcgtggcatgcgagggtgcagcgggaggggacccgtgggatgagttgggacgaggacctccatgggaaggagacgacggcgcaggcaggcgactgggcaagggagagaaacattctcctcttggaaacgaagcgatcggaagcaaaggcagaggttctgggaggggttgctgcagatctatccattccattcttggcggtttgaggctaagaggcttcttgtgcagtttttaaacgaaaaaacaatgcatataggatacaaatatttcgttgtagttccttatatttataagctgcagatccatatccatgtgtgcctacagcacataaatttaaggggctacaacgaataagtttgcatagcatatggttttttacgtaaaaactaacatttaattttaaaaaaaacaaaagccaactaaaggtattggtttttatcaaaatacacagctaaagcagtttttacctactacaaagttggtagcaattttactactatttctacctgattttgatttttaattattaatgaaaattactcacctatcacttatttttattctttttccattgatttttaattattaatgaaaattactcacctttatatgttgaccattcgctccccagctccgtaaggctattcacaatggaggtttcatggggtgtttcatgtattaattagcctgccacatcagctattttgatgacatgtcatatcatttaagaaggaagagtttcatggagtttcatggggatgaaaccatgttaactcgtttccaagatcttggaaactgtgtgaaacctccactgagagtgttttgtttcatcttcatataattgagtaaagcctattggttatttatatgcagcatttaatgggggtgttgacatatgaaatggtgagatgaaactctctattgagagaagatatttcattcatccataaatctgatgtggcatttttggaaagagtgacatgaaatcccattgtgaatagccttatcgcatgcattcagcatggctatttaaagcatgcaggcttgattgagaagacaaccaatcagaccctaacctacacagtgcgctaacagagacacgtttagcagcactattgcactgtcttttcttttccttttacgagcatgaaaatgcataacgcgagtcggcgagtgtaattcgcgctctcacgtcgatgatgccttcagtatggccttccaaaccctactcctctatttgagtcttaggtcatctataacatgggccttaaagtatcctctgcgctagattttagaggacagagttgtcctctagacacccaacaaagttctctagatttgctgctagatcctccagacctagcaaaactgaattatatagaatacatttgagaatatgataaatatgtacatacaaaaaacaaaaataaaaatatgtgtctagtattggtattagatgagagaatcttttagaaaagaccttaaaagataaatataaaagacgttgctagagacaatcttagattttagaactggcaaaattattgttctacaaacaacgcattgaaatctacatcattcactttttttcaaaactctaatcatccatctttttcaaaaaaaaacgtgagttatcattttttttgttatgatttgttttatcacctaaggtcgtttgagcgtgacttaaagtttatattttaaataaatattttgtataagacaagtaattggacttttataaaaagataaccacgtgtcatataaaaaataacgacgttaagtcccatgacacatatagtaaaacaagagcagccttactgccttatgaaatatatgactttgaagtctcaatttgttgtacaaaataaatcaaggccagccagaatgtatatagcaaaacacgagcagccttacgagtaaatgactttcaactctaaagttatt

SEQ ID NO: 19422 - DNA, 1373 bp, Zea mays
cgtaccacacccaccccacgaaaccgtaagaagcgcagagtgtgagagagagaggagcatcaaggacgacgtgggcaagatgatgcaggtgttcgtgaagacgctggcggggaagacgatcacgctggaggtggagggcagcgacgacgccgtcgagaacgtgaaggccatgatccagggcaaggaaggcatcccgccggaggagcagcgcctcgtcttcgcgggcaagcagctggacgacgacggccgcaccctggccgactacggcgtccagaaggagtcgacgctgcacctggagctgcgcctccgcggcggcagcaggggcggctaccccatggggatcccgcccagcctccgcgagctcgcgcagaagtacaacgagaacaagatggtctgccgcaagtgctatgcgcggcttccgcctagggcaaccaactgccgcaagaagaagtgtgggcacagtaacgagctgaggtcgaagaaaaggttcatgtccaagattggcgggaaatgatcggcttttgtcattgcgtgacatatatggagcatcagctgaaatttcttagacgcttaataatttttactttaacgccgtggttgtgatcttttactgaataaagttgtagtagaaacaaaaaattcgtgctactcttgatcgagatgtttcttcatatacgccctttcgctgtggtttgcttaggctaatcacaatgaaggtttcatgaggtgtttcatgtatttattagcttgacacatcagctatttcgatgacatgtcacatcatttaataaggaagagtttcatggagcttcatgagatgaaactatgttaactcgtttcccaaggtctgaaaactgtgtgaaacctccactgagagtgttttgtttcatcttcatataattgagtaaatactattggttatttatatgcagcatttaagaagtatgttgatatataaaatagtgagataaaactctctattaagagatgatgtttcattcaaccataaaattgacgtggcatttttagaaatagggacatgaaatcctcactctgattagccttacgaacgtacgtccaccggagaacgaggatcctcgaaacatgcccaactagtctcataattacacagccatttactgatttacaattacaaccagacagccttaattttactggtttcttatacacaatccagtttccagaagtcctcagtgagatatcgtcgaacaaatagcacgcacccgcttgttgccccctcactgcttcttggattcgtggagggcctccccagctcccctcaatctcttggaggtcctcttggattcttggagttgatgtagtcctggagcgcctccatctgctccctggtc

SEQ ID NO: 19423 - DNA, 2632 bp, Zea mays
cgggatcacttgttcttcttcgagctaccagctgcctatcatggtcatcatggtcgagctgctgccggcacttgcctctctaatcctcagtcctctgtagagctggtcctcctacccctcactttgccttgagcaatttggtttctagcatctgtggggtggcttgtgggtggtcgccttggactgctcctttctccacctgctgcgccggcaggcgacgagggtccaaaagcctggtggggctcatcatcaagaacaccgaagcggcgagagtggcatgggatctgatccgaggcggagctcgaggagctgagggctgtacgtgctcttggatccggtagagatcacgtgccctcgtgttcgtccccggccgccgcgatggggaacacgtgcgtcggccccagcatcaccatgaacggcttcttccagtccgtgtccacggcgctgtggaagacgccgcaggaaggcgacgcgctgcccgccgccgccaatggccccggcgggccagccggggccggttcgcagtcggcgctgccgaagccggcgtccgacgtgcaccacgtcgccgtgcagagcgaggcccctgagcccgtcaagatcgccgcctaccactcggagccggcgcccgccgtgcggagcgaggcccctgagcccgtcaagatcgccgcctctcactcggagccggcgcccatggccgccaagcctggtggcgccgccgccaacgccagccccagccccagccccaggccgcgtccgcaggtgaagcgcgtgtcgagcgccgggctgctgctggggtcggtgctgaggcgcaagacggagaacctcaaggacaagtacagcctggggcggcggctcgggcaggggcagttcggcacgacgcacctgtgcgtggagcgcgccacggggaaggagctcgcgtgcaagtcgatcctgaagcgcaagctgggcagcgacgacgacgtggaggacgtgcggcgggagatccagataatgcaccacctggcgggccaccccagcgtggtcgccatccgcggcgcgtacgaggacgccgtggccgtgcacctcgtcatggagctctgcggcggcggcgagctgttcgaccggatcgtgcggaggggccactacaccgagaggaaggccgccgagctcgcccgcgtcatcgtcggcgtcgtggaggcctgccactccatgggcgtcatgcaccgggacctcaagcccgagaacttcctcttcgctgaccactcggaggaggccgctctcaagaccattgacttcggtctctccatcttctttcgccctggccaaatcttcaccgacgtcgtgggcagcccttactacgtggcgccggaggtactgaagaagagatacgggccagaggcggacgtctggagcgctggcgtaatcatctacatcctgctgtgcggagtgccgccattctgggcagagaacgagcagggcatattcgaggaggttctgcacgggaggctggacttcgagtcggagccgtggcccagcatctccgacggcgccaaggatctcgtgaggaggatgcttgtcagggacccgaggaagagactgaccgctcacgaagttctacggcatccgtgggttcaggtcggtggagtggctcctgacaggccgctggactcggccgttctgtctcgcatgaagcagttctcggctatgaataagctgaagaagatggctcttagggtgatcgccgagaacctgtcggaggacgagatcgccgggctgagggagatgttcaagatgatcgacgcggacaacagcgggcagatcacgttcgaggagctcaaggttggcctggagaaggtgggcgccaacctgcaggagtcggagatctacgcgctcatgcaagccgcggacgtggacaacaacggcacgatcgactacggcgagttcatcgcggccacgctgcacctgaacaaggtggagcgggaggaccacctgttcgcggcgttccagtacttcgacaaggacggcagcggctacatcaccgccgacgagctgcaggtggcgtgcgaggagttcggcctgggcgacgtccagctggaggacttgatcggggaagtcgaccaggacaacgacgggcgcatagactacaacgagttcgtggcgatgatgcagaagccgacggtggggggatcccgaagaaggccgatctgcagaacagcttcagcatcgggttcagcatcgggttcagggaggcgctcaggatggcctagacctctgtgtctctggcttccctgctgcctgcgtgtaggtgtagatgattgaattgagtgggtgtcagtgcagttgctgtagagaccaccgtagcatagagatctgatgagatgcgagttgaggcgggccaggagacgtgtacatgtgccatagccatacaggcggccctgcatcggtttgatttgattgcttggttccaaacggtcctgtgtttcatgtcgcgtgcacatgtgccatatctgcctgctgctgctactactgctatatgccgtgcacgtgcacgtcggtgacctgaaacttggctgtccggcggtccggccaccgagctctaaggctatccatagcggtttttctaaatttttatccttatatcattttttgcgtc

SEQ ID NO: 19424 - DNA, 721 bp, Zea mays
gggagacggaaaaccccaacgccggcaagaaccgcccctcgcaagcaatcgcttgctcgtcgcgctcgaatcccgcgcgttcgcgggagcggcgaggaggaggaggagcatggccgggaagggaggagggaagtcgctggtcgccgcgaagatagcggctggcatggacaaggacaagaagtcgccggtcaaccgctccgcgcgcgccggcctccatttccctgtgggacgcatccaccgccacctgaaggatagcgcacaggccggcgagcgggtgggggcgacggcggccgtgtacgcggcggccgtcctggagtacctgacggcggagatcatggagctggccgggaacgcgtgcagggacctcaaggtgaagcgcatcaccccgcggcacctccagctggcggtacgcggggacgaggagctggacaccctgatcaaggccaccatcgccggcggcggcgtcatcccccacatccacagggagctcatcgacaaggctgcctaggaatgacgaaggagcaagcagtctgttaaaaaaaaaccctgagaaccaagtaccatggacctcttgtgggtggcttaaaaatagaggcgggcactcgccgcttcatgctcccttagttactactggatggttgttcttttcatccatcagctgataaacattccatctatcatgatatactgagagttatgatatctaaaaaaaaaaaaaaaa

SEQ ID NO: 19425 - DNA, 652 bp, Zea mays
ctctccttcttcttcctcttcgctcagctcctacaataaagggcgaagaatctcacctccttgacttttgctttgccatcgcttccttttgaggtcaaaatggttgaacaaactcagcagcccacgattttccagaaggcttctggccagatcttgcgttccggtgtttcccaggacatccatggctacgcatctggtttccagaggcgtgcaacgtacggaaactactccaacgctgcgttccagtaccctctcgccgctacttccaggattgtggcgaatacttcccctgtgttcgtccaggctccaggagagaaaggattctctagctttgctattgatttcttgatgggtggtgtttcagctgctgtgtccaagactgctgctgctcccatcgagcgtgtcaagcttttgattcagaatcaggatgagatgcttaaggctggtaggctctctgagccttacaagggtattggtgactgtttcggcaggaccattaaggatgagggatttggttctttgtggagaggaaacactgctaacgttatccgttacttccccactcaggccttgaactttgccttcaaagattacttcaagaggcttttcaacttcaagaaggacaaggatggctactgggaagtggtttgtg

SEQ ID NO: 19426 - DNA, 564 bp, Zea mays
aatggggttttggggccttttttttttttttttttctttttttttttttttttttacatatcatacctctccagggcgtctgaaattaattcaagcatagtattatgggctaaagagttcagaagtacaattcaatcaaaaagtctcaagttctagcgcttcttgatggcagcaagaccacacttagttggcagcagcaacacccttctttggggcagcctcagtcccttctctgaagttgctcttgaaacggcgaggcacgtgtcgcatgtacctcatccttccggtaccagttgtcttacgcctgatggctttcacactccagttatacttgcggatgcgggcggcggggtagccgcaggaggagcaggtgctcttctggaggtggaagctgcggcggccgcagcggatgcagagcgtgtgcgtcttgttccggcgcttgccgaagctgcccgtacccttccccatttccttccttgctccgctcggctaagggttccaggcggaggcgcggcgtggtcgtgagtggcggcgtggacccgccggcccggcctcgcggtaccc

SEQ ID NO: 19427 - DNA, 851 bp, Zea mays
ggccaaggccagcagagctgccgccaccatcatctgggaagacctcgccatcgcgtgctagctctcggtcgatcggctctcttcttgcttgcctgcttgcgtgcgcgcccttcttgctcctcctcgacgactaaaaggctaggctagcctactagtggtgtgtgtgtgtgtgtggccttgctctatccctcttgctactgctgtggagtggtgtgtgatcgtgattttttttttttttttccgggctcgtgttttttttttttttttttttttttatcttggcagacttgcacaacgcttttcaaggctagagcgtactgaaccattctcaccaaaaagatacatatcatacctctccagggcgtctgaaattaattcaagcatagtattatgggctaaatagttcagaagtacaattcaatcaaaaagtctcaagttctagcgcttcttgatggcagcaagaccacacttagttggcagcagcaacacccttctttggggcagcctcagtcccttctctgaagttgctcttgaaacggcgaggcacgtgtcgcatgtacctcatccttccggtaccagttgtcttacgcctgatggccttcacactccagttatacttgcggatgcgggcggcggggtagccgcaggaggagcaggtgctcttctggaggtggaagctgcggcggccgcagcggatgcagagcgtgtgcgtcttgttccggcgcttgccgaagctgcccgtacccttccccatttctttccttgctccgctcggctaaagggttccaggcggaggcgcggcgtggtcgtgagtggcggcgtggagtccccggccccggccggctgcccgg

SEQ ID NO: 19428 - DNA, 667 bp, Zea mays
  misc_feature (312)..(312): n is a, c, g, or t
  misc_feature (443)..(443): n is a, c, g, or t
  misc_feature (501)..(501): n is a, c, g, or t
  misc_feature (557)..(557): n is a, c, g, or t
  misc_feature (561)..(561): n is a, c, g, or t
  misc_feature (589)..(589): n is a, c, g, or t
  misc_feature (641)..(641): n is a, c, g, or t
  misc_feature (653)..(653): n is a, c, g, or t
  misc_feature (655)..(655): n is a, c, g, or t
  misc_feature (661)..(661): n is a, c, g, or t
tccgcccaagcgttccgcgccacccccctcgtgttttttttttttttttttttttttttttttttcaaggctagggcgtactgaaccattctcaccaaaaagatacatatcatacctctccagggcgtctgaaattaattcaagcatagtattatgggctaaatagttcagaagtacaattcaatcaaaaagcctcaagttctagcgcttcttgatggcagcaagaccacacattagttggcagcagcaacacccttctttggggcagcctcagtcccttctctgaaagttgctcttgaaacggcgaggcancgtgtcgcatgtacctcatcctttccggtacccagttgtcttacgcctgatggctttcacactcccagttatacttgcggatgccgggcggcggggtaacccgcaggaggagcagggtgctcttctggagngtggaagctgcggcggccgcagcggatgcagagcgtgtgcgtcttgttccggcgcttnccgaacgctggccgtacccttcccctgtgagccacaacaacagcacgttagcgggnctgncggaggcggaggggaggcggcgcgcgtnccatttcttcccttgctccgctcgactaaagggttccaggcggaggcgcggngtggtcgtgacngncggagnggagtc

SEQ ID NO: 19429 - DNA, 736 bp, Zea mays
gggtaatgtttttagcaaatttgcgtgtgcttccacaacttaataaatatgatggaagcccccaaataaatcactgcccacttaatcaactttgtaactcggaagatgcagctctctttctcctctaataccgtacagggcgcaaaggtttcccatgcgagcatgagcatcatcaattttttgttttttttttttaaaagaagaaacatcaaaccaccagggcgtctgactttaattcaaagcactataaaccagtacatccagagtatttgggctaaatagttcagaagtacaactcaagcaaaatgttccaatgttctagcttatcaggttcttgatagcaacatccagacttagttggcagcggcagcactcttcttgggagcagcctcagtcccttctctgaagttgctcttgaaacggcgaggcacgtggcgcatgtacctcatccttccggtaccggttgtcttgcgcctgatggccttcacactccagttatacttgcggatgcgggcggcggggtaaccgcaggaggagcaggtactcttctggaggtggaagctgcggcggccgcagcggatgcagagcgtgtgcgtcttgttccggcgcttgccgaagctgcccgtacccttacccattcctccctcggctgggggtcaagcggaggcgcagcgtggtcgggttggggggagtggcggcgtggaactgtcgtgccgtatcctccgcggccgcgcga

SEQ ID NO: 19430 - DNA, 728 bp, Zea mays
  misc_feature (649)..(649): n is a, c, g, or t
  misc_feature (652)..(652): n is a, c, g, or t
  misc_feature (654)..(654): n is a, c, g, or t
  misc_feature (657)..(658): n is a, c, g, or t
  misc_feature (661)..(669): n is a, c, g, or t
  misc_feature (672)..(672): n is a, c, g, or t
  misc_feature (674)..(674): n is a, c, g, or t
  misc_feature (678)..(679): n is a, c, g, or t
  misc_feature (686)..(687): n is a, c, g, or t
  misc_feature (690)..(690): n is a, c, g, or t
  misc_feature (693)..(693): n is a, c, g, or t
  misc_feature (704)..(705): n is a, c, g, or t
  misc_feature (707)..(707): n is a, c, g, or t
  misc_feature (712)..(712): n is a, c, g, or t
  misc_feature (717)..(718): n is a, c, g, or t
  misc_feature (723)..(723): n is a, c, g, or t
tttttatttttttttttttttccccccctctttttttttttctttggttcttttttttttttttttttttcacgagcataaaactggggtaataaataaatcacgctcccaaagaagatggcgtctggcttcaattcaaaacacggtaaaccagtactgtaatagtattacgggcaaatagttcagaagtacaattcaataaaaagatccaacgtctagcttctgaggttcttgatggcaacatcgacacttagttggcagcagcagcactcttctttggggcagcctcagtcccttctctgaagttgctcttgaaacggcgaggcacgtgtcgcatgtacctcatccttcccgtaccagtggtcttgcgcctgatggccttcacactccaattatacttgcggatgcgggcggcggggtagccgcaggaggagcaggtactcttctggagatggaagctgcggcggccgcaccggatgcacagcgtgtgcgttttgttccggcgcttgccgaagctgcccgtacccttccccatttccctccttaccccgctcggctagggttcgaagcggaggcgcggcgtggtcgggttgagaggagtgacggcgtgggggcccccggccggccgcgagcgccgcgccggaccgcncancnccnnctnnnnnnnnnctngnaacnngaaaaannacncgntacaaaagaanntngcaanaaaannataancaaac

SEQ ID NO: 19431 - DNA, 679 bp, Zea mays
ggccctaggggccttttttttttttttttttcctgcaactcggaagatgcagctctctttctcctctaataccgtacagggcgcaaatgtttccatgcgagcatgagcatcatcaaactgtggtaccaaataattaaaagaagaaacatcaaaccaccagggcgtctgactttaattcaaagcactataaaccagtacatccagagtatttgggctaaatagttcagaagtacaactcaagcaaaatgttccaatgttctagcttatcaggttcttgatagcaacatccagacttagttggcagcggcagcactcttcttgggagcagcctcagtcccttctctgaagttgctcttgaaacggcgaggcacgtggcgcatgtacctcatccttccggtaccggttgtcttgcgcctgatggccttcacactccagttatacttgcggatgcgggcggcggggtaaccgcaggaggagcaggtgctcttctggaggtggaagctgcggcggccgcagcggatgcagagcgtgtgcgtcttgttccggcgcttgccgaagctgcccgtacccttccccatttctcccttgccccgctcggctgggtatcaaggcggaggcgcagcgtggtcgggttggggggagtggcggcgtcccggcccggccggcctcgagggtccca

SEQ ID NO: 19432 - DNA, 2741 bp, Zea mays
gcatgcctgcaggtcgccatcgggaatttccctttttcactctcgagtgcaagaattggtaggctggtcgtccggacggtggagcagcagctatatggggagtgcaaaaatatccgatggaggatcgaaccatacggacattctgaatttagaaacatcaagtggaactgaaatcctttaatcctctatctttttttctaggttgtttatatatctctcgaaagaggcaggatttgtgcggtccaggatgaatggttgcacttgcacgggctgagatcagagagaccgggcctacctgggatgggagagtacacgacctaagaaacggcagcaaggtcactgtagtctcccgacactgctatgagaagcagcagtgcagaggcgtgggggcacacgcacacgcagacgcaggccactgaaagccgcctcgctgtcgtccctgctgctccggaccatatgcgcattactgccggcatgtgccgatgctcatgcaccgagcgcccgggcctcgcgaaaaggccccacggaaatcacgcacgtaagcacgacagttggtcagctgacagttcccaccgggcggtgggagggcagtgagtgcagaccctcctatccacatccatcctcggatgcacgccgtggtgcgtgcttcccagaccccagagcatgacggcggccgccggctggcctgcgtcgtttgagctacggaaagctggtggtggtacttgtcatgatcatgcagcatcgcgtagtgcagcgcgatggcgagaccacgcatgatgagccgcgcccgccttcccttgcctttgccttcacttccctttccgatgtggtggtggtggtggcggcctaacgggctaacacccacccaacgccacgcatcacgcaacccatcgcccatgcaacgcgagcatcgctggtgaacgctgctcgcccgccctgatcctccgcgacttctatcccgtcgccgcttcggcatcacggttagtgagctagcgatcggccatgatccgtgatgcaatcctcagccagcgattggcgcaacaaggaaggaagaagtgaggaggaagcaagcacgccggccgggctcacctctaaacgcggatttgcgcactagccgacagctaactgcgttggtaagcaaaggcggggggcgatgccgatgagacgtatgaacgaacgggcggcgggggtagttttatgatggaatcatggccgccgggcggctgttttgcttgtgtggggtaggcggattggatttgaaaaatcatagtagtggagtactaatcgttgctgcttatctactcggaacgagaacaagctactgcgcgagaggatagagagagagagagatagggggggtggagagacgaggatgatgacttgtttttcttatcactgttacagctgtcctttttgacatttggaaagaccgccacttggggccgccgcctccgcctccgttcccgcctgcccgccctcccctcgtgcttatccacgacgtaccgaaagccctcgccgcgacgcccgccgaccgaccatccagtcgcacagaacggacgggtaggcaagcgggtcagctgggccgtcgtacgtacgtggatacgaacgaagacgacagcggcatgctgcgctgggcgccgtcgcaacaacggacgtcgtcgtcgttgagcctttgcggtggctgctgctgctgctgctcgctcgcttctcatgtcactcggcgtcggagctctcggggctgggcgcccgatttagatccgggttcttgacgcgcccgctccacgccggccgctgcggcgactgcttcacctcctgccggtgctccgccacagcccgccgcctccgcggcggcggcgtgcatccgcagctgcggcaggtggtggtggtggtggtggtggtgcctctggcgctcgcggtggtgcggcggcggcaccatcatgccggtctgcagcgcgtccacgcgggaccccacctcgatggccttcttccggatggacgcggcggacagcgtgccgccgccgtcggcggggtcgcgcgcgggctccccgccgtcgccctcgccctcgccctccgacggcgccagcgacgggatctcgtcggggaagttgagccgcgccgaccggccgcgcaggtagaacacggccgtgtcgtaggcgcgcgccgccgccacggccgtggcgtaggaccccagccagatgcgcgtgcgcttgtgcggctcccggatctccgccacccacttgccccacttgcgcatgcgcacgccgcggtactgccgccgcggctgcatctgctggtgctggtgctggtgcgccgaccccagctgcggcgcagccgcgctcgccatcgccgcctgctccgcctccatcttcactgctgcggccgcggcggccgccagaggagccatggctgcggctgctgcagcggccgccgactcctcgctggaagaccggtactcgccttgcatgggcaacagctctagccgcctttgctggctaccgctgccgcttcgcgctgtctctcttcctatctctctctctctcgcctgcggccctgctgagggttgtgcaggcaggtgtagcacgccgtgttatcgacagctgctttggtcgttggcgtggttttcttggcttccctccgccgtccctctggctatctatttgctgggcgagtatttgtattgggattttgcgggtggagaagggggtttttcgattaggatgttctaggtaatggtctcgtgc

SEQ ID NO: 19433 - DNA, 633 bp, Zea mays
aaaattctctccggagagcttagttcccgttagaaattaacatctgaaaatggagatcacaaacgtaaccgagtatgaagcgattgcaaaggagaaattgcctaagatggtatacgactactatgcctctggtgcagaagaccaatggactcttcaagagaacagaaacgctttcgcaagaatcctctttcgacctcggattctgattgatgtgagcaagattgatatgacaacaaccatcttgggtttcaagatctccatgcccatcatggttgctcctactgccatgcagaagatggctcaccctgaaggagaatatgctacggctagagctgcctctgctgctggaaccatcatgacactatcttcatgggctacttccagtgttgaggaagttgcttccacagggccagggattcgttttttccagctctatgtatacaagaacaggaatgtcgttgagcagctggtgagaagagcccgagagggcagggttcaaagccattgctctcacagtagacaccccaaggctaggtcgcagagagtctgatatcaagaacagattcccttttgcctccaacctgacatttgagactttgaaggtcttgaccttggaaggatggacgaggccaa

SEQ ID NO: 19434 - DNA, 643 bp, Zea mays
tcactaattctttgtgttgtgaaacctgacaaaaataatgttggccaccggaagggtagcaaaacaaaaggaaatagcccaaagtacaagacgtgttgccaatcaaggaaaggcaactgtgcttgctctcggtaaggccttccccagcaatgtagtctctcaagagaatctcgtggaggagtatctccgtgaaataaaatgcgatgacccctctatcaaagagaagctgcaacacttgtgtaaaaccacaactgtgaagacacgctacaccgtcatgtctagcgagacgatgcaaaaataccctgagctagcaaccgaaggttccccaaccatcaaacagaggcttgagatcgcaaacgaggcggttgtgcagatggcatatgaagcgagcttggcttgcatcaaggaatggggaagaggagtggaagatatcactcatcttgtctatgtttcctccagtgagttccgtttgcccgggggtgacctttacctctcggcacaactgggacttagcaacgaggtgcagagggtgatgttttattttctgggatgctacggaggtgtgagtgggatgcgcgtggccaaggacattgctgagaacacccctagggagcccggtgctgctcaccactccgagaatatg

SEQ ID NO: 19435 - DNA, 879 bp, Zea mays
caaccatatattcacaaccaataatcatcacatcaactttcgtctctaagaaacaaaataaataaaaaatggcttcgatgggtgttggcttacgtgtcacatctcctgccgttctcgaaggaagcgtgaagatcaacggctctagccgtctcaacgtaaccggaagagtgacggtgcctcaaaggtctggacttgtcgtcagagctcagcagagcgaggcggcgccggagactactcgaaggtctgtgattggtctcgtggccgccggtttagccggtggctcgtttgttcaggctgtcctcgccgacgctgttccgatcaagatcggccctcctccacctccctccggtggccttcctgggacggataactcagaccaagcaagagatctgaaacttgcgttgaaggaaaggttttatttacagccattgccaccaacggaagctgtagctagagccaaagaatctgcgaaggagattgtgaatgtgaagtcactgatcgacaagaaagcttggccatatgttcagaacgatctccgtctaagggcttcttatcttcgttatgaccttaacacaatcatctcctccaaatccaaggatgagaagaagtcactcaaggagctcactggaaagctctttgataccatcaacaatctggattatgcggcgaagaagaagagtactcctgatgctgagaagtactattcagagactgtctctactttgaacgatgttcttgccaagcttggttaaccatttcaatgcttgcattctttgtaaatctatcgtctcttgatttttgtttcctgagtacttaaaactcaaaatccctgaatccgaatttgtgtttcaagtttttaccccaaaaaaaaaaaaaaaa

SEQ ID NO: 19436 - DNA, 3096 bp, Zea mays
ctcgagcccgccccgggcccgacagagagcaaaacccaaaccctaacaatcatttgcagcccccggcgtctccagaacctccaaggaaccatccacaggcgaggcctcgctccgtgcccggatctcccatttccgcccggccggcgcggcgggatcctgatactggtgctgtctgctggggtttcgtgtaggagaaggcgcgagcgcgggtgtttggatcgggggaggcaacgctggcggctcgcggcggcagcaggtgatggcggatccgcctagcggtgggggatctagggcttgtgtctgcagggagagacaggtcgaggaggcagaggcgggtctggggctcgggagaagagaacaggggaggaaggagggaggatgctgagcgtggttcgggtacacctgccgtcggagatcccgatcgtgggctgcgagatcacgccgtacgtgctactgcggcggcccgacggtgcagtctccaccaacgatgtccccgaaaccgcgcccgctgatggccagttcatgcggtacagatggtatcgcatacagagcgaccggaaagtccctatctgcagtgtgcatccaatggaacaagcaactattcagtgcctcggttgtctcaagtcaaaaatacctgttgctaagagctaccactgttcagccaaatgcttctctgatgcatggcagcaccacaaagttttgcatgaacgagctagtagtgctctaaatgaaaatggggctgaagaagaggagttatttggcagatttggcagtggtggttctggggttctaagtactgctggatctggttctttgtcaaattttggacaaagccctggtgttaataatggacctgtgcctttctatccctcaggcactgataaaaattctggagaaacttggtttgaagttggacgctcacgaacatatacaccaactgctgatgatattggacatgcactaaagtttgagtgcgtagctgtggattcagaaaaaaagtctccaattggaccctcaacctcaatcatgacatcacgtgtaattcccgcgccaactcctacccctcgccgccttatccaagtgaatggggatgttttaggtcacttggatttagacagccaaatttcgtccttagggacattcactgtgttatcctacaatattcttgctgatgcatatgctacaactgatgcatatagctactgcccaacatgggcacttacctggaattatagaagacaaaatttgctgcgtgaaattattggttatcatgctgatatcatctgtctacaggaggtacaagtaaaccatttcgaagattttttttcacctgagcttgacaaacatggatatcaggcgctttacaagaaaaggacaacagaggtgtattctggaaatcctatggccatagatggatgtgctactttttttcgtagagacaagttttcacatgttaaaaaatacgaggttgagttcaataaggctgcacagtctttaacagatgctattattcctgctgcccagaaaagagtggctttaagtcgattgattaaagacaacattgcactaattgcggttttagaagccaaatttggtaatcatggagctgaaaatcctggtaaaagacagctcctttgtgtggcaaatacacatataaatgtccatcaagacctaaaagatgtgaagctatgggagggttcataccctcctaaaaggattggagaagatagctgtcagtgcagacattcctatgttggtctgtggagatttcaactcaacccctgggaggtgcatctgcatttgaaaatcatggcaatatttaacaggttttattttttcttgaacaatggttgtctaagcacacaattgtacatttcagttctccacatgcgcttctggcaatgggcaaagttgatcagcatcatccagatctggcaatagacccccttggaattttacgccctccaagcaagttgaatcaccagcttcctttggtcagtgcatactctgcatttgcaagaatggtaggtgttggctatgatttggagcatcagcggaggacagaccctgcaacaaatgaaccactcttcacaaattgcacaagagattttactggaactattgattacatattttacacagcggactcattgacagtggattcattattggaacttttggatgaagaaagcttaagaaaagacacagctctcccatcccctgaatggtcatcagatcacatagcactcttagctgagttccggtgcaagccaagaatcagacgttgacacattaggtcttgtagaaaaggtcattgtcatcatccttggtggtggaacaccgttccatgtgggaacttgaggcagggcgggaacgcgggctctcggggaagcaaacaaccaagcagcctcaggaaggggaagaggcttgtaacatttgatttttaccctcctacatttgagctcatgatacttaagatgcccctgtgtaccattactttctatagaagaaaaatacttgagagaaatatttgaagggttataaggcccgtttttcttttttgttcactgcggtcgcgttcgattccttttggctgtgtccatgctcgctgcctacaatacgcagccacgcaggagtcctcgacttctgtaaattctgtaccaatgtaataccagttccagtttttgttttccaaaaaaaaaaaaaaaaggctcaggcactcattaaaaaaaaaaaaaaaaaaaaaaaaaaaaaaaaaaaaaaaaaaaaaaaataaaaaaaaaaaaaaaaacggaagaatgaaggaaaatgataaaacaattgaaaaaataaaaaaaaaaaaaaagggggggggcccttttaaaggacccaagtttacgaccccggcctggcaacgtaaaactttttttttgggggccccaaattaaatttcccggcccgggttttaaaaacgtggggacgggaaaaaccggggggtacccaaattaaaacccttggaagaaaatccccttttccccagtgggggaaaaaaaaaaaaggccccccccaatgccctttccaaaaattggccacccctaatgggaaaagggacccccc

SEQ ID NO: 19437 - DNA, 2658 bp, Zea mays
  misc_feature (49)..(131): n is a, c, g, or t
  misc_feature (313)..(347): n is a, c, g, or t
  misc_feature (359)..(359): n is a, c, g, or t
  misc_feature (2649)..(2653): n is a, c, g, or t
ccacgcgtccggggtggcgcgagcacacagacatagaggcacggaaagnnnnnnnnnnnnnnnnnnnnnnnnnnnnnnnnnnnnnnnnnnnnnnnnnnnnnnnnnnnnnnnnnnnnnnnnnnnnnnnnnnnaacgttccagaaccttcaaggaaccatccacaggcgcgagcgcgggtgtttggatcgtgggaggcaacgctggcggctcgcagcggcagcaggtgatggcggattcgcctagcggtggaggatctagggcttgtgtctgctgggtgagacaggtcgaggaggcagcgtcggggctggtgctnnnnnnnnnnnnnnnnnnnnnnnnnnnnnnnnnnnccggcgcgtggntccgggtgcaccttccgtccgagatcccgatcgtgggctgcgaggtcacgccctacgtgctactgcggcggcccgacggtgcagtcatccaccgacgatgtccctgaaactgcgcccgctgatggccagttcatgcggtacagatggtaccgcatacagagcgatcggaaagtccctatctgcagtgtgcatccaatggaacaagcgacgattcagtgcctcggttgtctcaagtcaaaaatacctgttgctaagagctaccactgttcagctaaatgtttctctgatgcatggcagcaccacaaagttttgcatgaacgagccagtagtgctcaaaatgaaaatggggctgaagaagaggagttatgtggcagtggtggttctggggttctaagtactgctggatctggttctttgtcaaattttggacagagccctagtattaacaatgaacctgtgcctttgtatccctcaggtactgataaaaattctggagaaacttggtatgaagttgggcgcttgcgaacgtatacaccaactgctgctgatattgggcatgcactaaaatttgagtgtgtagctgtggattcagaaaaaaggtctccaattggacctccgacctcagttatgacgtcacacgtaatccccgcaccaactccgacccctcgtcgccttatccaagtgaatggggatgttttgggtcacttggatttagacagccaaacttcatccttggggacattcactgtattatcttacaatattcttgctgatacatatgctacaagtgatgcatatagctactgcccaacatgggcacttacctggacttatagaagacaaaatttgttgcgtgaaattattggttatcatgctgatatcatctgtcttcaggaggtacaagtaaaccactttgaagattttttttcacctgagcttgacagacatggatatcaggcgctttacaagaaaaggacaacagaggtgtattctggaaatcctatggccatagatggctgtgctacttttttccgcagagacaagttttcgcatgttaaaaaatacgaggttgagttcaataaggctgcacagtccttaacagatgcgattattccttctgctcagaaaagactggctttaaatcgtttgattaaagacaacattgcactaattgcggttttagaagccaaatttgctaatcatggagctgaaaatcctggtaaaagacagctactttgtgtggcaaatacacatataaatgttcatcaagacctaaaagatgtgaagctatgggaggttcataccctcttaaaaggattggagaagatagctgtcagcgcagacattcctatgttggtctgtggagatttcaactcgccccctgggagttctccacatgcgcttcttgcaatgggcaaagttgatcagcatcatccagatctggcaatagacccccttggaattttacgccctccaagcaagttgaatcatcagcttcctctggtcagtgcatactctgcatttgcaagaatggtaggtgttggctatgatttggagcatcagcggagaaggacagaccctgcaacaaatgaaccactcttcacaaattgcacaagagattttactggaactgttgattacatattttacacagcggactccttgacagtggattcattattggaacttttggatgaggaaagtttaagaaaagacacagctcttccatctcctggatggtcatcagatcacatagcactgttagccgagttccggtgcaagcctagaatcagaagttgacacattaggtcttgtagaaaaaggttattgtcatcatccttggtggtggaacagcgttccatgtgggtatgacgggacgcgggctctcggggaagcaagcagcctaggtagcagcctcagcaaggggaaggggcatgtaacatttgattttacccttttacattttagctcatgatactcaagctgcccatgtgtaccattacttcctatagaagaaaatacttgagagaaattttgaaggctagtttggaaactctattttttccaaggtatttctatttttcaaggggaaatgaaatattttttcgtggaaaaatagaaatctctagaaaaaatgaggttcctaaactagcccttaaagggctataagcccctttttttctttcactctggtcgcgttggatttaacctctttgctgtatccatatgctcgctgcctacaagatgtaggagccttcagtttctctaccaatgtaattccagttccagnnnnngttct

SEQ ID NO: 19438 - DNA, 651 bp, Zea mays
tctcctttagttctctcgcttagtttcgtagccgcaagactccctctcagattcttacttgcagctatgggtaaagagaagtttcacatcaacattgtggtcattggccatgtcgactctgggaaatcgaccaccactggtcacttgatctacaagcttggtggtattgacaagcgtgtcatcgagaggttcgagaaggaggctgctgagatgaacaagaggtccttcaagtacgcatgggtcttggacaaacttaaggctgagcgtgagcgtggtatcaccattgacattgctctctggaagttcgagaccaccaagtactactgcaccgtcattgacgcccctggacatcgtgatttcatcaagaacatgattactggtacctcccaggctgattgtgctgttcttatcattgactctaccactggtggttttgaggctggtatctccaaggatggtcagacccgagagcacgctcttcttgctttcacccttggtgtcaagcaaatgatttgctgctgtaacaagatggatgccacaacccccaagtactcccaggctagggacgatgagatcatcccgggggtgtctctttctacttggaaaagaaggttgggtacaaccctgacaaaatcccattcgtccccatct

SEQ ID NO: 19439 - DNA, 638 bp, Zea mays
ctcctcttctccagcgtccgatccccgtttcccacgaatcccactctactcctccatctgcggcctcctccatgctcctgcccccttctctctcctccttgcttccccgcgcgcacgtttttacaagggtttcggcggaggcgaccggtcgccgacgatggcggacgacagcggcagccacgagggcggcggcggcggcggcgacgacgtccgggagcaggacatgttcttgcctattaccaacatcacccggatcatgaagaaggccgtcccggccaatgccaagatcactaaggacgctaaggagataatgcagtactgcgtctccgagttcatattctttgtgacgagcgaggcgagggagaaaagcaaaaaggaggagcgtaagagaatcaacgtggacgatttgctctggtcagtggatacggcaggattcgagtacgtggagcttctcaggatttgcctacaaaagtacagagagacggggaagtgcacggtgtacacgacgtgatcaggttattaacctgtaacaccttagtgagaaaacattgagcacttggcaggtagtacgcaatcagtttaagaaactgcaaactgcaagctcctgggcaaactagggtgggttgctggggaaaaag

SEQ ID NO: 19440 - DNA, 2547 bp, Zea mays
cattgggtaccccgccgccccgggacgaaagaatctccctcccgttcccgtcctcccccgctccgcctttccctttcctcccccttcctcttcctctctccttgggggcgcggcgagatcgggcggaggagccctaccgccccccctcgccgaaggccgcagcggaggcgggtgctcagctccgcggaaggttagaggtgcggggctgcgtttggcaccggcggtaggcgcgggagatccggccagcggggatgcagcaggaccagcggaacaaggcttctgcagaggccgacttcttcacagagtacggggatgcgaaccggtacaagatccaagaggtcatcggcaagggaagctacggggtcgtctgctctgccatcgatctccacactcggcagagggtggcgatcaagaagatacatggcatcttcgagcacgtctccgatgccgcgaggatcctccgcgagatcaagcttcttaggctcctgaggcaccctgacattgtcgagatcaagcacattatgctgcctccctcgagaaaggacttcaaggacatttacgttgtttttgagctcatggagtccgacctccaccaagttataaaggccaacgatgacttgaccaaggagcattaccagttctttctctatcagttacttcgggccctcaaatacattcatactgctaatgtttaccaccgtgacctcaagcccaagaatattttagcaaactctaactgcaaattgaaaatatgtgactttggactagcccgggtcgcattcaatgataccccaacaacagtcttctggacggattatgttgcaacaaggtggtacagagctccggagctctgtggatccttcttcaccaagtatacaccagctattgacatttggagcattggatgcatatttgctgaggtgttgacagggaagcctttatttcctggtaaaaatgttgttcaccagctagatttgatgactgatcttctaggcacaccatcaacggacacaatttctcgggttaggaatgagaaagcaagaaggtacttgagcagcatgagaaaaaaggaccctgttccattttcccagaagtttcccagtgcagatcctttggcacttaaactcccagtcgacctcttaccctttcgtccaaaggaccgtctgacagcagaagaggcattgcgtgatccatacttcaaaggtcttgccagggctgaaagagaaccatcctgtcagccaatcagaaaagtggaatttgactttgagcacaaaagaatgtcaaaggaagagataagagagttgatattccgcgagatactggaatatcacccacaactgctgagtagctacattaatggcacagagaggacaacctttctctacccaagtgctgttgatcaatttaagaagcagttttctcatcttgaagagagtggtggtaacggcccatcagttccaacagacaggaaacatgcatcccttcctaggaccactggggttcactcgaattcaattcctgccaaagaacaacctcttggtgcctcatcaagggttcgaccagtctctgatgattcatgtaagaacccttgggagaaaggaaggggtcctggaaatgttcccaggacatctctgactccacaagggctgcaagcacaagcagcaggatcagtaagagttaatggcccagtgacggattcaaggtatcccctaccaacaaatcccacaagagcatacaccgcaaatgcctgaaggttggggttggacagtaccaacccatcgcaggccatgggaggttacacgctgcagtcgcagaaggcctatgcttgtggaaacggcaaaggctcgcctgatgtggccgtgaacatgagagctccccccttccatctcccagctggaccaaagaagaacccattagataggatagcacctgacaccaccgacatatacacaagatccctgaacggcatcgtcgccgccgccgctgcatcagtgggcgctggcgctggtactcaccgaaacatcggcgttgtgccatctggcatgtcaaggatgtattagctgctgctgaaatgctggcaaatcctacctagccttgtggccacagcttctccgggactagctggcaaggctacaaggagtgggcatgtcacatgtggtgcaaggagtgattcataagaggtggtcctgtggtcttggactcctggacatgttcttaggtcacgtattgaagcggaaaaatggcgccattttgcgcacaactgaaggattgatcgattcatttgattcaattgaagctaatgtatttgctaatagtaaaaggacgctgatccaagggaaaggctggagaaattctgacataaatgcaacataggccgttgaccgttgcagtgggacctgagggcgtgtgtatacaatgtattaggctcgttttatcgaccgtcacatctggtattatcatgctatcagccacctttaatctttatctaccacaacagttcaatacagtgctttactgttaaacctaactcgagggggggcccggtac

SEQ ID NO: 19441 - DNA, 1013 bp, Zea mays
  misc_feature (1004)..(1004): n is a, c, g, or t
ggcacagagaggacaacctttctctacccaagtgctctgcttcgttggcccccccccccttctcatcttgaagagagtggtggtaacggcccatcagttccaacagacaggaaacatgcatcccttcccaggaccactgtggttcactcgaatccaattcctgccaaagaacaacctcttggtgcctcatcaagggttagaccagtctctgatgattcatgtaagaacccttgggagaaaggaagtggtcctggaaatgttcccaggacatctctgactccacaagggctgcaagcacaagcagggatcagtaagagttaatggcccagtgacggattcaaggtatcctcctcaccaacagatcccacaagcatacggttaccgccaaatgcctgcaaggttggacagtaccaacccatcgcaggccatgggaggttacacgctgcagtcgcagaaggcctatgcttgtgcaaacggcaaaggctcgcctgatgtggccgtgaacatgagagctccccccttccatctcccagctggaccaaagaagaacccattagataggatagcacctgacaccaccgacatatacacaagatccctgaacggcatcgtcgccgccgccgctgcatcagtgggcgctggcgctggtactcaccgaaacatcggcgttgtgccatctggcatgtcaaggatgtattagctgctgctgaaatgctggcaaatcctacctagccttgtggccacagcttctccgggactagccggcaaggctacaaggagtgggcatgtggtgcaaggagtgattcataagaggtggtcccgtggtcttggactcctggacatgttcttaggtcacgtattgaggcggaaaaatggcgccattttgcgcacaactgaaggattgatcgattcatttgattcaattgaagctaatgtatttgctaatagtaaaagacgctgatccaagggaaaggctggagaaattctgacataaatgcacatangccgttggc

SEQ ID NO: 19442 - DNA, 840 bp, Zea mays
actattatgctcttacctattcctgttctccatagtacaaaagatgatattgattttgtggctggtttcatttgttggaatgctcttcaactttcttacgctcgtttacattgcttttctctgcggtaaattgctggcttaaatgcatgctgcttgaaccctataatcagatagaccatcccgaatgcaagtcaaggcctgatagtggtctttctgcaattacagagctggaccctggttatataacaggtttcaggtcctctctcttcagtatggaaagaatgggtcaaatggtgtgtagagtttggcattgaagctaatgcaattatcgctgttccgtatgattggagactgcccccatcaatgcttgaggagagagatctgtactttcacaaattaaagtttgtaacacttgcctcaacttgttatgaagcaaccaaatgctatacatctgttaggatcagtaagagttaatggcccagtgacggattcaaggtatcctgctcaccaacagatcccacaagcatacggttaccgccaaatgcctgcaaggttggacagtaccaacccatcacaggccatgggaggttacacgctgcagtcacagaaggaaacattatttgaagagttgccattttgaagagttactcgaatccaatattttgctcttttgaattccttggtgtacactggcaaatattagcatatttgaagagttgccatttcgatcatcatcttcatttgtactttttgggtcagatctaataaagcatcagcattaaatttacaaaaaaaaaaaaaaaaaagaaaactcgaatacgagggggggcccggtaccca

SEQ ID NO: 19443 - DNA, 5036 bp, Zea mays
  misc_feature (1101)..(1101): n is a, c, g, or t
  misc_feature (3293)..(3293): n is a, c, g, or t
tgtactagagaatcctgtgcggccaatggatatatcactgtaagcaggaggaggagcctcgagaggaggtaggacagagcgtttatgcagctcacgaatctcaagccatgcctcataggtcacgttggttgtatattaacatgtcccaaaaatggcacttagctaatgtggaagcttgctcttcttcctatgagaagaggaagaagggcaggaggacacaggttagtcgctggcaaaagaactgagaggacgatcacctccaaacgatgccctagggcaaccactagtagaagatgttggctagggtcaacataggtagaggagtgagtcctttctactctgaaagtctcatgtagaccatcatgtggaaagataaatcctatcacccgctcattgataaacattacatgaggcgcatagggaacgtcttgtgggaatcctcgatcacaaactgtaactcattccagatgaaatgagagaccaagaagggagcgccactaggaccaaaccttgccataagatttcttgcatatccatagagattggaaattgatcctacccatagggattgcaagttgatcctatcttggggttgatgttctagaggaaaaggttgtagaacatataagggctttagatctctcacaagagcatcaactgttgtggggttgacatacacgaaggtgatttcacgttcaatcagattccttttatcatgaaacttagcaaaacacatgtccatcgaaatgaagcccaacaaacgaacaaaagtgataaagtcaagcctatagtgcctgccttctgtcatccagtgaagtatgtctgtcatattgcaccaatagtaggtggagatgaactggtgcaagatatttgtgctccaattgttaagaatatttatcagggtactaaaaatacatcaactaataaagaccatgacaagtgggtctgtgagctcgactacgctatccagggactcgccccacatgttagagagacacttggctcgtcaaaaaaaaatcaaagatgcaggatcttatcagatttgtagatatctatgtaataagatagtctggatggtaaaggaaacatgtctataaaccntcctcttcttggattataaaaaggatagatgagtcctctttttggattataaaaggatagatgagtcatctactagattataagataatatccagcagatcgtgtatatggttgtgtaaaataatattttgtagtacaatatgcattgttcatatattgaagtttggagaatggattgtgtggtgatggatgatgaatggattgtgtgcaaagcataggatgctcctactgccgctgccggacaagaatccctgagctccatttattcctccttgacatcctaatcgaaaaatcgtcagcctgcctcgcgtctcgtcgaccatccaaatccactcccttctctagtccaaggagctcaggaggtcgaggaagaaggaatggcgccgtcgtaccggccctaccacgtcgccggcgaggatcagcagcgtaaggtgaaggcgggtgggaagtggttggccgcgtggagcgtgctgggtgttggcggcgacccggcggagatgaagcggcggaggcgggtggccagctacaaggcgtacgcggtggaaggcaaggtgaaggcgtccatccgccggggcatccgatgggtcaaggccaagtgcgaccgcatcgccgccattcacaactagctagtagagcagagctgagctgagcatgtcgtcggttcctttccttgtgcgcttgcattgcattgcattgtgtttttacctgttcaggatccatttccatttaccagcttcttgttgttgttgttgttgttgttgtcacatgtatgtgcatgatccattctgaacccggttttaatccgaaacaaatcagccactagagcaaagttcattgaaaaaaaaaaaaaaagcctcgcaattcaccggaatcggacggtcgaacccgcctcgggacagcagggtgcccaccaccgccatgtcgcggcagaacacgccatggaacggcgggatcaatggtggtgtggctgcagtcgccataggcatgttgccaccgtttgcagtggcactcccttgcactgttgccaccacctctttttcttcttcctccggccctgccgtggcagcggcgtccttgcctctctcctccagcaccgccgacatgatgaacgagtagcccttctgcagcatccggtacagaaacagcgccgacatgcgcgcctggtcgcgcaccgcctccaggtcccggtgctcgtccacgagctccatcctctccgcgaacgacaccgaccgctcgggcttcagcttcagcgtcagcaccaggtgcgcgcgctccagctccgaccgcgtgcacccgcgccgcaccccgaggagtgcgtagtagtcgacgccggcggcgacgcggccgcggagctgctggatgcgcgcggtgagcgtgcggtgcgcgcccgcgatctccgcgaaccggatgccgccctgcgggcgccagcacgggcctggcagcttgccgtcccggagcgcggcgtcgtacaggagcttcaggtggtcgaggtcccggaggcagtccggaagcgccccgaccgactccagcacgtcggcacgcgcgcgcagcgctgggatataggccgggtccagcgccagcgcgcggttgcagtccgcgatggcgtccgcggggcgccccgccgagcggaacgccgcggcgcggcccacgaggcaggccgtggcgaaggggtgcggcagcacgctgcggcgcgtgtcgagcaccttgttgaaatggcgcacggcctcgccggggaagccggcgtccagcgccgccaccgcggcggcgcggcggcggaggagcagcttcacgtgcgccagcagctgcgacacggactccgcccttgtattggcgggcgccagcaggttcgacgggggcgggaacctgtcctccgaccagcacacgctctcgcgccggaacgccgcggaggcgaggcggcgaccggtttggagaagcaccaacgcgtcctccatcaggccgaggtggaagcaagcctggcccaggaccaagtacctccactggtgggcgtggatgctggagaaggtggcgaccaggcggcgcttgaggccggacacgtcgaggcagcacaggaagcggccagcgtcggggcggtcgtggtccggtgacaggagatctgccccggagccagacgagcaggatgaggaggacgaggcggtggtggcgtcgtcggccgagcacgacttggcgcagcngctggggatgtagtcgcagagcatgtcggcgacgtcgcggtagcgcctgagcgcgaggagcgcccgcgcccggagctccagcgccgcctcggcccgcggcgacatctccagggcgacggtcaccaggccgagcgccgccgccgccgcgtcgtccgcatcctcggtgtcctgcgccgccgcagcgagagccgcccgcgcctcgccgaggtacctgtcgaccacctgtcgcacatcgcaatcaacgcgtggccttccaacactgaaacgaaaatttgtggcggaaaaggacaacgaagccgtccacgcaaacagaaggcatcacggaagaggacgagggtccgtcctcgaatcacgaacgtctcgccatcacggaagtggatcgatcagcaaggctggcactcctctcgggattgcagaaggcgaaaccgggcaggcatggacggacgagacgagagtagagttgagtgggggaggggagcaatgcgggcacgaaccttcttgttgcttcgcagccacctgatgcgattcttggtcggagcggaggaagggggcggcggcgccattgcgtcccccgcatcaaccaaaaagatatcctactcctctatagtagcaccggcaatggcatcaacggggtggagatgagatcctctacagcgtctctaagttttcttgttgcgcggtgcctgccaaattgattgatggatccgaaatgccagcttggagcctagactgaaataaaacggagggagggaggcatgagagttgagacagggtgctgctgactggttttgctttgtgacaaagaaagcatcgatcctccaagttcctagctggaagagatgcccgtggctggctttgctgtggatgagccttttttttttttgaagaggaagacgacagggggttggctatcaggttccttaaaacctgaagcgttttcacgcgccctccgcgtttcacggttctttgcaaaatgtctgtgcgacacgtccatacgactcacgggtcgcttctcgctccgcgcgtgatgggtgttctctctcctcgcggacatgacgcttcgtccagccacgctgtcctctccatctgcttcgccgatgtgtcgcgcttcaccacagccaagtgccccgcgtcagcagcctccggatctgatgggtgccgcggcagccgagtcgcgcggagcagtggcgtggccgcccctccggtgaggccgactgtcgcgagctgtggtgggctccgctccgcgcggatcctgcagcgagcaacccgtcgccccgcgtctgcaccccgccttcggatctgaccagtgctagagctgtctcgtcgcgcggagcaggggcgtggcggtgaggtcggcggtcgcggtctgcagatggggccctccgcttcgttcgcagtgcgcggagcaggggcgtcgccgcccctccggtgaggccgaccgtcgcgagctgcggtgggctccgctccgcgcagacccacttgtagctgcagcgagcaacccgtcgccccgcgtctgcgctccgccttcggatctgaccagtggcagagttgtctcgtcgcgcggagcatgggcgtggccatccctccggtgaggccggtggtcgcggtctgtagatggccccccctctgcttcgttcacagtgccgtcgggggatgcacgggagtaccgctgtcttcacccactgcgcagattaaactaccgctgctgtggtgggcagcggctccgcgtggacccacgcacag

SEQ ID NO: 19444 - DNA, 3059 bp, Zea mays
gaccgtctgacagcagaagaggtagtcctttgctgctgtctcatcttaaaacttctttgtgtctaatttttctctatggatctagatctgagatgttgctttcaactttactttgtaatccttagtatttgtaacatctctttcaattgtttcaggcattgcgtgatccatacttcaaaggtcttgccagggctgaaagagaaccatcctgtcagccaatcagaaaagtggaatttgactttgagcacaaaagaatgtcaaaggaagagataagagagttgatattccgcgagatactggaatatcacccacaactgctgagtagctacattaatggcacagagaggacaacctttctctacccaaggttttagcttttctgtgtttgcacatgtatgttgctttgcacatgcatgtaattgctcatgtatccattcgtttgaacacttgacggaacagttgctggctatttttatgcagtgctgttgatcaatttaagaagcaattttctcatcttgaagagagtggtggtaacggtccatcagttccaacggacaggaaacatgcatcccttcccaggtaaatagggcatcatagtcttgatttcattctcacactgctttgaggtgcaatttcaagtacatttacatcttagtttctctccatattaaggttctcccttgtggcctgagtgcccaatggtaaggagtagccgggaaagttgctcccacttgtctgggcttctgtccttttgtcactgtaatttagttgggtgaaagcttttgctttttggttttgctaatctgcagcttcattttgtaggaccactgtggttcactcgaatccaattcctgccaaagaacaacctcttggtgcctcatcaagggttagaccagtctctgatgattcatgtaagaacccttgggagaaaggaagtggtcctggaaatgttcccaggacatctctgactccacaagggctgcaagcacaagcaggtatttccgtgttcacttactgccaacttcctctgttccaaattgcaagtcagtcgtttgggcttagatacagagcaaaaactatgttatctacaaaaaccaaaacgacttataatttggtacggagagagtactacaaatgatctgttgatattttctgacttacgatggcccgccctgttctgagattgttttccatttgccacagcaggatcagtaagagttaatggcccagtgacggattcaaggtatcctcctcaccaacagatcccacaagcatacggttaccgccaaatgcctgcaaggttggacagtaccaacccatcgcaggccatgggaggttacacgctgcagtcgcagaaggcctatgcttgtgcaaacggcaaaggctcgcctgatgtggccgtgaacatgagagctccccccttccatctcccagctggaccaaagaagaacccattagataggatagcacctgacaccaccgacatatacacaagatccctgaacggcatcgtcgccgccgccgctgcatcagtgggcgctggcgctggtactcaccgaaacatcggcgttgtgccatctggcatgtcaaggatgtattagctgctgctgaaatgctggcaaatcctacctagccttgtggccacagcttctccgggactagccggcaaggctacaaggagtgggcatgtggtgcaaggagtgattcataagaggtggtcccgtggtcttggactcctggacatgttcttaggtcacgtattgaggcggaaaaatggcgccattttgcgcacaactgaaggattgatcgattcatttgattcaattgaagctaatgtatttgctaatagtaaaaggacgctgatccaagggaaaggctggagaaattctgacataaatgcaacataggccgttggccgttgcagtgggacctgagggcgtgtgtatacaatgtattattctcgttttatcgaccgtcacatctggtattatcatgctatcagccacctttaatctttatctaccacaacagttcaatacattgtctttactgttaacctacattcgccttagcgccttaaccacctttactttatactaactccatttgtttttatttaacgctggctaatataactttacactaaaacaagtcaaatattaaaaaccggaggcagtatattttttagttagaacaaaacacgaaataaaaatatatccatgtataaaaattatataattcataaaaaagcaaatgaaatgtaaaaactacaaacaacaaaattgacataattcataaaaataactgatacactgttactcttcggcatctttctctcccgtctctttgtacttttttgcgtctttgtctaagtcaacatttgagtgatccaacaaattatttaattattcaaataatttagattgagtcatcctctacctggtctgtacaacttgctcaatagtttttctccataactctagactagctgctacttgttgctatttataaaataatcgtttagttttataactttcgatcttggatgtagtgtttctcatttgcgtagagtgttagttattttggaataaattttaaatcttagaaagttgtttgttttgggacacaagaagtatatgtatagaaaagtcaaaaaatttataacagaatgaaaggagtacatgtataatccccaataaaaaacaaacaacatgttccttgggcttaaagccacccgtttgggcggctgctgccaccattccaagaatcaatacattatacaaagaatccattacgatactgaatacaaaaattctcagatgtaaaaccaaaaccgaactgaactataaaaaaactaaaattttggttcgatttaatacagttcgggtttagcgtaaaaaaaagtgcccgccctaagactcgcgaggctgtgtaaacaagcggagctgttattactgctagactggagagtactactgttactaccacggtttacaaaaccgttccagagttaaaaaccgccccccaccggtaacggtttaccaaaggtaaaccaaggg

SEQ ID NO: 19445 - DNA, 641 bp, Zea mays
  misc_feature (627)..(627): n is a, c, g, or t
atgattcaaatctatctctagggtttccaaagagagagggagctaggcagagagaggttcagcgaaaatggcgatggccatggctcttcggcgactttcttcttcagttgacaaacctattcgtcctcttatcagatcaactacatgctacatgtcatctctgcccagtgaagctgttgatgacaaggagagatctcgtgtcacttggccaaaaaagcttaacgcatctttggaggaggttgatcctgagattgctgacattattgagcatgagaaagctagacaatggaagggacttgaactcattccatctgagaatttcacatctgtctcggtgatgcaagctgttggctctgtgatgactaacaagtacagtgaagggtaccctggtgctagatactatggaggaaatgagtacatagacatggcagagactttatgccaaaagcgcgctcttgaggctttcagattagatcctgaaaagtggggagtgaatgtgcaacccttgtctggatctcctgccaacttccatgtctacactgcattgctcaaacctcatgagagaatcatggcactggtcttccctcatggtgtcatctttctcatgttatcagatgacacaagaanaattctgctgtgcc

SEQ ID NO: 19446 - DNA, 744 bp, Zea mays
ttccccataagctaataattattttaagcgagagattttttgtcaatcttttttttttttttttttgaactcccaatggatttccatttataacaggtgtgtagtgcaaagccgcataaataaaatctggaatagtaaaataaaattcaagtacacaagggttagaagacaattctagtgttacagacttgtttatcttcaaggcagcatgttacataaacatattatctcagtacagccaacggttgcgatgtcagcgcctttgttcggttatttacttcttgtcatctctgaggacaacgtagttgtggccgttcgtcttctgtatcttcgaaattttcttcagaatttcagcaaatgcattcttgtcctctgcacctcgaagcctagacttgaatctggataccagatcttgtgtggtgactggagccactgcaagaagaacactcctgatttcatcctctgtgacaggtgatacgcttgtcccactttttgatgcagcagaggtctttgatgcaggttttgccaaagatgatgcctcctctttgaggcctgatgctttcgcatcctttttgctttctttgaagctgcaccactagaagtttttgcatcatcaacacctgattttctcttttgcttggatttggatgccggaggtgtgcctcgagcatgtcctgatggtgctggtttagatgggctgctatccacaggttcatctttaacttgatccttctgttttggagc

SEQ ID NO: 19447 - DNA, 2710 bp, Zea mays
  misc_feature (1252)..(1252): n is a, c, g, or t
  misc_feature (1260)..(1260): n is a, c, g, or t
catccaccgcccttcacccgctcttctttgcgaggtttgttttggttagatcactctttgtattgttcttctgtctattggacatgtcttgcctcttcgaattccattctgcctatcttacctcttcgaattcctgcgtttagggtacatgtttcatccagatctgacccctatatatggttgccttgttttacttgtgcgctgctgatgcatgcttatgccagccctgtaattgtgcctaagctccagaacatagatcagatacgtttaggactcgtaatggatcgtggctaaatatggggttagttgctccgtggagcaaaccggatgtgatccatagaaccaaatgagtactccagaagcaccggtctgtccatacatgtaatccagcttcaacccagtgctccaatggatcggctgggtctattgtatgatgagctagcggtgtggcgctacatgctccgatcgaagccatctgccggcctgggtccattgttgattggatgtagcaatttgcccacataattgtctttatagatttctaagagctgttgccttcctgcaataccttgagcgattgtttatacacatgctttatggtttttaaccacacaagtagaacaatcgaattgagaattgaactgacgaatacatattttcttggctatgccgcagttccatggattgtcaaagcttaaccagcaagaacctgatgctgtgcaaggcaacaacctttgaacacaagtccacaaactacaaaaaacaacaatgatttgccattagtgtaagatcacaaactgaaaaacagaacacaactaaggttcaccaacacataattcttttctcacgaacactaatatactaacaaacacagttattgcactgcattcatcagtaacgagactatattttgcataattattttggagataaatattcgtcagcctggagaatgcaagggatccttgatgttcacatgctgtcaactagcatcacaatctttaaaagatatttgagatcctctacttctcacggatgcaacttactaggttgctcctcattcaatgcaaattggatcacctttcttttctcctcctgccagtaagcatacacatgttatcatcaccgacgaatgtaggatctgtgtgactttgtaagcataagaaagcaaaatgattgctttttttgtttcatcatgaacgaccaactgcatcaatgctacatgctgtaggtatttcttagctatatttcnaaaatatngaatatcaaatatgtgatactcactattggcagccaacatcatgttgtgttctcacagttgcagtagtgaatgcaaatattgtaatctgaaccccgttctgccggtggttgcgagagtgtgttaagacaagatggtggcgaatggcgacgcacctgctagagggagtgcggcggcagctgcaagcctgcgcaggcgtaggaccacaagcggtgctgctgctggcggaggtggtgccagctcgatgctccagttctacaccgatgaggctgcgggccgcaaaatgtcaccaaacaccgttctgatcatgagcattgggttcatagctgttgtcgctatgctccatgtttttgggaagctgtaccgcacctccaactaggttggtattaccataaccaagaaaacagaggccaccaagagaggagccttatagagccatttcaatggatagcaagtgactatcaaagaggaaccttgtagagcgatttcaatggatagcaagtgactatcagattgtgaagtgttatagaagtttatctatacaacttgcaatgctgagggctatgatcaatctctgcgagtcttgtttaggcttcatgttttttgcatgtgcttgcatatgctactttctatttctgttgtcctgatcttgccgttcgatccttgttgcttacctttggcaatctgcctaatgggcaaacactatttctcactgatagccttgcgcttcctgttagcaaagtcgttgtcacctctagcaatcttgacaactctcagactattgctaactttgttcaattccatcattagagatggtaaaacactatcatccaactccctcccaatctgccttctatgtgccattttctccattatcatctctcttaagccgtcaaatagctcatgaggtaagagacccctcggtgccttaatttggttattgaaactctcagatgcatttttagttaggtagtcacatttgctatgttcatagaagccacttctataccaaatcctagaatgatttctgtgaagccatgttatagcttctaggctattatctgccatcttttgtaggcgccacttgaatacgtcctttgtttaggacctgagtacagtaagggcttgttcggttagctctcaatccatatggattgagtgaaattggatgggtttaaatcccaagtaagttaaacttcttcttaaaattttccaatctcatccaatccatgggtaacaggattaaccgaacaaggggtaacaggattaaccgaacaaggggtaacaggattaaccgaacaagggctaaaatggctgagcgagatccgtgtatgccgtctgcctcgatatcgtacccggatgacgtgcaacgcacgttctgattgggcgatccggcgctgcgacacgaagggtaaatatcaaaagaacactggactggtggattaacgtgca

SEQ ID NO: 19448 - DNA, 815 bp, Zea mays
  misc_feature (581)..(581): n is a, c, g, or t
  misc_feature (598)..(598): n is a, c, g, or t
  misc_feature (606)..(606): n is a, c, g, or t
  misc_feature (612)..(612): n is a, c, g, or t
  misc_feature (626)..(627): n is a, c, g, or t
  misc_feature (638)..(638): n is a, c, g, or t
  misc_feature (649)..(649): n is a, c, g, or t
  misc_feature (659)..(661): n is a, c, g, or t
  misc_feature (672)..(672): n is a, c, g, or t
  misc_feature (677)..(677): n is a, c, g, or t
  misc_feature (682)..(682): n is a, c, g, or t
  misc_feature (690)..(690): n is a, c, g, or t
  misc_feature (700)..(701): n is a, c, g, or t
  misc_feature (705)..(705): n is a, c, g, or t
  misc_feature (710)..(710): n is a, c, g, or t
  misc_feature (719)..(719): n is a, c, g, or t
  misc_feature (723)..(723): n is a, c, g, or t
  misc_feature (736)..(736): n is a, c, g, or t
  misc_feature (742)..(742): n is a, c, g, or t
  misc_feature (756)..(756): n is a, c, g, or t
  misc_feature (765)..(765): n is a, c, g, or t
  misc_feature (769)..(769): n is a, c, g, or t
  misc_feature (783)..(784): n is a, c, g, or t
  misc_feature (801)..(801): n is a, c, g, or t
  misc_feature (809)..(809): n is a, c, g, or t
  misc_feature (813)..(813): n is a, c, g, or t
gccggccgtactgggcggaagcagcgtctaacacggatctcgctcggccatcggactgtgcgtgcccaagacggaggggggaacagcggattcgtcaccgccaggcgtcaggtcagagtgtgttaagacaagatggtggcgaatggtgatgcacctgctagagggagtgcggcggcagctgcaagcctgcgcaggcgtaggaccacaagcggtgctgctggtggtggaggcggtgccagctcgatgctccagttctacaccgatgaggctgcgggccgcaaaatgtcaccaaacaccgttctgatcatgagcattgggttcatcgccgttgtcgctatgctccatgtttttgggaagctgtaccgcacctccaactaggttggtattaccataaccaagaaaacataggccaccaagacaggagccttatagagcgatttcaatggatagcaagtgactatcagagaggaaccttgtagagcgatttcaatggatagctgtgaactgttatagaagtttatctacacaacttgcaatgctgagggctatgacaaaaaaaaaaaaaaagagtcccccagccnggggatccctatttaanccgccgcnccgggnggactccacctttnntcccttatganggtaattcaanctggcgaatnnngcatactggtnctggngaatngttccctnaattcccaanntcanccgancttaatgtnaacnggggcctaagggnccaacnattttgggtgcccntggcctttnaagngaaacttttgcccnntttattccccccggganggtggttngccntc

SEQ ID NO: 19449 - DNA, 492 bp, Zea mays
atatttacctttcgcgtcgcagcgccggatcgcccaatcagagcgcgcgttgcacgtcatccgggtacgatatcgaggcagacggcgtacacggatctcgctcggccattggactgtacaaggacgagagcgagaacagcggattcatcaccgccagcgtcaggtcagagtgtgttaagacaagatggtggcgaatggtgatgcacctgctagagggagtgcggcggcagctgcaagcctgcgcaggcgtaggaccacaagcggtgctgctggtggtggaggcggtgccagctcgatgctccagttctacactgatgaggctgcgggccgcaaaatgtcaccaaacaccgttctgatcatgagcattgggttcatcgccgttgtcgctatgctccatgtttttgggaagctgtaccgcacctccaactaggttggtattaccataaccaagaaaacataggccaccaagacaggagccttatagagcgattt

SEQ ID NO: 19450 - DNA, 768 bp, Zea mays
  misc_feature (751)..(751): n is a, c, g, or t
caatcagagcgcgcgttgcacgtcatccgggtaccaggccagacgccggccagacgcaaagccggaagccagcgtatatacatgtgaataacgcgggtcaggcggaccgtacggcgtacacggatctcgctcggccatcgggactgtacaaggacgagagggagaagagaacagcggattcatcaccgccaggcgtcaggtcagagtgtgttaagacaagatggtggcgaatggcgacgcacctgctagagggagtgcggcggcagctgcaagcctgcgcaggcgtaggaccacaagcggtgctgctgctggcggaggtggtgccagctcgatgctccagttttacaccgatgaggctgcgggccgcaaaatgtcaccaaacaccgttctgatcatgagcattgggttcatcgctgttgtcgctatgctccatgtttttgggaagctgtaccgcacctccaactaggttggtactaccataaccaagaaaacagaggccaccaagagaggagccttatagagccatttcaatggatagcaagtgactatcagagaggaaccttgtagagtgatttcaatggatagcaagtgactatcggattgtgaactgttatagaagtttatctacacaacttgcaatgctcagggctatgataaatccctgcgagtcttgtttaagcttcaaaaaaaaaaatttgcggccgctcgcatatgctcctttcccatttctgggtgcccgggatcttgccgnttcattccttggtgctg

SEQ ID NO: 19451 - DNA, 677 bp, Zea mays
cggatctcgctcggccatcgggactgtacaaggacgagagggagaagactggaggggattcatcaccgccaggcgtcaggtcaggtgcgtgcgcatacatccatctgccacccttcacccgctcttcttctgccggcggttccctccacccgctcttctgccggtggttgcgagagtgtgttaagacaagatggtggcgaatggcgacgcacctgctagagggagtgcggcggcagctgcaagcctgcgcaggcgtaggaccacaagcggtgctgctgctggcggaggtggtgccagctcgatgctccagttttacaccgatgaggctgcgggccgcaaaatgtcaccaaacaccgttctgatcatgagcattgggttcatcgctgttgtcgctatgctccatgtttttgggaagctgtaccgcacctccaactaggttggtactaccataaccaagaaaacagaggccaccaagagaggagccttatagagccatttcaatggatagcaagtgactatcagagaggaaccttgtagagtgatttcaatggatagcaagtgactatcggattgtgaactgttatagaagtttatctacacaacttgcaatgctcagggctatgataaatccctgcgagtcttgtttatgctccaaaaaaaaaaaaaaaaaagcggcc

SEQ ID NO: 19452 - DNA, 702 bp, Zea mays
tcggggaggcggaccagacgccgtacacggatctcgctcggccatcggactgtacaaggacgagagggagaagagaacagcggattcatcaccgccaggcgtcaggtgcgggcgcataccatccatctgccacccttcacccgctcttcttctgccggctgttccctccacccgctcttctgccggtgcccggtggttgcgagagtgtgttaagacaagatggtggcgaatggtgatgcacctgctagagggagtgcggcggcagctgcaagcctgcgcaggcgtaggaccacaagcggtgctgctggtggtggaggcggtgccagctcgatgctccagttctacaccgatgaggctgcgggccgcaaaatgtcaccaaacaccgttctgatcatgagcattgggttcatcgccgttgtcgctatgctccatgtttttgggaagctgtaccgcacctccaactaggttggtattaccataaccaagaaaacataggccaccaagacaggagccttatagagcgatttcaatggatagcaagtgactatcagagaggaaccttgtagagcgatttcaatggatagctgtgaactgttatagaagtttatctacacaacttgcaatgctgagggctatgataaatccctgcgagtcttgtttatgctccaaaaaaaaaacaaaaaaagcggccaaaaagcggcc

SEQ ID NO: 19453 - DNA, 616 bp, Zea mays
agggttttgcaccacacaatcgccgaacgaatccaacaccatgggacgaagacctgcgagatgctaccgtcagatcaaggggaagccctacccgaagtcccgctactgccgcggtgtccccgaccccaagatccgcatctacgacgtcggcatgaagaagaaaggagtcgacgagttccctttctgcgtccacctcgtctcctgggagaaggagaacgtctccagcgaagccctcgaggctgctcgtatcgcctgcaacaagtacatggtgaaatccgccggaaaagacgcgttccatttgaggattagggttcatcctttccatgtcctgaggatcaacaagatgctttcgtgcgccggggctgataggctccagactggtatgagaggtgcgtttggtaaggccttggggacttgcgctagggttgcgattgggcaggtgcttttgtctgtgaggtgtaaggataaccatggagctcatgctcaggaggctctcaggagggctaagtttaagttcccggggcgtcagaagatcatcgttagcaggaaatggggtttcactaagttcaaccgtgctgactacacgaggatgaggcagtcgaagaggattgttccc

SEQ ID NO: 19454 - DNA, 638 bp, Zea mays
atcatcgagtgtctcgccaagtgcttcaccacaaacactaaaaagacatctcttctctcctgcaaaatgttcagatccgcgcttgtccgatcctccgcctcggcgaagcagtcgcttctccgccgcagcttctcttccggatccgtccccgagcgtaaagtcgccatcttgggagccgccggtggaatcggtcagcctctggctctcctcatgaaactcaatcccctcgtctcaagcctctccctttacgatatcgccaacacacccggagtcgccgctgacgtcggtcacatcaacaccagatctcaggtggttgggtacatgggagatgataacttggcgaaagctcttgaaggagctgacctcgttatcattccagctggtgtccccaggaagcctggtatgacccgtgatgatcttttcaacatcaatgctggcattgtcaagaacctttgctctgccatcgccaagtactgccctcatgcacttgttaatatgattagcaacccggtcaactctactgttccgattgcagcagagattttcaagaaggctggtatgtacgatgaaaagaagctgtttggtgtacccactcttgacgttgttagggccaagactttctatgctggaaaggctaa

SEQ ID NO: 19455 - DNA, 629 bp, Zea mays
atcgagtgtctcaccagagcttcaccacataaactctgaaagacatctcatttagatcttcctcctctcctcccaaaatgttcagatgtatgcttgttcgatcctcttcctcggcgaagcagtcgcttctgcgccgtaacttgtcttccggatcagtcccggagcgtaaagtcgccatcttgggagcggccggtggaatcggtcagcctcttgctcttctcatgaaactcaacccgctcgtctcgagtctctcactctacgatatcgcaaacacacctggagttgccgctgatgttggccacatcaacaccagatccgaggtagttggatacatgggagatgataacttggcgaaagctcttgaaggagctgaccttgttatcattccagctggtgttcccaggaagcctggtatgacccgtgatgatcttttcaacatcaatgctggcattgtcaagaacctttgctctgccatcgccaagtactgccctcatgcacttgttaatatgatcagcaacccagtgaactcgactgttccaattgcagcagagatcttcaagaaggctggtatgtacgatgagaagaagctgtttggtggtaccactcttgacgttgttagggccaggact

SEQ ID NO: 19456 - DNA, 1708 bp, Zea mays
ttttttttttttttttatgcagcggaaactttttttaataaaaaaactgatatgctcggagactcccgactttttttgttgtgcaaaagcactgatatgaactgagatttctgacttacatggatgagcaaaagcacaagacgacatcaaatatggcaagtgccaaagctttgaactgtaaaatcttgtggcccgtccatgatggtacagaaaaagcctagtgtggtggttgttggtgatttaaaaggaaaaaatcgttctgcaaatacaacatcattggaacaccaatcagctagttacatccaagatgaacaaagaatcatggcccccatgctcaagtagctgaaaataaacaaccaccaatacactgagacaaaaccctgtaaagcagcaacagctagtatttttttcgacggggcagaacctgatcaatcaaaactgagacctgaagtatcttaacatacaatgcaaagcagactgcgaaagtcctcatgtgctcttctcagcaattgttttagcagaattactctcctacggtcattccgaaaccaaacttgtagttcttcttacaatggtcaatctcagcagatagaagaaagttgacacccatgttcaacctctcctccagatatgccgcaacaacaccattcgagtcaattttgcctcttagacggcactgcctaagcaagtaatcgtaaccaaagctggaagttacgtctcttgacatatggttatacatgaaatcagacgcaagggaaaccttctcagaaatcttctggacataacttaaggcaactattccagtgcttgcgacctgtagagtgcccaccattttgtccgtgttatagcgacaggcaaaaccaattccagacttcctttggtgaccaagccagaacatttcagttcccattgataggttcggagtaacactctgaatataatttgcaccatagaatgcattgttccctatttggaattgtgctcgatagtcacttcccttgtagtcaaagttaaacattccttgtgagtaatgtgcctcttgggtaagctgtgcatttactttcagcatcagattgtctgtcaaatcacatttcacgcgagcattaagccttccatctgtcatcacccttccaatgagcattaactttggatctaaaaaattggcaccaaattcataatgagcagttggaactttaatagtttcagacccctgggctggaacttctaaggagcccataaaaacgctgtggctaagagaaaacttttgattcaacccttttgtgaagtcaaacctcaatccttcaaaaagttcaggcttcaaagacatgagagcctcgcgctggatctcctcgaagggcacggggcagaggaggttgaggtagtccaccttctcctccttcttctcctctcccactgacgtctgcgggaggatcccggcgagcccggggccatagggcggcgcgccctcctggggtagcgctgagtgaggagaaggtggcgctgctgcggaggcaacagatcccatggcgatggcgtaaccctatgtcggggttctggggtttgggtttggggcgctctggcttcgtctcgtcccccacctcgcgacgctgaggcggccggaatttttcaccaaaccctttcacttctacggcagactgcaatatgtctggtggtttgggaggagaatgcgttcgtttgtttaggaatt

SEQ ID NO: 19457 - DNA, 1640 bp, Zea mays
tggtaaaaaacgatttgaactttcttacttgcaatggatgaacaaaagcacatgacagcatcaaatatgtcaagtgctaaatggtgatatgctttgaaatcgtacggctcgtgtatgatgttacagaaaaggcctagtgaggtggattggtagtgatttaaaaaggtaaaaattgttccgccaatacaacattgttggaacaccaatcagctagttacatccaagatgaacaaagaatcatggcccccatgctcaagtagctgaaaaaacactgaaatacaaaaccctgtaaagcagcaacggcctgtgtttttccacggcgcaatggcaaaacctgatcagtcaaaactgagacctgaaatatctttaacaagtcaacatacgcgcgaagccgactgcataagtatctcatgtgcgctcacagcaattgttttggcagaattactctcctacggtcattccaaaaccaaacttgtagttcttcttacaatggtcaatctcagcagatagaaggaagttgacacccatgttcaacctctcttccaagtatgcggcaacaacaccattcgagtctattttgcctcttaggcggcactgcctaagcaagtaatcataaccaaagctggcagttacatctcttgacatatggttatacatgaagtcagacgcaagggaaaccttctcggaaatcttctggacataacttaaggcaactattccagtgcttgcgacctgtagagtgcccaccattttgtctgtgttgtagcgagaggcaaaaccaattccagacttcctttggtgaccaagccagaacatttcagttcccattgataggttcggagtaacactctgaatataatttgcaccatagaatgcattgttcccaatttggaattgtgctcgatagtcacttcccttgtagtcgaagttaaacatcccttgtgagtaatgtgcctcttgggtaagctgtgcatttactttcaacgtcagattgtctgtcaaatcacatttcacacgagcattaagccttccatctgtcatcacccttccaatgagcattaactttggatctaaaaaattggcgccaaattcataatgtgcagttggaactttaatagtttcagatgcctgggctggaacttctaaggagcccataaaaatgctgtggctaagagaaaacttctgattcaatccttttgtgaagtcaaatctcaatccttcaaaaagttcaggcttcaaagacatgagagcctcgcgctggatctcctcgaagggcacggggcaggggaggttgaggtagtccaccttctcatccttcttctcctcccccttcgacatctgcgggaggatcccggcgagcccgggcccgtagggcggcgcgcccgcctgaggcagcgctgattgaggaggaggtggtggcacagcggcggaggcaacagatcccatggcgatggcgtaaccctaggtcggggttctggggtttttggttttggggcgctctggcctcgtcccccaccacgcaacgccgcaacacttcttttcctagtgctctcttttgcggcagacggcagggcctgccctgcagtcctgcacactgcagcaggttttcgattaggatgttctaggtaatggtctcgtgc

SEQ ID NO: 19458 - DNA, 2613 bp, Zea mays
ccgtcacgagatcacactctacaatacataaacccttcactgcagcagcaaggcacacacacgcgacagccgaccccacacagcagagaccgagacacacacgcgacagctacgccgactccggagtccggaccactcacggcagttggtgcgtcgaacccttgcacccgcctcccgacgctgtggcaagtcaggcgatggttcgtgtatcagcttctggctgcaccttctccagtgaatcatctggtgttggcttctctagtgattgatcacgagctggcatagtaacagaactcgtttgcacgacgctttattataccaaaacaaagacgtaagtacgatcggtctcgacacggacagacgacctgacactgagaatgagcatcatcctgacagactcgacagtgtgctagctcattcacgacactatcactgttactgctggaccaagaacaaacaaaccaaaaccacgtacatcagtggctcagtggcacgctagctgctggctctctccatgtctgcgtgcatcatcatcctcatttcgacgctgctgctgggggccggccgggttccgtcgaggcacctgcacaccggctctcccctgataaaaatgcagaacgggtgctcgcatggtggtgctggtgcgcgcggcggcactacgagactgtcatgcactagctcgtccttggcgccgcggccgctctccgtcgtcgtccggtcggcgcgggtgtaggggcagaagcagatgtcggactcagggaagcagattgggtgctcgcaccaccggagctgcttcttgtcgtccgccgccgccgccgaagtagtcactcctctttcgccgtcgctcggaaggcggacgatggcgccgccggccggggcgtcgggtatgacgcggacagcgtcagcgaaggtggcttcaagggagagcaccagtaggacgacgatgacgctagacgcaatgcttctcttcatggaggacatggcgcgcgggcgcggctagctagacaagaagcttcttcgtatcggttgtgttgtgttgtgtgtggttgactggttgtgatgtgcgctcggcagacaaatgcccggccggcccggccgccgctctttatagcgcttatttctgcattatattgttcacaaccactgctgttagggtgtgtttcttgaagcgtacaaagagatacaagaaaacggctatattttctatagtgtttggttgaaagctatgcatggcgatatcgaaccaatttttggtgcgtgaaacacgatccatgcatatatggggccggccgggctggcaatgaatatgatggtcataataataattcgtggacgcacctgctggcatccattcatcaccgtcgtacgtgtaacatgagacgaggggcggcgagcatgactttcatgtgtgctctcacgggtggtcgatccggacacacgactacgtacacaatgcaagcggcagcaatcagactcagagagctgcgagcctatctacacaaccgtgtgttctggagagtacttagacaattaccatttccaattgtaggcgcatttcctaatcaaatactgatggtctcctacaagcaaattgtaggcgcaacaattattttttatttactttctagagatgacgattagagttagaaagctacaactagatctaatcctaagaacaagaaagtaaataaaatataactgttgtttagtaatttgattgttgtgctccaattgttcgtagcccctttatatctaaagaggaggtctggaccctttcctaaacgaaaatctaataaaatcccataaaaaatcgaatgagtcccacgagaaattgggactctagcctgaactgtccggactaccacgacgcggaccgtttgggcttccccgtcggactatctaggacttcaatattaggtgttcaacacttgcccccatcctactgtttggtggatttttgagagccaaaagcaccgagcacgcctcgtatactttggagaccaagatatgcatatgtcaacacatcaacatatgaatatgtcaacatatactactccaaagcaaaactcgagatgttagaacatcgatttttcaagcatcttgccaaacactaggatcatattgttttaagaaacgaccatttaatgctttaggtaacttatcaccttgcaaggtctccatcatatttgcattaccagagattacatgatgtgcaattctgtaagtcccttcccaacttggagaccacttaccaaacttacggtctttggtatttaatggtaaaattgtcttccatagcagatctccaacctaaaataacttagcctttatcttcttattataggtcttgtcaaccacaagtttgtctttctctttctccttcaaagttgtcaacctttcgtcggttacctcatcaatattatccatcattagataatggtatacatcgatagctaaatcattgtgcctggcaaacctaatgacgtttatttagacttatctctccacagcaaaataacttcctaaccatgtacaagctcaaaaggagacactttagtagcacgatgcccaaatattatgtgagcccatagagcttcagacaaaaccttatgc

SEQ ID NO: 19459 - DNA, 2276 bp, Zea mays
ccaagggacaggactatgtggagggtgaaaatgcttccaaagcatccacatctgactccttgcctcacgctattctcgaggttgtcgtcacggaagttcttggttatgggaagttttatgttagactgtgggtgcgacggtcgagtgattttaagggatgacgctttacagattggttcaaaaaaaagcatatcctctttcaggttcttcagtccagtggggatgactgcaggggttgtgctattcggattcggccttttcaaaagggtttttccctatggtaccgcttgctttgtccaaacctccattttatattatcaacttgtgtgcatgaccagacaagatgtgaatattgtcaatccaattgatgtttgatgcgatgatacttcatcaggctgggttttccctatggtgccgtcggcttacaggaggggttcgccagctcgctgttcgccaccgccgtcgtcttcgcctccgtggttggttcccctcctcgctcccctctccctttcgacaccaaaaaaacacgctgaccatctttggcaggcggtggatctgataggcagccttatcatcttcagaaaatacagtattaacctttatattcacttatggtttccaaagatcgtgattcttctgtcctacatgttagattgctatccacttactaaaatctaaattttattatcctaaaggtgtacttccatattttttatctgaacccaacatgtgcacaaagaaaacacttaatctaaggggaaaataatagaaaatgactacacattttcctatttgatatgttttttttcttaaagggaaaataccaacctgaatacttttttacagggatgtggagtggagttattgcagtcattgcacttcattttttcttaaaaaatatacaaacatttttgtgatggacaaatattttgagacactgcttcctgaagatttgagttttgacaaaattgtacagagtagattttgtagttcatttcaatcaaactgtgaacttgtgaagcataagctaaagtaatttttctaagtaaatctgaatgaaatctctacagttctatgaaataatgtttgtctttggaggatatgaattatggacatagatagtcgtttcacattttttttcttggatctgttacttatttagtgcatctggtctgctgtggataaatatagtgaaacagaggtagggatattgtagattaggttcttgaacatgctgctgtcttggtttcgtgatcttctgttgcaccttccaacttggcgcttaaatttacaaagcagccttatttacaaagcaaccttctgagacgacgtgactgtacttatttgtcttgcaggcatacattctcatcttttgcattgaaagaactgaaccataaaaaaaataaagacaggagcacttctctagattcaatgccaatgaaaaaacttatagttattgcacaagctagaatgttttctcgatcaacttcctttccagataacttcctaaatgccaagtatattcctgaaacatcaataaatataccttctaaggaaggtccacataggcagttgtcaccctcaaatcggataatcaggtctacttctggaaatgataatgtcaattctaggagtctgtttgataatattcagcagaagaaattagcagcgcatggagccaatgcagcgagaaggtctttcaaagatttcctcagtacattaacaagaaccaaagaaagtatatcgcgtgcgacacgtcttgctatggaatgtgctaaatttggcattgctggtgaggtgatgtatgatgcctttggtgttaggctacaagcaggaaagcaagcaaaggtcttgaaccagattgtgtatgagcttccatcagaacatccactggctgaaacaagaccgctgcgagagctactagggcacacacctccacaggtatttgctggcgaagtgcttggatttgcagtagccacatttatagcgatgatcgctgggcttggtagttgactccgcatttgaagaaatggtcaacattcacattgaagttctagaattcaaattggacacatgtttcctagctagcttatgatagataatgtgttgtgtataggtgtatttaatatgaaaattgctgtcaatttgttgaaaaaaaaaaaaaaattaacttggtgctaatcgacgagtgaactatatgctttattcgttcctgtccaaagtatttggagtgattgaaagtacctcttgataaagcattcatgagatttccgcac

SEQ ID NO: 19460 - DNA, 2081 bp, Zea mays
tatttcggctcaccttcatgccctctccagcaaggcatgcgggttgagtcaggacggactagatttgccgaggtctaagaagtttttttggttaacaactaaaattagcatgtgaggcctgctatagatggtgaagtttctattaaatctatacaacttattaaggctctaagggtagcctaccttttctcgttcttccttccaatgatctcaaccgtccatccatgactctgttttcatcgtccatcggatgcaaccctgcagcaaccaacaccggatgacgcccacgcctcgcgcgagcaccggctcccccgatccatccctcctccccacgcctctctctcacctgactgccccactccgatcccaccgccgacgccctggccccgcgcaagcgccagctccgaccccgccgcgtctctcatcccgccgatccctcctccccttcatcccaactctcctcctcgcgccctctctgacctaaccaccctccatcgccacacgagcgccgccagcctgagcccgcctctcgacacgaggacttcctagagtcatgcctggcgcacgccatcgcactcacctcaccacgccatgggggggagcagatagcgcctataaaggccgactccagaactccagctcgcgcgctggatcctagtgagcagctgagaccccgcgtgtgtgcaactgcagaagatggacgatgaggcgctggatcaaggagatggaggcggaggccgccgcggccacctcgtccaggtcgagtacgccctcgagggtcgtacgcaagggcaacgccactgtcagcgtccgcggcgtcgagaagaagtccaccccaagctctaggactccaggtcggtacctctccctccctcccttccaccagatctcttgatcccagcaagaattttcttggacctatcggcgagttcatcgactcgtgatcagaacacggtagcaagaatatatcttctgcgattacgcgctgatggctctactccttggctccaggtgttcccggagccacaagcatgctgtcccccgacacagagaagaagaggaagggcatgtggatccagatcgatggcgtgcacgaggtcaatcggttgttgcaccttggagaacggcgagctcgtcggcgtgcataaggtcaatccactgccacgccttgttgtctgaccagcggcagtgggcatagggcacgccgtcggcatagatccccttcaacaaccggtcacctcggcagcaaacttcggcggccacatcggtatgtctctgctcaaccttctgtaagttcgttaggctgcctatgcgcaagtggttcattcccttagtcactatacgaggattgtgaaatggcttttgtcacacttacgaatgaaagggaggctcaacagacatttacgggaggagtctgatgtgagctgggtagcagagtgctcccagtctgttgacccacacttacgaaatactgagaacattgtagttgtatgattaaattttttttgctctgctttgcagtttgcacgcacaactcgatcgccccccttcgcttctccgagttcttaataatggtgcgcggagtgcagtaccaccagacggccgtggtgccccgggagtccatcctcaagaccgaggcggagtggctcaactctatcaaggccgaccttgtggtaccaatactatgatcactgatcgttaccggtttatgttgtcactcttctgtctgaacatctctgcacaccgagtagagcttaactgaacccacttgagcaaacgctgccaggtttcagatgttgtacccgtcgtgtgtagggcagctacagatgctggcattcgatccgtgtgcgtcacgaattttaggtaagcggcggtcctgttgcttctttgtttccgcgtgtcgttaagagcatggaggaatgctgataaacactagaatacgctatagtctgttatatttaattttgattcgtcaggtaagtgtctgggcgatctgcctgtagttactacaggcaacatgtaaatttggggatcggatcccctgacgtcgaagtcacctgacgcacctatttttgcgccag

SEQ ID NO: 19461 - DNA, 2100 bp, Zea mays
  misc_feature (14)..(49): n is a, c, g, or t
tttttttttttttnnnnnnnnnnnnnnnnnnnnnnnnnnnnnnnnnnnntttttttttttttttttgaatggaaacgaggaagattgacatggataacttttttactcgtgccttaagagtaaattctggagtcatccctcccttcagcacgagaatccgtttcctacgattcacttgattcatagtgcatctaagtgaaaagtttgctgtgttacatgagcttaatcctacctaaaaacggtacgggatttaaagcccaaagcattccagattgtttccaatgcagcaatgcttgttcctgctccatccaaactaatattgttattacccttgacacaattcatataacgggacggccggaacacagttcatccttgctcataaccttcagttcagttctgatttctgtatgaagatattataggattgaaggttccatgatttgttcggaagatagttattttgattccaggaagcatcattgtgactggtaaaataacctgccggtaaattgatgcctcttttgatggtattcacaattcagtgcttctgagaatcacagagcaccaacaagccagctagggcatatactttttttgtggctgctgaaggcccaaccatcttcacccatgcaggatgtgatcacaaggggtggaccaaaatattgctatcgcaaggtttcatacgaagtgatcaagccatcatacgaagactcaactaccgacgaggctgaggcgaggatggttgatcaggagatgaatgagaggaaccacccctatatcgaccacgtctttgcccataaaacccattaggcattacttggcgtgtcgaccttggtatgtcatcaccatctgctgcaggaagtggcccaagagatccaaattcaattggttcagatgaggaagcagcatgatttgagccttgttcataagagtacaccataaaaaatggtggtcctggagggccagataaagcactggtaccatttgaatacgtagatggtggtgtataaaccccatgcactgtgtttcctggtttgcgcatagagcttgtggatccaaaaggttggccctgcacaagatactgagagcttgcctcatgccggtacgagtcatttctataagttcgtcgttgcctatcagaccggctctcatcagtgacctgtctatcagacctcatgccggacctctctgactggctacgtccatagccgcggtttggatttcgttgttttgagtttatccagcttccctccttatcattatagtcacccctgtcaccattataacctcctctgtagttccttgaatttgagtgtcggtccctaaaatgaaccttaggatttggcaagtaggttcctgtgcctccacggtatctgggtgcatcttcaccgtagtgctgaaaaacaccagttctttctgtagccggttgtacaggcatcacaggaaatactcgttgaccgcccaccatttgtgtccagttaacatttggtgcagctggtcttccaggcccatcccatggaacatggccctgtaaatacatcggtggcactggaacagggtatagaacaggacccatgggacgaggattctgacagagtcgcccatactgtaaattgtgccaatggctgacaaaatcactatgcaagatatcaggcttgtgttcaccagatggctcagtcatagtactggacgatactgttgagatagcactggaatcttgttggtgaacatcattaagtgaaccaaaaaattgacctacagtattggcaggaagctgatcaattccttcgcttctctcaaactgggggccagaaccatcattattccctggaacaaacgggagcacaacaaaaggaactggtggacctgttggaacaaaagtaagtccagagctatcagcttgcctatgctgtggtgatccaataagaaaaggtgtaaacactggattaggcatgccaacttgtgatggacccggcccgccgcgtgcttccctaggtcttgattttgatgaaaaagaatcagaccctgttactatctcagaagcttcagtgatgattggtaccactgtcccatttctggggccatcattaacttcag

SEQ ID NO: 19462 - DNA, 952 bp, Zea mays
aattcggcacgaggcccacatctaccgcgtgccagccgccctcgctcccgttcagtccgtctcccccctctcttccactccaaagcctacgcgccgccgccccgccaccgggcgcgccctcgttctcctacctagccgtgttctccaactgcccgctcgtcgccgcggtgctcaccttcgccatcgcgcaatccatcaaggtcctcaccacctggggtaaggagaaccggtgggatgcgaagcagctggtgggctccggtgggatgccgtcctcgcactcggccaccgtcacagcgctcgccgtcgccgtcggcctgtaagaggggctcgccagctcgctgttcgccaccgccgtcgtctttgtctccgtggttggttcccctccccactccccctctccctttcgacaccaaaaaaaacgcgctgaccatctttggcaagctgtcgcccaccccaccccaaaaccctagctctattccatcgctcccgtactccctgttgcggcggttgagaacagtggcgacaagatctcatggagagaagctatgcggaccccaggaaaggtgaagtcgtcgtgcgatggtggagatggccgatgggaggctccaccaaccctagggtgcggccaacaagacgctactcgccactgcgtgggtcggcagtgagatctcagggagagaagccatgcaaccccatgaaaggcgaaactgtcgcacgatggtggagacgaccggcggtaggatgcaagtatgagcatttggcaaagagagtattcctccccatgctcccgctccctcctgcaccccacgctcggccgacgagccgctcgacctcgtcgcagcttgccgagccatcatgcgccccggtgcggtggtaaacatcaatccacgccgtcaatcgcgtgttggtcctacgctcagtgcatgagtccttcaaggggatctctagagtc

SEQ ID NO: 19463 - DNA, 3868 bp, Zea mays
cttgcagtcgcagtgggggtcgctgtcaatggatcaatgcagtttccgccggtacgcctctatcgccggtagcctcccctcggcagacagcctcgcctcgcttgcttctattgctgtgctccaccatggagctctaggtggagctacgaaccccgtgatccccagcggtgtggcaccggagctcgacggcgacggcgggcacatccccctcatgccctaggtggagcaacgaaccccaccgtgctcaacatagccgccaagaacgcgactctcctcgccgcgctgctctatctcggggacctcgcctagcattgccccttgccccgcgtcgacgaggtggagtcctccctcacccgcaccttccggatgatccaggtgctactcgaggttgtatgcattgtgggaataagggatatgtagctgcttacattttgaagagatttgattataccttaagcacgattgcaactgaaactttggctgtgggtgatgggttctgctattttggtatgttattattcatctctatgatagagcagattcagaatggtgagtttggcaggggttaattgtttcaatttgttagaatttttcaaacgaaagttgtctcaatttttggatcattcttggttttatgacgaatgcccaaactacagattatcgaatggtcaaagtgaatatttgttttatagcaaaagaactatctagaaaattacctctttcatgttttgttcagcggcggtccacgcggctaccaatagggatgatacaggttttgctattcttttatttattaattggttcaattggagaattacctcaacttgttgggattaatgtgctttgttctttgatgaccccttgttgagtgaaaaatacatgtgtatgttacaaaataaactacttgtatgttaaaaaaaagtttctccctgccattacattgacatctcaaactcctcgcacctgttgccttttggaacataggcgttataacccacattttgcattgtgatttctctactaccaacaccaattttcttagaaggctatgtagcagtaatttttgtactagctacaagaaacccattctatgcaataaatatccatattacgtaggtctgcagattacgacatattgctttcatttcaaagctttgagaatcatgtagtcatgcattagattcacatgcaccaaatttaagctaactggaaagtgggatcatatttttttatctcgtgcaaataactattaagctgctcaagtttctttatttggtaattaattaaatttttcaaccatgtcatattgcatatcaattgccaactttttctacacagatgcacatgctcaattatgataatgtcatatggtctgtcaaccatatgtggtcaatgcaaactaaattgttttattctttatatgttttgatttgattttttgtatttgtcactgggatcatatttttctctcaacggttttgctggttgctgtttcaattcaggtctgcactgctaagatgaatttgagtgacgagattgatttggaagattatgtttgcagaccgggtaagatcagtgttgatgatgttgagttggtttcatggtgcagaccaagatttttatgcatttgttgttttctaactattgtattgccagggtacttttgtcctgccctagccaaagcattctccattcatttccataatactaatgctcttattcattcttacaagtaatttgtctcacggaatacattaagatttgcatgacttctaatagaatatgtttattgtattagtgtgttggaaggggtgaaaatgaatcgtggtatcttagatctgggttgcttcctgtcatagaatttggttacaatgtatcttttggtggaaatcatttttttgctatttgtgttccaaattctgcatgttgggtgagttagccaagtttgtttcatctatttatgagttctgacattgaaatgtttaccgtgaacctcctcgctgacacgtcgccccgcccccgagccgacttcccgatgccaccctcgcacaagatcccaatgtggcaatggcgaccagcgacgggcggtcaacgccaccgcgccgcctgtgaacccatggtgagaagtgtggtatcgatctagagccgaaggacttccccaacaccccttcctccatcggcgtgacatcggccagctcatctgcgacgacgaggcatcttcgaccgacttcccgacaccccattctccatcaatgcggctccagtaccccttcctccatcggcgcatcaacatccaattcatctacgacgacaaggcatcttcgacaaaccacgccctactacaagtggtgtcagtccatctcagccgtccgcgtgcgcatgtgagatctagggagaggaagaggaggaagggttgtggggaccgggggtgcgagatggcggattcacctgcaactacaagaaaagaaagagcgagagatttacagaaacctccagagccgcggaggaggaggaggagattaggaggatctctacggcgctgacggattagttaaggaacgaaagatcacatcgtgtccggtaaccagattcagatgtgggcaccatgcgtgggtgcagggccaggccgaggcgaaagagattcgacgattgagaatacatcaaagaataaaaatgtggaactcggattttcagatgaagagcgtgaccaagaatttcctgattttccatcatttattccattcttacctcctctgagtgcagctaacctaaaggtctactatgccacacgtttcaccatcatagttgggataatggtgttcggtggttttcttgcaccaatcttaaacttggtctaggggcacatcttatgaagactccatccgcagcgttcatctgtcgacgtagttgagaagtgcactcaggttatacatccagtaaagagcaagacatttgaaagcttatgggccaactgtgttgctattgatgcaagcgaaagttggctgatgaattctctatgcctacttctagagtgatgttcaaagaggttgacgctccttcaccatccccagctttgtggaatgggccacaggtagccatttaggatgacaaagccacaagggtgtccttcatcaaggctatgctagaagcctcagacttgtgtatgaggaaaattcataaaaatggtacacagaaggctgggaagaaagtggaagaggaatttagcacttgccctctgtcggtcctaatgatgagcgttaagaacaacaccaagatactgaaagcaaacatggcttgttcaatcgggcagcggcagcagaggggtggggccaatgacggagacggagaggagaacccatcgatttggtggcataagtgggagctcatcgaggccggtgcgtttgggcaggtctaccacaggatttatttgcccttctagggatcagcagatcccacacctattacatgatctgtccttctagaatagaatctgctctctatcttctgaaccagtactgccttcttcaatatcagccaccggccggtccacctcttcaataatcgtccttcatcgcccttcagttgtgagttgtgacatactatttatattcggatctgatctattacaaatatacatgcatattatagggtgtgcatctgcatattacccatgttaactttacaacggcccgtccttaggtgatatgagtagtaagtataaacttgcttcttaccaagagttaggctgtatgtgtgtatgtattttttagtacaatagtattcaaaatttatgaggaccctttctttttgattgttttgaacaatgggcgtatgaaccggtggaagaacaattcatttgatagttgtt

SEQ ID NO: 19464 - DNA, 1006 bp, Zea mays
ggggacccccagggcccgcgggcaacaccaccaaacggcaaacggaaacgggggcagttggtgagttgggacttgggagccgacgctgtcggggtgatccagtcgccgccgacgccgccgaacgcgcccgcgcccgagcctccctctacgcggacgcgggaggacccttccactcccagagccgggcgtgtccgatcgtgagcccatggcggaatccatcgtctccggcgccgccgccccgccgccgggcgcgccctcgttctcctacctggccgtgttctccaactgcccgctcgtcgccgcggtgctcgccttcgccatcgcgcagtccatcaaggtcctcaccacctggtataaggagaaccggtgggacgcgaagcagctggtgggctccggcgggatgccgtcctcgcactcggccaccgtcaccgcgctcgccgtcgccgtcgggctgcaggaggggttcgccagctcgctgttcgccaccaccgccgtcttcgcctccgtggtgatgtatgatgcctttggtgttaggctacatgcagggaagcaagcagaggtcttgaaccagattgtgtacgagcttccatcagaacatccactagctgaaacaagaccgctgcgagagctgctagggcacacacctccacaggtatttgctggcggagtgcttggatttgcagtagccacatttacagcgatgatcgctgggcttggtagttgactccgcatttgaagaaatggtcaacattcgcattgaagttctggaattcaaattggacacatgtttcctagccagcttatgatagataatgcgttgtgtataggtgtatttaatatgcaaattgctgtcaatttgttgaagagaaacttgcgccattcttttgtagttaatcgacgagtgaactatatgctgtattcgttcctgtccaaagtatttggagtgattgaaagtacctcgtgataaagcattcatgagatttccgcacgaaaaaaaaaaaaaaaa

SEQ ID NO: 19465 - DNA, 1565 bp, Zea mays
  misc_feature (1560)..(1560): n is a, c, g, or t
ctagtgtggtatctaattacgattagacttaaacaaacataatttaagattattagttactcattacgttacaaatatgtgaccaaacggcacctttgttcctacgtttcacttagctcatagtacatcttagtgaatagtgtgctgtgtgttacatgagcttaatcctacctaaaaatggtacgagaattcattattagctttcacttacgcacgcccagacacattaaaacccaaagcattccagattgtttctgatgcagcgccacaatgcttgttcctgctccatccatactaatattgttattacccttgacacaattcatataatgagacggccagagcagagttcgtccttgctcataatcttctattcaattctgatttctgtgtgaagatattctgggtttgatggttccatgatttcttctgaagataattgttttgaatccaagaagcaccattgtgactggtaaaataacctgccgataattgcttttgacggtattcacaattcagtgcttctgagagatcacaaagcaccaagaaccaactagggcatatacttgtgtgtgtgtttttttttttggtggctgctgatggcccaaccatcttcacccatgcagaatatgatcacgaggggtgaaccaaaatattgctatcgcaaggtttcaatgacagaaaccaagtgatcaagccatcatatgaagactcaactaccgacgaggctgaggtgaggatggttgatcaggagacgaatgagaggaaccgcccctatatggaccacgtctttgcccataaaacccattaggcattatttggcgtgtcgaccttggtatgtcatcaccatctgctgcaggaagtggcccaagagatccaaattcaattggttcagatgaggtagcagtagcaccatgatttgagccttgttcataagagtacaccataaaaaatggtggtcctggagggccagataaagcactgggaccatttgaagacgtagatggtggtgtataaaccccatgtgatgtgtttccttgtttgcgcatagaacttgtggatccaaaaggttggccctgcacaagatactgagaacttgcctcatgccggtacgagtcagttctataagttcgcctttgtctatcagactggctctcatcagtagtctgtctatcagacctcatgctggacctctctgactgactacgtccatagccgcggttcaaatttcgttgttttgagtttacccagcttccctccttatcactatagtcacccctgtcaccattataaccccctctgtagtttcttgaatttgagtgtcggtccctaaaatgaaccttctgaacagaagccatagaattgacagcttagttttccacagtccagactatgaatttcataaaaagttgcttaataaatctatcacttgcaaaacatggaaatcgaagtgcctagaactaccataagaatacctacatcatacgtaatccagtaatatatcttaatccagtcacaaaatggaccaagttttcttcatgggcaactcaaaagtttttncccgg

SEQ ID NO: 19466 - DNA, 3827 bp, Zea mays
  misc_feature (480)..(480): n is a, c, g, or t
  misc_feature (515)..(515): n is a, c, g, or t
  misc_feature (568)..(568): n is a, c, g, or t
  misc_feature (649)..(649): n is a, c, g, or t
  misc_feature (787)..(787): n is a, c, g, or t
  misc_feature (964)..(970): n is a, c, g, or t
ctgctttctccagtgagccgcacccgcacccccccgggcccggattaaccacaagcgaccgtcgccttcccccacctcctcccttcctcaaaaaaaggcggaggcgggagtggtggtggtgctcgtgggcacgcagcggagcaccctgtacagcagcagcgctgcggcagtagagagtgccattggtggagctggtaactagccctcccccctccgttcccgtcccgcgcgcagccgtctgccgagcctgctcagtgcccatcatggtgaggaagaagagaactggccctggtggctctggagaaacttctggagagtcttcaggagcctctggacaaggttcctcacagcagcctgagcgaactcaacaacctgggggaggacgtggctgggtgcctcaacagggtggccatggtggtgggcaacaccagggtcgtgatcgacattatcagggacgtggaggaccagggccacatcacncttggtagtggggcacctgagtatcacccgcgtgnaataccagggacgtggtggtgaatatcagggacatggtggtgagtaccagggnacggggtggtgactaccagggaacgtggtggtggccgctccagaggtggaatgccacagccatactatggtgggcataggnggaggtaatgttggacgcaatgttcctccaggtccgtccaggacagttcccgagctgcaccaagccccatatgtccagtatccaggccccgggtggtttcgccctccccatcgggacctggctcatcctcacagcctnatggcagaggtgagctctggacaagtccagcaacagtttcagcaacttgccgatcgtggtcagagttccacgagccaagaaattcaggtggcaccagcatcaagcaaatcggttcgattcccgttacggcccggcaagggcacttatggggacaggtgcattgtgaaggcaaatcannnnnnngctgagcttcctgacaaagaccttcaccaagtcccccccccccccccccccgaggttacttcacgtggcgtcaatcgtgctgtcatgggtgagcttgtaacaatatatagacaatcccatttgggtgggcgtctacctgcatacgatggaagaaagagcctgtatactgctggaccattgccatttacttctatggcatttgaaattaccttgcaagatgaggaagatagtcttggcggtcgccaaggtggacataggcgtgagagagtatttagggtggtgatcaaatttgcagcccgtgctgatctccaccatctggctatgtttctagctggaaggcaagcagatgcccctcaggaagctcttcaagtgcttgacattgtactacgtgaattgcctaccgcgaggtattctcctgtcggtaggtcattttactctcccaacttagggagacgtcaaaaacttggtgagggattggaaagttggcgtggtttttaccaaagcataaggccgacacagatgggccttttcactgaatattgatatgtcctctactgcatttatcgagcctctccctgtgatcgattttgttgctcagcttcttaacagagatatctcagttaggccattgtctgattctgatcgcgtgaagattaaaaaagccctaagaggtgtgaaggttgaggtgactcacaggggaaacatgcgcagaaaatatcgcatttctggcctcacctcacaagcaacaagagagctatcattccctgttgatgatcgtggtactgtgaagactgtggtgcaatacttcatggagacttatggttttagtatccagcacaccactttaccatgcttgcaagtgggtaatcaacaaagaccaaattatctgcctatggaggtttgcaagatagttgaaggacagcgttactcaaagcgactcaatgagaaacaaatcactgctctactgaaagtgacctgccagcgccctcaagagcgcgagctggacatcttacagactgtgcatcacaatgcatactatgaagacccctatgcactggaatttggtataagaattgatgaacgtcttgctgcagttgaagctcgtgttctgccaccaccaagacttaaataccatgatagtggccgagagaaggatgttttgcccacagttggccaatggaacatgatgaataagaaaatggttaatggtggcagagtgagcaactgggcatgtattaacttctctcggaatgtgcaagatagtgccgctaggggtttctctcatgagttggcagtcatgtgccaaatatcaggaatggattttgctcttgagcctgtgctgcctccagtgactgcaaggccagaacatgttgagagagcgttaaaggcacgttatcaagatgcaatgaacatactgaggccacagggaagggaacttgatctgctgatcgtaatactgcctgacaacaatggttctctttatggggatctcaaaaggatctgtgagactgaactcggattggtctcccagtgttgtctgactaaacatgtttttaagatgagcaagcagtaccttgcaaatgttgcactcaaaataaatgttaaggttgggggaaggaatactgtacttttagatgctttgtcaaggagaatcccccttgtcagtgacagaccgaccataatatttggtgctgatgttacccatccacatcctggagaagattccagtccttccattgcagccgttgttgcttcgcaagactggcccgaggtcacgaaatacgctggactagtgagtgcgcaagcccatcgccaggagctgatacaggatcttttcaaagtatggcaggacccgcagagaaggacggtaactggcggcatgataaaggaacttctcatttctttcaagagggcaactggacagaagccccagaggatcatattctacagggatggtgtcagtgagggacagttctatcaagtattgctgtacgaacttgatgccattagaaaggcctgtgcgtccctggagcccaactaccagcctccagttacttttgtcgtggtacagaagcgccatcacactaggctgtttgcgaacaaccacagtgatcagcgcacagtcgatagaagcggaaacatactgcctggcaccgtggtcgattcgaagatttgccatcctactgagtttgacttctacctgtgtagccatgctggcattcagggaacgagccgccctgctcactaccatgtcctgtgggacgagaacaagttcacagctgacgagctgcagaccctgacgaacaacctgtgctacacgtacgctaggtgcacccgctccgtgtccatcgtgcccccggcgtactacgctcatctggcagccttccgagctcgcttctacatggagccagacacctctgacagcgggtcactggccagcggtgcccgtggccccccacccggtgcggcacgcagcagcacgagaggggccgggagtgtcgaggtcaggcccctacctgctctcaaggagaacgtgaagcgtgtcatgttttactgctgagacgctggtgggctgccttcgccaaggaaaatgccctggagcattcccatgtacccgcactgtttcggtgatacagtactatctaacgccgattttgcgcgttaagacttccagtgatctgggaaatttcttgtacgactgttgtagtgttgtgtattcgtaatgtgatgacgcggcagttgtaggagcttagtgccgtgtaaagtatctgttgtaagttgtaacctgtcaccctctagtgttatgtcatgatgaaccaaattatttgttgtcaaaaaaaaaaaaaaaaaagccagt

SEQ ID NO: 19467 - DNA, 2773 bp, Zea mays
gggtacctcgaggccggccgggaacctatatagacaatcccatttgggtgggcgtctacctgcgtacgatggaagaaagagcctttataccgctggaccattgccttttacttctatgacatttgaaattaccttgcaagatgaggaagatagtgttggcggtggccagggcggacaaaggcgcgagagagtatttagggtggtgatcaaatttgcggcccgtgctgatctccatcatctggctatgtttctagctggaaggcaagcagacgctcctcaagaagctcttcaagtgcttgacattgtactacgtgaattgcctactgcgaggtattctcctgttggtaggtcattttattctcccaacttagggagacccccccccccccccccccctttggaaagttggcgcggtttctaccaaagcataaggccgacacagatgggcctttcactgaatattgatatgtcctctactgcatttatcgagcctctccctgtgattgattttgttgctcagcttcttaatagagatatttcagttaggccattgtctgattctgatcgcgtgaagatcaaaaaagccttaagaggtgtgaaggttgaggtcactcacaggggaaacatgcgcagaaagtatcgcatttctggcctcacctcacaagcaacaagagagctatcattccctgttgatgatcgtggtactgtgaagactgtggtccaatacttcatggagacttatggttttagcatccagcacaccactttaccgtgcttacaagtgggcaatcaacaaagaccaaattatctgcctatggaggtttgcaagatagttgaaggacagcgttactcaaagcgactcaatgagaaacaaatcactgctctactgaaagtgacctgccagcgccctcaagagcgtgagctggacattttacagactgtgcatcacaatgcgtactatgaagacccgtatgcacaggaatttggtataagaattgatgaacgccttgctgcagttgaagctcgtgttctgccaccaccaaggcttaaataccatgatagtggccgagagaaggatgttttgcccagagttggccaatggaacatgatgaataagaaaatggttaatggtggcagagtcagcaactgggcatgtattaacttctctcggaatgtgcaagatagtgccgctaggggtttctgtcatgaactggcaatcatgtgccaaatatcaggaatggatttttctcttgagcctgtgctgcctccagtgactgcaaggccagaacatgttgaaagagcgttgaaggcacgttatcaagatgcaatgaacatactgaggccacaggggagggaacttgatctgctgattgtaatactgcctgacattaatggttccttatatggggatctcaaaaggatctgtgagactgatctcggattggtctcccagtgttgtctgactaaacatgtttttaagatgagcaagcagtatcttgcaaatgttgcactcaaaataaatgttaaggttggccgcggggccgcccggcctttagatgctttgacaaggagaatcccccttgtcagtgacagaccgaccataatatttggtgctgatgttacccatccacatcctggagaagattccagtccttccattgcagctgtggttgcttcgcaagactggcctgaggtcaccaaatatgctggactagtgagtgcccaagcccatcgccaggagctgatacaggatcttttcaaagtatggcaagatccacagagaaggacagtaactggtggcatgataaaggaacttctcatttctttcaagagagcaactggacagaagccccagaggatcatattctacagggatggtgtcagtgagggacagttctatcaagtattgttgtatgaacttgatgccatcagaaaggcctgtgcatccttggagcccaactaccagcctccagttacttttgtcgtggtgcagaaacgacatcacactaggctgtttgctaataaccacaacgatcagcgtacagttgatagaagcggaaacatactgcctggcaccgtggttgattcgaagatttgccatcctactgaatttgatttctacctgtgtagccatgctggcattcagggaacaagccgccctgctcattaccatgtcctgtgggacgagaacaagttcacagctgatgagctgcagactctgacaaacaacctatgctacacgtacgctaggtgcacccgctccgtgtcaattgtgcccccggcatactatgctcatctggcggccttccgagctcgcttctacatggagccagatacctctgacagtggctcaatggccagtggtgcccgtggccctccaccaggtgcggcacgcagcatgagaggagcggggagtgttgcggtcaggcccctacctgctctcaaggaaaacgtgaagcgtgtcatgttttactgctgagatgctgagctaccttcaccaagaaaatatcctgacttgttccatgtacccgcactgtttcggtgatactatctgacaccgaatttatgcattaagacttccagtggtctggggattttaggtaacgcctgtttttattcgtgagttgtaacgctgcggttcgaggggctttagtgctgtatgatgtgtaaactatttgttgtaacttgtaagttgtaaccaattgttgtaagttgtaaccagccactatgttatggtcctgtttgtttccgcttttcacggtttcttgctacc

SEQ ID NO: 19468 - DNA, 903 bp, Zea mays
  misc_feature (121)..(121): n is a, c, g, or t
cccagcgtccggcccaccgtcggggggacgttcttcagtttgtgttgaacttgtgcctcagaaggcctgtgcatccttggagcccaactaccagcctccagttacttttgtcgtggtgcangaaacgacatcacactaggctgtttgctaataaccacaacgatcagcgtacagttgatagaagcggaaacatactgcctggcaccgtggttgattcgaagatttgccatcctactgaatttgatttctacctgtgtagccatgctggcattcagggaacaagccgccctgctcattaccatgtcctgtgggacgagaacaagttcacagctgatgagctgcagactctgacaaacaacctatgctacacgtacgctaggtgcacccgctccgtgtcaattgtgcccccggcatactatgctcatctggcagccttccgagctcgcttctacatggagccagatacctctgacagtggctcaatggccagtggtgcccgtggccctccaccaggtgcggcacgcagcatgagaggagcggggagtgttgcggtcaggcccctacctgctctcaaggaaaacgtgaagcgtgtcatgttttactgctgagatgctgagctaccttcaccaagaaaatatcctgacttgttccatgtacccgcactgtttcggtgatactatctgacaccgaatttatgcattaagtcttccagtggtctggagattttaagtaacgcctgtttttattcgtgagttgtaacgctgcagttcgaggagcttcagtgctgtatgatgtgtaaactatttgttgtaagttgtaaccaattgttgtaagttgtaaccagccactatgttatgatcctgtttgtttcagctttttacaaattttaaaaaaaaaaaaaaa

SEQ ID NO: 19469 - DNA, 2426 bp, Zea mays
  misc_feature (2132)..(2132): n is a, c, g, or t
ctttagatacgacctgaatttccatggtaccatttcgatgagtggacaaggccaagatttctggctcgatgtagttttccgatcgagctgggcccaacactaaaacaatctaacgacccaacgacctttgggtccgggcgtgggctgcaattttcaacccatggtcaggtttcagatgcgagacaacagaagagaagattacccccgccatttgaacctccgagttcagaaactgaccccctcggccctccccaccatcgcgatggctgacgaagccgcggcggcggcgttcgcgccctctccctcgccaccgtcacccgtagcgcaacctttgcccgacctctccccgccgccgcccttctccccaccagccggcacccctgcttccggggcgcagacgccgagcctcccggacaccccggcctccctagatccggacacccccttctccgacgccaccccgacccccgccgacgcctccgacgccgccctcgcttcggacgacggcatcaccaacccgtcggggggcaccgccggcaagcacatgacgctcgcgccgcccgccccgcccgccaagaaaccgtccaagaagaagggcggcaacagcgtctggacccgcccggcctcccgcaagggcaagaagaaggcgaggcagccgggcggcctcggccacggctccggcggccccgccggggccgccagaggctccaaccctaggcccaacgccggcggcgaggaggagttcctcctcgtccccgcgacccgcctcgccgccgagcgctccgacgacgcgcccggccagcctgtgctcctctcccgcgtcttcaagtccgagcggatcgagctctcagaggaccgcctcaccgcggccagcaccaagggattccgcatggtgcgcgcgacccgcggcgttgcggcaggggcgtggtacttcgaggtcaaggtcgtgcacctcggccccaccggccacacccgccttggatgggccaccaacaaggctgacctccagacgcccgtcggcttcgacgcctatgggtttgggtaccgtgacgtcgatggcgccaaggtgactaaggcttggagggacaagtatgctgatgaagggtacggggaaggagatgtcctggggttctacatttctctgcctgatggggagcggtatgaaccgaagcagcctgacctgattcagtacaagggaatgccttttcacgtccaagtccccaaggaggagcagaagacgccggatcctgtccctggtgagtacttatttagttgttttagtagatcttgtgtctgtggtagattgcaatgccaactaaggacacagtacattgtcaaggtaaattatgtcttattgaataagtgaccaggtttgtgtacaacatgattacttctacaattctgttagttatacaacaataagtaggactgcggaaaaattatacatcataggcagaaattgtgtactgatgttgaattaggcagaaaatgtatttctcatgctttgcagttgtctctcttgataccgttgtcctttgatttattttctcagttcacctgttaggctgctgcacaaattcatgacccctcttcagataccatataaggctacttaaatgtgtaagaacttgatagatcagcatggcaaacactagatactagttttcattttattcatcttataataatcttcaaagcctaaacaataatccaatcagtcatttattttcatctcaagctcataaattaacacataataaggaaagcgaacagcagcaaatgatgtcaactgctatcctgaaagcagaatgttaagttcataattttttctgtatagttgatatttggagaacttgacagttatttttctgcccagtcggaaataacgaacacctttattaagtagtttaaatgtttaatcgacccccattgttttcttctcagtagtatgtgcttcttttcttcaagggagtgagcatttgtatatattccaagatgggatgctatgattagcaagatagaaaactagagatacctaagattgaatagtcaagaaaaaaaaatgaactgaacaaaagttaagtccctccaatattgtctctggaaagaaatgcaaacttcatcaagtttantgaatgccaatatactgaaaagaaatgatggcaggaataaaattgactgaactattcctgttgccattttgctaaacacaattgcttcgtctattgtgctctctccatgctggcatcttcctttccagttatcacagtactagagctacctacacttccttttgtccagcctgttgttatgatattttgatattccttggtatccatagcaatatggatttattactctattggtgctaggatgctatatgaaaatttatgttgtggtgtaaccttttcttttaggacttcaca

SEQ ID NO: 19470 - DNA, 4408 bp, Zea mays
  misc_feature (21)..(43): n is a, c, g, or t
  misc_feature (168)..(177): n is a, c, g, or t
  misc_feature (2377)..(2381): n is a, c, g, or t
  misc_feature (2453)..(2495): n is a, c, g, or t
  misc_feature (2936)..(2961): n is a, c, g, or t
  misc_feature (3001)..(3029): n is a, c, g, or t
  misc_feature (3277)..(3304): n is a, c, g, or t
  misc_feature (3315)..(3320): n is a, c, g, or t
acggcaccttcggtctcttcnnnnnnnnnnnnnnnnnnnnnnncaccagcaatcagcaacaccatccggtattcctccgttccctgcccgacggagctgcttccctccttgctgtgctgtgcttgttccagattctactccatacgcccttgatttattttacttcgnnnnnnnnnnaaaaaaaaaagcttcttactgaatttcatggccgacttggcgctcgccggcttaaggtgggcagcatcgccgattgtcaacgagcttcttactaaagcttcagcttacctcagtgtggacatggtgcgtgagatccaacgactagaagccactgtcctgccacagttcgagctggtgattcaagcggcccagaagagcccccacaggggcatactggaggcatggctccggcgtctcaaagaagcctactatgatgccgaggacttgttggacgagcatgagtacaatgtccttgagggcaaggccaagagcggaaaaagtctcctgctgggagagcatggaagctcctccactgcaactactgtcatgaagccttttcatgctgctatgagcagggcacggaacttgctccctcaaaacagaaggctaattagcaagatgaacgagctcaaagcaatcctgacagaagcccaacaacttcgagatcttcttggtttgccacatggcaataccgtcgagtggccagctgcagcacctaccagtgttcccacaaccacatcacttcccacttccaaggtttttggtcgcgacagggatcgtgatcgtatagtagattttcttctcggcaagacaacaactgctgaggcaagctcagctaagtactcgggtttggccattgttggagtgggaggaatggggaagtccaccttagcacagtatgtctacaatgacaaaaggatagaagaatgcttcgatgtcaggatgtgggtgtgcatctcacgcaaacttgatgtgcatcgtcacacaagggagattatggagtctgcaaaaaagggagagtgcccacgtgttgataatctcgatactctccagtgcaaattacgtgatatactacaagagtcacagaaattcctgcttgtcttggatgatgtttggtttgaaaaatctcataatgagacagagtgggagttattccttgctccattagtctctaaacagtcagggagcaaagttttggtgacttctcgaagtaaaacacttcctgccgctatttgttgtgaacaagaacatgtcattcatttggaaaacatggatgatactgagtttttggctctttttaaacaccatgctttctctggagcagaaatcaaagaccaactgttacgcacgaagctggaagacactgcagtggagattgctaaaaggcttggacaatgtcctttggcagcaaaagttctgggttctcgattgtgcaggaaaaaggatattgctgaatggaaagctgctctaaagcttggagatttaagtgatcccttcacatctctgttgtggagttacgagaagttagatccacgtctgcagaggtgcttcttgtattgcagcttgtttccaaaaggtcatagatatgatcctaatgagttggttcacctttgggtggcagaaggatttgttggttcatgcaatttgagtaggagaacgttagaagaggttgggatggattacttcaatgatatggtctctgtatctttcttccaattggtttctcaaatgtattgtgattcgtactatgtcatgcatgatatccttcatgattttgcagagtcactctctagggaagactgctttagattagaagatgataatgtgacagaaataccatgcactgttcgacatctatctgttcatgttcaaagtatgcaaaagcataagcaaattatctgcaagctatatcatttacgcactattatctgcatcgatccgctaatggatggtccaagtgatatttttgatggcatgctacggaaccaaagaaaactgcgtgtattgtctctgtcattttacagcagcagcaagttgccagaatctattggtgagctgaagcacctccggtatttgaacctcgtcaggacgttagtttctgaattgcctacatcattatgtactctctaccacttacaattactttggttaaaccacatggtggagaatttgcctgacaaactatgcaatttaagaaagctacggcatctaggagcgtacgtgaatgatttcgcgattgaaaagcctatttgccaaattctgaatataggtaagttaacgtcgctacaacacatttatgtcttttctgtacaaaagaagcaaggctatgagttgcgacagggggaggacttgaatgagcttggtggcagtttaaaagtgnnnnntcttgagaatgtcattggaaaggatgaagccgtagagtcgaagctatatctgaaaagtcgccttaaagagtnnnnnnnnnnnnnnnnnnnnnnnnnnnnnnnnnnnnnnnnnnntattctagaaggtctgagaccaccaccccaactgagtaagctcacaatcgaaggttacagatctgatacatatcctgggtggttactagagcgatcctattttgagaatttggaaagttttcagcttagtaattgcagtttgctagaaggcctaccaccagatacagagctccttcggaattgctctaggttgcgtataaactttgttccaaatttgaaggaactatctaatcttccagcaggccttacagatttatcaattggttggtgcccactgcttatgtttatcaccaacaatgagctaggacagcatgacttgagggaaaatataataatgaaggcagccgacctggcatctaaacttgcattgatgtgggaggtggattcaggaaaagaagttaggagagtactgtttgaagactatgtatctctgattcggtnnnnnnnnnnnnnnnnnnnnnnnnnnatatcaaagcatcttcaaattattggaagtgttctggttnnnnnnnnnnnnnnnnnnnnnnnnnnnnncatcaaggcatggctcttttgccatgagcagaggataagattcatttatggaagggccatggagatgccattggttctaccgtcaggactctgtgaactttctctttcttcatgcagtattacagatgaagctttagctatttgccttggtggcctcacttcactgagaactttacaattgaaatataatatggcattaactacacttccatcagaaaaggtgtttgagcatttgacaaagcttgatnnnnnnnnnnnnnnnnnnnnnnnnnnnntcaaatcactnnnnnncttacgtgctgctccatctctttcctgttttaactgttgggattgtccttctttagagctagcacggggagcagaactaatgccgttgaaccttgctagcaatctcagcatccttggctgcattcttgcagctgattcgttcattaatggcttgccacatctgaaacatctttccattgatgtctgcagatgctccccatccttatcgattggccacctgacctcccttgaatcattatgtctaaatggtctccctgatctttgctttgttgaaggcttgtcttccctgcaccttaagcgcctaagtttagtagatgttgcaaacctcactgccaagtgcatctcaccgtttcgtgtccaggaatcgctcacggttagtagctctgtattgctcaaccacatgctaatggctgaagggtttacagccccaccaaatcttactcttttagattgcaaggagcccgccgcgtcatttgaagaacctgcaaatctctcatccgtcaagcacctgcacttttcatgttgcgaaacagagtccctgcctagaaatctaaaatctgtctcaagtctggagagtctttctatagaacaatgccccaacatagcatctttaccagatctgccgtcctccctccagcgcataactatattgaattgccccgtcttgatgaagaattgccaagaacctgatggagaaagctggccaaagatttcgcacgttcgttggaagagctttccaccaaaatcgatctggcttccttagagttgccactttgaaataaatgagaaggcaccttgacgtcacccctcttctcttgaagctccagagttcaggctcaagtcagaagccaatccgtcgttaatgctgccgtccccgcggttccctgtttttgccgcttgtattgctccgctatttcagttgctatatcattcattccttggttgtgcacaattgccaatatgtatttctctgacagaatgaagtaataactgtggccagggcttttgttttcatgtgcacaattgctatatcattcatgtggcaattagtataaatactccaggcaatcgaaaaaaaaaaaaaaaaa

SEQ ID NO: 19471 - DNA, 5668 bp, Zea mays
  misc_feature (5053)..(5053): n is a, c, g, or t
ttgaaattggttggttttactattagcgttgaatttgatattttagaaaatacatgggcttttttgaacaaattattttatttcaatcaacaaaaacttcacaattcatatcgcccccccccccccccttccctccgtcactgtttttgttacgacaaaaaccaaaaaagaacacataattggtagctgtgtacatattctattatcaactaatgacatactccattatcagtagcttaagctatctgattatatagtatgtacgccaaacgataagacagttcataacttactatacaggtgccaaaaacatgctataattttgtctcagacttttgactttgctgggcttacagatgggcgcgtttcgtcgatataaaagtaaagttcgagtcgacaataagtaaacaaggaaaataatagaaaattacattagcccaatctactatagcccaaacatccatacctgcttgccttctgcagaagaaaaagaaaaaaaaagaacagctttgttactacttcccatcgttcacccattcatattttttttcttggttcacaaagtaagaggaagcacaaactactccaacttcatggcggacttggcgctagttggcttaaggtgggcagcatcgccgattgtcaaggagcttcttactaaagcttcagcttacctcagtgtggacatggtgcgtgagatcgaacgactacaagacactgtcctgccacagttcgagttggtgattcaagcggcccagaagagcccccataggggcaagctggaatcctggcttcggcgtctcaaagaagccttctatgatgccgaggacctgctggacgagcatgagtacaacgtccttaaggccaaggccaagagcggaaaaggtcccctgctccgagaggatgaaagctcctccactgcaaccactgtcatgaagccttttcattctgctatgaacagggcacgcaacttgctccctgggaacagaaggctaattagcaagatgaacgagctcaaagctatcctgacagaagcccaacaacttcgagatcttcttggcttgccacatggcaataccgtcgagtggccctgctgcaggctgatccccgtggtatgcttgatcaccaccttgtacatcctttccgtcctgccagacaaggtgaccacgaattccatggtctcgaacggcagctcgccagcggagaacagtagcttccggccgtcgtatgcggggaggcggccaccaagctcggtctgccggttctcggaaaccagcttcgacatgatttccctgtacatgccctttggcgttgtatctggtgagatggtcacctgcataagcacatagtaatggtgggcaacggtggtcatcagatgaacaccaagaacgcggagtggcgagcggtcttacgtcgtattggtgcaggccgcccttgtcgacgaggccgacgaagaagtggttggccctaacgccgcacggcgtccccacggcgcccaagcccgggcgcgctggaaacatgggctcgtcgcggacaatgtccatcgtcttgaacttctccctcagcgcggctgcggcggccgccgcgttgcgctccgcgagagacggacctgcttctgcttggcgcacatcatcaggtcctggcgtttgcgggccgccgtgcccgcgcccgcggccgtagtcgctgcctccctggtagccgtaggcgtagccacctcggcccccgccttggccacctcggcccccacctcgtccgctgccgcggccaccgcttttgttgccgttgcgccggttcccctgaaagacgttggggttcgcctgatcccgacctcctccgcgctgatggctcgccatggcagctgctcacgccccctgggaaagaagaacaagcgcccatgatcagctactagtacaactcagtcgcacgaaaaggaaggaagggaacggaggaaacaagtcacatttcaccgttttgacgatgatatccaagaaatgtgaaggaagaagaaagaatagcgataacttaaagatgaaggggagaaagaaactgcgagtctgcgaccgacttgtatagagccgttttggtcaggcgcgcaacgaaacttcaatttgtttaccttgtgcgtgttcaaggatggccggcgacgagatgcgaaatggcgcctgccgcggcagggagggaagggaagagggaatagccgaccggtgcctccccgtctgcgcgacttccttcgtcgcgtggttggcactacaagctatactgccgctctggtgctggtgcctgcactgcaggcgtcaatatataggcggggtgggaaggggtcgtcagcaagtcatcaggtggggacccaccagatctttccggtgcaaactgcaaagagaaggtgcggtggatgtggtcgctccctcacgatgactgcttggaattgagtcgggtacatcgtgatttatgtcaaacgagtttgaaccaacaaaacctataaaaaattgagtcgtaccgtgatagtatgaagtataaaaatagtgacctagccagaccctaaattatatcgtgccttcgttggtccgaaccgacccatatatttgatcacatatgtaaaatctatatattactaaattaaatatattaaacaatactaacatcatttaaccacataaagtctaaatagcaaacaatataaagtctataacttgttaaattaaaaaattaaatcatatgggcttaattgggttgtgcttgggtccggcgagccaaaatttgagacctggctcaggttcgctttcgtgtcgtgctagcccaacccatattattccgtgtcggaccgtcatttagactcatattttcggaccgtgctcatgctggcccaaaattcatggcccatattcccggcactactcaccgcccctgaacaaaacaacactcagttcagtagttttcgtttgtactatcctagtctcctagatataattgttattcttaaatttttggtaggatatcaacactcagttcatctagttcgtaatccgatgacatatgtggttggtctcccctacccctttgtgcatgggacgcacctatttcattgatttgaagcccgacatatacaactaatcttggcaaatagatatccagattattgggcgatcaaaacaacagcctaagatttttacctgccaggcaaagctaaccggacaactaaacaactcggtgacctttatcgtaaacctgatcaagtggtttggcagtacattgctgatccaagatcattctaacctatggcgaggtgttaaaggcattctgtcggttcatgaagacagagacactattataaaatggagtacatgaattgagaccttgattattattgctggtttagttgcaagggaagctcgtgaactaaaccttcacagtacgaaatacatttcttcagcgtcttcttgtagttgcatctccactggacagctagttcccatctttccacagatctcataagtcgaaaagggagtagactgttaccagaacaatcctgctccgctcgatggaaccggaggaacacagcaaactcctgctcaaaacctgaccgcttcgcatctgctctgcagttgctactgttctgtattgtgcgtagaaggacaagcagactgtcatcaaattctactgtcgtaggtaattgttgcaaagttccttcacatttgttgattaaccatttcataatccccatctcattttcagtcgaaagcattgatccagagtaaacctgatgactgacagcctttctacggtttgtgggagttgaccaaagccttaatgcacataacaatgcaaatgaggggtgtccgtttggatgaatatacatcgaatcttttggccaggttcccactgagcaaatatccaaatccaactcgatgaaagttttctcgttggggttctcacccaaaagaaagccatagtgttcaaggagttccaggtttgtgtatgttccataagcaaggaggacctgctccccctttttataattttttcttgcatacagacagtatgcattacaatcttcgtatccaccatctgttaatctctcagatgaattggtcatcccattcttctgctggtaattcgtaagttcagctgtatcctcgtcctccaataaagtgtcatcatcaggagcagcataattgaacaaatcacccacagggcataagcaaccagcttcatcccatgaatatgtaatgtgcgagaagataccgttgcaaatgcccagagccaggatttaaacatcaaaagcttaggtttaaattccaattctttcattagtggtgtcgcatcttcccagtctgattttatggcacttttagccttttgtgcaacccaaatagcatcatcaacttggagagcttcgacttcaaaatcattgaaggtagccaagatagtgtagtagctgggtagctgacacaggtaggggtaccagacagagttgctccctttccccacttcggccaataagcacactatgagtatctgcacggaggagaggcggggcttgtgggcgctgacgcaggcggcgatcctggggtcgtcggccgtgacgcggtcgcttgtgagcagcgcggctcggggcaagcgcaacaccagctccccgcgccgcaagtcacgcgccgccgcgaggcccctcccgccggcgtcggggaagtcggcgacgacgagggagccgccgaggcaggacggcgaagagatgtttccagagggggaggaggaatggggcgacggcgagtcggagacgcccagctcggccgcccacttgaggagcgcctccatcggcagcggccacctgggcgctttggtcagggtccaccctgtagctgtgatttacgtcgggaagtagcggcaactgagatgcccacttttgtacaacattcttaggctatccgcactcatactactctaaatccgtactctaaaaagaatattctgtcctcgtcagcaagattatctactctataccacaatcctccgctatcatgtttactctatatctcaactttataccaactttcanatactatattattttttttacttcactctgcctccctgtgtggctgtgtctgccgccttgtatacgtggagcatactccgacgacggaaggacaggagagagatttggagttgaacgctatatatggcgtttcccatgccctctgtatatttgcagtcgtggatggagtgcctcactgcagcattttcttgactgcatatctatgcagtaggctttagcgctccccagtgcgcacagccttaggcttgtttgtttcttccgcacttatcctattctaaatttatacttaaaaaatattaccctctcttttctttttagttgtcgctgaatatttttacactatccagcgacaactaaaaaaacagagagagtatatcctagttatgaatattttaaaatacagtagacaaactcccgtatctataactactcaatattccagctctatataaaccactataatttttattaatattttttacttcacttctgctagcttgttcaaacatgcaagtacaaatagtgttgccacgttgaatctagtgtttcaacactagcgtggatcataaggtaaatgactacaacagttttttttcttggcgtactattcagagg

SEQ ID NO: 19472 - DNA, 8701 bp, Zea mays
  misc_feature (2472)..(2472): n is a, c, g, or t
tttaagggatttttattttcacaaaagagaaaatgaactaatttctcttgaaaaatggaatttttttggaaaaatagggttgccaaactagctctaaaataaagaaaaactaagtaagtagaacaataatttccctcgggatttctttttttctttgtgttttcttttttctggaaaaaatgaactaatttcacttgggaaaattaaaaacttctgaaaaaaatggggttccaaaactaccatgattttgttctcctggccaggcaactccattatcacagtacagacaaactgcacgtccatcgacaccagagctaaaagatacggagaccaactaggtgaaagagcagcagcagcagcagcagcaaagcggctggctcatctcattctcatcaacgagctgcatgcagcacagggactagcgggtcaacggtccaaccaggcgcggggaacaacgtgcaccggcgaccggatcggtccggtcaagtcctccatctcctgcaaccggaacgacggcaccgaaaccgaatccgccggtccgggggcccacgagccgccgcagccaccgtggacgacagcggcgagcaacccgtcgcagcagcagcagcagcaggagtcgtcggcgtagctgtaaccgctgctgctactgccgctgctgctccagcagcaggccacgtcgtcgccggagatcgccggagattcagtccccgtggtgacggtggtggaacaagcggaggcggcggcggcggctgacgtagttgccgttgccggaacgacgacgacgacgggatcgggctggcctgcaggtgcacggacgacgacgctggtggtggtctccaggatgaccggcggggcctccagcgcgtcgtcgttggccgtgcaggtgtgctccgccacgtacaccaccgtgtactctgggggtgcggtggcgccgtcgtcgtcgttgcgctgcaccgtccgttttgcctggcagccttgcttggcgctctgtatgcacctgtagtaactcctgcaaatacgtacggatatatataatttattagtggtcacatcagtaatcactagtagttgtttggcaacacatgcatatgtaaaaactgtctcgatcgagatcgatgggtgaatataatggcgctctttaattgcatgtgagagtgagacaaggcacaacgtgtgtcacgacagtcgtattaggttagtacctagggatggatggatggatggtagggacatcagcatcagctagctaggcatccaccaccagcagcagcttgcagctagctagtgtcactggaccgctagctgcatacccaggcccacacccagatgccgcacaaagtatttcttggacttttttttaactaaattgtgataaataaaaaagaacgaagagagtatttaatatataaatatacgaagcgaaatggtggcataataaaatttgtcctaacaaattaatgttttcggaaagcagctacaactacaacacttcactgctgtagctctgctctgctgatgaaaaacgaagagcgaaaatgattggacagcgcatctcgatcgatcgagattattctcggaaccgttttcttcgtttgacgaacgaactactcactacatgcaaataaatgtacgaaggaatactaattaatgttttgttgttattattcactgcgtacagtatgtaagaagaaggaggagatggatatatacctggggtacatggcaccttcgatctgcttctgcccgtacttcctccactggtacccgtcgaagtcgggcactgtcgtcacaaggcacttgctctgctgccgcttcttcttattcttcctcctcctgcaggcagcagcaccatcagtcatgcatcatcgagatcgaaggaataatataataagactgcttgcatgcatggatggacaatcaccacgcacgcacctcgtccttttgcagggaggaggaggatgaggacaatagtgaggctgcgcagccgcaggttcgtcgccgtgctgctcggcctcggcttcgctgtcgtcgtcccggtctctcttgctccccagtcgtcgtccgccgccactagtgcccatgatggactccaccttaacgggagccgccggcgccgggggcgacgcaggaggtggtaggaacgtcagtagcgcgcggagctgcgccaggagctcctcctcccgccctaatactagcgccatcgccagcgccagcccagcccaggaccctgcagggaagaacacagtgcgcttggcttgtttaattagctagctagctggctctggtggcatttataaagaagaagagaaagagagcgggactacggaaggcatcatatcactgaacgccagcgcagccgcgccccagttcgatcgatgtgccggtcctgaattacgtgcacaccggtggcgtcagcaccatgacgtatgcatgcctggttacctaccgctacctcttctgctgtccatcttnttcatcgtacagtcgcccgtacactgtatatctgtatggaggagagaagacgacttccttccgcgttgactagggcgcactggaggacggcaggcaggacgcacatcaatctatgaccctcaattaataaaacaattcacaacaaatgtaaataataactcaagattaatttaataagagtagtcaaagtttttttttaaaaaaataagagttactggcatcgtatatttatgaacgaacgaaagtagtagtagcttttcggagaacgctgaactgaagccaatcgtcgttcccgtctcacgggggcgtttggtgtcctttgaccggcaccgcagaaaaaatatggtcccaaacacgtactgcacgaccctgctactgatcccagtggtggtccctcgtaatgaataatggtccccatcatgtcctgtgctccccggtgcccaggcccatgtgtagcacaacgaccctccgtgggcctgatgccactacactccactccactccagttgtgttttagactccagcattagtcatccacccaccaagccaatagcggctactacgtcctggccttcctagtgcgcccatgaacgttgaggtgtatggacacattcatattcagacttcaagtttataaaatatgcagactggactccctaggggctcaatatagaaaccttcaagtacaaaattacatgtataagtatgagcaataccagtctcattgtcacaagaaggttggtcattcactgttagaaataaatgaaaaatgcaaaagacatagttgtagcatcaacaggtactgtttgaaagacactgaacttactgaacaatcaataagcttgctgggcctaatcagatatttttaatcaaatcaacaaaaaaaaattatcatgtgaaaggaaatggggaattgcatctacacttctgctagttttaatcagttaccttacctgtatacaggccagaatcagtacaaatggtagcaaagaaccataattgccttatctatcagattatacaataaaacaagatgtgggcagtttgattttttttttttgctagtgtattttgtactataagtcctcatggtgccaaagttgcagatgtggtcacgccttgctttcacgccaacagacgccagttccgtgcatcctaagatcgacaagaatatgtttagatgtagatgacatgtcgtccatgtagaaaatttcgagtttcttttttttttgaaatatcaggagggggaacccttgttgtaaaatttttattaataatgtaaaattacaacgcgacgtaattacaagagataaaagtgagctggggaggtctagttaggaagctaaaaagaagaatccaaggagtacaaaagttatgcctaccggagtacaaaagttatgcctaccactgattaagccagttcggaattgagttatcatatttccctctcgctctgtgtacaaccagctataattccttgatgaattcattcttgcaatgttgtactgatgggtctttgttttcaaatagccattcatttcggtatttccagatactccatgtcataagtataataatctctatagaaaaaggaacactaagttggtgcttgaggtttgccgaggcctcctccgaatgagcaattctaggaggggttatgccaattgaattccagcatgcttttgcaatgttgcatctaagaaacaggtgataaagagtttcctcccgttgccatatacagttctcacacgaatatgactccagtgtcatgtttttccttctcagttgaaagcatctaccaaatttacacagaaggtcaaagcttcataacggtattgacacttcaacacaaaacaacagattaaccaccaacgactctaaccaagtcatcttgctcggatgtactctcctcttcttcaacctcagcaaacaatgctgatgcaggttcatatccagagagtttcatctcaccgattagactattcagcatctcatacacctccttcgacctgggatgaaccttatcgccgacaaggaaaccgtgcatctcggattgcacctcgatccagctacaaccaggttcctttctcagccgtccctgcctcattagccttctggtccttgaaacatcgacccatttcccggatccagcgtatacgttagagagaagaatgtaaaccgacgcgtcgtctgggtctagccgtaggacattgctagcggcagtttcggccacttcgacgtcttgacggatcttgcaaatgcttagcagagtcttccatacgacagcgtctgcctcaataggcatgcttctgataaattctagggcttcctgtgggccctttgagcgtcccagtatatccaccatgcaagcaaagtgttccagttgaggaaccagtttgtagcggcttgtcatcagatggaaatactggcatccatcgtccagcaggccgacatggctgcatgcccgcagaactgcgacgaaagtcgcgtggttcggcaccacatttgctctctgcatcctctcaaacatctccagggcttcaagtccctggccgtggagcgcgtagccacatatcatggcgttccatgatacgaaatccagtttccgcgccttctcgaacattagcagcgagtctggcatgttcccacacttggcatacatgtctacaagagtgctggagatatattcgtctccaagcatttcctgtttgataatctgaccatggatctgtttccccaactcaatggtagccagattagcacaagtgtcaagaacggtggcgtaagtaaaatggtcaggttttacacccatgtctagcatctctgagaagaatctctgtgcctcttcactctgtttggtgagtgaaaaacctgatatgatggagttccacgaaacaagttcttgccccccaattctatcatggagtttctgagcctctgttatcgcgccgcatttgcagtacatgtcaacaacagtgcttgaaacaaaagcatctaaaccaagtccagacttgatagctttgccatgaaccaccaacccatattccaaagattgtagacctgcacaagccttaagaacactgccgtacgtgaaatcatcaggttccataccagagcgcagcatttcatttagatgagctatagtatcctcataacactcattttgctcgagagctgcaataatagcgttccaagagaccgaatctctttgctccatctcctggaatacaaggtatgcttctactaatgctttgcacttcccatatagatccagaattgcatttctgacacaaacatccacatcaaaacctgatttaactgctaagcagtgtacttgcaacccttgaaagtaccccttaacctcagcacaagcactgaaaacacctgataagctaattacatcaaacccaacaccagacctggtcatgaactgaaacagttgcatggcctcagctcctagccctgtgcgcacaagcccaaccatcatggcattgcatgtctccacattatggtgaggcaaaccaatgaatgcccttcttgcatcaaccaagttaccagccttcgcatacacgtccacaattgctgtcccaacaacacggtcagagctaaaaacattcttgatggcatgcgcatgcaactgcctagcggtgctcagacatggcattgctgcacaggatctaaaggcactggcataagccggctggctgactccaagccccaacctctgcatctgcacgaacagctccatcccccgtgtgtactgctcgttctgaacacacccagcgatcgccgcaccccacgagaccgaattcctctcacccattccatgaaagaagcgcagcgcgtcatccaagctcctgcacttgccatacatgtcgacgagagcgctaccggcccggacatccgtctccaggcccgtcttcaccgccagcgcatggatctgaacaccaagcgccaggtcgtccaagccaccgcatgacttgagcaggacagcgagcgtcgtcctgtcgagggcaacaccacggcgagacatctccatagacaggcccaccgagttccggaacatgccgcgctggcagtagcccgagatcagcgtgttccaggacacgacgtccgggtccggcatcgtgccgaagagggacgcggccgtgtcggtgtcgcccgcgtgcacgtacgccgtgagcatggtgttccacgagaccgtgtcccggtggggcatcgtgtcgaacaccccgcgcgcgtgggcggtgcccccgcagcgggcatacatctggaggaggcagttggagacgaacgtggtgggcacgaacccggacacaagcatccgggcgtgcgcagcctggcccgtggtgagggccgagcgcccagcgctggtgcatagctggtagaggtgggagaaggtggcggtggcgaggaaccccgctccggctgagcaggcgtggggcggcaggggcatcctgggctcaggctggtggcgatcatgtgttaattaatgtacgggacacatctttctaccttcgcattccagcctcctatattgcaaattgcgatgccattaaaacatggatattcacccaacatttggaaattgggattgaacaactcgatgtggtattgttctcaccttgagctcctgtgatgtgtgcggttgtccacctggacgaactcgaactcgcctttcttctgcctcgcaaatcaaatcaaaacgggctagcacctgtaagtaaatttgtgtttgtcaaattgagagggcccggttccaattcaaacacctattactatatggataataggacccactgtccgtaaagatgacttttttcgccatcctctttccgcgcttcttccttcctctttccctcagctgtctgtcagcagcaccatccctctcctctacgacaaaaacagatcttctatcaccagcaatcagcaacaccatccgctattcctgcattccctgcccgacggagctgcttccctccttgctgtgctgttctgggctgtgcttgttctagagtctactccaccactgcggcgacctcgcgctcgttgtcgattccagctccatgcgcccttgatttattttacttgtgtaagatctctaatctccacttttcgcttgctgtgttagctgctatttcccctttgtgttggcaagtggcatccctaacacatgacgagaaagaaaaagaattggtttgtgctccattttcccattcagattcactaattttatgcgtctttccaatcccaggttttctccagtccgtagcgtctttatcagttgcttgccttctgcagaggaaaaaagaaaaaaaaagagtcagctttgttactgcatcttcagcttgttcatttcgctctagtctggaaatattcatccaagatctctccatcttctccactcacaaagtaagaggaagcacaaaccactgcaatttcatggcagactttgctctcactggcttaaggtggacagcagctccgattgtcaaagagcttcttactaaagcttcagcttacctcagtgtggacatggtgcgcgagatccaacaactggaagccactgtcctgccacagttcgagctgataattcaagcggcccagaagagcccccacaggggcatgctggaggcatggctccggcgtctcaaagaagcctattatgatgccgaggatctgctggacgagcatgagtactatgtccttaaggccaaggccaagagctcctcccctgcaagtactgttatgaagccctttcataatgctatgagcagggcacgcaactttctccctcagaagagaaggctaattagcaagatgagcgagcttaaagctatcctgacagaagcccagcagcttcgagatcttcttagtttgccacatggcaataccgtcgagtggccaactgtagcagctaccgttgttcccacaacaacatcatatcccacttcaaaggttttcggccgtgatcgagatcgtgaccgtatagttgatttccttctcggcaagacaacaactgctgaggcaagctcagccaagtactcgggtttggccattgttggaattggaggaatggggaagtccaccatagcacagtatgtctataatgacgagaggattgaaaaatgctttgatgtcaggatgtggatctgcatctcacgcaaacttgatgtgcatcgtcacacaagagagatcatcgagtccgcaaaaatggggagtgcccacg

SEQ ID NO: 19473 - DNA, 2440 bp, Zea mays
aattctttaaaccaaacatccttttaaaaattaattatgttactctgttttttttttagaattactatagatcccaacacagccgaatctgtccctgtcagtagagctacccagaagcttcctttgtctctgtcgatgctgactccttcaccccaacagctcccaatcttcccaacgctgcttcctttcccagcgagcagtcagcagcaccatcggtctcctccacgacaaaaaacagatattctatcgtcaggaatcaatcagcaatcctgcgttgcctgcccgacggagctgcttccctcgttgctgcattgcactgcggcggcctcgcgcttgttgtcgattccagctccatgcgcccatgatttactttacttgtgtaagatcaccaatctcgactgctatttcccctttgcgttgctgccttgctggaaaataattggtttgtccatttagattcactaattttatgcgtctttccaattctaggttttctcgagtctgtagcggtttttatcagctgcttgccttctgcagaagaaaaaaaaaacagccttgttactacttcccatcgttcatccattcatttttttttcttggttcacaaagtaagaggaagcacaaactactccaacttcatggcggacttggcgctagttggcttaaggtgggcagcatcgccgattgtcaaggagcttcttactaaagcttcagcttacctcagtgtggacatggtgcgtgagatcgaacgactacaagacactgtcctgccacagttcgagttggtgattcaagcggcccagaagagcccccataggggcaagctggaatcctggcttcggcgtctcaaaaaagccttctatgatgccgaggacctgctggacgagcatgagtacaacgtccttaaggccaaggccaagagcggaaaaggtcccctgctccgagaggatgaaagctcctccactgcaaccactgtcatgaagccttttaattctgctataaacatggcacgcaacttgctccctgggaacaaaaggctaattaccaagatgaacgagctcaaaaatattctggaagatgccaagcagcttcgagaacttcttggcttgccacatggcaatatcgtcgagtggccagctgcagcacctaccagtgttcccacagccacatcacttcccacttccaaggtttttggtcgcgacagggatcgtgatcatatagtagattttcttctcgacaagacaacaactgctcaggcaagctcagctaagtactcgggtttggccattgttggagtaggaggaatggggaagtccaccttagcacagtatgtctacaacgacaaaaggatagaagaatgcttcgatgtcaggatgtgggtgtgtatctcacgcaaacttgatgtccatcgtcacacaagggagatcatggagtctgcaaaaaagggggagtgcccacgtgttgataatctcgatactctccagtgcaaattacgtgatatactacaagagtcacataaattcctgcttgtcttggatgatgtttggtttgaaaaatctgatactgagacagagtgggagctactccttgctccattagtctctaaacagccggggagcaaggttttggtgactactcgacgtgagacgcttccggccgcaatttgctgtgaacaagtcgtttatttgaaaaacttggatgatactgagttcttggctctctttaaacaccatgctttctctggagcagaaatcaaagaccagctcctacacacgaagttggaacacactacagaggagattgctaaaaggcttggacaatgtcctttagcagcaaaagttatgggttcccgattgtgcaggaaaaaggatattgctgaatggaaagctgctctaaagcttggagatttgagtcatcccttcacatctctgttgtggagttatgagaagttagatccacgtttgcagagatgcttcttgtattgcagtttgtttccaaaaggtcatagatatcaatctgatgaattggttcacctctgggtggcagaaggatttgttggttcatgcaattggagtaggagaacattggaagagattgggatggattacttcaatgatatggtctctgggtctttcttccaattggtttctaaaggatgttattcgtactataccatgcacgacatccttcatgatttggcagagtcactctctagagaagactgcttcagattagaagatgataatgtgacagaaataccatgcactgttcgacatctatctgttcgtgttgaaagtatgcaaaagcataagcaaattatctacaagctacatcatttacgcactgttatctgcattgatcgactaatggataatgcaagtattattttttatcagatgctatggaacatgaagaagttgcgtgtattgtctttgtcatt

SEQ ID NO: 19474 - DNA, 1184 bp, Zea mays
tacctagaatcgtttcaactgatcaaaatttatacaaattaaataaacaattcgggtagaatttgatctgagacaagtctaatgattggttttttggagtatgatttttggaccaatcaagtttcgccgtctcaacacgcattgctttgttcgcatctcgcattcgcacctgagtgaggacgtgaggtccgtcatatggacacacgtgctcaccgaccagccgaccacgcttctctagcttgggcttggcagtgccaatccgatccacacaccccagtttcttccttccttcctcggtctaaagaagcaagcagccatggacggcgacgtcgcgaccggcggcggcgggggcaccagcatccacatcacggcgctggacggcatcgtgaacgtgaattcgctcttcaccctggccgccttcctgggcctggcgtggcggccctcctccgacgggccggggctcgccgacggcgccgaccgcacgggcaacccctgcgccgcgggggaccgcgccgagtcggacctcgtctccttccacgtgctcgccttcgcctgcttcctcttctccagcctcgtcgcgctctgcctcaagcagctcgtccgcacctaccccgcgccccaccgccgccgcgccgcctccgcctccgcctccgcccgccggcggcggccgcaccgcgcggatcaaccgcgcggcgctccgcgtcgggatcctcgcgtccgccgtggggtccgtcgccggatgcggcttcctgatgatggccctcgtcaacgtggtgcaggtgaagctcgggcgactcgggtgcggcgccggcggggccgccgcctgggccgccgtcgtgccgctcgtcaccctcgtcccttccgccatgctcatctacatcggcaccgtcttctacgccttcacacgctagtcggtggcggatcaaggaacactctgaccaaagcacccgtttttcgatcagatctttatctgtgtgatccctcctcagtctttcttgtgtgtgattggtggtgatggcgtgagagaacttccaggggggaacaatgcagctgacttttgtagatttaagatatgtaaaatccatgcgatattatgattgtgttttggagttttggaacaaaaaaaaaaaaaaaaggttttatctgcaattggcctttgtatttgcacttgagaagttggtcag

SEQ ID NO: 19475 - DNA, 5169 bp, Zea mays
  misc_feature (2210)..(2210): n is a, c, g, or t
  misc_feature (2380)..(2380): n is a, c, g, or t
cattgggtacctcgaggccggccccgcttccgcttcccctcagccgtcacctccccgctcccaccgccaccaatcgcactcgcagtggctgttggcgtgcgctcgcgtccaaaccaagcaaaccccacaaatcctaccttccgccggcgtcgccaccggccgtgctccctccctccggccccggttgaccctagcctcgcagcaccctaaccctacccccctcccgccgctgccagagcaggggaaaaagatgccgcgcgagatcatcacgatccaggtggggcaatgcgggaaccagatcgggatggagttctggaagcagctctgcctcgagcacggcatcggcaaggacggcctcctcgaggacttcgccactcaggggggcgacaggaaggatgtcttcttttaccaggctgatgatcagcacttcatacccaggtctctgcttattgacctggagccgagagtgatcaatgggattcagaacagcgagtacaggaacctgtacaaccatgagaacatatttgttgctgagcacggtggtggtgccgggaacaactgggccagtgggtatcatcagggtgaacaatttgttgatgatatcatggacatggttgacagagaagctgatggaagtgatagccttgagggttttgtcctgtgccactctattgctggtggaactggttcaggtatgggttcttatctattggagacactgaatgatcgatacagtaaaaagcttgtgcagacatatagtgttttcccaaatcaggtggaaacaagtgatgttgtcgtccaaccttacaactcacttttgactctgaagcggctgacactgaatgctgactgtgtggttgttcttgacaatacggctcttaataggattgccgtcgagcgccttcatctatcaaatcctacgtttgcacaaacaaactctttggtctccacggttatgtctgcaagcacaactactttaaggtatcctggatatatgaacaatgatctggttggccttcttgcctccttgattcccactccaaggtgtcattttttgatgacaggttatactccgttgactgtggagcgccaggttaacatgatacgcaaaacgacggtattggatgttatgagaagacttctgcagacaaagaatataatggtgtcatcatatgctcgaacaaaagaagctagccaggctaaatacatctccatattgaacatcattcaaggggaggtggaccctacacaggttcacgagagcctgcaaagaatacgcgaaaggaagcttgttaactttatagactgggcacctgcaagcattcaggttgctttgtcaagaaaatccccttatgttcaaacaacccacagggttagtggtctgatgttagcaaatcatacaagcatccgtcatttattcagcaaatgcctgggacaatatgaaaagctaaggaaaaagcaggcttttcttgacaactacaggaagttcccaatgtttgcggacaatgatctatctgaatttgatgaatctcgagagataatagagagcctagttgatgaatacaaggcctgcgagtcgcctgactacatcaaatggggaatggaggaccctggagaggcaaatgttgtggcggcacttgactctaagttggtagtgtaaatataaaggagagcagtctatgggacgtgtcccacctaaagtgaagacctgcaaaggacaccaccattgggagtctatcggacgtgtcgcacctaaagtggagacctgcaaaggacacgaccattgggcatgacaactcgagcagtagcaactgcttagaaggttaatattcataacaatggtcacatagaagcaccacggtggaatggctccatctgctcgtggatttgtaaaagcgaaagtagtggtccccacaagggcggagccaggattatgatagaagaggggccgaccaattcatcaatactatatgataaaataatattgtatattgttatcaagtttaagcactcagcatgaaataaaaattctagatctttacaaattgtcttagtgcataagtccattttctagctaattaatatattgaactaaagttgtgacacaagaacaatactaaaataataaagacgatataacgatgaatatccgactgatgagattcaacttttatataatgactcaattcatgaggcagctaacaaatttntgagataattcaaaaatccaactagcctcaatgatccatgaaaattcgtcaacctactcgagtaaatgtcaaatttgttgtacacaccaactatcaggtgacaactttagttgaaatttatagattttattatccacgagatctgatgtagtatgtatataagttgctgngctcattctactacttcagtgatcaccttctttggactttagttgtgggactataataaagacaagtcaggtggtcagcgccaatcgacagctgcctagccaaacgataggatgaatcataaaggaggtgcagttcggatatcaacatctgcaagtaaattaagtttgacgttttatggatcgattggtcattcaacgaatatttcatcttatattctttgtctttttagactttggttggcatattacaatagagttatggatcatttattaccaatcactatattaaactttaattaattgcgatgtacaaaatttagagtatatatatttagacacacaaaaattagaatatatatacgtatactaatatttggaaaattttaaaatataactatatttaattaaatactttaattaatatctattcagataattccctttaacgtcttgtgattgtgttctttggtggctttggtgctgatagtttcaattgtgccgagcatttctcgctgatgacttggaaagttttagtctagttttttggcctggtccccgtcctgttaggggcgacgctatgctatcgtctctgacaatgttttagcttatcgagattgcgaacattaatgttttacccgatttgctgtgttaaagatggatatggttgataaagtaactgctgttgaactattgaaatgaacaatagagagattctttattgcttgagtatatacacaggagagcagtctatgggacgtgtcccacctaaagtgaagacctgcaaaggacacgaccattgggcatgacaactcgagcagtagcaactgcttagaagtttaatattcataacaatggtcacatagaagcaccacggtggaatggctccatctgctcgtggatttgtaaaagcgaaagtactgatccccaatagtctactgattatcgaagtttctaaaatggcctaactgtataaacttaaaatatttaattaacagatttgaaaattgctggtctgacactggctgattttattgtataaaacattggtttacgacagcacatttatgcaattttgttactaccatgtgttttcagctccagctagctgaccagatctctacaaacctatggcaggagcaataatctacgaatgaaacggccaaaaggggcgaccagagacgtttaacaatctgctgtgcctactagtaaattgcccaaacaggaaggtacatgcaggtaggaagaataaggctatatcgtgtaaataagaagatttgataagatagctgctaggaacagcataagaatcctgagcaattcagttactacgttactgcaatgtggtcctttcgtcctttatattatttccttggcctaccgccccactttttgatgtcaccagtaaaaaatactaacacttacgccgagtaaaataagggatttacacagtagattacattatttacagagtgaagtttaaaatagagaatgtgatagaatagctactgtagacaaccttataatataaaataaggataattacatcaattacaagatgtttttacaactaaattggagatataaatatcggacattattcactacaaatttagttaaaattaagcattaagctactttacacagccgcattttttttttgaaacagaaatagtctatgatcctatggaaataaaaatactcatttattgtgactttttgggtacgttttcactcgctcgatagaaggcaacgattgatatataaacagtccttaaatacaaatacgtaagtgagttttttgatccgttagattataatccaaccatatattatatttaagacttattttttcaccaccagcttaccatgtattaactagtctagtctctactatatttaggtgagaatctcctttagtatgttgcctacgcatgcgatcgctgcgtgctctacgccgagcacgcgtccactggcaaaaaaatggtgtgggctggtactcgaacccgctcctgtcatagggcaaaacatcgagttcgtttgtgtttaaaaaagaacaataatttaaatatacttctaatatttgaaagtttaaaaatacaattatatttaagtaaatgtctcgtttaattaatatatacccatataatatatagaaaccatagaaaataacagataaattgattagttccctttaacgttttgtgattgcgctctttggtggctttggtgctgatactttcaattgttccgagcatttctcgctgatgacttggaaagttttaataaaggtttagagcaaaggaccgacgagcaattttaaggtcaattatatgtgtacaccgaaaaaggccatcaaggaatcggataggaatttatttgggatcaagtggtgtacaatgtgtttagatactacgttcgtatgcgtttatggaattctgggagaccatttgttacgaaaatggcttaaaatggatttcagatagacgggcccaaggcgtgtgctgctgtttagtgcgtactatgctatgcactcggtccatgagcgaagtggcgcatggagaaatgtgggccacgggcccacccacgcttgaccggaacagagcgactgcatgtcttctccaacgaacctattcttttcccgtgagagttacatcccacccaaaacaacctcctaaatttaggctctagttgacatgactctaacttcaaactttagattggagttgagtggagagcttgctaagaacgtgtttggtatagctccaaagccaaaaactataaggaggacg

SEQ ID NO: 19476 - DNA, 1842 bp, Zea mays
ggccgccacgcttcgtttgcttcccgctcccacccccgcccgccacccggcgcactcgcagttggcgcgcgctcccgtcctaaccaagcaaaacccacaaccctagcctccgccggcgccgccatctgccgggcctccctccggtcccggccgaccgtagcctcgcagcaccctaaccctatccctcccccgctgccgcgggagcagggtaaaaaaatgccgcgtgagatcatcacgatccaggtggggcaatgtggaaaccagatcgggatggagttctggaagcagctctgtctcgagcacggtatcggcaaggacggcctgctcgaggacttcgccactcaggggggcgacaggaaggacgtcttcttttaccaggctgatgatcagcacttcatacccaggtctctgcttattgacctggagccgagagtgatcaatggaatccagaacagtgagtacaggaacctgtacaaccacgagaacatatttgtcgctgagcatggtggtggtgccgggaacaactgggccagtgggtatcatcagggtgaacaagttgttgatgatatcatggacatggttgacagagaagcagatggaagtgatagccttgagggttttgtcctttgtcattctattgctggtggaactggttcaggtatgggttcttatctgttggagacactgaatgatcgatacagtaaaaagcttgtgcagacatatagtgttttcccaaatcagatggaaacaagtgatgttgtcgtccaaccttacaactcacttttaactctgaagcgtctgacactgaatgctgactgtgtggtggttcttgacaatacggctcttaataggattgcggtcgagcgtcttcatttatcaaatcctacatttgcacaaacaaactctttggtctccacagttatgtctgcaagcacaactacattgcggtatcctggatatatgaacaatgatctggttggccttcttgcctccctgatccccactccaaggtgtcattttttgatgacaggctatactccactgactgttgagcgccaggttaacatgatacgcaaaacaacagtattggatgttatgagaagacttctgcagacaaagaatgtaatggtgtcatcatatgctcgaacaaaagaagccagccaggctaaatatatctccatattgaacatcattcaaggggaggtggaccctacacaggttcatgagagcctgcaaaggatacgtgaaaggaagcttgttaactttatagactgggcacctgcaagcattcaggttgccctgtcaagaaaatccccatatgttcaaacaacccacagggttagtggtctgatgttagctaatcatacgagcatccgccacctgttcggcaaatgcctgggacaatatgaaaagctaaggaaaaagcaggcttttcttgacaactataggaaattcccaatgtttgcagataatgatctctctgaatttgatgaatctcgagagataatagagagcctagttgatgaatacaaggcctgtgagtcgccagactacattaaatggggaatggaggaccctggagaggcaaacgttgcagcagatcttgactctaagttggtagtgtaaatataaaggtaccatttcatgaatcatgatcaggcactttatatgcggaaacaatttgatgtcctatcatattgattattgattgaattgacaatccacttgaacaccactctttcttttgatagccatgtggactacatcaattattataaatgatccacaatctctgctacatgttgaaaatgattgctaaaaaaaaaaaaaaaaaaaaaaaaa

SEQ ID NO: 19477 - DNA, 820 bp, Zea mays
gatcaatcttcagatcaatttcacacacctataaataggaacttttttttttttttttttaaaaacaaaaaaaatctattccgttttcgaatgtgcctccacacagctggcagaaatacccaacagtttctcgatacacagcttgtcgatgagacagcaaatctacacattgagaaatgcaccaatgcaaagaaaaatatatatatgagatatctgagaatagtacagtacagatatatcaaggttcctatcagcctgccttgcctggatccatctatgagcttcaactgaagaagcatacactgctgtaccacgatgatataccatgggcaaagcacacgcaccaatgttaagagccgctgttaacacatccaggcaagcacagctgctgaagacccaacagcggttccaggaacctcccctgcggcaaaactgactagtccattcccagtctacaaccacaaatcttggaatcagcatcatgtggaggtaaccaaaaataaaattacagcagccacctttcaccaccctggaagaaaactcgcacttgaaagacgagggctcccgaggtattccgaggccagaccaacaaacaggaaactacattagagaaagcagaatcaaaacaaggaacactacgaatctaccatctcgtcttgcaattcgctaggggcaatcagccccggaatggcaagcattcgttggcgctccctttctctttgggcagcagcctcttccgcgtatagatccttgttatcctgagctgagaactccttcgactgcaccaggaaatctctaatatggtttttgaagctcggaa

SEQ ID NO: 19478 - DNA, 1021 bp, Zea mays
aaccaaattactacatttatatatgtaatctccgcaccagagtgctaacaaaggaacatagttttttctccatacacagccaagccaaacctacccttgttgatgagacagcaaatcaatgttagcaaagtacaccgagcacaagagccgctgctaacacatccaggcaaccacagctgctgagagacccccagcagcagtcatgcggcaaaactgactgtctactaccacaaatcttggaatcagcatcatgtggaggtaaccaaaaataaaattacagcaggcaccttctttcaccaccctggaagaaaacttggacgtcgagggctccagaggtattccgatgccggaccaacaaacaggaagctacattagagagctgaatcaacaaggaacactacgaatctaccatctcgtcttgcaactcgctaggggcaatgagccccggaatggcaagcatacgttggcgctccctctctctttgggcagcagcctcttccgcgtatagatccttgttatcctgaactgagaactccttggactgcaccaggaagtctctaatatggtttttgaagcttggaagatcaagttttgaactaagaagaccatctacaaactttgtcacctcggttactgtcatgttaggaaatgatgtccctaagagctttatggtgtaatctcgaacaaacatagcattatccgtatattggtaaggtacagaagacgcgtcccatagaggctccgttagaccatcaaccgcacaaaacaagtgttgcagcaccgaaacatgaagcttgaaaccaggtttgtggaatgtgtctgtgaggactgcaaaaatctcttgctcaattgtcaaaaagtaggttttgtagaattggttttggaatcctgaagcctggaattttttcaagatctccaacaacaggctaaggccagtctctgcaatatttctctctgtatgtctgaacgcccaattaattgaatcgatcacaagcttcaattgctgacttgaaagctgcgc

SEQ ID NO: 19479 - DNA, 4176 bp, Zea mays
  misc_feature (18)..(18): n is a, c, g, or t
  misc_feature (2802)..(2802): n is a, c, g, or t
tttttttttttttttttngcaccaatgcaaagaaaaatatatatatgagatatctgagaatagtacagtacagatatatcaaggttcctatcagcctggatccatctatgagcttcaactgaagaagcatacaatgctgtaccacgatgatataccatgggcaaagcacacgcaccaatgttaagagccgctgttaacacatccaggcaagcacagctgctgaagacccaacagcggttccaggaacctcccctgcggcaaaactgactagtccattcccagtctacaaccacaaatcttggaatcagcatcatgtggaggtaaccaaaaataaaattacagcagccacctttcaccaccctggaagaaaactcgcacttgaaagacgagggctcccgaggccagcccacgcggccgcaacaaacaggaagctacattagagaaagcagaatcaaaacaaggaacactacgaatctaccatctcgtcttgcaattcgctaggggcaatcagccccggaatggcaagcattcgttggcgctccctttctctttgggcagcagcctcttccgcgtatagatccttgttatcctgagctgagaactccttcgactgcaccaggaaatctctaatatggtttttgaagctcggaagatcaagttttgaactaagaaggccatccacaaacttggtcacctcagctacagtcatgttaggaaatgatgttcctaagagttttatggtgtaatctcgaacaaacatggcattatccgtatattgatatggtactgatgaagaatcccatagaggctcagttagactatcaaccacataaaataagtgttggagcaccaaaacatgaagcttgaaaccaggtttgtggaatgtgtctgtgagaactgcaaaaatctcttgctcaattgtcaaaaagtaggttttgtagaattgattttggaatcctgaagcctcaaagttcttcaaaatttccaacaatagactaaggccagtctctgcgatatttctctcggtatgtctgaacgcccaattaatcgaatcgatcacaagcttcaattgctggcttgaaagctggattaatgcttggaagcaatgggtgccaattgcacggagcaaagaaaaaaatttgaggcggtgctcaggataatcttcaaagttcttagtaatcatctcaagagtgcactggaaaacagcctcaaatatacgaggcacatcctcaagcatttcccctttgtacttgttaatgattgttgcaaacaaagacagaacttcagactcccttgcatcgggtacatttctagcataatcaccaaggacaggatccatcattggtggaacaaactgctttcctaagtgcggtaaatcttctgccttgtccacaaaagtctcgatcaactttagggtttccctcttgacagatctcaatagttttacaaatgatgtccttgaggcaaatggtcctccttcagcgatcgtgcttgatacaagctcgctgtacattctgtagactgttagcatgtccaagaaaattagagaaatctgtgggaagaagtgtggtccaagggagctcgcaacacttgtgtttgtctgtaggatgttgagaactgatctgataacatcttggttcttcaagatatcaatgctttggcttgcctgtccaattatttctgcccacttctgattaggaaggctcatcaatctcttgagatattcatctctcttagtgttgtcagattcagcttgaatcatatggccaaccggtcccgtgggcgtatgaatctgatgtggctcaagatcggcgatggttgtagcaaggttggacagaagttcagaaacaaatggttcattctcgcccacctggagaaaatatgcaaatgtgaaaatcaaaacctggcaaagatctaaggaggattatttatatgtaagaatttgagactagcgaaacaaattttgtaggtcatgatgggtaagttgaaccaaccccgcaagagttcacttttaaaacaacaaaaaaagaaatatcaactacaagcatatagacctctgggaaaaccctcgcgcccgccggcgcgggcgcaaacttgcgcttgcatttttgaacaattttcaggaaggtatcacatgccatatcctgccacaagccacagcacatatcacacatggtattcattgaagacattattgaaaacgctgacttaagtgaatatgcaaatggaggcccaaatacaaaagggtaagagaggcatcaagccatcaactaccaaataaggtcaaggtacaaacaaaaggatgagaaatgacttgttaaaccacatactcaaacaagaaatgatggccatgcattcgagaaaaacaaaaagatgaccagactacataaacaataaaaagatgcatctttgccaactcaaagaatacaaaggcaaaactgacctgaactccaggatgcatctcatgcatgaactcaaacaatttgttgaccacagttttcaaaaacttccaatgagccctgagaaatcttggatactgaccaacaacatacctaacaattacatcacaaatcagcaaattataataaataaaataatcatatacatgtgataaatggaagataaatgctttattacataatgttacttgcaatcacagctttattgtcctttccctttgtgatttcacagaggtttagcaaatcacgaataaccataaccagaaatctattctcctgcaacatacccatgagatgaaattagaattccagtacactacatccaacattagctgcgaaaggncctctagcgtgtaatggttaaggcttccgagtagcaccctccaggtcccgggttcgatccccctcaggggcgaatttcaggcttggttaaaaaatcccctcgttgtgccccgcccgctcccgggttacgtcctgcgcgccaccctccatctggcccgcctgcagagtgggcggtgatggcccgctagtgatgggggggtcagggcttttctcggacaggaccatgttttggtcactggaagggcggtctttccctccccggccgagtttttacatccaacattagctaaggattgatacttccataattgtttctcagaagcaagagaagggtcagaacaacatacaaacctgctcctctaccatagaacctgatattgatccaatagcccaacagagagtattaaggttattccaactccagtcttctccatttaattgcttgcttagtttcttcaacatctgaaattccaaagtaaactatcctaagtgctgggtaaattcacaaacggcaataatagaacaagaactgctattcactatggccttcatcacagttacattgaatcaggccttctaaccataaaagtacaagctacaacgtaagcaccataaaccacttctgaaattaactaactgttacaagcttcattcatttagtattattttctgagcaagttaagcatacagtactattaattacattttgttcttaaacacaagtatccgtgaacacacctgttgttctgtgtcctcgtgatcaagatgggataaatagatcagtgtttccctcatgatctgatatcatccaaaataatggcaatttcaacatcagacagaaggttacaaagcttataaagcaaaaggcatatgaattgcagggcggtacgaaattaggcaatccttttactaaccttgtactgaacaagaacgtcgttgtctttcattgtctcgcgtacaatattgccgttttcgtcttcaacaataagtacttcctcaggctttgccatacggcaaatcatcagcatccgtagtttcgagagtgggccagagtaaagctgtctcctctgtttaacagctgtgcccccatctaccattccaggaaccatctgcgcctacagcatggttttaataaaattcaaagtcagaacaaaacactaagtagagacatcgaactaagaaaaaaaaagatcccaaagaaaggcagtctacataggagcaactaaaactatcataaaacccaaatgggaaaggacgctgaagaaacgtcacaacaatgtatgataagtagaaagtcattattcgtttattaaggcaatgttccaaaagttaaataaaagcacctgaagccccatcatgcttacagttactgcag

SEQ ID NO: 19480 - DNA, 3984 bp, Zea mays
  misc_feature (1336)..(1340): n is a, c, g, or t
  misc_feature (1433)..(1437): n is a, c, g, or t
  misc_feature (1455)..(1459): n is a, c, g, or t
  misc_feature (1502)..(1507): n is a, c, g, or t
  misc_feature (1663)..(1669): n is a, c, g, or t
  misc_feature (1814)..(1839): n is a, c, g, or t
  misc_feature (1852)..(1856): n is a, c, g, or t
  misc_feature (1955)..(1985): n is a, c, g, or t
  misc_feature (2004)..(2010): n is a, c, g, or t
  misc_feature (2905)..(2905): n is a, c, g, or t
cagtacataaatgtttgtgttctgtactgcagctttgatagaagtatagttgccatagatggggtatcgaactactgccaagcatatttgcggactacatacgagaattattacgcatcagcagttagttgtgtacatgaaaataaataaaccatgcgctcccctctttatcttgcttgtcaaataccactacgcgtgtggacgtcaaagacagacgggcaggggtggtcccatccatcgtctctctcccacttgccaaccagtagctaaagctgctctgaatccaacaaggaaactgccccctcgtttacataatcagcacagaacaaattactacatttatatatgtaatctccgcaccagagtgctaacaaaagaacatagttttttctccatacacagccaagccaaacctacccttgttgatgagacagcaaatctacacattgaggaatgcaccaaagaaaaagaaaaaaaaaggcgtatgagatatctcacagaatagtacactacagacatagtaacaaggttcctaccagcctgcctggatacataaatcgctattccatctattaacttaaaccaaagaagcatacaatgatgtaccacaatataatatatgatgggcaaagtacacgcaccaatgttagcaaagtacaccgagcacaagagccgctgctaacacatccaggcaaccacagctgctgagagacccccagcagcagtcatgcggcaaaactgactgtctactaccacaaatcttggaatcagcatcatgtggaggtaaccaaaaataaaattacagcaggcaccttctttcaccaccctggaagaaaacttggacgtcgagggctccagaggtattccgatgccggaccaacaaacaggaagctacattagagagctgaatcaacaaggaacactacgaatctaccatctcgtcttgcaactcgctaggggcaatgagccccggaatggcaagcatacgttggcgctccctctctctttgggcagcagcctcttccgcgtatagatccttgttatcctgaactgagaactccttggactgcaccaggaagtctctaatatggtttttgaagcttggaagatcaagttttgaactaagaagaccatctacaaactttgtcacctcggttactgtcatgttaggaaatgatgtccctaagagctttatggtgtaatctcgaacaaacatagcattatccgtatattggtaaggtaccgaagacgcgtccccgcgaggctccgttagaccatcaaccgccctatacgcaaatccaacaattagaggaacaaataaaatgaagggttaccnnnnnaagtgatataagcataccgcacaaaacaagtgttgtagcaccgaaacatgaagcttgaaaccaggtttatggaatgtgtctgtgaggactgcnnnnntctcttgctcaattgtcnnnnngtaggttttgtagaattggttttggaatcctgaagcctggaannnnnncaagatctccaacaacaggctaaggccagtctctgcaatatttctctctgtatgtctgaacgcccaattaattgaatcgatcacaagcttcaattgctgacttgaaagctggattaatgcttggaagcaatgggtgccaattgcacgaagcaaagnnnnnnntttgaggcggtgctcaggataatcttcaaagttcttagtaatcatctcaagggtgcactggaaaacagcctcaaatatacgaggcacatcctcaagcatttcccctttgtacctgcaggaaagaattaacctttcgaattgatgnnnnnnnnnnnnnnnnnnnnnnnnnnccacgaatgcagnnnnnttttaaccgttataattgatgcaaagatgcaattaatgagaaatagccaagaatggaaatacatgaattcaattgtggctctagacatccgacgtgacnnnnnnnnnnnnnnnnnnnnnnnnnnnnnnnaggtgcagcttcgtttggnnnnnnntcggcatgtgaccatggtacagaatgaacaaagaacaggcatactatacttgttaatgattgttgcaaacaaggacagaacttcagactcccttgcatcgggtacatttctagcataatcaccaagaacaggatccatcattggtggtacaaactgctttcctatatgtggcaaatcttccgccttgtccacaaaagtctcgatcaactttagggtttccctcttgacagatctcaatagttttacaaatgatgtccttgaggcaaatggtcctccttcagcgatcgtgcttgatacaagctcgctgtacattctgtagactgttagcatgtccaagaaaattagtgaaatctgtgggaagaagtgtggcccaagtgagctcgcaacacttgtgtttgtctgtagaatgttgagaactgatcggataacatcttggttcttcaggatatcaatactttggcttgcctgtccgattatttctgcccacttctggttaggaaggctcatcaatctcttgaggtattcatccctattagtgttgtcagattcagcttggatcatatggccaactgattcgtaaaacgtatgaatctgatgtggctcaagatcggcgatggttgtagcaaggttggacagaagttcagaaacaaatggttcattctcgcccacctgttgtgtcacaaacttgcgcttgcatttttgaacaattttcaggaaggtatcacatgccatatcctgaactccaggatgcatctcatgcatgaactcaaacaatttgttgaccacagttttcaaaaacttccaatgagccctgagaaatcttggatactgaccaacaacatacataatgttacttgcaatcacagctttattgtcctttccctttgtgatttcnacagaggtttagcaaatcacgaataaccataaccagaattctattctcctgctcctctaccatagaacctgatattgatccaatagcccatcacagagtattaaggttattccaactccagtcttctccatttaatcgcttgcttagtttcttcaacatctgctgttctgtgtcctcgtgaccaagatgggataaatagatcagtgtttccctcatgatcttggtactgaacaagaacgtcgttgtctttcattgtctcgcggccgaatattgccgttttcgtcttcaccaataagtacttcctcaggctttgccatacggcaaatcatcagcatccgtagtttcgagagtggcccagagtaaagctgtctcctctgtttaacagctgtgcccccatctaccattccaggaaccatctgcgcctgaagccccatcatgcttacagttactgcaggttccatttgattgtgtgcttcaaatagctctaatacaaatacattccagtaatccaaggacaccttaaaaacctctgtatcgtcaacatatgaaattccaataaggtactcgagacccataagcaaagcagcaatattttcttgagttgtttccagtatacgcatgtgattcttaaaaaatgatgtgaagaagagtgcaagattttgtataaacgcctgctcttcagtggaaccattagcatatacgtccgggattttttcaggaggaagaatagcctgcaactgaataatgaaaaatgtatatgtcttcacatactgcacattataaaaatcaccaaactgaagtgctgcaacctctgttaggcattgaagtgtaagattccgataagcagccatagggaagaacttcagtaatgtctccagcaacggtgactcaaagatgaatccaactgggatccatgataagaaagcatggagtgtcgccaatgtagcacggatgagctgtggcctttgcgttgcagataagacatacaagcatagctcatgaatgagccggaattcactattaagtgcagaaaacagttctttgatcctttgttgtgtcatttcacctcttgagaagtc

SEQ ID NO: 19481 - DNA, 1774 bp, Zea mays
ccggccgggattgcaccagtacgtacgtgtactgatgatacacctatagggttcttcaattcatcagttgggttgattctttcttcgtcaaggcccctcaagggtgacggagatggcattttcacaataaatcaacttaaagaacgtgcatgcaggggtgcgacgcgtcggttctccttgacccgacgccggcgaacccggagacagagaagacggcccggccccaacgtctccgtgaagggctacgacgtgatcgaggagatcaagacggagctggagaagaagtgcccgaacgtggtgtcgtgcgcggacatcatctcggtgagcgcccgcgactcggtgaagctgacgggcgggcccgagtacgcggtgcccctgggacggcgcgactcgctcgtgtccaaccgcgaggacgccgacaacctgccgggcccggacatcgcggtgcccaagctcatcgacgagttcgacaagcagggcttcaacgtcgaggagatggtcgcgatgctgggcggcggccacagcatcggcgtctgcaggtgcttcttcatcgagaccgacgcggcgcccatcgaccccaagtacaagaagacgatcagcgacgcgtgcgacggcaaggactcgggctccgtccccatggactccacctcgcccaacgacctggacgggagctacttcggcctggtgctggagaagaagatgccgctcaccatcgaccgcctgatggggatggacaagaagacggagcccatagtgaaggccatgtccgacaagaccaccgacttcgtcccgctcttcgccaaggccatggagaagctcagcgtgctcaaggtgctcacggggaaggaaggcgagatcaggaagacgtgctccgagttcaacaacccgcagaacagcagcggcagcacgtcggtgatacggatcagctccatcgaccccgaccagatggccggcctgtcgcagccagggtcgacgtccaggaaggtgggcggccgcgcggatgtcagcactcccgccgcggtggaaacgcccgccatggcggccactgaggcggccgccaaggttcctggcggggtggtcgtcagcgtcggcgaccaggataggtccggctccggctccggcccgaagctccgcggcagcggggtacctgtagtgaacccggtcccggcggcgcccggcggcgccgaggaagctgccaagcagcaggaggtgacggacctattcggcacgaggagaggggaacatggccaagctccgcgcccccggtcaggccaagctgtagatggatcatcggagtaggtgttccggccttcgggctgccactgccactgtgccaggccgcgccgtttcgctgtgcgcgtgctcctctcatcatcttgtcacccaagtcatttttttttctcactgtctctttcgtttgtgcaagaagggacgagcaaagtacctaccgcagcggattactaaattgtctaattacgcagttgtcgtgtcgagtttactaaagatgaccacaggtaccttcttggtgtccccggtcggtcaggagaagtcctgtcgaggcatgctcaagtttagtatatcgcttttgcttaataattgtctgcgtgcaaaactacgtgagaatgtggtgatgaatcgttaatgtaataaagtatctaaatttgacattatttcatacatgtgtttgaatatcttggatactttgttttgttatacaaaatataattgggcgcgaaaaaaaaaaaaaaaaaaaaaaaaaaaaaaaaaaaaaaaa

SEQ ID NO: 19482 - DNA, 1182 bp, Zea mays
ttttgggtcgctcccgctacctcccctctccatctctgcgtgatggacgcccgcctcgtcttcctcctcctcctcgccgccgcggcgtccgcgccgctggcctccgcgcagctctcggcggatttctacaagacgtcgtgccccgacgccgagaagatcatcttcgacgtcgtccagaagcggttcaaagctgaccccggcaccgccgccggcctcctccgcctcgtcttccacgactgcttcgcaaatggctgcgacgcgtccatcctgatcgacccgatgtcgaaccaggcctccgagaaggaggccggccccaacgtctccgtgaagggctacgacgtgatcgaggagatcaagacggagctggagaagaagtgcccgaacgtggtgtcgtgcgcggacatcatctcggtgagcgcccgcgactcggtgaagctgacgggcgggcccgagtacgcggtgcccctggggcggcgcgactcgctcgtgtccaaccgcgaggacgccgacaacctgccgggcccggacatcgcggtgcccaagctcatcgacgagttcgacaagcagggcttcaacgtcgaggagatggtcgcgatgctgggcggcggccacagcatcggcgtctgcaggtgcttcttcatcgagaccgacgcggcgcccatcgaccccaagtacaagaagacgatcagcgacgcgtgcgacggcaaggactcgggctccgtccccatggactccacctcgcccaacgacctggacgggagctacttcggcctggtgctggagaagaagatgccgctcaccatcgaccgcctgatggggatggacaagaagacggagcccatagtgaaggccatgtcggacaagaccaccgacttcgtcccgatcttcgccaaggccatggagaagctcagcgtgctcaaggtgctcacggggaaggaaggcgagatcaggaagacgtgctccgagttcaacaacccgcagaacagcagcggcagcacgtcggtgatacggatcagctccatcgaccccgaccagatggccgggctgtcgcagccagggtcgtcgtccaggaaggtgggccctcctcccgtcgaggaggaaacacccgccatggtggcgaccgaggcggccgccaaggttccgggtggtgtggtcgtcagcgtcggaggaggacagcagccg

SEQ ID NO: 19483 - DNA, 1145 bp, Zea mays
actcgtgggtcgatgcaagccgcaccgaccccctccctcatctctgcgcgcgtgatggacgcccgtctccgcctcggcttcttcctcctcctcgtggccgcggcgttcgcgccgctggtctccgcgcagctctctgcagatttctacaagacgtcgtgccccgacgccgagaagatcatcttgggcgtcgtcgagaagcggttcaaggcggaccccggcaccgccgccggcctcctccgcctcgtcttccacgactgcttcgcaaacggctgcgacgcgtccatcttgatcgaccccatgtcgaaccaggcctccgagaaggaggcgggccccaacatctccgtcaagggctacgacgtgatcgaggagatcaagacggagctggagaaggagtgccccaacgtggtgtcgtgcgcggacatcatctcggtgagcgcccgcgactcggtgaagctgtcgggagggcccgaatacgcggtgctccttgggcggcgcgactcgctcgtgtccaaccgcgaggacgccgacaacctgccgggcccggacatcgcggtgcccaagctcatcgacgagttcgacaagcagggcttcaacacggaggagatgatcgcgatgctgggcggcggccacagcatcggcgtctgcaggtgcttcttcatcgagaccgacgccgcgcccatcgacgaggcgttcaagaaagacgatcagcgacgcctgcgacggcaaggactcgggctccgtccccatggactccacctcgcccaacgacctggacgggagctacttcggcctggtgctggagaagaagatgcccctcaccatcgaccgcctgctggggatggacaagacgaccgagcccatagtcaaggccatgtcggacaagaccaccgacttcgtccccatcttcgccaaggccatggagaagctcagcgccctcaaggtgctcacggggaaggacggcgagatcaggaagacgtgctccgagttcaacaacccgcagaacaccagcggcagcacgtcggtgatacggatcagctccatcgaccccgaccagatggccggcctgtcgcagccagggtcgtcgccccggccggtgggcggccgcctcccgtcgagaaaaaataaaccgccatggtggagaccga

SEQ ID NO: 19484 - DNA, 739 bp, Zea mays
agctccatcgacgccgaccagaggccggcctgtcgcagccagggtcgacgtccaggaaggtgggcggccgcgcggatgtcagcactcccgccgcggtggaaacgcccgccatggcggccactgaggcggccgccaaggttcctggcggggtggtcgtcagcgccggagaccaggataggtccggctccggcccgaagctccgcggcagcgggggacctgtagtgaacccggtcccggcggcgcccggcggcgccgaggaagctgccaagcagcaggaggtgacggacctggaggagaagaagaagaggaacatggccaagctccgcgcccccggtcaggccaagctgtagatggatcatcggagtaggtgttccggccttcgggctgccactgccactgtgccaggccgcgccgtttcgctgtgcgcgtgctcctctcatcatcttgtcacccaagtcatttttttttctcactgtctctttcgtttgtgcaagaagggacgagcaaagtacctaccgcagcggattactaaattgtctaattacgcagttgtcgtgtcgagtttactaaagatgaccacaggtaccttcttggtgtccccggtcggtcaggagaagtcctgtcgaggcatgctcaagtttagtatatcgcttttgcttaataattgtctgcgtgcaaaactacgtgagaatgtggtgatgaatcgttaatgtaataaagtatctaaatttgacattaa

SEQ ID NO: 19485 - DNA, 2565 bp, Zea mays
acaaataaaaagaaacggagggagtatctattacattaatgcatgatgcactgcatctactagctctagtgccacatgcgctatatctaacagccattcctttgctaagtgccccggccggctatgaataatcccagcgacattcgtgtgcatcctcctgttgtagtggaggaggctcgcgacaaggcggccccggccacgggagtacgggacgatggaaaaccccctgccccttcctattattacaccgcgagagagagccgctcgtcgcgttccaggcgtgtccaccgctccgcctctctcggaggctgacgaccggcggtataagcatggcccggacgagccctagcatcgcaccgagcccttctctcatctctgcgtgcagcgtgcgtgatggacgcctgtctccgcctcggcttcttcctcctcctcgtggccgcggcgttcgcgccgctggtctccgcgcagctctcggcagatttctacaagacgtcgtgccccgacgccgagaagatcatcttgggcgtcgtcgagaagcggttcaaggcggaccccggcacggccgccggcctcctccgcctcgtcttccacgactgcttcgcaaacgtacgtaaacgacttgctagccgtcgtcgactcgtcgtacgcgcgttgcttagtggtagcatgcaatgcatgcagcgcgtgactgtattgtgcgcggctccgcccacggctgcgacgcgtccatcctgatcgaccccatgtcgaaccaggcctccgagaaggaggccgggccccaacgtctccgtcaagggctacgacgtgatcgaggagatcaagacggagctggagaaggagtgccccaacgtggtgtcgtgcgcggacatcatctcggtgagcgcccgcgactcggtgaagctgtcgggagggcccgaatacgcggtgctcctggggcggcgcgactcgctcgtgtccaaccgcgaggacgccgacaacctgccgggcccggacatcgcggtgcccaagctcatcgacgagttcgacaagcagggcttcaacacggaggagatgatcgcgatgctgggcggcggccacagcatcggcgtctgcaggtgcttcttcatcgagaccgacgccgcgcccatcgacgaggcgttcaagaagaagatcagcgacgcctgcgacggcaaggactcgggctccgtccccatggactccacctcgcccaacgacatggacgggagctacttcggcctggtgctggagaagaagatgcccctcaccatcgaccgcctgctggggatggacaagacgaccgagcccatagtgaaggccatgtcggacaagactaccgacttcgtccccatcttcgccaaggccatggagaagctcagcgccctcaaggttctcacggggaaggacggcgagatcaggaagacgtgctccgagttcaacaacccgcagaacaccagcggcagcacgtcggtgatacggatcagctccatcgacgccgaccagatggccggcctgtcgcagccagggtcgacgtccaggaaggtgggcggccgcgcggatgtcagcactcccaccgcggtggaaacgcccgccatggcggccactgaggcggccgccaaggttcctggcggggtggtcgtcagcgccggagaccaggataggtccggctccggcccgaagctccgcggcagcgggggacctgtagtgaacccggtcccggcggcgcccggcggcgccgaggaagctgccaagcagcaggaggtgacggacctggaggagaagaagaagaggaacatggccaagctccgcggcgccggtcaggccaagcagtagatggatcatcggagtaggtgttcgggccttcggggtgccactgccactgtgccaggccgcgcgcgccgtttcgctgtgcgcgtgctcctctcgtcatcttgtcgcccaagtcatattttttttctctctctctctgtccctttcgtttgtgcaagaagggacgagcaaagtacctaccgcagcggattactaaattgtctaattacgcaattgtcgtgtcgagtttactaaagatgaccacaggtaccttcttggtgtccccggtcggtcaggagaagtcctgtggaggcatgctcaagtttagtatatcgcttttgcttaataattgtctgcgtgcaaaactacgtgaggatgtggtaatgaatcgttaatgtaataaagtatttaaatttgacattatttcaaaaaaaaaaaaaaaaaactggggggggggccggggttatacaaaattgggtgggacattatttctcggctggagctctcctaggtcgacaactccttgcactttgatcgagctctcaggcccccaaggcccgaacgaagctgactcaaacaggaatttagaggtgtttgaatgcatagagataatagttagtatctaaaattagttagagatattcaaacaccctagctaatagtttagctattagctatttttagtaaattagctactagttggctaactatttgttagctagctaattctactagtgataacttcaacttaagacccta

SEQ ID NO: 19486 - DNA, 1933 bp, Zea mays
aacgcctcgccctcaagagtgagtgtgagaccagtcggcaccgtcctccactcccaaatttgttgccttgaggcggcggccggcgggagagagcagctctagagagaacagagagcgcataactagcggcggcggcgatgaggatagaggaggtgcaatcgacctcgaagaagcagcgcatcgccacccacactcacatcaagggcctcggcctcgacgccaatggaatgtcgatgccgttggcggcggggttcgtgggccaggcggcggcgcgcgaggcggccgggctggcggtcgacatgatccgccagaagaagatggccggtcgcgcgctgctccttgcgggcccgcccgccacgggcaaaacggcgctagcgctcggcatagcgcaggagctcggcagcaaggtcccattctgtcctatggtaggatcagaagtgtactcctcagaggtcaagaaaactgaggtgctgatggaaaatttccgtagagctataggtttgcgtataaaggaaaacaaagaggtttatgaaggagaggttattgaactttccccagaagaggctgagagcacaactggtggatatgcgaaaagcattagccacgtaatcattggcttaaagactgtcaaagggactaagcaattgaaattagacccttcaatttatgatgctttgatcaaggaaaaggtggcagtgggtgatgttatatacattgaagcaaatagtggagcagtgaaaagagttggtagatgtgattcttttgctacagaatatgatcttgaagctgaagagtatgttcctatccccaaaggtgaagtccataagaaaaaggaaatagtgcaggatgtcacactccatgaccttgatgcagcaaatgctcagccacaaggtggccaagatattttgtcccttatgggccagatgatgaagccacggaagactgaaatcaccgaaaagctacgccaagaaatcaataaggtggtaaacagatatatcgacgaaggaatcgcagagcttgtacctggtgttttgttcattgatgaggtccacatgttggatattgaatgcttttcttatcttaaccgtgcattggagagcccattatcaccaattgtgatactcgctacgaatagaggaatatgtaatgtgagaggaaccgatatgacgagtccacatggtataccagtggaccttctagataggttggtgattattcggacagaaacatatggccctactgagatgatacagatactggctatccgagcacaagtggaagagattgatatcgatgaagaaagtcttgcttatttaggcgagatcggacagcagacatctttgagacatgctattcagttgctatcacctgccagcgtggtcgcaaagaccaacgggagagaaaagatgtgcaaggctgacctcgaggaagtcagcgggctctatttggatgccaaatcctcggctcgcctgctccaggagcaacaagaaagatacatcacctagacttgcatctcctgctgtggaaggaaaagcctcgaagagaaatgcattctgcaaagtgcgtcgatctgcttcagtatgtcgtagtctacaagtcttggagagagcacgtttctgcggggaaggaaaactgtttgaattttgtagtacctgttttttgttagcctccagcgaagacttgattccggcatattgcttgttcacgcaccgttaacaccgattaagattggcccagccgtgcaggaattgccgggtgtgttttcaccccctcgctaatcgatgtccagaatctgtgtgcccacgggtgttgtattgaccctagctttgtaaccatgcacatgatttcttttttaacgctgatggatggcacctggatctctgtccatggccatcgtaatcccactgtctggagcagggtttcatgaaaaaaa

SEQ ID NO: 19487 - DNA, 1873 bp, Zea mays
cgttgctgtcggggaatttacgaggcaccaaacaaaaaaactgggacatacattatgtggggtacatataagtagcaaaaataaacggaaatatataagaaacaaatacaaaactcctattaatttcacatctatctgacgcgcaccatgagcgaatgaaacctacagtcgcttgaggagcatggggagcccatgccttgggcgcagggtgatcaagtccatgggcgcgtggacgtatttcggggacagctccagtgcaaacctctgcaggatcatggcgaccacggcctttgcctcgatcatggcgaagttctggccgatgcacgaccttggcccgctggagaaggacagcagcgcgttggggtgcttggccgccctcgtcaccccgttctcgaacctctccggcctgaactcgccggcgtcctcgccccagacctccttgtcgcggtggatcgtggcgatcggaatggtcaggatcgcgccctcgggtacccggatgccgccgaggtcgagatctgagcccgccttcctctggatcagggacaccgggccgtacagccgcagggtctccaggaggaacatgttgacaagcttcagcctgttgagcgcgtcgccggtggggacctcgtcgtcgccgcactcccgccggacctcgtcccggagcctgtgctgccactccgggtgcgtgctcagcaggaaggaggcccaggtgagcaggtgcgacgtggtgtcgtggccggcgaagaagaaggtcttgcactcgtcgacgatctcgtccatgctcagcgtcgtcggcgccgtctcgccatggtgctccggtggcggcgcgcacgcctccagcatgagcccgagcaggtcgttcccgtagccgccggcggtgtccttgctggcgaggcgggcctcgatgatgtccatgagcatggccctcacctgcctgtccagcttccgtgtcctgagattcttctcggtcgggaggtacttgagagctgggatctggacgttgaaaatggtcgagaaggcgcttggcggccggcttcctcgccgccaggaagagccgctacccctcgctgtagctgctgccgaacgcggtgcgggagatgacatcccccgtgagggcctggagctccggccagacgtccagctcgcacgagccgccgtcgggacccaggcaccgcgccgcccatctgccgacaagctcttcgcagcatgcagagaacgtaggcagcatgagctgcaatgcaatgcaatgcaaaggtcacatacacactctagccagcgatcaaccacagaccaaattgtacagaccacgtaccctgagcttctcgagatggaacgcagggttgaggatcctcctgtgcctaacccatttctcgccctcgtggctggtgagcccgtcggagagcagcttcgtcagggccgggaactggggcttcccgaagtggccgaacttgttggagagcacgtccctgaccagcgccgggtcggtgatggtcacgttggggatcggcccgaaccaagagaagcacgtcttgccgtgctcccggacgttgccgcagaggaacggcgtgacgcggggcacgatgtcgtggcaccccaggggcagcggcggcctggcccaagcctccttgttgaggcggccgaactccctcagatcgcccgtcaggaagcggtacgaggtgccgcggagaccctgcgcgcgcagagcccgctccagccgccgaggctcccgccatagcctgctcagcagccgcccgccctgccaaagcaggacgaggccagggacaccgtacaccagcaggctgcgtgctgctggtgccgacgtggtcaccgcggcgaacagagctcccagaaacattgctgcaggcatgcaagc

SEQ ID NO: 19488 - DNA, 1864 bp, Zea mays
tcccatacaacttcccacaggagacccgtggcgcggcgtctcccatcccccgcccccaaatttgttgcggcgggagagccggagaggaggcagctccacagaaacagagagcgcataaccggcggcgttggcggcgatgaggatcgaggaggtgcagtcgacctcgaagaagcagcgcatcgccacccacacccacatcaagggactcggcctcgacgccaatgggatggcgattgcgttggcggcggggttcgtgggccaggcggcggcgcgcgaggcggccgggctggcggtcgacatgattcgccagaagaagatggccggccgcgcggtgctccttgcgggtccgcccgccacgggcaagacggcgctagcgctcggcatagcccaggagctcggcagcaaggtccctttctgccctatggtaggatcagaagtgtactcctcggaggtcaagaaaactgaggtgctgatggaaaatttccgtagagctataggtttgcgtataaaggaaaacaaagaggtttatgaaggagaggttactgaactttccccagaagaggctgagagtacaactggtggatatgcaaaaagcattagccatgtaatcatcagcttaaagactgttaaagggactaagcaactgaagttagattcttcaatttatgatgctctgatcaaggaaaaggtggcagtgggtgatgttatatacattgaagcaaatagtggagcagtgaaaagagttggtagatgtgattcttttgctacagaatacgatcttgaagctgaagagtatgttcctatccccaaaggtgaagtccataagaaaaaagaaattgtgcaggatgtcacacttcatgaccttgatgcagcaaatgctcagccacaaggtggccaagatattttgtcccttatgggccagatgatgaaaccacgaaagactgaaatcaccgaaaaactacgccaagaaattaataaggtggtaaatagatatatcgatgaaggaattgcagagcttgtacctggtgttttattcattgacgaggtccacatgttggatatcgaatgtttttcttatcttaaccgtgcattggagagcccattatcaccaattgtgatacttgctacgaataggggaatatgtaatgtaagaggaactgatatgacaagtccacatggtataccagtggatcttctagataggttggtgattattcggacagagacatatggccctactgagatgatacagatattggctatccgagcacaagtggaggacattgatatggatgaagaaagtcttgcttatttaggcgagatcggacagcagacatctttgagacatgctattcaattgatatcacctgccagcgtggtctcaaagactaatggaagagagaaaatctgcaaggctgatctcgaggaagtcagtgggctctatttggatgccaaatcctcggctcggctgctccaggagcaacaagaaagatacatcacctagatttggatcacctgtcgtggaagtctcgaagagaatgtagttgccagctcgaaagtcatctagtgaattgatctgcttcacaggtcttggagcgagcacatttcgggggggacggcttgaattttgcagtgcctgcttgtgttagtctccagagaagacttggtacctcggccgcgaccacgctagcactgttcgctgattagattggtcaccggtgcaggaattgccgtgtgtgttttttatcttgctcatcggtgtccggaatctgtgcctccacgggttgtattggcccgaaccctatctttgtaaccatggataatggatagcattcttacagaatgcaacttgcatggctttatt

SEQ ID NO: 19489 - DNA, 833 bp, Zea mays
ccgtccgggagagcccattatcaccaatcgtgatacttgctacaaataggggaatatgtaatgtaagaggatctgatatgacaagtccacatggtataccggtggatcttctagataggctggtgattattcggacagagacatatggccctactgagatgatacagatattggctatccgagcacaagtggaggagattgatatggatgaagaaagtcttgcttatttaggcgagatcggacagcagacatctttgagacatgctattcaattgatatcacctgccagcgtggtctcaaagactaatggaagagagaaaatctgcaaggctgatctcgaggaagtcagtgggctctatttggatgccaaatcctcggctcggctgctccaggagcaacaagaaagatacatcacctagatttggatctcctgtcgtggaagtctcgaagagaatgtagttgccagctcgaaagtcatctagtgcattgatctgcttcacaggttcatagtctactggtcttggagcgagcacatttcggggggaacggcttgaattttgcagtgcctgcttgtgttagtctccagagaagacttggttccggcatattgctcgttcacgcactgttcgctgattagattggtcaccggtgcaggaattgccgtgtgtgtttttatcttgctcatcggtgtccggagtctgcctccacgggttgtattggcccgaaccctatctttgtaaccatggataatggataggattcttacagaatgcaacttgcatggctttattatttctaaatgtccataaagcataacgaaatgtttctacaac

SEQ ID NO: 19490 - DNA, 653 bp, Zea mays
tactgagatgatacagatattggctatccgagcacaagtggaggacattgatatggatgaagaaagtcttgcttatttaggcgagatcggacagcagacatctttgaagacatgctattcaattgatatcacctgccagcgtggtctcaaagactactggaagagagaaaatctgcaaggctgatctcgaggaagtaagtgggctctatttggatgccaaatcctcggctcggctgctccaggagcaacaagaaagatacatcacctagatttggatcacctgtcgtggaagtctcgaagagaatgtagttgccagctcgaaagtcatctagtgaattgatctgcttcacaggtcttggagcgagcacatttcgggggggacggcttgaattttgcagtgcctgcttgtgttagtctccagagaagacttggtaccggcatattgcctgttcacgcactgttcgctgattagattggtcaccggtgcaggaattgccgtgtgtgttttttatcttgctcatcggtgtccggaatctgtgcctccacgggttgtattggcccgaaccctatctttgtaaccatggataatggatagcattcttacagaatgcaacttgcatggctttattaaaaaaaaaaaaaaaaaagcggcc

SEQ ID NO: 19491 - DNA, 2962 bp, Zea mays
  misc_feature (487)..(511): n is a, c, g, or t
  misc_feature (2774)..(2795): n is a, c, g, or t
  misc_feature (2884)..(2888): n is a, c, g, or t
ccacgcgtccgccgcctcccagatccgcctggccgtcctcctcgtccgccacgcccgcggtgatccctcgccgccccgcccttgataccgtcgagaggatcgtcgaggacttcgccatggacctcgccatcaatcccttctcctccggtacccgcctccgggacatgatacgtgcgatacgcgcgtgcttgacggcagcagaggagcgcgccgtggtgcggcgggagtgcgcggcgatacgggccgctatcagcgagggcgaccaggactaccggcatcggaacatggccaagctcatgttcatccacatgctcggctaccccacacacttcggccagatggagtgcctcaaacttattgctgccgcaggcttccccgagaagcgcatcggctatctaggactcatgctgctgctcgacgagcggcaggaggtcctcatgctcgtcaccaactctctcaagcagtatccaccctgtctgcacttaannnnnnnnnnnnnnnnnnnnnnnnngttgtttctgattgtaattacttaacgtgggcagagatcttaaccactcaaaccagttcattgttggtcttgcactctgtgcccttggcaatatatgttctgctgaaatggcgcgtgatcttgctcctgaagtggagcggctgttacaaaatagggaccctaatacaaagaagaaggccgctttatgctctgtgaggattgtacgaaaagttccagacttggcagaaattttcatgagtgccgccacatcattactgaaggaaaaacatcacggtgttctgatatctgctgttcagctttgcatggagctatgtaatgccagccatgaagcattggagtacttgaggaagaattgccctgaaggactggtccgaatactgagagatgtatccaacagttcatatgctcctgaatacgacattggtggcatcacagatccattcttacatatccgagtgcttaaactcatgcggatactgggccaaggagatgccggttgcagcgagtatatcaatgacattcttgctcaggtttcaacgaaaaccgagtcaaataagaatgctggaaatgctattttatatgaatgtgtggagacaataatgagcattgaagctacaagtggtttacgtgtgttggcaattaatattttgggccggtttttgtccaaccgcgataacaacataagatatgttgccctaaacatgcttatgaaggccattgccgtagacacacaagcggtgcagaggcacagggcaacaatattagagtgtgtcaaggatgcagatgtttctattcgtaaaagggccctggaacttgtttacctacttgtcaacgatacaaatgtaaagccattgactaaggaacttgttgattaccttgaagtgagtgatcaagatttcaaggaagacctcactgctaagatatgctcaatagttgaaaagttttccctggacaggctatggtacttagaccagatgttcagagttttatctctggctggtaatcatgtgaaggatgatgtatggcatgctcttatagttctagtgagtaatgcatctgttcggcacggggattcagtcaggtcattatataaggcattgcaagcatctagtgaacaggaaagtttagttagggtggctgtttggtgcatcggtgaatatggagaaatgctggtcaacaatcttagtatgttggacatggaggaaccaattacggttgctgaatctgatgctgtggatgccgtagaggctgctcttcagcgctactctgcagatgttactactagggctatgtgtcttgtctctcttttgaagctttcctcccggtttccaccaacatcagggaggataaaagaaatagttgcgcaaaataaagggaatactgtgcttgaattgcagcaaagatctattgaattcagttccattatacaaagacatcaatcgatgaaatcatctttgcttgaacggatgcctgtattggatgaagctaattatttggtgaagagagctgcttctatacaggctgcagttccatctgtaaattctgctccagcaatcacttctggaggcccatttaagcttcctaatggtgttggaaagcctgcagctcctttagcggatttgcttgatttgagttctgatgatgctccagtgactacctcggcccctacaacagcacctaatgattttctacaggatctgttgggcattggcttgactgattcgtctcctataggcggagctccgtctacaagcactgacattctgatggatcttctatctattggttcatcttctgtacaaaatggaccaccaacggcaaactttagccttcctggcatagagactaaatctgtcgctgttacacctcaagttgtggatcttcttgatggtttgtcctcaggcacatctcttcctgatgagaacgcaacctaccccacaatcacagcattccagagtgcaactttgaggatcacattcagtttcaaaaaacaacctggaaaacctcaggagactacaattagtgcttctttcacaaatttagcaaccactgcattcacagatttcgtcttccaggcagctgtgccaaagttcatccagttgcgtttggacccagcgagcagcagcactcttcctgccagtggaaatgggtcagttacacaaagcctcagtgtcaccaacaaccagcatggccagaaaccacttgcaatgcgtatccggatgtcttacaaagtgaatggtgaggacaggctggaacaagggcnnnnnnnnnnnnnnnnnnnnnngttgtagggccacctgtgtctatagggtttgggttgctctttcagacttatgcttgcctgctagtgagttgtgtacactggtagttggnnnnnggccgtccattatctctttatatatatagtgtacagtagatgacagcgattaatgatatatcctcagttttgcc

SEQ ID NO: 19492 - DNA, 4498 bp, Zea mays
aaatgaatggtaaaaacaggctggaacaagggcaaaacagcaactttccttgtgggttgtagtgccacctgtgtataaggggttggggttgctctttcagcgtgcaacaagcaaggggtttgaattcttgttattaaacattttcacttttgggggccggaaaatgagttgtggaccctggtagttggttttggtcgcccattctctttttatatatagtgcacagtagatggcagcgattaatgatatatcccaccaaaattttcaatcttaggctatctccagcagcctccttgttcttctcacttcttatttcaaactccactcttgtaaacagtatcgcctacagtacaaaacagtgttttgccccctcgtttgcatggactgttggagttggccttatgctcccatacacagaaggaatgtgttgtatcgcgattttcctgatgtaattatttatttttctaatcaagctcgtacaggcttattgtgcacagacaaattaattgtttttcatgtgcgttcctttaggttcagacatatttggaataccagactcccccaattcttgccaaaaaataggcagttatcaaatattttcatatggtcccatggtttttaagtttgacttagaaagtttcagataatttggtctcatttgatggtcctcaactttatctggatgtgcggaaagcacgatctgttgcccactcgagtgcttcgtggtgcgttgtcagccatttgcgctgcgcatccttgatggtcaacgtcagactgattgcacgagtgcagtgtgacaacatcagcacaattctgtagtggtacttgtttccactgctccagacatctagtagtaacagtacccagaagcagttaccgtcacctcatttgtcacccatgtttgtttcaggcatgtctgcatctgcatgccagaagagtttggttgattggttcattcgaattcacccctccctctgcttctaagaaaaatcccgttggcgacccaactttgaaacttcctgttcctgctttccacttctcttctacaagtattaaatgcagtttagtactactagtactgacgccctgtttggtgctgccactgccagttaattagcacgggccaaacatgacaaagcctaaagcatcttcatcccgttaattcatgacacgatcgcacaaccaatttgcctagctgtgtcaacacagtggagcggtgctaatcgctgagccgtgcaacgggcacaatgaatgcgccatcacattgaaggtcagcagtacttgctgtctgcttaatacccggatacggacacataaccgcacatgcggctgcagtcaggagcgggggggctaggctagacgataaacacgcccatccatcgctctcggggcgattcagagacgctacagtccaagtagcaaaccctggacgtgtctgattaagttttttcttaattttttttacccgttcctgcagccggtttcctaaccagatctctgtagcttttactgttggtgtaggtcgcctgcagaatccgcgaacaattcacggaaaccagccggcagccagtcatgaaaaaaaagctctcctgtaacatcacattactacttgccctgcctgcagcgtcagtcaatcctattaaagctgctttcattcgtcattacggtgacctaattttcggcgcttactaacttccatggctctgggaaaatggagtggttgggctggaactggaacgagtcctgtgctgtaaatttccttccttcctcctctatttccagagaagggcctgcaagtgtacggtcccttcttgttcacaagtccttgtgatggcttgagcattgagcaacagtacttgttgtcaaaacaataatccgccattaaaacgaatactggtgcgaaacagtgccctcgcgaaataaaatttaagagtgtgacctagaagacaaaaaataacgcggagcacggattggtacctcgagtttgcgagggcaatttcgtctctgtactaaccttggcttgtagtaacacttatcacttccccaagttcatttttgtctgtataatattgtcagcaaagacgctggcgaatggcaaatgatggaatggctaattccagattgggatgctctgttgaacacacaagtttcatcttcctcatgcacctagaaagccaggatcaccaccaccacaagcaggcaagcaagcaaatgagatttattattactagtaagataagataaacaacgaatgcctatgaaccaattcatcatcagcggttaaaagggcgagcagacaagctcaatacaagtttggagcacgcaccaccacacacgctttctctgtgtcacgacacgattcacgaatccccgggacttggcctctgccacggcagcctgccgttcatggccggcgagtcatcggacgcgagcacgggaagcttctccttgccgttccgcggccactgccaaatcttggacaccgagaagctgtcgcctttgctgcccgcgccgatcctcttcccctctgtggcgccggcgcggttggagcccacgccgacgccgacgcctctgagacccgccccgcccctgccatggccgtcgccgtgcctcctgtggacggacacctggaggctcgcctcggcgaggacgtactggtaggagcccatggagtagcaccgcctggcgtccaggctgctgctgctcgtctcgccggcctccctggtcacaatgccggcgccggcgcgcacggggccaggcgccgccctggccaggttcttgaacttgccgaggcgcacggggagcacggcgtcctcgtgctcccacatgccttcctcgtcgaacagcgcggcagcgtcggcgccgagcgcgcaccggcacagcgggcacgtggagttggagagcagccaggtgtcgatgcagccgatgtggaacgcgtgcccgcacagcggcagcagccgcagccggtcctcgccggcgaactcgcacaggcagaccgcgcagtcgaacggctccttggcgccggcgccggcgccgaccacctcccggtacaggaacaccgggagcgcgtcgatgacgtcctggtccagcccggcgtcgtgcaggtggaacagctgctgcagctgcctctgcaacgcggactcctccccgccgccgcccgccgcgtccgccccaccgccggcgccggcaccggcctcggcccccgcgcgcgcacgggcacgggcacggccgcgcctgagcaagagcctgaccaagagatgcagcaggcaggagacgaacagcaccacggccgctatcaccacggcgaacagcacggcggggctaatcttggaaccaagaccatgaccgcccccggaggacgacgccccgccgccgtcctgcttctcggcttccccggcgacggcgaggacgcagcagcccgtggctaatcctagcagcaacatctctccctcctccttctccctgtcgcccgatctgccgcgggcagcgcgctgctcatttcgtgcactaaacctgaacgccttttgagctgagcagagcctgagcagctagtagtggtagcttctcggttgcctgcaacttgcaggaggcggggcaagggtccaagacattaggcgatgagggaaaggccaagaggcaagagcaaaagtgcgtgaggagcccatgcttatatgcaattgggggagacacaaacacacggccactgcaagcaaccaaaccaaagctacaaaagcagcagggcatacgtggctcttcttttgcgagctgcacctgcaaaggtaaatctcgttctttttctatcgacgtttcgcactaaaccaaactttgacttttgagtaccaccgatcaaaaccaaatccaaatcctttgtactatacatatcagcttgcgacatttctagacctaataacaaaattttgtagggcatagctgaccaaaaaacataataagggtacatgtgagcacaccaccaaaactacgggcaccaattttaaaaactcaaatttgtatcaataaaatagtcctcaaacaaaacgaaaatgtagaatctacatacatagcagtgtttttcatgtcaaggaagccggattctctgtctggcatcaaagtgagaaaagaaggaaggaacaaagattgcgatctctgggcaaggttggtactgcgtttttcttccatcacgcatttgggcttccacttccactcagcttttagaacctggcgatgctgcagttagaaggccgttttctcgcgaaaaagaaaggtgcgtgctgcaaggcacccgggccggctgggataagcaccagctttgcgctcttgttctctcctcctcgtcctcggtccctcgtgcgaggaaaggcaaaaaaaacgaaggaatgctcggggaggcaccgggcaaaaagtgggaaaatggtggccggggccgatggcgatttctgtggaacgtcgtcgcttgggccggtggaggtggggggtggatgagattcgttgaagctttcag

SEQ ID NO: 19493 - DNA, 1468 bp, Zea mays
  misc_feature (1467)..(1467): n is a, c, g, or t
tgcagcccctttagcggatttgcttgatttgagttctgatgatgctccagtgactacctcggcccctacaacagcacctaatgattttctacaggatctgttgggcattggcttgactgattcgtctcctataggtcttacactaagctattttgctttcttattgatttgcttctgctgcttgttggtttgctcacgcaaagcacgtcatgctttatcattatgtttattatttcttggcacatgacacagtacacatttggttttattttatgccactaatgcaacatgcttatttctgaacacatactccaagtttggtattaacttatgccagtagtgcataccttgttgttctataaataggattaaacatggtcgagtgcatcttgtttcagacggttaacatctgttgattatacatttatgctctggttgcagcgacattcttagttgaaatgttgcttatgagtttggtctggtcttgtgtctaggcggagctccgtcgccggccgcggccagtctgatggatcttctatctattggttcatcttctgtacaaaatggaccaccaacggcaaactttagccttcctggcataggtatgtctgtatagacaatctgtttttttagtttctgtcatttctgctttttttatctgacaccatgctgcagagactaaatctgtcgctgttacacctcaagttgtggatcttcttgatggtttgtcctcaggcacatctcttcctgatgagaacgcaacctaccccacaatcacagcattccagagtgcaactttgaggatcacattcagtttcaaaaaacaacctggaaaaccacaggagactgcaattagtgcttctttcacaaatttagcaaccactacattcacagatttcgtcttccaggcagctgtgccaaagttcatccagttgcgtttggacccagcgagcagcagcactcttcctgccagtggaaatgggtcagttacacaaagcctcagtgtcaccaacaaccagcatggccagaaaccacttgcaatgcgtatccggatgtcttacaaagtgaatggtgaggacaggctggaacaagggcaaatcagcaactttcctgctgggttgtagggccacctgtgtctatagggtttgggttgctctttcagacttatgcttgcctgctagtgagttgtgtacactggtagttggtttttggccgtccattatctctttatatatatagtgtacagtagatggcagcgattaatgatatatcctcagttttgccgaaatgtatttttatcttggtgcatatcggacttcagggtaaccaaaattttcacccttttccccgcgtaccaagcaccaaaggaatgtgttgtaccatgatattccccaatgtaattatttatttttctaatcattgtacaagcttattgtgcagacaaattatttgtttttcgcggccctnt

SEQ ID NO: 19494 - DNA, 1723 bp, Zea mays
  misc_feature (9)..(9): n is a, c, g, or t
  misc_feature (1719)..(1721): n is a, c, g, or t
aaaacccgnccgaccgacgcgtccggaaaggttttccctggactttctatggtacctagaccacacgttcacagttttgtctctaagtggtaattatgtaaaggatgatgtatggcatgctcttatagttctaatgagtaatgcatctgaacttcaaggatattcaatcacgtcattatataaggcatcccagcgtccgggtgaaccaggaagtttagttagggtggccatttggtgcattggtgaatatggagaaatgctggtcaacaatcttagtatgttagacatggaggaaccgatcacggtaactgaatctgatgctgtggatgccgtagagattgctcttcagcgttactcggcggatgttactaccagggctatgtgtcttgtctctcttttgaagctttcttcccggtttccaccaacatcagagagaataaaagaaatagttgcgcaaaataaagggaatactgtgcttgaattgcagcaaagatctattgaattcagttccattatacaaagacatcagtcgataaaatcatctttgcttgaacgtatgcctgcattggatgaagcaaattatttggtgaagagagctgcttctacacaggctgcagtttcatctgtaaattctgctcctgcagtcacttctggaggcccacttaagcttccaaatggcgtagcaaagccaccaccagctcctttagctgatttgcttgatttgggttctgatgatgctccagtgactacttcggcccctactacatcacctaatgattttctacaggatctgttgggcatcggtttgactgattcgtctcctataggtggagctccgtctacaagcactgacattctgatggatcttctatctattggttcatctcctgtacaaaatggcccaccaacgtcaaactttagccttcctggcatagagattaaacctccccctgttacacctcaagttgtggatcttcttgatggtttgtcctcaagcacatctcttcctgatgagaatgcagcttacccgacaatcacagcattccagagtgcaaccttgaggatcacattcagtttcaaaaagcaacctggaaaacctcaggagactacaattaatgcttctttcacaaatttagcaactactgcattaacagatttcgtcttccaggcagccgtgccaaagttcatccagttgcgtttggacccagctagcagcagcactcttcctgccagtggaaatgtgtcagtcacacaaagcctcagtgtcactaacaaccagcatgggcagaaaccacttgcaatgcgtatccggatgtcttacaaagtgaatggtgaagacaggctggagcaagggcaaatcagcaactttccttctgggttgtagtgccacctgtgtctatggggttggggttgctctttcagcgtgctacaggcaaggcgtttgtattcttgttcttgaacattttcacttctgcttgcctgctaatgagttgtgtacactggtagttggttttggtcgcccattctctctttatatatagtgtacagtagatggcagcgattaatgatatatcctaccaaaattttcaatcttaggctatctccagcagcctccttgttcttctcacttcttatttcaaactccactcttgtaaacattcttatttcaaactccactcttgtaaacagtatcgcctacagtacaaaacagtgtttggnnnaa

SEQ ID NO: 19495 - DNA, 1428 bp, Zea mays
ctgcagttgtttggagtgaaacaaaagactgatgcagctttgctctaattaactatactgaccatgtgcatagggccggccataggcggcatcgaacacagtttacacctcgtaatctccatccatcctcgcttagttaacatcccaggcagctccactactgtgctggactccagaaatgggaggctccgacgaccacgcccgcaggaagccgtccctgccatggacggtgcgcgtccagctggccgcgctcgccctggtgcaccgccgggacggcagcgtccggcgcctcctcttctccctcggcgacctcaagtcgggcaccacgtctcgcccgggtgcctcgggggtgcgctccgcggacgtcaccatcgacgcctcccgcggcctgtgggcgcgcgtcttctccccctcgtccggcgcggacgcggacgcggacgccgcggcggcccccgttcccgtcgtcgtctacttccacggcggcgggttcgtgctcttctccgcggcgtcccgcccctacgacgccttctgccggcggctctgccgcggcctccgcgccgtcgtcgtgtccgtcaactaccgcctggcccccgggcaccggttccccgcggcgtacgacgacggcgtcgcggcgctccgctacctcgacgccaacgccgactccctgccggcgcacgtccccgtcgacctctccagctgcttcctcgccggagacagcgcgggcggcaacatcacgcaccacgtggcacagcgatgggcggtggccgcggcgtcgcccacgaacctccgcgtcgccggcgccgtcttgatccagccgttcttcggcggggaggagcggacggcggccgaggtggcgctggacggggcgtccgcgctgtcggtggcggcgacggaccacttctggaaggagttcctgccggagggcgccacacgggaccacgaggccgcgcgcgtgtgcggcgagggcgtcaagctcgccgacgcgttcccgcccgcgatggtggtggtcggcggcttcgacctgctcaaggactggcaggccaggtacgtggaggcgctgcgcgggaaggggaagccggtgtgggtggtcgagtaccctgacgccgtccatggcttccacgtgttcccggagctcaccgactccggcaagttcgttgaggagatgaagctgttcgtcctagagcacaagtccaccaacaccaagcgtgccgtctagtctacactctacagatatagatatggtaggcacacggtccctgtcatcaggtttacatgacattttggtgaagaactcgtgcaaaattggatccacgcttggtggcaagacccactttatttgttccttctcaattaaaacgagctattgagtctcattaataactctctcttcatatttcggatggagagaaagtaaaataagagttttca

SEQ ID NO: 19496 - DNA, 2707 bp, Zea mays
gcacgagaccattacctagaacatcctaatcgaaaaccatggagaaaactcgttgagcagattccttgttcctgcagtaaccctgtccaacccccgcagcggcggcaaccacagaaacactgcctgtaaattccattcctccgcgttcggcctccctcatcgcgcgaccgttccctctgctcgaatcggcaagcccgcatttcgagccccggaggtggccgcgaaccctaaccctacagcgaggcgtcgccggagttgtgggggctccgttggccatgtcgatggactcggacagctcgtcgcacagcggcgccgactacaggagtttccgccagatcacccgagaccgtttgttagttgaaatgctgagatcgactcgaaagagctcaaaatcatcatggaaggttctaatcatggacaaacttactgtcaagataatgtcattttcatgcaagatggcagatatcacagaagaaggggtttcattggttgaagacctatacaaacggaggcagccattgccttcaatggatgcaatttattttatgcagcctactaaagaaaatgttgacatattcatgtcggacatgtcaggaaaaaattcattgtacaagaaagcttatgtatttttcagttctcctgtacagagggagttggtagctcatataaaaaaggattcgactgtgctaacacgcatcagtgcacttagtgagatgaacttagaatactttgctattgacagtcagggcttcataactgaccatgacaaggccttggaggagttgtttagtgaagatgcagaaggctcacacaagtacaatgcatgccttaacacaatggctacaagaattgctacagtgtttgcatcattgagggaatttcctcgtgtgcactatcgtgtagccaggacaatcgatgcatctactctgacgacactacgagatttggtcccaacaaagcttgctgcttccctgtggaattcccttgtcagatttaagtcaacgatacctgaatttccacaaacagaaacatgtgaactacttattgttgaccggtcaatagatcagattgcaccaattattcatgagtggacgtatgatgctatgtgccatgatctattgtgtatggatggcaacaagtacgtgcaagaggttccaagtaagaatggttcagcaaatgagaaaaaggaggttttgttggaggatcatgatccagtatggcttgagctgcggcatgcacatatagctcatgttaatgaaacgctacatgaaaagatgaccagttttgtatcaaagaacaaagcagctcaactacagcaggcaagatctggtggagagttatctaccaagcagttgcagaaaatggttcaagctcttccacaatacagtgatcaaattgacaagctcacccttcatgttgagattgcaggaaaactcaataacataatcaaagaacaccaccttaaagatgttggacagctagagcaagatcttgtgtttggtgatgctgggacaaaagaactaatcagtttcttacgaacccgcatggatgtaagtcgtgaaaataagctgcgtttgctgatgatttatgcttccataaacccagagaaatttttcgaaagtgagaaaggtgcaaagctgatgcagcttgcaggattatctgctgatgatatgattgtagtaaataatatgcgctgcttacgtggagctgattctaagaagtcttcagttggggcttttactttgaaatttgatcttcagaagaaaaagcctggtatcaggaaggagcggactggagaagagtcaacatggatgctatctcgattttatcccatcctggaggacttgattgagaaacttagtaagggtgagctaccaaaagatgagtaccactgcatgaatgatcctagtcctagtttccgtggaattccagggagcacatctgctcgaacgagcccagctcatcagccagcccaatccatgagatctagacgaataggtggcacatgggctagacctcggaactccgatgatggttattcgagtgactctgtactgaagcatgcatcaagtgacttcagaaagttgggccagcgcctatttatctttgtaattggaggtgctactcggtctgagttgcgtgttgcccataagctgtcaggcaaactgaagagagaaattatccttggctcctctagtcttgatgacccaccgcagttcatcactaaactgaagatgttatcaaccgaggaactgtcgcttgatgatttgcaaatataacaattccaaggacgattgtccgtggcattctacactgtaattatttatttatttgcatctctacaacgggtttagttttactcccttaaccgaaccacaggtgctcttacacaggctagaggggcatgatattcattcggtagccaatgtcagttacaatcgagtgtacacacatggcagcgaccagagactgtaatataggtggcgtctttattagattggtggatcagtgaagttcaatgttccgaggacttctatttgtcctcagattgctgctattttgtggggaaagtgtatattttttcctcaaaccggtaaaaaaaattcgtgtaataataacaacaaaaagaagagctagagtaagaacaaaaatagtaataataccagtagcaataatgataataatataagagcaatgaatttacaac

SEQ ID NO: 19497 - DNA, 5485 bp, Zea mays
tgctcttaagccgaaacggtttcccatagtctgctgccatttcctcgtggacgcacgcacgctgccaaggaagcacaccaacaaaacctagcgcgtacgtgcgtgcctgagccccgatgtgccttgtgtcgtggctggtggagcggtggtgagtgctgtcgcagcaaccgtgcccccagccccaccccgtcggtctcctggcacccgcccgcggcgtccggcattcccgggcggccgttcaccccccgctgcggcctccggccccctccggccctcccttctcgcgcccttcctatttcaggatcgctatactactatggccgcgaacacgtagcccttggtctctccccttcccccgttcgctgtcccgacaggtcctccccactcctggagccccggtctaccctccccgtacgcatgcatgtcgacatgtcccaccgcgtccggctcgccgcggcggcgctcgtcgtggtcgccgctctggcgcttgcccccggcgccgcggcggcgtggcagctgacgaagaacggcaccgtggtcagctacgaccgccgctcgctcatcatcgacggccgccgggagatcttcttctccgggtccatccactacccgcggagcccgccggacatgtggccggagctcatcgccaaggccaaggagggcgggctcaacaccatcgagacctatatcttctggaacatccacgagcccgagaagggtcaggtaataaggatcgaagaatgagaatgcgcgctcatggcgatcgatgaaacgcccgatccattattccatccttcaaccgcgttccttaattttcttgcgcgcagttcgacttcgaggggcggtacgacattgtgaggttcttcaagctgatccaggagcacaacatgtacgccatggtccggctcgggcccttcatccaggcagaatggaaccatgggtttgttcgtgtgcctttaacatctcttccttcaattcagttgctctaattagcatttgatacgatcttccaaagttgtctttccatttccttctttcttattccttattattgtttctgtaccaattctttatcagagggctgccctactggctaagggagatccctgacattgtgttcaggacaaacaacgagccatataaggtgatcacaatctatctgatgaccaaaaccactaattgtgcacgcggacgttttgcgatacgtacaagtcaccagatgttgacgatctgtgacctgttgattccgtttacgcagatgcacatggagacgtttgtaaagatcataataaaaaggctcaaggatgccaaccttttcgcgtcacaaggagggcccattattctagcacaggttagacagtcaaaactgttgcggcagcctcttgttttgaggttttctcctttccaacgaattatctgttcccaaatctgcctgccagattgagaatgagtaccagcatttggaagcggcgttcaaaaatgatggcaccaagtacattaagtgggcagcaaatatggccatctccaccaacgtcggcataccatggatcatgtgcaagcagaccaaagctcctagtgatgtggtaactttcattttttctgaccgaataataaatacatatgctgtggttccctcttcaacaaactggggttaatcttgacaggcttagcattcagatgacattcagagtttcagaataacaatgttcagtagttgttataccacatcgttaaaacgtcaaatgatagccttttcgtcttattccatccgtttcagatcataattctttttaacctttttctaagtcaaaacatattaaggtcgaccaaaattataactaaaatcacaatgatttataatgtcaaatagatatgctacgaaaaagtaactaatgaataatctaacgatacttatttggtataataaatattactcactccgttgtaaattaaaattcattttaataaattaatagattcatatacttgatgcatgtgtatttgttttttatatacgtgtcatcagtatccattttaatatatacataaaaattaagagatagaactaatactgtttttggacgaggaaagtactgttttattaaataatatggtcaaagataaattattttaacttataatttgaaaccgcaaggagggagtacttcgaaaatacacatgcaatgatatgctgggctcttttcttttgttttcttttcttcttgtgtagattcctacctgcaatgggaggaactgtggagatacatggccaggtccaatgaacaagagcatgcccctcttgtggactgagaactggacagcacagtaagtcccttcttcctgcaacagtaatccattaacttgcctttgttcaactagatagatcactgtccatataccacttcgtcgcagaaaccttcatcgcaaaccaatcatttccttggtgtgtgcaaacaggtacagagtattcggtgacccaccatcccagcgttctgctgaggacattgcatttgccgtggcgcgcttcttctccgtgggcggtactatgacaaactactacatggtactcagctgtagtatatatgaagcgaaataccaaaaagaaagctccattacacattttaggaagtgagactgttgtcgctgaaccgcacggtttacattgcatatgcttgtttgaaactctgaacagtaccatggtggaacaaactttggaaggacatctgctgcctttgtgatgccaaaatactacgacgaggcacctctcgatgaattcggtgagactacggcatcgacagcagccgatcgcgttgctgctagtcgggaactttatttgcattccgtctctgttgttgatggactatatattcaggtctgtacaaggagcctaagtggggccatctgagggacctgcccctggcgctgaagctgtgcaagaaggccctgctctgggggaagacatcgacggagaagctgggcatgcagttcgaggcgagggtgttcgagatcccggagcagaaggtgtgcgtggcgttcctctccaaccacaacaccaaggacgacgtgacgctgacgttccggggccagtcctacttcgtgccgcgccactccatcagcatcctcgccgactgcaagaccgtcgtcttcggcacccagcacgtgaacgcgcagcacaaccagaggacgttccacttcgcggaccagacgacgcagaacaacgtgtggcagatgttcgacgaggagaaggtgcccaagtacaagcagtccaagatcaggctgcgcaaggccggcgatctctacaacctcaccaaggacaagaccgactacgtctggtacacctccaggtgcggttgctgcttgcttcaaaacttcaagttgataagtggtgtcatgtatgtgtgggtgatctgagcgtggacgacacatacctgcctgcctctgtgtggcaacagcttcaagttggaggcggacgacatgccgatccgccgcgacatcaagacggtgctcgaggtcaacagccacgggcacgccagcgtggcgtttgtgaacaccaaattcgtaggtaataggacttgatcttcagactgccatggatgaggagatagaaagaagcttaatgaatgtgtgtgtgtgtgcaggatgtgggcacgggaccaagatgaacaaggcgttcacgctcgagaagcccatggacctgaaaaagggcgtgaaccacgtcgccgtcttggcgtcgacgatgggaatgatggtgggtgtggaccctattagataggttcatatgtgcatcggagagcattgccgttcttggttgaaatcaggctacaatgggttcagaatatagcagctgattggttgggcgaacgcccatagcctgcctcaggggagcatggcccgcgggaaacgaagcatttgagcgtatccgtgcatgcgggctaaagagatatttttagctaagatgggatctgctgatgcagtttggtctcgctttatgcagctaaccaaacaaaggctgtcttttagtcaacgcatgtgttgagactggatagatgtgcgcacgataccaatcagaaggataatgtatacaatgggttgtttcaggacagtggcgcttacctggagcaccgtctggccggcgtcgacagggtgcagatcaagggcctcaacgcgggcacgctggacctgacgaataacggctggggccacatcgtcggcctcgtcggcgagcagaagcagatctacaccgataagggcatgggcagcgtcacatggaagccagccgtgaacgacaggccgctcacctggtacaaggtaaactagctcatcagtcatcacgaattcacgacacgacaccagtagtgaataatcccagctactaggctgattcaagtgttgccgtgttggtgtgtgcttctgctcgttgtgtgtgtgtgctgtcagaggcacttcgacatgccgtcgggagaggacccgatcgtgctggatatgagcacaatgggcaagggcttgatgttcgtcaacggccagggcatcggccgctactggatctcctacaagcacgccctcggccggccatcgcagcagctgtaagctcttactagtaatttgctgtaattcttagtttttgtcgattatatatatacataatatgatgatatgcaggtaccatattccacggtccttcttgcggcagaaggacaacgtgctggtgctgttcgaggaggagttcgggcggccggatgcgatcatgatcctgacggtgaagcgcgacaacatctgcactttcatctcggagaggaacccggcgcacatcaagtcgtgggagcgcaaggacagccagatcacggtgaccgccgccgacctcaagccccgggccacgctgacgtgctctcccaagaagctcatccagcaggtggtgttcgcgagctacggcaaccccatgggcatctgcggcaactacaccatcggcagctgccacacgccgcgcgccaaggagctggtggagaaggcctgcctcggcaagcgcatctgcacgctgcccgtgtccgccgacgtctacggcggcgacgtcaactgccctggcaccaccgccacgctcgccgtgcaggccaagtgctccaagaggtcgcccagagccgcgcagtaattcggtagtcgtcggcttcggcctcggcttgctacctcccgtcgtctttcattcttcattgctgatgctgctgctgtaccatgggaccattatctgaccggagacgtcgattcggatttcggacccatccatgcgtggctgggtggggaaacagattgtcggtactgtcactgtatgctttattatacacaaatatattatctataggaatagattgttaatttgatgagcaaacatatatgcagatatcaatttggtgattaataatggcaataatatatagcctagtggcctaactgacaaaaaaaaaaaaaaaaaaaaaaagaaaaaaaaaaaaaaaaa

SEQ ID NO: 19498 - DNA, 2149 bp, Zea mays
cagaccaaagctcctagtgatgtgattcctacctgcaatgggaggaactgtggagatacatggccaggtccaatgaacaagagcatgcccctcttgtggactgagaactggacagcacagtacagagtattcggtgacccaccatcccagcgttctgctgaggacattgcatttgccgtggcgcgcttcttctccgtgggcggtactatgacaaactactacatgtaccatggtggaacaaactttggaaggacatctgctgcctttgtgatgccaaaatactacgacgaggcacctctcgatgacccccgcctccgcccgcgcccccggtggggccatctgagggacctgcacctggcgctgaagctgtgcaagaaggccctgctctgggggaagacatcgacggagaagctgggcaagcagttcgaggcgagggtgttcgagatcccggagcagaaggtgtgcgtggcgttcctctccaaccacaacaccaaggacgacgtgacgctgacgttccggggccagtcctacttcgtgccgcgccactccatcagcatcctcgccgactgcaagaccgtcgtcttcggcacccagcacgtgaacgcgcagcacaaccagaggacgttccacttcgcggaccagacgacgcagaacaacgtgtggcagatgttcgacgaggagaaggtgcccaagtacaagcagtccaagatcaggctgcgcaaggccggcgatctctacaacctcaccaaggacaagaccgactacgtctggtacacctccagcttcaagttggaggcggacgacatgccgatccgccgcgacatcaagacggtgctcgaggtcaacagccacgggcacgccagcgtggcgtttgtgaacaccaaattcgtaggatgtgggcacgggaccaagatgaacaaggcgttcacgctcgagaagcccatggacctgaaaaagggcgtgaaccacgtcgccgtcttggcgtcgacgatgggaatgatggacagtggcgcttacctggagcaccgtctggccggcgtcgacagggtgcagatcaagggcctcaacgcgggcacgctggacctgacgaataacggctggggccacatcgtcggcctcgtcggcgagcagaagcagatctacaccgataagggcatgggcagcgtcacatggaagccagccgtgaacgacaggccgctcacctggtacaagaggcacttcgacatgccgtcgggagaggacccgatcgtgctggatatgagcacaatgggcaagggcttgatgttcgtcaacggccagggcatcggccgctactggatctcctacaagcacgccctcggccggccatcgcagcagctgtaccatattccacggtccttcttgcggcagaaggacaacgtgctggtgctgttcgaggaggagttcgggcggccggatgcgatcatgatcctgacggtgaagcgcgacaacatctgcactttcatctcggagaggaacccggcgcacatcaagtcgtgggagcgcaaggacagccagatcacggtgaccgccgccgacctcaagccccgggccacgctgacgtgctctcccaagaagctcatccagcaggtggtgttcgcgagctacggcaaccccatgggcatctgcggcaactacaccatcggcagctgccacacgccgcgcgccaaggagctggtggagaaggcctgcctcggcaagcgcatctgcacgctgcccgtgtccgccgacgtctacggcggcgacgtcaactgccctggcaccaccgccacgctcgccgtgcaggccaagtgctccaagaggtcgcccagagccgcgcagtaattcggtagtcgtcggcttcggcctcggcttgctacctcccgtcgtctttcattcttcattgctgatgctgctgctgtaccatgggaccattatctgaccggagacgtcgattcggatttcggacccatccatgcgtggctgggtggggaaacagattgtcggtactgtcactgtatgctttattatacacaaatatattatctataggaatagattgttaatttgatgagcaaacatatatgcagatatcaatttggtgatttaataatgccaataatatataccctagtgccctaactgacagatt

SEQ ID NO: 19499 - DNA, 1173 bp, Zea mays
tccggtgggcacgggaccaagatgaacaaggcgttcacttctcgagattcccatggacctgaagaagggcgtgaaccgcgtcgccggcttggcatcgtcgatgggaatgacggacagtggcgcttacatggagcaccgtctggccggcgtggacagggtgcagatcacgggcctgaacgcgggcacgctggacctgacgaataacggctggggccacatcgtcggcctcgtcggcgagaggaagcagatctacaccggcaagggcatgggcagcgtcacctggaagccggccatgaacgacaggccgctcacctggtacaagaggcacttcgacatgccgtcgggagaggacccggtcgtgctggacatgagcacgatgggcaagggcatgatgttcgtcaacggccagggcatcggccgctactggatctcctacaagcacgccctcggccggccatcgcagcagctttaccacgtgccccggtccttcctgcggcagaaggacaacatgctggtgctgttcgaggaggagttcgggcggccggacgcgatcatgatcctgacggtgaagcgcgacaacatctgcaccttcatctcggagcggaacccggcgcacatcatgtcgtgggagcgcaaggacagccagatcacggcgaaggcgaacgccgacgacctcagggcccgggcggcgctggcgtgcccgcccaagaagctcatccagcaggtggtgttcgcgagctacggaaaccccgcgggcatctgcggcaactacaccgtcggcagctgccacacgccgcgcgccaaggaggtggtggagaaggcgtgcctcggcaagcgcgtctgcacgctgcccgtggccgccgacgtctacggcggcgacgccaactgctccggcaccaccgccacgctcgccgtgcaggccaagtgctccaagaggtcgcccagcgcggcgcagtaattcagtcgctcgtcgggacatcctattcgtggctgggcggggaacacattgtcggtactgtcattgtaagctaaaaaaaccctatattgtactcgtggctgggcggggagcatctaaccatatatttatagattgttcattttagtgaaaaaaaaaaaaaaaaatttgcggccaaaaaaaaaaaaaaaaaaaaaaaaaaaaaacaaaaaaaaaaa

SEQ ID NO: 19500 - DNA, 5108 bp, Zea mays
ccctatgaggccatgtacaaccttatttaatactccattttttaataggtctttaaggggttaaatataaaaaatataagagacatactcttcactaagacctgtctcagcatgcctctccatgtataatatttcttaaaagcatttatgatgtgattgattttaaagacacaacattgtataatgtagtttttgaaatgtctcttatgcataaaaaatagatcagcatgctctaagttgttcgtggcctgaaccttttgcagtagggtttttttaaccttgtccaccacctcctattgtccaaccttcttgatacgtgggcttcattaattcctcgggagaagttatagtacgtcgaaaactgcggtgagtagcaatcttccggttgactagctacttctggcaacgaaacagaacgatcgatcgaccatcatttgcattgaataatcttttggaacatggaatcccaaagctttgaatttctaacattccttttttatcactgacgagtgcgagtgtacattgtacaacatgtgtttttcttctgacaacgcgcggtactagtatagtgatagtggtagcaatacgtacatcaaacaaattaaaccaaacatgaaagttagggtagaccttgggaggcgttgagaacggctacttatctgcagatactggaacaacgctctagagtaagagtagagtccagatagtagtgttgcagactgatgaagcccaccaccaccttcgaattcgaagcaaacctccagaaccagaaaaatgccggcgagggcagtgacaatcccgacggcggtacctgggtggtgctccagccgtcccggatagtctacatcgtcatgatctccaccgccttctgggcctttgtcttatactactacatgcaaaatggcgacggcggcgtggcgtccgtcctgttcaagccgtctgcgttctcgctccccctgctgcccagcatcaccggggcccagagcccgcgacccgtgcaacccgagcagaagcacgccggaccgggacaggcgcccccgccgccggtgctggccgatcgctgccacgggcggtacgtctacatgtacgaccttccgccgcgcttcaacgacgacctcgtccgcaactgcaggaacctccagatctggatggatatgtgcccgtacgtggtcaactgcggcatgggcccggcgatgggcgacgaggggggcgccttctccggccgcggctggttcgccaccgaccagttctcgctcgacatcatcttccacggccggatgaagcgctacgactgcctcaccgacgacccgtcccgcgccgccgccgtgtacgtgccgttctacgccagcctggacggcgggcggtaccagtggaacagcacgtcgatccgggacgcgctcggcctggacctcgtcgactggctggcgcggcggccggagtggcgcgccatgggcggccgcgaccacttcttggtggctggccggaccgcggtggacttcggccggaactccgacctcgaccacgagtggggcaccaagctcctcaacttcccggccgtcgagaacatgacggcgctggtcctggagaccaaccagtggaagcccaagaagcggcgcaatttggctgtcccctacccgacgtacttccaccccgagtcggcggccgacgtggtcgcctggcaggagaaggtgcgcaacaccgagcgcaactggctcttctccttcgccggcgggccgcgcccagggaacaccgagaccgtccgcgccgacatcatccagcagtgcgccgcgtccacccgctgcagactcttccactgcggcgccggccccgacgccggcgccaactgcagctcgccgggcggcgtcatgcgcgtgttcgagagctcggtcttctgcctccagccgcgcggggacacgctgacgcggcggtccacgttcgacaccatgctggccggctgcatccccgtcttcttccacccgggctcagcgtacaggcagtacacggcccacctccccaaggacccaaatagctactctgtgctcatcatgcacaccgatgtcaccggccggaacgtcagcatcgaggacacgctgagcaacatctcgccggcggcggtgaaagccatgcgcgaggaggtcatccggctcatcccgaggttggtttacgctgacccgagatcgaggcgtgtcgatttcactgatgcgttcgacttggcgacggaggcggtcatcaaccgcgtggccaagcggcggcgcggcgtggtcggtagacaggactagtaacgccgccacgatgcgatcttgtgaccaacacagcccgtgagttttagtttgttgctgattgcaatttcacatagctatggcaaaattcattgatttccaaaaaaaaaaaaaaaactccctgcattttaaattataagacgttttagacattttagattcataacttacactacccaaataaataaataatatatctaaatatatataaaactctaacagtagcaacatattttataatctatagatgccagcgaaggcaatctggtgatacttgtgacctcaaaaaactagaaagagcacaagaattttagtcttttagacatcaaagctatgtaattggtcattgcaaatgtcaaataccccatcggcggtttagtttaaaaatacggtttagtttaaaaataaattaatggacgataaataaatattcggaaacggagccagcaggaggaacttggtacatgaagtgggggagccaaacgattgaggtaaaatacttccaggggagtaaaccaacatgggtgtgaaccggaacgccggcccatccattttgtaatgatctttgacctattttttgtattttgtttcttgcttgtttcttttttcaaaaaaattatcttgttccttgattcttaattttatctaagagaaacggataaaaatatttctaaaatataagatattttgtttttaaatacaatatttaaatataaaatacataaacatattgtatatctaaagatatatattacaaagataaaaatatcttctaattttaaaaattagaagcaaatatttttagagtgttttcaaatttgcttccaagatttgtagcttgtgttcttgatttggtgttctttttaattctagaacttctactttcttgatttttttatttatcctatactttacgtgtccaaattttaagatgatttcagggaaattattgtacaaatgtaagtatattattactgttgtgatttgttatttgctttatattataacatatattttttttgtcattgtcggactataaaaataattgtgaattgctagttttatttttgccaacacaaatcaatttttatcagattcatgaatttgtttaacggaacttttattcttgagactaaaaactgcagattatgactctagaaattggaacaaactaaaacaattttttaatataaaatccatgcaatggtggagctagagggctcgttggcaggagtcgccccctaactagagatgaaagtggatacacgaattgttcgaacaaattatatattatcgagcacgcattattacaaataagaataaaatttagtataaattgttttatacattatttgctcactacaacaaaaaagatgaaaacaatatcttaatatgtatccagattttatatctattatttgagaaaacatatgaaaaaattgaggcttagttgttataaatctttacaagctcaatgcttaaaataagaatacgaattggcatagcaagttctatatcctatttatttgcaattaaagaaaaagcctcaaaaaaatgatatccaaataagtatatgttttcatccctacccctaacataccacaataattttgttactagtatatagttctataatttttatttatattaatagaaacaatatagcaaaaaaatgttgtcatatatatacctattaatatcttctaggtaatatgatcaatcaccttataagcatatccaaaagaccgagctatctgaaatttcaagagtcaccataaaaccttattttcaacggacatatcttctatcactgtaagaataatgtctaaaatcctaaaaatacatatataagaaattgtggacccatgtcagctcaaaagttaagaaacaaatcgataaattaacttagacaatcagcacgagaaacgtaaccaattgagatgcgttcatttttctagaatttaaatttttttggttgccccatgtgtataatttccggctccagcatagaacctatgtaataaccatcatctaaaaaaccaaaattcagagacttccattttggcaagtcattttttaaggtgcatgacgagcagggtgaccggcaaggcaagtagggcacacagggcgatgggcagagaggcagggccgttcctcacggggtgcaaggtgcggccgcaccaggctcctaaaaataaagggctcccttagccattagatgttaacatgttaggaatgttattttaatgtctcaattgcttattaaatattatttactatatttgtgatgattttatcggttgagatttgagagaagtttttaaaaatttaaattattgaggaactaatttaggtcaacaatgactcaatagaagttaaatatttaacaattctatgcatcgaaaagaagttgttagataagatttatctcaatgtataatcgacgactttatatcataaaatgttagatgatatttttagtgtgatatcaagacacgtgtttatggctatattttatatttgtcattttataaactttgaagcattgaatagattttttatattgaatatttaataatatgcatataatttaatatacacataaatataatatatatatatacacatatataaatacacgagcatatcagatttgaccctaggcctccaaaaagtcaggaacacgcgctgcggcgagggtgcgaggcaccagcagatcgggcccatactccagaaaggagtgcatctcctacccctaaaactaggggtttcttagcttcttagagattatgacaacaaatagactcctatgagtatgtatggtttagc

SEQ ID NO: 19501 - DNA, 1700 bp, Zea mays
gaaaagagtaatttacaaactcaaaactaaagcagcagccgacaaatagccattgagaagaatgattcatggtttccctgtacactacatgtacatatagcaagtttaccaaaagagctcaacttgaaaatttcattgacagtcagtcccttggtattaattggccaaccactgacagcacatagtttgcttaattattagccataacttaccatgctagtctacaatttgattctacaacaaattgtgtagccaagaattatcagcgttgatatctttgtgcagcaaagaagccagcaggaaaccttgggtgtgcggtgctcctggtgctgctgcttctgcttctgaaaggagtaagaccagcatccacagtgctggtagaagaagggtagcgaacgctgcggctgcggcggagccagtccatgaggcgaggccggcaatggtggacatgcgcatgtccaacagaatcaccggggagtgatatctcagaagagtccataccattcccagctgaagacacggagtggctgccgttgaggcggacaccttgcgactgggacgaagaggatcttgcaatggcggcgcccccggggtggagggcgtattttgacctagaggactcggagaaagatctgttaagcagatgccctccgggcttggcgaggacgcccttgattagccagagttggttccacctcaggctccccgtcctcctctcgaccatggcagcgcaattgcttcccgcagaagcagcggcgttgtttgagtgtggattagcaggcgccagcgtcacaccagcagctgcggcggcggaggtggtggaagaagaggcatcgagagactgacgggagggtaggcaggaggaatggttggcggcggcggcgtcgcagcaggcgatccattcgctgcaggagtggcgaagggagcgcttgcgctggagatgaaacggcggatcttgggcgtcgccgccactggtggaggtggcggcgtcggtgccggtgccggtgccggtgccggtgtcctgctcacgctcgtctccttggtcctctagctggaagagacgaaggagcgtggtcctccccccaaccgctggcggttctcctgttgtccctttggaacgggaacagggaggcaggaactcctcctcctcctccaggtcctggtggaagggaagcgaaggcggacgaggcggccgggaaggggaggccacaaccacaccaattaggttggtagcgtggagcctgtcgaggaggcaggcggagcagaagccggtgaagggcggctccgacgggtgcttggggcacctcctccccgtccccgatgcagcatcgccatcgcccatccggatgggatggaattaggtgcttggattggatccttgggctagaaaggaggtcaattggaggctggattggatgccggggatcaaacggcgaggtttgactagggttttgaccagcgatctggtgggtggagtgtgaagtggggaacggccagccagctacacggctcagccagagcaacaagacgaatagcggagagagagagccgttgggccgctgcgttgcgtcgcgtcggcataagccacgctgccatgtgggccccgttagcaggatagaattcgcttataccgttccaatccaaggacaagtatttaactaactagtcatttgattcaccgtttggcttacaccatacca

SEQ ID NO: 19502 - DNA, 1849 bp, Zea mays
  misc_feature (10)..(10): n is a, c, g, or t
  misc_feature (22)..(22): n is a, c, g, or t
gccgccacgnaaggatggcgcncacacaaccaccaactcgcgatccatcgatttgattgcagaacaccacccaacagccaaaccatcactaggcgtctacgcttgacatggataaggcctacatcgccgcgctctccgccgccgccctcttcttgctccactacctcctgggccgccgcgccggcggcgagggcaagaccaagggctcgcagcggcggctcccgccgagccctccggcgatcccgttcctgggccacctccacctcgtcaaggccccgttccacgcggcgctggcccgcctcgcggcgcgccacggcccggtgttctccatgcgcctggggacccggcgcgccgtggtcgtgtcgtcgccggactgcgccagggagtgcttcacggagcacgacgtgaacttcgcgaaccggccgctgttcccgtcgatgcggctggcgtccttcgacggcgccatgctctccgtgtccagctacggcccgtactggcgcaacctgcgccgcgtcgccgccgtgcagctcctctccgcgcaccgcgtcgcgtgcatggcccccgccatcgaagcgcaggtgcgcgccatggtgcggaggatggaccgcgccgccgcggccggcggcggcggcgccgcgcgcgtccagctcaagcggcggctgttcgagctctccctcagcgtgctcatggagaccatcgcgcacaccaagacgtcccgcgccgaggccgacgccgactcggacatgtcgaccgaggcccacgagttcaagcagatcgtcgacgagctcgtgccgtacatcggcacggccaaccgctgggactacctgccggtgctgcgctggttcgacgtgttcggcgtgaggaacaagatcctcgacgccgtgggcagaagggacgcgttcctggggcggctcatcgacggggagcggcggaggctggacgctggcgacgagagcgaaagtaagagcatgattgcggtgctgctcactctgcagaagtccgagccagaggtctacactgacactgtgatcactgctctttgcgcgaacctattcggcgccggaacggagaccacgtccaccacgacggaatgggccatgtcgctgctgctgaaccaccgggaggccctcaagaaggcgcaggccgagatcgacgcggcggtgggcacctcccgcctggtgaccgcgggacgacgtgccccaccctccacctacctgcagtgcatcgtcgacgagacgctgcgcctgcacccccgccgcgccgctgctgctgccgcacgagtccgccgcggactgcacggtcggcggctacgacgtgccgcgcggcacgatgctgctggtcaacgtgcacgcggtccacagggaccccgcggtgtgggacgacccggacaggttcgtgccggagcggttcgagggcggcaaggccgaggggcgcctgctgatgccgttcgggatggggcggcgcaagtgccccggggagacgctcgcgctgcggaccgtcgggctggtgctcggcacgctgctccagtgcttcgactgggacacggttgatggagctcaggttgacatgaaggctagcggcgggctgaccatgccccgggccgtcccgttggaggccatgtgcaggccgcgtacagctatgcgtgatgttcttaagaggctctgaaaacctcatggatcgaattgctggcatcggctgaagggtgtatgactatgacgtagcttccaagttccgagcatatatattcgtattgtgggttgccttgtgctggtggttgccttgtactaattgatctttgccgagtgtatggaatggattttcttccaaaaaaaaaaaaaaaaaagcggcc

SEQ ID NO: 19503 - DNA, 2905 bp, Zea mays
ctcttatgaattagtcatgttttatacggagtataattagttgtataattaatttatgtttagtctttataactaatattcaaaatctagactaaattttagtccgagattatagaatctggattaataaaaagttctgtaagacctctatttcaaactccaacctgtgaccgtttcgcgcagcgcgagttggcatttgcaccgttcgagttcgatcgattcccggacagcgccaaacgtcatccgttgcgtctgcaatattaatcttggccttagtggcgtcgtatctgtgactgtgatcgctcgtcgctttgcttgagagggtcccggtgtgcttgtatatatgtgtgccacgccacgccccgggcacggggacagcacgcataggacgaactaccgatgcaagctgcgatcgatcagtcaccgcatctccggttccgcgcaggcatggacgacaagtcctgctacgtggccaccggcctctccctggcggccatcctcctcgtcctccaccgcctcgtggtccgtgctggcggcaaggggaacgccgccgcgcggcggctgcctcctagccctcccgccgtcccgttcctcgggcacctccacctgctagcatcggagtgccctctccactcgtcgctggcccgcctcgcggcgcgccacggccccgtgctctcgctgcgcctgggctcccgcgccgccgtggtggtgtcgtcgccggagtgcgccgaggcgtgcttcacggagcacgacgtggcgttcgccaaccgccccaggctgacctcgcaggcgctggcctccttcggcggcgccgcgctggccgtgtctagctacgggccctactggcgcaacctccggcgcgtggccgccgtgcgcctcctctccacgcaccgcgtggcgtgcatgtgccccgtcatctcggccgaggtgcgcgccatgctgcgccgggtggggcgcgcggccgaggcggcggggcgcgtccagctcaaggccagtctgttcgagctctccctcagcgtgctcatggagaccatcgcgcagaccaagacgtcgcgcgccgacgacgcggacgacgccgtgtcgcccgaggcgcacgagttccggcggatcgtcgacgagatcctgccctacctcggcgccaccaacctgtgggactacctgccgctcctgcggcggttcgacgtgctcggggtgaggaacaagatcagggacgttgtcggcaggagggacgccttcctgcagcggctcatcgacgcggagcggcggaggctggacggcgacggcgacggcgacgacggcgagaagaagagcatgatcgccgtgatgctctcgctgcagaagtcggagccggacgtgtacacggacaccatgatcatggcactgtgcggggtgagtcagtccgtcgccagctagagccatcttttgtttttcttctccattattgtggccataaccgccatcaattccatacgtaactgagacgttgactgactgtctgtcgttttctgctctaacaaacctatccatccctggctgtgattgaaaccaaaaaaaaaaaaaaaaagaacttgtttacagccggaacggagacgacgtcgtccacgatagaatgggccatgtcgctgctgctgaaccacccggaggcgctgaagaaggccgaggcagagatcgaggcggccgtgggcgcgtcccgcctcatcaccatggacgacgtgccggggctgggctacctgcagtgcgtcatcaacgagacgctgcgcctgtacccggtggccccgctgctgctgccgcacgagtcggcggcggactgcacggtcggcggctacgacgtgccccgcggcacgctgctgttcgtcaacgcgtacgccatccacagggacccggcggcgtgggaggagccggacgagttcaggccggagcggttccgcgacggcaaggccgagggccggctgatgctgccgttcgggatgggacggcgcaggtgccccggggagacgctcgctctgcggaccgccggcctcgtgctcgccacgctcatccagtgcttccactgggacagaatcgatggcgctgagatcgacatgaccgagagcggcgggctcaccatgccccgggccgtcccgttggaggccacctgcaagcctcgcgaagccatgcgtcatgttcttcagcagctctgattggtctatgtgctaaacattctcatccctattctctcttgtgtgtgtggcagtacgaacagcacgtgctagctaaataagctgcgagcaatagctatccgcgtaacagtatggttcgtctaagttgttatctttcaaaagttatctagtactataaacaaattgttcgtgtcttgttcattcgtctgtctcttatgttattttgtcacacaccctgtccgccttctatcccagtcattgtctcataaaatatgttatatctttgtccaattgttctaatcctttactcaaaaactatgttatatatacaatactccgtccgtctcgaaatatagttatttctagactaatttttccgtccatatttattcaaataataataaacatagatatacataaaaacaatattctcatatattactcaacgaatatatgattagtctaaaacaaattatattatgagatagatagattatttttttttctgacacactctaccttgtccctcgtcctcgtcctcactctgctccatccttcttaactttttttttggcaatttcatgtatgccactgaacgagacggttcgattcatataaagtttactgtaaatcatatacagcttctttttttcttccttcgtgaaccacacttctatcaaatgggcatcaactccccgactagcaccgttagttccgagtatcacacaaggaattgtctaaaaaac

SEQ ID NO: 19504 - DNA, 1899 bp, Zea mays
  misc_feature (12)..(12): n is a, c, g, or t
gagaccattacntagaacatcctaatcgaaaaacagcacgcataggacgaactaccgatgcaagctgcgatcgatcagtcaccgcatctccggttccgcgcaggcatggacgacaagtcctgctacgtggccaccggcctctccctggcggccatcctcctcgtcctccaccgcctcgtggtccgtgctggcggcaaggggaacgccgccgcgcggcggcgtgcctcctagccctcccgccgtcccgttcctcgggcacctccacctgctagcatcggagtgccctctccactcgtcgctggcccgcctcgcggcgcgccacggccccgtgctctcgctgcgcctgggctcccgcgccgccgtggtggtgtcgtcgccggagtgcgccgaggcgtgcttcacggagcacgacgtggcgttcgccaaccgccccagactgacctcgcaggcgctggcctccttcggcggcgccgcgctggccgtgtctagctacgggccctactggcgcaacctccggcgcgtggccgccgtgcgcctcctctccacgcaccgcgtggcgtgcatgtgccccgtcatctcggccgaggtgcgcgccatgctgcgccgggtggggcgcgcggccgaggcggcggggcgcgtccagctcaaggccagcctgttcgagctctccctcagcgtgctcatggagaccatcgcgcagaccaagacgtcgcgcgccgacgacgcggacgacgccgtgtcgcccgaggcgcacgagttccggcggatcgtcgacgagatcctgccctacctcggcgccaccaacctgtgggactacctgccgctcctgcggcggttcgacgtgctcggggtgaggaacaagatcagggacgttgtcggcaggagggacgccttcctgcagcggctcatcgacgcggagcggcggaggctggacggcgacggcgacggcgacgagaagaagagcatgatcgccgtgatgctctcgctgcagaagtcggagccggacgtgtacacggacaccatgatcatggcactgtgcgggaacttgtttacagccggaacggagacgacgtcgtccacgatagaatgggccatgtcgctgctgctgaaccacccggaggcgctgaagaaggccgaggcagagatcgaggcggccgtgggcgcgtcccgcctcatcaccatggacgacgtgcccgggctgggctacctgcagtgcgtcatcaacgagacgctgcgcctgtacccggtggccccgctgctgctgccgcacgagtcggcggcggactgcacggtcggcggctacgacgtgccccgcggcacgctgctgttcgtcaacgcgtacgccatccacagggacccggcggcgtgggaggagccggacgagttcaggccggagcggttccgcgacggcaaggccgagggccggctgatgctgccgttcgggatgggacggcgcaggtgccccggggagacgctcgctctgcggaccgccggcctcgtgctcgccacgctcatccagtgcttccactgggacaggatcgatggcgctgagatcgacatgaccgagagcggcgggctcaccatgccccgggccgtcccgttggaggccacctgcaagcctcgcgaagccatgcgtcatgttcttcagcagctctgattggtctatgtgctaaacattctcatccctattctctcttgtgtgtgtggcagtacgaacagcacgtgctagctaaataagctgcgagcaatagctatccgcgtaacagtatggttcgtctaagttgttatctttcaaaagttatctagtactataaacaaattgttcgtgtcttgttcaaaaaaaaaaatcttatgttattttgtcacacaaaaaaaaaaaaaaaaaaaaaaaaaaaaaaa

SEQ ID NO: 19505 - DNA, 2156 bp, Zea mays
aaactattcttttttgccaggggaggcctgtaattatatcactgtgtacaaatattaatatattttatatccaacgaaaaatggataaactcattacctatttcttccaagaaattattgttcagattgtcagacggggtgcttgcactccccagttcccactgaaatcatacatttccattgcctatccagagtcctagtccatatcctagcttatgttcacctgacccaaattattcgcgacctatgaattaagacggtctccagttgtttagatgacacattgaagaatgaagtttaaaaaagaagattagttaagggattgtatatgggatctgctgccgatcgagctcgttacttgtttcccaaggacggatctcgcagcatgtgttggtcttcgccagtccaggaaggagccgcgatggagcgatggcgatctccagacgcaatcagacagtgatctcggagcttaaaaaaaacgcatccacgcaccacatggagatcctataaacagcactaggcatgaaccatcctctccgaccggacgtgcgtcatcagttgcgtatgcacaagtgaataggtataataaactaatctcggactgtgtatatgtagcaaactccggcacgaaggccgagatagcgccacacactgccaccgccactgtcatacagatacagcacactagctaacaccaacttgcacatcagcacgtcatggataaggcctatgtcgccgtcctctccgtcgccttcctcttcttggtccactacctcgtgggccgcgccgcccctggcggcggcaaggggaggaagcggctgccaccgagccctctggccatcccgttcctcggccacctccacctcgtcaagacgccgttccactcggcgctgggccgcctcgcggagcgccacggcccggtgttctccctgcgcatggggtgccgccgcgcggtggtcgtgtcctcgccggagtgcgccagggcgtgcttcacggagcacgacatgagcttcgccaaccgcccgcgcttcgagtccatgcgcctcgtgtccttcgacggcgccatgctctcggtgtccagctacgggccctactggcgcaccctccgccgcgtcgccgccgtgcagctcctctccgcgcaccgcgtcgcctgcatgtcccccgtcatctgcgccgaggtgcgcgccatggtgcgccggatggctcgcctagccgcgggcggcgccgcgcgcgtccagctcaggcggcgcctgttcgagctctccctcggcgtgctcatggagaccatcgcgcggaccaagacctcccgctccgaggcgtgcgccgccgacactgacgtgtcgcccgaggcgagcgagttgacgcggatctccgaagagatcatgccctacctcggcacggccaacctgtgggactacctgccgttcctgcggtggttcgacgtgttcggcgtgaggaaaaagctcatggccgccgtgaggtggagggacgcgttcctgcggcggctcatcgacgcagagcgccggaggatggacggcgacggcgacggcgagaagaagagcatgatcgccgtgctgctctctttgcagaagtcggagccggagctgtacacggataccatgatcatggcgctgtgcggggtgactgtttcggatagtactttctttcgggcaacgtttgctaataagggaacatattctatgatgcaaaaaaaaatcactaaacgaaaggagtagtgataaaatgtggcgcgttttcttctttttcccctgtgatttgaaggacttgtttggagctgggacggagaccacatcggtcacgacagaatgggccatgtcgcttctcctgaaccacccggaggctctgaagaaggcacaggcagagatcgacgcggtggtgggcaactcccgccgcctgatcaccgccgacgacgtgccccgcctcggctacctgcactgcgtcatcaacgagaccctgcgcatgtacccggccgctccgctgctgctgccgcacgagtcggcggcggactgcaaggtcggcggctacgacgtgccccgcgggacgctgctgatcgtgaacgcgtacgccatccacagggaccccgcggtctgggaggacccgggcaggttcgtgccggagcggttcgaggacggcaa

SEQ ID NO: 19506 - DNA, 2333 bp, Zea mays
ggcacactagctaacaccaacttgcacatcagcacgtcatggataaggcctatgtcgccggcctctccggcgccttcctcttcttggtccactacctcgtgggccgcgccgccggcaaggggaggaagcggctgccaccgagccctctggccatcccgttcctcggccacctccacctcgtcaagacgccgttccactcggcgctgggccgcctcgcggagcgccacggcccggtgttctccctgcgcatggggtgccgccgcgcggtggtcgtgtcctcgccggagtgcgccagggcgtgcttcacggagcacgacatgagcttcgccaaccgcccgcgcttcgaggccatgcgcctcgtgtccttcgacggcgccatgctctcggtgtccagctacgggccctactggcgcaccctccgccgcgtcgccgccgtgcagctcctctccgcgcaccgcgtcgcctgcatgtcccccgtcatctgcgccgaggtgcgcgccatggtgcgccggatggctcgcctagccgcgggcggcgccgcgcgcgtccagctcaggcggcgcctgttcgagctctccctcggcgtgctcatggagaccatcgcgcggaccaagacctcccgctccgaggcttgcgccgccgacactgacgtgtcgcccgaggcgagcgagttgacgcggatctccgaagagatcatgccgtacctcggcacggccaacctgtgggactacctgccgttcctgcggtggttcgacgtgttcggcgtgaggaacaagctcatggccgccgtgaggtggagggacgcgttcctgcggcggctcatcgacgcagagcgccggaggatggacggtgacggcgacggcgagaagaagagcatgatcgccgtgctgctctctttgcagaagtcggagccggagctgtacacggataccatgatcatggcgctgtgcggggacttgtttggcgccgggacggagaccacatcggtcacgacagaatgggccatgtcgcttcttctgagccacccggaggctctgaagaaggcacaggcagagatcgacgcggtggtgggcaactcccgccgcctgatcaccgccgacgacgtgccccgcctcggctacctgcactgcgtcatcaacgagaccctgcgcatgtacccggccgctccgctgctgctgccgcacgagtcggcggcggacatgcaaggtcggcggctacgacgtgccccgcgggacgctgctgatcgtgaacgcgtacgccatccacagggaccccgcggtgtgggaggacccgggcagcttcttgccggagcggttcgaggacggcaaggccgaggggcggctgctgatgccgttcggcatcggccggcgcaagtgccccggcgagacgctcgcgctgcggaccgtcgggctggtgcttgccacgctgctccagtgcttcgactgggacacggttgatggagctcaggttgacatgacggagagcggcgggctgaccatgccccgggccgtcccgttggaggccatgtgcaagcctcgtgcagctatgtgcgatgttcttcgggagctctaatattctggcacatcctaggttctcgctctataggtgaaagtttcatatgtagtttcgtagaagtatgcatgtctgatggtctgcgctgaactaagtacattatcatctagtacaaaatatcgtacatatacccgcatatatgtaaacaactagtactcaattagtactggtcgttgtttcccggcgtgctttagcaaatttaatcttcggcgaacgagaaatttgctattatgggcaccctcccgtgtggcttcgacgttttagaggcgtaggcaagagattagctgatatagaaaagcagggaataggccactcgctaaaacgaacaagaacactctattacttgatgacctctttgattaaaatcatggatactcacgtcgtctgcatccgttacctctctccaagcagacgtcgttcttttctctggaatgcagcagccgtcttcctcgtccttgcaacagccgctagcccaggacgacgcgtcggaccaggggctcgattgggggaagaagaagtgctcggctgggagaaacgtcggggcgctatgggagcacggagaagattcgacgagcagactgggcgagcaccaggaaatttgcgccgtgggcctcttcgccggctccctcctcctcaccgtcgtcgctgcccccatcgccctccctcgccttctccctcccctccatccccaaacccaaggttccacctccctttcctagcttgggcgcatacattcgtttgggatcataaactaacccggt

SEQ ID NO: 19507 - DNA, 769 bp, Zea mays
cggcacgagcctgactctcctttgattggttcatctgaaatcaagtttatatctacattcggtgccgcgcggccggccccgattaaggatagctggtactccaatgtactttatcttgggaatgaggatgaagttccaattctaactatgacgtgccccgcatcagatattgagaggtataaatctggtgagctgcgtttagcacctccatcagagacgtatgcggccactctgataaagggactagtggaaggcaagcaaatggatgcggacggagctgccagctacatcaacgctgctgctgcaagagccttgtgaaggcggcttcagcgtgtgcttttgtacagccagtaaggagtagcaaggatacactatctgttagcgtggcgacaccaggaaaccttcattgtccgcaaatggagaacttggatccaatttgaattgggaagcatgattcgagcttgccctagcttgattactggtgaacggtgatctcccctggctggttgattctgggagaaacactagctgtgtcggggtggagcaacactagttggcggttgcaacaggtgctctcactgcactggtatcgtgcttgtctgacataccgtagtatttgcatggcatgctggtgatggtatttgtgcaaaaaaaaaaaaaaaaaaaaaaaaaaaaatgcccgggcggccgcccccctcgcgctcctaatcaccgacgaataatctcttcttcacctcactaacaccgagctagcagctcgctctgtcct

SEQ ID NO: 19508 - DNA, 1028 bp, Zea mays
  misc_feature (16)..(17): n is a, c, g, or t
  misc_feature (903)..(903): n is a, c, g, or t
ctcgagccggccgggnngccggccggtccgagcggcgtcgtcccgtcgatacgcctgaaccccagctttccactcgcctcgctcgcccctttcgcgtccaccgaccccgaccccgaccccgatccccgccggtgcttcgccaccccgatccccaccgcgcgatggcggagccggctccggctcccccggtgaccgcgccgctggtggggctgctgtacgacgagcggatgtgcgcgcacgcgacgcccaacggggaggaacacccggagaaccccgagcggctgcgctccatctggcgcaagctcaacgccgcgggcgtcgcgtccaggtgtgtggcccttaaggcaaaggaagctgaggacaagtatatagcttctgttcacagcaagaggcatataaagctgatgaaggaaattagctcaacaatatatgatgccagcaggaacaagattgctaggaaattcaattccatttacttgaataagggttcctcggaatctgctgttcttgcagctggttctgtcatagaggtagctgagaaagttgctgcaggtgagttaagttctgctattgctctagtcagacctccaggccaccatgcagaacatgatgaggctatgggattttgcctcttcaacaatgtggcagttgcagctaattatctcttaaacgagaggcctgatttaggtatcaagaagatattgattgtcgattgggatgttcaccatggaaatggcacacagaaaatgttttacgatgatcctcgggtattgttcctctcagttcacagatttgattatggaagcttctatcctgctgaaggggatgcttctcattgtttcatcggggaagaagctggataagggaataacatcatgttccctgggagcatgccagtggggngatgctgattatatgctgcatgggacatgtactgcttcctgccactaatttttgacctgaataattctggatcagggggtttgatgcaacatgggtgaacctctcgggggggctgcataacccaa

SEQ ID NO: 19509 - DNA, 2807 bp, Zea mays
ctcgaggcgtccatacgcctcagccccagctttccactcgctcactagtccccccccccctccaccgaccccgaccccgatccccgccggtgcttcgccaccccgatccccaccgcgcgatggcggagccggctccggctcccccggtgaccgcgccgctggtggggctgctgtacgacgagcggatgtgcgcgcacgcgacgcccgacgggaaggaacacccggagaaccccgagcggctgcgctccatctggcgcaagctcaacgccgcgggcgtcgcgtccaggtgtgtggcccttaaggcaaaggaagctgaggacaagtatatagcttctgttcacagcaagagacatataaagctgatgaaggaaattagctcaacaatatatgatgccagcaggaacaagattgctaggaaattcaattccatttacttcaataagggttcctcggaatctgctgttcttgcagctggttctgtcatagaggtagctgagaaagttgctgcaggtgagttaagttctgctattgctctagtcagacctccaggccaccatgcagaacatgatgaggctatgggattttgcctcttcaacaatgtggcggttgcagctaattatctcttaaacgagaggcctgatttaggtatcaagaagatattgattgtcgattgggatgttcaccatggaaatggcacacagaaaatgttttacgatgatcctcgtgtattgttcttctcagttcacagatttgattatggaagcttctatcctgctgaaggggatgcttctcattgtttcatcggggaagaagctggtaaagggtataacatcaatgttccctgggagcatggcaagtgtggtgatgctgattatattgctgcatgggaccatgtactgcttcctgtcactaaagtttttgatcctgatataattctggtatcagcggggtttgatgcagcattgggtgatcctctcggtgggtgctgcattacaccaaatggatatgcactgctactaacaaagttgttaggatttgctcaaggaaggatagtgatggcccttgaaggaggttataaccttaggtccatagcgaactcagtttgtgcttgtgcaaaagttctcttgggagacaaattcacattcaacactccagagatgcaaccatttgaatctacatggagagtaatacaagcggtacgcaatgaattgaagacatgctggcctgttctgagtagcaagttgccagaaaatgtatcattgaggattaagcctgcaccaagcgagctctacgcttcttctgattccgaatctgatagtgaagatgttgatgagctccttggcactgttgcatctgtcaatgttattgaagctactggtgttgctataagtgaacacctctcaaagatgaaacttgatgatgacagccttgcagtgaagactaactcaagttgctcagcagcagaacagcatccagttgattcagtaaaagtacataacaatgcatctgttgtgctgaccaaaaaaatatctgatttatctcttgagtggcgatcagatttatcgaaaactgatgtctggtatgccagttttggatcaaacatgtggagaccaagatttctatgctatattcaaggagggaaggctgagggtatgaatataccatgctgcggatcacgtgacacaagctcaccaaagggaaccgtgtggaagactgtacctcacaggttgcttttcggtagatcgtctaccccttgttggggaactggtggtgtggcttttctcaaccctgagataaactacaatgagaagttgtatgtctgcatgtacaaaataacgttggagcagttcaatgacatcttgtttcaggagaatcgtttagtgctggaggatggcaaagacggaaacactgtgtatcctgactctcctttgattggttcatctgaaatcaagtttatatctacaaacagagctgttcatcttgaacctattaaggatagctggtactccaatgtactttatcttgggaatgaggatgaagttccaattctaactatgacgtgccccgcatcagatattgagaggtataaatctggtgagctgcgtttagcacctccatcagagacgtatgcggccactctgataaagggactagtggaaggcaagcaaatggatgcggacggagctgccagctacatcaacgctgctgctgcaagagccttgtgaaggctgcttcagcgtgtgcttttgtacagccagtaaggagtagtaaggatacactatctgttagcgtggcgacaccaggaaaccttcattgtccgcaaatggagaacttggatccaatttgaattgggcagcatgattcgagctcgccctagcttgattactggtgaacggtgatctcccctggctggttgattctgggagaaacactagctgtgtcggggtggagcaacactagttggcggttgcaacaggtgctctcactgcactggtatcgtgcttgtctgacataccgtagtatttgcatggcatgctggtgatgttatttgtgcaattactgcattatgttctgttaaaaaaaaaaaaagaaaaaaaaaaaaaaaagaaaaaaaaaaaaaaaaaagctcgagggggggcccggtacccaatccgccttataaggaggcgaattacaattcactgccgccgtttaacaacgtcggatggggaaaacctggggtacccaactaatcgccttgaaaaaatccccttttcccagttgggtaaaagcgaaaagccccgaccgacgcccttcccaaagtggca

SEQ ID NO: 19510 - DNA, 1710 bp, Zea mays
cccctcgagttttttttttttttttttttttttttttagcacaacgcaaatccctcacacatttactaaaaggctattgaaaacatctgctgtaaatttattcgccaccattgaaaaggtgtaacacaatgatacaaagctcccaagtccgatgtacatcacaggtaaaacattctcagttcgacaagctactatatgcaccatgtaaaatatcactccgatcacctatatcatataccatctccgtgaaacgagtacctcatggtaggctataaaatgtcttcgacgcctaaggcctgatctacatgtagaaagggaagcacaaaatttcctatcgggcacaaagatggaagtgttgattaataccgttggggaaaaaatggatatcatgtactctatagcagtcagcaacctttacaaactacaccgctgaagcgaagttgctgatccgttaatccactattgctcagtcagcaacttgctcaactacagcttttatgctgatggttcttcatttttcgtaccccactgttcctcgctactgtttccattcacaaggacagcaccatcacttgaaccctcagcctcaacctcaacagcttcatcttgactttcttctactccgtcatcctctgcatcgacctcaacagcatcttcttgactctctactccaccatcctcaataacctcgtgaacagtatcttcattatcatctggtaccatctcttcatgtacatgcatatttttaaaagcttccactaaactctcatttgacctttcagcatgaatcatgtactcctcggccgatggatagatactccttttagaggcaacagcagcttctacgttgagagcaatctgccagtcttcaaataagtttgggtactcattaggatcagccagcgactctgctgcttttgagtttaccttctggagatcctttttccacaatgctacaatctcagggactttgctgggaagataagatcttgccatcaatgctgcttccggaatacgattgctttctattagcaattgaagacactcttccagctttcctagcatgaagaaacaaaggaaagcaacattgttctttccttgttctttggctacagatgccaatttgttaatgccttcagcatccccaagggaagaatacaaaagcaacaaaccactgaggtccatagcatgtagaagacactcctctgccatctcaagctttccacttgacatagctaactcccctaatatcttccacttggactcactttgcgcctcggtagcaatcgccttcgcaatttcaagtcgaccaagttgcacagccaggtcaaatctgtaattagtgtcagttgctatctcgagggcttcctccaacattccacgtgattccaagaaacgtgccacactgtcatattgttcctttggtatagatgataaaacatcattcgcgcgatcgaaatccccacgcattacaagtgttttatattcgatcaaactaaggagtaaagtataccccacagcactgcaataataaggtacattagccacagaacatgtgtacaaaaaactacaagtggaatttaggtaacaaagatgaactaacttaaattgcttatcaataagatagacacggctttggtttgcaagatatcctagtaaacacattggccgatccaagtgaaacaaagttgaagactctcctcctaccga

SEQ ID NO: 19511 - DNA, 741 bp, Zea mays
aaagagaataaataaaacacatctcctgtaaatttattcgcccccattgaaaaggtgtaacaatgatacaaagcttccaagtccgatgtacatcacaggtaaaacattctcagttcgacaagctactatatgcaccatgtaaaatatcactccgatcacctatatcatataccatctccgtgaaacgagtacctcatggtaggctataaaatgtcttcgacgcctaaggcctgatctacatgtagaaagggaagcacaaaatttcctatcgggcacaaagatggaagtgttgattaataccgctggggaaaaaatggatatcatgtactctatagcagtcagcaacctgcaatagggttggttacttgggttatagctttaatacgactgcaaaggtggtgtatgagtcattgttcacttggaatagcatttcacctttacaaactacaccgctgaagcgaagttgctgatccgttaatccactattgctcagtcagcaacttgctcaactacagcttttatgctgatggttcttcatttttcgtaccccactgttcctcgctactgtttccattcacaaggacagcaccatcacttgaaccctcagcctcaacctcaacagcttcatcttgactttcttctactccgtcatcctctgcatcgacctcaacagcatcttcttgactctctactccaccatcctcaataacctcgtgaacaggatcttcattatcatctggt

SEQ ID NO: 19512 - DNA, 892 bp, Zea mays
agcacaacgcaaatcgttcacacacttactaaaataggctattgaaaacatctgctgtaaatttattcgccaccattgaaaggtgtaacacaatgatacaaagctcccaagtccgatgtacatcacaggtaaaaacattctcagttcgacaagctactatatgcaccttgtaaaatatcactccgatcacctatatcatataccatctccgtgaaacgagtacctcatgataggctataaaatgtcttcgacacctaagacctgatctacatgtagaaagggaagcacaaaatttcctatcgggcacaaagatggaagtgttgattaattgcgggtgcaacttcgtatatggataagccaatcctcgagcacatcacatgcttaataccgctgggaaaaaatggatatcatgtactctctatagcagtcagcaacctttacaaactacaccactgaagcgaagttgctgtcccgttaatccactattgctcagtcagcaacttgctcaactacagcttttatgctgatggttcttcatttttcgtaccccactgttcctcgctactgtttccattcacaaggacagcaccatcagttgaaccctcagcctcaacctcaacagcttcatcttgactttcttcatcctctgcatcgacctcaacagcatcttcttgactctctactccaccatcctcaataacctcgtgaacagtatcttcattatcatctggtaccatctcttcatgtacatgcatatttttaaaagcttccactaaactctcatttgacctttcagcatgaatcatgtactcctcggccggtggatagatactccttttagaggcaacagcagcttctacgttgagagcaatctgccagtcttcaaataagt

SEQ ID NO: 19513 - DNA, 1433 bp, Zea mays
ttttttttttttttttctttttttttttttttttttttttttttttttttttttcactaaactaaacacagactgttgaaaacgtatgctgttgatacaaagctcccaagtccgatgtacatcacatgtaaaacatcctcagttccacaagctactactctatgtaccttgtaaaaataccactccgatcaccaatcacatcccatatttccatctcggtgaaacaagagtacctttgatgaagttttctgagacctaaagacctgatctatatgtaaaaaaggaagcacaaaatttcctatcgagcacaatgatgaagttttgattaattgtggtccaacttcgtatgtggataagccaatcctagagcacatcccatgcttaatactgctggagaaaaatggatttcgtactctagaaagcagtcagcaacctttacaaacttaaccacttgcaaagttgctgtcccgttgatccactattgctcaggagtcagcacccactgttcctcactattgtttccattcacaaggacagcaccatcagttgaatcctcagcctcaacctcaacagcttcatcctgactttcttctactccatcatcctctgcatcaacctcaacagcatcttcttgactctcttctactccaccatcttcaataacctcgtgaacatactcttcattatcatctggcaccatctcttcctgtacatgcatgtttttaaaagcttccactaaattctcatttgacctttcagcatgaatcatgtactcctcagccggtggatagataacccttttcggggcaacagcagcttctacattcagagcaatctgccagtcttcaaataagtttgggtactcattaggatcagccagggactccgctgcttttgggtttaccttctggagatcctttttccacaatgctacaatctcagggactttgctaggaagataagatctggccatcaatgctgcttccggaatacgattgctttctattagcaattgaagacactcttccagctttcctagcatgaagaaacaaaggaaagcaacattgttctttccttgttctttggctacagatgccaattttccccaagggaagaatacaaaagcaacaaaccactgaggtccatagcatgtagaagacactcctctgccatctcaagctttccacttgacatagctaactcccctaatatcttccacttggactcactttgcacctcggtagcaatcgccttcgcaatttcaagtcgaccaagttgcacagccaggtcaaatctgtaattagtgtcagttgctatctcgagggcttcctccaacattccccgtgattccaagaaacgcgccacactgtcatattgttcctttggtatagatgataaaacatcattcgcgcgatcgaaatccccacgcatta

SEQ ID NO: 19514 - DNA, 1303 bp, Zea mays
gtatcaacaaaagatgatgatagtctggaaataatcgaatattgacaccacttccgatttacaacagatgaacgcaattaaagcgccatcatctgatgcaagaggtaatcagagacaatacaaaaggatacagttatagatgaagacaaaaagaacaaaaaaaccttttagaggcaacagcagcttctacgttgagagcaatctgccagtcttcaaataagtttgggtactcattaggatcagccagcgactctgctgcttttgagtttaccttctggagatcctttttccacaatgctacaatctcagggactttgctgggaagataagatcttgccatcaatgctgcttccggaatacgattgctttctattagcaattgaagacactcttccagctttcctagcatgaagaaacaaaggaaagcaacattggtctttccttgttctttggctacagatgccaatttgcccctgccgtcagcatccccaagggaagaatacaaaagcaacaaaccactgaggtccatagcatgtagaagacactcctctgccatctcaagcctccaattccgttgctgtcgctcccctaatatcttccacttggactcactttgcacctcggtagcaatcgccttcgcaatttcaagtcgaccaagttgcacagccaggtcaaatctgtaattagtgtcagttgctatctcgagggcttcctccaacattccccgtgattccaagaaacgcgccacactgtcatattgttcctttggtatagatgataaaacatcattcgcgcgatcgaaatccccacgcattacaagtgttttatattcgatcaaactaaggagtaaagtataccccacaacattaaattgcttatcaataagatagacacggctttggtttgcaagatatcctaataaatacattggccgatccaagtgaaacaaagttgtgacctctcctcctacacagtaattaagacgccatgaagaattattgtagatgaaacaatcgccaacccatagcccagtccggacacgttcgttgatctcatgaagcagttcaaaggcatcttccacaccttcctcaccagctgaaccccctctatccaaatgagatgaaactacatccctattatatttcaaaatgtagaatgacgtatcacttgcaattgttactaaatcaccactgtcagcccagtaaagattcttcacattgacatcgattcgacgtatcaatctgcattctgcccaatcatagaagcaaatgaagtcatttgtacacatagccggacgcgtggg

SEQ ID NO: 19515 - DNA, 2535 bp, Zea mays
tgggtaccgggccccccctctagttttttttttcttctttttcttagctcaacacaaattattcactaaactaaacacagactgttgaaaacgtatgctgttgatacaaagctcccaagtccgatgtacatcacatgtaaaacatcctcaattccacaagctactactctatgtaccttgtaaaaataccactccgatcaccaatcacatcccatatttccatctcggtgaaacaagagtacttttgatgaagttttctgagacctaaagacctgatctatatgtaaaaaaggaagcacaaaatttcctatcgagcacaatgatgaagttttgattaattgtggtccaacttcgtatgtggataagccaatcctagagcacatcccatgcttaatactgctggagaaaaatggatttcgtactctagaaagcagtcagcaacctttacaaacttaaccacttgcaaagttgctgtcccgttgatccactattgctcaggagtcagcaacttgctcaactacagcttttatgctgatggttcttcatttttcataccccactgttcctcactattgtttccattcacaaggacagcaccatcagttgaatcctcagcctcaacctcaacagcttcatcctgactttcttctactccatcatcctctgcatcaacctcaacagcatcttcttgactctcttctactccaccatcttcaataacctcgtgaacatactcttcattatcatctggcaccatctcttcctgtacatgcatgtttttaaaagcttccactaaattctcatttgacctttcagcatgaatcatgtactcctcagccggtggatagataacccttttcggagcaacagcagcttctacattcagagcaatctgccagtcttcaaataagtttgggtactcattaggatcagccagggactccgctgcttttgggtttaccttctggagatcctttttccacaacgctacaatctcagggactttgctaggaagataagatctggccatcaatgctgcttccggaatacgattgctttctattagcaattgaagacactcttccagctttcctagcatgaagaaacaaaggaaagaaacattgttctttccttgttctttggctacagatgccaatttgttaatgccttcggcatccccaagggaagaatacaaaagcaacaaaccactgaggtccattgcatgtagaagacactcctctgccatttcaagctttccatttgacatagctaactcccctaattgcttccacttggattcactttgcacctcagtagcaatcaccttcgctatttcaagtcgaccaagctgcacagccaggtcaaatctgtaattagtgtcagttgctatctcgagggcttcctccaacattccacgtgattccaagaaacgtgccacactgtcatattgttcctttggtatagatgataaaacatcatttgcacgatcaaaatccccacgcattacaagtgttttatactcgatcaaactaaggagtaaagtataccccacaacattaaattgcttatcaataagatagacacggctttggtttgcaagatatcctagtaaatacattggccgatccaagtgaaataaggttgtaacctctcctcctacgcagtaattaagccgccacgaagaattgttgtagataaaacaatcgccaacccatagcccagtccggacacgttcattgatctcatgaagcagttcaaaggcatcttccacaccttcctcagcagctgaaccccctccgtctaaatgagatgaaactacatccctattatatttcaaaatgtagaatgacgtatcacttgcaattgttactaaatcaccactgtcagcccagtaaagattcttcacattgacatcaattcggcgtatcaatctgcattccacccaatcataaaagcaaatgaagtcatttgtacacatagcaagtaacacaccaccaaatatccgttcaaccgaaaatgatggtcttatacttttcctctcctggaaatttttactgtaaatctttatccttgaggtgctttctctgatggcatattctccatcagttgaccaaacaaattcaagtgcagacccaaatgatctgtttctccatgctaaggctgtgtatattatgtattctccatctccacatacaactacaaatctcccattcggattgtgccttaagctttgtggataaaggtcacagcttcccaactccttcacggccaacggtaaccgatcaccatctgcgatctcattgtctgcaccaacactcttgatgttaacagtttgcgatttcattatgctttgcccatataatttttccactgctatccatgctagcaacaggaacttcacgaccaatttttatcattattgtcccttcatcgtatccaatcacaacccttcttgaccctttcatataccctaaagcccaaactcgctcaaggaaatagttaagagtgttctcaagcctgtaggtagtagaatgc

SEQ ID NO: 19516 - DNA, 2518 bp, Zea mays
tcgctgctacctgcattcgtccccagcgcctgctgccaccctatccctgctccattccaaccgcgattattgtttcctttgtttgggttgacggtgcagttacatacatgaatgttttcagcgcagggctacagtgtcctcctccctgagaaattgcaaaccggcaggtggaacgtgtaccgatccgcgcgttcaccgttaaggctgataagtagattccctgacaccccagacattggaacgctgcatgacaatttcacgtatgcagttgagacatttacagactgtaagtacctgggaacaagaatcagagcagatgccacgccgggggactacaaatggggatgacatatggagaagctagcacgagcaggactgcagtaggttctggccttatctatcatggagttcgtgagggtgcatgcattggtctgtattttgtaaacagacctgagtggattatagttgaccatgcttgttctgcatattcatatgtatctgtgccactttatgacacacttggcccagatgctgttcaattcattgtgaaccatgcagcggtggaagttatattctgtgtgcctcaaactctaagcactctgttaagttttatagctcaaatgccatgtgttcggcttatagtggtagttggtggagatgatgcaaatctgccatcaacgccagtaactactggagtgcaaatcataacttactccaggttgctcatccagggaaaggctagtcctcaacctttttgtcttccaaaacctgaagatgttgccactatctgttacactagtggcactactggcacaccgaagggagctgttctttctcatgggaacttaattgcaaatgtagcaggatcaagcctaaacattaagttttacccctccgatgtgtatatctcatatctgcctttggctcacatttacgagagggttaaccagattgcagcactgcactgtggtgttgccattggattctaccaaggggataatttgaagctcatggatgatctggctgctttgagaccgacaatattcgcaagtgttccccggttatataacagaatttatactgcgattacaaatgctgtgaaggagtctggtgggctgaaagaaaaattgtttcatactgcatacaatgccaagagacaagcaatccttaaagggaaaaatccatccccagtgtgggataagttggtatttaacaaaataaaagctaggcttggtggacgagtgagacttatgagttcaggtgcttctccactgtcagcagatgtcatggaattcctgaggatatgctttggtggtgaagttcttgaaggctatggaatgacggagacatcctgtatcatatctgcaatggatattggtgacagatcaattggtcatgttggatccccaactgcatcttgtgaggtgaaacttgtggatgtcccagaaatgaattatacatctgatgatcaaccttatcctcgtggagaaatttgtgttagaggacctataatattccagggttactataaggatgaagttcaaacaaaagaagtcattgatgaagatggttggttgcacactggagacataggtctgtggctacctggaggacgtttaaagatcatcgataggaaaaagaacattttcaagttagctcaaggagaatacatagctccagagaagattgaaaatgtctatgccaaatgcaagttcattgcccaatgttttatatatggcgacagtttcaactcttccttagttggtattgttgcagttgaaccagaggttatgaaggcttgggctgcatctgaagggatccagtgcgaagacttgaggcagctttgtgctgaccctagagcaagagctgcagtcctggccgacatggattctgttgggaaggaagcacagctaagaggttttgaatttgctaaagctgttcggcttgcggacgcgtgggtcacagtggacaatggtctcctcaccccaacattcaaggtcaaaaggcagcaagcaaagacatactttgcaaaggaaatttcagatatgtacgcggagctgcgggaggcagaggcacccaggtcgaagttgtaatgatcaattcaaggagaagcgacatatacaggcttacagatcatatgtctagaagaaacgtaatcatctttttactggcgcagcaaataatggttcctgcaatggtcaggaagagtcgagacggaggcagtgcttggtgcaaatcatatagatgaatcctcgttatgaacctctcaactgaatgccgttttcccttgtccaacgtgccaagccacgttagcctgatactaggtagagaggaaaaagatattctgcaaatgtaacagtgaacagttaacaatcgtggtgtgttgttgcatatctagttgatcggaacgacctagagaaatgtgaagaacacgaagcgcctttctgtttgaatttaaataaggattattcgcgatggcaatctctcaatataatctactgctaagcaatcaaattgc

SEQ ID NO: 19517 - DNA, 2726 bp, Zea mays
gtcgacccagcctccccacgcaacgcaacggatcgccaaatcaacttgagcttgagcatcccaccaatccactccccaacagcaatggacgccgcccagcgccgcgtcggtacccacctccagcgcccgccgccgcccgccgggggctacggcctcaccgtcaaccccaccgcggccgagtacgtccacgcgcagggctacagtgtcctcctccctgagaaattgcaaaccggcaggtggaacgtgtaccgatccgcgcgttcaccgttaaggctgataagtagattccctgacaccccagacattggaacgctgcatgacaatttcacgtatgcagttgagacatttacagactgtaagtacctgggaacaagaatcagagcagatggaacaattggagactacaaatggatgacatatggagaagctagcacgagcaggactgcagtaggttctggccttatatatcatggagttcgtgaaggtgcatgcattggtctgtattttgtaaacagacctgagtggattatagttgaccatgcttgttctgcatattcatatgtatctgtgccactttatgacacacttggcccagatgctgttcaattcattgtgaaccatgcagcggtggaagttatattctgtgtgcctcaaactctaagcactctgttaagttttatagctcaaatgccatgtgttcggcttatagtggtagttggtgggagatgatgcaaatctgccatcaacgccagtaactactggagtgcaaatcataacttactccaggttgctcatccagggaaaggctagtcctcaacctttttgtcttccaaaacctgaagatgttgccactatctgttacactagtggcactactggcacaccgaagggagctgttctttctcatgggaacttaattgcaaatgtagcaggatcaagcctaaacattaagttttacccctccgatgtgtatatctcatatctgcctttggctcacatttacgagagggttaaccagattgcagcactgcactgtggtgttgccattggattctaccaaggggataatttgaagctcatggatgatctggctgctttgagaccgacaatattcgcaagtgttccccggttatataacagaatttatactgcgattacaaatgctgtgaaggagtctggtgggctgaaagaaaaattgtttcatactgcatacaatgccaagagacaagcaatccttaaagggaaaaatccatccccagtgtgggataagttggtatttaacaaaataaaagctaggcttggtggacgagtgagacttatgagttcaggtgcttctccactgtcagcagatgtcatggaattcctgaggatatgctttggtggtgaagttcttgaaggctatggaatgacggagacatcctgtatcatatctgcaatggatattggtgacagatcaattggtcatgttggatccccaactgcatcttgtgaggtgaaacttgtggatgtcccagaaatgaattatacatctgatgatcaaccttatcctcgtggagaaatttgtgttagaggacctataatattccagggttactataaggatgaagttcaaacaaaagaagtcattgatgaagatggttggttgcacactggagacataggtctgtggctacctggaggacgtttaaagatcatcgataggaaaaagaacattttcaagttagctcaaggagaatacatagctccagagaagattgaaaatgtctatgccaaatgcaagttcattgcccaatgttttatatatggcgacagtttcaactcttccttagttggtattgttgcagttgaaccagaggttatgaaggcttgggctgcatctgaagggatccagtgcgaagacttgagacagctttgtgctgaccctagagcaagagctgcagtcctggccgacatggattctgttgggaaggaagcacagctaagaggttttgaatttgctaaagctgttcggcttgtcgctgagccattcacagtggacaatggtctcctcaccccaacattcaaggtcaaaaggcagcaagcaaagacatactttgcaaaggaaatttcagatatgtacgcggagctgcgggaggcagaggcacccaggtcgaagttgtaatgatcaattcaaggagaagcgacatatacaggcttacagatcatatgtctagaagaaacgtaatcatctttttactggcgcagcaaataatggttcctgcaatggtcaggaagagtcgagacttataccagacggaggcagtgcttggtgcaaatcatatagatgaatgctgttttcccttgtccaacgtgccaagccacgttagcctcaacgaaagatactagatagagaaaaaaaaaagatattctgcaaatgtaacagtgatcagttaacaatcgtggtgtgttgttgcatagctagttgatcggaacgacctagagaaatgtgaagaacacgaagcgcctttctgtttgaatttgaataaggattcacgatggcccaaaaccaaaagaaaaaaaaaaaaaaaaaaaaaaaaaaaaaaaaaaaaaaaaaaaaaaaatagggctgggggctgctaaatgatccaagattactgccatgttcatgcagagctaatgagattgttatatagtgtgacctaaaataaaattaatgggcctgacatttacaacacggggattgggaa

SEQ ID NO: 19518 - DNA, 2531 bp, Zea mays
  misc_feature (2338)..(2342): n is a, c, g, or t
  misc_feature (2392)..(2398): n is a, c, g, or t
  misc_feature (2454)..(2457): n is a, c, g, or t
  misc_feature (2477)..(2477): n is a, c, g, or t
  misc_feature (2498)..(2498): n is a, c, g, or t
gccaacatcgcatatccgccacctcccgcgcgccctccctcctcggcctcgcgcgcgccttcccacacatcctcctcccccccacgccacgaaacgccaaagggagggagcccgagcctagcaggagcagcgcacggaaacaatggcgcgggaggagcaggagcagtccgcattgggcgccgcccacgtccaccaccaccagcctccggccggcggatgcggcctctccgccaaccccaccgccgccgcagccgagtacgcccacgaacagggctacagtgtcgttctgcctgagaagctgcacactggaaagtggaatgtgtacagatctgcacattctcctctaagattaataaataaattccctgataacccggagattggaacgctccatgataattttgtatatgcagttgaaactttccgagattgtagatatttgggtacaagaatccgcccagacgggacagttggagactacaagtggatgacgtatggagaagctagcacgagcagaactgcaataggttctggtcttatttatcacggaatatctgaaggtgcacgaattggtctatattttataaacagaccggagtggatcatacttgaccatgcttgtgcggcatactcatatgtatctgtgccgctttatgatactctcgggccagatgcagttcagtttatagtgaaccacgcaacggtagaagttatattctgtgtgccccaaactctaagcgctattttaagctttattactcaaatgccgtgtgttcgtcttattgtggtgggttggtggagatgattcaaatatgccgtctgcaccagcaactactgaatgcaaaattatgacgtacaacaggctacacaatgagggaaagatgagtcctcaaacttttcgtccaccaaaacctgaagatatagccactatctgctacaccagtggcactactggcacaccaaagggagctgtactttctcatgagaacttaattgcaaatgtagcagggtcaagtttaggcattaagttttacccctctgatcggggccgcccgggtcctcctctggctcacatctatgagagagctaaccaggttgcattgcttcactatggtgttgccattggattctaccaaggggataacttgaagctgatggatgatttggctgttctgagaccaacaatattcgcaagtgttccccggttatataacaaaatttatgctgcaattacgaatgctgtgaagcagtctggggggttgagagaaaggctgtatcatactgcatacaatgccaagcgacatgcaatgataaatggtagaaacccatcacctatgtgggacaagttggtatttaacaaaattaaagctagacttggtggacgaatgaggcttatgacttcaggtgcttctccattgtcaccagatgtcatggaatttttaagaatatgcttcggtgaagttcttgaagggtatggaatgacagagacatcttgtgtcatcagtacaatgaatattggtgacagatcaattggacatgttggatctccaaatccttcttgtgaggttaaacttgtggacgtcccagaaatgaattatacttcggaggatcaaccgtatcctcgtggagagatttgtgttaggggacctataatattctgtggttactataaagatgaagtccaaacaagagaggtcattgatgaggatggttggttacatactggagacataggtttgtggctgcctggagggcgtctaaaaattatagataggaaaaagaacattttcaagttagctcaaggagaatacatagctccagagaagattgagaatgtctatgctaagtgcaagttcattgctcaatgctttatatatggccgacagcaacgactcttccttagttggtattgttgcagttgaaccggatgttatgaaggcttgggctgcatctgaagggatccagtgcgaggacttgaggcagctttgtgctgaccctagagcaagagctgcagtcctggccgacatggattctgttgggaaggaagcacagctgagaggttttgaatttgctaaagctgttactcttgttgctgagccgttcacattggataatggccttctcaccccaacattcaaggtcaagaggccgcaagccaaagcatactttgcaaaagaaatctcagacatgtattcacggttgctagagacagagttagctaggtcgaagttgtaacttgtgcggtatcagtatcaggagaaaggtcatcaatacagccgtacaggagattggattctgcaattgtttattccacctcacgaaataagtagtaaaatcnnnnnactgatacgggaaataacggatcatgccatgctccggagtcgatagtcgnnnnnnncaccagacggaggcagtgcttggcgcatgctgaatatatggtttctagttataaannnngaaatgagagtgtatattgngatctgaacagctgccctggnaaggtagttcacagaaaatatattgtggtattg

SEQ ID NO: 19519 - DNA, 630 bp, Zea mays
aaaattaaattaaaaaacaaaaacctctctgttctccccaaaaatggcacacactcaccgtcttgccgtccttctcatcctcctctccgccaccatcggcttctcctccgccgcgttggtcgaagagcagcctctggtgcttaagtaccacaacggcattctcttgaaaggaaacgtcactctcaacctcgtctggtacgggaagttcacctcaatccaacggtcaatcatcgtcgacttcatccgctctctcagctcctccgccgtcccatcaaaaggtccatccgtggcctcgtggtggaagacgacggagaagtacaaaggcggctcgtcgaagatcgtcgtcggtaaacagctcctcctcgagaactaccctctcggaaaatcgttaaagagtccttacctcagagctctctcggggaagctcaacggaggtggtgttcggtcgataaccgtcgttttaacggcgaaggacgtcgccgttgaaggattctgcatgaaccggtgcgggactcacggcgcgaaagcacgttccgttaacagcggagcttacgtctgggtgggaaactctgaaacgcagtgtgctggctactgcgcgtggccgtttcatcaggccgatgtacggacctc

SEQ ID NO: 19520 - DNA, 635 bp, Zea mays
  misc_feature (635)..(635): n is a, c, g, or t
agtatctactcttgcttgccgcatcaacctctttgctgttgatcttcacctccttcgacgaacaaacatgggtaagacaaggggtatgggagctgggcgcaagctcaagaggctccgtatcaatcagaggtgggctgacaagcagtacaagaagtcccatcagggtaacgagtggaagaagccttttgctggttcttcccacgccaagggtattgttcttgagaaaatcggtattgaggctaaacagcctaactctgctatccgtaagtgtgctagagttcagcttatcaagaacggcaagaagattgccgcttttgtccccaacgatggttgcttgaactacattgaggaaaatgacgaggtgttgattgctgggtttggtcgtaagggtcatgctgtcggagatattcccggagtcaggttcaaggtcgtcaaggtttctggtgtctcactcttggccctcttcaaggagaagaaggagaagccaagatcttaagatattgcatcaagcttttgaaatttgttttgatgttataagcaccttttgttagttcagtttttgaaaactcttatgttctgttctattctacgcaaaggttcctgaactcgatgtgtttaatcactttttcaatgan

SEQ ID NO: 19521 - DNA, 765 bp, Zea mays
  misc_feature (495)..(497): n is a, c, g, or t
  misc_feature (500)..(500): n is a, c, g, or t
  misc_feature (505)..(506): n is a, c, g, or t
  misc_feature (511)..(511): n is a, c, g, or t
  misc_feature (513)..(513): n is a, c, g, or t
  misc_feature (515)..(515): n is a, c, g, or t
  misc_feature (517)..(517): n is a, c, g, or t
  misc_feature (522)..(523): n is a, c, g, or t
  misc_feature (531)..(531): n is a, c, g, or t
  misc_feature (536)..(536): n is a, c, g, or t
  misc_feature (542)..(542): n is a, c, g, or t
  misc_feature (544)..(545): n is a, c, g, or t
  misc_feature (552)..(553): n is a, c, g, or t
  misc_feature (555)..(558): n is a, c, g, or t
  misc_feature (561)..(561): n is a, c, g, or t
  misc_feature (563)..(563): n is a, c, g, or t
  misc_feature (567)..(567): n is a, c, g, or t
  misc_feature (569)..(569): n is a, c, g, or t
  misc_feature (574)..(575): n is a, c, g, or t
  misc_feature (577)..(577): n is a, c, g, or t
  misc_feature (579)..(579): n is a, c, g, or t
  misc_feature (588)..(588): n is a, c, g, or t
  misc_feature (592)..(592): n is a, c, g, or t
  misc_feature (594)..(594): n is a, c, g, or t
  misc_feature (606)..(607): n is a, c, g, or t
  misc_feature (609)..(610): n is a, c, g, or t
  misc_feature (613)..(613): n is a, c, g, or t
  misc_feature (615)..(615): n is a, c, g, or t
  misc_feature (619)..(619): n is a, c, g, or t
  misc_feature (622)..(622): n is a, c, g, or t
  misc_feature (631)..(631): n is a, c, g, or t
  misc_feature (633)..(633): n is a, c, g, or t
  misc_feature (639)..(639): n is a, c, g, or t
  misc_feature (641)..(641): n is a, c, g, or t
  misc_feature (643)..(643): n is a, c, g, or t
  misc_feature (648)..(648): n is a, c, g, or t
  misc_feature (654)..(655): n is a, c, g, or t
  misc_feature (664)..(664): n is a, c, g, or t
  misc_feature (666)..(667): n is a, c, g, or t
  misc_feature (669)..(669): n is a, c, g, or t
  misc_feature (676)..(677): n is a, c, g, or t
  misc_feature (681)..(681): n is a, c, g, or t
  misc_feature (683)..(683): n is a, c, g, or t
  misc_feature (685)..(685): n is a, c, g, or t
  misc_feature (700)..(700): n is a, c, g, or t
  misc_feature (702)..(702): n is a, c, g, or t
  misc_feature (708)..(708): n is a, c, g, or t
  misc_feature (714)..(715): n is a, c, g, or t
  misc_feature (718)..(720): n is a, c, g, or t
  misc_feature (722)..(722): n is a, c, g, or t
  misc_feature (729)..(730): n is a, c, g, or t
  misc_feature (737)..(737): n is a, c, g, or t
  misc_feature (739)..(739): n is a, c, g, or t
  misc_feature (741)..(741): n is a, c, g, or t
  misc_feature (744)..(744): n is a, c, g, or t
  misc_feature (757)..(758): n is a, c, g, or t
  misc_feature (764)..(764): n is a, c, g, or t
tcactaaaaaccctcactcactattttcacattcttcttctctctcgatatcatctaaatctctctcttgatctcaatttcgcaaaatggctgacaagaagatcagaatcggaatcaacggtttcggaagaatcggtcgtttggttgctagagttgttcttcagagggatgatgttgagctcgtcgctgttaacgatcctttcatcaccaccgagtacatgacatacatgtttaagtatgacagtgttcacggtcagtggaagcaccatgagcttaaggtgaaggatgacaaaactcttctcttcggtgagaagccagtcactgttttcggcatcaggaaccctgaggacatcccatggggtgaggctggagctgactttgttgttgagtctactggtgtcttcactgacaaagacaaggctgctgctcacttgaagggtggtgctaaaaaggttgtcatctctgccccaagcaaagatgcgcccatgtcccggnnnctncaccnnccccntncncngtctnnccttcacnttccntccccncnncgccganncnnnnctncnttcntncctcnncnangatccaccnggcncnggcttcgctcgnncnnctncnctcntcncaccacccntnctctcncntnctccncaaccnncttgttccncnncncccgttnnatancntnctccctctttccggncnctccgnattctnntcnnncnctccccnntcccccngnanggncgtcccgctcccnnctcagnc

SEQ ID NO: 19522 - DNA, 679 bp, Zea mays
actcacttgactattttcacattcggagcttagctttctctctcgatctcatcgccatggctgacaacaagaagattaagatcggaatcaacggtttcggaagaatcggtcgtttggtggcgagagttatccttcagaggaacgatgttgagctcgtcgctgttaacgatcctttcatcaccaccgagtacatgacgtacatgtttaagtacgacagtgttcacgggcagtggaagcacaatgagcttaagataaaggatgagaaaacacttctctttggcgagaagccagtcaccgtgttcggcatcaggaaccctgaggagatcccatggggtgaggccggagctgactttgttgttgagtctactggtgttttcactgacaaggacaaggccgctgctcacttgaagggtggtgccaagaaagttgtcatctctgctccaagcaaagatgctcccatgtttgttgttggtgtcaatgagcatgaatacaagtctgatcttaacattgtttccaacgctagttgcaccactaactgccttgctccccttgccaaggttattaacgacaggtttggaattgttgagggactcatgactaccgtccactctatcactgctactcaaaagactgttgatggtccatcaatgaaggactggagaggtggaagagccgcttc

SEQ ID NO: 19523 - DNA, 637 bp, Zea mays
atcactcatcattccacacacatctcattttgcaaacaaaaaaaatctaagagagaaatatggctggtctaatgaagttggcatgcttgatcttcgcctgcatgatcgtggccggtccaatcacatcgaacgcggctctgagttgtggcaccgttagcggctacgtggcaccttgcattggctacctggcccagaatgcgccggccgttcccacagcgtgctgcagcggcgttactagtctaaacaacatggcccgtacaaccccagaccgtcagcaagcttgccgttgccttgtaggagccgctaacgccttgcctactatcaacgttgcccgtgcagctggacttcctaaggcatgtggagtcaacattccttacaagatcagcaaaaccaccaactgcaacagtgtgaaatgagcggcggtcggatgaagctaatgcagacgttcaagtattatgtaatggatgagcgaatactaaaataagatgctccaatggttgttgtttttagagtttttcaatttcctgtcttttatgttgtgacgttcctattactttggtcgtttgtactatggtcacaaatcacgttatatgaatttcagatctaagagtaattcaccgttgctaacaaaaaaaaa

SEQ ID NO: 19524 - DNA, 644 bp, Zea mays
  misc_feature (644)..(644): n is a, c, g, or t
atatacgtttctgagagagagagggagcacaaaaaaagaaagagctgtagattttgatttgatcagatattctcaagacttttacgagtctgatctgatctgatcatcatcctcttctctcgcctgtgagtcacagtggtcatcgaaaatggcgccgaaattcgacacggagaagatgcaggaacgccagaacttccgcaacgtctggcacaccgatctcactcacaccatccagggcgatactccttattgctgctttgcgctgtggtgtgccccttgtgcgtcatatttgctacgcaagcgtgcgctttacaatgacatgtcaaggtacacttgctgcgccggttacatgccttgtagtggcaggtgtggagaagcgaaatgtcctcaactctgtcttgccactgaggtcttttgctgctttggaacctctgtggcatccactcgttttcttcttcaagatgagttccagattcagacgacgcagtgtgacaactgcatcattggatttatggtttgccttagccaagtggcgtgcatattctccatagttgcatgtatcgtcggcattgatgagctttctgaagcttctcagctgctctcttgttagctgacatggtttactgcaccgtttgcgcttggan

SEQ ID NO: 19525 - DNA, 614 bp, Zea mays
  misc_feature (583)..(583): n is a, c, g, or t
  misc_feature (606)..(606): n is a, c, g, or t
  misc_feature (614)..(614): n is a, c, g, or t
aaattgccctccctctctctctctgcaatggcgtctcttcagcaaactatgctctctctgcagtccaaacttcctccatcatctttccacatcgggggatctcttcccatgcgaaagacagccttaccgctccgaaccagaggcggaaacgccgcgggagcgagaatgtcagccacggcggcgggaagctacgcgatggctctcgcggacgtggcgaagaggaacgacacactcgaactgacgagcgcagacgtcgagaagctcgagaaggtcttctccgatccgcaggtgctcaacttcttcgcgaatccaaccgtcgagctcgagaagaagcgtctcgtgatcgacgagatcgtgaaatcgtccgctctccagagccacacctccaacttcctcaacatcttggtcgacgcgaatcgtatcaacatagtgagggacatcgtgaaggagttcgagatggtgtacaacaagataacggacacgcagctggcggaggttagatcggtggtgaagctggagccgccgcagcttgctcagatcgccaaacaggttcagaagctgaccggggcgaagaacgtcaggntgaagacggttcttgatccgagncttgtcgn

SEQ ID NO: 19526 - DNA, 635 bp, Zea mays
gtcttcttgtgaaagcttgtatatatacgattgctctccctcctccgctcaaatccttcacccctctctctgcattatctcttcacattctctaaggtctctcagaatggctgcagctaccaatggaagtactgactacggtgcctacacatacaaggagcttgagagggagctctactggccttccgagaagctgaggatctccatcaccggcgctggaggtttcatcgcttcccacattgctcgccgtctgaagcacgagggccactacgtcattgcttctgactggaagaagaatgagcacatgactgaggacatgttctgcgacgagttccaccttgttgacctcagggtcatggagaattgcctcaaggtcaccgataaagttgatcatgtttttaacttggctgctgatatgggtgggatgggtttcatccagtccaaccactcggtgattatgtataacaacaccatgattagcttcaacatgattgaggctgctaggatcaatgggatcaagaggttcttctatgcttcaagtgcatgtatctatccggagttcaagcagctggaaaactaccaatgtgagcctcaaggagtcagatgcttggcctgctgagctcaaggatggctaa

SEQ ID NO: 19527 - DNA, 588 bp, Zea mays
gaattagggtttactagtctcaggaggaggaagaagaggaggagcagcagccagcagcaacaatggttctcaagaccgagctttgtcgtttcagtggccacaagatttacccaggaagaggaatcagatttatccgatctgactctcaggtgttcttgttcatcaactcgaagtgtaagcattactttcataataagctgaagccttccaagcttgcatggactaccatgtacagaaagcagcacaagaaggatgcagctcaagaggctgtgaagaagaggagacgtgcgactaagaagccgtactcgaggtctattgttggtgctaccttggaagtgattcagaagaagagagctgagaagcctgaagttcgtgatgctgcaagagaagctgctcttcgtgatatcaaggagagaatcaagaagacaaaggatgagaagaaggcaaagaaggctgaatttgcttctaagcaacagaagattcaggctaagatccccaaggctgctgccaagggaggtcctaagttgggaggtggtggtggcaaacgctgaagaacctaaccaagaacatctctctctcactctgtgg

SEQ ID NO: 19528 - DNA, 621 bp, Zea mays
atccatctcttctgcaattcttagggttttatcctccaaagtcacattcttatcctcacgaaatggcggcgacacaactaacagcatcaccagtgactgtctcagccaggagcttagcctcgctggaaggtctcagagcttcgagtcccaagtttggaactttgaaaccaggcacctttaagcagagccagttccgttctttggttgtccgagctgcttcggtcgttgctcctaagtatacttcaattaagccattgggagatagagttttggtgaagatcaaggaggcagaggagaagaccatgggaggtatcttacttccatctactgctcaatcaaagcctcaaggaggtgaagtcgttgctgtgggcgaaggaagaactattgggaagaacaaaatcgacatcactgtccctactggagcacaaatcatttactccaagtacgctggaactgaggtggagttcaacgatgagaagcatctcattctcaaggaagatgacattgttggccttcttgagacagaggacatcaaagatctcaagcccttgaacgaccgagtcttcattaaggttgctgaggcagaggagaaaacagctggagggttgttgctaactgaga

SEQ ID NO: 19529 - DNA, 614 bp, Zea mays
  misc_feature (555)..(555): n is a, c, g, or t
cttttcgcttccagctttccgcgtcccggccggagttctctcgcaacccgaatcccaaatggcgtcggagaagaagctatcgaacccaatgagggacatcaaagtgcagaagctggtcctcaacatctccgtcggtgagagtggagatcgtctcaccagagcctccaaggtcttggaacagttgagtggccagactcctgttttctccaaagcgagatacactgttcgttccttcggtatcagacgtaacgagaagattgcttgctacgttaccgtcaggggagataaagcaatgcagctccttgaaagtggactcaaggttaaagagtatgagctcttgaggaggaactttagcgacactggttgcttcggtttcggtattcaggagcacattgatttgggtatcaagtatgacccgtcgactggaatctacggtatggacttctatgttgttcttgagcgtcctggttaccgtgtggcacgtcgcagaagatgcaaggctcgtgttgggatccagcacagagtcaccaaagatgttgccatgagatggttccnagttaggtatgaaggagtcatcctcagcagtctcagaacattactggttggaaacatct

SEQ ID NO: 19530 - DNA, 1784 bp, Zea mays
ctcgaggccggccgggctccccgtcccgtccaccgattcccctccctaccgcccggcccgccgccaccagacgagagacgacctcccccctcccccgcattctctcacgccgcctgcgctctccccctcgcgagatagacaaccctagctcccgtctccttgcttaccctcctctccaacccctctccgatctctataaaagacccgaatttcgaattccccctcgaacccgcgatccgcgctttccttcccgcccatttcggtctctgattcggcgcggattcgctgcgcgggagcccccgaggttgcgtgcgtgattcggatggcggagccggggctcgagggcagccagccggtggatctgtccaagcacccctctggcatcgtccccacgctccagaatatcgtatcaacagttaatttggattgtaaacttgacctcaaagcaatagctttgcaagcacgaaatgcggagtataacccaaagcgttttgctgcagtcatcatgagaataagagaacccaaaaccacggcactgatatttgcatcgggtaaaatggtatgtactggagcgaagagtgaacagcaatccaagcttgcagcaaggaagtatgcccgcattattcagaaacttggttttccagctaagtttaaggattttaagattcagaatattgttggctcttgtgatgtcaagtttccaattaggcttgagggccttgcatattctcatggtgccttctcaagttacgaacccgaactctttcctggccttatctatcggatgaaacaaccaaagattgttcttttaatttttgtttcaggcaagattgttttgactggagcaaaggtgagagaggagacctacactgccttcgaaaacatctatcctgtactgtcagagtttagaaaaattcagcaatgatgacatgtgatgtgaaggtcacgttcttcaaattacaagcttcctcgaggattctcgtgtgaccatgaattctaaatgtacataaaagtctggcggaacttatagcatcctgtaatctctgtgagccgcggtctgtcagtattgggtgggcttgctgtggtaactggtggacatgtcgagttcatccatttgggtaggccttggtgaacacggacgccccacatcatgtctcagtttgagtagtttgtgtgaactgaagggtacgtgcttctcccatgtggttgcagcgttaacttgagtcaagtgctaacaagagtagataaaattttgccccagttcgtctttgtgacagtcttttaaagtcttttttctgagtatctttcaaagtgttttcagagtatcttccagtgtgctactgctgtgcgatgatgagaaggctggcactgtatgtaacgggggcaacgtgaccggttgtaagttatgtattgtagttgagatgctgtagcgcctagggcactgggattgaacttgtggaggaaccagtcagtcgaccgttctatttgtgtggccctctgctactgactaatgtggcctgttccaaatgtcgctgcgattttcgtttcttttaccatgttgatgttgcatgctaaggtgcaagggtgaagaatttggatgccaccagagatgcgtgtccgggaaagaaatgctcagcgaacatgatgttcctgggctcatggcgcagccacatgcctgcctcgctcgaaaacactttcgtatgcaatgaaatcgacgttgacgagttcctgggttgcgcatttctatcctgcagctgcaggcaggctctagaggggtccccggg

SEQ ID NO: 19531 - DNA, 1537 bp, Zea mays
cattgggtacctcgaggccggccgggaggctcccacccaccagacgacctccccttgcattctcagtttctcacgcccctgcgctgtcccgtcgcgagatagataaccctagctcccttccattgcttgccctcttccccaacctctctccagatctctataaaagaccagaatttcgaattccccctcgaacccgtgacacgcgcgctcctttcccgcccatttaggcctctgattcggcgcggattcgcggcgcggagccgccgaggttgcgtgcgtgattgggatggcggagccggggctcgaggacagccagccggtggatctgtccaagcacccctccggcatcgtccccacgctccagaatattgtatcaacagttaatttggattgtaaacttgacctcaaagcaatagctttgcaagcaagaaatgcggagtataacccaaagcgttttgctgcagtaatcatgagaataagagaacccaaaaccacggcactgatatttgcatcgggtaaaatggtatgtactggagctaagagcgagcagcaatctaagcttgcagcaagaaagtatgctcgtattattcagaaacttggttttccagctaaattcaaggactttaagattcagaatattgttggctcttgtgatgtaaagtttccaattaggcttgagggccttgcctattctcatggtgccttctcaagttacgaaccagaactctttcctggccttatctatcggatgaaacaaccaaagattgttcttttaatttttgtttcaggcaagattgttttgactggagcaaaggtgagagaggagacctacactgccttcgaaaacatctatcctgtgctggcagagtttcgaaaagttcagcaatgatgacctgttgtgaaggtcacatccttctaattacaagcttccttgatgattttcgtgtgaccataaattctaactgtgtacataaaaagtctggcggaatttatagcatcttgtaatttctgtgagctgctgtctggcatgattgggtgggcgtgtcgtggtagctggtggaattgtcaagatgatccgtttgggtagaggccctggtgaacacggacactacattatgtcgcagtttgagtagtttgtgtgagctgcagggtacatgcttgtcccatgtggttgcagcgttaacttgagtgctaacaagagtagataaattttggtctgcttcgtctttgaggcaggagtccttcaaagtctcttctgagtatgtttcagtgtgatgtgcgatgatgaaaaggctggcgctgtatgtaacgtgggacaagggcaaagggcaagggcaatgtactgacgactggttgtaagttatctgttgtatttgagtttgagatgctgtagcgtttgacatggggaaaaaaaaaaaaaaaaatgaccgtatggaggaaccggtcgattgaccatgctattggtgtgactctgttagagacaataatgtgcacttaaaccgtgcaatcaaacgatctgatgtatgcaagctatttt

SEQ ID NO: 19532 - DNA, 617 bp, Zea mays
  misc_feature (606)..(606): n is a, c, g, or t
  misc_feature (617)..(617): n is a, c, g, or t
attacggttaggcaataacttgcacaaaagtcaacaactttccaaatgggctccgccggaaaacccgccgacgacatctcaaccgacccggaatcaggaccggagacatccctcctcggatcaacccccaaatccccacccgactccttccacttagcctacatcatctacttcaccctcggcgtcggcttcctcctcccatggaacgccttcatcaccgccgtcgactacttctcctacctctacccctccacctccgtcgaccgcatcttcgccgtcgtctacatgctcgtcggcctcttctgcctcctcgtgatcatcgtcttctacgcgcacaagagcctcgctagcttcaggatcaacctcggcctcttgctcttcgccgtctccttgctcgtgatccctgtcttggatctcgtctacgtcaaggggcgagtcgggttgtacgttgggttcgatatcacctccgtcgctgttggcctctccggtgtggccgacgcgcttatgcagggtgggttgatcgggtgtggctggtgagatgcctgagaggtatacgcaagctgtcatcgccggaactgctgggctccgtgtgcgctgtgtctctgntgaagatctgn

SEQ ID NO: 19533 - DNA, 569 bp, Zea mays
  misc_feature (517)..(517): n is a, c, g, or t
agttttgactccgcaactctctttgcttcttctctctaactcgactttgatctccttgcaatggcgtcggagaagaagctctcgaaccccatgagggacattaaggtccagaagcttgttctcaacatctccgttggtgagagtggtgatcgtctcacccgtgcctccaaggttttggaacagctcagtggacaaacccctgttttctccaaggcgaggtacactgtgaggtcttttggtatcaggcgtaacgaaaagattgcgtgctacgtcactgtgagaggtgacaaggcaatgcagcttcttgagagtggcttgaaagtcaaggagtatgagcttcttaggaggaactttagtgacactggttgctttggtttcggtatccaagagcacattgatcttggtatcaagtacgatccatctactggtatctacggaatggacttctatgttgttctcgaacgtccaggataccgtgtggctcgtcgccgtagtgcaagactcgtggtggtatccnacacgagtgaccaagatgatgccatgaaatggttcccagtcagtatgagggg

SEQ ID NO: 19534 - DNA, 615 bp, Zea mays
atcaattaaccagatctattccaaggagagcgtcttcatacacgccctccgatttcatcttcttcttcatcgaatctaaggctttttcctcagatctctaaacgaaaatgagggagtgcatctcgatccacatcggtcaagctggtatccaggtcggaaacgcctgttgggagctttactgcctcgaacatggcattcagcctgatggacagatgccgagtgacaagaccgttggcggaggtgacgatgctttcaacaccttcttcagtgaaaccggcgcagggaaacacgtccctcgtgcagtcttcgtcgatcttgagcccactgtgatcgacgaggtcagaaccggtacttaccgccagctcttccaccctgagcagctcatcagcggtaaagaagacgctgccaacaacttcgcccgtggacattacaccattgggaagggagattgttgatctctgcttggaccgtatcagaaagctcgctgataactgtactggtctccaaggcttcctggtcttccacgctgttggtggaaaaactggggtctgggcttgggtctcttccccctggagctccctgtggactatggaaaagtcaagctgggttcatgtt

SEQ ID NO: 19535 - DNA, 634 bp, Zea mays
aatcaatcaaaaaaaaagttcgttttctttctcaaaccctttctagcgatgtcaggttaccctccgacgagccaaggctacagttacggctacggcggtggaaatcaacctccccctcctcagccaccttactcctccaccggaaacaatcctccgacgagccaaggtcacggttacggctacggcggcggaaacaatcctccgtacggatcatcatctccttacgctgtcccctacggcgcgtcgaagccccaatcctcgtctgctccttctgctccaccgtacgctccttctcctcctccaggggacttcaacccgccaaaggacaagcctttcggcggcggctacggagcttcgccgccgtctgggccttacggtgctgctcctccccgtccgggaggatacggagctgctccgccgcattccgaatacggcggttacggcgctgcgccgcgtccttacggcggatacggagctgctgctccgccgtcgggggttcctggaatacggcggttacggtggtgctccgcctcgtccaggaggatacggaggctatccttctcctcaggggtcttcttacggaagccccttcgcttctctgggttcgtcgggttttgctccgggggccgatcga

SEQ ID NO: 19536 - DNA, 623 bp, Zea mays
  misc_feature (598)..(598): n is a, c, g, or t
agaactttcgggttgcgtgtccttatttataaatggttttcaactttttactcaccagagattttgattaatactttgagaaattcgaatgctctgttttgttttctcgggaaaattatcagagtgagataaagatcagaggaaagatgagagccggcgcgagtggaaacaacgtttcggagactataaacgcagccgctagtgcgtttgcttcctctgatgatcgtgttcatcaccaaccttctccgattcataagaagcgaagatggtgggatcgcttcatatgtttcagaccttcaacacaaagaagaaaacgaatagggaaagccgctcttgctcctgaaccggttcataccgattccacatccaattccggttatcgttcggttatgacggctcttcctttcatagctccaccttcatctcctgcttccttcttccaatcagaacctccttccgctacgcagtcgcctgtagggatcctctcctttagtcctctaccttctaacaacaacaacaacaacaacaacaacgagcgtccttcgatattcgccatcggaccttacgctcacgagcctcagctggggtctcctccggntttctctacttacaccacgaacatc

SEQ ID NO: 19537 - DNA, 1652 bp, Zea mays
gcacgagggagagaactagtctcgcgtttttttttttttttttttttttttttttggccgcgcttgctctttgccctttcgcattttttttttttttttgggatttcaccatttcatcatacaccaggaccaaccaataaatctacacaaagtctcgaccctctcaacgcgcggattccgctgcagggcagctttcgctgccttgtctacatgacctaaccaacagcgacaaagggaagtaaaacaaaacgattgttccataacaaatagactgtaaattcctgtaggtatagaagtcatggtgacacataaatactgcagacttctcaacggatcgccacaaggtgtaacctccagctgatttgtgatcaattcttgttgctgggtgggtcaccatcctgtgcatttccttgtgagttgctaccactgcctccactgttcccattctgctgcgatgtttgccctcccagtccactgaatggccacggcagcgacacattgaacctcctctcaaccacccttggattctcctgcctctcctccatctgtccctcagcagcagtagagctcccagatgcagcagcagccacaccaacagccggctgaggattagtgcccttccgcccctcgtaatcaggatcgtcagtaggcagctcaaatcggcagatggggcacgagttgtgaagctcaagccacggcacaatgcagtcagtgtggtagatgtgcttgcagggcatctgcttggccacctctccaggcgagaaatcctccttgcagacggcgcactcagcgccctccgcagctgcgaccatggcatgagtcacgaggacgtcggggagcgaggagaggaccgatttggcagccggcggcgtgccatagcggttggggtcgttctcggcgagctgctcgatgagttgttcgaggcctgggccgacgaagtaatccccaaagcttgccccgccgatacgcccgaggccgggtccggagccgagggtgacgctggcgtcgtcgaggaggacctggatgttggcgcctccctcaacgaggctatggatgtaattctggaagaacatgaccgggtcgaagggctcgggctcgttctcgggggtggccgtgccggcggcggcgcgcgaggcagagccgccgaccctgatgggttgttcgcctagtcccaggaaggagttgaggatggaggagatgtcgttgggctgggaaggggaggtcgcggcggaagaggacgaggacgataaggaaggggacccaccggagccggctgctggggcgggggccggggtggtgctggcggcggggatcgtggtgggggcaaaggggaacgggaagggcagcgggatgaaggtgggggcagggacggtgacctcctcgaggaagtcgccgtggcactcggggcacgagagctccccggcggcggcggcggaggccgcgatgagaacggtgcggttgcattggtagcaaaagtattgcttgcgcgcggcggcggcgtagtaggcggcggctggagtcgacatggcggcgcccggcgatctcgcggcgagggtggatggattgggatttttttctctcgctctctctatggaatttaggtcatcgattttctagtgctggttttcggccccggccggccccgggggccc

SEQ ID NO: 19538 - DNA, 4792 bp, Zea mays
  misc_feature (2004)..(2052): n is a, c, g, or t
  misc_feature (2056)..(2121): n is a, c, g, or t
  misc_feature (2453)..(2457): n is a, c, g, or t
  misc_feature (2548)..(2552): n is a, c, g, or t
  misc_feature (2703)..(2706): n is a, c, g, or t
  misc_feature (2760)..(2760): n is a, c, g, or t
  misc_feature (3791)..(3791): n is a, c, g, or t
gcacgagaccattacctagaacatcctaatcgaaaagggaaataaagctactagggttggtggggtcattagcggagctgtgactctgtgaggcgacgatggggctgggggctgcgatggcgctggcgctgggcgacccgccagcggactacgcctccatcgcggcggtggggctgttcgtggcgctcatgtgcgtctgcatcgtcgtcgggcacctcctcgaggagaaccgctggatgaacgagtccatcaccgcgctcttcatcgggctgggaactggagcggtcatcctgttcgcgtcgagcgggaagcattcgcgcgtgctggtgttcagcgaggacctcttctttatttacctgctgccgccgatcatattcaatgcagggttccaagtgaagaagaaacagttctttcgaaacttcattactattacactgtttggtgcagttggcaccttgatctcttttactgtaatatcccttggcgctctaggactaatatcaaggcttaatatcggcgcacttgaactgggagactatcttgcacttggggcaatattctcggccacagactcggtttgcaccttgcaggtgttaagccaagatgagacaccattcttgtacagcctcgtgtttggtgaaggtgttgtcaatgacgcaacttctgttgtgttgttcaatgcaatccagaactttgatcctggaaatatcagcagtgccaaattactgaacttcattggcagtttcctttatctgttcggctccagcaccattcttggagtagcttctggacttcttagtgcttataccattaagaagttgtacttcggcaggcattcaaccgatcgtgaagtttccattatgatgctaatggcttatttatcttacatgctagctgaattgctcgatttgagtggcattctcactgtgtttttctgcggtatcgtaatgtcacactatacttggcacaatgtaacagaaagttcgagggtcacaaccaagcatgcctttgcaacattgtcgtttatctccgagacttttctgtttctttatgttggtatggatgcattggatatagagaagtggaagattgtcggtcaaacttatagcccggtaaagtctatcgctttgagcagcaccattttagccttggtgctggtttcaagagctgcttttgttttcccactatcctttgtatcaaatttgaccaaaaaaactccaaatggaaagatatcttttaggcagcaggttattgtttggtgggcgggtctcatgagaggtgctgtgtctattgcgttggcttacaataagttcacaagatcaggccatactcaacaacctagcaatgctatcatgatcacaagcacaatcagcgttgttcttttcagcacaattgtctttgggctgctgacgaagccactgatcaggctcttgatcccgtcaaggcacctatccagggaaccaagcgccctttctgaaccttccagcccgaagtctttctttgagcagctggccgccaacagccctggacacccggatcttgagaatggcataagcctacgacgcccggcgagcctccgttttctcctagtaagcccggcacggtccgtccaccattactggcgcaagttcgatgacagtttcatgcggccggtgtttggtggccgtggcttcgttcccttcgtccctggttcacccactgagagcagcttgccattgcttcctggcaatgagaactgaaaccagcgtatcgaggggctttaattcagcagaagttttgtaaattggcttcgcttatggttataatattttgtgtaaatctaggtttgtagattcaacttggtaccatgtacatgttgatgtaggctagttaactgaccagcagcccccaaccggctgggcatattgatatctcgtcgctatcaatgagttcgtatttataaaatactctgtacatcggatcactatatatgtatcgtctccaacttaataaatactcatccgnnnnnnnnnnnnnnnnnnnnnnnnnnnnnnnnnnnnnnnnnnnnnnnnncggnnnnnnnnnnnnnnnnnnnnnnnnnnnnnnnnnnnnnnnnnnnnnnnnnnnnnnnnnnnnnnnnnncattcaaggcaatctgtacattacaatacacgtgaccatcacacgtaaaggtccaactaatacctcagcgacattcttatggctgggagtacaatacatagtgcttggcgtgggtcgtgatttcgactatatcactatacatataaccatctatcatgtgattatggccctgtttggcacagcttattttcagcttcttcacaaatttaagctgaagtcctgccaaacagtcagcttctgcagcagcttatcagttcagctgcttctcaaaatgaactaaaagcagccaacaagcagaagctgcttcttaccagcttatcagataagctgcnnnnncaacaagcagcagttgtcccaaacagggcctatatacaatcttataataagtattatctccattctcgaatatttatcgttcgcttgtttnnnnntggaggagtcaaatatatatgccatgcacgagcacgcttgtcttggatgacgtaacagcatcatgcgtactgtatgctgtgcgatggttacgttggtggacgcgatcggcgctctagacggggtaggacggcagcttggcgagaccgcagnnnncctccccgcggacgccgcgttgccggatccggacgtatccgccctcgccccacngacgcgccccaggagttcttcatcagccagtaccttgtgccgtcggccgccgtgccgtacccgacggccgtgatggcgtggttgaggtccgtgccgcaggccccgcccagcacgccgctgtcgtagaagcggaacgccatgtcctcgccgttgatggccacggacacgggctggtgggccacggcggccgcgagcgcggcctcgttgttgcgcggcacgtcctcgtggccccggatggacgcggcggcggcggcggccgacgagcggcagggcccgtcccggccctggtacgggtagcccgactccgaggccagcccgccgcggcgcgcgacgaactggaaggcgttgtccatgaggccgccgtcgcagccctggtccacgccgctgacgtcgcagtccaccagctcctgctccgacagcgacaccagccgccccgtccggatcttgttcagcccttccaccgccgccaccgccgagaacgcccagcagcagcctgcgtgcgtgtgtgttgacgtgttgtgcatggctacgttggattaattgcctaaaataactgggaaccttttaacttaattggtccttcattcagaaaaaaggtagctagatggagacgtatccacggccacgcacggtaggttttgatcgttcactattcagaatgcatgcatcgtgcatgtgcgcaggtggtgtttccgtgtttgcatggtcgttctcgttcgtaggtacgtaccgcacgctccctggtccttgacgccggtgacggcacccatggcccgccagtccacgctctgcgccgcgtccgccaggctgaagttctcgtacctgaaccggccggcgcccgcggacggcgccgggcgcggccggagcccggtcctggccgcgcggaactcctggacggtgaggtcggcgaacctgttggtcgccagcccggtggctgtgcgtccctgcggcgttgaacgagtcgatcagctccgcgttggcccggaacacctccagccgccgcgccttctcggcctcatccttgtacgcgncgcccgtgctccgccatccacttctcgtgccgcgacgccatcgcggcggcgccgccgcgagcgcgcggggagcggcggcggtgcacagtacggcgctgcccacgacgaggacggcgaggaggaaccgtgacgcggacatatttttttgggggggtatgctagtgtatttagctatggagttagtgtgtcttgtgtgtgccctgctagtgtgtcgtcgtctttagctcatgtcatgtgacctagctagcttagcgggtgcttggccaaaccctgcaatgcaggaaggggtttatatagcagtacgttcaggaggtagccggaaaggacccaaaaggatttaagttaggcatggttaactgtgactccattgtcagtgttagcaggaggggagagagttagcctaacaaattatatatccatggatcaggagaaaagaggcgtcaagtaagctcccaccatggacgattattatcacagccatcgtattcagggcactcgttctcttgaaaaggatccaaaattcataagcatatatgcatgtaggacataattctgatgtagctggtggtggacacgccgttttttcttttatctttcaacgagtgagactggcgaggacatggagtccacacttgcgctgctggccagggctagctctgctctgctggttgaaacgaaacacttggggttggactggtgacgtgagcgagcggctctccttgaccgagacgtacgtgaccgtgagtggtttgctggattcctatttcctacggcagcctcggaatctcttggctggctagcttgcagtcactgggtctcttatcctcgcagagattgggatcggacatttcgtggatgcaaattaaaatgcctagctaggtgtcgcttgccgcttggtatttagtgatatatatatatatatatatatatatatatatatatatatatatatatatatatatatatatatatatatatatatatataaaaacaaataaaaa

SEQ ID NO: 19539 - DNA, 1659 bp, Zea mays
ccgttgctttttgtctcaatctaaatcgtcaaaaatgaattaacaacacgattttgtccgagttcagagaattcgctaaatcaagtcgttagtcctcggatttccatttcaagattcgggaaatggtttttttagttgaatagtgtatcgatccagtgtgcattgctaaaaatccggacacaaaaatatctatagttttctgtaaaaaaaaggagaaaagaaaataaaaaaaatatctctacagctgttcttcccgagcgctcacctctgcttccttcacccggtcgtcctcatccgctccggttgctgggaacaaaaatctgtccgccggtggccgtgcttatcctcgcagccgccgctctgctcaagatttttctcaccgccgttgcctcgttcccatccgctcggccatcctggataaaaatcccatcggtgtccatcttctgctctcaaccaagcgcccctgccttgctcctcggcctccctcttctgccgcagctcgccgagttcctctgctctctccctggcgcgcgcgagcttgcccctgcgcgcagctcgccgggatgcccctttccccagccgcggactccctctccagagctcctccctgtgcgcgctggagtttctctgctccaaaaatggctgccgcgagccccccatggcgtctttccctcggcgcgtccagctcctttgttctccttgccggagctcactgcgtcgcgcccaagcttcctccctctgctcctccaagctcagctcgcccatggccgtcgcgcccttgcttcccagttttctccatggccgccctttctttgcccccaggtggcgagctcgctcctgtcctctgcccaacgccggcaccctccacagccaagctcgccctcacctccaaggctctgctcacgttcaaactctgctcatctgccagtttccatagcacgcaggtagaatctccaatgtctggatttgtgtggagtggtgtgtttggggagtggtgggggtgctccctgttcaaatagatggtggccgggagggactcatggtctggtggctgcacggcagcaccaccacgaccctgtggatgccatatgtgacttacgtatgggatttggggaagaagtgctagcagaggagattgaagaaatcctagggggttgaatgaaaatagggcatggttttcatttttcaatttcagtctatagtagggaacttaaaagtaccgtagaaattcaaagaaaagtcgtagaaacaaaaattcacttttattagcttcggcacaatacatagcatatgggaaaaaatggtaaggtccaaatatacggaataatttgctgcagtttaattatattagtgtttctgtaatttaataatatttttaaatctgtaaatgcgaaatttctaaaaattttagacacgagttgattgtatatctagaggttatagaaaaagtttcatacagaaatgaggttgctaagtgagattttactaatttagtttgtttatgctagaaaagggtaaaaatatgtttagtattcaatcggctagtcaacatgttccataattgtgttaattttgcttatatggtaaagtgatgctttgtgttaatagtcatcgtgttcagagttaaatgatttaaaggattgttggtgccacccaacg

SEQ ID NO: 19540 - DNA, 1552 bp, Zea mays
gccgcaactaggcccgccaatgcatcatccgacaggcgccgccttaatacagtttttttgatggagttggggtttaccatttcatggaccaggatcaatcaacaaatctacacatgaagtcccaactctctcagcgcgcaaattctgctgcagtggcagtttttgcgccgtgtctacatgaaaaacaaacgattgtttcgtaacaaacagagactgtaaattcctgtaggtgtatagtcatggtgacacgtatatactgcagacttcttaacagatcgccaaaaggtgaacctccagctgattttttatcaattcttgctgctgggtgggccaccatcctgcgagccactgccttgtgagttgctaccactgcctccactgttcccgtcctgctgcgatgtttgccctcccaatccactgaatggccatggcagcgacacattgaacctcctctcaaccacccttggattctcctgcctctccatttgtccctcagcagcagtagagctccctgatgcagcagcagcaataccaacagcctgctgagaattagagcccttccgcacctcataatcaggatcgtcagtgggaagctcaaagcgacagatggggcacgagttgtgaagctcaagccacggcatgatgcagtcggtgtggtagatgtggttacagggcatctgcttggccacctctccaggagagaaatcctccttgcagacggcgcactcagcgccctccgcagctgcgaccatggtgtgagtcacgacgacgtcggggagcgaggagagggccgacttggcagccggcggcgtgccatagcggttggggtcgttctcggcgagctgctcgatgagttgttccaagcctgggccgacgaagtaatccccgaagcttgccccgccgaggcgccctaggccgggtccggagccgaggctcgcgctggcatcgtcgaagaggacctggatgttggcgcctccctccacgaggctttggatgtaattctggaagaacattaccgggtcgaagggctcgggctcgttcctgtgggtggccgtgccaggggcgaaacgtatgctggagccgctgatcctgttgggttgttcgccgggtccgacgaaggagttgaggatggaggagatgtagcggggctcggaccgagaggtcgcagcggaggaggacgagaaggaagggggcctgccggtgccggctgctggggcggggcgcggggcggtactggcggtagggatcgtggtggaagcaaaagggaaagggagctggatgaaggttggggcagggatggtgacctcctcgaggaagttgccgtggcactcggggcacgagagctccccggcggcgacggcggaggccgcgatgaggacggtgcggttgcattggtagcaaaagtattgcttcgcagcggcggctggagtcgacatgggagcgaccggcgatctcgcggcgagggtggattaggatttttttttttctccctcgttctctgtcaatgcaatttggcttttcgatgaggatgttctaggtaatggtctcgtgc

SEQ ID NO: 19541 - DNA, 2539 bp, Zea mays
  misc_feature (1724)..(1724): n is a, c, g, or t
ccacgcgcgagacttcccgcctccctgtcctatccctctctagtctctacccccatctgtagtgcggtctgcggccaagagcccggggaaacgatcgagacgatatgtgcgggggagcaatccttgccgaactcatcccagcacgggtgcaccggccgctgaccgccgccacgctctgggcggcggccctgagtgggaccactaccgtcggcaagtggaaggccgatgcagccgccgctaccgacgacgacgacgacgaagagttcgaggccgagttccagcttttcgacgacgatgacgagtgcgaggccgagttccagcttctcgacgaccaccaaccatctcccgcagcttcgcctgaggccagcggctgcaagcggaagcctgcccttgctcctcctgctggtgcccccgcttccacggatccggcgaccccgtgctccaggaagtacaggggcgtccggtaccgccggtcaggcaggtgggccgcggagatcagggacccgcggcaggggcgccgcgcctggctcggcacgtaccgcaccgccgaggaggccgccctggcgtacgaccgcgaggcccgccggatccgcgggaagagcgcgcggctcaacttcccgctgctcatcccgcacgagggtcccggccgtcacgcgcgcacgccggtggccatcgacctcaacttgccgcccgtctccgacggtctcggcgtcccggctccggctggcgtcggcgacgacggcacggcgaatgccgacggagatgcagatatggccagtactaagactcagagcacgctagcgcgggtcaaggaactgatcgcgcagggacctcacgacgagcggctggcggcgaggatcgtgcctgagctgatgatgcacgggagcagggacgaggctgcggcgttgatcgccgagttcagccgtcagatggaggagatcgctgcgttgcggagggaccttgagacacgcgagaggcagcttgttcagctggtttctctagtacttcgttgaccactcactccgatgatgcatgatctgatgactgtcaagtgtgaacaatgtgtttgtgacactagaacagtcatcatctactgctatagttataggtcctgtttggtacaacttattttcagcttcttcacaaatttaagcagaagttctgccaaacagttagcttctgcagcagcttatcagttcagctgcttctcagaatacactaaaagcagccaataagcagaagctgcttttcaccagcttctcagataagctgctttttcaacaagcatcagctatgccaaacagggccatagcatggtagacaagtgttctcagacagccactattgggcacagcaagcagtgcgtgttgctgctgctgcactccctctctcccacgtactgttcatgcagtgatgaaaactagcagcggcagcgctgacgctgtggccagttctatttcttgaactctggaccatcctagtactgtgctagtattattattactagcatatacacatttcttttgcgaatagtatatacgagaagaattgaagagaggcctgggttcatggactacactgcgaaaattgtacggctaccgcaaaatccatctctgctgcgccgcaaattgagctaacggtgtgctaataacggtaaaagtaaaagaacacgtgtgtgagacggagaagcttttcagttccgccagagcaaattgaatcgggcnggcagtgtaacagagaacggcaaaacaatactactataacagatggaatgcctttccagctctgaatgactcgccattgcaaaaaggaacagaagattacaagtagacatgcacaatcggagaggtactctacagagtgcagacaatacatcagcacagcgcgtcagagcccagccctgcgatctgaattctgacgggctgaaggctctacgggaatagccagtaatttttctcccgcgggggttaaaaagccagcccaggggggaaacgttttacacgacgagattattactcaccaaattacgctgctactggcctactgcctgctgctgctaccaacaccaccacctttactcctgctaaaactatgtggagtaatttgctgacagcggagaacgggtcaggagaaggttagtgctacaggaagatgaagcactccatggccaccaaagggttgtccagcgactccttcccctcaccgtcgccggcaaccgcggtggtcgtggacccggcattctcctctggttgcaccggcggcggagatgcactatcctcaggctcgcgtggctgcgccggctcgggaggcgcctgctgcccacgccgcggcgacgcgcggccacagggcctggtggggacaggcggcttacgctgtgtcgcagtcgcagaggcggcgcccgcgcggcgctgctcctgcgtccgcttcgccgcgggcgacggagacctccgcgccgcccgttccccggcatcgcgccgccgctgctgcagcggcggcggcggcgagggggacgcgcggcggcggggtggtggtcgccggc

SEQ ID NO: 19542 - DNA, 3223 bp, Zea mays
tgcatgcctgcagtttatgttggaaagaattaacacaggaacattgcacgtatttggttactgttttagaacctatttctataggttttctctttggagctttctgagctaaagtccaaaaaggattccatcttctgaacacttcagtagcaaagcaactatgttgtgctattaaatataaatctgcaattattccaccaagtgtttggcgttaagagtgtagctgatatgttgtcatgtataatttgctgaatatctggcactaagaacctttgtgtataacccactcacagttctttttcttcttcttgcccaataagccaggttccaagtgaagaagaaacagttctttcgaaacttcattactattacactgtttggtgcagttggcaccttgatctcttttactgtaatatcccttggtaggttcggtcccaaatttcacttttaacatgattatatgcttctgggtttctgcctgcctaactcacatttgatctcaataggcgctctaggactaatatcaaggcttaatatcggcgcacttgaactgggagactatcttggtaagttcatcacccaaagcataaacacttctgttgcccatatacagttctttctttctgactcttgtacatcttaaatttcagcacttggggcaatattctcggccacagactcggtttgcaccttgcaggtgttaagccaagatgagacaccattcttgtacagcctcgtgtttggtgaaggtgttgtcaatgacgcaacttctgttgtgttgttcaatgcaatccagaactttgatcctggaaatatcagcggtgccaaattactgaacttcattggcagtttcctttatctgttcggctccagcaccattcttggagtagctgtaagttatatgctcttccgcttctagctttgctaaagtttactgacatgtgtttttttctgctagtctggacttcttagtgcttataccattaagaagttgtactttggcaggtttgtacttgacacaacacaattttttgaattgaaaaattgatggtatttccactatcttacattcctcttatttgacatgcaccccaggcattcaaccgatcgtgaagtttccattatgatgctaatggcttatttatcttacatgctagctgaagtgagcaccctgtacttttaacctctgcagacattttgcattttttaaaagcaaacatagctgtaaattgttattaacgggttgcctttttattgtaagttgctcgatttgagtggcattctcactgtgtttttctgcggtatcgtaatgtcacactatacttggcacaatgtaacagaaagttcgagggtcacaaccaagtaagtagcttcataccttctgtatggacatttgcttttgatcatgcattctttggtaatgcttatgctaatgtactattggatggatcacaggcatgcctttgcaacattgtcgtttatctccgagacttttctgtttctttatgttggtatggatgcattggatatagagaagtggaagattgtcggtcaaacttataggcatactctctccctctttctctctcttcattgctcaactagaagatctttcttctgaatctgtattttctatcatgtgcagcccggtaaagtctatcgctttgagcagcaccattttagccttggtgctggtttcaagagctgcttttgttttcccactatcctttctatcaaatttgaccaaaaaaactccaaatggaaagatatcttttaggcagcaggtaagtctttaacttagcaacatcttaacttcttatgttctcttgaaacagttgttatattccttacatgatattggtcatttaggttattgtttggtgggcgggtctcatgagaggtgttgtgtctattgtgttggcttacaataaggttaatcttgtgtttggtctatctggtttgagctttggtctggaattatgttactgcttttgtttcctctatccattccaaaacataggacattttttgttgtcgtaagtcaaaaattctctaactttgacagagtttatagaaaaacaaaccaacatcaacagccttcatttcttaatcttatatagaagttgcagtattttagtctaatagatggacatgttttaaattttgaggcattgaaacaatttgcatcatgaaggcgttcgacttaatgtttccaaggttctgtggcagtgcgaggcattttgggaggtggtgagcgcctcgcttggcaccttcattttcgtgatgatgctgtccttcaggctgcagtgccacacaagttcgtttggtgtaggtgctgcttgatttttggcggtgcatgccgggtgttcgacaatgtttctgaggttttgtggcagtgcgaggcattttgggagggacatcatcatgcccaacttgaagtcgtccgtgaccacaacagcgagcgcggtggagtacatggatgaagtattgaaggcgttgccgccagccagtaccgtcttcgccgacccatgacactacctcgtagacaacacaagtctagatgagatcaggctcgcaagtatgacctacctgttgccattttttgttaatcttttaaactgaagcaaaagttttccccgtgagatttttcccctggttgtgtcgcgattaggcgtaatggatgcctcttttgctgctcgcatgtgcttgttttttttcccgtgtgtagcaacctttgcttagcattcataagaaaatgttgtcgtccccatatttggatagataaatggatctaattaaatatcacgtgcctatcataatgttcgcgttgctagcagatttaaaggggggtagtggggaaacaccattttccgttggtcaagcaattaactcgcctgagttagtgtgagccattgcttgctttactgccacaagaggggtcttgttgcagttatgcagctatctgatttgtatgccttttcttgtccggagattaagtcgatctgaccggtgcattcccatccccaccatctggtgagtccttttatttgttcttctgtaaaaatttaaaaatgtctctttgttttacaggtgaggccaagaatgaggattcacgaacactgcaattcaattatggttcattcaaacataaggcattggataaattcttaactaaaaaggttcctaaaaatcgtttgacttcaaatactaaactaacacaatg

SEQ ID NO: 19543 - DNA, 2139 bp, Zea mays
gaagctctttttcttctcgagtagcagcgcgccccctccccgccccacactaaaacagccacacgctcgccacccatggccaccaccaccaccaccaccacagcacaggcccactgccaccgctaccgctaaccatggcctcctcagcgtccctgcagcggttcctcctgccctcctcgcacgcggcggcgacggcggcctcgccgtcctcccggctgcgccgcacagggcgcgcccgcgcggccgtctccgtgccgccgccggcggcggcgggggagcaggtcccgacggagcggctggagccgagggtcgaggagcgggcgggcgggtactgggtcctcaaggagaagtaccgggcggggctgaacccgcaggagaaggtgaagctggagaaggagcccatggcgctgttcatggagggcggcatccaggacctggccagggtccccatggagcagatcgacgccgccaagctcaccaaggacgacgtcgacgtccgcctcaagtggctcggcctcttccaccgccgcaagcaccagtacgggcggttcatgatgcggctgaagctgcccaacggcgtgacgacgagcgagcagacgcggtacctggcgagcgtcatcgaggcgtacggcgccgacgggtgcgcggacgtgaccacccggcagaactggcagatccgcggggtgacgctcccggacgtcccggccatcctggacggcctccgcgccgtcggcctcaccagcctgcagagcggcatggacaacgtgcgcaaccccgtcggcaacccgctcgccggcgtcgacccccacgagatcgtcgacacgcgcccctacaccaacctgctctcctcctacgtcaccaacaactcccaggggaaccccaccatcaccaacctgccgaggaaatggaacgtctgcgtcatcggctcgcatgacctgtacgagcacccgcacatcaacgacctcgcgtacatgccggccgtcaaggacggcgagttcggcttcaaccttctggtgggcgggttcatcagccccaagaggtgggccgaggcgttgccgctcgacgcctgggtcgccggggacgacgtcgtccccgtgtgcaaggccatcctcgaggcgtaccgggacctcggctccaggggcaaccggcagaagacgcgcatgatgtggctcatcgacgagctcgggatggaggtgttccggtcggaggtggagaagaggatgccgaacggggtgctggagcgcgccgcgccggaggacctcgtcgacaagcgctgggagcggcgggactacctcggcgtgcacccgcagaagcaggaaggcctgtcgtacgtgggcctccacgtgcccgtgggccggctgcaggccgcggacatgttcgagctggcgcgcctcgccgacgagtacggcaccggcgagctccggctcacggtggagcagaacatcgtgctccccaacgtcagcaacgagaggctcgacgcgctgctggcggagccgctgctgcaggagcagcggctctcgccgcggccgtcgatgctgctcagggggctggtggcgtgcacgggcaaccagttctgcgggcaggccatcatcgagaccaaggcgcgggcgctgcaggtggcgcgggaggtggagaagcgcgtggccgtgccgcggccggtccgcatgcactggaccggatgccccaacagctgcggccaggtgcaggtggcggacatcggcttcatgggctgcctcaccaaggacagcgacggcaagatcgtcgaggccgcggacatcttcgtgggcggccgcgtcggcagcgactcgcacctggccgacgtctaccggaagtccgtgccgtgcaaggacctggtgcccatcgtggccgacctcttggtggagcggttcggggccgtgccgagggagagggaggaggatgaggagtaggaccttcgtcaagcgccggctgggactgtcctgacctattttatgaggtcttgattggatgtatatatatattcatcttaatctatatggatttctgaagtttgatctaaagtagacgcgctgccttcttccatggcacgatttgttttggtattgtcgtagcaacaaaatgtccccttattcacgtcacagagaataagtgcacgcttca

SEQ ID NO: 19544 - DNA, 909 bp, Zea mays
  misc_feature (815)..(815): n is a, c, g, or t
  misc_feature (879)..(879): n is a, c, g, or t
aacttccctacgccgcggtaggcacttccacggacgacggttgggttggcagcaggcacttgcgcttccccacgccgccgcacgccaagaaactaaaagggggcaaccgacgggctcgttcacctatatttgttaagtttcaggcagagagaaagatagaggagcaaacagcaactccagaagatgagtctccctcgccgccgccaccttgtcctgctcgcctgcctcctggtcttcctcgtcttcgccgcgtccgcgtcgacgagttccgccgaggtggccccgagcgtggcggtggacttcgtgcggcggtcgtgccggtcgacggagtacccgcgcgtgtgcgagagcacgctggtcccctgcgcggctggcgtggggcgcagcccgcgcctgctggcgcgagcggcgctggtggttggcgccgaccgcgcgcgcaactgctcctcctacatccgcggcggcggcggcggcgcgatgaaggactgcgcggagctggcgcgcgacgcggaggagcggctgcggcagtccgcggcagagatggagcggatgggccgtgccggcacaccgcgcttcgcttggtccctcagcaacgtccagacctgggccagcgccgcgctcaccgacacctccacctgcctcgactccctcgcccagcagtcccgcggtggcaaggacagcgacgacgccgtcagggtgaagaggagggtgggggccgtcgcgcaggccaccagcaacgcgctcggggctcgtcaacagggctccagcccggcgcccgcaccggcggacgtctcctgttgactctttgtagccancagcttagccacggaaatcttttgatgggttcctcgtttctcatccatggtcgacatcattcgnccccctgcatcttccttctcccattgccat

SEQ ID NO: 19545 - DNA, 1708 bp, Zea mays
attcggctcgagccaccacagcacagggacagcagcagtgccaccgccaccaccaacaccaaccatggcctccacagcgtccctgcagcgcttcctgcccgcctccccgcacgcgtcgtcccggcgccgcgccggccgcgcccgagcggccgtctccatcccgtcgtcgtccccgccggcgacacgggataatgaggtccccgcggagcggctggagccgagggtcgaggcgcgggagggagggtactggtccctcaaggagaggtaccggaccgggctgaacccgcacgagaaggtgaagctggagaaggagcccatggcgctgttcatggacggcggcgtcagggacctcgccaagatccccatggacgtgatcgacgccgccaagctcaccaaggacgacgtcgacgtccgcctcaagtggctcggcctcttccaccgccgcaagcaccagtacgggcgcttcatgatgcggctgaagctgcccaacggcgtgacgacgagcgagcagacgcggtacctggcgagcgtcatcgaggcgtacggcgccgacgggtgcgcggacgtgacgacccggcagaactggcagatccgcggggtgacgctcccggacgtcccggccatcttggacggcctccgcgccgtcggcctcaccagcctgcagagcggcatggacaacgtgcgcaaccccgtcggcaacccgctcgccggcgtcgacccccacgagatcgtcgacacgcgcccctacaccaacctgctctcctcctacatcacaagcaactcccaggggaaccccgccatcaccaacctgccgaggaaatggaacgtgtgcgtgatcggctcgcacgacctgtacgagcacccgcacatcaacgacctcgcctacatgccggccgtcaaggacggcaagttcggcttcaaccttctggtgggcgggttcatcagccccaagcggtgggccgaggccctgccgctcgacgcctgggtcgccggagacgacgtcgtccccgcgtgcaaggccatcctcgaggcgtacagggacctcgggttcaggggcaaccggcagaagacgcgcatgatgtggctcatcgacgaactcgggatggaggtgttccggtcggaggtggagaagcggatgcccaacggggtgctggagcgcgccgcggcggaggacctcgtcgacaagaagtgggagcggcgggactacctcggcgtgcacccgcagaagcaggaaggcctgtcgtacgtgggcctgcacgtgcccgtgggccggctgcaggccgcggacatgttcgagctggcgcgcctcgccgacgagtacggcacgggcgagctccggctcacggtggagcagaacgtcgtgctccccaacgtgagcaaccggaggctggacgcgctgctcgcggagccgctgctgcagcggcagcgcctctcgccgcagccgtcgctgctgctccggggcctggtggcgtgcacgggcaaccagttctgcgggcaggccatcatcgagaccaaggcgcgggcgctgcaggtggcgcgggaggtggagaagcgcgtggccgtgccgcggccggtgcgcatgcactggaccggatgccccaacagctgcgcccaggtgcaggtggcggacatcggcttcatgggctgcctcaccaaggaccgcgacggcaaggtcgtcgaggccgcggacatcttcgtgggcggccgc

SEQ ID NO: 19546 - DNA, 977 bp, Zea mays
ttgtcctgctcgcctgcctcctggtcttcctcgtcttcgccgcgtccgcgtcgacgagttccgccgaggtggccccgagcgtggcggtggacttcgtgcggcggtcgtgccggtcgacggagtacccgcgcgtgtgcgagagcacgctggtcccctgcgcggctggcgtggggcgcagcccgcgcctgctggcgcgagcggcgctggtggttggcgccgaccgcgcgcgcaactgctcctcctacatccgcggcggcggcggcggcgcgatgaaggactgcgcggagctggcgcgcgacgcggaggagcggctgcggcagtccgcggcagagatggagcggatgggccgtgccggcacaccgcgcttcgcttggtccctcagcaacgtccagacctgggccagcgccgcgctcaccgacacctccacctgcctcgactccctcgcccagcagtcccgcggtggcaaggacagcgacgacgccgtcagggtgaagaggagggtggtggccgtcgcgcaggccaccagcaacgcgctcgggctcgtcaacaggctccagccggcgccgcaccggcggcgtctcctgtgactcttgtagcagcagctagccacggaaatctttgatggttcctcgttctcatccatgtcgacatcatccgtcccctgcatctccttctccaattgccatgtatgcgtgtatgtatgggtatggtatgcgtgtatgtatggactacggatcgatcagctttctcgattgcgtggttgtcgttgtctatctgtagtaactctgcagctgggatcactcaattcccgctagtggttgttcaggattatgctcaagtttatgcgtagtaaatagcaaaatctttgattagcctaaaaaaaaaaacagtgagggggtagactaccattccgtgttcggtcatattgtccatattccgtgttcggtcaaaaaaaaaaaaaaaaaacgctcaaaaaa

SEQ ID NO: 19547 - DNA, 3754 bp, Zea mays
ctccgggtccacttggatagatgtgaacgtgtcagtatgtactctccagaaaatcgagcttccattgctttagagaggcagatgcatatataattcttgaaacgccgcgctgtttctcaacgtaggtagcctctgtcaacgcgatacagcagtaaacatgagtacaacgtgagctcagagccgtccatggcgtacgagggcacgtcggtaaaatctcaacgtcccgtcccgtgcctgcctgccatttcgattagttagaggagctgcgcctgcgtctgcctgcccccttgaactccccaagagccaagaaccagcgcagcagcgcgccccctccccgccccacaataaaacagccacacgctcgccacccatggccaccaccaccacagcacaggcccactgccaccgctaccgctaaccatggcctcctcagcgtccctgcagcggttcctcctgccctccccgcacgcggcggcgacggcggcctcgccgtcctcccggctgcgccgcacagggcgcgcccgcgcggccgtctccgtgccgccgccggcggcggcgggggagcaggtcccgacggagcggctggagccgagggtcgaggagcgggcgggcgggtactgggtcctcaaggagaagtaccgggcggggctgaacccgcaggagaaggtgaagctggagaaggagcccatggcgctgttcatggagggcggcatccaggacctggccagggtccccatggagcagatcgacgccgccaagctcaccaaggacgacgtcgacgtccgcctcaagtggctcggcctcttccaccgccgcaagcaccagtgtacgtccactcccactctgcaacagggctagtttacttgcatgcagctcgtaatgcggccgagccgcttgccactcgttcggtctcgggcgactctgttcttcacttcttgatgcgctgtgacgtgctgtgtctgcggcagatgattgaacaggacagttgttctctctgagacataatgtctgccaatcgttgcttacggccggcttagagctcgcgtctgaatgttcgacgcttccgtctgatcgttttcgcgcgctcatgtttaccttttgggctggttctggaatctgcatcttggttttgtttccctttcagatctgattcacgctgcgtcaacgtgcttgcaaagtggtgaatatgctgcgtgggagggagccttgtaaagtagtcggacgcatgggatttcagtcccctaaaatcacaacctgtgctaatctcacccgcataacgacacaagatcccctgccgactgttaaaaacaacagtttaggacgtcatttcaaaaacaaaaacaaacgcgtagctgaacccaaaaaaagtctcagcttgaactcttggtaggcaatagaaaatttcctgttggcatcatggggttggcagcactagctagtactaaatagaagcatcccagctgccaaagttctgtgctgaatagaacgtctgttccaaataaaatacacctgaggagccaaaggtcaagcatcccagttgttcaaactgccactgttacactccacgcttgtgaattgttttcctttctttatccgtaatggactgctaatccaaacctgctacttgtagattcctcattcgtcatgcacttttttccttgataaactggtgaaatacaaaggttcgtttatattatagtagctttttatagacaacgaatatattatataccttacctttgtcacaaatacgatctttcctgcctttctgtgttatctcgaaccagcggcttcagtttcgttctttcttggaccacccgttggttggtcctacagaggagaggacaagacgtcccggattgggttcactccgagctgagcctgagaccgtgagacgaactggtcaagcaaggtgacaacactgttgttaactaacgagcaacgactaacgacacctccatccccatggctgtgctgcactgcagacgggcggttcatgatgcggctgaagctgcccaacggcgtgacgacgagcgagcagacgcggtacctggcgagcgtcatcgaggcgtacggcgccgacgggtgcgcggacgtgaccacccggcagaactggcagatccgcggggtgacgctcccggacgtcccggccatcctggacggcctccgcgccgtcggcctcaccagcctgcagagcggcatggacaacgtgcgcaaccccgtcggcaacccgctcgccggcgtcgacccccacgagatcgtcgacacgcgcccctacaccaaccttctctcctcctacgtcaccaacaactcccaggggaaccccacaatcaccaacctgtcagtctcagtctctctctctctcacactgcgttgagtgagccgttgacacggtgttaccaatctgacacgctgctgccggtaataacaggccgaggaaatggaacgtctgcgtcatcggctcgcatgacctgtacgagcacccgcacatcaacgacctcgcgtacatgccggccgtcaaggacggcgagttcggcttcaaccttctggtgggcgggttcatcagccccaagaggtgggccgaggcgttgccgctcgacgcctgggtcgccggggacgacgtcgtccccgtgtgcaaggccatcctcgaggcgtaccgggacctcggctccaggggcaaccggcagaagacgcgcatgatgtggctcatcgacgagctcgtaagttcccctcgatcgtctcatccattcagtccagtcaatggttattggttactaccccaagcgtagggtacgtagctgacacgatgcgcatacgtgcaggggatggaggtgttccggtcggaggtggagaagaggatgccgaacggggtgctggagcgcgccgcgccggaggacctcgtcgacaagcgctgggagcggcgggactacctcggcgtgcacccgcagaagcaggaaggcctgtcgtacgtgggcctccacgtgccggtgggccggctgcaggccgcggacatgttcgagctggcgcggctcgccgacgagtacggcaccggcgagctccggctcacggtggagcagaacatcgtgctccccaacgtcagcaacgagaggctcgacgcgctgctggcggagccgctgctgcaggagcagcggctctcgccgcggccgtcgatgctgctcagggggctggtggcgtgcacgggcaaccagttctgcgggcaggccatcatcgagaccaaggcgcgggcgctgcaggtggcgcgggaggtggagaagcgcgtggccgtgccgcggccggtccgcatgcactggaccggatgccccaacagctgcggccaggtgcaggtggcggacatcggcttcatgggctgcctcaccaaggacagcgacggcaagatcgtcgaggccgcggacatcttcgtgggcggccgcgtcggcagcgactcgcacctggccgacgtctaccggaagtccgtgccgtgcaaggacctggtgcccatcgtggccgacctcttggtggagcggttcggggccgtgccgagggagagggaggaggatgaggagtaggaccttcgtcaagcgccggctgggactgtcctgacctattttatgaggtcttgattggatgtatatatatattcatcttaatctatatggatttctgaagtttgatctaaagttcacaccagattactgcaacccacgtggattaaagtggatacgtagcattcaaacaagtcctcagcggtgagatg

SEQ ID NO: 19548 - DNA, 1549 bp, Zea mays
  misc_feature (20)..(20): n is a, c, g, or t
  misc_feature (34)..(34): n is a, c, g, or t
ggctaaaagaattatatatntgggacagaggggntacgttggaagcatctttatagccagcagtcggctgtacttgctcagtcaagaaaacgcgacataggcctccctcaccaacactatctgctataaataaaaggatcccgccagtacattccctctacgtggtcattgaaccaaatcgcagttcctatgtcgacacatcactgtcaatttccacggaagttccagctgcaatccgatgcatagattacacagaatgcatatacttccaatagtaggctatgccatctccatatcactgtgactcatgagtacagtgtaaacatgaaggcaacgttctgttcgtaaggatttcagaacattttccgagtaactcatttatatgatccgttattcgatcttcagatatggtcctgttattcgatcttcagacttactaaagcaaagccatgtggagaagaacttcgccctctacttggccttcttggaagcctcgtacaagtagccagcgataactacggctgcagcaactgctaccccaaaggcactctgtgcaagcacggcggcggttggaagatctgatttggatggtgctgtgctgcgaggcgtgaagccaagctcagagagtttcttgtgtgattcagcataatctttgaagaacgcatcttcatcctttgcatagagctccacatagcgcctaaattcaggatctgataacagtgccttgtcagttgggagctttaaaagtccctcagattcctcattcaacagctcaagaaagtatgagttatcaaacttaagaggctcctttgtccaggcaccatcgaatccagacctctcagggtgagcccttcccagagtatgtccccctgatagagctacaatatctttgtccgataagcccatccgataaaagatgtccctcagatgtggtgcacctttcttagcatctggcagacgcccttcacgggggcacaccgacgaatcacgtctgccaggaataaattcaacagttggccccccagtcacttcgactgcaaccactccagcaagctgatacaggtctgcatatgttatctttggattctttgctttgataggctcaaggagatcgatagcaatctttaaaccagcatttgaaccatgagtgtactcttcttcatatctaatcgaaccatttgcaccaccagtttttgtcttcaggtcataagttccagcatcatgccatgcgaggcggagcatgatcggggcgcatcccttgttggagatgagggcgcggaggtggcggcgcgccctgtcgacctggcgcaggtattcggcgtcgaccatgggagccgccatcgccggcgcctcagccgcggattcctggagatcggagagttggagtggaaccgtgggcggagcggaggcgtgtgggtggcgagtgctgactgactgctgagcagtgggggatgggaagggaggaaacgacaactgacgagccgaacaagataacgcaagcgagcgattctattggcctccagttgccggcgcctggcaacccccggcc

SEQ ID NO: 19549 - DNA, 649 bp, Zea mays
atacaaaaaaagtttagttttctgttcagattcctagaaaaatgtcggctcttgcagatttaatcaatctcgatctctccgactcctctgagaagatcattgccgagtacatatggattggtggatcaggcttggatatgagaagcaaagcaaggactttgccgggaccagtgaaggatccatcggagttaccgaaatggaactatgacggttcaagcaccggccaagcccccggcgatgacagtgaagtcatcatctaccctcaagctatcttcaaagatccattcagaagaggcaacaacatccttgtgatgtgtgacgcttatacaccggctggcgaaccgatcccaaccaacaaaaggcatgcggcggccaagatctttagcgacccaaccgttgccgccgaagaaacatggtacggaattgagcaagagtatactttgctccaaaaggatactaagtggccagttggttggcccgtcggtggcttcccaggtcctcagggaccatactactgtggagttggagcagacaaagcctttggaagagacatcgtagatgctcattacaaagcatgtctttacgccggaatcaatgtcagtggcactaacggagaagtcatgcccggcccgtgggaggttcccctcgg

SEQ ID NO: 19550 - DNA, 2170 bp, Zea mays
cataaaccaaaaaagagccacatagtgtaccgggttcaacaaatggaacatcaattccagaccaaactttctgaaaatggaagttctgtggaggctcaggacaaagacgttattctgggttagtactgttatttctcatgatgagtggactccattatctgtcagtggtctccgtccgaagcctcgttatgagcatggagcaactgtgttgcaaaataagatgtatatatttggtggaaaccataatggacgttaccttagtgaccttcaggctttggatctgaagagtttgacctggtccaaggttgatgccaaattgcaagcagaacctgctgatccactaaaacaacacaaattgctccatgtgctggtcattctttgatttcttggggtaacaaatttttatctattgctgggcatacaaaagatccatctgaaggcattacagtgaaggaatttgatccgcatacttgtacctggtcaattgtcaagacttatgggaaaccaccggtgtctcgtggaggtcaaacagtgactcttgttggaacgacactagttttgtttggtggtgaagatgcaaaacggtgtctcttgaatgacttgcacatccttgatcttgaaaccatgacatgggatgatgtggatgcaataggcaaccctccttctccaaggtcagatcatgctgctgcttgccatgctgaccgctatcttttaatttttggtggggggtctcatgcaacatgtttcaatgacctacatgtccttgatttgcagacgatggaatggtcaagacccaaacaacaaggcctgactccaagcccaagagctggacatgcaggtgcaactgtcggtgagaactggtacatagttgggggtggcaataataaaagtggtgtttctgaaacactagtgctcaatatgtcaactctgacatggtcagttgttagcactgtggaaggacgtgttcctcttgccagtgagggcatgactttagtgcatagcaattacaatggttatgattatctcgtctcttttggaggatacaatggacgatacagcaacgaggtttacactcttaaactcagcctcaaatcagattcacagccaattgtagaagaagaaactgtctcagatactatatctagggtcagagaacctgagaccgaaatttctcaagatgggaggatacgcgagattgccatggacagtgccgattcagacctgaataacagaaatgatgaagcaagtgaacagcttgtagcagatcttaaagctcagaaagaggaactagaagcaacaattaacagggaacagctgcaaactgtgcaacttaaagaagacattgctcaagcagagaccagaaatgcagagctgacaaaggaacttcaagctgtccgtggccaacttgcttctgagcaatcaagatgtttcaaacttgaggttgacgttgcggaacttcgacaaaagcttcagagtatggacgccctggaaaaggaggtcgaactgcttcggcgacagaaagctgcttcggagcaagcggcgctggacgcaaagcagaggcaaggttcgggtggtatgtggggttggctcgctggaagcccgccaccatcacagtagttcgtacaggccgtggttcatatattttacttgtaacattacatatcatttgacatttgtctacattttttttgtcacatggcattcgtgtttcgttttgaccacacaaagaacaacgtgctctggcgagcgttatattgtgctcatagagaatcgttaggttgccccctcacaatcactcaaatgtatcattaggttttaacaatgtactgatcatgtatgaacttccatttgacgttgtgctggttgcctataggtagtttatttttcaaaaaaaaaaaaaattagaggttttgctgcattgcatgtgtcatggagctggtggatggcaagttttcgttgttcctttttgtggtttattagatgacgtgaattagtggtgaattgagccttattagagtgggttaaatacaactgtcccaagtttcttcgctccagcagattgtttgagggcagggctagctaggaacttcaggaattgctaagcggtactacctacctaaggacatgtttggtttgacaaaaaaaaaaaaaaaaagcggccctcgagctc

SEQ ID NO: 19551 - DNA, 4261 bp, Zea mays
aagccaaacctttacgtcttacggcttgtctgctgtgtattgtgtgttagaggtgtctgctcctaatttctagcctctcatattcgagtagcgatgtacgcaataacccaaatcatctgttctctgacgccgatcatcagttacaataaaaatcatcagctctagaactagtcatcataaatcataacgactaactgaaaaagcacactcttttccaaattataatggttttttttctgggtgtatagcaaattagaaaaattagactgactgataatctggaacagaaggagtaattagtaactaataaaaggaaaaaaatgacataactacccggtgcccataaagctcactcagccgagcgcccggatgatttgcacgtcagcccataaagctcctatttttcttggcccgacccagctgaagcaccacttcgaggccgcttcttagcaaggcccagagttaaatcgtccgtgggcgtggcgctcctctcgcggggagggttttagggtcttcgtctcccgctcccccgggtccattcgcacccaacgcagctacagacggtctccatggcgaagaaaggggcgaagagaaagcagcagttgccgccggctcccacggcgaagaacgggagcaaggctgtgctcccactgaaggccgcgaagagagcgcccaagaagcagaaggttctggagtcctccgacgattctgatacggagcagcagcagcagcttcaggaggaggactccgacctcgacgtttcctctgattccgacgccgaggagctctctgggtcggacgctgaggctgacgagctctcgggctcggacgccgatgctgacggaggctcgacccgcggcgacgacatggatgatgacgacgacgacgaagatggtgaaagcgatgatgactctcttgcggacgacttcctcgctggtagcgacgaaggaagcgagggtggtgactctggtctggagtcagatgggtctgatgaccttgaggcaaagtcacgagcaattgacgagcagaaactcaaggcggaagaagatgcagaggaggaacttcaaaccaacataagatcagaatcggttgttttctgcttaccctcgccagaggagctggaggaagaggcacacagaccgcctaacctaccaaatctcaaaaggaggatatccgaaattgtacgagtgctctcaaacttcagcaaactgaggcagaaagatgttccgcgaaaagattatatcaatcaactgaaaactgacgtcatgtcatactacggatataatgattttcttgttgaagcattaattgagatgttcccagctgttgagcttgttgagttactggaagcctttgagaaaagaccgcctgagtgcttgcggacaaatacactgaagagccggaggagggatcttgctgctgctcttataccaagaggatttaatttggacccgataggaaaatggtcaaaggtaggattagttgtctatgactccaccatttcagctggtgctactactgaatatatggctggacattacatgaaacaaggtgcaagttctttcttgccagtgatggcacttgctccacaggagaaggagcgaattgttgatatggcagctgctccaggcggtaagactacatacattggcgctcttatgaagaatactggaatcatctatgcaaatgagttcaatgagaaaaggttgcatgggcttatgggaaacatccatcgaatgggcgtgacaaataccataatttgtaactacgatggtaaagagctacccaaagttcttgggatgaattcggttgacagagtattgctggatgctccctgcacaggaactgggaccatttggaaggatctacagatcaaaacttcaaaggacattgaagacatcaggaactgtgcctttgtccaaaagcaattgctgctagctgctattgatttggttgatgccaactccaaaactggtggttacattgtttactcaacttgttcgataatgatcccggagaatgaggcagtgattgactatgcacttaaaaagagaaatgtaaaacttgtgccttgcgggttggattttgggcgtccaggattcatccggtaccgggaacatcggtttcatacttctttagaaaagacaagaagattttatcctcatgtcaataacatggatggattttttgtagccaagctgaaaaagttaagcaatacaatcccggtgacttctgagcagcctaaagcgtccgaaggagcagctgagaaggccgatggagaagatgagaaagttatttctaatgaacaggagacagctgttcctggtaaagatgaaaaaactgttgagatgaaaaatcataaaaagactaaggtgactaataaaagaacaagtgtggccaaagaggctggagggtataaacgtgaacctaataggtcaggaaagcatctcaataaaaataaggataccgataccaaggaagttgatggccctgaaagcactgaaacaaatggagatgggaaagaagagcaacgtgaacaaaccaagcaaacgagccacaaaaggaagattgattctgataaaactaaaaaatctggccctgtgagcttctcgggtgttcaagagaagaatcaggtcagtggcaagaagacaaaaaggaaatggcaattcaagctgaggcgagactgggaagctgaaaagaaaggtaccaagaggagtaaagtatgagtattcagatatccacaaaccacaatgaaatttgatccgctgggcaacaaacaattttgaccaagcatgggttcgcacccaggattttttttgcatgtacgaaatagcgattgtaatttgttgtattttattcgatgtgcgtgtagacgagtggcatatctgtcagtggaactgaagcaagttatcttgatgaatgccatgtgaatcctgctgcttatatatgtcaaattttagtttctacccacgagcccccccacgcgtccgcccacgcgtccgcccacgcgtccgcccacgcgtccgcccacgcgtccgcggacgcgtgggcagtaattgactatgcacttaaaaagagaaatgtaaagcttgtgccttgcgggttggattttgggcgtccaggattcatccggtaccgggagcatcggtttcatacttctttagaaaaaacaagaagattttatcctcatgtcaataacatggatggattttttgtagctaagctgaaaaagttgagcaatacaatcccggtgacgtctgagccgtctaaagcatctgaagaagcagctaaggttgatggcgaagatgagaaagctatttctaatgaacaagagactggtgttcctgataaagatgagaaaactgttgagataaaaaatcataaaaatgtgactaatataagaacaagtgtcaccaaagagactggaagccataaacgtgaatccaataagccaggaaagcatctcaagataaataagaataatgctaccaaagaaattgatggccctgagagcagtgaaacaaatagaggtgggaaagaagagcatcgcgaacaaaccaagaaaatgagtcacaagaggaagtttgcttctgatagatccaaaaaatctggccccgagagcttctcgggtgtcaaagagaagagacaggtcagtgacaagaagcggaaaaagaaatggcaattcaagctgaggcgtgactgggaagctgaaaagaaaggtgacaagaggaggaaggtatgaaggagtattcagatgtccacaggccccaatgaaatttgatgggtgtgtaagggcaaccgagaattttgagcaagcacgagtttggagccaacgaaaattttgatggaaactgaagcatattattatcttgctgaatgctatgtgaatcctgctgtacgtgttataaaaaaaaatcatatctgagctactagctgcaagaacctgacttctagatactgtgggttctgaatagtttcatcatgtggcttgtttggagatctagatcatgaaggcgctgtggcaactgattctgaagttcacgtttgggtttggagtcttgggagacaaggtgagatcagacatgtcctttagctgatcgatgtttgtgtttgataggagtgatgggggcggagagaatgcatggttgtttgttttcagatcagacatgtcctttagctgatcgatgtttgtgtttgataggagtgatggaggcggagagaatgcatggttgtttgttttcagtaattattggtcactttt

SEQ ID NO: 19552 - DNA, 2296 bp, Zea mays
gggcgacttcctcgctggtagcgacgaaggaagcgagggtggtgactctggactggagtcagacgagtctgatgacctcgaggcaaaatcacgagcaattgatgagcagaaactcaaggcggaagaagatgcagaggaggaacttcaaaccaacataagatcagaatctgatgagttcagattacccacaacagaggagctggaggaagaggcacacagaccacctaacctaccaaatctcaaaaggaggatttcagaaagtacgcacatctaataataccgttcctatttaccatgtttcatgtatttctactattattacgccctatcggatttgtagaatacaggttatattgtgctattttattatgagcattgagcagatattttgcactgactgctttcacatatactgatactgattttcttatctagttgttcgagtgctctcaaacttcagcaagctgaggcagaaagatgttccacgaaaagattatatcaaacaactgaaaactgatatcatttcatactatggatataatgattttctagttgaagcattaattgagatgttcccagctgttgagcttgttgagttactggaagcctttgagaaaaggccgcccgaatgcttgcggacgaatacactaaagacccggaggagggatcttgctgctgctcttataccaagaggatttaatttggacccgataggaaaatggtcaaaggtaggattagttgtctatgactccaccatttcagctggtgctactactgaatatatggctggtcattacatgaaacaaggtgcaagttcgtttttaccagtgatggcacttgctccacaggagaaggaacgaattgttgatatggcggctgctccaggtggtaagactacgtacattggcgctcttatgaagaataccggaatcatctatgcaaatgagttcaatgagaaaaggttgcatggacttttgggaaatatccatcgcatgggtgtgacaaataccatagtttgtaactatgatggtaaagagctacccaaagttcttgggatgaattcggttgacagagtattgctggatgctccctgcacaggaactgggaccatttggaaggatctacaaattaaaacatcaaaggacattgaagacatcaggaactgtgcctttgtccaaaagcaattgctgctagctgctattgatttggttgatgccaactccaaaactggtggttacattgtttactcaacgtgttcgataatgattccagagaacgaggcagtaattgactatgcacttaaaaagagaaatgtaaagcttgtgccttgcgggttggattttgggcgtccaggattcatccggtaccgggagcatcggtttcatacttctttagaaaaaacaagaagattttatcctcatgtcaataacatggatggattttttgtagctaagctgaaaaagttgagcaatacaatcccggtgacgtctgagccgtctaaagcatctgaagaagcagctaaggttgatggcgaagatgagaaagctatttctaatgaacaagagactggtgttcctgataaagatgagaaaactgttgagataaaaaatcataaaaatgtgactaatataagaacaagtgtcaccaaagagaatggaagccataaacgtgaatccaataagccaggaaagcatctcaagaaaaataagaataatgctaccaaagaaattgatggctctgagagcagtgaaacaaatagaggtgggaaagaagagcatcgcgaacaaaccaagaaaatgagtcacaagaggaagtttgcttctgatagatccaaaaaatctggccccgagagcttctcgggtgtcaaagagaagagacaggtcagtgacaagaagcggaaaaagaaatggcaattcaagctgaggcgtgattgggaagctgaaaagaaaggtgacaagaggaggaaggtatgaaggagtattcagatgtccacaggccccaatgaaatttgatgggtgtgtaagggcaaccgagaattttgagcaagcacgagtttgcagccaacgaaaattttgatgtatgaaatagcgattgtagtttattattttttattcggtgtacgtctcaagttttatctttaatgagtgacatatctggcagggaaactgaagcatattattatcttgctgaatgctatgtgaatcctgctgtacgtgttataaaaaaaatcatatctgagctactagctgcaaaaaaaaaaaaaaaaaactaaaacccgagggggggcccggtaccc

SEQ ID NO: 19553 - DNA, 3161 bp, Zea mays
  misc_feature (1320)..(1320): n is a, c, g, or t
  misc_feature (2136)..(2193): n is a, c, g, or t
  misc_feature (2737)..(2747): n is a, c, g, or t
  misc_feature (2794)..(2818): n is a, c, g, or t
  misc_feature (3141)..(3141): n is a, c, g, or t
ggtgatgatttattgatatagatatagacaaaataaaaatgaaactagtactaagctatcaacctattcatttcggattaaaactagctattcggactattgagacaaaacacagtacagtagaattcgttttgggttgaatccacctcattcagccgcgggcccggccgatttgcgcgtcagcccataaagttcctatttcgcttgtaccggcccagttgaagcatcagctcaattgtcgcttctcgtgatctcgtccttgtcaataaagaaaggccgcttctctgccaggcccagagttaaaacatccgcggctagggtttaaggtctttcttctccgctcccccggcccccattcgcacccagcacagctacagacggtctctatggccaagaaaggggcgaagagaaagcagcagccgccgccggcggctcccaccgcgaagaaggggagcaaggctgtgcccccaccgaaggctgcgaagagagcgcccaagaagcaggagcttctcgagtcctccgacgattctgatacggagcagcagctcctggaggaggcctcccacctcgacgtcccctctgattccgacgccgaagagctctctgggtcggacgctgaggctgacgagctctcgggctcggatgccgattccgacggaagctcgagcagcggcgacgacgtggaggatgaggaggaggaggaaggtgatggaagtgatgatgaccccctggcggacgacttcctcgctggtagcgacgaaggaagcgagggtggtgactctggactggagtcagacgagtctgatgacctcgaggcaaaatcacgagcaattgatgagcagaaactcaaggcggaagaagatgcagaggaggaacttcaaaccaacataagatcagaatctgatgagttcagattacccacaacagaggagctggaggaagaggcacacagaccacctaacctaccaaatctcaaaaggaggatttcagaaattgttcgagtgctctcaaacttcagcaagctgaggcagaaagatgttccacgaaaagattatatcaaacaactgaaaactgatatcatttcatactatggatataatgattttctagttgaagcattaattgagatgttcccagctgttgagcttggtgagttactggaagcctttgagaaaaggccgcccgagtgcttgcggacgaatacactaaagacccggaggagggatcttgctgctgctcttataccaagaggatttaatttggacccgataggaaaatgggcaaaggtaggattagttgtctatgactccaccatttcanctggtgctactactgaatatatggctggtcattacatggtatcctctctctaccttttcattatttgttttctgtccattactttgactaataatattctcctatagaaacaaggtgcaagttcgtttttaccagtgatggcacttgctccacaggagaaggaacgaattgttgatatggcgtaagttgttctcctttcccttgggcaagagttaatttctattacgacatcaaagttagcaatgtaactgtacgccttttcatgctacaatattaagatattatgtacttgtttcagaattttgattgttaatcttcaattgatctattcattagggctatgctatcatatgcaatgaacaatattagaatagattattttcttgtttacagggctgctccgcgcgggaagactacttacattggcgctcttatgaagaataccggaatcatctatgcaaatgagttcaatgagaaaaggttgcatggacttttgggaaatatccatcgcatgggtgtgacaaataccatagtttgtaactatgatggtaaagagctacccaaagttcttgggatgaattcggttgacagagtattgcttgatgctccctgcacaggaactgggaccatttggaaggatctacaaattaaaacatcaaaggacattgaagacatcaggagctgcgcctttgtccaaaagcaattgctgctagctgctattgatttggttgatgccaactccaaaactggtggttacattgtttactcaacttgttcgataatgattccagagaacgaggcagtaattgactatgnnnnnnnnnnnnnnnnnnnnnnnnnnnnnnnnnnnnnnnnnnnnnnnnnnnnnnnnnnattcatccggtaccgggagcatcggtttcatacttctttagaaaattcaagaagattttatcctcatgtcaataacatggatggattttttgtagctaagctgaaaaagttaagcaatacaattccggtgacgtctgagccgtctaaagcatctgaagaagcagctaaggctgatggtgaagatgagaaagctatttctaatgaacaagagactggtgttcctgataaagatgagaaaactgttgagataaaaaatcataaaaatgtgactaataaaagaacaagtgtcaccaaagagactggaagccataaacgtgaatccaataagccaggaaagcatctcaagataaataagaataatgctacaaaagaaattgatggccctgagagcagtgaaacaaatagagatgggaaagaagagcatcgcgtacaaaccaagaaaatgagtcacaagaggaagtttgcttctgatagatccaaaaaatctggccccgagagcttctcgggtgtcaaagagaagagacaggtcagtgacaagaagcgnnnnnnnnnnnggcaattcaagctgaggcgtgactgggaagctgaaaagaaaggtgannnnnnnnnnnnnnnnnnnnnnnnnattcagatgtccattcggctcgaggggcctaccatggtgtgtaagggcaaccgagaattttgagcaagcacgagtttgcagccaccgaaaattttgatgtatgaaatagcgattgtagtttattattttttattcagtgtacgtctcaagttttatctttaatgagtgacatatctggcagggaaactgaagcatattattatcttgctgaatgctatgtgaatcctgctgtacgtgttataaaaaaaaatcatatctgagatactagctgcaaaaaataaaattatattttttatttttatttaaaaaaaaaaaaaaaaaangaaaaagggcggcccccgac

SEQ ID NO: 19554 - DNA, 2216 bp, Zea mays
taatgccagtggagaggctcgatttgcggaatcacaggaagccacaagctctggcaaaaatagtacggcctcacaacttaggtgctcaaagaaggagaatttctcatttatttgcgaatgtttcttcatgacctcaagagtacttaatctcgggttgatgaaagctgtatcggacttcaaacatatttctcagcaactttcaaggttcgaagatgatttggaatcaaacagagcagtgagagatcaaggagggggttcaccgcagcttgagcaagatataactcgcttggagaaaattgtcgaaattttatcacaggacaaattctgttatgaagctcagatactacgggatggtgcattccttcaacgagcattatctttctacaggttaatgatactctggtcagttaacctagttggcggatttaagatgcctttgccatcacaatgtcccaaggagtttgcttgcattccagaacattttcttgatgatgcaatggatttacttgttctaacctctagaattccaaaggctttggaaagctttgtattggatgactttctcagcttcatcattatgttcatgggaagcacatcttacattaagaatccttacctaagagcaaagatggttgaagttttgaattgctggatgccacaaagaagtggcttgaattctacagcctcattgtttgaggggcaccaactgtgtcttgactaccttgttggaaatcttctaaagctttatgtggatattgaattcactggctcccatacacaattttttgacaagtttaacattcgacataatattgctgagcttctggagtatttatgggatgttcctagtcaccgaaacgcatggagacaaatagctaaagaggaggagaagggtgtatacttaaattttcttaactttctcataaatgatagcatctatcttcttgacgagagtttgaacaaaattcttgaactgaaagaaatagaggctgaaatggctaacatagttgagtgggagcgcagacctgctcaagaaagagaggagcggctgcgtgtatttcatcagtgggaaaatattgttcgttttgacatgaggctagccaatgaggatgttgggatgcttgcattcacctctgaacaaattccagcacctttccttctccctgaaatggtggaaagggttgcgagcatgcttaattacttcctcttgcaacttgctggtccccagaggaaatctttgactgtaaaggatccggagaagtacgagttcaagccgaagcagcttttgaaacagattgccaccatctatgtccatatctcaaggggcgacaaggaatctgtcttctcagctgcaatctcgaaagatggcagagcatacaatgatcagttgttttctagtgcagctaatattctgtggaagattgggggtgatcccaaaatcatacaggagtttgtgcaacttgctggtagggcaaaagctgctgcttctgaagctatggatgctgaggcaatccttggggacataccagatgaattcctcgatccaattcagtatactctaatgaaagatcctgtgacactgccatcgtcaaaggtcacagtagaccggcccgtaattatcaggcatctgctgagtgattctacagatccatttaaccgctcccacctcactcaagacatgctgataccaaacacggagctcaagttgcagatcgaggagtttgtccggtcccagcagtcgagaaagcgaactgctgcggcgttgttggagattggcgaagcggagggtactgatgatatggccgaatgaattgtgccaggagcaggggatggacacattttttttgtggggaaagagtgatggttaattcacatgaaatgtatcggtccatctgtccgtataaagttggtttcccggcttgtgtccctgttgcctcgattctttgtaaatattgtaggtgcacacctgatacaaatgtagttatagaggaagcctgtcagcccgtctcatcaacaatgtgttttacgatatccccactacaacttttttttaacacgatattatcactataacttgatatgtgtgttgggctgagaagcgtttgccttcgccttgttggttctccgcgataagtgtgaacaagccctggtcttctcatttctgcgaaccaacaatcacaagtgaattatttatgccagttgccaggttttcatcc

SEQ ID NO: 19555 - DNA, 917 bp, Zea mays
tttactcttcatcacttttcttctacatctgttatggcctgggatagttctctcgttttgtttacttgtctttctgttgtagattgccaccatctatgtccatatctcaaggggcgacaaggaatctgtcttcccagctgcaatctcgaaagatggcagagcatacaacgatcagttgtttgctagtgcagctaatattctgtggaagattgggggtgatcccaaaatcatacaggagtttatgcagcttgctggtagggcaaaagctgctgcttctgaagctatggatgctgaggcaatccttggggacattccagacgaattcctggatccaattcagtacactctgatgaaagatcctgtgacactgccatcatcgaaggtcacagtggatcggcccgtaattatcaggcatctgctgagtgattctacggatccatttaaccgctcccacctcactcaagacatgctgataccaaacacggagctcaagttgcagatcgaggaatttgtccagtcccagcagttgagaaagcgaactgctgcggtgtcagagattggccaagcggatggtgctgatgatatggccgaatgaattgtgcgagcagcagggatggacattttcttttgtggtggggaaagacggatgctaatttacgcgaaatttaccagttcatcggtccgtataaaatcggtttgccagcttgtgtcaccatttgtctccattctttgtaaatgttgtaagtgcacggttgtaattttaagtccctgtttgtttacctttgagattatggccctgtttgtccttctaggattatatagtccagcttattataagcatctattgacctgcttatgaattatcataatttaggtgtttagattacataatttatataataaaaaaaaccccccac

SEQ ID NO: 19556 - DNA, 1014 bp, Zea mays
ggtgaggttttaagaaacaagatagggaacctacttttcttacagaaaaaaaagaactcgtaaaaagatggagcaccctgcatctgcgtactgcgtccataacaagcagaggcacaatgaatatttgggcatcataactgacaaagaatgtcttgaaattcaacagagagagagagagagagagatgatgtacttcttttcaattaatcgatacgaaatcaagcatgagtatgccccgaaccaataaatggtgatgatacaagtaattagaatccacccgcccaaaattagatacgtgtaacccgagcagccaggtgatcagaatcagaacaggtacttggacagcacgtacttgggggcaggcctcctgtccccgagccagtgctgcatgtgcacgccgatggcgtccaggtgctggtcgctgcggccgtggaaccccaccaccttcccctccgtcgtcgccgacgagaagtaggcgccgaactcgtcgccgaacggcccgtacttgcccctgttggtgaggaacgtcagcgacctcaggacccggggcccgtcctccttgctcgtgtcgtagtagccgtacacgcacgtcagcacctcgtgcgggaagtccagcttcaccctgtgggtgatgtggccgctgttcccatgccttgaagaccagatggagtgcccgctcctgtcatactcgatctgtatcgacccgatgaacgctcctctcatgacgtagatctgcttcacgccagtgtaaaccccgtcgtcccatgcccggcctccctccccaccccatggccctggtcccatcgggaccggttctttcaccatgccataagcaacctgcaaaaacgatcacagtccatcgtcacttctccgaaccggattcagagcttcgtactcgacgcaagaatgtctagttacctcgccgtccgtgtaagtagcactcggcgcctgggcgagcatgttgtaatgcaccaatgggctagtcggagtcttcggtctgctaacaaaccgctg

SEQ ID NO: 19557 - DNA, 603 bp, Zea mays
  misc_feature (501)..(501): n is a, c, g, or t
attcttccttcccccaaacctaaagtactgaaacatgtctgacgaagagcaccacttcgagtccagcgacgccggagcttccaaaacctaccctcagcaggctggtaacatccgcaagggtggtcacatcgtcatcaagggccgtccctgcaaggttgttgaggtttcgacttcgaagactgggaagcacggtcacgcaaagtgtcactttgttgctattgacatcttcactgctaagaagcttgaggatattgttccctcttcccacaattgtgatgttccccatgtgaaccgtattgattaccagttgattgatatctctgaggatggctttgttagccttttgaccgacagtggtggcactaaggatgacctcaagcttcccaccgatgacagtctcagcgctctgatgaagagtggattcgaggagggaaaggatgttgtggtgtctgtcatgtcttcaatgggagaggagcagatctgtgccgtcaaggaaagtgntggtggcaagtaaaacccattctctgagagaggatatcttattaccagtggtcatgttataagacaagaacttgttttttttccttttctatttagatcatt

SEQ ID NO: 19558 - DNA, 1036 bp, Zea mays
agtaagacaggtagtggagggcggaaaggtgctgcaggttcatcaacaggaacaatagcattatccatacccatcaaatcacctaaaaggtctggcattgcaggtggggatgcagccgccagctgcttcacgggtacattagaagaagtaccagcactagatgaaggtgatgccccatcaacaccctgggatggtgactccgagtaccctgtttcagctgtatcagcaaactcttcatcatcggccctaggagcagccttaacacggctgacaaatgattctgggggcttatgataaactgatgaaagggtagaaatgtttgctagcagctcatcaagaagtgatgagtcaagctggttggagtcatcactgatcacaggtttctccgccaaaactacatctttcgcagcctcaggatcagtagacagaagtcgccagtatatgtaagctctgtccctcaaatcaggattatctgtttcaactgttgcattattgagaacagcctgaatcatctgttgtggcccctcagttggcttcttaagaaacaatttaacagtagcggttagcagctgcagttgaactaatgctggttcttcaggaaatgtttccaagaaactctcaagaagttcatcagcattgtcaattctttcagcatattctccaattatccaaatcatggatgccttagcctctggttcatctaaagtgtccagactttcacaaagtgtagcgatgatagactcatacgtgttagggtagcgtctgaagatgtctttgataacaattatagcttcctgaacaacataattaacttttatcttaatcagctcaagcaaaacgctgatgcacctttcagcagctctctccaatttaattgcacatctcccaatcgcacgaacggctttccgcacaaagtcaacatcaacctctgtggcatattctttgaattccaagagcacctgatctatatttcgatccgaggcaagctttatcataatctccagtttttccggacgcgtgggtatagggtcattgt

SEQ ID NO: 19559 - DNA, 2111 bp, Zea mays
tgcatgcctgcaggacatatgaacctatcatagaaatcactaagtagtttttttttatgtagactattcttttaggtttgatgtagtaagcagatagaattgtggtccatttggaaaatatagatacatcaccattaaaatagtgattgggttgcagggcaattaataacaatccacaatcgtaccagttaatctatgcttattctactttttcgtcacctacaattccatcgcttcatacaacatggtaagatgtacaaatcatgcaaggcatgaacacctccagtatttctggtgaaaaaactttggaaccaggaaactagcagtttaaatactgtaatctaataccaaaaaaactacaattcacaccagcttccgtgaaaaataaaatgccacgtccaaacacctatagcagctcatcgactgattttttttttgtagaaccaccgatccagatccattaagtttgtcgtcacttggtgagagcctccatagcttcaaagaagagaggaaccatctccctatttggtgttttgactgcacacttcacgccaggaacaccaaccacggctgtaacctctataaggaaggggattccacggggcatcttcgcggagagatacagaacatccatgttcgcatttttccgcttggctatgaagaacacatttgatgctacgaggcgctcaacagtagcatctatgctgctgatgacagagcccgggaattcttttgtaaattcattgtcatcaggcaaagatttccaggcctcaagaaaaccagctcgttccatttttccatcttcaccaaagaaaacatgcagcggaattttgtcattgaagtaccacactggctgctgattattcttccacagcaacctgtagtagcgagtttggtgcaccagggctgatattctggaacggggtcatttgtaaaagtgtccttgttgattggcctggttgcagtggagtaacctgaagtgcttcaccagcagcaagaccaaatgtgttcttgttaaactgaatcataaatccgtctaggacaccctgggtgccattctcaaaagatatgtcatagtatatctggccatcacgccgtgttagctgtgcactaatttgcagcccttgacctgtagtcgaaggcagtaagacaggtagtggagggccggagggtgctgcaggttcatcaacaggaacaatagcattatccatacccatcaaatcacctaaaaggtctggcattgcaggtggggatgcagccgccagctgcttcacgggtacattagaagaagtaccagcactagatgaaggtgatgccccatcaacaccctgggatggtgactccgagtaccctgtttcagctgtatcagcaaactcttcatcatcggccctaggagcagccttaacacggctgacaaatgattctgggggcttatgataaactgatgaaagagtagaaatgtttgctagcagctcatcaagaagtgatgagtcaagctggttagagtcatcactgatcacaggtttctccgccaaaacaacatctttcgcagcctgcagaaagccaaatatagctcagtcggtggatatttattatttaataaatcatcagtcgaaaagttgagatatgcaatacctcaggatcagtagacagaagtcgccaatatatgtaagctctgtccctcaaatcaggattatctgtttcaactgttgcattattgagaacagcctacaggcaatagcttcaaattagcagtgaactggcgttgaacaagactcttgatcatgatatcgaagatgaaccaacatttagagaagaaggaagcaactacttgcaacaacggtcaccattattaacagtgttctcaagacatcaacatgtcatcaatgcaaggctgagagcccatgataccaaataagtaaatattcagacaccttgaaggcttgaaccaagtggaaagctgtcatgtactcaatgatctctaaaagtctaaacaaaattgcaaagataagtaaacatgtaagcatctgaaatatcaacctgaatcatctgttgtggcccctctgttggcttcttaagaaacaatttaacagtagcggttagcagctgca

SEQ ID NO: 19560 - DNA, 1778 bp, Zea mays
acgttatctttttttttttttagttgtcttttttttttttttttttttttttttttttttttttttttttctgttttcttttgccgtgtagaaaactagtcatatttcatatgctatgcataacaagatgaaaatttccaggtccaacagggtaagatgtacagattatgtgaggcaagaacatctccagtatttctggcgaaaaactttggaaccaggaactatcagtttaaatactgtaatctaatacaaaaactacaattcacacaagcttccgtgaaaaaaaaaatgccgcatccaaacacctatagcagctcatcgactgataaatttttgtagaaccacatatccattaactttggcgtcacttggtgagagcctccatagcttcaaagaagagaggaaccatctctctatttggagttttgactgcacatttcacaccaggaacaccaaccgcagctgtaacctctataagaaaggggattccgcggggcatcttcgcggacagatacagaacatccatgtttgcatttttccgcttggctataaagaacacatttgatgctgcaaggcgctcaactgtagcatctatactgctgattacagagcccgggaattcttttgtaaattcattgtcatcaggtaaagatttccaggcctcaagaaaactagctcgttccatttttccatcttcaccaaagaaaacatgcagtggaattttgtcattgaagtaccacactggctgctgattatttttcacagcaacttgtaatagcgagtttggtgcaccagggctgatattctggaacgtgttcatttgtaaaagtgtccttgttgattggcctggttgcagtggagtaacctgaagtgcttcaccagcagcaagaccaaatgtgttcttgttaaactgaatcataaatccatctaggacaccctgggtgccattctcgaaagatatatcatagtatatctggccatcacgccgtgttagttgtgcactaatctgcagcccttgacctgtattcgaaggcagtaagacaggtagcggagggccagaaggtgctgcaggttcatcaacagggacaatagcattatccatacccattaaatcacctaaaaggtctggcattgccactggaccaggtggggatgctgccgccggctgtttcacgggtacattagaagaagtaccagcactagaggaaggcgacgccccatcaactccctgggatggggactccgaataccctgtttcagctgtatcagcaaactcatcatcatcagccctaggagctgccttgacacggctgacaaatgattctgggggcttatgataaactgatgaaagggtagaaatgtttgctagcagctcatcaagaagtgatgagtcaagctggttggagtcatcactgatcacaggtttctccgccaaaacaacatctttcgcagcctcaggatcagtagacagaagtcgccaatatatgtaagctctgtccctcaaatcaggattatctgtttcaactgttgcattattgagaacagcctgaatcatctgttgtggcccctcagttggcttcttaagaaacaatttaacagtagcggttagcagctgcagttgaactaatgctggttcttcagggaatgtttccaagaagctctcaagaagttcatctgcattgtcaattctttcagcatattctccaattatccaaatcatggatgccttagcctctggttcatctaaagtgtcccggacgcgtgggcggacgcgtggg

SEQ ID NO: 19561 - DNA, 3364 bp, Zea mays
  misc_feature (1510)..(1538): n is a, c, g, or t
atcaccattaaaatagtgattgggttgcagggaaattaataacaatccacaatcgtaccagttaatctttttttttttttttttttcgtcacctacaattccatcgcttcatacaacatggtaagatgtacaaatcatgcaaggcatgaacacctccagtatttctggtgaaaaaactttgaaaccaggaaactagcagtttaaatactgtaatctaataccaaaaaaaactacaattcacaccagcttccgtcaaaaataaatgccacgtccaaacacctatagcagctcatcgattgatttttttttattttttttatttatttttttagaaccaccgatccagatccattaagtttgtcgtcacttggtgagagcctccatagcttcaaagaagagaggaaccatctccctatttggtgttttgactgcacacttcacaccaggaacaccaaccacggctgtaacctctataaggaaggggattccacggggcatcttcgcggagagatacagaacatccatgttcgcatttttccgcttggctatgaagaacacatttgatgctacgaggcgctcaacagtagcatctatgctgctgatgacagagcccgggaattcctttgtaaattcattgtcatcaggcaaagatttccaggcctcaagaaaaccagctcgttccatttttccatcttcaccaaagaaaacatgcagcggaattttgtcattgaagtaccacactggctgctgattatttttcacagcaacctgtagtagcgagtttggtgcaccagggctgatattctggaacggggtcatttgtaaaagtgtccttgttgattggcctggttgcagtggagtaacctgaagtgcttcaccagcagcaagaccaaatgtgttcttgttaaactgaatcataaatccatctaggacaccttgggtgccattctcaaaagatatgtcatagtatatctggccatcacgccgtgttagttgtgcactaatttgcagcccttgacctgtagtcgaaggcagtaagacaggtagtggagggccggaaggtgctgcaggttcatcaacaggaacaatagcattatctatacccatcaaatcacctaaaaggtctggcattgcaggtggggatgcaaccgccagctgcttcacgggtacattagaagaagtaccagcactagatgaaggtgatgccccatcaacaccctgggatggggactccgagtaccctgtttcagctgtatcagcaaactcttcatcatcggccctaggagcagccttaacacggctgacaaatgattctgggggcttatgataaactgatgaaagagtagaaatgtttgctagcagctcatcaagaagtgatgagtcaagctggttagagtcatcactgatcacaggtttctccgccaaaacaacatctttcgcagcctcaggatcagtagacagaagtcgccaatatatgtaagctctgtccctcaaatcaggattatctgtnnnnnnnnnnnnnnnnnnnnnnnnnnnnntgtgtttgtaaactgaactctatggacaaaagacaggaaactgacgtcagatgacatctttaacttatccattaactaatgctggttcttcagggaatgtttccaagaagctctcaagaagttcatctgcattgtcaattctttcagcatattctccaattatccaaatcatggatgccttagcctctggttcatctaaagtgtccagactttcacaaagtgtagcaatgatagactcatacgtgttagggtagcgtctgaagatgtctttgataacaattatagcttcctgaacaacataattaacttttatcttaatcagctcgagcaaaacgcgtgatgcacctttcagcagctctctccaatttaattgcacatctcccaatcgcacgaacagctttccgcacaaaatcaacatcaacctctgtggcatactccttgaattccaagagcacctacaagaagctctgtcaacgcttgaacagagagaagtcacctgatctatatttcgatctgaggcaagctttatcataatctccccctgctcgaattccgttgctgtcgggtcattgtacttgcaaaagaaaaccttaatctcatgagcgagtattgtaggcctcttttgaactatcagattaatgttcctcaaggctacatactgaatttcaggctctgctgacaaaagagtaacaagagggggagccattttcttgcagagattcctgactacatccgtgctcgtaatgagctccatttgtagaaggattatcttgacagcagaaagaacaaccgcacaatttgcatgttggagacggggtgtaactcgttccactatgttttcagcttccctggcatctgctgctttatatcttgacaaagaatccaaaatgaaaacttggccccactctgtgcattcattcaaagctgtcagaagctttgacagtgtatggctggtgatttcaaagattggctgaacactactatcttgaatctctgccagagcagcaacagcatttgcaacaaccataggattattgtcagatattaagtccttaagggcctccagaaatcctctgtcctctactagctcagcgtttatatcataaagtttagcaacgcaaatagctgcagtcttccgtacatacggatcgtcatccttgaggcatctttgaagtggatcacagagatactctgtgattttgtccacgcggatacaacccattgtcctaacagccaaagcacgaatcaatgggtttgggtcttgtgaatccttaacaaatgtgttcacagcaagaatggcaagatcaggttgacttttagcatagttgatgagatacaaatatactagtttctttagctccaagttctcagtctgcatgcagttcacaacatcagtgaacaatgatgagacatcctttcctacagtcatagcagcaatcactttcttgacagcatcttttctcttgtccttatactgggagttgagctcctccttgagctcggggatctcccccttcttggtggtagagaagtacttggagtcgtgcccgctcatctcgtccgccccggcaagccgagcctaccctgtggacgacgctcgccgcctgctccggacgccgcagcggcgccggtggtcacggtgtggacgcttgcgatctcgcgcgcggtgtcggtgattggggagaggagaggctggaaaggagttcaatattttgtcaatttgagagatcgagagagggggcgacgacgacaagtcgaggacggtggagttctgatcaccagctgccctgccgctaaatccccggccggcctcgaggtacccaatg

SEQ ID NO: 19562 - DNA, 1520 bp, Zea mays
ttgtaaaacgcgggccaggattggtattcgcctccctatgggcgaagggcccccccgccccccctcgtgtttttttttttccttttcctttttttttttttttttttttttttttttttttttttttttttttttttaaagtaacaaggccaaaaggagtcaggaatggatagaaacggtcggtttgaattgtttcttgctagtacaggacggacggagccgatggttgtctgagctgagctgagctgtgggcaataatgtcaatttaagcattttctgctcacgtcctgacaaagtccggctctgatctaatacgaccaccaatggcagagcccacctgtgccgatttttttttgttttttaacctttttttttgaacaaaacttacactaagatccctggataacttcagtttttagacccctagctcggcgtcatggcctatgacgtcgagctcttacgtggcgacggcggctagggttgacgtgcaagccgacgtgacccctagctcggcaccatagatcttctcacgccacaccgccgttatcctcttcccgccgcgtcgccgccgttctgtgttacctcggcgccataacccgcgtggtgcggcgcctccattcaccattctagtagtacctacagaatttgcgatgcccaggccaccgctacatttggcgatgctccgacaggatgagaatctgaatctcaatccttaggacatcacttccaggatgagaattttctgagatgatgggccgacatatgttttcctagtcaagggcatacgggaatgattttttttatcgtggagcgtggccaacaccccttttcaactcagcatgctctccgtcggccacctcggcagcaggcagtttcactccatccatccgacagcactctatcatctcctgttgcgtcactacaactccttgacatcgatcattaaagcatcaccagcagctcggcaatatcatccctcatgctcataaaactgttatatattggtggagacgctccagcagttcccagattgctctttttttcttttttgtcaccaaaaaacctcccatctcccctcaaataaaggggaccacagcaactgtcacctttttttctcacacatcctccattctgacatgtggatcccatgtgttggtaaaggctactatcagtgatctgctctaacatctcctcaccatgtggttcatccctgccttcagaatacatacacaggctgtccccttttttaggatcatcagtgtctcgtatgcacccatcattctgcatcaatggaacagagaaatcggaccaggtacctttgttgaataaactatgacccttttcctctcaagtttatcaaaactctgtaaaagtgggtctgccgtagcttctaccggaagcaaaacaggtgtcacatacactatctgaatatctgatagccaacagggggggggggggccgggaactacggagctctctctctctctccggagccggggggatccctaattttaaagggg

SEQ ID NO: 19563 - DNA, 1843 bp, Zea mays
attcacatacttaagtggttcctagtcctctccgtgattacgtttggatgtgttgggtttttgccaaattttgttatcttattcaggttatgagtatgccgcataacctctaatacaatacagtacaatattaatgcgagtaaccccaatcagacagacccacgcttatggctggtattgacaacatcaccatggggggttcgtatcgggcttggttggagatgatatccagactcatgcgtaatcctttacaatgatattcttagtgtccattgccagcgtataatgcccactgaggtgtggttggacaggttacatccaaagagtgtcattgaccttgattgcagctttctaaacacgcagccgaaggacctcgctcgatgcactgaagaagatagctgtgaagccaatctaatgtttgaggaaaccaatttgctgagatatcaacaatggtcaatccctgtgactcaaaagaacaaaggtggtcctgaataagcttaagggtgtttataagtttccgatgatcctgaggaatgcaattatctctgaaagctctagtggctatccattcctctagcaatgctttgtgatcaaaatcagacatcctcagtacaattggaacaattatcggctcagcagcaggtttgtctttcttggtggcattattcttctgttggtccaaatctttgtgcccatcacctttctccagtgtgctttttttgcttttgacgaagtttttgttgtcctcagtagaatccattctgttctctgctagtccatttttgaattgatgttcgaccttcctttctacagagatgcctggattttcagaatctgttactgtcttctccgtcctggaattaccatcactcttttcctcatccataagataaatgcttggatccaaatgtattccctctataataattggtttcccatctttcatggccttcttcaaatcgccagccaaacccttgcgtacaactctgcattctctgcagaattcagtgataagctcttcaggtgaattaaaatcgcgagcccacacaggaactgaagtaagtggcgcatctgttgatgtccgcagcagctcatacaccatgtcagtctgcaaaacattaggcaaattgagcctctgagcaagttgtgtagcgattgttgattttccagtacaggcagttccacacaccaaaattactagtggaacccgttgatgatggaaccttgtcatcattttatagcgatttatatactcctctccgtatccccgtttttccataagcttgaacagattagcctctagatcactctgggatacatcaagcaggctgttgtcgacaagcagcttcttgagctcaagggcaatcttgatggcgacatgattaggaatcttggtgactgtgagcatcctgctgaggaggaacctggagaggacgtagtagtggtcggcgttctccccgagccagaccttgaccttgacgaaatcgtacttggaggaggcgttgcgggaagggatcgtctgcgttgcggacgaggcggcggcatcaccgaggtcggggggcggcagtgggtcgggatcggcgggtgctgggtcctgctgttgctgcatcgggtctgggtctggcggggctggggctggggctggggctgggatcgggatggtgatgatagatggatttggagaatggcgcggagacgagactaggaagatgaatcatcaatcgactcgagctcgagagacgcaccaagtcgcagaggatggagggatgcgcctcctcctcctcgtcctcccggacggaggaacaagacagctggctcccggccggcctcgaggtacccaatg

SEQ ID NO: 19564 - DNA, 1945 bp, Zea mays
ctgccctcgaatgacttcggctctgaggacgatgccaaaattttcttttcctttttttagataaatctttacaagtttatattcagataaagcaaacaatgccaaattttgttatcttattcagattatgagtatgccgcataacctctaatacaatacagtacaatattaatgcgagtaaccccaatcagacagacccacgcttatggctggtattgacaacatcacgatggtattttcacatcggtcttggttggagatgatatccagactcatgcgtaatcctttacaatgatattcttagtgtccattgccagcatataatgcccactgaggtgtggttggacaggttacatccaagagtgtcattgaccttgattgcagctttctaaacacgcagccaaaagacctcgctcgatgcactgaagaagatagctgtgaagccaatctaatgtttgaggaaacgaatttgctgagatatcaacaatggtcaatccctgtgactcaaaagaacaaaggtagtcctgaataagcttaaggttgtttataagtttccgatgatcctgaggaatgcaattatctctgaaagctctagtggctatccattcctctagcaatgctttgtgatcaaaatcagacatcctcagtacaattggaacaattatcggctcagcagcaggtttgtctttcttggtggcattattcttctgttggtccaaatctttgtgcccatcactttcatccttgggatttttttcttgagaacgtgcagaatcatggaccttggtttcgtggttctgagcataagatagaccttcactggttctacctttctccagtgtgctttttttgcttttgacgaagtttttgttgtcctcagtagaatccattctgttctctgctagtccatttttgaattgatgttcaaccttcctttctacagagatgcctggattttcagaatctgttactgtcttctccgtcctggaattaccatcactcttttcctcatccataagataaatgcttggatccaaatgtattccctctataataattggtttcccatctttcatggccttcttcaaatcgccagccaaacccttgcgtacaactctgcattctctgcagaattcagtgataagctcttcaggtgaattaaaatcgcgagcccacacaggaactgaagtaagtggcgcatctgttgatgtccgcagcagctcatacaccatgtccgtctgcaaaacattaggcaaattgagcctctgagcaagttgtgtagcgattgttgattttccagtacaggcagttccacacaccaaaattactagtggaacccgttgatgatggaaccttgtcatcattttatagcgatttatatactcctctccgtatccccgtttttccataagcttgaacagattagcctctagatcactctgggatacatcaagcaggctgttgtcgacaagcagcttcttgagctcaagggcaatcttgatggcgacatgattaggaatcttggtgactgtgagcatcctgctgaggaggaacctggagaggacgtagtagtggtcggcgttctccccgagccagaccttgaccttgacgaaatcgtacttggaggaggcgttgcgggaagggatcgtctgcgttgcggacgaggcggcggcatcaccgaggtcggggggcggcagtgggtcgggatcggcgggtgctgggtcctgctgttgctgcatcgggtctggggctgggatcgggatggtgacgatagatggatttggagaatggcgcggagacgagactaggaagatgaatcatcaatcgactcgagctcgagagacgcacgcagtcgcagaggatggagggatgcgcctcctcctcctcgtcctcccggacggaggaacaagacagctgccggccgccggccccgggggtcccaatg

SEQ ID NO: 19565 - DNA, 1166 bp, Zea mays
  misc_feature (34)..(34): n is a, c, g, or t
  misc_feature (1155)..(1155): n is a, c, g, or t
  misc_feature (1157)..(1157): n is a, c, g, or t
ggcagcgaccggtccacgtccactctctttctcnttcttcacctttggggtgtgctgctgctgcggccacggcggcgttgctgggcgaggccttgccgctgtcagtgggaactgctgacaccgagccggaggcggcggccatcatcgcccgcctcgccttccgctgcctgataccgcacgcgttgcagagcgacttggggccgcaaggaccactcctcccacaagggtgtcttggtggtgttgcagtcggagcacaccctaataacacccaaattcggttggccgctcatggtgtcgtcgtaccctgcttgcgcccttctccttggcttcttccccgcactgggatcggcagtggccttcctcgtgatcctcatcttggctgccgccggcgtccagctgcaagcatccatcgacccgccgacctgcagcttccccatgtcgtatggatcgtacgaggcaggctcgatcatgtcgtcgcggatgctctccacggtcgggaacggcgtcgagaagacactattcccagtcgcagttgatgatcctccaatcatatgttggggctccagcatagcttgatgacgctgcctcaacaagtgatggtctgcagccgatccatagctcaaactgccttcgctggcgctactattgctgatcacaaaggggaaaaggatcggtgtttcctttggcagggtgaaggcctggaagtggccttggtggtggtgatgatgatcttggtgatctccctccatgagagggagggcagtggagagctggctcatgtagattgcagacatgggatgcactgagaggaatttgcgctcaagatctgatggagctatatatgcagatctcgtatggttaggtgatgagtgaagatcaggatgagatatatggagagtaggaagaggcgaaccgaagcggctggtgcagtggttattatgtcggaatggcaatttgcagccagggatcaagagggaaagcgaggtagcgatcatcccggccggcccgagggttcccccttttataaagagacaaaggagagagctcgcctaggctgtgtagatcattcgtgtgtgatccttttcatggacacacgcacgagagagatgtggagagcaaacaatagatgcgctagctacatccccggcaggactngnagggtaccc

SEQ ID NO: 19566 - DNA, 2783 bp, Zea mays
tatttttaattattgggcatgtcaataaaggataccaagctcttcagatccgatgacatagattaaagaagactgtaaaaataatgtatgagaaccggtgaaatgaaatggagaccgaaactttacatactttagcttagatcaaggcacatcatattttgaaatggagactacgtacgtacaagaatgttgtatgcatactgacagaagcatcagaaacaaaagccatgaacgagtagccaggaagacaagcacgacaccttgcatcgtcggtatgacggtatgtctcaaaacattcccattacacttttaggttccttaaaagaaactcaagcaaaaggaagaataaaaaaatatgtagcagcagccagcgaccaggccgctgcctctggttcggttttaaagaacttgtacacactcaaaactgaaactcctcacactacatgcgattatatttactagctattgtagctagagacggtgctcttgtcgctcctatcatctcaactagacctcttctctctctctcactcatcgaacgaatcacatgacttgaacagtgacaagggtggtcacactagcaacaagaagctaaacaaaagcactacaggtattacggtagacgacgatggtaacagcagtaacagtaacgctagctaacagtcaaaggcacaagctagctgctagctgggaaaagcctacggtgcgctgggtcgtccttcgtagaggtagcagatcgtggatcagctccggacaagcccgcaggacagcgtcatcagcagcatggcagcgtccgtgatctcgtcctgctgcacgggcaacgccggcgacgcccggaagctgcaggtggccgcagccgctgaggcgggtgccgccggactcctgctccagctgatgagcccaccaatgtcgtcgacaagcagatccctgctcggacaggtgtcgtcatcaccatcctcggcggtggcctgcacgacagtcgcgctgtcggtggcagcagcaggagctgcaacgacgacggccgcaccgtgaccttgctggaccaccttgcaccgtttcttgaacggcagcgaccggtccacgtccactctcttctccttcttcaccttggggtgtgctgctgctgcggccacggcggcgttgctgggcgaggccttgccgctgtcagtgggaactgctgacaccgagccggaggcggcggccatcatcgcccgcctcgccttccgctgcctgataccgcacgcgttgcagagcgactgcgccatgcaaaacaagatacgcatgggccgggcccgcgcttgcaaagatcacgaatttgattggacttagaggcagaaaacaaggtaggataccttggggccgcaaggaccactcctccacaagggtgtcttggtggtgttgcagtcggagcacaccctaataacacccaaattcggttggccgctcatggtgtcgtcgtaccctgcttgcgcccttctccttggcttcttccccgcactgggatcggcagtggccttcctcgtgatcctcatcttggctgccgccggcgtccagctgcaagcatccatcgacccgccgacctgcagcctccccatatcgtatggatcgtacgaggcaggctcgatcatgtcgtcgcggatgctctccacggtcgggaacggcgtcgagaagacactattcccagtcgcagttgatgatcctccaatcatctgaggtatatagtcgaaaagggcatgagtgacaaaattaacaaggaaatcaaatctgtgattttttacacatgggatatgattggggaattgaacacatgtacagttcagtagctagcacgtacatgttggggctccagcatagcttgatgacgctgcctcaacaagtgatggtctgcagccgatccatagctcaaactgccttcgctggcgctactattgctgatcacaaaggggaaaaggatcggtgtttcctttggcagggtgaaggcctggaagtggccttggtggtggtgatgatgatcttggtgatctccctccatgagagggagggcagtggagagctggctcatgtagattgcagacatgggatgcactgagaggaatttgcgctcaagatctgatggagctatatatgcagatctcgtatggttaggtgatgagtgaagatcaggatgagatatatggagagtaggaagaggcgaaccgaagcggctggtgcagtggttattatgtcggaatggcaatttgcagccagggatcaagagggaaagcgaggtagcgatcatgcacggaagggagaggcatgtcccttttataaagagacaaaggagagagctccctaggctgtgtagatcattcgtgtgtgatccttttcatggacacacgcacgagagagatgtggagagcaaacaatagatgcgctagctacatcggaggggaacagtaaagctacgttagcgcagttatagcaacaatttcatgcgatattgtgagctattttttgccaaacaatttttttacaaaactgctgtttcacggatgaagcttgttttttatgctatcacaaagaaatcaagggaggtgaagatgaaaaaaagtagattttcatagctttctcactcattttcttctctcaaccacacattattaagctgtttcgccgaacagtttttccaaagcagttcgtcttcatcgagaaatctacttgtgaagctgttttccaaaacataatagcttcaataatggtgaagcttagctatgccaaatcgggcctaaaatacgtcggctgca

SEQ ID NO: 19567 - DNA, 694 bp, Zea mays
  misc_feature (635)..(635): n is a, c, g, or t
acaaccctttcctcgtctggtccaccacaccatcctctttctctctacactccctcgatctttccgacaaaaaccatgtctgccttcaccagcaaattcgccgatgagttgatcgctaacgccgcatacatcggcacacccggaaagggtattctcgccgccgatgagtcaaccggaaccatcgggaagcgtcttgccagcatcaacgtcgagaacgttgagaccaacagacgtgctctccgtgagcttctcttcaccgctcctggtgctctcccttgcctcagcggtgtcatcctcttcgaggaaactctttaccaaaagagctccgatggtaagcttttcgttgatatcttgaaggaaggaggagttctcccaggtatcaaagtcgacaagggtaccgtcgagctagccggaaccaacggcgagaccaccactcagggtcttgacggtctcggtgagcgttgcaagaagtactacgaagctggtgcacgtttcgccaagtggcgtgcggttctcaagatcggcgagaacgagccatcagagctttccatccacgagaacgcttacgggttggctaaggtacgctggtatctgcccaggagaaccgtcttgtacccttcgtcgagcctgaattnctagtcgacggttccatgacatccacaaggtgtgctgctggtgaccgagcgtgttcctt

SEQ ID NO: 19568 - DNA, 1913 bp, Zea mays
cttgctcgccttcacccctcgccgccgccgtcgccgccgtcgcaagcgacgatgctcgacatcaacttgttccgcactgacaagggcggcaacccggaccttattcacgagtcccagtgcagtcggttcacctccgtcgagctcgtcgacgaggtcatcgccctcgacaaggcatggcgcgaaaggcagttcgagctggataagatccggcaggagctcaacgctaccagcaagaagatcgacaagctcaaagccagcaagcaagaagaggaagcaaagaagctcatggaaatttagttggtgtttgttctggctatttgctttccactgaagtaaccgttagactgtagtgtgacatcctaaatattagctccactgtcaactccaaccctgattctcacactcacaatttgattgttggaattctaattgtgctttagggttctatgtgaagatacaaaaaaatattgcattcctattctggtcccgtattgaaattgccagtggtccctctgaattttgatccaattgttataaatttcagatgaactgaataaaactactacttgtaggcaaacaataaaattgtacgggcatttggagagaagagagtagaggataatttgaagaaccacgtggacctttgcaggatgcttgatattgtcgcattggaaaaggccattgtctcagatagataaccttctgcagacatcttatgatcaaggggacaaatgagatcatgccagctctactccatgtactgctggtgtcacaggattaatatacaatgaagatgttgattcttggagttgcacgaaataaccttgtgattgtgattagttacttcaaagcgttttttggtcttaatgcatggtaagtttattcaccttttatttcatcagacattatgacattccattttgagacaaggatctacaacaattatgtagaagcaatcctttaacaacatatgttacagttaatatattatgttttttctacatgtactcatttgaaacaagtaccagttcattcctcagctgatcttcttgaacaacttatttggttacctgtccttgctaattattattaaggggtgaaatgcagatctataccatgttatgatgtacatgttctttagcccaacaaatgatttttgtgagaactagttttttgtgagatctataccatgttagtccagaagacagtgcatgtctatattccttgttggtaagttctcttctgtgaagcagactgatctatcatgcctaaccactcgccttctctaacaccagcttattctacttctacttgctttagtgtttgtgccttggatgtagtaatactacattgttaaattatttttctttacaaacaaatatataaccttatgaatactagaaattgacgttgctaataatagagcaaagagacctacacatatctaaaacatagaaccccacagttctaaagtcgtatgacctatattctctatttcatacataattacttactaattccttggttattttcaataggatgggagagtgtcggatgcttcttcatatactatttcttggtccatcaaatctgcttgactcaaatgcaagttttgctcaaatgtggcaaaaataattgtctcaccaattgtcagcgcgcctgtttccagcaaagtttcagagaaggaaaagatggaatgtaactcaaattttggtggccgcacaagtgtggagacttgaattcatatatacttagttaggctcaatattagtgcaaacagttgataaccaagtttttcaattagtatttagttttggctttagagtacacttatgtatgagttatttgacaatatttatttatgagatattgaatggtacttatctatattatattagttacaatgttattaa

SEQ ID NO: 19569 - DNA, 1920 bp, Zea mays
atttcggcccaaatagcatgccaaggggcaagcgcccaagctcacccgcgacgtcaagcctgccctaacctcgtgtttcccttgctcggcttcaccccatcgccgccgtcgcaacgtgcccgcctgtttcccttgctcgacttcaccccatcgccgccgccgccgtcgcaagcgacgatgctcgacatcaacttgttccgcaccgacaagggcggcaacccggagcttattcgtgagtcccagcgcagccggttcgcctccgtcgagctcgtcgacgaggtcatcgccctcgacaaggcatggcgcgaaaggcagttcgagctggacaagatccggcaggagctcaacgctaccagcaagaagattggcaagctcaaagccagcaagcaagaagaggaagcgaagaagctcatggagagcacagacgaaattaagaaaaggttggcagccaaagaagttgaggtgcaggaggccaagagcaccctcgacgccaagctcacgacgattgggaacatcgtgcatgagtccgtgccagtcagcgaagacgaggcaaacaataaaattgtacggacatttggagagaagagagtagaggaaaatttgaagaatcacgtggacctttgcaggatgcttgacattgtcgcattggagaagggtgctgatgtggctggtgggtaggggtttctatttaaaggatgaaggtgtcctccttaacctggcattgataaattttgggctagcctttctgagaaaacggggatttaaaccaatgcaaactccctttttcatgagaaaggaaactatggcaaaatgtgcccagttggcccagtttgatgaggagctttacaaagttacaggtgatggtgaagacaaatatctcatagctacatcagagcagcctttatgtgcttatcacttaggtgatagaatataccctgctgaacttccaatcaaatatgctgggtactccacatgcttccggaaggaagctggttcgcatggaagggacacagctggtatcttcagagtccaccagtttgaaaaaatcgaacaattctgcattacaagcccaaatgacaatgattcttgggagatgcatgaagagatgctaaaaaactcagaagattactataaggagattgggctaccataccaagttgtttccattgtctctggcgctcttaatgatgctgctgctaagaaatatgatttggaagcatggttccctgcatcaaagaccttccgagagttagtatcctgttcaaactgcactgactttcagtcaaggagacttggaattgggtatggccagaaaaagaatgatgagcagtccaagcagtttgttcatatgctgaactctaccttgactgccactgagaggaccctctgttgtattctggagaatttccaaaaggaggacggcgtcgaggtgccaaaggcactgcaaccttatatgggtggaatagagtttcttcctttcaagcaacctttggatgtgaaacaagcttctgactccaaatcaaacaagtccaaatcaaagggaaatgctgcttgagctggatgaggaacactatgttaatttttgggcctaccagtacacaatacccatagcatgactatggcgttgcaggttttcgttttacccattttggtttcttggttgccacattatctaatgacctacctggcatacttatattgcaatagcatttcttgaaatctggaatatttgaccaaaaaaaaaaaaaaaaaatgtgtttagcccgctgccacagaacgctgcttgtttgtctccgaaaccaccagcgttctctgtagcacattagtaacaatttgctggtggatttgatatcatcttttttgaatgatggtgtattggtgtacttgtgatcgataatgaaaaagacatcttgtgttagt

SEQ ID NO: 19570 - DNA, 1391 bp, Zea mays
acaatccacagatacggtcataccgactgctgttgcccccgatttcccgtccgcccgcagtttctgaaggcacaccaaaacgatgagacctgtagacagtactctagtctctagtccacgaaatcctcgtacttgtgttggctggccctcgactagcgtgttgtagcacactagcgccacagtaatcgagagtgctctcccaggtcgaggtggtgtaggtgtttggcggagcagccggggcgttagaatctgaggaggagaagatggtggtgctggtggtggccacgacgtcggacccggcgtccattgggcccgccgccgccttcctcgccatgcccggatggtcccccggcccgcccatcgccgaggcgatggagagttttactaatgggaatgttcgattactgaagcatgagcgtagcattgtcgcagaggatgatcttgaccagcgatggcaggaagccactggagagtctgtttctgaggtcatattcctcagcaaacacactgcagtctccaaacgtccagcactcacagtgcatccaattggtgtgccacatctgaaggaggatgaaaccccaccccaaggaggaactcctggatgggcagcaattccaagtcctcgaattggaccttggctccggttgatgcaaaagatagctgtagaacaaggccttgttccagagtttgaggttacgcttgaggctactcaccatggaccagttaccagcacacccaccatgtttgttgagataggaagtacagaagaccactggggtcgacaagatgctgcacaggcaattgctctagttctatggaaaggtcttggtctggaggatggaaatgctgttggaacttggcagaggaattgtgaaaaggttctattaggtataggaggtggtcactatgttcctcgtcacatggatattgtcatcaaagatggtgtatgggtcggtcatttactctctggttactccttgccaatggacatgccgtcacaagtaaatgtaaagagttctgaagaggttgctggaatgtggaagcactccatcaaagtttcttatgaagcaacaaaggcagcatttcctggtggtgaagttatcgcacatcttgatcacaagagcttcaagggctggcagaagaatgctgttacatgcttcttgcaggagcagaacatcaggataggaaagcctagcgatttcctgtgacgtgctgcgacagcagtgctggacaggacaggtggaagaggctgtgaatgcttgagctgatttccctggtcacgccacgcgcgcgctgaataaatatgagacgtatagtaagactcgatccttaatgcggttcaagagcttgaatttgccgttagaaaaaaaaaaaaaaaaaaaaaaaaaaaa

SEQ ID NO: 19571 - DNA, 2207 bp, Zea mays
cattgggtacctcgaggccggccgggtcagaagcccgccgggccgcaaaacgaaaggactgccctaacctcgtgcagtcgtgcccgcttgtttcccttgctcgccttcacccctcgccgccgccgccgccgtcgccgtcgcaagcgacgatgctcgacatcaacttgttccgcaccgacaagggcggcaacccagaccttattcgcgagtcccagcgcagtcggttcgcctccgtcgagctcgtcgacgaggtcatcgccctcgacaaggcatggcgcgaaaggcagttcgagctggacaagatccggcaggagctcaacgctaccagcaagaagatcggcaagctcaaagccagcaagcaagaagaggaagcgaagaagctcatggagagcacagacgaaattaagaaaaggttggcagccaaagaagttgaggtgcaggaggccaagagcaccctcgacgccaaggtcacgacgattggcaacatcgtgcatgagtccgtgccagtcagcgacgacgaggcaaacaataaaattgtacggacatttggagagaagagagtagaggataatttgaagaaccacgtggacctttgcaggatgcttgatattgtcgcattggaaaagggtgctgatgtggctggtggtaggggtttctatttaaaggacgaaggtgtcctccttaacctggcattgataaattttgggctagcttttctgagaaaacggggatttaaaccaatgcaaactccttttttcatgagaaaggaaactatggcaaaatgtgcccagttggcccagtttgatgaggagctttacaaagttacaggtgatggcgaggacaaatatctcatagctacatcagagcagcctttatgtgcttatcacttaggtgatcgaatctaccctgctgaacttccaatcaaatatgctgggtactccacatgcttccggaaggaagctggttctcatggaagggacacagctggtatcttcagagtccaccagtttgaaaaaattgaacaattctgcattacaagcccaaatggcaatgattcctgggagatccatgaagagatgctaaaaaattcagaagatttctacaaggagattgggctaccataccaagttgtttccattgtctccggtgctcttaacgatgctgctgctaagaaatacgatttggaagcatggttccctgcatcaaagaccttccgagagttagtatcctgttcaaattgcactgactttcagtcaaggagacttggaattgggtatggccagaaaaagaatgacgagcagtccaagcagtttgttcatatgctgaactctaccttgactgccactgagaggaccctctgttgcatcctggagaatttccagaaggaggacggcgtcgaggtgccaaaggcgctgcagccttatatgggtggaatagagttccttcctttcaagcaacctttggatgccaaacaagctgctgactccaaatcaaacaagtccaaatcaaagggaaatgctgcttgagttggacgaggaacagactggaatgcaaatgcacgtgcaggttgcaaattcttatttatgttaatttttggggcctatcagtacacagtactcatagcatgacaaatggcgttgcaggttttggtttttacccgttttggtttcctggttgccgcattctctgacgacccacttggcacacttgtattgcaatagcatttcttgaaatccggaatgcttggccaccaccgccagctcaaccgggctgtgtttatcgcgttgccacagaacgcctgcttgtctgtctccgaaaccaccaggtgttctttgtagcaagcacattagaaacggcttgctggcggattggttttttatccttttttttttccaatgacggtggattggtgtacttctgatcggtaatgaaaaaaaaggcatcttgtgttagtggaatctagtgctgttgtggctggaacctggaaatcctcagtcctcacaagcatgttcttggattctcgcatcgcatgcattgtatggaaacaccggtacctacagcgatggtcaggttctggtggattctgtttggctctgctttccagccttttcactgctcaacgtgactgtagccttttataacatccatcgaattggatctcatcttctattttaaaattccatttataaacgctgttacatagtgtc

SEQ ID NO: 19572 - DNA, 1966 bp, Zea mays
gtgtttcccttgctcggcttcaccccatcgccgccgtcgcaacgtgcccgcctgtttcccttgctcgccttcaccccatcgccgccgccgccgccgtcgcaagcgacgatgctcgacatcaacttgttccgcaccgacaagggcggcaacccagaccttattcgcgagtcccagcgcagtcggttcgcctccgtcgagctcgtcgacgaggtcatcgccctcgacaaggcatggcgcgaaaggcagttcgagctggacaagatccggcaagctcaacgctaccagcaagaagatcggcaagctcaaagccagcaagcaagaagaggaagcgaagaagctcatggagagcacagacgaaattaagaaaaggttggcagccaaagaagttgaggtgcaggaggccaagagcaccctcgacgccaaggtcacgacgattggcaacatcgtgcatgagtccgtgccagtcagcgacgacgaggcaaacaataaaattgtacggacatttggagagaagagagtagaggataatttgaagaaccacgtggacctttgcaggatgcttgatattgtcgcattggaaaagggtgctgatgtggctggtggtaggggtttctatttaaaggacgaaggtgtcctccttaacctggcattgataaattttgggctagcttttctgagaaaacggggatttaaaccaatgcaaactccttttttcatgagaaaggaaactatggcaaaatgtgcccagttggcccagtttgatgaggagctttacaaggttacaggtgatggcgaggacaaatatctcatagctacatcagagcagcctttatgtgcttatcacttaggtgatcgaatctaccctgctgaacttccaatcaaatatgctgggtactccacatgcttccggaaggaagctggttctcatggaagggacacagctggtatcttcagagtccaccagtttgaaaaaattgaacaattctgcattacaagcccaaatggcaatgattcctgggagatccatgaagagatgctaaaaaattcagaagatttctacaaggagattgggctaccataccaagttgtttccattgtctccggcgctcttaacgatgctgctgctaagaaatacgatttggaagcatggttccctgcatcaaagaccttccgagagttagtatcctgttcaaattgcactgactttcagtcaaggagacttggaattgggtatggccagaaaaagaatgacgagcagtccaagcagtttgtccatatgctgaactctaccttgactgccactgagaggaccctctgttgcatcctggagaatttccagaaggaggacggcgtcgaggtgccaaaggcgctgcagccttatatgggtggaatagagttccttcctttcaagcaacctttggatgccaaacaagctgctgactccaaatcaaacaagtccaaatcaaagggaaatgctgcttgagttggacgaggaacagactggaatgcaaatgcacgtgcaggttttggtttttacccgttttggtttcctggttgccgcattctctgacgacccacttggcacacttgtattgcaatagcatttcttgaaatccggaatgcttggccaccaccgccagctcaaccgggctgtgtttatcgcgttgccacagaacgcctgcttgtctgtctccgaaaccaccaggtgttctttgtagcaagcacattagaaacggcttgctggcggattggttttttatccttttttttttccaatgacggtggattggtgtacttctgatcggtaatgaaaaaaaaggcatcttgtgttagggaatctaaaaaaattgtggctggaacctggaaatcctcagtcctcacaagcatgttcttggattctcgcatcgcatgcattgtatggaaacaccggtacctacagcgaaaaaaaaaaaaaaaaaaaaaaaaa

SEQ ID NO: 19573 - DNA, 8922 bp, Zea mays
  misc_feature (3456)..(3456): n is a, c, g, or t
  misc_feature (3738)..(3738): n is a, c, g, or t
  misc_feature (3748)..(3748): n is a, c, g, or t
tggattagttcatcggttgagaaggatcatcgattgagaaagatggatgttgagacctgctgtgttgtgtgcgacaaggatgttgagtagggctggaaacgagtcgagtttgactcggctcactgcggctcgctcatgcaacgagtcgagttcggcttggctcgctcatctagcgagctcgaaaaagcggctcggctcggctcgctcttggctcacgagccagctcgccgagctaacgagcctaggcataaacgtaaatctgctctttaaattataatataaaatcttaaaaaaatttaaataatatattttaaattagtaaaacagatatatcactaatataatatataaaatagattatttttgtatagtaatctcaaataacataaattaattgtctactcggtactaatattatatgccaattaagattttatgtaacaaattattgttgggtcgagccacgagccagctcgcgagctgcaccgagctgagctagctcgctctttttacaagccacaaaacaggctcggttcaggctcgttctgagcttcgagacgatctgagccgagccgagctgctgcgagcccgagccagcttgtcgagctcgagctttttttttctagccctaatgttgaggatgaaggccacccctttttcaaaggggcaaatactcttcagtaaaatcgcttggcaccaattggatcggcacgggaagcggtctggttcgtcctaggattggagaagggaactcaatgtaaaatggtcggcgactagatggtaacggagacctaatatccgattctggaaattctgtattagagaatgggcatgagagcaatttagaccctatatagctctaaacggaaaaaaaatagtctacgtcgggttcatagggatggaaatgtttttcacgcgtatccatccgcgaactttttttaatctaaattagtccattaaaatattaaaattatactaaaaatttaatatattttctattataaaatagcaaattaaactttaaagatgtctcttgtagttttaaattttgtttgtgagaataaatatagtctaattataaaactaattacaaagataaagactaaacggtaatgcaaacatattaagtctaattagtccatatcattctttgtgatgctatagtaaacatttgataatcataaattaattatacttaataaaattgtctcatttgtaatcttaatctctgtaattagttttataattaaaatatatttaatacttataattgtcattcaaacatttaatgcgacacatactaaactttagttaggataccaaacaccccttgattcatgattctagatggtttagtttgattttttttaagttaaggttctagatggagcaaaactgatccagatggtttagtttgaatgattctagacggtttagtttgatttttttagaaaaaagttaaggttttagatggagcaaaactgatctagatggtttagtttgattttttaaggccaggttctagatggtaagtttgagaaatcattagaaaaaaaatatcttttgcgccaggaagggttcgaaccttcgactttttgtttaggaaacaaacgctctatccgctgagctacaggcgccatttgttataatatttccatcagttttttttgggccgggccgatacacaacgaaggctgtcactagagacatttgcagattcagccttttcctgaagggccccatcaacttgttggacttttctcaacgctttggccggatggcgctatccacacccacgcagtaacatcaaacttgcacaacaacaaagaaatgccccgctcgcgagggtttttttttttttttaataaaaagaacatttcctctatgatgaacaatgaaacaatcaattacagaagggagaagaaaaagaatcagctcgccattctttctttaaccgagaggagcagaaacgagaaaatggacagaagagacaccagacttccaactgtgaagatttttacactggcgccaactgcatgccattggtacaccaacgtacatgccaccattgctacttaacccaaaaatgattaccatggcgccggtgtgctggtgtgaagccattgtgacttttttggacgaaagaattctatagaagcaccaagcggagcttctaacagagccctccttcataaggactcccgccttaccgaaaaatgattcgtaaaaagattctccttcatgcttaatcctcggtgtcacgagagccggacggctcggggaagatctccttggattgcctcctgcgggaggatgaatggtccccgttgctcccgccagacgatttgattgtctctgagcgtttcagaatgttgtcctccctagaaggccctatatcagacgagctatgccgccaactcccaaagagtgcagcgttccatgaaccccgtgacgatgttgctcttaacctgcccgagccattgccattgtcttctctcaccaccttcaaagggttctctagtgcttttaggatgtacttcattggcgggcgtttagaggaccgaggattcaagcaggacttggcaacaatcgccattgcccagacttcctccagatggtcctcgtcaatgataagcgttggatcaatgatcttgctcataagctccttctcgtaaatgttgacgtaccgcagggtggcatcaagccactcgcttgtggaagcatcatttgatgcactgattccaagtctccctgtcaccagctccagtaaaacttttccaaaacaatagacatcatatgggcaagttgcagatggggaacctgtttacagagagaattggtcaattaacttgcatcaaataaatagtagaattagagacgatgttcaaagcatttatcacagacagtagaacagttgaatcatcagctttagcaggaaactgactgatgaccaatcttccatattagaaatgcctgaaagcaacgaaaggttgcatgaacaaactcaccagaagaaccttgatctgctgtcctgcattcccacaaaaataaagcatcagaagatgggaatggactttggatattagaaaatgaaactacaccaaggaagtacttcatcatgtaactatcaactaaaacaagggtgctacatgtccattcatgctaagatatggcaagtgaattgaaacagaaggaaacagaatggtttacaattacctaggctctcatggctctacaagctctagttttgtcgcacttattgataccatttagatttttgcatagctatgtcacagcagggtcatcaagaaactgactggaataatgctgacaacacgctatttaaatccaccaaatattcatttattcatccaaaaagtatccatctaattcttgctataaaacaggtaaatactgatttcatggttaacatttgaacaaaactaccgttaaaantacatgatccaatagtgaatataatatatgtatggatttgcatgctccacaaaggaagcatttagcatggaaaagagaccaaagccatgcagagatggtatctgaaacttacgaagaaaatcttaacagctttgtgataacattttggtgaccttccccctcttgaggacacacctcgctcaagctaccaaggcgtacatcaaatttatcatcaagaaggatgctgctggcttgcacatccctatagtacaaaactgacaaaattagtcaacggcaaacctntgcattgatntaatttactggtcttggaaggaagcatctatgcagtcagaatcattcatgtggccatataaaaccgacaaaatgacaaaacaatcagaaatgattgcgatatactgcatgcctcacattaataacaaaacatgaaaaaaggtgaaatcagggtgataaagaacttcctgttattttgtatggtaaaattggtgagtatttaaatgatatagaccagcagaaacatctctgcaaagatattaaagcaaataacagcagtgtccacattgaatttccagtactcagataatgcacggtatataccgcatcaagcacaaaatattaagtttttgagtcagcgattgctagcacacattagtgtatgttcaatgtattcctagctgtcaccaaatctatgggggaaagctcattgcagtagctgctgaaacctctagtaccaaactaaaaaaacaattatcagagcacccatagtgaaacacacatagcggagactgactgtcaaccactaaatttcaagtaatgatacagattgaatttctatgataaatctaaaactttatcgtcttaaacaaaaaaatcgttttcagcttcaaagcagactgctgctggcttgcacatccctatgaaccatcggtggagaacactcatgatgcagatagcaaagagcctcagctactcccgttgcaatcttcaacctctttatccagtccaaagattgcaagccttcatcttcctcccttgactttttgtgcagtgcacttgacaagtcaccatttcggacaaacctatacacaagaaccttttcttcttctttatcaaggcagtgacccaggaaaggaaccagcctttcatgcaatcctttggcaaacaaatctaactctgccagataggcatccttccgagccacgcgcaaagtgatcctcttcaccaccacggcagtcccgtcttggagcacaccatggtatagatcacctgagtgaccatgcttgatgagcctctcttccccaaatcccgatgtggcattggcaatttggtcgtaagcaaatgaatcgccgactttcgccatgtttgtggacaatgcagaagggtgtgtgccaccagtagctgcagctgtgccggtagctgacactaccgatggtgctggtgcacttggtgatgccccactttccctctgaccatccgtcctccctgttctcacagaacacacaaagcagaacacaatggctgcaaccccggctatcagcaggaggcttccaccaatggccccgatcagtatgtatttcagattcctgttcttcttccttgccggtgaaggtgcaggctgtggtgcgggtgggataactggaccatcatatggcaagccacgcttggcatagaactgctggcaatcagcctgggtacgctgtcccagaacgtcaaggaagcaattcgattgaaacgaaacattgccaccaggcccaccaccaccatcggacactcctagcttgccgtcgaagtagttcccagaaatattggccagcagcaactgggcgaacagccggcgaaaggtctctggcacgccgctatagaacaagttcgacgacagatccaccacctgtgcattggctggcagcgcgaaccctgccgtgggcaatgcgccggtgaggttgttacgagagacgtccagaacgctgagccccgggagcgaccagaccgcgtcaggcagggcgcccgaaaacgcattggacgagaggttgagggtcctgagccgcgttagcctcgagagcgcggtggccgggagttgaccggacagttggttgcctgcgaagttgagggtggtgaggttgccgaggcccacgagcgcggaggccgggatctccccggagacggcgcaggcggagatgtcgagggactggaaagtgggagcgagcccgtcgcctagccacgccgggatggagccggggagcccgaaccccgaggcgttgaaggcctcgagccgcgtgaggttgcgcaggccgtcgacgtcgaagcgcggggacaggcggcccagccgcgtgcgccgcagcccggcgaggttgagcgagacgacgcggccggcgcggcagcccacgcccgcccacgccgtgcacgggtccgcacgccgcggccagtcccgcgccctcaggccgagcgagccccgcagcgcgtacagcccagcgagatccgaccgcgacgtcaggttcccctgcgccagcaccgcccagggcgccgccgccagggcgacgagcagcagcgcccagagcccgcgcgctcgatcgcgcatcatcgcctcgagcgcctcctcctgccgccgccgccgccgccgccgtggcccatgtccactccgcgttacaggtgtcgatggggttggcgaggaggccgaagcgctggaattcggagggaaattaaacgcaataaaggcgggggtgcagaggccgagctacgcaggtaaactacagggcgccaccaccagagaggcctcctcccttggggggtctctcaccaccccgccattaatgcccaaagttacactcctccaactgcctcccaattattactcctccacttcccccctgctccggttcgaaaccagcacgagcagcacccaaattccgcacctctcgagcccgcccgcggccacggtggcgccggagagcacagcgctagcagcagacgcgacggctgcggcgacggggcggccggagctggggaagagagaaagagagagagaggagtggggaggagaggagaggagacgagacgtaatggaggaggcagaaccgcagagggacgaagccgatgcttgtgtcgcggaagctgttagtgttttttgaaattctcggggctttgaatggaagggttggttttgcttccttcttctgcgctgtccgcgatttgttgccacgtttggtttgtttttcagcagccagaggccggatcccgctgggtgtttgggtttctgagatctgacggcgcccgcgttgttgtggttctggttctggttctgggtcgagccgtgccagcggtgtggtggtgcgcacagatgcagcggtgacagagtcatgagatgaactggtgcgcgttgggttggtcgggtgggtgcgtgcgtttagtggccggttccggggggcttgatggggttttcgatgggatggatgagcatagcggactgggaggattgggtcaacgaggcttctgcttttgttgtgttcgagtcaacgggatctgcggctgcgatgcgagcggctggcgtggcacggcgcggcctgccgggtcgtggcctcgtggtcgtgggcgtggctcgcgggcgcccgccggccggtggattatggttccttttttttccagaaaattaaatatatacattaaaagctcatgagtaaaaatgagcatcgaaagattcagttttacaaaaaaaaccatcgaaaagctactttgttacagtgattcatcgttaaatgaaactgagaaagaattggacagtcttataaaacttcgatagcatctattcctgcctaaatatctcaggttctcaattttaacagtaacttaagagaaatggtagaaatatataacaaagcggagtttcgaaagtatttttaacctaaatatttcaacgctatttttttaaaaaaaaacttagatgttttaatgcacagatctattgtttttaccccttttttcctctctggaccttgcccctgcccagtccgatctacctcatgggtacagcgacattggaatctgacgcacggtaacacacggaacggtgcaaatgttacaggctgtagaatgtgcgtgattctttctgtgttcgtccaccgtttttggacttttcactgcctgccgaattagcagcacgtgactactattttcttcctgagtacgtgagtagtactagtgtcgatgatggctaaccattttctggagcattaaactggctactagatctaagcgtccactaggccgcgggctgtatttagttgcggtgatttggcgatctacggggctgtgtttgcgtgtgctccgggtaaaattggctggtaaaacatatcgcattagcaattcccttttctaggaagatcgctgcatacaccgagcagatccaagcgttctgatgagccggaacaccctgcagaatctctagtagctgtatttggttggaaggaatcatgcaggaattgctcatcagatttacaggctgctaaggcgttggagtaacatccactcatccagagactctcagccacagggcggcaggcgtaccgcgtagtacgttcgcaaaagacggagcgagtagtacttgtctaaccagccgatctggcaccgcggggaaaccacttggccgctgcttgcgctgcgtggagccagccaccatacgcctcctcgccgatgcgtggaatggaggggagttcagaacgtactaggtgcgtgtgcgtcacaggcgacaaggcaagacgggatccacttcgcgcgcccagcgcgtggggccgctgcccgccgcgcgaggactccgagaaaaccacctgacgtgtccatggcgcggctccaggctcgagctcaagctcaacgaactggtggtgactgctaccgcctgccggccccgcggcggctgagtgagacaggagcgtgcaaggcgcggaggactgcactgcacgtccgcgcgccggccgcacgagggaatgttccgccccggctcggcagactagtagtgcgtgcgcccttttggagtttttttttgccgcgcccttccttttgacttgaccgcttctcctgcaccgggtggtcgtgcctaggacagcgtgtttcactgtctcttctcttccactccggatgcgtcgtggtttgcgctgtaatctgcgtgggaaactagagagatgcatgaccaacatctgctccgtgcagaattccttacgatgtttttcccctatttgggccctggtataacggttgcttgttgagaaaacaggttatctgagaagttggtaagctatttttagtttattgtgagaaaaagctgaactgataaactgttgtagaagctacaagtttaacgcagtttctgcttaaatatatcaagaagctgaaaataagttatacaaaaaataagcttacatggactgacactatataaaggaacaagaacccagaagcaaagtcagcacaagtttcatgtgc

SEQ ID NO: 19574 - DNA, 1938 bp, Zea mays
ttttttaatatcagtatcaggtcgtgtgtgttggtgactaccttttgttttatcttatgtgttatctggagaactttggtgtttgctagtataaattcatttttatctcaagaaatctaatgattgactcttgactttcacaactcatgtttatttgagtttcaattattttcagggagtttttatcaattgtgcattgattgaaccatttggactcaccttgattgaggctgctgcatatggtctacccatggttgccacccgaaatggtgggcctgtggacatacatcgggttcttgataatggaattcttgttgacccccacaatcaaaatgaaatagctgaggcactttataagcttgtgtcagataagcacttgtggtcacaatgtcgccagaatggtctgaaaaacatccataaattttcatggcctgaacattgccagaactatttggcacgtgtagtcactctcaagcctagacatccccgctggcaaaagaatgatgttgcagctgaaatatctgaagcagattcacccgaggactctctgagggatattcatgacatatcacttaacttaaagctttccttggacagtgaaaaatcaggcagcaaagaagggaattcaaatgctttgagaaggcattttgaggatgcagcgcaaaagttgtcaggtgttaatgacataaaaaaggatgtgccaggtgagaatgctaagtggtcgtcattgcgtaggaggaagcacatcattgtaattgctgtagactctgtgcaagatgcagactttgttcaggttattaaaaatatttttgaagcttcaagaaatgagagatcaagtggtgctgttggttttgtgttgtcaacggctagagcaatatcagagttacatactttgcttatatctggagggatagaagctagtgactttgatgccttcatatgcaacagtggcagtgttctttgttatccatcttcaagctctgaggacatgcttaaccctgctgagctcccattcatgattgatcttgattatcactcccaaattgaatatcgctggggaggagaaggtttaaggaagacattaattcgttgggcagctgagaaaaacaaagaaagtggacaaaaaatatttattgaggatgaagaatgctcatccacctactgcatttcatttaaagtgtccaatactgcagctgcacctcctgtgaaggagattaggaggacaatgagaatacaagcactgcgttgccatgttttgtacagccatgatggtagcaagttgaatgtaattcctgttttggcttctcgctcacaggctttaaggtatttgtatatccgatggggggtagagctgtcaaacatcaccgtgattgtcggtgagtgtggtgacacagattatgaaggactacttggaggcgtgcacaaaactatcatactcaaaggctcgttcaatactgctccaaaccaagttcatgctaacagaagctattcatcccaagatgttgtatcctttgacaaacaaggaattgcttcaattgagggatatggtccagacaatctaaagtcagctctacggcaatttggtatattgaaagactaaatctttgatctttgctggtcagcagaggaatcaaagcagtaggatcgaggagtgacaggacttccccactgtgcacttcgccgaaaagtaataatgggattgctatgcatggcccttgttgtacactagaaaattgggcacgcaaacttgtgtcagtttttccgctgttgcaaaattcagtgatggtgtttttgtaactataccaacctgtgtcagttttgccgttgttgcaaaactcagtgatggtgttttttgtaattattatacatccgaataataagactggtgtttccagacagactatgaaagctaaggggaaatcacgattttcctagatc

SEQ ID NO: 19575 - DNA, 3740 bp, Zea mays
tttagcattagcctcagctggcgtaccgtcgagtccattcccccccccctccgccttccagaaacctccaggatccgactccaatcgaatcgccaaagcagacaggggcgctcgcgggggcgccgagctcgacggggcgagatggccgggaacgactggatcaacagctacctggaggctattctggacgctggcggggccgcgggagatctctcggcagccgcaggcagcggggacggccgcgacgggacggccgtggagaagcgggataagtcgtcgctgatgctccgagagcgcggccggttcagccccgcgcgatacttcgtcgaggaggtcatctccggcttcgacgagaccgacctctacaagacctgggtccgcacctcggctatgaggagtccccaggagcggaacacgcggctggagaacatgtcgtggaggatctggaacctcgccaggaagaagaagcagatagaaggagaggaagcctcacgattgtctaaacaacgcatggaatttgagaaagctcgtcaatatgctgctgatttgtctgaagacctatctgaaggagaaaagggagaaacaaataatgaaccatctattcatgatgagagcatgaggacgcggatgccaaggattggttcaactgatgctattgatacatgggcaaaccagcacaaagataaaaagttgtacatagtattgataagcattcatggtcttatacgcggggagaatatggagctgggacgtgattcagatacaggtggtcaggtgaaatatgttgtagaacttgctagggctttaggttcaacaccaggagtatacagagtggatctactaacaaggcagatttctgcacctgatgttgattggagttatggggaacctactgagatgctcagtccaataagttcagaaaactttgggcttgagctgggcgaaagcagtggtgcctatattgtccggataccattcggaccaagagacaaatatatccctaaagagcatctatggcctcacatccaggaatttgttgatggcgcacttgtccatatcatgcagatgtccaaggtccttggagaacaaattggtagtgggcaaccagtatggcctgttgttatacatggacactatgctgatgctggtgattctgctgctttactgtctggggcactcaatgtacccatggtattcactggtcattctcttggcagagataagttggaccagattttgaagcaagggcgtcaaaccagggatgaaataaatgcaacctataagataatgcgtcgaattgaggccgaggaactttgccttgatacatctgaaatcataattacaagtaccaggcaagaaatagaacagcaatggggattatatgatggttttgatctaactatggcccggaaactcagagcaagaataaggcgtggtgtgagctgctttggtcgttacatgccccgtatgattgcaatccctcctggcatggagtttagtcatatagcaccacatgatgttgacctcgacagtgaggaaggaaatggagatggctcaggttcaccagatccacctatttgggctgatataatgcgcttcttctcaaacccccggaagccaatgattcttgctcttgctcgtccggatccgaagaagaatatcactactctagtcaaagcatttggtgaacatcgtgaactgagaaatttagcaaatcttacactgatcatggggaatcgtgatgtcattgatgaaatgtcaagcacaaatgcagctgttttgacttcagcactcaagttaattgataaatatgatctatatggacaagtggcataccccaagcaccataagcaatctgaagttcctgatatttatcgtttagctgcgagaacaaaaggagtttttatcaattgtgcattggttgaaccatttggactcaccttgattgaggctgctgcatatggtctacccatggttgccacccgaaatggtgggcctgtggacatacatcgggttcttgataatggaattcttgttgacccccacaatcaaaatgaaatagctgaggcactttataagcttgtgtcagataagcacttgtggtcacaatgtcgccagaatggtctgaaaaacatccataaattttcatggcctgaacattgccagaactatttggcacgtgtagtcactctcaagcctagacatccccgctggcaaaagaatgatgttgcagctgaaatatctgaagcagattcacccgaggactctctgagggatattcatgacatatcacttaacttaaagctttccttggacagtgaaaaatcaggcagcaaagaagggaattcaaatgctttgagaaggcattttgaggatgcagcgcaaaagttgtcaggtgttaatgacatcaaaaaggatgtgccaggtgagaatggtaagtggtcgtcattgcgtaggaggaagcacatcattgtaattgctgtagactctgtgcaagatgcagactttgttcaggttattaaaaatatttttgaagcttcaagaaatgagagatcaagtggtgctgttggttttgtgttgtcaacggctagagcaatatcagagttacatactttgcttatatctggagggatagaagctagtgactttgatgccttcatatgcaacagtggcagtgatctttgttatccatcttcaagctctgaggacatgcttaaccctgctgagctcccattcatgattgatcttgattatcactcccaaattgaatatcgctggggaggagaaggtttaaggaagacattaattcgttgggcagctgagaaaaacaaagaaagtggacaaaaaatatttattgaggatgaagaatgctcatccacctactgcatttcatttaaagtgtccaatactgcagctgcacctcctgtgaaggagattaggaggacaatgagaatacaagcactgcgttgccatgttttgtacagccatgatggtagcaagttgaatgtaattcctgttttggcttctcgctcacaggctttaaggtatttgtatatccgatggggggtagagctgtcaaacatcaccgtgattgtcggtgagtgtggtgacacagattatgaaggactacttggaggcgtgcacaaaactatcatactcaaaggctcgttcaatactgctccaaaccaagttcatgctaacagaagctattcatcccaagatgttgtatcctttgacaaacaaggaattgcttcaattgagggatatggtccagacaatctaaagtcagctctacggcaatttggtatattgaaagactaaatctttgatctttgctggtcagcagaggaatcaaagcagtaggaatgtaggatcgaggagagtgacaggacttcccctctgtgcacttcgccgaaaagtaataatgggattgctatgcatggcccttgttgtacactagaaaattgggcacgcaaacttgtgtcagtttttccgctgttgcgaaattcagtgatggtgtttttgtaactataccaacctgtgtcagttttgccgttgttgcaaaactcagtgatggtgttttttgtaattattatacatccgaataataagactggtgtttccagacagactatgcaagctaaggggaaatcacgattttcctagatcaaatatgtaatatgttcttttccgatgaaaaaaaaaaaaaaaaaacctagggccaaaaactcgaggagggg

SEQ ID NO: 19576 - DNA, 2894 bp, Zea mays
cattctggtttgcagccggtctgcaccaattttttttcccactgcgccacgctcggttatgcatcaaccagcagttcaggtttcagaacctggcgtcaccacttccggttactgtgattttcttctcttttttgcttgccagcaagtgagattctttgagagctgggtcctgtgtattttgctgtgggcctggctgaactacattactctacacgtagcttgtactggtactcagttctcctaagatggcgtgaaactgtccaagaatctgtagagcaagcatgggaacgcaatcctgttcctgtgccgcagtcacaacgcccagaatccttatcgcaaccgactcgcaaccatagattcatagtagtactcgtagctcctcggcctcagcgaccaccgccattaacaccgcctgatctccggctaccgagtagcatccataaaactactgcacacacaccaatacgaccacccccaccgcgaatgatccatggagtttgaggagacgccggcggatgaatctagcctgaatcttcgacggcgacgcccccgacggacgagcaggggccggcagcccaagagcccagcccaggcagccaacttggtcgcagccagcacaaggcctcaactcccgagctgaatctgacaccatccccctcagctttccgttaccgccatcaattcaaatcaaatcgttcccgccgcaaaggcaagccggcatctcccccgctccgcgctataaatacggccccccacctcccaagcccccacaagcctctgctctcacacactgcaacagccaagtgcaagtgatcgagctcccccctcctcatcagtcgctaggcacagcgcacttgcaggatggcgcaggtctctaagacgcttctccttgtggccctggtgttcgtgtcgtcggcggcggtggagctgtgccgcgcgatcgacttcgacgagcgggacctggcgtcggacgaggcgctgtgggacctgtacgagcggtggcagacgcaccaccgggtgcaccggcaccacggcgagaagggccggcggttcgggacgttcaaggagaacgtgcgcttcatccacgcgcacaacaagcgcggcgaccggccctaccgcctccgcctgaaccggttcggcgacatggggcgggaggagttccggtccacgttcgccgactcccgcatcaacgacctccggcggcaggattcccccgcggcgcgggccggggccgtgccggggttcatgtacgactccgccgccgacccgccgcggtccgtggactggcggcaggagggcgcggtgacgggcgtgaaggaccagggccactgcggaagctgctgggccttctcgacggtggtggccgtggagggcatcaacgccatccggacgggcagcctggcgtcgctgtcggagcaggagctgatcgactgcgacacggacgagaacgggtgccagggcgggctgatggagaacgccttcgagttcatcaagtccttcggcggcatcaccaccgaggccgcgtacccgtaccgcgcgtccaacggcacctgcgacggcgatcgggcccggcgcgggggaggcgtcgtcgtggtgatcgacggccaccagatggtgccggccggcagcgaggacgcgctggccaaggcggtggcgcaccagccggtgtccgtggccgtcgacgcggggggccaggcgttccagttctactcggagggcgtgttcacgggcgactgcggtacggacctggaccacggcgtggcggcggtcggctacggcgtcggcgacgacggcacgccctactggatcgtcaagaactcctggggcacctcctggggcgagggtggctacatccggatgcagcgcggcgccggcaacggcggcctctgcggcatcgccatggaggcgtccttccccatcaagacctcgcccaaccctgcagacccgccgcgcaagccccgccgcgcgctcatcgccagggacacctcttcttcccagtgacacacacgaccacaactggcacgtaagtacacgttgccaggaatgacatgctatgctactagtgtttgcttgaactattatcgattgggtttgtactagtgatgacagtttcatcgattgcgcggtcgatctccatcagagacagagacgatataatcagaataaagtatagcagcgcgtgtgcgcaacagggtaagattaggcgtgtgatttgatttcaaagctgtgcttgtaacgtaatgtaatacggtgtggcatatgcaccgggatatggtatgtgtattgggaagacgctatgcgtagcgtaagctagcagttgttgcattgcatttgcatgcttggatcggatatgcatgtgttcttctgcctgcgacatcggtagcgcgtgaggctgtgactctgtgagctgcgatttccgcagttgaatcggtagtgtaagcggaaatgtcggaatttaaatctggctggatttcgttcagagcggcaggggcttgtttgtttcatgggtttgaaattgttttggtttattgggggtcatcccgccaggtgcaaggcaacagatcctgggtcctggctccggctctgagcagcgtccaaaattggaggcctgggaagcctgcttgggccaggcagccttttgaagcccacctaccagcaccaaaccaggatgcgaagcaaagcaagctggatgaacatgcttggcagctcgcccaagccagggtccaaagcgattttttatttttttaaaaagatattattttagtaatctcacgtgctttttagttctatttctaaactttttttgcgccaacgtggcaaaaacacactgtcgtatcatctggcacaattttcagctagaatatcttgccgtaccaataccacggttgacacga

SEQ ID NO: 19577 - DNA, 2467 bp, Zea mays
  misc_feature (2451)..(2466): n is a, c, g, or t
gactgtatagaatgcgccacatatcatatttaaaggaactgttggagtacccatcataattcactcttaaaacattttagcctactcttaataatcagtttttggggtaaaaattttaacattcttttggagttgctcttacataaaagtagttatatcttttcactctcacatttgtcctctatcctgtgcatgctttagagtcgttctcgttttctatatttaaacatgactatattttagaataatatacgactatatttaaataactaaacaaagaagccgtcgaagttttttttattgaaatatctgtttctgtatgaagagtacaaaaaaaatctctcgacgaacttgccgactcatacctcctcggcctcagcgaccatcgccattaacgccgcctgtcgtcagtgatatcctcgacggccaccacacccaggttaccgagcagtagtagcattcataaaactgctgcacacataccaatacggccggaccggccactcccactcccaccacgaaggcaccggacgcaaacgatccatggaattggaaggagacgcggatgaatcttcgacgctccggtcctggtgggcagcccaagagagcccagccgacgcagccgctatcggccggcctcaacctcaactcccgagctgaatctgacaccatctcccttccgctttctgttaccgccataaattcaaaccaaatcgttgccgccgcaaaggcaaaggcggcaaggagcctctcgcccgctccgcgctataaatacggctagctcctcgtcgcccccctccacccaccccatcagctcacactccggcagccgagcgatcgagctccccggtcgctagcacagccggccactgcacacgacggtgctggtaggttgcaagcacttgcaggatggcgcaggtcgctaagacgcttctccttgtggccctggtggtcgtgtcggcggtggagctgtgccgcgccatcgagttcgacgagcgggacctggcatcggacgaggcgctgtgggacctgtacgagcggtggcagacgcaccaccgggtgcaccggcaccacggcgagaagggccgccggttcgggaccttcaaggagaacgcgcgcttcatccacgcgcacaacaagcgcggcgaccgaccctaccgcctccgcctgaaccgcttcggcgacatgggccgtgaggaattccgttccgggttcgccgactcccgcatcaacgacctccgccgggagcccaccgcggcgccggccgtgccggggttcatgtacgacgacgccaccgacctgccgcggtccgtggactggcggcagaagggcgcggtgacggccgtcaagaaccagggccgctgcggcagctgctgggccttctccacagtggtggccgtggagggcatcaacgccatacggacggggagcctggtgtcgctgtcggagcaggagctgatcgactgcgacacggacgagaacgggtgccagggcgggctcatggagaacgccttcgagttcatcaagtcccacggcggcatcaccaccgagtccgcgtacccgtaccacgcctccaacggcacctgcgacggcgcgcgggcccggcgcgggcgggtcgtggcgatcgacggccaccaggctgtgccggccggcagcgaggacgcgctggccaaggcggtggcgcaccaaccggtgtccgtggccatcgacgcggggggccaggcgctgcagttctactcggagggcgtgttcacgggcgactgcggcacggacctggaccacggcgtggcggcggtcggctacggcgtcagcgacgacggcacgccctactggatcgtcaagaactcgtggggcccttcctggggagagggcggctacatccggatgcagcgcggcaccggcaacggcggcctctgcggcatcgccatggaggcgtcctttcccatcaagacctcgcccaacccgtcgcgcaagccccgccgcgcgctcatcaccagggacgcctcttcccagtgacaggctgatccatctcggcgtcgaactcgtactactggcacgtaagtaggagtacgttgacaggatgacatcctgctgctgctgtttgcttgtactattttcgattgtgtttgtaggtttgattgtgccagtctcgatcagagacgatatacacatgctagaataaaatatagcagcgcgtgtgcgcaccaaagactagggccgggttctcttggtgcctaacttgccacactttgcctaacttttgtgcctaaggttagttattcaattcgaacgactaaccttagacaaagtgatgcacatttagctacaaaccaaacagcccctaggagtgtgatatcaaagttgtgcttgtaatgtaacgtaatacggtgtcgcatatgcaccgggatatggtatattgaatggagctatgcgtaagctagcagttgttgnnnnnnnnnnnnnnnng

SEQ ID NO: 19578 - DNA, 1818 bp, Zea mays
tgggtaccgggcccccccttgagttttttttttttttttttcatccaatctttttttggtcttcgcatgtataagcacccagaatttttttttttttttagatattctttgtacagctttattacgcatacataataaattgtttcgcacaccaaaaaaatttgtttctgaactctctatattggactcttggggcgaacatcttgcaattcacaagtgcagcatgaagaaacattgccacatatgtctatcacttgcggccatcaacttacaaaaacttcgacaacatgagtaagtacattaccctttttactacaaaacataacagggctcagtgccttttgctgtattgtttgtccttgagagaataatgaagttggcccaagtccaaaatttcttcaatcactgaagcaacactaataatacgtccagcagagtagaccagtcaggggctgaacagaaatctatctcaacgctgcaacattgccaaaatgtcttctttgtgctgcgtacagtagtacaccaaaattgcaagaataacaactagtagcatgggccatatgcttgttccattactctttggagacccaacagatgtcacccttgcagaagagtcgaaggaagttgacagcaatgttcttgaatcctgagagaaggtcagcgtagtaacaataccaagatgagcctttttaactgttacaagtgtccgcatgtcttttgagccaactacgatgatgcttccttctattgttccaattgcaagaagagcaccgttgggtgacacagcaaaagctgaaattgcctcacgagttattttctttgatccggttctcgtccatgaggtagtattccaagacactatttttccataatcgccttccatcacagttataaataggacatgactgttgtcagccttattagagaatctgcagaatccaaatatttcccctgtttctcttggcagactggctacaacttcagatgactgcaaatcccacactctacatgggccactgctcctattcacagcaagaaacttctcgtcggaactgatagtaagatccttaatcgatgttttagtatcgatttctgtgagaacagaccccatggtaggccagttgaaaactcttaaatacccatcttcaccaccaatagcaagtattgaaccttctccactgaaggatacggccaactgcaaaccgacatctttcagctctgctaaagcatcctggtccggctccaaagccaacctctgtggtccctctccttcctgtgattcccatcgatacaacctgcagccgttggggaaggcacagaacacgccatcgccacgcgggtggacggccattctgtacggcacctcctcctcactattcacctcgaccaccgtatcgggggagagagccggcgcggcctcttccccggtggcgagggccgccaccacgagcttgttcggcaccccgctccggccctccccgccaccgcccccgaggacagccatcggaagcgagggggtggaggaggaggggtcatccgcatccgcctcggcagcgggagggtcgggcttgatgatgtgggcgagcgggagccaggcggcgcagtagatcgggaagccgtaggactggctaccgccgccgcgagttaccatcgcgccgagaaagaagggtaaggggcgccggggaggtgggccggtggcggtggccgccggtggggacgcgcggcggacggtggaggggagcgcgtgtggggggctggagaacgagaataataacgcggctgtgaaaggttcgtttcccggccggcctcgaggtaccc

SEQ ID NO: 19579 - DNA, 844 bp, Zea mays
agggggggaatagaaatgggatttcttaaatcagtaatgctgacaagcgaacgccaaatgcaaccgatgcacttccagttatcaggttactgcataatccattacctggaattcacattgcagtacaatgatggcgagcagacatacacagaattagcatagccaatcatataaccacagctatgcaagcacactacttcaggtcagtaagttcgatacagaaggcagcttccatgctgaaagagagttaacaataaacttggtataatcacgaacaggatgaacacatccgagatgacgaaacatccaatgattacccaaaataacgtgcaaagtccatggagatgccttcgcctcgaatggttactctggggagcaaaagctcattacacatcgggtggtgaaccaccaggaaccaaaatggctatgttgttgccgtttaggaggatctggtcaagttttgtaatgcggcgcccttcagcagtgtattcatactcggtgacgtcctccagcaccatattgacgtagacatcaaagccgcagagggtgccaacgagctccttgtcccccttcatgatcacccagatcttggacccgatgcaccgatcgatcagctctgaggggaggagctgggaggggttgttctgagacatctcgacacctcttgtgaatcgtggcagtgggagcggtggggatggataggcgacgatgtggccgcgactgcaacggcggcggcggcgcagagagggttctgttcctgtgtctcagagtctcagacgccctagtcgatttgtgacgagaaggcatgtggtactacctccccggcccgcccgcctcgtgccga

SEQ ID NO: 19580 - DNA, 1662 bp, Zea mays
tgggtaccgggccccccctctagttttttttttcttttttttttacaactcacttttttttttttttttaaacataaacacagatgactatcacttgcggccatcatcaacttacaaaacttggacaacctgagtacatgaccctttctactacaaacatgaaagggctcaacaccttttgctgtattgttgtatccttgagaaaataatgaagttgacctaagtccaaaacttgtccaatctctgaagcaacactactaatatgtccagtagagtagatcagtcaggggagcggtggggctcaacagaaatctatctcaacgcggcaacatcgccagaatgtcttctttgtgctgcatacagtagtacactaaaactgcaagaatgataactagtaggatgggccatatacttgttccattactcttcggggaaccaacgtacgtcacccttgcagtagagtcaaaggaagttgacagcaatgttcttgaatcctgagagaaggacagtgtagtcacaacaccaagatgggcctttttaactgttacaagtgtccgcatgtcttttgagtcgactatgacgacgcttccttcgattgttccaattgcaaggagagcaccgttgggcgacaccgcaaaagctgaaattgcctcacgagttattttctttgaccctgttcttgtccatgaggtagtattccaagatactatttttccataatcaccttccattgctgttataaataggacatgactgttgtctgccttattacaaaatctgcagaatccaaacatttcccctgcttctcttggcagactggctacaacttcagatgaatgcaaatcccacactctgcatgggccactgctcctattcacggcaataaacctctcatcggaactgatggtaagatccttaattgatgttttagtatcagtttctgtgagaacaggcgccatagccggccacttgaagactcttaaatgcccatcttcaccaccaatggcaagtattgaaccttcttgactgaaggatatggccaactgcaaaccatcttctttcagctccgctaaagcttcctggtctggctccaaagacaagttctgtagcccctctccttcctgtgattcccatcgatacaacttgcagccgttggggaaagcgcagaacacgccgtcgccgcgcgggtgtacggccattctgtacggcacctcctcttgggtcctcacctcaatcaccgtatcgggggagagggccggcgcggcctcttcgccggcggcgagggccgccatcacgagcttgttcggcacgccgttccgtcccttcccaccgccgcccccgagcaaaaccatcggaggcgggggaggggagggtgagggggcatccgcgtccgcctcggcggcgggacggtcgggcttcaggatgtgggcgagcgggagccaggcggcgcagtagatcgggaagccgtaggactggctaccgccgcggcgaatcgccatcgcgtggagaagggagggtgaggagcgccgggtgccggagataggtgggccggtagcggtggccgccggtggggaggcacggcggacgcgggacggtgggggagaacgcgggacgggaaaataaaaggttccgtttcggttccccacttgccgcgggggtacc

SEQ ID NO: 19581 - DNA, 897 bp, Zea mays
  misc_feature (868)..(868): n is a, c, g, or t
ttttcctcggcttttttttttttttttttcaaacgccaaatacaaccgatgcgcttccatttatcaggtttcttcataatccattgcctgcaattcacattacagtacaatgatgatgagcaaagcgaatcatataaccacagctatgcaggcacactacttcaggtcagtaagttcaatacagaggagagattccatgctgacagagttaacaataaacttcggtataatcatgaacaggagaaacacatccgagatgaggaaacatccaatgattaaaaaatataaggtgcaaagttcacggggctgccttcaccacgaatgatactctgggaagcaaaagttcattacacatcaggtggtgaaccaccaggaaccaaaatggctatgttgttgccgttcaggaggatctggtcaagttttgtaatacggcgcccttcagcagtgtattcatactcggtgacgtcctccagcaccatattgacgtagacatcaaagccgcagagggtgccaacgagctccttgtcccccttcatgatcacccagatcttggacccgatgcaccggtcgatcagctctgaggggagaagctgggaggggttgttctgagacatgtcgacacctctggtggcagtgggggcggtggggatcggtacgcgacgatgaagccgcgactacaaacggcggcgggctaagaacgacacggaacgacggcgggcgaagaacgacacagaacggcggcggcgcagagattggggattttgcttcttcgttgggttggatgggctccttccattcgagacgcccttgtcgattagtgacatcaaggcgcggctcgggggcacagcggagccgtgcggtatctttnttgacccggccgcctcgagcgccgcacag

SEQ ID NO: 19582 - DNA, 2169 bp, Zea mays
ggctctccgcttggcaatttaaggcaatttaaggactaaaatgaaatgactaatctttagtactcaacccaaccaaacgagacattacaagagctcagttggtgtgatgaactgacggaacggcccctgtaatgaatcatttgatacatccgcaccgcaatacaccaggaaaaaacatacaaattgcctatgtgatatccgcgcaaccgtgcagaccttccaaaagtgaactccaggcacccaaaccttctacagaaccaaaagccaagataaagtatgatctctgctctgaaacctcacatacgtgatacaaagaaaacaactataatcaaactaatcctcgtccatcccgccaccaggctgggcatctcttcttggacctcctgccggctttgccataatgatctggtcaacccgcagcaccgtgcaagcagcatcggcagagtattttagggcaaaaaactttgtgacatagaggtcccatatttttaaagtcgagatgtccttgcaggcgccttcctccagatcaatgccaactttcgcattgccactagcatgctcagcataaagagaggatattatctccattgcgctaagtccagcattttctgccagggttcttggaaccatttcaaagctttcagcaaatttcgcaatggcatactggtccaaccctgtttccttcaaagagaactccttcaatctctttgccagctcaacttctgttgcagcagcaccaggaattatcctactgtccctgcacattgacctgtatgtattgacgccatcatcaacagctctttcaagatcatctagtatactgtcagtactgcctctcaggacaacagtagccactgaatttccaccatcttcgttcttgacgacagtaacccgagtaccaccaatttcttctacagaaacagaatctgcgtatcctagttcgtccgcattgggttggctaagtttcaaaattgcaacagccccagtagtacggcagaaccttcttagttcaaacttcgagctgattttcagaaccatcagcttataacgttcacagaaatgaagtgccatgtcacccactgcagctccactgacaataaccttggcaccagagtcagcgacagctttgataagctcctccaccttagcttcctcggtcttagcataattttctagctgctcagcggaatggatcaacacggttccctttgtttcagttgccgaggtgtcgacaccaccagcaaatacgacaatctttgccttctccgcccttttgatgctaccaacagcatcatttttcagaaccatcccacggaccacagaagaattgtgcaaaccacctccaagtagcttagccactctaacattgtcaacattaaagtttgcaggatttttggggcaaacttgaatgcaggcatcagccacaagagggcacagcatatcctcctggccaaactgcttgcttgcgacagcagatctcatcctcaacacaacatcctccttgtttcttacgtccatgttctctgagcctttctcaacaagatcctctaaaatttcaattgtcttgttgatggctttggtgtagccaatgatgatctcactcggatgcaagcccatcctgatgagctcctcagccttctcaagcagttcaccagcaaacgatatggtgagattggctccatccccaatctcctcctgttgagccttggcagccagtaccaggattttagcagccgggtgctgaacctcaagctcattcacgatggtggcagcatcgtttgtgacaaacagcttgtccaagtgattgataaccatcttgttcattccgttggggcccagggatgtgcgcgtgatggcggagagctcgcggcaggcgtcgatgttcttgagcacggcctcctcgagcccggagaggtggcggtggccttccttgagcatcgactggatcccatagcccgccatcgagccgagccccaccatcgtcgtctccggctgggtgtgggggcgttggtctggcggcaggcgacagcgccggaggcgaggcggatcggggggaaagtttaaaccctactagtgtccgctgctttgggagtgcgagtgccggggctggatgcggagtccggggaggcggcgagacgcggaggccaccaaggtgttctagtatcgttt

SEQ ID NO: 19583 - DNA, 2196 bp, Zea mays
  misc_feature (5)..(20): n is a, c, g, or t
gaagnnnnnnnnnnnnnnnngggccccccctcgagttgttccctcgttttttttttattttgttttttttttaaggctgtaacatttttgcttctataataaaaaaactgaagtaacactcatatgagctcagtcggtgtgatgaactgaaggaaagaaccctcgaatgaataatacatcggcactgcaataatacaccaggaaagaacaagcaaattccccatacgataccagcacagccgtgcaacccttccaaacgtgaactacaggcaccaaaaccttctacagaaccaaaccctaaataagacatgatgttccctgctctgaaaccttgcgtacgtgatacacaaagagaacaatcacagtcaaactagtcctcgtccatcccgccaccaggctgggcatctcttcttggacctcctgccggcttcgccataatgatctggtcaacccgcagcacggtgcatgcggcatcggcagaatattttagggcaaagaactttgtgacataaaggtcccatattttcaaggtcgtgatgtccttgcaggcaccttcctccaggtcaatgccaactttcacattgccactagcatgctcagcataaagagaggatattacatccattgcgctaagtccggcattttctgccagggttcttggaaccatttcaaagctttcagcaaatttcgcaacagcatactggtccaaccctgtttccttcaaagagaactccttcaatctctttgccagctctatttctgttgcagcagcaccaggaattatcctactgtccctgcacattgacttgtacgtattgacgccatcatcaacagctctttcaagatcatctagtatactgtcagtactgcctctcaagacaacagtagccactgaatttccaccttcttcgttcttgatgacaataacccgagtaccaccaatttcttccacggaaacagagtctgcgtaccctagttcatccgcattgggttggctaagtttcaaaattgcaacagccccagtagtacggcagaatcttctcagttcaaacttcgagctgattttcagaaccatcagcttgtaacgttcacaaaaatgtagcgccatgtcaccaactgcagctccactgacaataaccttggcacctgagtcagcaacagcttttataagctcctccaccttagcttcctcagtcttagcataattttctagctgctcagcggaatggatcaacactgttccctttgtttcggttgctgaggtatcgacaccaccagcaaatactgcaatctttgccttctccacccttttgatgctaccaacagcatcattttttagaaccatcccacggaccacagaagaattgtgcaaaccacctccaagcagcttagccactctaacattgtcgacattgaagtttgctggatttttggggcaaacttgaatgcaggcatcagccacaagagggcacattatatcctcctgaccaaactgcttgctcgcgacagcggatctcatcctcaacacaacgtcctccttgtttctcacatccatgttctctgagcctttctcaacaagatcctccaagatctcaattgtcttgttgatggctttagtgtagccaatgatgatctcacttggatgcaagcccatcctgatgagctcctcagccttctcaagcagttcaccggcaaacgatatggtgagattggccccatccccaatctcctcctgttgagccctaccagccagtaccagaatcttagcggcagggtgctgaacttcgagctcattcacaatggtggcagcatcgtttgtgacaaacagcttgtccaagtgattgataaccattttgttcattccgttcgggccgagagaggtgcgcgtaatggcggacagctcgcggcaggcgtcgatgttcttgagaacggcctcctcgagcccggagaggtggcggtggccttccttgagcatcgactggatcccgtagcccgccatcgagccgaaacccaccatagtcgtctccggctgggtgtagggtggtggatttccggcggaggacgacgccggcggcgaggcggatcggggggaaagtttaaaaccctagtgactaatgagcgctgcttgcgagtgccgtgggtggaggcggggagatgcggaagccgatggcccggccggccccgtggtacccaatg

SEQ ID NO: 19584 - DNA, 4693 bp, Zea mays
ggagcatatgccttggaaaaaagttgatgtcttctaaatgcttacattactttcagtgattacatttatacaatttactttataaatttatatttttaaaattaccataatatcataggattagaattagagtgtaaaagttttttttatacatactatgcactcggttaaagctaagcttgccatcagaatttaattatcgcaataaattttggaaaacctaatttatcctctcttagacatcgcgaccgttctaacacaaataccttgaactatccgacttcgaagacattattattagtccatgtatgtgttcaagaaaagcaaccgtatcagtcatccctgatacagatggccaaccacaaactgataaccaatcgctccaactgctctccagtttttttggcaacccgtattagttagcgtcaaactcttgaacacggggaaaaataaagcaaaggattctatgggttcactagaacaagcaacagaagaccagatctggttaaagaaatggtaaaaataaaaggggcaattacgattatacgcttgtctgaccttgattttatcgatcgtttttcaactttattattttacccctatattttaaaaaacgaagtcgttgtttgtttgtccctccccttcaatagtgttagtgaaaatcagaattaatgattaaaaataaaaaaattagggataaaatcataattacaaggtaagaaaaaaagggtataatcacaataaactctaaaaataatattgaaaattttagaacggtgttaaaaggagaggcaaacaatagcttcatttcaaaaaaagggtaaaatcacaaagttgaaaaacaaaaaagttgaaaaacgaaaggtaaaatcgcaattacaataccaaataagggtataatcataattactccaaagtaaaaacacgatcatccaggggcgagcggtaggagcagagcagatgggcgtcgtgtaattgttgcagctactacaccaaacttagaaggcgctttgagtgcaagtcatatcaactaatgatgtttacgcagataatgtaaagctatacacgcatgatgaagtcatagttgggagcaccacgcttgctactataatttcataacctatacagcagcagatgaataaaggtattcatgatgtaaccacaagacaggctgttggaaaaacatatagaaagagagtaaacgcttacgcatattaattcaggaaacaagaaaacaagatggtgcattggtgctacacagtatttacacaaatataagacacccctcttagaaagggaaaaaaaaggtttagagggttgctctgtaatcataagctccactttgaagtgatgtgaaagtgtgagctttgtatattggaagctttgttgctgaaaatgcttccataaaatgttttcactatcaacatttgaacaaatttgtttcttctgtacagctggatgtatccattgacatgctcttcgctccaaaaatttccagtgcagggatccaagggaatgtcattcataacccatgcagggaccacacactggcacacatacattaaacgactggcaggcaaaatcgggcatttccaatagaatggaaacgaagtgtttgtatcgtatatttgtattggccatttttttctttgtttctttctattaataacaaaatagatcgcacttggtgtcatcgtgtgggtataccaagctgttgttgcatagcagacctgatgtcaccagtgctaaatccctcaattgcaatgatatttgagctatcaagagcaacaacatcctgtaaagggtaccttctaaccgtatggatcctattggcaggagtgttgaatccacccttaaggatgactgtcttgtgaagacctccaaacagttcctcgtaatcagaatcaccagtttcaccaacaatgaccacagcatctggcaactctatgccccagcaaatagacaaataccttagagcctgagatcgcgatgcatgaattggaattacagataacctggtggcgccatggttatacagtgcatgacaacgcagtgactggattctcatcaatttttgcagctccttcaaaggaggcaaatgacttggattaatcactttaaatgcaagacaatatgttgaagagtgttccgaatcttcaaagatgacttgcttttcggttctcccccttctttctactactgaagaggcccacttaactaagtacttccttaaaccttctccaccccaacgatactcaatatgtgatcggtagttatggtccgatgcaaatgtaacacgggaattgcttggcacatcactagactgtgatggataatatatgtcactcccactattgcatataaaggcatcaaagtcagtagggagcatgcctgtgcgtactattacagactgtaactctgctattgtcagtgaagtcgacagcacaaaacctgtcaaatctgacatagttccagagcgtgtagcctcaacagaatttctgataatctgaattaaatcttccttgttaacggagtctacagcaataacgaatatatgcttcctgcacttcacaggcactttatggtcttctttgcatgcgaaagcaggatgtcttggacctagagttaatatccttgacaagtaattcttgcaatgttcaggccaagaaaactggtgtatatttttcaatccattctctcgacatcttgaccaaaattgcttttcagacagcatcttatagagggcatctgcgattgcatgctgatcatggggatcaacaaggagaccattttccagaacctgatgaatttcaacaggagccccattttttgttgcaataacaggcagcccgtgcatggcagcctctatcaaggtaacaccaaattgttcaaagtaagcaacatttataaaagcgccctttgttcttgctgctaaacgataaatatcaggaacttcagagtgcttgtgatgctttgggtatgccacttgaccatataaatcgtattcatcaatcaatgtaagcactgatgtcaaaacagctgcactgattttgttcatcttggaaatagcctcacggttacccattatcaatgtaaggttagcaagttccctcaacggatggcattcaccaaatgccttcacaagcgttgcgatattcttctcagcatatggacgggcaatagccagaatcataggtttcctaggatttgtgaagaaccgcattatctcaaaccaaatagatggatcctcagaggctggagatgggttatcttcatctccatagatatcaaaatcatgaatcaattggccgaattcaactcctggaggaattataaccatacgaggcatataacgaccataacagttagcaccacgcttgactaacgcacggagcttcctcgcaagcatgacttcaaaaccatcatacaagttccattgttcttctatttcttgccttgtgctagcgataactatttcagacgcatcaagagacaactcctctgcctcaattcggcgcattattttgtatgtcacgtttatttgttctcttgtctgtctcccttgcttgagaagcccttcaagcttatctttcccaagaaaatgcccggtaaacaccatcgggacattaagtgctccagatagtagagcagcagcaactcctgcactggcataatgaccatgaatcacagcaggccacactggacacacactgccagtttcttcgcctaaagtttttgacatccgcacaatatgacctagtgcaccatcaacaaattcttgaatgaaaggccagatattttctttagctagatgcttttctttggggccaaatggtattctgatgatatgtgcaccactgttctctcctcgttcgcatttaaagttcttgaaacttgtcaaagccagcatctcgtctggttcaccatagccacgatcaaaatttggggctatggtttgtcctgccaatagatcaacccggtaaactccaggacatgaccttaatgctttagcaagtcccacgacatatttgacctggccaccagtatctgaatcacggccaagctccatattctctccacgtatcaggccatgaagactgattaccactatgtatagcttgtcaaatgaactgatcctaggtgtgttcccagctgtgctgtcaccgtaggcaacagatggatcaccaacgtcttctcccttcacaccttcaaaaagatcttcagacatgtctgcagtagcatcattttgtggcttctcagcctctagacggcgtttggacaagcgattggcttcctctttctcaaactccttcttcttcctggcgaggttccagatcctccaggtcatgttctccaggcgcgtgttcttctcctgcgggctccgcatcgcgttcgcccggagccaggtcttgtagaggtcggtctcgtcgtagccggtgatgacctcctcgacgaagtagcgcgccggggagaagtggccgcgctcgcgcaggagcagcgagggccggtccccgccgccgcctccccggcccctggcggggccggcgcccttgccggcatcgaggatggcgtcgaggtagctgttgatccagttgtcgttgccgtacatcgccggcgagatcgaggcgaatgaatgaggggcgcgcgggcgggtgcgggtggggtggggggaggccgggcctcgtgccgaatt

SEQ ID NO: 19585 - DNA, 3654 bp, Zea mays
  misc_feature (3017)..(3017): n is a, c, g, or t
tataaatttatatacaaagggtttaaccctcttcaatctctctcagtcaacccctaaccgaacaagccttatgccttatatggacactctcgtattcaccttaatcggccttatatggacactctcgtattcaccttaatccacatgtattgggatgaattggtgtgtaaattagttttagttacatctcaatctatctcaacacatatggattgaggtaaatacaaacaagcccttagacgattgcactgtaatcagatgctccacattgaagcgatggaaagtgtgaactttgtatattggaagcttgtttgctgaaaatacttccacaaaatgttttcactatcaacatttgaacaaatttgttccgtctgtacagttggatgtatccattaacaagctcttcaatccaaaaaatctccagtgcgggatccaagggaatgtcattcataacccgtgcagggaccaccacacacatacattaaatgactggcaggcaaaatcggacatttccaatagaatggaaactaagtatttgtatcgtatatttctgttgtctgtttctttctttctattaataacaaaatagattgcagttggtgtcattgtgtgggtataccaagctgttgttgcatagcagacctgatgtcaccagtgctgaatccctcaattccaatgatatttgagctatcaagagcaacaacatcctgtaaagggtaccttctgaccgtatggatcctattcgcaggagtgttgaatccacccttaaggatgactgtcttgtggagacctccaaacagttcctcgtaatcagaatcaccagtttcaccaacaatgaccacagcatttggcaactctatgccccagcgaatagacaaataccttagagcctgagatcgcgatgcatgcattggaattacagatagcctggtggcgccatggttatacagagcatgacaacgcagtgactggattctcatcaacttttgcagctccttcaaaggaggcaaatgatttggattaaccactctaaatgcaagacaatatgttgaagagtgttccgaatcttcaaagatgacttgcttttcagttctcccccttctttctactactgaagaagcccacttaactaagtacttccttaaaccttctcctccccaacgatactcgatatgtgatcggtagttatggtccaacgcaaatgtaacacgggaattgcttggcacatcactagactgtaatggataatatatatcgctcccactattgcatataaaggcatcaaagtcagtcgggagcatgcctgtgcgtactattacagactgtagctctgctattgtcagtgaagttgacagcacaaaacctgtagaacctgacatagttccagtgcgtgtagcctcaacagagtttctgataatttgaattaaatcttccttgttaacagagtctacagcaatgatagatatatgcttcctgcacttcacaggcaccttgtggtcttctttgcatgcgaaagcaggatgtcttggaccaagacttgatatccttgacaagtaattcttgcaatgttcaggccaagaaaattggtgtatatttttcaatccattttctcgacatcttgaccaaaactgcttttcagaaagcatcttatagagggcatctgcaattgcatgctgatcatggggatcaacaaggagaccattttccagaacctgataaatttcaacaggagccccattttttgttgcaataacaggcaacccgtgcatggcagcctctatcaaggtgacaccaaattgttcaaaataagcaacatttacaaaagcgccctttgttcttgctgctaaacgataaatatcaggaacttcagagtgcttgtgaagctttgggtatgccacttgaccatataaatcatattcatcaatcaatgtaagcaccgatgtcaaaacagctgcactgattttgttcattttggaaatagcctcacggttgcccattatcagtgtaaggttagcaagttccctcaacggatggcattcaccaaatgccttcacaagtgttgcaatattcttttcagaatatggacgagcaatagccaaaatcataggtttcctaggatttgtgaagaaccgcattatctcaaaccaaatagatggatccgaggctggagattggttatcttcatctccatacatatcaaaatcatgaatcaattggccgaattcaactcctggaggaattataaccatacgaggcatataacgaccataacagttagcaccacgcttgactaacgcacggagcttcctcgcaagcatgacttcaaaaccatcatacaagttccattgttcttctatttcttgccgtgtgcttgcgataattatttcagatgcatcaagagataactcctctgcctcaattcggcgcattattttgtatgtcacatttatttgttctcttgtctgcctaccttgcttgagaagctcttccagcttatctttaccaagaaaatgcccggtaaacaacatgggaacattaagtgctccagataatagagcagcagcaactcctgcactggcataatggccatgaatcacagtaggccacactggacacacactgccagtttcttcgcctatagtttttgacatgcgcacaatatgacctagtgcaccatcaacaaattcctgaatgaaaggccagatattttctttagctagatgcttgtctttggggccaaatggtattctgatgatatgtgcaccactgttctctcctcgttcgcatctaaagttcttgaaacttgtcgaagccagcagctcatctagttcaccatagccacgatcaaaatttggggctaagatttgtcttgtcaatagatcaacccggtaaactccaggacatgaacttaatgctttagcaagctccacgacatatttgacctggccaccagtatctgaatcacggccaagctccatgttctctccacgtatcaggccatgcagactgatcaacanctatgtatagcttgtcaaataaactggtcctaggtgtgttcccagttgtgctgtcaccgtaggcaacagatggatcaccagcgtcttctcccttcactccttcaaaaagatcttcagacatttctgcagtagcatcattccgtggcttcttagtctctaaacggtgtttggacaagcgaatggcttcctctttctcaaactccttcttcttcctggcgaggttccagatcctccaggtcatgttctccagccgcgtgttcttctcctgcgggctccgcatcgcgttcgcccggagccaggtcttgtagaggtcggtctcgtcgtagccggtgatgacctcctcgacaaagtagcgcgcgggggagaagtggccgcgctcgcggaggagcagcgagggccggtccccgccccagcctccgccccggcccctggcggcgcccgcggccgcggccgcgacgcccttgccggcatcgaggatggcgtcgagatagctgttgatccagttgtcgttgccgtacatcgccgccggcgaaatcgaggcgaatgggggccgcgcggcgggtgcgggtggtggcgagggcgagggcggcgacgggtaaagagaggagagcaacggcacgaggcctcgtgccgaatt

SEQ ID NO: 19586 - DNA, 3479 bp, Zea mays
ggtgtgtagaagatgcgcttctagttctagttcactgtggatatgtaactgtacaaactgcgtagctgtgacggtgaagaaacgcaaacaaacatgtgaacatacatgactttatacagctccctagattttgcccagaaagtgacacgctggtcgtgaaaccaacagtgaagtatagatcaatcatgcaaccgaatctgatgcaggagcaggattcagaatcgaattcatcattcgtatgcactggccattacactacatacatgaaaaacaaggcatgctattgccggctgtcagtccatggtgatcctgcccggacctcccttgagtgagctgtacagcggcctcgatcgtttgaagccgaatatgtctgtaattctgtacattttgggcgggtcggcttcgttgattgccttcttgaactctaccaaatggttgccgccgaagacttgcacgcttagtgtcctcctttgaggcgcgtccacttttatatactggttgaagtactcgatgaattcttctttcttgagctctcttagcatagcgacctcagactcgaccctatcaaacttcagagttcctgcctcaatctctccccagtagaaatgagattcctcccataagtttttaaacttctccagtttagaatcaattaatgatttcacatttctcttgaaatccttgtcggagagttcatagattttgctttcaaacatcttaaagaactcatcaactctaacatcgaggtatgaaggatcctttactgtggactggataacaacctggagtgccaggactccatagtcggatctcagagaaagacttgttatatacccaagttgttcaacagttcgtagctggttgaaggctggctgttttgctattagagagaacagctcaagtttgatattcaaaatggcgtcatcttgatgcacctgaatatattggataactgatgaattctcattcttctggtttaatccctcagtttggtagtagcatttcaagtcattttcaagcatgatgacccttttaatcagatattctgatggagacatggatttgaacaaagaattgggcgtagtaaatatagtgttttcgatttcttctacgatagattttgcttcacttggttcaatgttcccttgaacataacattccaaaaatgtttttgacagtaggtgtggtacgaactttgcaaaataatctgattcaagcttagaaagagcttcaagtttctcagctacaggccattttttatctcccaatatcaaagagacatagtatgacgcttgagaataaggttgtcggaaattgaaattctggtagtccttgacagaagtttccttcagtgcagaaaatctgtttggcttaacttcaaatttcacaatttgcactagtatggcatttaagagaactctcatcttgtcattgtaaccacctaaagaaacctggaatccagctgaagtaacatatattgaatagaataaaccagcaatttgagcatcataagcataagcattcaaataatctactaacaaatcaacaaagagctcagtagcaacaactgcttcaggggagtggctggataatggacagtggaaatcaatgataatgtgaacctttggtgtggagaacagcatatcaggcttataccacaactgtgaaagtgggctcttccttaacactgttggaaaagtaaccttttcatgcacttctttaagagataaatcctttggtatgaaaatattaggttttggaagatggagtttttcagtaggagctttttcaatccattcctgtatcactgaaggagtgacattttcaactgaaaatggtgtgttataccagggctcagcagaactcgtagatccttcaaattttttggactcccagaatattcttactgtttcaggtattagttgattgagtatcatatttattctctgtgatgcatactttgatggtaatgctgctccaaccagccattcttctggtgggaacaaccgcatagttgagacagtgcgcatcacatagttgattgggcggactttgtcttgataatggaactccatttcatttatcgccgcaagctcattaaatatccactcatggactccgtcttcttttaatagatgaagatatttgaagatcaacccaacaatatcctccatgcgttcatggccagcatcagtgagcctcatgcttactgagaaaaaggaatactcattactgtcactgcactctccagccattaagttcatggcccatcctagttcctttataatatggaagatggacccctcgccttcatgtccaatgaggtgactcagataatggcaaggagcttctttgtaaaactggatgctaggtgttattggccatataattcttagatagtccccttctactattggcagcccggccacaagaagctgtaaatgttcctctgaaagaggatgacttggacatttcaagcttctctgatcagtgttttttatgtcactaaacatacgctcaaccaagccctgaatgcaatcgaggttctcctttccataaacaacaaggtgcataacgtttgctgaataattcttgtaaaacttcagaagttcaagtctgatatccaggcccctcgcttttggtttagtttctagtgttccccacctccctgtactgaatttgtggtaggggtgatcctttgaagcaaaatgctttggaagctgatacatcctccagccatcagacaacaaatttttcttgtgttcagaatccacagcttttatctctctaagaacagcatcctgtgacatcaatggcttaatgaagaactgagcaaatctatctaaggcttcttcaaaattgtccacattgacatcgaaaaagaaattcgttgtctcggagcttgtatatgcattgtaagagccaccatgctctatgatatatttcgtatattcatgttctccaggatacttctcgctggcataaaatagcatgtgctcgaggaagtgcgcgaggccctcaagtccctccggatcgctgaacgagcccacctcgacctccatgcacgccgccgccttgtcggtgtcggggtcgctgattagtaggatctcgagcgcgttggcgagcaccacgcggcggtactcccgcttgtcgctgcgcgcgcggatgaactcgacattgctgctccccgccgcggccaccgccgccgccgccatcagcacaggctcgcaatcccccgccccttctcctttttcgcttttcgcttcgactggagacgatcctctgatgatctctcgcaatgctggaagctggattggattaggggccaagactacttgagaggctattagtttttgtctcttgtcaattttatactagcatagtgaagggactcaaccactcagaggccagccgcccgcaagcagggccgcaggggccctctgttcgaaccggatcccggccggcctcgagggtcccaa

SEQ ID NO: 19587 - DNA, 3340 bp, Zea mays
  misc_feature (1147)..(1147): n is a, c, g, or t
gggaactgtaactgtacataatgcatagctgtcagaagaaatgcatacagacatgcgaacatacatgactttatttatacagccccctatatctgcccagaaagtgacacgctgtcgtgcattattggttaacataacaaaccatcagttaagaatagcatcaatcgtgcaatcgaatctgatgcaggattcaggatggaattcaggcgtatgaacaggccgttacactacgtacgtacatgaaaactagggaatagctgcgtgatggctgtcagtccatggtgatcctgcccggacctcccttgagtgagctgtacagcggcctcgatcgtttgaagccgaatatgtctgtaattctgtacattttgggcggatcggcttcggcgatcgccgtcttgaattctgccgaatggttgccgccgaagacttgcacgcttagtgtcctcctttgaggcgcgtccacttttatgtactggtcgaagtactctatgaattcttctttcttgagctctcttagcatagtgacctcagactcgaccctatcaaacttcagagttcctgcctgaatctctccccagtagaaatctgattcctcccataagtttttaaacttctccagtttagaatcaattagtgatttcacatttctcttgaagtccttgtcggagagttcatagattttgctttcaaacatcttgaagaattcatcaactctaccatcaagatacgaaggatcctttactgtggactgtataaccacctggagtgccaggactccatagtcggatctcagagaaagacttgttatatacccaagctgttcaacagttcgcagctggttgaaggctggctggcttgctattagagagaacagctcaagtttgatattcaaaatggcgtcatcctgatgtacctgaatatattggataactgatgaattctgattcttctggtttaatccctcagtttggtagtagcattttaactcattttcaagcatgacaactcttttagtcagatactctgatggagacatggatttgaacaaagaattgggggcattaaatatagtgttttcgatctcttgtacgacagattttgcttcacttggttcaatgttcccttgaacataacattccaaaaatgntcttcgatagtagcccggccgccctcgtggcacccaatgctgattcaagcttagaaagagcttcaagtttctcagcgacaggccattttttatcttccaatatcagagagacatagtatgaagcttgagaataaggttgtcggaaattgaaattctggtagtccttgacagaagtttcctttagggcagaaaatctgtttggcttaacttcaaaactcgcaatttgcactagtatggcatttaagagagctctcattttgtcattgtaaccacctaaagaaacctggaatccagcagaagtaagatatattgaatagaacaaaccagcaatttgagcatcataagcataagcattcaaataatctactaacaaatcaacaaagagctcagtagcaacaactgcttcagaggagtggctggataatggacagtggaaatcaatgataatgtgaacctttggtgtggagaagagtgtatcaggcttataccacaactgtgaaagtgggcttttccttaacactgttggaaaagtaaccttttcatgcacttctttaagagataaatcctttggtacgaaaatattaggttctggaagatggagtttctcagtaggagcctttttaatccattgctgtatcatagtaggagcgacattttcaactgaatatggtgtgttataccagggctcagcagaactcgtagatccttcaaattttttggactcccagaatattcttactctttcaggtgatagttgatcgagtatcatatttattctttgtggtgcatactttgatggcaatgctgctccaaccagccattcttctggtggaaacaaccgcatagttgagacagtacgcatcacatagcttattggatcaactttgtcttgataatggaactccatttcatttatcgcttcaagctcattaaatatccactcgtggactccgtctacttttaatagatgaagatatttaaagatcaacccaacaatatcctccatgtgttcatgaccagcatcggtgagcctgatgcttactgagaaaaaggaatattcattactgtcagtgctctctccagccattaagttcatggcccatcctagttcctttataatatggaagacggacccctcgccttcatgcccaatgaggtgacttcgttgctgtcgcggggcttctttgtaaaactggatgctaggtgttattggccatataattcttagatagtccccttctactattggcagtgctttgacaagaagctgtaaatgttcctctgaaagaggatgacttggacatttcaagcttctctgatcagtgttttttatgtcactaaacatacgctcaaccaagccctgaatgcaatcgaggttctcctttccataaacaacaaggtgcataacgtttgctgaataattcttgtaaaacttcagaagttcaagtctgatatccaggcccctcgcttttggtttagtttctagtgtttcccaacttcctgtactgaatttgtggtaagggtgatcctttgaagcaaaatgcttttgaagctgatacatcctccagccatcagacaacaaatttttcttgtgttcagaatccacagcttttatctctctaagaacagcatcctgtgacatcaatggcttaatgaagaactgagcaaatctatctaaggcttcttcaaaattgtccacattgacatcgaaaaagaaattcgttgtctcggagcttgtatatgcattgtaagagccaccatgctctatgatatatttcgtatactcgtgttctccaggatacttctcgctggcataaaatagcatgtgctcgaggaagtgcgcgaggccctcgagtccctccgggtcgctgaacgagcccacctcgacctccatgcacgccgccgccttgtcagtgtcggggtcgctgattagtaggatctcgagcgcgtttgcgagcaccacacggcggtactcccgcttgtcgctgcgcgcgcggatgaactcgacattgctgccacccgccgccgcggccgtggccgccaccgccgtcgccatcagcacacccttctcctcctctccgcttcgattggacgcggtcctctgatgatctctcgcaatggtgggtgcgggattggattggggaccaagattacctcgcgccgtgtgacttcccggccggcctcgaggtaccc

SEQ ID NO: 19588 - DNA, 1036 bp, Zea mays
ccggccggggggtttctatcgagtgggggcctttccctagccggccaatccccatcagtctccccttccaaaaccggatttgcgaaccacacctagcagccgaggttagcacgcgtcctgcggccatggaggacgaggagcacgaggtgtacggccaggagattcccgttgacggcgaggacgtcgacatggctgccggcgacgatgccaccaagctgcaggaacttgacgatatgaagcgccggctcaaggaaatggaggaggaggccgccgcgctccgcgagatgcaggccaaggttgccaaggagatgcaaggtgtagatcccaatgcaaccacatctgaaaacaaagaggagatggattctcggtcagtattcattggaaatgttgactatgcgtgcactccagaagaagtgcagcagcacttcaattcttgtggaactgtcaacagagttacaatcctgactgacaagtttgggcaaccaaaaggttttgcttacgtggaatttgttgaagttgaagctgttcaggaagctatcaagttgaacgagtcagagttgcacggtcgccaactcaaggtggcaccgaagaggactaacgttcctgggatgaagcaaccccgcggtcgaggtttcaatccgtaccatggccacccctacatgaggccgtatggttatagtccttatggttatgggagattccccagattccgccgcccgcgaagaccttatttttgaagctcggttcccatttggcagaacatgggcgataatcggccgcgttctgttatttcatagcttattcgggacgttcccatgcatgtttctgtattgacgatgcttaagctttgtactgtattgtatcagttatgcaagacgattatgatttagttacacgaaatgcactgttgtgatgctacttggggtgcgccacttttgggcctcgaatatgattgtataagctgatgcattatttattcacgtctatgtcacatttaaaaaattcagtgcgagggctctagaggatccgagctcac

SEQ ID NO: 19589 - DNA, 3343 bp, Zea mays
  misc_feature (447)..(447): n is a, c, g, or t
  misc_feature (664)..(664): n is a, c, g, or t
  misc_feature (2757)..(2757): n is a, c, g, or t
  misc_feature (2864)..(2864): n is a, c, g, or t
ccctaataatcggctatcctgtcagtttccctctcccctcccgaaaccggattccgtaccgaatctggtctcgccttggagccgaggttgcacgcggttcgtcctgcggccatggaggacgaggagcacgaggtgtacggacaggagatccctgttgacggcgaggacgtcgacatgtccgccggcgacgacgcgaccaagcttcaggagctcgatgagatgaagcgccggctcaaggagatggaggaggaagccgccgcgctccgcgagatgcaggctaaggtcgccaaggatatgcaagatcccaatgcaaccacatctgaaaacaaagaggagatggattctcggtcggtattccgttgcaaatgttagtctgctgcgctctttatgcaaattaagggaacttatgtatagttcaatgggtatatgatattattgggggagggngggggaaaggggtaatattatattcgattttcactttccagtgaatattatgtttgtttggctgtgctccactagaaacccaatttctataaaaatgcgatcaaaccagcaataaagcatgggatcacattgtgttagtttgcagttcatttgtaaaagttccatttcattgaacaagtgcacatatgatcgcattttatcatatatttttctattntttcccctactttgtgttgattgaacaatggcaatggtcgctggttagtctgctgtcatcaagcctttctatcaaagttttggcatctggttcagtttcagcacaagttctagtgttagcttcgtgggggaaagaaaaaaaagaaggaaaaaaaatccaagaaagttcttgaaaaaagaaagaaaaatagaaaaacaatttgaaaaagcaaaaaaaaaagtatacaaaaatggaaaaaaaatagtgatgatgtcataggctaggaattatcccccagggtagccagcagagaatgggtcaggcacattcatggtactgatgtggagtgatatcattagccatttactggcaatagcatgtaagtttgatctcatatttttgctgagcatattgagattgttatatgcttctgtagatgttctctctgttatcttacacttgacatcttttgcaatttatatatttcattaatcctcttttacactgaagaattttttatttgggacctttactgtccagaaaccatccattagttagccttgtgtgatccttcaatattctcgtccctacaatccctaaattatccttttttctttattggcaagttgattatgtttcatagtataaagtataaacatagtggggtgttaaatcatatcaataatctgcctgtgttacgatagatgaattcactattgcagggatgacaaatacttccgttgacgttacacggttaataatttgatcaattggattctacgaaattttacccactactatggaccctcctattcatgccataaaaatgtcaagtattggagaagatagaaatttgtattgatagatatatactagagtcgaatactagtaaaggatcacattgctttttagtcattgtatattatgtttgtggtgtatattgacaatgtaactggtctttggttgtaatttagcttgttttatgaatgcacaacctatatgtttatcatgctctggacccatcaattttcagctgatgtagtgtaaatacacatttcttttttgagagcaaagcattacacatgtttctgacatgttgaagatgctaagtagatgtgtacttcagtgaaaattgttgaacattaacttttgatgcccttaaatcatagtttttaaggtgtccgtaaggcgatgcttaagcgtcgcctaagcggtaaggcgagggtgactcgcctggcctaagagctctccttagcccgccttagctcgctttagcgtcgcctaggcggtaaggcgatggtggctcgcctcatctcgccttaccgccttaaaaaattatgccttaaattgaattggtaattttgatacgaatttgctttgttttgcagtggcctgtggtaattagaggttacaatgggctctaaattttacactataagattttaaggaccggatcggattaggatcgggccttatttctattcatttttgaactaaaatttatttagggccctaccattttatgaagaagcatttggattgcgatccattaccacccctagtggtaatgtggattcattaatttgttcattttgtgaccacctttgagcatttattgaaacaatttgagggactgctgattatcctagttggaacatactttgggccaccaaacctgattgtgcagttttataatcaaactgatgaatctttacaaatttgagttagctctggacttcggttcagctaatatctcatatgatttagagcagctgactccaatactatttttgtttatgtgagcagagacatgttattaatgcaccgacctattagttgtttcaaatgaattatgtattagttgtctgcaaaagtttaggttcgaagttttatttgtatatatgtctatttgtcagctgtttggttattgaaatatgtaacattacaagtatgctcagtttcggtgtaatggcaactacaggttgactatgcatgcactccagaagaagtgcagcagcatttcaattcttgtggaactgttaacagagtgacaatcctgactgacaagtttgggcaaccaaaaggttttgcttatgtggaatttgttgaagttnaagctgttcaggaagctattaagttgaatgaatcagaattgcatggtcgccagctcaaggtgtgaatctttttttttttttgctttttactaagaacatcaacatcnaatgggtgctttgtatcccattttgcatccatatctggactcctcgagcagccggtggcatgttgacatgaatcagttttgcatggtcgccagctcaaggtggcaccgaagaggactaacgttcctgggatgaagcaaccccgcggtcgaggtttcaatccataccggccatatggttatagtccttatggttatggctatggctacgggagattccccagattccgccgcccgcgaagaccttatttttgaagctcgtatgtccatatggtttgcagaacatggacgatgagacggcttgaccttatattcccgcgtcctattacttcatagcttattcgggatgttctcagacatgttattcccatattgacgatgcttaagatttgtactgtattgtttcagtgacagttacgcaaaacgattatgatctagttacgcggaaaaaaaaagaaacgaaaaaaaaaaaaaaaaaaaaa

SEQ ID NO: 19590 - DNA, 2379 bp, Zea mays
  misc_feature (1800)..(1800): n is a, c, g, or t
gggaaaaaaaaaaaaaaaaaaaaaaacatagggtacccccagggcggcgcccctaataatcggctatcctgtcagtttccctctcccctcccgaaaccggattccgtaccgaatctggtctcgccttggagccgaggttgcacgcggttcgtcctgcggccatggaggacgaggagcacgaggtgtacggacaggagatccctgttgacggcgaggacgtcgacatgtccgccggcgacgacgcgaccaagcttcaggagctcgatgagatgaagcgccggctcaaggagatggaggaggaagccgccgcgctccgcgagatgcaggctaaggtcgccaaggatatgcaagatcccaatgcaaccacatctgaaaacaaagaggagatggattctcggtcggtattcgttggaaatgttgactatgcatgcactccagaagaagtgcagcagcatttcaattcttgtggaactgttaacagagtgacaatcctgactgacaagtttgggcaaccaaaaggttttgcttatgtggaatttgttgaagttgaagctgttcaggaagctattaagttgaatgaatcagaattgcatggtcgccagctcaaggtggcaccgaagaggactaacgttcctgggatgaagcaaccccgcggtcgaggtttcaatccataccggccatatggttatagtccttatggttatggctatggctacgggagattccccagattccgccgcccgcgaagaccttatttttgaagctcgtatgtccatatggtttgcagaacatggacgatgagacggcttgaccttatattcccgcgtcctattacttcatagcttattcgggatgttctcagacatgttattcccatattgacgatgcttaagatttgtactgtattgtttcagtgacagttacgcaaaacgattatgatctagttacgcggaaaggtactgttgtgacgctgcaagcccgcctcgcgggcgggcccggacccctatattcaaggccattcgcaggaaaatagtgatagaatgggaaaacaaaatggcctagaactagaagcggacggaggttccccatgtgcgcgcgtccttaagggtcgccgccagccaaccgagcccctcgtgcaggccctcgccggtgagcgcgcaggcccccactgcacgcgacgtcctgttcttgaggtcgtacaggcccaggcgctgccccacttcggaggggctcatcgcgcctttctgccaagaaaaaaaaaaaggagcacagatgagatgcgaggagaggcgcttttgtttggttcttggatgagtcactaattaccatatcctgcttgttggcgagcaccaggacaacgctgctgagcatgagcgggtccttgacgatggcctggaactcctccctggcaaccccaatccggtccctgtccaccgaatcaacaacgtatatctgcgacccccacacaataaaaaaaatcattcagcataacgcatcaacgagaatggagtacaggagagggaaactggaatggaaataccagggcgtccgagttgctcaagtactgcctccacagcggccgcagcttgtcctgccctccgacgtcccacaccgtgaaggccacgttcttgtactcaactttctccacgttgaaacctgcacacacacacacacacacacacacacaatgctacctcgaaccgtggtctactacgaggatcaacgtagctctatgagagacgcataccgattgtcggcaccgtcgacagagcttcgccgacgtgcagccggtacagtgcngtcgttttgccggcggcgtccagcccaagcatcacaacctgcaccatacagcagagcaagcgagcagctgaaacaccggaaaaggaatccattcagacagatcgagctcagccgtagcactgtctgtctgtctgtctgtaccaacggcacgcaccaccgtccgtcgtcaccttcacttctttctggcaggagtcgtcgaagaagagcttcatcagagactggcccatgcctcaattcgccaagcgttgttttgcctcgcacgcacagaacgcccccttttttccccctcccagtttctttctgtgcatttatgtgagggtggacggtggttgtcaacctgtcatgcaggccacgacgcctctttgttcctgtatcagtttgtgttccacgcatctcgatcgcacggtgccaacgtagattctgcaactaggacgatgacatggggagcacgaatgccgcatttcacttcaccgacgtttgggtgcgtgccagctgaaactcccatataaactagagcgcaaaaacaaacggcttgacaattgtaatccatagagataataaaaatattgtagaagccac

SEQ ID NO: 19591 - DNA, 496 bp, Zea mays
  misc_feature (23)..(23): n is a, c, g, or t
tgggtacctcgaggccggccggnaataatcggctatcctgtcagtttccctctcccctcccgaaaccggattccgtaccgaatctggtctcgccttggagccgaggttgcacgcggttcgtcctgcggccatggaggacgaggagcacgaggtgtacggacaggagatccccgttgacggcgaggacgtcgacatgtccgccggcgacgacgccaccaagcttcaggagctcgatgagatgaagcgccggctcaaggagatggaggaggaagccgccgcgctccgcgagatgcaggctaaggtcgccaaggatatgcaagatcccaatgcaaccacatctgaaaacaaagaggagatggattctcggtcggtattcgttggaaatgttagtctgctgtcatcaagcctttctatcaaagttttggcatctggttcagtttcagcacaagttctagtgttagcttcgtgggggaaaaaaaaaaaaaaaaaagcggcc

SEQ ID NO: 19592 - DNA, 3936 bp, Zea mays
  misc_feature (3704)..(3704): n is a, c, g, or t
gtgggcccatggcacagacggcttacagagatcctaccccacattccagagatatggaacgccaccatggccgataccgaacagccgcgccatgtgtcacacatcgggagcacttcgtcaacaatccaacggtccatgattattaaggcccacatgtcatagaaccctctggcaccctctcgccgcttcgtcacctgtcccgtcgctcgtcctctcgtttccacggccttctagactcccggcgaacactcccctccgccttcttatgctcatcccctccgcttccgaagcaaattcggcacgagggaaacactagccgaagcaaatccattccacaagcacctggtgggatcatctcatcatcagaaaccaagagagagattccgtgcccgcttgtagattgtgaggactgaggaccgagaagcagccatgaatccggacaacttcacccacaagacgaacgaggcgatcgtgggggcgcacgagattgcggtggaggccggccacgcgcagctcacgccgctgcacctggccgcagtgctggctgcggacaagggcggcatcctgcggcaggccatcacgggggcgtcggggggcgacggagcggccggggactcgttcgagcgcgtgctgaacaactcgctcaagaagctgccgtcgcagtccccgccgccggactccgtcccggcgtccacggcgctgatcaaggtcatccgccgggcgcagtccgcgcagaagaaacgcggggactcgcacctcgccgtcgaccagctgctgctcggcctgctcgaggattcgcagatctccgactgcctcaaggaggccggcgtgtccgcggcgcgggtgcgcgccgagcttgagaagctccgcggcggggaggggcgccgcgtggagtctgcctcgggggacaccaacttccaggctctcaagacatacggccgggacctcgtcgagcaggccgggaagctggaccccgtcatcggccgcgacgaggagatccgccgcgtcgtgcgcattctctcgcgccgcaccaagaacaaccccgtcctcatcggcgagcccggcgttggcaagacggccgtcgtggagggcctcgcgcagcgcatcgttcgcggcgacgtgcccagtaacctcctcgacgtccgcctcatcgcgctcgacatgggcgcgctcgtcgcgggcgccaagtaccgcggcgagttcgaggagcggctcaaggccgtgctcaaggaggtggaagaggccgaggggaaggtcattctcttcatcgacgagatacacctcgtcctgggcgcgggcaggacggagggttccatggacgcggccaacctgttcaagccaatgctggcgaggggacagctcaggtgcatcggcgccaccacgctggaggagtaccgcaagtacgtggagaaggacgcagcgttcgagcggcggttccagcaggtgttcgtcgcggagccgagcgtgcccgacaccgtcagcattctgaggggcctcaaggagaagtacgaggggcaccatggcgtgaggatccaggaccgcgccctcgtggtcgcggcacagctctccgcgaggtacatcatgggtcggcacctgcctgacaaagccatagacctggtggacgaggcctgcgccaatgtgagggtgcagctcgacagccagccggaagagattgataacctggagaggaagagaatccagcttgaggttgagctccacgcgctcgagaaggagaaggacaaggccagcaaagcccggctgattgaggtgcgtgtctcgagcactgaattttcctcaaacaagtcctcttgtctgatgttcctgttttgaacttttgatactaacgtcgcttaactgtggccattgttcaggtcaggaaggaattggacgatctgagggacaagctgcagcccctgaccatgaagtacaggaaggagaaggagagaattgatgagatcaggaagctgaagcagcgccgcgaggagctccagttcaccctgcaggaggccgagcgccggatggacctggcccgtgtggccgacctcaagtacggcgccctccaggaaatcgacgctgctatctccaagctggagagcgaaacaggggagaacctgatgctcaccgaaaccgtcggccctgaacaaattgcagaggtatgttattattcttgttcaccgtcacaaaaattttgcagagcaagtgccgaatttgccgatcgtctcctagtagagtagtcgtgcagcgtgctgaaatggtgtttcgtcctatgggcaggtggtgagccgttggacgggtattccagtgacccggcttggccagaacgacaaggagaggctggtcggcctggctgacaggcttcaccagagggtggtcggccagacagaggctgtgagcgccgtcgcagaggcggtgctgaggtcgagggccggtcttggcaggccacaacagcccactggctcgttcctcttcctgggtccgactggcgtggggaaaactgagctggccaaggccctagccgaacagctgttcgacgacgagaaccttcttgtccgcatcgacatgtcggagtacatggagcagcactcggttgcccgcctcatcggagcaccacctgggtaagtagcagaaaatgcatgcatcttcgtatttttaactgcgaattgcgatgaactcttgttctgacagtgggccggacctgtgacagctacgtcggccatgaagagggtgggcagctgactgaacaagtgaggaggaggccgtacagcgtgatcctgttcgacgaggtcgagaaggcccatgtcgccgtgttcaacaccctgctccaggtcctcgacgacggcaggctgacggatgggcaaggcaggacggtggacttcaggaacaccgtgatcatcatgacatcgaacctcggcgccgagcacctcctcgctgggatggtgggcaagaactccatgaaggtcgctcgcgatctggtcatgcaggaggtatgcattgcgataacgttctgaatcgtcgttagacattgttcctctgcagcgtgatgctcaatcggatcgttattgctgtgtgcaggtgaggaggcacttccgccctgagctgctgaaccgtctcgacgagatcgtgatcttcgatcctctgtcccacgagcagctgaggaaggtcgctcgccttcagatgaaggatgtggccgtccgtcttgccgaaaggggcatcgctctggctgtgaccgacgccgcattggacatcatcttgtctctctcttacgatccggtatgtgaccatccatgatttgatccatctgaattcgtcggtgacacctgatggtgctgactctcttatctctcttgtgtggcttcaacaacaggtgtacggcgcgcggccaatcaggaggtggatcgagaagagggtggtgacgcagctgtcgaagatgctgatccaggaggagatcgacgagaactgcacggtctacatcgacgccgcgcccggcaaggacgagctggtctacagggtggaccggagcggcggtctggtgaacgctgagacggggatgaagtcggacatcctgatccaggtccccaacagctccaccaggagcgacgctgcgcaggccgtcaagaagatgaggatcatggaggaggacgaggacggcatggacgaggagtaaaaggcgggccggaggacgcggagctgcgcccaggccgcangtctggcgccggcatcatcgagtgtcttttgaataagcgtgtagataagcccgtgaatatgcagacgaggttgagatgatgttcttgtaacgctgctgtttgtcaagcatggacggatggtctctcatatggtatcaaagtgacgaaggtctctcaatcgatgtcttgtcattatttttatctccctaaatgtttttacatgttttcctctattcattgcatcctttatgca

SEQ ID NO: 19593 - DNA, 3639 bp, Zea mays
  misc_feature (6)..(6): n is a, c, g, or t
  misc_feature (52)..(53): n is a, c, g, or t
ttattntcggcaccgagtgcttcgtctttccaccggccctttctagaactcnnccggcgaaaccacttcccaccttcctgcctttctttactgccgcactcccccttccgctttccgagagcaccgaattcggcacgagggaaaaactagccgaagcaaacccattccacaagcacctggtgggatcatctcatcatcagaaacaaagagagagattccgtgcccacttgttgtagtagattgtgaggattgaggagtagcaaagagaagcagccatgaatccggacaacttcacccacaagacgaacgaggcgatcgtgggggcgcacgagattgcggtggaggccggccacgcgcagctcacgccgctgcacctggccgcagtgctggctgcggacaagggcggcatcctgcggcaggccatcacgggggcgtcggggggcgacggagcggccggggactcgttcgagcgcgtgctgaacaactcgctcaagaagctgccgtcgcagtccccgccgccggactccgtcccggcgtccacggcactgatcaaggtcatccgccgggcgcagtccgcgcagaaaaaacgcggggactctcacctcgccgtcgaccagctgctgctcggcctgctcgaggactcgcagatctccgactgcctcaaggaggccggcgtgtccgcggcgcgggtgcgcgccgagcttgagaagctccgcggcggggaggggcgccgcgtggagtccgcgtcgggggacaccaacttccaggcgctcaagacatacggccgggacctcgtcgagcaggccgggaagctggaccccgtcatcggccgcgacgaggagatccgccgcgtggtgcgcatcctctcgcgccgcaccaagaacaaccccgtcctcatcggcgagcccggcgttggcaagacggccgtcgtggagggcctcgcgcagcgcatcgttcgcggcgacgtgcccagtaacctcctcgacgtccgcctcatcgcgctcgacatgggcgcgctcgtcgcgggcgccaagtaccgcggcgagttcgaggagcggctcaaggccgtgctcaaggaggtggaagaggccgaggggaaggtcattctcttcatcgacgagatacacctcgtcctgggcgcgggcaggacggagggttccatggacgcggccaacctgttcaagccaatgctggcgaggggacagctcaggtgcatcggcgccaccacgctggaggagtaccgcaagtacgtggagaaggacgcagcgttcgagcggcggttccagcaggtgttcgtcgcggagccgagcgtgcccgacaccgtcagcattctgaggggactcaaggagaagtacgaggggcaccatggcgtgaggatccaggaccgcgccctcgtggtcgcggcacagctctccgcgaggtacatcatgggtcggcacctgcctgacaaagccatagacctggtggacgaggcctgcgccaatgtgagggtgcagctcgacagccagccggaggagattgataacctggagaggaagagaatccagcttgaggttgagctccacgcgctcgagaaggagaaggacaaggccagcaaagcccggctgattgaggtcaggaaggaattggacgatctgagggacaagctgcagcccctgaccatgaagtacaggaaggagaaggagagaatcgatgagatcaggaagctgaagcagcgccgcgaggagctccagttcaccctgcaggaggccgagcgccggatggacctggcccgtgtggccgacctcaagtacggcgccctccaggaaatcgacgccgcgatctccaagctggagagcgaaacaggggagaacctgatgctcaccgaaaccgtcggccctgaacaaattgcagaggtggtgagccgttggacgggtattccagtgacccggcttggccagaacgacaaggagaggctggtcggcctggctgacaggcttcaccagagggtggtcggccagacagaggctgtgagcgccgtcgcagaggcggtgctgaggtcgagggccggtcttggcaggccacaacagcccactggctcgttcctcttcctgggtccgactggcgtggggaaaactgagctggccaaggccctagccgaacagctgttcgacgacgagaaccttcttgtccgcatcgacatgtcggagtacatggagcagcactcggttgctcgcctcatcggagcaccacctggctacgtcggccatgaagagggtgggcagctgactgaacaagtgaggaggaggccgtacagcgtgatcctgttcgacgaggtcgagaaggcccatgtcgccgtgttcaacaccctgctccaggtcctcgacgacggcaggctgacggatgggcaaggcaggacggtggacttcaggaacaccgtgatcatcatgacatcgaacctcggcgccgagcacctcctcgctgggatggtgggcaagaactccatgaaggtcgctcgcgatctggtcatgcaggaggtgaggaggcacttccgccctgagctgctgaaccgtctcgacgagatcgtgatcttcgatcctctgtcccacgagcagctgaggaaggtcgctcgccttcagatgaaggatgtggccgtccgtcttgccgaaaggggcatcgctctggctgtgaccgacgccgcattggacatcatcttgtctctctcttacgatccggtgtatggcgcgcggccaatcaggaggtggatcgagaagagggtggtgacgcagctgtcgaagatgctgatccaggaggagatcgacgagaactgcacggtctacatcgacgccgcgcccggcaaggacgagctggtctacagggtggaccggagcggcggtctggtgaacgctgagacggggatgaagtcggacatcctgatccaggtccccaacagctccaccaggagcgacgctgcgcaggccgtcaagaagatgaggatcatggaggaggacgaggacggcatggacgaggagtaaaaggcgggccggaggacgcggagctgcgcccaggccgcaggtctggcgccggcatcatcgagtgtcttttgaataagcgtgtagataagcccgtgaatatgcagacgaggttgagatgatgttcttgtaacgctgctgtttgtcaagcatggacgaatggtctctcatatagtatcaaagtgacaagtctctcaatcgatgtcttgatgtcattatttttatctccctaaatgtttttacatgttttcctctattcattgcatcctttatgcatacacgaagggagaactttcggccaactgtttggtttctagcgactccctagtccctacattttaatggagtccttttaggccagataatggagtccttttaatcggcgcgacggcggtggttgagaggaaacaaaataggcgatgtgaggcaggcaggatgtcgagatcgagagagtgcatacatggcggaccggcggaggagggcgcggccagcggatggtcggagcaattcctgtttcgtctttttaggagtagagatagatatagattagaatgaaattgttgcaaaataaaaggcctaggtgccaagtgccgaattgggccaaattttccaaggccgacgaaaacag

SEQ ID NO: 19594 - DNA, 1711 bp, Zea mays
  misc_feature (256)..(256): n is a, c, g, or t
caatgcaactctcagcatgcttcaattgattccaaaggtgaacatgatcagaacttcaatttgcgccactcagatacttaagttgtcaatatatctaatatttattcatctgcaggagaaagtcaggatgcctgtactgcccatgggaaagttgtagatggcagtatagacaaggatggtgccatggaatctgcattgggcagccagtgtaggttggttgttcccagtgggagatgcaggattggtccatgctggnggaatcttcattgtctgctgctgataaacaagcacagggtttgttaaaatcaactaatcataagcagcttctgagtgtgtcggacaacccaggcgcctttgatagacgtgacagtatggctggcaagatgggtgtgttggctgcagaggtgagaaaaactgatgccgtgggcaatagtaacatagtgcagaacgaggctgaaaagaaggaacatgcttgttcctctttgcctgatgttcccaaactagttgtcgcagcagcgtctccagttggtgtggcaaatgtgaataaggagatgaaagaatcaaaagacagttcaagtgaatccaatagccatgtaaaatctgaaggtgtcaattctcagcaaagcgagcaaagtgcaatgcagagttcaaagaaatcctgtgatggtgtgagtggaaaagaggacgaaaaagaagaccatgtcttatcagacgaaggttcttctctagccgctcacaccaagtcaaatgctacagccaagcttgatttcgacttgaatgaaggaatacctggagatgatgggcatcagtctgagccaactatctcgcctgttgtatgttcttcagcaatcaatttaactgggattttgccattcacttcgcctattacaacggggttgcagccagcttcaataacagtagctgctccagctaaaggaccctttgttcctccagaaaacctactaagagcaaagcctgagattgggtggaaaggttcagcagctacgagtgcatttcgtcctgctgaaccaaggaagattttggagattcctgctgctgcacgcgacattccagtatctcatgctgctgggaagcagtctcgtcccacgcttggttttgatttgaatgttgcagatgaccaagctctcgaggaagatatcccacagagttctgcacagactacctgttctgaatctggaaatacgagaagtcgagatggctcttcacgaagcgctggtattgaacttgatctgaacagagctgatgaagttgcagataatggccaatttgcaccaagtgcttcgcacagagttgaagtcccattgttgtcaacaagatcgttacatgggaggtttctctaatgctggcatgaatagcgcgagggactttgatcttaacagtggaccaggccttgatgatcttggcaccgaacctgcaccaaagagcttaccttctaaaagtacaagcagtattcaattcctaccacaagttcctgttaggatgaatagtgctgccatgagtaatatatcaccatggcttgcctctgccagcccttgtccagtagctatacaatcttttttatcaactagagaacagccatacccaattgaggcagcacctggagctcaaaggatcattgcgcctacagctgatgctggccagtttggaggtgatccctgtaggcctccagttgtttcaacgtctccagcga

SEQ ID NO: 19595 - DNA, 1146 bp, Zea mays
ctgatggtggccaatttggaggtgatccctgcaggcctccagttatttcaacgtctccagcgatggtttttcatccgcctgcatatcagtatgcaggattctctttccctccaagtgttcaccttcaaacaccagcattttcaattggatcagcaacatttaataattctgcatctgcaggagttccatattttccaactctttcctcctctcttgttgggccagccggagcgttgccttcccaacattcaaggcagtatgccataaatcttgctgagggtagcagcagtagtgtacgtgacggtaatcggaaatgggaaagtcagggccttgatcttaactcaggccctggaagtatagatttagaaggaaaggatgaacggatgcctttaccagtcagacaaaatttgatcccacccctacatggctttgtggaggatcaaggaagaatttaccaaatgccagttgtaggaacaaagagaaaggaacctgatggcagttgggactcagaaaggtctacatacaagcagttaccatggcaatgagggctctgaaggagatcattttgcaccgactggtctgcgaatgagcatgtatgtagttgattcaaacttttgaggtctgttctatttcttactaccagttgctaatcttgtgagatttgtggaatcatgcctttatttacagatcccctgcatgtagagcttggccggtgtgttcttcagtccctggactacactcaggggattcagccccatgacgatggcgtgggattgaggaaagcgaaaacttcctgtaattgttgtagattttttcttagctgttaggcttttggttctaatttactcaggagggtatggctgcggtggaggaatctttgtgatcctgagctctggggccactgtaattagcccgtccgctctgtttgttggtgataaactgttgagcacatgctgcagcttacataagaatttagatgtgcccttgttccttgttgggaaagcgttacgtcagctgcccatatacacactggtgcaacgaacagctcgagttgctaccccatgtatcttgggttgcagggcagctgtatgtataagaattctagcagatcagcaaactataattttttgctgtttctttgcccta

SEQ ID NO: 19596 - DNA, 5275 bp, Zea mays
atggagtatcggatgttttggtgcattgggtaggtaggtcagctatagattcctcatgtgaacaattggaagaatttaagtgaagatttccaaatgtacagctcacgaacaaattgtttgttgaggaggaaaatgttattgacttttttctgtagccagagaaggcacaaccaggcagggcagccatatcgagaaggaaataagaacagaagtggctatgatttggcaaccagatagattttgaaacagaaatatcctcaaatagtttgtgtaggagtaggtttgctgctacctgttgtgagtcggtttgttgtttcctagtttgcttagattgtgttagttatatttccattcgagtcaagagcacatgcctctatataagcgtcgtaggatgtaataggaagaacaccaaagaaatacaaatctcccagaggggcgaatccttcgacaccctagcgaagtctcacgctagagcagctgacaaagggatccaaccctctgttcggccaccgtattctctacgttctctcacacaatcatctatattgttctattcttccctgtacacacctcctagaaagaccaaaatacatcataagatgtctctcttatagcacgctagccccttcttaaatatagacctctgcaaatagactttaccctaaaggcccattagcgttctcatgaatcataattgccctttagacatatgttcaactgattcaggatcaaattcgttcataattttggattggtttgatcttcatatggtttacagtttggggttccctcgaaggagaaggctaacagatgaagacataattggaggcaagggcgaattcgcccttagtggtcgggttatacttgctgatgttattgcggctacagagagtcctgattgcctcggcagatttgtgcaatcaaggggccttcccgtgttggacagttggcttcaagaggccccaagggaagtctggtgatgggagtagtcctaaagaagcagataagcctattgatgaacttctcttggccctgcttcgtgcactagctaaattgcctattaatctcagtgcattacaaagttgtagcattgggaaatctgtcaatcatctgcgcagccataaaaatctggagattcaaaagaaagctaagtgtcttgttgagaactggaagaagcgtgttgatgctgagatgaagtcaaatgatgtgaagcctttagtttcaggtcaatctgtttcctggtcaggaaaagcaggttttcaagaaatttcaaatgttggaaccaaacgaggtggctcaagtgagaacagtccaaaaaattcagtgcccactctttcatcatcaaaagttttgactgataaacctgggggcacagatgctgcagcgaagttgaatcctggggtatctgcattgtcaaatttacaacatgtgcaatcaacacatgttactaccaacttgaaggagcagccctgcaaatcaactggtgggactggctgtcctgagctgcctactgtaaaagaggagaaaagcagcagttcaagccaatcgccgaacaacagccagtcaatatctagtgagccatcgaaggatgcaagaagttcaactgctgcttctggtggtgctagtaaaacttctggaagctcttcacggagccatcgaagggcaaacaatggtcttgtttcagggaacctgaaggaaccttctgtaggaagatctgtctcccttgatcgatcattgctgcaggataagtcatcccaaactggtacagcttctgaaaaaggaattgatatgccatctgatcatggaaataatcatagattgattgttcgctttccaaatcctggtcgtagtcctgctagaagtgcaagtgctggatcttttgatgacccatctgttactgggggtagagcttcatctcctgtggttgcagataggcatgatcagactgagcgcagggtgaaagtgaagactgaaaattctcggcctcatttagcatctgatgctaatgcagagtcctggcacagcaacgacattaaaggagctactggttcggaggaaggtgataaatcaccatgtgctatattagatgatgacaacagcaggacacctgatcattctgttaaggatgcacatgcatcgcgagctgcgtgctcgtcatatatgaatgaaaaaggtgtcagtgaaactaaggtgggaacctcattcagcccaatgaatgctcttattgaaatcaagtactctgaagctagtcattcactgcaagctggagatgacacagctatgaatcttcttgctagtgtggcaggagaaatatctaaatctgaattggcttcttcaccaagtacttctgtaaagaaattggtctgtgagggtgtcaatactggaaaggttaaagtagaaagtgacatgggcccatcacatccagggcaagcagatgctaagaaagttgccatggggaatgaagtgaaaaatgatgcttgtttggttccgaaggaggaacaacatcaaactgcgccatctcctgagctagcagattcaaaagcagttaaatcttcagcaaagattgaaatccatgaagggcatgcaaacaaatgcaactcccagcatgcttcaattgattccaaaggcgaaaatcgggatggctgtactgcccatgggaaagttgaagatggcagtacaaacaaggatggtgccatggaatctgcattcggcagccagcgtagcttggttgtttccagtaaaaattcaagattggttcttgctggggaatcttcattgtctgctgctgataaacaaacacagggtctgttaaaatcaactaatcataagcatcttctgagtgtatcggacaacccaggagcctttgatagacatgacagtatggctggaaaattagatttgatggctgcagaggtgaaaaaagctgatgtcgtgggcaatagtagtgtattgcagaatgacactgaaaagaaggaacatgtttctccctcttcggctgatgttccaaaactagtaccagcagcgtccccagttggtgtggcaaatgggaataatgagatgaaagaatcaaacggcagttcaagtgaatccaatagccatgtaaaatctgaaggtgtcaattctcagcaaagcgagcaaagtgcaaagcagcgttcaaagaaatccagtgatggtgtgtgcggaaaagaggacggaaaagaagaccatgtcttatcagacgaagaaggttcttctctagccgctcacaccaagtcaaatgctacagccaagcttgattttgacttgaatgaaggaatacctggggatgatgggcatcagtctgagacaactgcctcacctgttgtatgttcctcagcaatccatttaactgggcttttgccattcacttcgcctactacaagtgggttgccgccagctccaataacagtagctgctccagctaaaggaccctttgttcctcctgaaaacctactaagagcaaagccagagatcgggtggaaaggttcagcagctacgagtgcatttcgccctgctgaaccaaggaagattttggagatgcctgctgccacacgtgacattccagtatctcatgctgctgggaagcagtctcgtcccacgcttggtttcgatttgaatgttgcagatgaccaagctctcgaggaagattttccacagagttctgcacagactacctgttcagaatctggaaatacgagaagtcgagatggctcgtcacgaagtgctggtattgaacttgatctgaacagagctgatgaagttgcagacaatggccaatttgtaccaaatgcttcacacagagttgaagtcccattgttttcgacgagatcgttacctagagttttatctaatgctggcgcaaatagctcaagggactttgatcttaatagtggacccgacctttatgatgttggcactgaacctgcaccaaggagcctaccttctaaaaatacaagcagtattcaattcctaccacaagttcctgttaggatgaatagtgatgccatgagtaataatatatcaccatggcttgtctctaccagtccttgtggtccagtagctatacagtcttttttaccatctagagaacagccttacccattggaggcagcacctggagcccagcggattattgcgcctacagctgatggtggccaatttggaggtgatccctgcaggcctccagttatttcaacgtctccagcgatggtttttcatccgcctgcatatcagtatgcaggattctctttccctccaagtgttcaccttcaaacaccagcattttcaattggatcagcaacatttaataattctgcatctgcaggagttccatattttccaactctttcctcctctcttgttgggccagccggagcgttgccttcccaacattcaaggcagtatgccataaatcttgctgagggtagcagcagtagtgtacgtgacggtaatcggaaatgggaaagtcagggccttgatcttaactcaggccctggaagtatagatttagaaggaaaggatgaacggatgcctttaccagtcagacaaaatttgatcccacccctacatggctttgtggaggatcaaggaagaatttaccaaatgccagttgtaggaacaaagagaaaggaacctgatggcagttgggactcagaaaggtctacatacaagcagttaccatggcaatgagggctctgaaggagatcattttgcaccgactggtctgcgaatgagcatatcacctgcatgtagagcttggccggtgtgttcttcagtcactggactacactcaggggattcagccccatgacgatggcgtgggattgaggaaagcgaaaacttcctgtaattgttgtagattttttcttagctgttaggcttttggttctaatttactcaggagggtatggctgcggtggaggaatctttgtgatcctgagctctgtggccgctgtaattagaccgtccgctctgtttgttggtgataaactgttgagcacatgctggagctttacataagaatttagatgtgaccttgttccttgttggggaagcgttacgtcagctgaccatatatatacactggtgcaacgtacagctctagttgctacaccatgtatcttgggttgcagtgcagctgtatgtataagaattctagtagatgagcagctataactttttttgctctctttggcaccgaatccatctgcatctggtttactccaaaaaaaaaaaaaaaaaactcgagagtacttct

SEQ ID NO: 19597 - DNA, 4268 bp, Zea mays
tataaatctcagtgcattgcaaagttgtagcattgggaaatctgtcaatcatctgggtagccattaaaaatctgaagattcagaagaaagctaagtgtcttgttgagaactggaagaagcgtgttgatgctgagatgaagtcaaatgatgtgaaacctttagtttcaggtcaatctgtttcctggtcaggaaaagcaggtttccaagaaatttcaaatccgcgcgccgaacgaggtggttcaagtgagaacagtccaaaaaatccagtgcccactctttcatcatcaaaatttttgactgataagcctgggggcacagatgctgaagcgaagttgaaccctggggtatctgccttgtcaaattcacaacacgtgcaaccaacaaatgttactaccaatttgaaggaccagccctgcaaatcaactggtgggactggtcctgagctgcctactgtaaaagaggagaaaaccagcagttcaagccaatcaccgaataacagccagtcaatatctagtgagccatcgaaggatgcaagaagttcaactgctgcttctggtggtgctagtaaaacttctgaaagttcttcacgaagccatcgaaaggcaaacaatggtcttgtttcagggaacctgaaggaagcttctgtaggaagatctgtctcccttgatcgatcattgctgcaggataagtcatctcaaactggaacagcttctgaaaaaggacctgatatgccacttgatcatggaaataatcatagattgattgttcgctttccaaatcctggtcgtagtcctgctagaagtgcaagtgctggatcgtttgatgacccatctgtaactgggggtagagcttcatctcctatggttgtggataggcatgatcagactgagcgcaaggtgaaagggaagactgaaaatactcggcctcatttagcatctgatgctaacacagagtcttggcacagcaacgacggagctactggttcagaggaaggtgataaatcgccgtgtgctatattagacgatgacaacagcaggacacctgatgattctgttaaggatacacatgcatcacgagttgcatgctcgtcacatacgaatgaaaaaggtgtcggcgaaactaaggtgggaactccgttcagcccgatgaatgctcttattgaaatcaagtactctgaagctagtcattcacagcaagctggagatgacactgctatgaatcttcttgctagtgtggctggggaaatatctaaatctgaattggtttccccagcttcttcacccagaagttcttctgtaaagaaattggcccgtgatagtgacaacattggaaaggttaaagtagaaagtgacacgggcccatcacatccagggcaagcagatgctaagaaaggcgccatggggaaggaagtgaaaattgatgcttgtttggttgcaaaggaggaacaacgccaaactatgccatctcctgagctaccagattcaaaagcagttgtatcttcagctaagattgaaatctatgaagttgaagccaagattgcaaacaaatgcaactctcagcatgcttcaattgattccaaaggtgaaagtcaggatgcctgtacttcgcccccctccgcgccttaagttgtcaatatatctaatatttattcatctgcaggagaaagtcaggatgcctgtactgcccatgggaaagttgtagatggcagtatagacaaggatggtgccatggaatctgcattgggcagccagtgtaggttggttgttcccagaagaacttccagctgggtccagggtgtggaatcttcattgtctgctgctgataaacaagcacagggtttgttaaaatcaactaatcataagcagcttctgagtgtgtcggacaacccaggcgcctttgatagacgtgacagtatggctggcaagatggatttgttggctgcagaggtgagaaaaactgatgccgtgggcaatagtaacatagtgcagaacgaggctgaaaagaaggaacatgcttgttcctctttgcctgatgttcccaaactagttgtcgcaggaactggccacagttggggtggcgtttgtgtttgaggagatgaacgcctcccccgacagttcaagtgaatccaatagccatgtaaaatctgaaggtgtcaattctcagcaaagcgagcaaagtgcaatgcagagttcaaagaaatcctgtgatggtgtgagtggaaaagaggacgaaaaagaagaccatgtcttatcagacgaaggttcttctctagccgctcacaccaagtcaaatgctacagccaagcttgatttcgacttgaatgaaggaatacctggggacctcgggccccgcccggagccaactatctcgcctgttgtatgttcttcagcaatcaatttaactgggattttgccattcacttcgcctattacaacggggttgcagccagcttcaataacagtagctgctccagctaaaggaccctttgttcctccagaaaacctactaagagcaaagcctgagattgggtggaaaggttcagcagctacgagtgcatttcgtcctgctgaaccaaggaagattttggagattcctgctgctgcacgcgacattccagtatctcatgctgctgggaagcagtctcgtcccacgcttggttttgatttgaatgttgcagatgaccaagctctcgaggaagatatcccacagagttctgcacagactacctgttctgaatctggaaatacgagaagtcgagatggctcttcacgaagcgctggtattgaacttgatctgaacagagctgatgaagttgcagataatggccaatttgcaccaagtgcttcgcacagagttgaagtcccattgttgtcaacaagatcgttacatggagttttctctaatgctggcatgaatagcgcgagggactttgatcttaacagtggaccaggccttgatgatcttggcaccgaacctgcaccaaagagcctaccttctaaaagtacaagcagtattcaattcctaccacaagttcctgttaggatgaatagtgctgccatgagtaatatatcaccatggcttgcctctgccagcccttgtccagtagctatacaatcttttttatcaactagagaacagccatacccaattgaggcagcacctggagctcaaaggatcattgcgcctacagctgatgctggccagtttggaggtgatccctgcaggcctccagttgtttcaacgtctccagcgatggtttttcatcagcctgcatatcagtatccaggattcccttttcctcccagtgttcaccttcaaacaccggcattttcaattggatcagcaacatttaataattctgcatctgcaggagttccatattttccaactgtctccccctcttttgttgggccagcaggagcgttaactccccaacatttaaggcagtatgctataaaccttgctgagggcagcagcagcagtggacgagacagtaatcgtaaatgggaaagtcagggccttgatcttaactcaggccctggaagtatagatttagaaggaaaggatgaacgggtgcctttaccggtcagacaaaatttgatcccacccccacacggctttgtggaggatcaaggaagaatctaccagatgccagttgtaggaacaaagagaaaggaacctgatggcagctgggactcagaaaggtctacatacaagcaattatcatggcaatgatggctctgaagatcgttctgcactggactggtacccgccgagcatgtatgtagttggttcaaattgaactttttgaggtctgttcgatttcatactaccagttgctaatcttgtgaaatttgtggaattgtgcctttattgacaggtacctgcatgtagaacgggggcggtgtgttcttcagtcgctgcaatattactcgattcagcccatgacgttgatgtgggatccaggaaacgaaaacttgctgtaattgttgtagattttttccctagctgttaggcttttgattctaatttactcaggagggggtatggctgcggaggaggaatctttgtgatcctgagctctggggctactgtaattagacggtccgctctgtttgtcggtgatatactgtttatcacatgctgcagctttacatttcataagaagatacatgtgaccatgatctgtagtagatcaagggtcagctagctgcctatatgactggtggtacaaagatcaatgtcattcgacacttcatgtctcttta

SEQ ID NO: 19598 - DNA, 4046 bp, Zea mays
gtttccaagaaatttcaaatgctggtaccaaacgaggtggttcaagtgagaacagtccaaaaaatccagtgcccactctttcatcatcaaaaattttgactgataagcctgggggcacagatgctgaagcgaagttgaaccctggggtatctgccttgtcaaattcacaacacgtgcaaccgacaaatgttactaccaatttgaaggatcagccctgcaaatcaactggtggaactggtcctgagctgcctactgtaaaagaggagaaaagcagcagttcaagccaatcaccgaacaacagccagtcaatatctagtgagccatcgaaggatgcaagaagttcaactgctgcttctggtggtgctagcaaaacttctgaaagttcttcacgaagccatcgaaaggcaaacaatggtcttgtttcagggaacctgaaggaagcttctgtaggaagatctgtctcccttgatcgatcattgctacaggacaagtcatctcaaactggaacagcttctgaaaaaggagttgatatgccacctgatcatggaaataatcatagattgattgttcgctttccaaatcctggtcgtagtcctgctaatagtgcaagtgctggatcttttgatggcccatctgtaactggggatagagcttcatctcctgtggttacagataggcatgatcagactgagcgctgggtgaaagggaagactgaaaattctcggcctcatttagcatctgatgctaacacagagtcttggcacagcaacgacggagctgctggttcagaggaaggtgataaatcgccgtgtgctatattagatgatgacaacagcaggacacccgacgattctgttaaggatgcacatgcatcacgagttgcatgctcgtcacatatgaatgaaaaagatgtcagtgaaactaaggtgggaactctgttcagcccaatgaatgctcttattgaaatcaagtactctgaagctagtcattcacggcaagctggagatgacgcagctatgaatcttcttgctagtgtggcaggggaaatatctaaatctgaattggtttccccagtttcttcacccagaagttcttctgcaaagaaattggcccgtgagagtgacaacattggaaaggttaaagtagaaagtgacatgggcccatcacatccagggcaagcagatgctaagaaaggtgccatggggaaggaagtaaaaaatgatgcttgtttggtttcaatggatgaacaacgccaaactacgccatctcctgagctaccatattcaaaagcagttgtatcttcagctaagattgaaacccatgaagttgaagccaagattgcaaacaaatgcaactctcagcatgcttcaattgattccaaaggtgaacatgatcaaaacttcaatttgcgccactcagctaatactaaagttgtcaatatgtctaatatgtattcatctgcaggtgaaagtcaggatgcctgtactgcccatgggaatgttgaagatggcagtacagacaaggatggtgccatggaatctgcattgggcagccagtgtagcttggttgtttccagtagaaattcaagattggttcatgctggggaatctgcattgtctgctgctgacaaacaggcacagggtttgttaaaatcaactaatcataagcagcttctgagtgtatcggacaacccaggagcctttgatagacgtgacagtatggctggcaaattagatttgatggctgcagaggtgagaaaaactgatgtcctgggcaatagtagcatagtgcagaacgaggctgaaaagaaggaacatgcttcttcctttttgcctgatgttcccaaactagttgtagcagcagcatctccagttggtgtggcaaatgtgaataaggagattaaagaatcaaaagacagttcaagtgaatccaatagccatgtaaaatctgaaggtgtcaattctcatcaaagcgagcaaagtgcaaagcagagttcaaagaaatccagtgatggtgtgagtggaaaagaggacgaaaaagaagaccatgtcttatcagacgaaggttcttctctagccgctaacaccaagtcaaatgctacagccaagcttgatttcgacttgaatgaaggaatacctggagatgatgggcatcagtctgagccaactatctcgcctgttgtatgttcttcagcaatccatttaactgggattttgccattcacttcgcctattacaactgggttgcagccagcttcagttacagtagctgcaccagctaaaggaccctttgttcctccagaaaacctgctaagagcaaagccggagattgggtggaaaggttcagcagctacaagtgcatttcgtcctgccgaaccaaggaagattttggagatgcctgttgctgcacgcgacatttcagtttctcatgctgctggtaagcagtctcgtcccacgcttggttttgatttgaatgttgccgatgatcaagctcttgaggaagatatcccacagagttctgcacaaactacctgttctgaatctggaaatacgagaagtcgagatggctcttcacgaagcgctggtattgaatttgatctgaacagagctgatgaagttgcagataatggccaatttgtgccaagtgcttcgcacagagttgaagtgccattgttgtcaacaagatcgttacatggagttttctctaatgctggcctgaatagctcgagggactttgatcttaatagtggaccaggtcttgatgatgttggcactgaagctgcaccaaagagcctaccttctaaaaatacaagcagtattcaattcctaccacaagttcctgttaggatgaatagtgctgccatgagtaatatatcaccatggcttgcctctgccagcccttgtggtccagtagctatacaatcttttttaccaactagagaacagccatacccaattgaggcagcagctggggcccaaaggatcattgcgcctacagctgatgctggccaattcggaggtgatccctgcaggcctccagttgtttcaacgtctccagcgatggtttatcatccgcctgcatatcagtatccaggattcccttttcctcccagtgttcaccttcaaacaccggcattttcaattggatcagcaacatttaataattctgcatctccaggagttccatactttccaactgtctccccttcttttgttgggccagctggagcgttaactccccaacatttaaggcagtttgctataaaccttgctgagggtagcagcagcagtggacgagacagtaatcgtaaatgggaaagtcagggccttgatcttaactcaggccctggaagtatagatttagaaggaaaggatgaacgggtgcctttaccggtcagacaaaatttgatcccacccccacacggctttgtggaggatcaaggaagaatctaccagatgccagttgtaggaacaaagagaaaggaacctgatggcagctgggactcagaaaggtctacatacaagcaattatcatggcaatgatggctctgaagatcgttctgcactggactggtacctgcatgtagaacttgggcggtgtgttcttcagtcactgcaatattactcgattcagcccatgacgttgatgtgggatccaggaaacgaaaacttgctgtaattgttgtagattttttccctagctgttaggcttttgattctaatttactcaggagggggtatggctgcggaggaggaatctttgtgattctgagctctggggctattgtaattagaccgtccgctctgtgtttgttggtgatatactattgatcacatgctgcagctttacattacataagaatttagatgtgaccttgttccttgctggggaagcgttacgtcagctgaccatatgaacactggtgcaacgaacagctcgagttgctacgccatgtatctttggattgcagtgcagctgtatgtataagaattctagcagatcagcaagctatatttttttgctgttttttttttgtcgaaaaaccc

SEQ ID NO: 19599 - DNA, 1575 bp, Zea mays
gattattgtgaagacttctatattaatccaacgcactctatccttttgatcagaagaagatgctttcatcggacttcacaaagacaacaaaattccgcactcaatgtttgcttaaaacggcgatgtggttatctgctaacacatcgatgttgtgatgaaacaatggctcaccccgttaattgggcaatcaaacaatatattactaatacaacataaatggtctcaatgtacccatcatgggtgtaacaagcacactacatgctcagcttctgagcaaaggtttcagcaacggcgtcgtgaggttccgtctttccatcttgttctactctaagtacatcttggttttgactgctgggtgcttcctgccagataactcgtgcaattcatatgtgaactccatatccataagccgatggttttccttcgagcgaaccatcgagaaggaaacgttaacgttgtctcctttagtcacactcagaggtggagtcagcaagaatacctgctgaccccaatgagttccaccatgctcatctggcgctgtagttaattcaacttcctccaccccagggttttgagcactacctcgaaaatgaacatcaaaccatccagccagtgctgataatctagcttccattctgattggcaatgtgacttgtgctctgacttctcggatctcatcgacagtggctgtcaagcaatcaatttccttgatagctgcaggttgaccgataacttggtttggatgaagattgttccatattgaagacttcaaatagtatttttcatgttctgcacgatatgcctttgtcaaagcattcatgttgacaccataataagtttgagtgtcctgaacaaacaggctccagtcatccatagcaatatcaaaatcttccctcttcttgtcacccaaaccagttcttatgggtgctagccacatccgagcatggctaggatacatcacaccatctggcttcaaccagcggtcacgtgcgcaaatgacggaatcaaacatggactctctcaaaagaaagtagcccatccactctgatataatgacatcaactttctccggaaggtcaacgtcttccacggtgccctgtatcacctcaacgatatccgtgacgccgttggcgcgagcaagctcgcgcgcgtgctccgccatgttagtcgcctcgacggcgtacaccttcctggccccggcctgcgcgctccagatagcaaggatgccgctcccggtgcccacgtcaaggaccaccttgccctggaagtggggcgcgttgcggaagacggcggagtggtacgcgtccatgcggacgcggtcgcagagcatctccttctggtggtaaaggtaggcgtacgtgcagaagtagttggcgaagtccacctccttgtccacagggcgcgcgccgcatgagccagaggcggcggcgccgccaccgttagggagagacgccattgggtggaggcgggagcgaggcggggagattgcggagagggttctggtgtgagcaagtgtttttttccccgcacgggcccgcggccgccagggtttatggagttgtgcgttttaaaggg

SEQ ID NO: 19600 - DNA, 639 bp, Zea mays
agaacacacacacacaatggttggtatggctgtggttggtcaatggactctctgtgtcgcctcgccgtcgccgagagtaaagtcggcaacttgcaattcaaactcttgtccaaccaccgttaacttacgctctgagctgtctgcatttcgtcctcagttccggctcttctctcgtgtttctccgacacgccgccgccgtctttgcgcttccagctccgccgattcgggaatcttcctccctcaccttgtcgcttctatggagcaagttgaggagacttacattatggtcaaaccagacggcatccaacgaggccttgttggagaaatcatctctcgttttgagaagaaggggtttaaactgattggacttaagatgttccaatgcccaaaagaattggctcaggaacattataaggatcttagtgctaagtctttctttcctagcctgattgagtacatcacttctggcccagttgtgtgtatggcttgggaaggtgttggtgtggttgcttcagtcaggaagctgatagggaaaactgatcctcttcaagctgaacctggtaccattagaggagatcttgctgaacaacccggaagaacttgtgcatggtagtgaaagccctgaaacgaaagcgtgaa

SEQ ID NO: 19601 - DNA, 2305 bp, Zea mays
  misc_feature (1243)..(1265): n is a, c, g, or t
  misc_feature (1373)..(1377): n is a, c, g, or t
gcaaagcttccaggttgggctctcttggtcatctggtttgggaaggggctccaataagcaggctccaaacttcaatggcttggctgctttatcaagcaatctaaatccttcgagccgtgctgctgcccttttttttttttttttttttttcaacaaaatcactaaactgaatcaggtttcaaacaagcaaatacatgcagtctcaaatgcgacctttcaatacataggttcagaacatttgcggcagggctaaaaacataggcccacaggaagacaaagtaatgtagtgaggaatataaggtggtctatggcatccacacgggtcctcttaagcaaagcttccaggttgggctctcttggtcatctggtttgggaagggactccaataagcaggctccaaacttcaatgtcttggctgtttttatagtacgtgaggggagcaggggtggcaaaggtgaaaataacaggtccatcagatagctgctttatcaagcaatctaaatcctaataaccatgacgctttccatagtgaagagaactatgaccagataacccactattagaggagcgagcactgtacccgctgtaagccccatatcctcttccaggtgcctgggagccgccataacttgcatagctgtcagaaggaatcgtgtcatccgatgtacgaaaaccacttgaatatagatagtgcccaacaggcttggtgtctctgcctagatattttggttcatccgaaacaccagcaggcaaaggatggtaagggataacaggtggaaatgcagataaagagccctctctttcaaagaaattggctttcagccttgtagctatttgcacaagagcatttcttgcaacatcaaggcctccagtgatctgaaccatctcatcatcttctgctgctacctttggaacattttcttttgaaagaatacgtacattggctctggatgttctccgtatctcagtaatgattgagccacctttgccaattaggcacccaatacgtgatgttgacaccagcaagcgtgtagtatatgactgctcagccaattctaaatcacttttctcgctgcatctaggctgcaaacgaactgcagcatcaattgttggagatacaggatcttcaaagaactctttcgcagaaactgtaattatgcagtcatcatcagggtctgaattggagctagccactttgattaaagccccagactcctgcctaatctgtttgataattccaccnnnnnnnnnnnnnnnnnnnnnnncatttgcagcagcacaaagtaaacgcaagctaaactcctttgcagagctctcatcccttcgtggttggtataaagagggccaatctcctgctacatcacctttgtagnnnnnataaggaggaattactggagtgatccctacaacaggtgcagtagaggaaccaccaaggtggggtgctccctggataaggttgggtcaagctggatgcaagaagatgctgtgacttggatgggttgttatggaggcgagatgacacttgatgaagagcctttctgacaactaccgtgtccccagatatctggagaagttcgtctccactaatggcacatgcggggatatgatcattactaaggacacgtatttgtgcaccagtctcactgcggattccttggatgatctgcccaccttttccaataatgcatccaatctggtctgatggcacaagcaagcgaacagtaacttgaggtgaaatttcttcgctgtcttcgttcccaagaccctcatcactggcaagcctctcatgaactctaaagagggcatcctgagcagggcaaacctcatcttcagcaccatcgatggtattagttttcctgcttgtgctaaatatggtaacaactcgctcatcacatccagggacactctcgccaatcctgatcttagcttgggtctcagtcctcaactgctttgcaatttctccacccctgccaatgatactcccaatttttctagaggcacagaggtagcgatacacagtgtcatcaggaccaggtgcatatgtatcatcgccaggatttcttctcttactgcctccattttcagtaaaatcagactggcgctttccatgactgtttcggtggccagccattatctcggcggtctggggcagcgtcgcgagagagacgatgcggcccttgcggcggaacgatagatgccgccgtaaccaggagcttgcgaaatcgaggaggacagccgggcagggggaggctagggacaccgatcgacgaagagcgcggccgggccggcccggaggcccggcccg

SEQ ID NO: 19602 - DNA, 2105 bp, Zea mays
tttttttttttttttttttgtttcaacaaaatcactaaactgaatcaggtttcaaacaagcaaatacatgcagtctcaaatgcgacctttcaatacataggttcagaacatttgcggcagggctaaaaacataggcccagaggaagacaaagtaatgtagtgaggaatataaggtggtctatggcatccacacgggtcctcttaagcaaagcttccaggttgggctctcttggtcatctggtttgggaaggggctccaataagcaggctccaaacttcaatgtcttggctgctttatcaagcaatctaaatcctaataaccatgacgctttccatagtgaagagaactatgaccagataacccactattagaggagcgagcactgtacccgctgtaagccccatatcctcttccaggtgcctgggagccgccataacttgcatagctgtcagaaggaatcgtgtcatccgatgtacgaaaaccacttgaatatagatagtgcccaacaggcttggtgtctctgcctagatattttggttcatccgaaacaccagcaggcaaaggatggtaagggataacaggtggaaatgcagataaagagccctctctttcaaagaaattggctttcagccttgtagctatttgcacaagagcatttcttgcaacatcaaggcctccagtgatctgaaccatctcatcatcttctgctgctacctttggaacattttcttttgaaagaatgcgtacatttgctctggatgttctccgtatctcagtaatgattgaaccacctttgccaattaggcacccaatacgtgatgttgacaccagcaagcgtgttgtgtatgactgctcagctgattctaaatcacttttctcgctgcatctaggctgcaaacgaactgcagcatcaattgttggagatacaggatcttcaaagaactctttcgcagaaactgtaattatgcagtcatcatcagggtctgaattggagctagccactttgattaaagccccagactcctgcctaatctgtttgataattccaccacccttcccaattacaccccccacatttgcagcagcacaaagtaaacgcaagctaaactcctttgcagagctctcatcccttcgtggttggtataaagagggccaatctcctgctacatcacctttgtagcctccataaggaggaattactggagtgatccctacaacaggtgcagtagaggaaccaccaaggtgggtgctccctggataaggttgggtcaagctggatgcaagaagatgctgtgacttggatgggttgttatggaggcgagatgacacttgatgaagagcctttctgacaactaccgtgtccccagatatctggagaagttcgtctccactaatggcacatgcggggatatgatcattactaaggacacgtatttgtgcaccagtctcactgcggattccttggatgatctgcccaccttttccaataatgcatccaatctggtctgatggcacaagcaagcgaacagtaacttgaggtgaaatttcttcgctgtcttcgttcccaagaccctcatcactggcaagcctctcatgaactctaaagagggcatcctgagcagggcaaacctcatcttcagcaccatcgatggtattagttttcctgcttgtgctaaatatggtaataactcgctcatcacatccagggacactctcgccaatcctgatcttagcttgggtctcagtcctcaactgctttgcaatttctccacccctgccaatgatactcccaatttttctagaggcacagaggtagcgatacacagtgtcatcaggaccaggtgcatatgtatcatcgccaggatttcttctcttaccgcctccattttcagtaaaatcagactggcgctttccatgactgtttcggtggccagccattatctcggcggtctggggcagcgtcgcgagagagacgatgcggcggaacgatagatgccgccgtaaccaggagcttgcgaaatcgaggagaaggacagccgggcagggggaggctagggacaccgatcgacgaagagcggccccggccgggctggaccctcccaatg

SEQ ID NO: 19603 - DNA, 2176 bp, Zea mays
cgcgtaacatattcctgccctctcgcgtggctctcttggttttttcaataacaaaaaaacgactaaactgaagcaggttccaaacaagcaaatacatgcagtctcaaatgcgacctttcgatacataggttcagaacatttgcggcagggctaaaaacataggcccagaagaagacataagtaatgtagtgtgaggaatatcaggtggtctatggcatccacacagtcctcctaagcttccaggttgggctctcttggtcatctggtttgggaaggggctccaataagcaggctccaaacttcaatgtcttggctgctttatcaagcaatctaaatcctaataaccatgatgctttccatagtgaagagaactatgaccagataacccactactagaggagcgggcactgtatccgctgtaagccgcatatcctcctccaggtgcctgggagccaccataacttgcatagctgtcagaaggaatcatgtcatccgatgtacgaaaagcacttgaatataggtaatgtccaacaggcttagtgtctctgcttagatattttggttcatccgaaaccgaaacaccagcaggcaaaggatggtaagggatcacagatggaaatgcagataacgagccctctctttcaaaaaaattggctttcagccttgtagctatttgcacaagagcatgccttgcaacatcaaggcctccacttatctgaaccatctcttcatcttctgctgctacctttgggacattttcttttgaaagaatgcgtatattggctctggatgttcttcgtatctcagtaatgattgagccacctttgccaattaggcacccaatacgtgatgttgacaccagcaagcgtgtagtatatgactgctcagccaattctgaatcacttttctcgctgcatctaagctgcaaacgaactgcagcatcaatcgttggagatacaggatcttcaaagaactctttcgcagaaactgtaattatgcagtcatcgtcaggatccgaattggagctagccactttaattaaagccccagattcctgcctaatctgtttgataattccaccacccttcccaattacaccccccacatttgcagcagcacaaagtaaacgcaagctaaactcctttgcagagctctcatcccgtcggggttggtataaagagggccaatctcctgccacatcacctttgtagcctccataaggaggaattactggagtgatccctacaacaggtgcagcagaggaaccaccaaggtgggtaccccctggatacggttgggtcaagctggatgcaagaagatgctgtgacttggatgggttgttatggaggcgagatgacacttgacaaagagcctttttgacaactaccatgtccccagatatctggagaagttcatcgccactaatggcacatgcagggatatgatccttactaagcacgcgtatttgcgcaccagtctcactgcggattccttggatgatgtgcccaccttttccaagaatgcatccaatctggtctgatggcacaagcaggcgaacagtaacttgaggtgaaatttcttcgctgtcttcgttaccaaaactctcatcagtggcaagcctctcatgaactctaaagagggcatcctgagcagggcaaaccttatcttcagcatcatcgatggtattagttcttcgacttgagctaaatatggtaataactcgctcttcacatccagggacactctcaccaatcctgatcttagcttgggtctcagtcctcaactgctttgcaatttctccacccctgccaatgatactcccaatttttctagaggcgcagaggtagcgatacacagtgtcatcaggaccaggggcataggtatcatcaccaggatttcttctcttaccgcctccagtttcagtataatcagagtagcgctttccatgactgtttcggtgcccactcattatcttagcgccgccggactcggcgaaccctaggcgcgatggacctggggcagcgtcttgagaaagacgatgcggcagaagggtggatgccgccgtacggccgtaggcaggaccgcaggagcttgcgatggaccgaggagaagggcagtgggactgtgggagggcggagggagtaaagggagggacacctaccgacccgggccgaga

SEQ ID NO: 19604 - DNA, 931 bp, Zea mays
gttgggtcaagctggatgcaagaagatgctgtgactgggatgggttgttatggaggcgagatgacacttgacaaaagagcctttttgacaactaccatgtcccccagatatctggagaagttcatcgccactaatggcacatgcagggatatgatccttactaagcacgcgtatttgcgcaccagtctcactgcggattccttggatgatgtgcccaccttttccaagaatgcatccaatctggtctgatggcacaagcaggcgaacagtaacttgaggtgaaatttcttcgctgtcttcgttaccaaaactctcatcagtggcaagcctctcatgaactctaaagagggcatcctgagcagggcaaaccttatcttcagcatcatcgatggtattagtttttcgacttgagctaaatatggtaataactcgctcttcacatccagggacactctcaccaatcctgatcttagcttgggtctcagtcctcaactgctttgcaatttctccacccctgccaatgatactcccaatttttctagaggcacagaggtagcgatacacagtgtcatcaggaccaggggcataggtatcatcaccaggatttcttctcttaccgcctccagtttcagtataatcagagtagcgctttccatgactgtttcggtgcccactcattatcttagcgccgccggactcggcgaaccctaggcgcgatggacctggggcagcgtcttgagaaagacgatgcggcagaagggtggatgccgccgtaggcaggaccgcagaagcttgcgatggaccgaggagaagggcagtgggactgtgggagcctgggagggcggagggagtaaagggagggacacctaccgacaagaggccgagccgccgagggtggcaacacttttgtcgccaccattcacgaactctc

SEQ ID NO: 19605 - DNA, 646 bp, Zea mays
aaaacaaaaataagtacgtaaataaataaaatcagaacgatatatctacgtctctccctctcgccagatttcaatcatcgactcgatttcagatccgagataaaaacttcgaacatgtctacgttcagcggcgacgaaacagctcccttcttcggtttcctcggcgccgcagccgcactcgtcttctcctgtatgggagctgcttatggaacggcaaagagtggtgttggtgtggcttccatgggagtgatgagacccgagcttgtgatgaaatccattgtccctgttgttatggctggtgtgttgggtatttacggtttgattattgctgttatcatcagtaccgggattaaccccaaggctaagtcttactacctcttcgacggatacgcccatctctcctccggtcttgcgtgtggtcttgctggtctttccgctggaatggccattggtattgtcggagatgctggtgtcagggcaaatgctcagcagcctaagctctttgtcgggatgattcttatccttatcttcgcagaagcgcttgctcttttacggccttattgtaggaatcatcctctcctctagagctggccagtctagagctgaatgagaaagtaccccaaaggtacttcttttactttctggg

SEQ ID NO: 19606 - DNA, 693 bp, Zea mays
agtgtttcatcagacgttcttagtaacatgcgggtgctaatgacagaggattctaacagtgatgaaagcggttcgttcttgttagatgataattcgagcatcccgttctccgtggatgatatcaccaactcaatgcaggagaaggacttcacggatatcaaaccggctgatgagctactcgagaaccctgccttccagtttttacaggattagcgctagtgaagtcctcgagcattttatgctgctagatatcttgtcagatcatttattgatttgttgtatattttttggatcctttctaccacatgtgcctttttttagttatcttatccttttcagctagcttttgtaaaaattcatataggtatttgttagggttgggatgggattccgcccttacagttagaaaaggccttatcttttaaagcggggcaaatgattctttgtagggcaacatgaaatcaatctttttacccaagggtgtggtgagaaggggtagatgcaatgtttgtagcctctcccagttatagattgtgtaaattatatactgtaaatcaacagtgcaatggaaaagaaaggaaagctatatagcaagtgcagttatgttgtcaaaaaaaaaaaaaaaaaaaaaaaaaaaaaaaaaaaaaaaaaaaaaaaaagagggagaaaaaaaacatggtcttataatgtcaa

SEQ ID NO: 19607 - DNA, 2248 bp, Zea mays
ccatgatatatgcaatcttatttcttgtcgtagttctatttgatgggttgaaaagtataaaacttcaaattttctagctgtatggaattgctatatgctgaaactcactgctcaacagtcaacagtagagatgtgatttcttttttgttaaaaagtagtagcgctggctgcctatgctggattttttttacacggaatggggaaataaaagtaactgggccatctattgtttcaggttcttagtaacatgcgggtgctaatgacagaggattctaacagtgatgaaagcggttcgttcttgttagatgataattcgaggtaacattaagtaaagttttattaaactgtgggattgttatattgctttgatgattatggtcaagatgacaatctcggtctttatgcagcatcccgttctccgtggatgatatcaccaactcaatgcaggagaaggacttcacggatatcaaaccggctgatgagctactcgagaaccctgccttccagtttttacaggattagcgctagtgaagtcctcgagcattttatgctgctagatatcttgtcagatcatttattgatttgttgtatattttttggatcctttctaccacatgtgcctttttttagttatcttatccttttgagctagcttttgtaaaaattcatataggtatttgttagggttgggatgggattccgcccttacagttagaaaaggccttatcttttaaagcggggcaaatgattctttgtagggcaacatgaaatcaatctttttacccaagggtgtggtgagaaggggtagatgcaatgtttgtagcctccccagttatagattgtgtaaattatatactgtaaatcaacagtgcaatggaaaagaaaggaaagctatatagcaagtgcagttatgttgtcatccaagaaaaaaaaaaaaaaaaaaaaaaaaaaaaagtcttttgtcttgtgctgaacaattcgatcttagggtttatgtaatcatgtgtagcttttgttcatgcaatgacgcaacagaggcaatcctcgatgatcagagaggcagagaccacgatggtgacttcctggctgcttctaggcacggacaccataggaccactgatctagaacttgcagaggcaaccgctctcggattacctgttcgtttcgtctcaaaaattgaatttaaggctgtctctagcatcgtcgtaatgcaaaacattgttctatactgtaggtaacattatttatagagtagaatttaaaatagaaggtgagataagataatgagatagaaggctgttggatatagcctaacaaggtgataattgcatctgattgtttttctttgatgcaaaagctccaatcaaatagaaggaaccgctctctggtggcttccaccatccgtagcatcaagcaagtgaagaattaatgtatcgttttcgactttattcatgtcagtagtattatagatgtgttgatataggatagggtttgttgatgcaaggattttgttggttttagtaattgaatagtaacttaggtaaactaatatgtgtttaggttgggatgaatagacgattaaggttttgtggaagcactcgcgtaactgctcaaggctgtggcggtggaggaagatgctcacgtatgttgcagcggcggtggaagcttttgagagttggtttgcgaaaccctaatagctacaagcggttttcattataacccacgaaggaatgtgaagtgtcacgcgaatctaaagctagaagttggggctgaaagctgaagcgatatgcaaaatctaaaataccagtccaatgggttttatcgaattgtgaacattagaaggccgagtcatagactcagggactacattccgataaaggtaactcggttaccatggaggacaacttggagcatctactcctaagtattaacaagcgagaatcgatgatcatagtacgacttgatggctactattaaggatatataatattggcggtagctcagacgttccaacaaagaagacgttaaacatacaaacttggactcggtcgagggacttggacaccaggagtagtaattgcagcatgtaagggaagactaagatttatgataagcgtgatatctttttaaaagtagcatatccctatttacaaggaaattcacatgcaaagatagagataagtctccttgcttttaggtggggatcggctagactgatctccatccttcttatctagctaatagctgg

SEQ ID NO: 19608 - DNA, 4584 bp, Zea mays
  misc_feature (4396)..(4396): n is a, c, g, or t
acggaaagcaccaagatgatcatgcgatatcttgcttacatgggtgggaaggctgcttccgaagggcgaactgtggagaagcaagtccttcagtccaatcctgttcttgaagcatttggaaatgcaaagactgtcaggaacaataactcaagtcgtttcggtaaatttgttgagatccagtttgatcagaaagggaaaatatcaggagctgctgtaagaacttatcttcttgagagatcccgtgtctgtcaaatatctgacccagaaagaaattaccattgtttctacatgatatgtgctgcccctcctgaggagcgtgagagatacaaactcggagatcccagcacatttcactaccttaatcagtccaactgcattaagcttgaaggcctcgatgaatctaaagagtaccttgaaaccaggaaggctatggacattatcggaattagttctgaagagcaggaagcaatctttcgggttgttgcggctattctccacttggggaatgtcgagtttgcagaaggggatgatggtgattcatcaaaacccaaagatgaaaaatctctttctcatttgagaacagctgctgagctcttgatgtgtgatgagaaagctttaaaagattcattgtgtcagcgcattattgtgactcgcgatgagaatatagtgaaaactttggatcctgaagctgctaagggaagtagagatgcacttgccaagactgtgtactcacggttgtttgattggcttgtgaataaaatcaacaactctattggccaagaccccaactcgaaatgcttaattggagtgctggatatatatgggtttgaaagcttcaagacaaacagttttgagcagttttgtatcaacctgacaaacgaaaagctccagcaacacttcaatcagcatgtgtttaagatggaacaagaagagtacaccaaagaagaaattaattggagttacattgagttcattgataaccaggatgttcttgatctcattgagaagaaacctggtggaattattgcccttctggatgaagcttgtatgttgccgagatcgacacatgaaacatttgctcagaaattgtatcaaacttacaaaaatcacaagcgctttgctaagccaaaattatctcggtcagacttcaccatatgccattacgctggagatgtcacctatcaaacggaattatttctggacaagaacaaagattatgttgttgctgagcatcaggctttgttgagtgcttcaaaatgtgcatttgtttcaggccttttcccttttctatctgaggattcctcaaaatcttcaaagttttcatccattggttctaggttcaagcaacaattccaatctctgttggaaactctgagtgcaactgagccacactacatccgctgtgtaaaacccaataatttgttgaagcctgcaatttttgagaaccagaacgttcttcagcaactcagatgtggaggagttatggaggcgattaggatcagttgtgctggatatccgaccagaagaacattctatgaatttatagaccgttttggtattcttgcgcctgatgttttgagtggaagttctgatgaggtcagtgctgtaaggaggttgttggacaagatagatcttcaaggttaccagattggcaagacaaaagtattccttcgtgctggtcagatggctgaacttgatgctcgtagaaatgaagtgctagggcgttcagctagcatgattcagaggaaagtgcgttcattcttggcacagaagaatttcattgcattgcgaagatcagctttacaaatccagacagtttgtcgcggtgaacttgcaagaagagtttatcacaacctccagagagaagctgcttcactcaagatccagactttgtaccgtatgtatactgccagaaaagcgtacaacgaactttctgcttcagcagttaccattcaatcaggattgcgcggcatgtgcgcgcgtaaagagctccacttcagaagacaaacaagagctgcaatcatcatccagagtcgctgccgtcaattcttggcgagattgcattattcaagaacaaagaaagctgcaattactacacagtgtgcgtggagagggaaggctgctagaaaggagctccgcaagctcaaaatggctgcccgggaaactggtgcattgcaagctgccaaaaataaacttgagaaacaagttgaggagctcacgtggcggctacagttggagaagcgcatgcgagctgatctcgaggaaactaaatcacaagaaaatgcaaagttgcaagctgcattgcaggaggtgcaacaacagtacaaagaaacaaaagaaatactagtacaggagagggaagcagccaaaaaggctgcagagatagctccagttattaaagaggtccctgttatagatacagagctaatgaataagcttagagatgaaaatgacaaactgaagactatggtcagttcgcttgaaaagaagatcgatgatactgaaaagaaatatcaagaaacaagcaaaatcagtgaggataggctcaaacaggcaatggatgctgagactaaaatcgttgacttgaacatggcaatgctaaggcttcaagagaaaatatccaccatggaatctgaggagaaagtgcaaagacaagcgcttctaagcacgccagtcaagagcatgtctgaacatttgtcaattccaattgctccaaaggcacatcatttggagaacggctttcatgaggttgaaggacttaaggaaccccaaagtgcacctcctgctattaaggaatatgggaacggtgatcctaagatgaaaaaatctattgttgacagacaacttgaaaacgtggatgcactcattgagtgtgtagggacaaaccttggatactgtgcagggaagccagttgctgctattaccatatacaaatgtcttcttcattggaaatcattcgaggcagataagactagtgtttttgaccgtctcattcagttaataggatctgctatcgagaacgaggatgacaatgacaaccttgcttactggctctccaatacatctagcttattgttcctactgcagagaagtctcaaggctgctggtgctcctggtagcgtttcacgaaagaaacctcctcaaccaacatcattatttggaagaatggcccaaggcttgcgttctgcatcttttgccaacatgcatgttgaagcgacagatgttgtgcgccaagttgaggccaaatatcctgccttgcttttcaagcagcagctaactgcttatgtggagaagatatatggaatcgtccgagacaatattaaaaaggaattatcatctttgatttcgctatgtatccaggctccaagaacaatgaaagctagcatgctgcgagtttctggacgattatccagtcaatctcagagtcagagcaaccactggcagaaaatcattgagagcttggataagctcttgaagatactgcaagataaccatgtgcctccggttttagctcagaaaatatttacccagatattttcatacattaatgtccagctattcaacagtctattgcttcgtcgtgagtgttgctccttcagcaacggagagtatgttaaggctggtctagctgagttggagctgtggtgtgcaaaggcaacaactgagtatgcagcatcttcatgggatgagctcaagcatatcaggcaggctgttggatttttggttatattccagaagttcagaatatcttatgatgagatagtcaatgacctatgtccgatcttgagtgttcaacaactgtacagaatatgtacacaatactgggatgacaagtataatacccaaagtgtttcatcagacgttcttagtaacatgcgggtgctaatgacagaggattctaacagtgatgaaagcggttcgttcttgttagatgataattcgagcatcccgttctccgtggatgatatcttgtcagatcatttattgatttgttgtatattttttggatcctttctaccacatgtgcctttttttagttatcttatccttttcagctagcttttgtaaaaattcatataggtatttgttagggttgggatgggattccgcccttacagttagaaaaggccttatcttttaaagcggggcaaatgattctttgtagggcaacatgaaatcaatctttttacccaagggtgtggtgagaaggggtagatgcaatgtttgtagcctccccagttatagattgtgtaaattatatactgtaaatcaacagtgcaatggaaaagaaaggaaagctatatagcaagtgcagttatgttgtcaaaaaaaaaaaaaaaaaaaaaaaaaaaaaaaaaaaaaaaaaaaaggacaatataaaaaaaaaaaaaataanagaacgcgtacatgaaaaaaaaaaaaataatattttgggggggcctccataaaattcactgttcgtggcttttcaacgcagggccttggggaaccctttggttccccaacttaatataaatggcccgcgttcccccttttttagccgtggggaaaacccgagggttccccatctgattgcccttccca

SEQ ID NO: 19609 - DNA, 4865 bp, Zea mays
ctgcagcagttttttactggatgtgtagctgtatgttcgtagcgttttgtttagcgcacgccactgcggacagcctaaaagctactgcaatgaactagaacagctacgacaagcaaagatcacattacatgtccatatccatatccatagatagaggtccataggtagcaattaagtaaacattacagaccctctagatagtttgaaatttgaatatgttgctttttgcctctaaacattcaagtttcattattcaaatttgaggtccataattaaataggttggtttttgcttctggtcaatgttttgaaatttgaatggccatgtacgtttccttttatatgctatatgtttgtttgcacttatcaaacatcgaaaatggacatctagatattcgggtcacaaagccttaacaataatccacctgcatgatatgttttgattgtgcgatgttaagaaaagattgttggatagatgagcgatgccaatggccgggacctgctgcaccaaacagagccagcggcccgccttcctcctcgcgcctccgaaacagaacagcaacgacgtccagccaggggaggggccatggggccgcagtatatatacctgcgccttgtaccaccccccaccgtcgccccgtgcgcgcgtccctcgctcctgcgccgcccgtccgatccggtcactggccggggagggctcagaaacctttcatccaatacatacatctatctgagccctttcccgcggtgaggcccgaccggagtccacacacacacggtgtcgatggcggccgtaataaggagccgccgccgcgtgtccgttttcttctacgtcgtcctcgccgcagctgcagctgcagccgcggcgcaggcatccaataacgtcacctccgacgaggagtactgggcggagcgcgccgaggtggctcggtcgcgcaacctcgccgcctacgtcagcgaccccgtggccgccacgaaccgcttcaacgcggacgtgctgagggccacgacgcggcgggcgctggcgaggtacgatggcccgtgcatggcgaccaaccccatcgaccggtgctggcgctgccgcgccgactgggcgacggaccggaagcggctggcgcagtgcgcgcgcgggttcggccacaggaccgtcggcggcgcggccggcaagctgtacgtggtgagggacccgagcgacgacgagatgatcatcccgcggaagggcacgctgcggcacgccgtgatccaggaccggccgctgtggatcgtgttcgcgcgcgacatggtgatcgagctgcggcaggagctgatcgtgaaccacaacaagacgatcgacgggcggggcgcgcaggtgcacatcatgttcgcgcagatcacgctgcagaacgtgcagaacgtgatcctgcacaacctgcacatccacgactccaaggcgcactcgggcggcatgatccgcgactcgaagcggcactacgggctgcgcacgcggagcgacggcgacggcgtctccgtgctgtcgtccagcaacgtgtggatcgaccacgtgtccatgtccagctgctccgacgggctgatcgacgtggtgaacgggtcgacggccatcaccgtgtccaacagccacttcaccgaccacgaccacgtgatgctgttcggcgccagcaacgacagcccgcaggacgcggtgatgcaggtcacggtggcgttcaaccacttcggccgcgggctggtgcagcggatgccgcgctgccgctacggcttcttccacgtggtgaacaacgactacacgcactggatcatgtacgccatcggcggcaacatgaaccccaccatcatcagccagggcaaccgcttcatcgcccccgacgaccccaacgccaaggaggtgaccaagcgggagtacacgccgtacaaggactacaaggagtgggtgtggaagtcgcagggcgacgtcatgatgaacggcgccttcttcaacgagtccggcggccagaacgagcgcaagtacgacaggttcgacttcatcccggccaagcacggccgctacgtcggtcagctcacgcgcttcgccggaccactcaagtgcatcgtcggccagccgtgctagtagacagcggcccggtcgggcacatactcctcttcctatatacatcggatttggatgggcggcatatatgtacgtgtgtgtaatatattattactacatcttgtactatatgcgacgattgcttgactgatgaatcacgctttttaggttagaccaatttagaagggaattagagtggattaaattcgctcccggtaaaaaatgactcgaagaaaatttagggactgtttggtttgtggttaaatgtgctacactttgtttaatgtttaatgttagtcgttcggatcaaaaaactaatcttaggcacaaaagttagataaattgtgacaagttagacatcgaatcaaatagaccattaattttcttcaatccccttctaaattggcataaccgaacaaaccaggaagagactgatctaaggtgagtatactagttcagctcgtgcatccagaggaaacgcacacttccaaatagcagaacatttcaaaatcttcattttatatgatgtgttgctttatcaaacggggtttttattcttgaaaccgaaaattgcaactttggtctaaaaaatcgtaacgagctaaagctataattttaatatgaaatatatatgcaacaacggtcaccatcgcaaaataaaactaaatgataatctcatgaaacttgttctactaaacagttatgaaccattctgcagtcatactggcgctctatgatgcataacttgctaccagcatcgcaacactgaaattgttatcaactgcatcgcatatatctttttgccggttgtgcatgctacataagaatccatacattagttagcaagagcactaattactacgtctcaaaataggttataggtaaccttgatttctttctcctcatcaagagtaaaattatttaggtttccactacatgatgtgataacaattcattgttgtcaaacataagatcattttacgatgcttgctatcccttgtaaaatatcccatcaaattcgttgggctttaatgcaacattaaaattgctaacgtgatattgtctaggatcaagaatctagatcattgggaatttagaatttttgtgtttaatttaatctaaaaaaaccatagaaattgtaaagacatatgtgcacatgtgtaatacaactaattataatagtatttgacacacatatataaatcatactgatcaaatcgggaactaaactaaatttaacaaattcagaaaacaaagtatatgggcaccggtggctccaataacatgagttgacatcatgtgatttttgaactagtgaaccatagtcaatgcaggtatagatgtttacactaccatctctcggttgtccactaccaagaaaagaaagaagatgatcctttgatcttattagcgagcagtcgcggcgatgatccctaaaatcctggttgtcctctccctgagtaggtgctacagatggagacgatggttttggaggccttctctttgaatgaaatgtgcatgcagagaattagaacaagggactctcatgcaacttgactttatgccgaggggtgattgtgtgttgtactggtttctaactgttgttgcatggtaaaggataatagaccagagttttagggagatggaaatatgaaatcttcaccataaagtatgtccattacttcgtacactatcaatgtgtttggttggatgcgtgctggcaaccaggcgcggtgtgtgcgttgacttcaggtaagcacgcgtttggatggctgcacgcgagtgggcgcgcctgcatctgctggtacagctcagactaatttgtggccttctacctgcacgcatagaaacgtgagaagattgcgtctcccgcgagccaagctcggacaagctacaggtgcatatgcagacaactgatcatgaggtatatgtccattgcaccattaatccagttgtttcctccgatcctcattaaccgacccaagtgataaaataagtctaaatatataccatagtaactaggattagaaacgagctgagcctccactacacgagctcaaagatgagattgactcagcttacgagccataccttgataaatataattacattatatattaaattaatagtatttaaatataaaatatagaattattgtttaacattatgagtaatctaaaatttgaattatcatatccatcatcaaatactaagaaatgaaccaatgcacattagggatgtcgaaacgagccatcttggctcggctcgctccaccaacgagctagcttggctcggctcgcttcaccaacgagcctaaaaataggctcgactcagcttgctcgaggctcgcgggctgctttgagctcgagccagctcgcgagcgacgagcttattttctaggcctaatagtaacaccataatcacgaccatgacatgtcatatgatgagtctaaaggtccaatagcctcgacaataacaatgatcatgagaccttagggatgtctctgagggtctaggacaaccttaactgccttaggcggtctcaacaccctcgaatggttcttatacccctgatatatccaacgccttcagatgatccgacatatttaacatagacatatatttaatttaatttaatttaataaaatatagaccatatctatattaaaatctaagaaactttgctagctagatatgcacatggttgcctttactctctctctctctcgtgcatgcatgctcactcgaccgcctaggttgattgcaattactgccctgatagaccg

SEQ ID NO: 19610 - DNA, 1791 bp, Zea mays
cctgccgggagacagatgtcaaccccgaattttccgtcgccccccctgctcgccgtcgctccttcggcccttcctctctcccatctcggctagggttaggtcgtctcgccaagtcgccatgatgcagcagcccccgccgcagcagccgcagccgggcatggcgccgcctccgcctccgcaggctgctggcgggcagccaccgcagtggggtgggatcccgccgccgatggcgcagcagtacggcgcaccgcctccgcagcagcctccggcgatgtggggccagcctccgccgcaggcgcactacgggcaggcaccaacccctcagcagtactacgccgcgccgccggtgccggtgcaggcgccagccgcccccgctgcggcggacgaggtcaggacgctctggatcggggacctgcaatactggatggacgagaactacgtcttcgggtgcttttcgaacactggggaggttcaaaatgtgaagctcatccgtgacaagaattcagggcagcttcagggttatggttttgttgagtttacaagccgtgcagctgcagaacgagttcttcagacatacaatggacaaatgatgccaaatgttgacttgacatttcggctgaattgggccagtgctggtgaaaagcgcgatgatactcctgaatatactatttttgttggggatttggctgcagatgttacagattacttgttacaagagacattcagggttcattatccctctgtcaagggtgcaaaagttgtgactgataaattgacaatgcgcacaaagggttatggatttgtgaaatttggtgatcctacagagcaagctcgtgcaatgactgaaatgaatggaatgccttgttcttccaggcctatgcgtattggtcctgcagcaagtaggaaaaatacaggaggtgttgttcaagagagagtaccaaattctcaaggagctcagtctgagaatgatcctaacaataccactatatttgttggtgggcttgaccccaatgtcactgaagataccctaaaacaagttttttctccttacggtgaagtcgtccatgttaagatccctgttgggaagagatgtggttttgttcagttcgttaccagaccttctgctgagcaagcgctgctaatgctgcaaggggccttgattggtgcacagaatgttcgactttcatggggtagaagcctgtcgaacaagcaggctcagcctcagcaggaatccaatcaatggggtgcggctgctggtgctggtggctactatgggggctatggacaaggttatgaggcttatggcagtgggtatgcacaaccccaggatcctaacatgtatggttatggcgcttatggcggttatcccaattaccaacagcaaccagctgcacagcagcaacagcaacaacagtgatgcctgtttgctcgggtaggtcattgggttgtcgcgacggaattaattaaatattatttcaggacactctcatattgcattcttgtcaattgaggtggttttgaaaggctcctgattttgatggccccatggcacggtttcatctatttattagtatatgacatatatgcgctgtgaacaagtggcgctctactgtgattgctgtgttgagacatgctttcttagtttctttccatgtttctcggatctgttgtgttacctttattactgtgtatttgcatatctactgtgatgctatatatgcactgtgccgtttgtttcctataaaaaaaaaaaaaaaagagcccccgcccgggaatccggaccgtacggca

SEQ ID NO: 19611 - DNA, 1826 bp, Zea mays
  misc_feature (6)..(28): n is a, c, g, or t
  misc_feature (100)..(109): n is a, c, g, or t
  misc_feature (161)..(186): n is a, c, g, or t
  misc_feature (202)..(206): n is a, c, g, or t
  misc_feature (362)..(404): n is a, c, g, or t
gcacgnnnnnnnnnnnnnnnnnnnnnnngcaagtctcccgcgaagtcgcaagtctcccgcacgaaccacgacaaatgtcaaccccgattcctcgccgtcnnnnnnnnnnacgagcccatctcggctagggttaggtcgtctcggcaagtcgccatgatgcnnnnnnnnnnnnnnnnnnnnnnnnnnatggcgctacctcctnnnnntcagaccggtggcgggcagccaccgcagtggggcgcgatcccgccgccgatgacgcagcagtacggcgcaccacctccgcagcagcctccagcgatgtggggccagcctccgtcgcaggcgcactacgggcaggcgccgacccctcagcagtattnnnnnnnnnnnnnnnnnnnnnnnnnnnnnnnnnnnnnnnnnnngcggcggacgaggtcaggacgctctggatcggggacctgcaatactggatggacgagaactatgtcttcgggtgcttttcgaacactggggaggttcaaaatgtgaagctcatccgtgacaagaattcagggcagcttcggccctcgagggttttgttgaatttacaagccgtgcagctgcagagcgagttcttcagacatataatggacaaatgatgccaaatgttgacttgacatttcggctgaactgggccagtgctggtgaaaagcgtgatgatactcctgactatactattttcgttggtgatttggctgcagatgttacagattacttgttacaagagacattcagggttcattatccctcggtgaagggtgcaaaagttgtgactgataaattgacaatgcgtaccaagggttatggatttgtgaaatttggcgatcctacagagcaagctcgtgcaatgactgaaatgaatggaatgccttgttcttccaggcctatgcgtattggtcctgcagcaagtagaaaaaatgcaggtggtgttgttcaagagagagtaccaaattctcaaggagctcagtctgagaatgatcctaacaataccactatatttgttggtgggcttgaccccaatgtcactgaagatgtcctaaaacaagccttttctccttatggcgaagtcatccatgttaagatccctgttgggaagagatgtggttttgttcagtttgttaccagaccttctgctgagcaggcgctgctaatgttgcaaggggccttgattggtgcacagaatgttcggctttcgtggggtagaagcctgtcgaacaagcagactcagcctcagcaggaatccatgcaatggggtgcgggtgcgcctgctggtgttggtgattactatggtggctatggacaaggttatgaggcttatggcagtgggtatgcacaaccccaggaccctaacatgtatggttatggcgcttatgttggttatcccaattaccaacagcaaccagctgcacagcagccacagcaacaacagtgaggcctctttgctcgggtaggtcattgggttgtctgagatgggatcaattagtattatttctaggcattcatatattgatttcttgaaaatagaggtggtttcgaaaatctcctgattttgatggccccatggcatgttttcttcgagttatatcatatatatatgcactatgttatgtctatgaacaagtggtgctcaactgtgattgctatgttgaggcatgcttcgtagtttccttccagacttgtcttatatattgttctctcttttactctgtattgttatctctattagtgtgtattgcatatctactgcgatgctatatatgcgctgtgccgcctttcgttcgtttcctattacattttcgttctcg

SEQ ID NO: 19612 - DNA, 2235 bp, Zea mays
  misc_feature (2)..(12): n is a, c, g, or t
  misc_feature (15)..(19): n is a, c, g, or t
  misc_feature (22)..(22): n is a, c, g, or t
  misc_feature (25)..(25): n is a, c, g, or t
  misc_feature (28)..(28): n is a, c, g, or t
  misc_feature (31)..(32): n is a, c, g, or t
  misc_feature (35)..(35): n is a, c, g, or t
  misc_feature (49)..(49): n is a, c, g, or t
  misc_feature (65)..(65): n is a, c, g, or t
  misc_feature (68)..(68): n is a, c, g, or t
  misc_feature (72)..(72): n is a, c, g, or t
  misc_feature (74)..(74): n is a, c, g, or t
  misc_feature (76)..(76): n is a, c, g, or t
  misc_feature (78)..(78): n is a, c, g, or t
  misc_feature (87)..(87): n is a, c, g, or t
  misc_feature (110)..(110): n is a, c, g, or t
  misc_feature (130)..(130): n is a, c, g, or t
  misc_feature (140)..(140): n is a, c, g, or t
  misc_feature (145)..(145): n is a, c, g, or t
  misc_feature (158)..(158): n is a, c, g, or t
  misc_feature (172)..(172): n is a, c, g, or t
  misc_feature (400)..(400): n is a, c, g, or t
  misc_feature (426)..(426): n is a, c, g, or t
tnnnnnnnnnnnctnnnnntcnccncgnggnnggnccctctataactantggatccccccggctncanggananananaaaaaaaantcactaatccccccccccccccnccatatccttcatggaccangaggagctgnctganacttcctcttccnatgacgataactgngaggagtttttgatacaaaagaataccctgaagcgtccgagatctccagatggtgacaacatctctgctcttggaaattttgagggttcatcaaacgaggcagcaaagattttagatgtcacggatacaagaccatccctggacaattcaaataggaaaaaacaaggccgtggaaggggtcgtgctggtacaggccgaggccgtggctcaaagactgttgatcaaccncgactgactttgatttcctcagcagntgtaacaaatggtccactagataaattaaccaacaagggaaccccaatcgagtgttcaactgggccatgacgacagggctgctttacaggaagaattgtcaatgttacatggccaagttgcatttttggaggaggaactttctaaatcgcgtcaagacgcaacaaattaccatccactgagtggtaggggtgccaaggaattgaaggatctcaaagatcatgaccaacaaatgagatctaagcaaatgaaggtgctgtctgatctgctgatagctgtgtcgaaagcagagaggcaagaagcgcggatgaggataaggcaggaatctttcagacttgggaatgttggtgttatgagagctggaactatcatatctgaaatttgggaagacggacaggcaataaaagatcttaattctcacctgaaatctttactggaaactaaggagactattgaaaggcatcgtaaatcacttaagaaaagacaatctgacaagggtgatggcagtgacgctgagactagcatgtccgaggaggacattgtcttacaggacgaaatatgtaaatctcgtctaaccagtatcaaacgggaggaagaacagtatatgagagagagagatcggtatgagttggaaaaggggaggcttatacgagagatgaagcgtctcagagatgaagatggctcacgctttaacaacttccaaattcttcaccatcgttatgctctgttaaatcttcttggaaagggagggtttagtgaggtttacaaggcttttgatttggtggagtacaagtatgtggcatgcaagcttcatggattgaacgctcaatggagtgaggagaaaaaacagagctacataacgtcatgcgattcgtgaatataacattcacaaaactttggtgcatccaaacattgtcaggctatgggatatatttgagattgatcacaatacattctgcaccgtcctagaatattgcagtggcaaggatcttgatgcagtccttaaagccacaccaattcttccagaaaaagaagcaagaatcataattgttcaaatatttcagggcctggtttatctaaacaagaggggccaaaagatcattcactacgatctaaaacctggcaatgttctctttgatgaggttggtgttgcaaaagttacagactttggcctcagcaagattgtggaggatgatgttgggtctcagggaatggaactcacttctcagggagctggaacctattggtatcttcctccagaatgctttgacctcagcaaaacaccatttatttcatctaaggtggatgtttggtcagctggtgtaatgttttaccaaatgctttatggaaggcgtccttttggtcatgatcagactcaggagagaatacttcgggaagatacaattatcaatgcacgaagagtggagttcccctcaaagccagctgtatcgaatgaggcgaaggatctgatacgccggtgcttgacatacaaccaatcagagaggccagatgtactaaccataactcaagatcattatctctcgtatgcaaagaagtagccactaccccggagaacattttggcgatggtatctgttcaggcattgagattatggatggggatggataatctcgtggaagagctaagtattaaacaagctcaagaagaccacaaagggtgtataattgtaaattttagtctgccctattacggcaatgacctgaaatccagaaggcatcagttcaaaggccagcttcttttgtaacatagagaaaacatgcattaacgggcccatttaccctttgactgag

SEQ ID NO: 19613 - DNA, 628 bp, Zea mays
  misc_feature (544)..(544): n is a, c, g, or t
  misc_feature (551)..(551): n is a, c, g, or t
  misc_feature (553)..(553): n is a, c, g, or t
  misc_feature (557)..(557): n is a, c, g, or t
  misc_feature (567)..(568): n is a, c, g, or t
  misc_feature (574)..(574): n is a, c, g, or t
  misc_feature (576)..(576): n is a, c, g, or t
  misc_feature (585)..(585): n is a, c, g, or t
  misc_feature (592)..(592): n is a, c, g, or t
  misc_feature (596)..(596): n is a, c, g, or t
  misc_feature (617)..(617): n is a, c, g, or t
aaatggccaactaaataaattaaccaacaaggaaccccgatcgagtgttcaactgggccatgacgacagagctgctttacaggacgaattgtcaacattacgtggcaaagttgcatttttggaggaagacctttctaaatcgcatcaagaagcaacaaattaccatgaacttagtgataggttagcaaaggaattgaaggatctcaaagatcatgaccaacaaatgagattaaagcaaatgaaaatcctgtccgatctgctgatagctgtgtcaaaagcagagaggcaagaagcgagaatgagaataaggcaggaatctttcagacttggaaatgttgctgttatgagagctgggactatcatatctgaaacttgggaagacggtcaggcaataaaagatcttaatgctcacctgaaatctttgctggaaactaaggagactattgaaaggcatcgtaaatcacttaagaaaaagacaatctgacaagggtgatggcagtgatgcatgcaacttacaattgttccccatgtcagctcttagccngctacantngtangtctatcaanntttagntntgttgtagnagcagtnacgntaataattattcgaaggatgnggtatttagcc

SEQ ID NO: 19614 - DNA, 1819 bp, Zea mays
cagtgatgctgagactggcatgtctgaggaggacatcctcttacaagatgaaatatgtaaatctcggttaatgagtataaaacgggaggaagaacagtatatgagagagagagcgcggcatgtcgttggaaaaggggaggcttatacgagagatgaagcgtctcagagatgaagatggctcacgctttaacaacttccaaattcttcaccatcgttatgctctgttaaatcttcttggaaagggagggtttagtgaggtttacaaggcttttgatttggtggagtacaagtatgtggcatgcaagcttcatggattgaacgctcaatggagtgaggagaaaaaacagagctacatacgtcatgcgattcgtgaatataacgaattcagcacgacggttcatccaaacattgtcaggctatgggatatatttgagattgatcacaatacattctgcactgtcctagaatattgcagtggcaaggatcttgatgcagtccttaaagctacaccaattcttccagaaaaagaaggaaggatcataattgttcaaatatttcagggcctggtttatctaaacaagaggggccaaaagatcattcactatgatctaaagccgggcaatgttctctttgatgaggttggtgttgcaaaagttaccgactttggcctcagcaagatagtggagaatgatgttgggtctcaggggatggagctcacttctcagggagctggaacctattggtatcttcctccagaatgctttgacctgagcaaaacaccatttatttcatctaaggtggatgtttggtcagctggtgtaatgttttaccagatgctcttcggaaagcgtccttttggtcatgaccagacccaggagagaatacttcgggaagatacgattatcaatgcacggagagtggagttcccttcaaagccagctgtatcaaatgaggcaaaggatctgatacgccggtgcttgacatacaaccaatcagagagaccagatgtactaaccatagctcaagatccttatctctcatacgcaaagagatagccgctatgccggagaacactaaggcaagggtagctgatcatttaatgagattatttatgtatggggatggataatcttgcgaaggagcaaagtgttccacaagctcaagaagaccacaaagggtgtaactgtatatgttgtaaattttagtctttcccatcgcagcaatgacctgaaatccagaagccatcagttcaacggacagcttctttgtagcgtagagaaagcaggcattggtttgaacggggcatgcgtaacgtgatggtttcttggctggtgggctgtgggcagtggtcctgttgatggttggtttttgtttgctcatactgtcggtaaggtctgccaaatcagaaaccaccggtgacaggcgagagctcacatgctcacctccgaaaaaaatctcggccttgcactggcaggatggactggattttgcgtattgccaaaacagatttaaggtagcatgcatcaatacaggttactttggataacctatagactcaccacagccacaagcacagaagctcttcgtacaatttcagagagtaccgatgtgccagatttctgctggtgccaatttgtttgtgatcgctgtcacccttgtacaacactgggatcgctcattgagcatacacaagttatgcaatttgcttttttattatagtcatctttagggcgtcgttttgttcggaacggattctttggaactttaatgttagttttatttgtgttaaaactgaacgtggaatagttccaggttatat

SEQ ID NO: 19615 - DNA, 7469 bp, Zea mays
cacgcaagtttagcttcggcacgcacagcgtgagcctccgcgcaggccttgtcagcgtcctccttctccgcggctagccgacggccaagctcctcctttttggactccgccgtcgatagcttgtccattagattgcggctcttgctctccgcggctgacttgtcccgcatagcctcagagagctgtgtccggaggcgctcattcctcccttcaagtcgccgcttttcggcagcgaactctgaggtcagggccccggacgcaatctgttcggcgaaggcggtcgcctggcatcaaccaccgtcgaaatcgaagtcattaaaaaaacaaaaaaataaaactcgaaggcaacttacatgcttcactggctcgccgtctacgggctgggcctcggcctgctcggggcctcgctcacgctcagcctcacgtggtgggtgctggtcctgggccagttcgcgtacatcgtgtggagcccgcgctgccgggccacctggaccgggttcacgtgggctgccttcgccgacctgcccgggttcgccggcctgtccgccgcgtcggctgtcatgctggcgctcgaggtctggtacttccaggtgctcatcctcctcgccggcatgctgccggacccgcagatcgccctggactcgctaacggtctggtgggtacaaaaaccacactcccgacgccacgccgcttcttcgctttcttactgttactatctactatggccattttctactttgtaaatgcttaataattactttcaactcataatgccgctttctgcatggcaaatgttctgtgtgcagcacgtcgatccagtcatgggtgttcatgatctctgtgggcttcaatgcagcggcccggttggtttactctgtctgcatcatcctacctacagtgcttgtgttagctctcccatctgaggaggttcgatctgcactgcagcgtgagggttgggaatgagctgggcgccggcaaccccaggtccgccgcgttctctgcgtgggtggtcaccgccctgtcggcgttcgtctcagggatagctggcctcgtcactttcctgctcagggacaagctcagctacatcttcaccggtggcgaggccgtctcgcgcgccgtcgccgacttgtgcccgctgctcgttgggaccattgtgctctgcgggatccagcccgtgctgtcaggtgcttttcctctctttttttttcccttttccttttcctttttccagactgaaactgtggtgcaccttcagagttcagacctgacactcatccaaattcaagtggtactacagtgttacataagttaattcgctggagaacagacttattcgggctattaatctttgagccgtcgcattacactgcgacgggatccttcaccttcagtgatgcgtttgttctgttcttcttcccactggtactgaactttttgctcactggacgacgacgggtgatgaaaggtgtggccgttggctgcgggtggcaagcgatggttgcctacatcaacgtcgaatgctactacttcatcggcgtacccctcggcgtgctcctcggattcaagttcggtttcgggatcaaggtagtttcggtcccgaggaacatgctgtcacgtttttaatgcctactttggatcaaaggataatttactactaaatcctgtgattttgaactgatttctataaaattgtgcctataccattcctcctgtgaaaattccacgcaagcctgaaaaaaaaggaccctgtgctgtgcagggactgtggggaggcatgattgggggtaccctcatccaaacacttgctttgatctggatcacgttaaggactgactggaacaaggaggtaattttaagccaccgtaaatttccttggttaccgtgccgtgtcactgacagatggtcctcaaatccaccgcgcgtgccgatgtgttcgtcttcgtccatatgctcggttattccttccaagctcaggcttctgttgtgtggccattttcttctctgtgttttgattttttttttcttgtgctgtagtttatctgttctttttttctctctttttggtgtctgaatgtaggtcgaagaagcgcggaaaagattggataagtgggacgacacaaggcagcctcttgtcgcaagcaaggagtgatggatgatggtacaggagtggatgaagaagattcagtaggcttctgctagctgatccagtctgaaatcatcttgtagtcgccaccgctaactgcaattcagggatgtactaatgcagagcttctctggtctcggctctcaggaacataccataccacagtcagtttcggttgatggggccttgcgagccgggcgtccgttcaatcggtatgcgtggacatggcggccgttggctttactcccgtagtacgagcgacagtgccattattttttgtttgctccggtaattttggtggctgccttgcctttttttaaaaaaaaaactcttatgtctccactcacgtcacagtgagttcgttttttgctatcgtttaggtggagattagtatctgatacaaaccaacccttccgtgcaatcgtaaaaaacttctaatatgtaccatataatcttgatcaagtggacacacgggaatgaataattttgcacttaaccgcccactcataatcacacttttgtaaatatcctctctcactctcctgcgcgcgtccttagatcaacatcatacgaccgacgattgcacatagggagaggttggtttgcaccaccgattacttatgctcgaatctgtcttccggaggtgtccgtcccaacgttacacatgtgcctcaccgtatatcgtgtactgtagggacacatgcctctgagcttctgaagacgaccttcagcggttcagcacgtacgcactgtacggtttcctgcggtgctgtcttctattctattctatgctgcgatgccggatgatcagatcagtgatacaccaagctattcgttcaggcttggccgttgcatctttccatggcctaataaccggcaagaaacgacgcgctgctgaaacggtgcccagcatgtcgttctgcctctgcaacgccctccgcctggatggtcaccgctcgtcgctgccgatgctggtcctcgtcatcttccagagcccgtgttgctaggtgcctctgtgtggtcgcctgattcttgatgccccgttaccttatgtctgaatgaccaagcggtgtgtaccggcatctgaaacagctggtttcgctgtgctcatgtcctgacgatgaaggtgcggctgcaggctgtgctccgtacttaccatctcatcgccgatgcccccctcgatcgatgtgctcgttggattcaacggctttgactctggcatcaaggtacactgcattgtttcatcggagattgcgagatgaacgttcatgtacgtccagttgacttgctggttgtgtcgtgggctatataggatcccgtgaagtgtccctgaatgagaaacagtatcgagcggcgcttgtccctgaatccttgtgcgagtctggaaagggatcttgcaattgcatgcgtcgcagggactgtggggaggcatgattggggccgtgcaggggccaccctcctcatgtaaacacacttgctctgatctggatcacactcacaactgattggaacggtgtggtaagctaagctgtatgtatgcatgcacctttggtgggcatcataagcctcggtagccgcggcgcatcgtctcactgacagatgatcctcaaatctggctgctcacatgcccagccgcgtagtatcagttctgtgtggatgcgttattttagggcaattattccgccctacttgcatcgcatgtgtgtggtcattgtagggtttttttaatgtcatcattttaattaggttcgttgattagcataaattaatctggatttcgctctagattatattagtgggagccccttctcgcagaacaaggagtgatccatgatgtcaggagcggacgggccggagagtcagtagctagtatgctgctgcaagtgaagttgacccaattcgcattattgctattttcatgtaaatatatagaccactcaaataaacaaaaatgcagcaatgcatgctgcagtcgatttcatgagatcatgctgcttttttccggaactggtggcaccatatctttccgcctcacctattcatttccattcttatcaattcttgcaacagttgttagaaagaaacgttagttggtaagtggcctgcttgcgttagtgaaagaatatactgctagaacgcagcagcgactccgctctggtaaccgaaatgttttcttctccaaaaatgtgaggataattggtagtagctagctagttcctagctgtgagagtctgtgacgaagaagtgcaatcaatttaggaactgtaaatttgatcctagtactagtaattaacctttaatttaggtgctactcgacctcctcatgataagaacaataatgtagcgttttgattttgacctggtcgaatttattagtaaggaggatcatcgatcatgcgtggcgtctgtctcgtcgtcgtcgtccacgtctggttgtctcagtgacctcacaaaagccacgagcgcgcgccgggcatgcagcggccgccggcgacatgcaatgtgttaggtgatgagatgacggtcagaagttggccgacctttttcttggcaaggcatcatgtggatgggggcgatgcatgcatgcatgcatgcatgagagccaataatataattcgcaggcccccacggcaagtgaggcatctagctggtgcacgcggcacgcctgccagcttattaggcccctccccggatgccatttgcagttgacttgcatcgaaccacagcattggcatgcaaggcgttgattagcaacaagaggggaatctctgaggcgaacgaatggcctggaagaaggttggttcagattatgattacaagattgacaaaagaagggaaaaaagatagaggaaaagagcggtgttctaggaagtgaagtatatttatgtgtgtgcttgcattggtgacgaacgaatagctaggttgatctaaacgagacctaattgagttagaactgcaccggattctctacgcttatccgtgtcacagtctaatcattttgattttttttatgacgatcatatggtggaatggaagctagcacgcgtgacaatcctcaaggtcacactagcgccgtggttacctcagagtccggacttaacgattacagaccgggaaaaaaattaaaaatacgcaacctatggctgattttgtggcaagacaataagagatgattacggagaaggaaatctcttgctatccaaaatttaataacaatagatttccattcccatgaatcaattctctgcgggtagtaggattcgcattcaaagctcgatcgtgatttcctcgtcacgcgtacactctgatagcaagcaaaatccgagatgtgactggagtttcctctaggacgtgttgggaaaatgatgtgaccataccatacatgccatccatcgtttttagcatatgtcatgagcttcgagatttctaaatgcgtcgagagatcagataaaatagagagaggaaatacgactggcggtgcatgatataaagaatggtcatcatcattgacacggcctgtccaactaattaaaggtatgtgtggaaacaaacagtttttaaaaaactgatttataaaaactaaggtatttttaaacacactagtttatagaaattggattcttagtttcttaaaaaccaaaaaactagtctacctagctaaagacagtttatgaaaattaaggtggttccaaatatcgataaatatttttttaaaccggtttctagaaacaggagataaaaactaaattcttaaaaactttgttgcttccatcgaagtactctggtctctggtaatcccatcaacaattctacaaatataggaccagaatacaggaggatctgatatattacatttgttgatgaatatttgtcatcgattagtttatttttaaactaaaatatgacaaataaaaaaattagtaagtagtttgctgcttactatatagacacacacgtccccggccagacagccaacagctgcagaaagctcacgccaagagcgagagaccctttcccgatcccgccgcctcctcctcgccgtcgacgttgcttcgcgaagagccgaagatgctgctcctgcgggcatcgacggcgccgttcgcgtacgccaaggtggacaaggtggacgcggaggaggcgcggcacctcagggcgcagtacctcatccacaaggtgctggaggagaagagcccaaggccgccggcggcgctggcgcggaccagcaggcccagggtcggcgtccggctgaagaagctcaggctcgccgtccggggcctcagggcgcgcgcgtgccgggccctgctgaggcacctcaggaacctcaggcggctcgtcgggcacggagctcaggggtcgccgtgacgccgtcgccctactgatgacgccttgtgtccctggcgctttttctgcgaggaggaggagggatccggaatccccgtgtctccattttggttttggttcttggctgttgctgcgtggtcgtggatctgagctgtgctgagagatcgggatcagtttgcatgcgttttaattaggtgttggaatggtgtcatatagacatatatatactcatacaaaatgtgtaattgtagtagcaatcaagaaatgcttccaagctgcatttttatgcctctctgtgttctggaatcctgctgtgcatgttctgcagaagccagagatctctccatcagtaatgcagtagttttttctttcttttttaaaaaaaaaaaaaaaagctagtttctctgtcacattgtatcacgatgtgacaaccatctttttccagtgatccaccaccatgtctgcaactgcctccattgtttggactctggatctgcagcatggttcgcctggcatatatggcatggtttgtttgggttttttttttcggcttctgcccaccaaaaattgttgtggattgtcaaacgctctaattttaatcgttttggtgaacacaaaatcgatcgagtcgtagcgatagtgtaaatccatagttttctagatcctgaactctttggaccacttcatcttactccacatttctcacaaacagattatctgtactgtcatattctcaaaaaactggtaaaaaaaagctaaaccaaacagacctactgatctgcgtctgcagcaacccagacccgggcaccaggattaccagagtccatgaccagtaaaactcccatctgtatcttatgtttcagaatgaaaatacccagtattttttactgcattgatgtcccctctccccctgtttttctggaatttactcaaacaaaaccatcaccagtggcggacgcagaacaaaactttaggtggggcgaca

SEQ ID NO: 19616 - DNA, 2639 bp, Zea mays
gtagatgcgcggaccctccgagccctaggccaggtcatccaccacttttggtgttcatcaaaactgaaactgttttataggtcttattttccatcttgtttggcgtagctctcatcgttgactcgtaaagctatttagagctattattattttgtgtgtagcgccaaatgactctatctaaagagagtatttaaaaatatatatgctacgacaaaaaaaataccggaaaatagagtcagaaaaatagtggctacgcacgtagggttcacctcactagatggacctagcaaagaccaacacgagttttgccacctcatcacttatttcatcgtagaaaatttgctcacctttatttattctatatggcacgtgatgttatttaactcccacaaacctcatcaatcatacgggacgtaaaagcacgcgcgggtgggtccgactataacagtgtcgtttacacttaaatatagagtagtaaaacatatcttctactggcggctatttgagtatatacatgaatgcatgcttgtttagagtcaacaaaccaacggtagtttaaatatttgtttatgtacacctttagcttttttgttactatttaaatgttttaaatgtgaggcacacaaattgtcgtcaacgacgaagactagaatgcactagatggatccattagtagggggcgatgtgggggcagaacgttctagtcacactggcacgtactccagagacgagcgcgcgcgcgcggagcaggccgggtccataaattatgagctcgccctttggaaccgagaggcgtttcctacccaccttaccttatcattattagctccaagcaagtcgcacacgacacagacacacacacatcatcatcatcaacaacctgacatggccggcgacggggcggacgccgcgcacggcgcgtcggcgcggctggagggcgtgctgacggatgcgtcgaccccgtgggcgcggcgcgcgtggggcgcggccgccatcgagctgccgctgctgacgcggctggcggcgccggcggttgtgatgtacatgatcaactacctcatgtccatgtcgacgcagatcttctcgggccacctcggcaacctggagctcgccgccgcctcgctcggcaacaccggcgtgcagatgttcgcctacggactcatgctgggcatgggcagcgcggtggagacgctgtgcgggcaggcgtacggcgcccacaagtacgagatgctgggcatctacctgcagcggtcggccgtgctgctgtgcgcgacgggcgtgccgctggccgtgatctacggcttctcggagccgatcctggtgttcctggggcagtcgccggagatcgcccgcgcggcggccatcttcgtgtacggcctgatcccgcagatcttcgcgtacgccatcaacttcccgatccagaagttcatgcaggcgcagagcatcgtgctcccgagcgcgtacatctccaccgcgtcgctggcgctgcacctgctgctgagctgggtggtggtctacaaggtggggctgggcctgctgggggcctccctggtgctgagcctcagctggtggctcctcgtcgccgcgcagttcgcgtacatcgtgatgagccccaggtgccgccacacctggaccggcttcacctggcaggccttctcgggcctctgggacttcctcaagctctccgccgcgtccgccgtcatgctctgcctcgagacctggtactatcaggtcctggtgctcatcgccggcttgctccccaaccctgaacttgcattggacgcgctgtctgtatgcatgactgttaacgggtgggtgttcatgatcgcagtagggttcaacgccgctgccagcgtgagagtgagcaatgagctcggcgccggccaccccaagtccgcgtatttctcggtgtgggtagtgaccgcgctgtcgacgctcatatctatcatgctcggcgttctggtcctctgcctgcgcaactacatcagctacttgttcacggagggcgaggtggtgtccaacgcggtggcggatctctgcccgctgcttgccgtcacgctcgttctcaacggcatccagcctgtgctgtcaggtgtcgccgttgggtgcgggtggcagcagttcgtggcctacgtgaacattggctgctactacatagtcggcgtccccctcggcgccctgctcgggttcttcttcaagctcggtgttaagggcatttgggctgggatgatcggagggacctgcatgcagacggctattctagtgtgggtcaccttgagaactgactggaacaaggaggtagaggaagcacagaataggttgcacaagtgggaggctaacaagacgacggagccccttcttgcgggggtcagcaatgacaaataaataacgtaactgcgcgcggatgatcgatcgatccacaatatcaatcaatctccggccttcaccagtactagttcccttcatgcataatgttgggaactggcgtctttagattttctgtgcagtaaattaaatgaaccacggtaacgtcaatgtaaacgaatcacgcatgtttggtttgcttatttcttccgttttaatgcttaacgtacgacgcgaccaaaaatctgtccaaaaaaaaaaaaaaaaaaggtgac

SEQ ID NO: 19617 - DNA, 1054 bp, Zea mays
gcgggcacgaggcttcaccggtggcgaggccgtctcgcgcgccgtcgccgacttgtgcccgctgctcgttgggaccattgtgctctgcgggatccagcccgtgctgtcaggtgcttttcctctcttttttttttcccttttccttttcctttttccagactgaaactgtggtgcaccttcagagttcagacctgacactcatccaaattcaagtggtacctacagtgttacataagcttaattcgctggagaacagacttattcgggctattaatctttgagccgtcgcattacactgcgacgggatccttcaccttcagtgatgcgtttgttctgttcttcttcccactggtactgaactttttgctcactggacgacgacgggtgatgaaaggtgtggccgttggctgcgggtggcaagcgatggttgcctacatcaacgtcgaatgctactacttcatcggcgtacccctcggcgtgctcctcggattcaagttcggtttcgggatcaagggactgtggggaggcatgattgggggtaccctcatccaaacacttgctttgatctggatcacgttaaggactgactggaacaaggaggtcgaggaagcgcggaaaagattggataagtgggacgacacaaggcagcctcttctcgcaagcaaggagtgatggatgatggtacaggagtggatgaagaagattcagtaggcttctgctagctgatccagtctgaaatcatcttgtagtcgccaccgctaactgcaattcagggatgtactaatgcagagcttctgtggtctcggctctcaggaacataccataccataccacagtcagtttcggttgatggggccttgcgagccgggcgtccgtttcaatcggtatgcgtggacatggcagccgttggctttactcccgtagtacgagcgacagtgccattattttttgtttgctccggtagttttggtggctgccttgcctttttttttaaaaaaaactcctctggctccactcacgtcacagtgaattctttaaaaaaaaaaaaaaaaaa

SEQ ID NO: 19618 - DNA, 1895 bp, Zea mays
attgggtacctcgaggccggccgggacctatctcgctatcactggctctccccgtcaactaaactctagccagtgagtggatgatgggtcggacgggtgacggccgccgccgcgacgtcgacggccggctggaggcgctgctctctggcgccggcggcgaggagccgtggctccggcgcgtggcgctcgcgacggctctggagctgcggctgctggcgcccctggccgcgccggccgtggtggtctacatgctcatcatcgtcatgtcgtcgaccacgcagatcgtgtgcggccagctcggcaacgtccagctcgccgccgcctccctcggcaacaacggcatccaggtcttcgcctacggcatcatgctggggatgggcagcgcggtggagacgctgtgcgggcaggcgtacggcgccgagaagtacgagatgctgggcgtgtacctgcagcgctcgacggtgctgctcacggccaccggcgtgccgctcgccgccgtgtacgcgctgtcggagccgctgctgctgctgctggggcagtcgcctgagatcgccggcgccgccgccgagttcgcctacggcctcgtcccgcagatcttcgcgtacgccgccaacttccccatccagaagttcctgcaggcgcagagcatcgtggcgcccagcgcctacatcctggcggccagcttcgcgctccacgtgccgctcagctggctcgccgtctacgggctgggcctcggcctgctcggggcctcgctcacgctcagcctcacgtggtgggtgctggtcctggcccagttcgcgtacatcgtgtggagcccgcgctgccgggccacctggaccgggtttacgtgggctgccttcgccgacctgcccgggttcgccggcctgtccgcggcgtcggctgtcatgctggcgctcgaggtctggtacttccaggtgctcatcctcctcgccggcgtgctgcctgacccgcagatcgctctggactcgctaacggtctgcacgtcgatccagtcatgggtgttcatgatctctgtgggcttcaatgcagctgccagcgtgagggttgggaatgagctgggcgccggcaaccccaggtccgccgcgttctctgcgtgggtggtcaccgccctgtcggcgttcgtctctgggatagctggcctcgtcactttcctgctcagggacaagctcagctacatcttcaccggtggcgaggccgtctcgcgcgccgtcgtcgacttgtgcccgctgctcgttgggaccattgtgctctgcgggatccagcccgtgctgtcaggtgtggccgttggctgcgggtggcaagccatggttgcctacatcaacgtcggatgctactacttcatcggcgtacccctcggcgtgctcctcggattcaagttcggtttcgggatcaagggactgtggggaggcatgattgggggtaccctcatccaaacacttgctttgatctggatcacgttaagaactgactggaacaaggaggtcgaggaagcgcggaaaagattggataagtgggacgacacaaggcagcctcttctcgcaagcaaggagtgatgtatgatggtacaggagtggatgaagaagattcagtaggcttctgctagctgatccagtctgaaatcatcttgtagtcgccaccgctaactgcaattcagggatgtactaatgcagagcttctctgggcaaaaaaaaaaaaaaaataccataccataccacagtcagtttcggttgatggggccttgcgagccgggcgtccgtttcaatcggtatgcgtggacatggcagccgttggctttactcccgtagtacgagcgacagtgccattattttttgtttgctccggtagttttggtggctgccttgcctttttttttt

SEQ ID NO: 19619 - DNA, 1364 bp, Zea mays
agtacgagatgctgggcatctacctgcagcggtcggccgtgctgctgtgcgcgacgggcgtgccgctggccgtgatctacggcttctcggagccgatcctggtgttcctggggcagtcgccggagatcgcccgcgcggcggccatcttcgtgtacggcctgatcccgcagatcttcgcgtacgccatcaacttcccgatccagaagttcatgcaggcgcagagcatcgtgctcccgagcgcgtacatctccaccgcgtcgctggcgctgcacctgctgctgagctgggtggtggtctacaaggtggggctgggcctgctgggggcctccctggtgctgagcctgagctggtggctcctcgtcgccgcgcagttcgcgtacatcgtgatgagccccaggtgccgtcacacctggaccggcttcacctggcaggccttctcgggcctctgggacttcctcaagctctccgccgcgtccgccgtcatgctctgcctcgagacctggtactatcaggtcctggtgctcatcgccggcttgctccccaaccctgaacttgcattggacgcgctgtctgtatgcatgactgttaacgggtgggtgttcatgatcgcagtagggttcaacgccgctgccagcgtgagagtgagcaatgagctcggcgccggccaccccaagtccgcgtatttctcggtgtgggtagtgaccgcgctgtcgacgctcatatctatcatgctcggcgttctggtcctctgcctgcgcaactacatcagctacttgttcacggagggcgaggtggtgtccaacgcggtggcggatctctgcccgctgcttgccgtcacgctcgttctcaacggcatccagcctgtgctgtcaggtgtcgccgttgggtgcgggtggcagcagttcgtggcctacgtgaacattggctgctactacatagtcggcgtccccctcggcgccctgctcgggttcttcttcaagctcggtgttaagggcatttgggctgggatgatcggagggacctgcatgcagacggctattctagtgtgggtcaccttgagaactgactggaacaaggaggtagaggaagcacagaataggttgcacaagtgggaggctaacaagacgacggagccccttcttgcgggggtcagcaatgacaagtagctgatccagaatatcaatctccggccttcaccagtactagttcccttcatgcataatgttgggaactggcgtctttagattttctgtgcagtaaattaaatgaaccacggtaacgtcaatgtaaacgaagaatcacgcatgtttggtttgcttatttcttccgttttaatgctcaaaaaaaaaaaaaaaaacgccgcc

SEQ ID NO: 19620 - DNA, 2071 bp, Zea mays
ataaaaaatttatacaaaatcatatttttatttaaaataatgggctccgtatcttttgttttttttagcatcaaattttatacatatctattttaaaatattaaatttatcctaataattcagatatccgtttacacctaaagaaagcctcagatcgaagcagcagaacaaccagacgtacaatggggataaacattgccacgcaagagtccatgaagctcaaagcatcaagtacgaatcactataacaccaccctattttgggacaaacaggtccgggcagcagagacatggatctcaaattaaggagtcttcttaacggctgttccaaaaagaaaatgggacaaagattatgtctaagggcagattgttcttgaaagtattcaatgtgattgtccatgacagttagaacatgcgcctccgatttggaacaatctcagggctgttgttcctcatcatggcaacaaactcctggtaattaattcttccatcatgatctgtatctacttcagcaatgatttcttttatagttttgtcatctcccatatcatacttcttcaaagcttcttccaactcatctacggttatgtatccgctgtgatccttatcgaaatattcaaaagctttgagtatgtggtcttccttctccaatctattcaaatgcattgtggctgatataaactccgcataatcaatggtaccatttccatcaacatcagccgcctccatcaattgtttaatttctgattcagaaatttttgtaccaagttttggtaaaccagatcttagctcttcaagagtaattgtcccactgttatctgtatccagggatctgaacatttcttttaggcccataatctcttcatctgataagttctcagccacaaccttcaatgcaactttcttgagcttgttcattgccctgaactgtttcattctaccaatgacagtaatgtcaagtggcttatctggggcctctccatcctctctaatccatgggtggttcaaaatttcagcagcagtcaggcgttcttttgggtcttgtcgcagcatcttcttaaccaaatcctttgcaccattggatattgaaggccaagggtcagaagagaaatcgatgtgaccgcgcaagacagcatcaaatatgccatcctcattctctgcccaaaaaggaggaacaccagacagaaggatgtaaagaatgaccccagcactccatatgtcagcctctgccccatatttccgtttcagtacctcaggagcaacataatatgcacttcccacaagatccttaaacgtctccccgtgcttgaagaagacggagagaccgaagtccgtggccttgagcggggagtcctccttgttattgaggaacaggaagttctcgggcttgagatcccgatggaagacccccatggagtggcagctgtggacgacggcgacgatctcgcggcagagcgaggcggcggctcgctcggtgtagtggcccttggctatgatgcggtcgaagagctccccgccctcgcagagctccataacaaggttgaccgagtgcctgtcctcgtatgctccccggagctcgacgatgttgcggtggcccgtgaggtggtgcatgatctgcacctcccggcgcacgtcctcaatgtcgtcgcggtggacgagcttccgcgtggcgatggacttgcaggcgaagcgctgcccggtctccgagtgcgtgacgaggtaggtgaccccgaactggccccgcccgagctcgcggccgaaagtgtaggtcgcgcgcacgtcctccatgggccgccccagcacgcgccccaccgcccccacgtccgccgccggcttcggcttctgctgcgactgcggcggcgcctgctggtactgctgcgtctgcgtcggcggaggcggaggcggcggctggatctggggctggggcttcggcagggtcggcgtcgccggttgctgctcggcggcttggcggtggtggcgcgacgcacggttgcccatgtctgcttgccgggctggggcctggggtctgaggaaaggggagaaggtttccgcccccccggccgcggggtacc

SEQ ID NO: 19621 - DNA, 2058 bp, Zea mays
ttttttttttttttttgcgaagaccacaacacattagaacaattcacaagtggcaacactctgaaaaagcagagctccgagtacaatgggaataaacattgccacccatgagtccatgatgctccaaacatcgaagtacgagtcactataacaccacctattttggtacaaatatgtcccggctgcagagaaattgatctaaaaaaatattgagtccttacagttgttcccaaaagaaaatggggccaggattatgtctaagggtgcatattggtcttgaaagtattcaataaaattgtacatgacagttagaacatgcgtctccggtttggaacaatctcaggggtattgttcctcatcatggcaacaaactcctggtaattaattcttccatcatgatctgtatctacttcagcaatgatctcttttattgttttatcatctcccatatcatacttcttcagagcttcttccaactcatctactgttatgtacccgctatggtccttatcaaaatattcaaaagctttgagtatacggtcttccttctccaatctattcaaatgcattgtggctgatatgaactccgcgtaatcaatggtaccatttccatcaacatcagccgcctccatcaactgtttgatttctgattcagaaattttagtaccaagttttggtaaaccagatcttagctcttcaagagtaattgtcccactgttatcagtatccagggatctgaacatttcttttaggcccataatctcttcatctgataagttctctgccacaaccttcaatgcaactttcttgagcttgttcattgccctgaactgtttcattctactgatgaccgtaatgtcaagtggcttatctggggcctctccatcctctctaatccatgggtggttcaaaatttcagcagcagtcaggcgttcttttgggtcttgtcgcagcatcttcttaaccaaatcttttgcaccattagatattgaaggccaaggatcagaagagaaatcaatgtgactgtgcaagacagcatcaaatatgccatcctcattctctgcccaaaaaggaggaacaccagataaaaggatgtaaagaataaccccagcactccatatgtcagcctctgccccatagtgccgcttcaatacctcgggagcaacataatatgcacttcccacaagatccttaaacgtgtccccgggcttgaagaagacggagaggccgaagtccgtggccttgagcggggagtcctccttgttattgaggaacaggaagttctcgggcttgaggtcccggtggaggacccccatggagtggcagctgtggacgacggcgacgatctcccggcaaagcgcggcggcagcgcgctcggtgtagtggcccctggcaatgatgcggtcgaagagctccccgccctcgcagagctccatagcgaggttgaccgagcgcctgtcctcgtaggctccccggagctcgacgatgttccggtggccggtgaggtggtgcatgatctgcacctcccggcgcacgtcctcgatgtcgtcgcggtggacgagcttccgcgtggctatggacttgcaggcgaagcgctgcccagtctcccggtgcgtgacgaggtaggtgaccccgaactggccccgcccgagctcgcggccgaaggtgtaggtcgccttgacgtcctccatgggccgccccagcacgcgccccaccgccctcgcgtccgccgccggcttcggcttcggcggcggcggggcctgctggtactgctgcgtctgcgtcggcggcggcggcggctggatctggggcttgggaagggtcggcgtctctggctgctgctcggtggcgtggcggtggtggcgcgacgcacggttgcccatggctgcgtgccgaaagggggaggaggtggcctcgactgaagtggaaattgtatggagaacgagcgcggagcgcggcgcgttgatcacaagcgcgtgggtgggggcgcgttgggtgcggcaaggaacagaggctgcactgctgcagagctcccggccggcctcgaggtacccaatg

SEQ ID NO: 19622 - DNA, 1746 bp, Zea mays
acgcccgtaagagcaggaggactcagaaatggcaatcccagtgcgatcggctgccgcgccccgccgcctcgttccgtcgatacctccggcgagctctggacatgttcgcggcctggcgtgccccgaggagcgccccgtcgtcgttctctctgccatgggccaaaccaccaacaaccttctccttgctggagagaaggcagtagggtgtggagttatccatgtttctgaaatcgaagagtggaatatggtcaaaagcctacatatcaagacggtggatgaacttggacttccaagatctgtaatacaagacatgctagatgaactggagcaactattgaaaggtatcgctatgatgaaagagctgacgcctaggaccagtgactaccttgtttcatttggagaatgcatgtccaccaggattttttctgcttatttgaacaaaattcgtgtcaaggcacggcagtatgacgcatttgatattggtttcattacaactgatgaatttggtaatgcggatatcttagaagcaacctatcctgctgttgcgaagagacttcatggggactggatacaggatccagcgatacctgttgttactgggttccttgggaagggctggaaatctggtgctgtaactactttaggccgaggtggtagtgacttgactgctacaaccattggtaaagccttgggactgagagaaattcaggtatggaaagatgctgatggtgtacttacttgtgatccaaatatctacccacatgcaaagactgttccatacttaacatttgaagaggcccacaagaacttgcttattttggtgctcaggttttgcatccacaatcgatgagacctgctagagaaggtgatattccagttagggttaagaattcatacaaccctaaagctccaggcacccttattaccagacaaagagacatggataaggttgtactaactagcatagtgctcaagtcaaatgtcactatgttggacattgtgagcactcggatgcttggtcagtatggttttctggcaagggtatttgctatatttgaagatctatgtatatccgtggattgtgttgctaccagtgaagttagtgtttctgtgtcacttgatccatcaaagatctggagtagggaactgatacagcaggaacttgaccatgtagttgaagagcttgagaaaatagcaattgttcgtctacttcagcagagggcgataatttcacttatcggaaatgtggagcaatcgtctctcatactagaaaagacgggacgtgtgctgaggaaaagtggggttaatgttcagatgatctcgcaaggagcgtcaaaggttaacatgtcgctgatagtccatgatagcgatgcaaaggcactcgtagaagcccttcatcaggcgttctttgaagacgatgtcctatcacaagtcgaagcggagaacctactcgtgggctgatcaacgtaggctttgctgggtccaggcgtgttatctgttatagattcccactcgcctccatgaacggcatgggcattggatcattgatcatgttttgcttgaaacaagtatgtcttccaggttctcagccaatgactgcaaaactgtgtttctgttttagaactgtttgcagacaccccagtctgagctgcgagcaccgattgtcaacaagatggcaagcctgtgatataattccaactgtctctaatcaatatatataataaccattatcaatatctattaatt

SEQ ID NO: 19623 - DNA, 2996 bp, Zea mays
tcccccccccccccccccgaacttgccttggcgtttggagaactgttgaggagcttatggaccactgacggaaaaccagttccacctcattatttcaaggaaaaaattgcatgttttgctcctcagtttggtggctttaatcagcatgattcacaggaacttcttgcttttttactggatggtctccatgaagatcttaaccaggttaaatgtaaaccgtatgaagaagcaaaggatgcaagtggccgtcctgacgaagaagtagcagatgagtactggagcaaccatttagctcgaaatgactctgttatagttgatacatgccatgtaagtttaaatgcccctattctttaaactccactcttcctgaaatagtgacatatttatagttctttcgtgcttgtaaccttatatctgtcgattgatctcacagactagaaatatgttattattaaaacacttatggaagtgaccctattctattgtaaatacttttttgcagattctaaacactaatcaggggctgggattaaaacacttaattgatctatagtttttaccaattaagggagtgcataaccacataatatttaagattttctatttgagtaaacatagaagcatcttcattgagacattgcctattcattttattttttgtaatctgttgctacttgccactacgaggatgcaccttgctatttttgttgccacatggtgaaactatatattttatgcagtattagttcaatgtgaatccttttatgtgtatcagtgtatgttgttaaactcttctgattatcttttgcagggacagtacaaatctacattaacttgtcctacttgcagtaaaacatctgtcacctttgacccatttatgtacttatctttgcctgtaccttccacggcaaagagggtaatgactgtaacagttttcagcactgatggtagcagagaaccatgctcgtatgacgtcagtgtgccaaaatttgggactctgagtgatcttgttcaggctttaagcattgtttgcctacttggagatgatgagatcctgctggttacagaggtatggtttcccttcctcgttgccccctttgtttttttttgcaaattttcagagctattttaagcaagaaaagttatttagctctttcacttattgaaactgactatgcaggtctataataactgcatcatccgatacttggaggagccttcagattcagtttcattgctgagggatggagataaactagcagcataccgtctacccaaaagacatgagaaatccccccttgtggtttttacacaccaacattttgtccagtaagcacacccaaatttggtcagtgatgcaatccgccttcatgacattttgtgtattctgttaacattgtgtttacctgtcatttcattcaggcattctagtgatggtaatttaactccacaaatgagggagtttgaggccccacttttggcagcacttccagaggaaattagtggattatctcttcaggatatctacctaaagttgttgagtccatttcaactttccaacggggctagttcgcttaatgattgtatggagtctaatagtgactccgtcgatacgccttctgattcaggcagtatcaattttcagaacagccaattggaagatggccctgaaagcaaccactgtagtgctagtgaatgtgaagtaacaaaaggacctgatgatttatacgatggggtttctggttctaacaaggaagcacatatggacttcgaattttatttaaaaagtgaaaggggcgagggccagcaacagaagatagaaattaacgagctccatttattattggagacagcaccaagccggttgcatgtgaatgtccactggctacagaatgcttcaagaaaatatgccacctcaatgctgaacaatctacctgagatccacaagctcgagcttatcccgaaaggaactgaagattctgttgcactacatggttgtctggaagcctttctaaaagaggagccgttggggccggaggacatgtggtatgtgtaccctgcgctgacaagcggcttccgcttgccttgacggtttgcagagtagccttatctaaaatcgtcctttttttctctcaaacaaaatcattattgcgctcacactgcaagcgtcactgttggtttcatccattattgagtcccacttcatcctgtgcttgcttaccaggtattgcccgcgctgcaagaagcatcagcaagcgatgaagaaactggatctgtggaggctgcccgaggttctggtgatccacctcaaacggttctcctacacccagttcacaaggaacaagctggagacgttcgtcgacttccccaccgtcgatttggacctgtcgtcctacgtcgcggacaagagcgagcagccgagcagccattatcgcctgtacgctgttagcaaccactacggaaacatgggagggggccattacaccgccagcatctatgtgagtccctccacccgctccgttgaatcgttgtctgtgctgagtcctcagactgtctttggttccgttttgattcctcggttgacgatcaaggctggttgttggctggtaaggcgggttgctgacacgtttgccctttttctgtagcatgaggaagggaaggggtggtacaagttcgatgacgactgcgtgacccctatgagcgaggacagcataaagaccccggctgcctatgttctgttctacagacgagagtgactgactggggattgaagcgcatttttctgcaggtgggttttggtcggcaatccagagcagactgcctccctacacagtttgctgcttcaggcgtgtctgagttttctaacgtttcggcatttgaatctctcaagccatactgacgcctaccggtgatacaacaacattatgtacagattcatctgccaacaggagagagagagagagagagagagagagagagagagagagagagagagg

SEQ ID NO: 19624 - DNA, 1327 bp, Zea mays
aaggctcatgaaactttcgacccattggaggcccacgacctctccgtccgatccctaggcggcggatccttcctccaccaaacccgcacctgccgcaactgaatcgggtcagatcgggccatcggggaggcgagggagctcacgcggcgccatggacgaggaggagcacgaggtttacggccaggaaatcccggaggacggcgacatggacggcgctgacgttgatatggctgcctccggggatgacgcggcgaagctgcaggagctcgacgagatgaagcgcaggctgaaggagatggaggaggaagccgccgccctccgcgatatgcaggccaaggtcgccaaggagatgcaaggaggtgaccctagtgcatctacagctgaggcaaaggagcaggtggatgcccgttctgtgtatgttggaaatgtggattatgcttgcaccccagaagaagtgcaacagcatttccaagcttgtggaactgtcaacagggtcacaatcttgactgacaagtttggacagccaaaaggttttgcttatgttgaatttctggaacaggaaggtgttcaggaagctcttaacttgaatgaatctgaattgcatggtcgccagattaaggtcgccccaaagaggactaatgttcctgggatgaagcagcgtccaccacgtgggtataatccataccatggctacccttatagatcatacggggcaccgtatttccccccatatggttatgggagggctcctagattccgccgccctatgcgctacagaccttacttctgaagtacggggtagggtaatgaagttcaatgcaaaaccagcccatggtcactggtcagtcccgggaataatcaactgtatcgtttgcactgttgcggctcaatgctcctgtatcagctgccttttctgacctttgtttcaagtgccgccataagcgacggacatgttgtattggcttgtaatacaggacgtagtaagtgcacacactttctgtaagcgtgctttcccacttcccagggttactactgtttgcaatttctgtagttctttgggtcggtcggttaggacatgggagtggatcgttctatgcccatttgaggtagattagttatatgaagagaaagcttcgcatgcggggctgtcttgtttgcagattgccactacctcagtacggttccaggttcctcaaggtatccgctgagcatctgttctggtgtcggattccgagttcaggtcttgtaactaataaaaaacggaaattataatgtctctctttaccaaaaaaaaaaaaagcgggcaaatttgatccgctgttactgc

SEQ ID NO: 19625 - DNA, 3284 bp, Zea mays
  misc_feature (1595)..(1595): n is a, c, g, or t
ctttcctcaccaaacccacacctgcctcaactaatcgggtcagatcaggtcatcgggaaggccgccatggacgacgaggagcacgaggtttacggccaggagatccctgaggacggcgatatggacggcgctgacgttgatatggccgccgccggggacgacgcggcgaagcttcaggagcttgacgagatgaagcgcaagctgaaggagatggaggaggaggccgccgccctccgcgatatgcaggccaaggtcgccaaggagatgcaaggaggtgaccctagtatatctacagctgaggcgaaggagcaggtggatgcccggtctgtgtatgttggaaatgttgattatgcttgcaccccagaagaagtgcagcagcatttccaagcttgtggaactgtcaacagggtgacaatcttgactgacaagtttgggcagccaaaaggttttgcttatgttgaatttctggaacaagaagctgtccaggaagctctgaacttgaatgaatcggaattgcatggtcgacagattaaggttgcgccgaagaggactaatgtccctgggatgaagcagcgtccaccacgcgggtataatccctaccatggctacccttatagatcatatggagcaccgtacttccccccatacggttatgggagggctcctagattccgccgccctatgcgctacagaccttacttctgaagtacgtgcggggtaataatgttcaatgcaaaaccagccatggttagtggtcagtctcgggaataattaaacctactgctgtatcgtttgcgctgttcaatagttgacatcgttgcggttcaatgctcctttaccagctgccttttctgacctctgttctcgcataagcgacatgtagacacaggacgtagggttacaattgtttgcattttctgtcattcttgattctgatgaccctatacagcactcaccgaataagatgcagtgtcaagctctgggtaggtcggttaggacatgggagtggaccgttccttgcttatttgcgatagattagttatatgaagagaaatcatcgtgcactctcagattgctacctcagccctatggtagagctctcctaaatccagcgggagctctgctaaacaggtcacagaagtgatttaagaggccggaaggtgaaaaaggtagactcctttgattctgtgaaatgattctccacaatcaattgtatctattagagaatgaggttttatagagaattagaatcagctctacctgttacgtacactgttaagtcagcagcgtccacaatcctcaaacgtctctgctgagcatcagttccggtgtcggattctgaggtaatcaaaagctgaactaatagacagtctctctctaccagactattttaccgcgggcaaatctggtccgtcgttagactatcttaacgactatctccagcagactctcactctctatttcaatcttcaccatacaaataatgtcatctaactctctatttcaatcttccccatacaaacaatgtcatctaccgtatgaagcaatattttgcatccacgtttacaagattcgctagagttggccttagaccntcttcaacggttcccgctgccgctcccacacgccaaatacaacggctacagtacacacgatataggttcaacgttttactctagcgggcgctctacacgaaggttcccctagcaagcttctctctccccctctaaacactgttcacgtgggtctacttccaattattagtagatgaaaaattgataggaggtgaaaattaggtataaaaatgatattttatggttgtagtgggatataagggaaggatttaggggggaaccgctgtacagggtggagatatagggggaagagaacgctgacgtggcacgtgagtaggatatatgaggagaaatttagaggtaaccgttgaacacagtcttaccgcaaggccgacataaaagcctctgaaatattctaccatcacggcattgcccccacccccgcggacccgccccttcgcccatcattccaacacgaagaatactggcagacggcctctgattgccctcatgatgctgctgatgccaaagagtgttacagtagagcacagcggtggctacaggggcagcagcaacgtgataaggctggccgctggcaggcggcagccctactcctacatgctattgtcaaccacaagtcccaacagagaatctcgcaaagtttaataaagctaggggacaaaggcgtggcaggtgaggaggagagaagagcatggcttggaatagcaagagcacagtcactatactacatcctactccctcagaatcctcattaacgatcctgatgccggtggccaattgtggatctcaaaggagtttatgcttttgagaccgcactaatcaagaaagatcacgggcactggccggcccacagccacacagcaaagcgtagtgctgtacaaaagctgggggtatctgccaaaaatgtgtgtatgtagcacagtagtacagccgtcttttccattcagatcaaagtttcatgcctttttggttttcactggcgcctctagctcttcggctcgagaattgaaatggagaggaaaggaaaatgtccgattatatataagatagatagatgttcatgtccgtatacatgaccctttcttcatttgtttgtgtggatcttcgagccgttgcaaaagaatcattcctgatacacatgttcctagcggcgtgatctcaaataggcaaatcctggccaagcggcctctgtcaggattagtgccggtacggatcacacccagaaagcgtcaaaatacgagcacgccagatgcatgtccgtccattcccattcagacctgaccatacctcaaggtagatgaaaaataaaataaaaaatagaccgcacctcccccctgcggccctgccctgccctgcccgcatgggaattgggagaaggaaaaaaaaactgtcagaatcttagcgtgcagtgcagcaagcagcggcgggcagcgccaaggcttgcagaggcgcagcgagagggcgggggcggggctaacttgtcttgcaagagacaaccggcttgccagatgccagcggacggacgccggccaggcgggtagggctaaaacacccgtcgattcccattccccaccgattctgatttctgaggctggtgacaatgcaggctatagcgaggacgatagcgcccagcaggaggcgagagcggggctggaggcgggcgagagcgacccggcgggcgttactgcc

SEQ ID NO: 19626 - DNA, 1233 bp, Zea mays
agtcaactaccaattttctcgctcagacatacagaattacagagtcgaagtgcgctgtggcctgtggactctcccctccccaactccggcgaagggagcagaaacgttggcgtgttggttgggtggcgtcggcatggacgaggcaacgaagaagaatgtggaggctacggtgctggagatcctccggggctccgatatggagtccgtgacggagtacaaggtccgcgccgctgccagcgaccgcctcggcatcgacctctccatacccgaccgcaagctcttcgtccgcggcgtcgttgaggaatacctactttcactctcctccaaggaggaggcgaaggcggaggaggagggcgtcactggcagggagagcaagggcaaggaacacgaagaggaggacgaagaggatgacgatgaggaggaggatgaaggtaagggtggcgggaagagagagtacgatgaccaaggtgaccttatcctgtgccgcctttcgagcaagaggagggtgactttatcggagtttaagggcaggtcgttggtgtccatccgcgagttctacgtgaaggacggcaaggagatgccctccgccaaaggtatcagtatgactttggagcagtgggaagcattttgcaatgctgtacctgcaatagaggatgccatcaaaaagcttgaagattcagactgaactggttttaagagcctcttcttatgcccgtgtcaaatgaaaaagcctgggaagcatttcgcaatgctgtatctgcaatagatgatgcatgaaaaagcttgaagattcagacagaactggtttaggagcctcttattttgcctgtatcaaataaaaaagcctatttctgacccttaacgagggccatatatgtgtcttgcaagagctaagttctgtaaaagatttctacatgtaccatgtgtaggagttaggatagagtgatagacgtactgctgcatacagttcggaatatttgctagtaacaagtaatctaccattaggtggcctggagttcacatgctatgctatgtgatgatcggggatgtgtcctagcaatagcaagctcagcaccctccttctcccccctttttttttctgagaatatagggttagtttgacaacctcatttcctcagggatttctattttctcaaggagattcttttttttaatagagttgccttgccaaactagcctttacatgtttaaaaaaaaaaaacccccaacgcc

SEQ ID NO: 19627 - DNA, 716 bp, Zea mays
agcagagtccaggtgcgtcagccaggagtcaggactctcaactccggcgaagggagcagaaccgtttgtggcagttgggcggcgtcggcatggacgaggctacgaagaaggtggaggctacggtgctggagatcccgcgagggtctgatatggagtccgtaacggagaacaaggaggaggcgaaggcggcggaggagggcgacgctggcagggagagcaaggacaaggaacggaaggaagatgaggaggaggatgaaggtaagggtggcgggaagagagagtacggcgaccaaggggaccttatcctgtgccgcctgtcgagcaagaggagggtgactctgtcggagttcaagggcaggtcgctggtgtccatccgagagttctacgtgaaggacggcaaggagatgccctccgccaaaggtattagtatgacaatggagcagtgggaagcattttgcaatgctgcacctgcgatagaggatgccatcaaaaagcttgaagattcagactgaggacttgttttaggaggctcttcttttggcagggagctggacgtgatgcaatatatatatcgctgtagtaaggctgtctgaattacaaacgactttggtgatgttccagcggtcgcacatgggctttagggtggtgtatggctcctcggctctacgttttttagccatgttctacgaagctctactccataaaaaagtcagatc

SEQ ID NO: 19628 - DNA, 3191 bp, Zea mays
gagaacaccgtggtcaccaccttcttcgctcctgtccccactcttcaaaccccacccccaacacccatgggcaggcgagctgcgccacgatggcgtcgatgccgtcctccgacatgatgttctcacctaggatgaggcacttgaacacaagctcgaagaggtgggacgacttgttgagcgctgggtcgaagaatatcccaacgaggaatggtcgcagaaggaactggtccacgatggaggacgagaagccgagctgcacccggtgctcccccttggtcgtctctggcgaagatgacatcttccgaggtagcagtcgcgcggaggcgcgtgagctcaacaaggaacaaggcaggaagcagaataggtcggagagcaggtagaatggctccacggcgttggcgaagacgagcacgccgggggtagaacggtcggagcttgagcgcggggaagtcgaggaggtgccagcactccaggtacacggtgagaaagaaactatcaaggtactgaatggtgtcttggtacagatatcattgatcttatgtgatgctttagtgaatgacacatattgaatcaaagcgatgactgttagcagccagagaagttgggagattgtagagccaaggttacttggaatcggagaggacgaagatgcactgcagcatttttattcccttcgccattcgacgaggtggccggcggactgggggagacaacgacgatgggtagacgaggcaaggtagaagtgaatgaagggagaaggccattgtttagaacaaatgagatgatgttggccaaaatgtagccgtatttttttgtttgtatcctaggatgcaagtagaaacaaaaaataggtgatggcgtgtggcccaatcctatttctgctcttggatcccaactgtgaacaatattcagtagacacaatgttcattgttgtttttgtttgaagttccacatttatagtgcattggtcttgtattagtttcgtacaacttaaatctagagaacaaaaactttgaaaatttagatcccagttcatcagttactccctttgtcccaaataataattcattttaggaatttaatggattctggttctgtacagcgtggcagcccccgaccggaggcctccggcatggcgtccctggccttacgtgccatcccagtcgtgcgcacatatcaatgtttgtgcctttaccttgaatagctgagttaacctcttttctttggccagtgtgttgttagctggggagggcccgggcttttgtatggcgccatttgttttccggactgaatgcttggaattgcatataggtatttagtgctggaaactgtcctgttggaccaatgttcttatttcacacagtctccctacacaagattactggtactgtactagagttttgtgctttattgtcttatgctatcttggtcaatgccttgtttactcttgctttggaattccttaaccgtaagcatgaaaaatgcatttataattctaaatccttctttagtaaggtgccttttgacttctcataattaaactgtaactaattttgaagctctacggaagcctaagcaaatgttccatccaattctgaagaaacaatgatgcattgactgacagtatatcagatggacatgaaattgcaggtgattttcattttcctaacaaccatgattatactataagatttttctataatgcgttcaaaaaagatatgattgtatcaaaaaaaggtatgttctaacatctttcatggtacatattggaacttgcttattcttgctgaacattatatgcatatgaagtttaatattactcactccattaaaacatataaggtccattttaatttattcaagtccaacattatgtgtatgtctatatatattagtagcatatgaataaaatacaaaacaatcaacacattaaaactgtataaccagttgatatttaaaagctctcatacacaatatggactatataaattcatacacaatatgagaaataagggccaaatattaactttgatagtctaggcaaaataaaatataacttatactttgagtggtagaaagtaattatttaagagtaaataaattctaataattatgtttatatcatctattgatttgtctaccttcattaattacagtgtgtactttttttgctaagctaaaattttcttgtcaacatgaagataaagtagtttacttgattgaagagttaaattatttttgaattgcataaaataatagcagaaattatgaagtcaaagggcagactaaaactgaaatcaacaagggaatgatattaccatttcaaccactaacaatgatgtttcacaaaattaccacgcgtccgctctttttaatctaggggcaagtggttattttagataatcacactttgagctattttgcaggaatttatcaaagaggttatggctctggtagagcttgatcagctgagatatgcattagtagggaagcagggttctactgggttatcaacagagcaaatgaagggccttactaatttttcaaattctattgcttattgtagcagattgccagagttaccttacttttttcttgtaaaagaactattttgtttgttactgaatctcaatttaggggggaatacttccgcaactatctgcccatgatatcattaaatgtttttctaagatacttgttctccacacaaggccctttttatctgatactaatattgtatcatccaatgcaggtaatttcaatcttttggaggatcgtgcttttcttttggattttgtcttcaactatccttgtaaaggttgtgttcaggttgagctatcctgaattatttggagctcatggttctctttttctcttctttttcagcattaacctttagatttgtgtaatggatttctgcaacatcaagattgatactggcaactccattgataagactgcatgctcaaataaagcttggaccatgaagtgagatcaagctcatggacaagtagcgatcatcttttatccaatcttagtgtattcccaatagagcacacgtgaagaaaatattttgtttgactactgtaaatgtttaaggcaatgaaaattacaaatatgaaatagttgtggtatatgcatgttattcaaaggagacttcgtctgcaggtcgaataaagaggaaccggggt

SEQ ID NO: 19629 - DNA, 2420 bp, Zea mays
ctggatttggaatcgtgcaggtcatcaaacgacagtacatttctaggatacgtggacatattcaatggctacggacaggccctgctctaatatttctcatagagaaatatgggacaacgcaaagaaagataaaagggtcaccccttttctctaactctgtgggctggttgatcgaaatcgggcctcgtgcgtacgttggggtcgcatgggccaagagcccatcaatcggaactatccccgcccccgggagcccaatgctaacccctcactcctaagcgccgtcgcgatctgctgcggtggccgctgccggcgccgtccatccccaccgcacaccaccgcctccaccacgccaccgactccgcctctcgctcccccctcgccgcgccgcccgaacgccacgatgcgtcacctcctcctctcccgcttcctccgccgcggtggcggcagcggcatccccaacggccactaccaccacctccccctcctccgcgccctctcctcctccccctccccggtctcctcggacgcagagctccgcaagtacgcgggctacgcgctgcttcttctcggctgcggcgccgcgacctactactccttcccgttccccgccgacgcgctgcacaagaaggccgtgccattccggtacgcgccgctgccggaggacctccacgccgtctccaactggagcggcacgcacgaggtccacgcccgcgtcctgctccagccggactcgctcccggccctcgagggcgcgctcgccgccgcgcacaaggagcgccgcaagctcaggcccctcggctccggcctgtcccccaatgggatcgcgctctcccgcgctgggatggtcaacctcgcgctcatggacaaggtgctcgacgtcgacgccaagaagaagaccgtcacggtgcaggctgggatacgtgtcgcggagctcgtagacgcgcttcgggaacatggcctcacgctgcagaactttgcgtccattcgggagcagcaggtcggagggttcactcaggttggtgcccatggcactggtgcaacattacctcctgttgatgagcaagtcattagcatgaaactggttacccctgccaaagggacaatagagctgtcgagggagaaggatcctgagttgttttatcttgctcgctgtggacttggtggcctaggtgttgttgcagaagttacccttcagtgcgtagaaagacaccagcttgtggaacacacatttgtttccaatgcagatgaagtcaagaaaaaccacaagaagtggctatccgaaaacaaacatattaagtacttgtggattccatatactgacacggttgttgttgtccaatgcaatcctccctcaaagtggataaccccaaagttggcatcaaaatatggaaaagatgaagctttacagcatgttcgggacctttatcgcgagtcactgaaaaaatatagaactgaaacagaaagtaaagacccagaaatagatacactttcatttactgagctgagggacaagctgcttgcccttgatcctctggataaagatcatgtggtgaaaatcaataaagcggaagctgagtattggaagaagtcagaagggtatcgcatgggctggagtgatgaaatactgggcttcgattgtggtgggcagcagtgggtttctgaaaactgcttccccaccggaaccctagcaaagccaagtatgaaggatcttgattatatagataagctgctgcagttgattgaaaaggaggagatacccgcacctggacctattgagcagcgttggactgcccgcagcaagagcccgatgagcccggcatcaagctctgaagaagatgatgtattttcatgggttggtattataatgtatctgccaacatctgatgctcgccaaaggaaggaaatcacagaggagttcttcagttacaggagcctggcgcgaagtctctgggatgattattccgcctatgaacactgggccaagatcgaggttccaaaagacaaggacgaacttgccgaactccaggcccggctgaggaagcgtttccctgtcgatgcatataacaaggcacgtatggagctggaccccaacaaggtgctctcaaacgccaagttggagaagatgttcccagtgttggagcctgctcaccagacaaagtaatacgtgttgaagagcgcagagcaagggcacgtacgcagaacttggttgcaggaggcttaacccatacacatttgtagcactgttagttcctgtcatgattctgggaccctaccctggctgtcaaatgtgatggcgattaagatttgtcactgaaataaagttttttttgaagttcgaaatggaacccttttgaacgcgagatgtgctgccagaaggagatgagccttttgaactctctcccaaagaaaaatgagcattc

SEQ ID NO: 19630 - DNA, 6902 bp, Zea mays
  misc_feature (2968)..(2968): n is a, c, g, or t
  misc_feature (4817)..(4817): n is a, c, g, or t
gacacaagtacaacgataatagtcatatcaatgacaactggagctaatttttacaaggccacaggaatgccacaggaatctcagctactgctgacagatgacaagttctgcgacttgtctaaaaggttcctgcaagcactcttttcccttgcatttttttccttttcgtttcttgagggagacaaaaaaaaggatatgaagaaaaaatgaaataaataagttaacaatttgcttaagctagaataaagttcatatccttgaaagaggatggatatcatctccagaggagcaggataaggtctctgaatcccttccctctttctacaaacattgaactcataaagcagaggagcaccgtccgaataaagatgaaagtaaaaaaaaaaacaggtgaagacttgtctcttgcagcatgatcaggaaggatctgcacgagtctttgagctcccaagggtgagctccagctcatgctcgtccgaggcgcactcctcgtgtatccgttccccctcccatgccttcacgagaccaggcgactcgttgttgccgttgctgctgctcccgaaggcgaagtcatctggggcaccatcagccatctggacatcgtgatggatcggcgcaccgcccattacaggagagcacgttccactctgcccaggggtgcacattcttgaggtgctgacgatggtctccttgaagataccaaacggattcggagccacaaggctgtaagttggagacgaagggccagcagacgaaatctggaacccggctagccacgccgggtccggagcaacctggtgcccagggctcggcggctgggagttgggaagagacgcgtagttcgccccagcccacggtggctgaacactcgggttctcccagtcagtcttgatgcgaggcgtgcgggttggagagctggatggaggcgtcaccggcgcgctgatggaaccgccgttgaagtagaggtggtgaagctgcgggaacttggaggaggaggcgaacgaggagctcgacgagaggttctttagccacgggataagggagctgccctcgacgcctcccatgaagttgctcccgccaagagtaatgtgggaggaggacccagagcttgggaacgaggaggatgccgcgcttgggttgtatgaggctcgcggacttggttgatatgaagagcaggggcttggtgatgcagacctcccaattggatctggacgctctgttgccagaggtttacatcccttgcggtaggtggtgccgtcgggctcgacggtccagccggcctcgttgcagagcgccttgagcacctcgttgttgtcgcagtgcttggggaggttgtagttgccgtaggccctgaggccggcgaagatcttggcggcgatcgcgcggcgccggcgctccctgcggcggttgttctcgcgctccctccacgtgggcaccctggtgcccccgatcccggccgcggctcccccggcgccgctcgtcatcggcggcgcgccggatctcgcggatctgcacccctcccccacggctgcaagcctgcaacccccgcggtccctgttcccttgcggacgctgctcacctcctcgcttgctttgatttgtttattatttgaggggggtggaatttgggggaaggagcaggaggaggaggaggaacaaccgaacaagtagtagtcgtctgaacgcagccgccgctgctctgctgtggctacagctacgctgctgctgtggctgccgctaggttgctcctccctccttcctattgtaacgctggctgggggagtgagtgaggagcgaggctggccgtggccgaggctggcggagctgtgctgatgccgccggccaagctccaggagttacccggctcactcttttaccagcggcccccggtggaagcgccaaactaccaggggcagaagcggtattcccctcagcccgggcaggggaacggttaaaaaacgtgagggaccagcttttgcaaagtacgacgtcgctccctgacgcgcggggcccatgcgccacggcggtttcgtggtcaaacgggatgagtggtggtggggggcctcgacagccgccgtctcgtcagagcgcaatcatcacgcccaagcgggtggttcgcgcgagccggaccggcggaccgcggccgagctcacccgggggccgggacggtggcgtggctttggcgcgtgccagaggagggaccccgcgcggcgggtgagtgtgggaaacggcctcgggatccgcggcgggcgggaggcctacggcacgttgctgctcacgctcgccacgtaacgacgccgctgtggcctgggggatacactcccaactcccaagccctgactccagcggcgctgcgcctgccggtggccgctcggtcgccttgtttgcaccgcatcgtttgctcccgtagtcccgtgtccgtcttttgctcgcgcgtacgttcgcccggctttgccgggtgtgtttccgggcgtttcgtgcgtgaatccgggggccgcggcggcagcggccagctcgatgatgcatgtgtgtggtacattgtctagcgtgtgcatcgcgtactgctacgagtatataaataaaactttcttcccggatttgcgttaccaaaaaaaaaagacacggtggcctcactcgatagctagcgctagcctttgactttttgatggaagcatctgcgtcagcgtgacggtgaatgtactcctcggatgacgttttcttctatctccatggttttttagatatttgtctaaggaaacgatgatttttgtgtgcatcacgttacactagtcgatttagtgggtgtttaatttttatggactatttttagttactatattttattttattttagtttctatttttatggcaagatttttctcctgctacgtaggtcctactcgttagtcgttaatgacgggtaaaaagtgtggcaagattatcttagcgcgtgaaaaattgtggcccanaatttaaacgcctaaccttaaacaccttagacaagtgtggcataaaattctgtggcaatttttgacaccataggtatacaaccaaatagctttctagaggaatttttggcaaaaaattgcgcaatttttttggcacataggtatagattcgtcgttgcatatctcgcaaaatgcaatgtgtcgcccgcgggtgtctgtgtatacggcaaagctcggcgtcaaacttgtctgccactttgcacacggtcttgcatgcccgctactttgccacatatatttttttattttcaacaacttttattttaaaatagctccacttttaaattttttatgtttgttactgttttgttgcttaaacggatttgggatttggtgcggcaaaatcacgttgtcgcattacattagggctgaaaaataagttccaggcttgaaagccggctcgagctcacgagcctcgaacgagccaagcctgttgttttagctcattttcgcagcgagccgagccggctcgttccagctcatgagcctgttttttagtctttgatgatgaatatattatagtttataatttaaattactcataatattgaatgacgattctatattttaaatttatataatgttaattcactaaataatgcaataataagtattaggatatggctcgtgagccgagcctctttctccagctcgcggaatggacgagccgagccaagcttttcccatccctatattacatgtacacaacatgaaacagacaaaagtttgatggtcagcttatgtctgagccaatggatataggcttatttccgagtgtatgcagcgtccattagagcagaccatcaaacataagtttatgttcgacggcttagaaccttatcgtcggaagttactgaatatatggaacggcattgtggaggaaataaatgaagagaaagttgactgttgccgggagtgcattgtggaaaaactaaatgacgaggaagctgactcatgccgttaaaaataaagtctaaactatcggaataaagtctaatccatcgaaaataatatatgcccgacaacataaggcttatttctgacattaaaaatatatcgacgtatcaacgcctgctacgttaggtggtgattgttacgtgataaaccttgtcgtacaaatgtactccgtcagttccaaaatatagagctcttttggaacaaaggaaaattttctgaatcctacactttttctgtgtttttaactaattcctatgaaattcctataaaattcatgtgttcctttctagccctctttttccatcagaataatgataaatgtagatacacatatacatgttaattaataaatatatgtttaatctaaaattaattatattacctctgttcttgaatatttatcgttatctagtttatttttgaactaaaatgcgataaataaaaaaagaacagaagaagtgttaggtgtggagaataatcatgacgtttaggaaaaaaatcatttgtttccaaatacgacattgtatggagataatttttatatgaaaattatatatctcggttagatatgtaactttctagttttaagttttttatgaccattgagatgctcgaaagactaatataacgtttttagcggcataataatcgcgtacaagcatatgttgatcatagaaaaacaatgtttttcttatacaatgccaaatggagatatttttatatgaacgttgtaactcttaatggcatcgaaaactttataaacaaaatatgtacctctcggttgaggccattaaaaatgctaaaacaatataaattttagcaatatattaattaattacgtatgaggtcttgncacatcacaaatatcgtgtgtttctttaatctttacggtgacaaatgaggagagcttttgcaacaaaactatagctatcgatgagatctacaacttttgagttagttaaaatgttaaaaataataatacaaattttatatgatgcatattaatagtgtaccacacgacacataagtggttcatgggtgaatcagtactaggggcattttaacgtttttaacagacatgctctctctcctaaatgcagaaaaaagagttttaaattgatatgaagccctatacataaatacatattttaaggtgttcactaggataaagcaagttttgtagtgtgttatccataaaatattttttgtgtgcttaagacaaaaatccctttttttacattttgaaatacatatttttgtttatgtattggactgtaacccgatcatatttgttttgctagaaccggtacgaaatatttctcccttttttgtttggtgccagctcgaagtgtatatataagtaccggccagtgtcttgaaatggtgttgattacttaatattattagtaccggtttggagacacatggtggtactaaaggcacaacccgccgcacttcaaccgccgtagttgtggcggtcaatttgaccgccgccaagttacacgcggtgtgacggtcgaggcgccacaccaaacaggccttaaatgtcttacacgagaaagcgcgaaagttaagacgctggagccggtaccggttcaaaagcaaccggtattgatgttcttggttggaagcccggttcaatacaagtggctcagttggatctgaatgttgatggactatattgattctatcacgctaggtgatggatagttggcttgatgccatgcatggaccggagtttggtgagcgacgacgcgaggtataattgccgaagcatgttcatagcaccaggtcgtgagctcgacgattgactgccctgtctgcgcatggaaacatcgttttcgtgccgtggtccagtgctctcgctccgatcccttgagacgcgccaagccatggaacaatgaacatggcatgcaatgccgttcgtctctctatctcagggtcagccggtcagggcacaccaggggccggccggtggtgggtcgtcttgtgaggatgtgccgtgaccattcctcttttttttttctctgttgctgactgctgccgtcggcttcatctggtaggtgaggtcgtcgcacacagcaggcagcaggtgaggaacagatcacgaggggggatggagcgaaagggagggaggagggaggacagggcgtgcctctctctacgtacggtatcgacctgctgggtgtggcagcacactactcgtgagtacagtcgtcactgtcacactgttgcctttatatattcctagccggtagctcatcacgcttgaaagacgcatgcatgcatgcatggcacagttagtttgctctctgtgttcgtaattaatttgcatttgctcttgcctgatcaaatcaaaagcgatcgataacctatacacatcaaatggttccgaaatgtacgtacgtgctatgcccaaagtattttacgatgatatacggtgcatgcatcgcatactgtaatgcattatacggatggatggcaatggcatccaccacacaatagcatatccatggatcttttatagctaggtacccgcccgcccccaatcaatcatgaccctgagatagtagtggtggctaccgcaacgcaacaaggccagcaggcatagatggagcgagcatgcatgcagcacatcatcatttgcactccacatgttgggctactacctagagcgcacatgcagggcggtagcaccagcagccagaggcagccacaaaaggatctggtgccggtcaaacatacgggccagcaactgaaacacaagacatatatggcaactgataataatatactagtgagcttgcaaaatggtgcgtcgacatgacagtgcatagcctgcaataagtaattaaggtgtgcgttgctggtgccggcgcggcaagccaccaaaacttgcccgactaccccggccacttgtgctgagccaggaaggacc

SEQ ID NO: 19631 - DNA, 4568 bp, Zea mays
cgcccgcggacttggttggtacgaggaacatgggcttggtgacacggagcaaccgatgggatccatgcgttccatgggcttgcttccctgtgggagaaaaaataagacatggttagttgttgtgtcactacaagcattccattaaaatggacaaactaacaacagaactaatattccagaactactagcggtaaatccatgactctgctaatcatcagctatgtccattgtgtgacagagaaaccaaaaggctctttgtgcaggtcgaacaacatagttgagaaaggccaatactagtaatatctatgatgacaaagtagtgcccaaaacagttcagttaaccaccacataagcaacagcttgtgcaaggctcactctgcaaatcaaatatttttcagtctccttagctggaagagcatcaatcagtacacaagtgccaagcaagtaagatatactcgaaactatgcctcaggacagtccacacacgacacaacctagtgagtagcgacatgacttagaccctaacaggtaatgaactgaaccggtaccaaaactaaattgaacacatctttgcttatccaatccaatgcgcgaaacagcgttgcaggaccaacatcgaaatgctggagaagcagggccagctggagggtcggagcgcaagcagaactggatgcccaatcaatccatgccagccagcctccttaccaatccccggagaatctcgcgagcaccatctccggcgggagtctgaagcttggtggaggggattctccacggacgcgtcaatcactccacccaccccacaccacccgtgcgcggtccagtcgtccagactggcatcccgtaccttttgcgcatcgtccacgtgcgacacccaacccaacccacccacccatcaaaaaaatggaggagaaaaaaaaaccctgcaagctagagccagctagctgcacacagttcacacaccaccatcgtacaacaggcaaccaacccacggcgcacgcagagatgcacacgcttcgggatcgatggagggcggatcgagaggagggaggtcgcgaatcggcggaagctgcggctcggggaccgcgggaaggtacgagatctggcggcgcggggcgcagcggggcccccgatggcatccatgcgttccatgggcttgcttccctggcggtaggtggtgccgtcgggctcgacgacccagccggcctcgttgcagagcgccttgagcacctcgttgttgtcgcagtgcttgggcagcttgtagccgccgtgcgcgcggaggccggcgaagatcttggcggcgatcgcgcggcggcggcgctcccggcgcttgttgttctcgcgctccctccacgtgggcatccggccccccgcgccagccgcgcccaggcccccgccgccgccgctcgccatgggccgaccgcgcgagcagcgctcgcagctcggctcgcgtggggaggaggggatgggagtccggctgactgggtccgggtcgccgcgcgcgctcgtctgggtggggagcggaggggaggggaggagaggaggagcgggcgagcgaaggaggtgtggatgttggggtgggcgggtggagaagcctggggcgagaagagaccacacggaaaggcaacacgccgcgcgaggcgagcgagggagacgggggtgtgggggtgggtggggaactgggggcgaggggagcagtggcgtgagccttgaaaggctctctctccggcccgtgtgggaggcagacgacaatacccctggacttgggcatgtatttccgcggctgccgctgccagcgcgcttgcttggccgtgcggtgcggggaaggaggggcgcggcaggcgtgccgcctgaagcgagcgatgccctcgggtcccgcgccgtggggtcacccagggccgggggcagaatggggaaaagcggccctaccagacagcggcaggccacgaagcgtgtctccgccgcgcgcgcgcgcggggctcggtccacgtcgagcggcgctgcacgtgggcgccagtgggttgtggggcccacatggcggccggagggaccgcgcggtgtgggaagtagtagtacgaccgagctggcccaccgccgggagaggggggggtacacgtgattgggcccaccgttcgcttttacggatcacgcctttattttcttcctttttctgtcacttgctaaaaatatttgtttgttctagtaacctccccgttctaacgtttttataatttttttacacgagaatttataagaggtaaaaaagtataatacacagaaaacaagaaagagagataaaaaaaataaagataggatgtattaaatatttatatcagttaagtaaaatattctttaaaagtgataatgcttattacgttgaaataaaatttaaattcaagaagatgaacatttttatgcgggggtgtaggtacatttctatctcacacagaccccagccgcccacgtacagtattttaataaaaaaatataatcccgtctcggcgggcgggcaaggtaggcaggaggcagcggcggccgcaccgcaccgcacagcacgcctgaacgaacagcagtcgtgcgttgcggtgctggacggagcgcgagggcgaggcccctctggcggtcgacacgtggggggcgtgcgggtcccggcgagcagggacggccgcagaggccgagcgtgggccttgtgcttgtgcgcgtgggaacgggcgctaggcagggtctcctcgcgtctagaacggcgtgagcggcgattttcttcttctactactacgcgcaccgcacccaaggcaacgtggaatgtcacgacggtcagtggcggtgtttgtttttatagtacgtacaatggtccgaaaacaaaatctggaatccctgagttcttgacgcaggcaggggggttgggttgggtttggagtggagtggggcccccagtagagtacgtgcgtgtacgtacgtacgcacgcacgcgcactgtgcccctgtcgcggaacaggcagcgcggcgctgctgggctgggtatctccctcgtcagcgtgggcgggacccactcgggcactccactccactccgctccaagcgcgggtgggtgggtgggtgacgactgacgccaccaccacgccggaaggggacaaacgcggctacgcgcgtgcggagccggagccggggccgggggcgctgggaaatggcactgtccacaccacgccacagtgtggccgtctgagtgaggcagcggcagcaccgcacagcatgcacgtgagcggcgggggccgtccccgtcccatcgcctccgttccggtgcaggcgtccagccggcgcacggagccaggcggacgccgcggcagcattgcagcagactagcaggccactgctgctgtgtgcgtgctgccaccaccacgtgatcacggaacccgggggggggggggggcacgtggtcctcatcctctgcggctcgcccttcctgtggcctgaggctgagagagaccgacgagtgggcgtggcgctccctcccctgcggctgcggccccggccccgcctgggcctgactgccagtgctgccactgcccactgctatggaatcatgtgacgccgtatttgtgtcacgccggtcatgtcactgccctcccctgttccgccagtacgtgcagccaccgcccagcgacgagatgccctcgctcgctcgctcgaccacagtgcgctgcgaagcgcactgacgggagcaggtctgctggagccgcaccattgccaccgcagcagaggagcaggcgagcagcgcgctgtccatccccagcagaatcgcaggagtaccccctccatccctatctcatccactgttttaagatccacccaatacattacgaatataacaaacccaagtcaaggtaacacaggtcagatccggacagtagttaaagtttggggggtttttttatcgtacctgcaggtggctaaacaacgtcacgtgcagatcagactgatagctggacgacttgctggggggcctccgaaccgcggtggtgaaagaaacgcaggcttctgcactggcgcgtgcaaatcaatcacccatttcgacttctgacacgagtaaactcacacgaggaaacatcgtatctaatgtccgttggatttaatctatatcagcttatattacttttacaatgtttttgtgtctgtatgaattgaagtatgcaataaatcaaagtgattcctcgggaaaaaaaaaaggtttctgcaaaaagcaatgcgttccaagtgggtcccaagactcactcctactacagtagcccgtcaacgaccttgaggtttatgtcatcaaactgttccgaccttgaggtcgcccgtcaacgaccagagttcctgtacatcgttaggcgattcaatgcgggtatagcgagactgtcggcacatgaagcgaacatgggacctgatgatgcttatccgagattgctgggcctgggcgttagctgtttattgccaggaatgagtcactaagtaaaaactccaagttaaaaaagtgttgcatgtatctcttgtttattttactaggtgagtgaccgtgcgttgcaacg

SEQ ID NO: 19632 - DNA, 3809 bp, Zea mays
gtataaattctttttttgttttgcttacatcttgattttttataattagccccctaaatacccctcgtttaattagattttacatgccttaatactccaattatgtgaatccatacacataatttacgagcaatacatagcattgcagtttgcacatctcatgcaaaacaaataagccacggttacatcgaatgcgccgcacacaaattaggaactctgcccctcacgaaaatttgcaaaattttacctccgcatctgcgataggttttgactatttatctataccagtactagtactacatagctcaatgtgctcctacatctgtttggaacctcgagcaacaacaaatacgagtgctggacaccaacaacgtaaagaattcctatttgcttggctttcatgacacgagctgaactttcttgccgtccacattgaatttcctgcttccttgaagctttttcttcaaaaacaacagggcttcgcgtctaccagagaagctggaaaatacaacatttgagtgttcctcaacggcgaccttaagatccttcaatttcattgactgagatggggcctgacgaagtattcttttgcaaagtttcttgaccttggttttgggtctagcatccacaagcaattctttgtctgcattcttatctgtgtctattgattcagaagcactgatatgttcttcctcatcgccattctcttcgatttctgaatactcatcgggctgggctgaattatcatcatcactatcaacaaacgaagttttgtttcccttccaacgttggccagcaactttcattggcaggcctttgatgccaagaccctgctttccagaagtagctttatcctgaacaagattgtacaaattttcttgatcttcctctgcaaatgtctggcggacattagcaggatctttttgtgaagatttatttttacgggattttgctcctagaaaccctcctgataaaaatccaaacttgtgcccccaccagttcacatcatcagcttgggatactgcatccggacagatgatgggatcaggttcatccaagcatgtcggttcaagtttctgatccactttggaattatcttcatttttgcgtacgagtatgccttgaagatctgttgctgaataagagttcacacttttccccctctctcttttcttgtatcttccttgaggtcgagtaactttagtaacttcatgttttgctgatttgtctttcttgggtgtgatgtcaggtgaatcactttctacagctgcaacctcttcttgaacaggattagctgattgcactttcagtttcttcaatatgttgtcaaattgggtggtatcgtatacccatttgttatgagggctatctacaccaacacctagtgtgtcctgcttgtttttcaccctaacatgaccctttatgccttgcttgtctttgccaaggccttcaccttcttcccatcccatttgcttcataaggcggaaggcggcggactgccgcgcgatcccgacgtagcatgcgggcgcttcgggagcagccatggcgcctctgctccgttggatcgtcgcggcttcaccgccgccgggtaggagccgcgctctctcctgagttgccggagggggcagagaagaaaccctagctatgcgggtaggccgttttgtgcccgtggattttgcctcgatattcgggcttggtgggttggtgatggcccccataactgcccaacgaggtaggccttctgggcctgaatatgcctattgatgggccttttctaacgcttagccccatgggtcgtcttaggcccattttttttgaccccggccgcccggcgcctgcttcctcctgacctcctgtgcatctgcgactgctggagatggacgccgacgcatcctcttcccatcgggtactgatttgctgaacgtcgacgtcctccccgtgacctccctcacccgcgccgctctccctcccaatgtgtatggggataaggatagcttcatggggatgagtatggagtatccaaacccgttccaaaatttttcgtcgacatctctggcgttgaaggttgaatactggggagtggggatggtctgcgttgtgcactcgtgttgactagcgaattgtcgcatctgcgtgtggagcgcctggagtcacggtgaccggcaaaatcgtgagtccatcaatactggcacttgccctagaagttggcaccgatgattgccgcctgcgcggagccggagcatgtagccgcgcaaaggcttcagcagcgacctccacacttcacactcgtgattgcggttgtgtccgtgtcccccatccgtcagaggcgccaatgggagagcaagagctcatgggagtgtggtggtgtgtcatgtcgcgtggaaggggatggttgaaggaacgtggcgtaaatcaatgaaaacgtccctcgatatttcgatctggccatgggataaggtgggtctacaatcttcatataggattaggcgctacgtgggcctatacaatttgttatcctgcacggcaggcaaggcgagctacgtgtcggcgagcccgagcaaaggcggcggcggcgggggaggcagcgccactgcggcggccggtcggtcgggtctgccttgccaaacctcgcgttgccgcctccactatgaagcacaagcactactcaaggcactcgctttctttgtggtcgtcccggtcgcctcgccaccactggcatggcatccatccataccaggtgtccggacgagggagcccgagcccgccggtttgtggactcgccatgagggaagagtggacatcggctagtgggatcggcgacctgcctacagtggggcggcagagcaccgggaggaagcggaggaggaggaccccctgttgacacgtacctcgcctcagccgtcccggactctgcaatgcgatgcgacacggagaaaaatgagaagaggaacgggctataggaagtgcactccctgcacttccacgcactagacacacactgcacgcaagatgtatccaaagcaggagtatctcattatggtaatttgtaacatcttagttctaagctttccagacttcttcacatgcaagcagggatgcatgtaaaggatgtatctccagaaaataaaaaataaaaattacaacacgtctccacctcatcaatttaaaacatctctatctaatggcgtgtccaagaatcaactaaaggagggctgattttctagtgactattggggaaggaagacaagacaagccaatatgaagcctcatttttctctcttcgtcctcctcccatgtgctctaccattcacctctttctccaatagagtgtggaaggcttatttttctttcttcttcctcctcctcttttttctcgaccctccacttctatatcaacgaagttttatggatgtaggaggctggagccctccaacccctcttcagatccgtccctatctctatctctgtctattatataaaacacaagtttctacgattccacagtcttgcgtgtcatctttttccttcccgcttcatacaaaaataaggtaaaattatgcacaggtggaggtcaaatcttggttgttagctctatatttacacttatctacccaacacaacatacatattatgtgttttatttaaaaaagtctatttgtgatatatagaaactgtagcaatgcacgagaccaataacattaaagccacggaagccgctggataaggagcaaaatcatgtgtgtttgtgttaaattacgagttagtcgccattatttcatgttgtcgctctatcagtcagtcaccagtaa

SEQ ID NO: 19633 - DNA, 1830 bp, Zea mays
cctaaaaaaaggttattaaaaatttggtcgaaagccaaaaatttggcaaaaaaattaccttttttgggaaggtaccccaagaatttaaaagttttcttccataaaaaaaaaaaaaaaaaagggggcccccccttttttttttttttttttttttttttttttttttttttcgcccttaagcagtggtaacaacgcagagtacttttttttttttttttttttttttttccgaatggttttctgacattaatttacacttgtcacaacaacagcaaacaaggagcttaatgcaccagccaagtggagtccaacagctagccgaacacagctccgccgggctacaattcgagtagttaaaataacaccacaattaccccaccacagatgtgaatctaaccgaaccgaggccacatgatccggcttccatcagcaactagagaacaataacaggtacactaaaaaaacaacaccaccagcaactcctcacgttagctacgttaaccatcagcgcccggacgcctgccctagagcttcagcgtcagctccaggtcgtcggacccagagtcctcgtggatccgctcgccctcccaggccctcaccagcccggcggcctgctgcgcgccgttggtgctgctcccgaacgcgaactcgtccgagaccacatccatcatgtggacgtccgagtgccgtggcatgcccgggatcgcgggggagcaggcgccgctctgccccggcgtgcacatcctcatcgacgagtcgccgccgccgaccgggatggactccttgaagacgccgaacgggttggtggagacgaggctgaaggtcggggagtttggactggtggacgagatctggatgccggcaagccatgccgggtcaggcgcgatgggccggccggggctgggcggcgtggagttcactattgtggggctgcttgcaccgtgccatggaggctggacggccgcttcgtcccagtccgtcttcatccggggcgtccgggcagacggcgagcttagaggaggggttaccggagcgctgattgagccgccgtggatcagcagcggtgggaggagcgggtgtttctttgatggagtgccgttggagaatgtcttgagccatggtaggattggattgccgtcgataccgttgggcatttcgttgggagggaggaagggggaggatgcgccgctggggaatgaggacgaggtagggcttgcattgtatgacgcccgcggacttggttggtacgaggaacatgggcttggtgacacggagcaaccgatgggatccatgcgttccatgggcttgcttccctggcggtaggtggtgccgtcgggctcgacgacccagccggcctcgttgcagagcgccttgagcacctcgttgttgtcgcagtgcttgggcagcttgtagccgccgtgcgcgcggaggccggcgaagatcttggcggcgatcgcgcggcggcggcgctcccggcgcttgttgttctcgcgctccctccacgtgggcatccggccccccgcgccagccgcgcccaggcccccgccgccgccgctcgccatgggccgaccgcgcgagcagcgctcgcagctcggctcgcttggggaggaggggatgggagtccggctgactgggtccgggtcgccgcgcgcgctcgtctgggtggggagcggaggggaggggaggagagaaggagcgggcgagcgaaggaggtgtggatggtggtgggggcgggtggagaagcctggggcgagaagagaccacacggaaaggcaacacgccgcgcgaggcgagcgagggagacgggggtgtgggggtgggtggggaact

SEQ ID NO: 19634 - DNA, 1663 bp, Zea mays
  misc_feature (675)..(675): n is a, c, g, or t
caagcaaaggctgctgctgcatactggaaggccctctgtctgtgtgcgagcgcaagagcaagggagtcagagagagagagagagagggaggagaccttgcagaggagcgaagcaagcaaggtgggaaagaggcagcagcaagggcggcgggctgccggaaggggaacatgctccctcctcatctcacagagaatggcgcggtgatgattcagtttggccatcagatgcctgattacgactccccggctacccagtcaaccagtgagacgagccatcaagaagcgtctggaatgagcgaagggagcctcaacgagcataataatgaccattcaggcaaccttgatgggtactcgaagggtgacgaaaacaagatgatgtcagcgttatccctgggcaatccggaaacagcttacgcacataatccgaagcctgaccgtactcagtccttcgccatatcatacccatatgccgatccatactacggtggcgcggtggcagcagcttatggcccgcatgctatcgtaagtgatctccatgcgtccagcctgttgtttcactacttgctgccggtgctagatgatgccctttgtccactttgaagacactttgctaggcaatgcggtcagtactggtgctttctttttgtttttcctgtgcgttattgcgtttagtggntgttcttcatttgctagcacagcatgcctatcggctgagacagcacccagcagcattgccatcgatttaccccttcaactcattcgtctcgtcagatcttactcctgctatgttattgaagcataggcgttttttacgtttcacgcctgcatcattgccattctcctggtcctgggtaaagcggcttgttttttttcttcttctgataattacaaattaatcagagtctcgtattttgcctggtaaacaaatcgagcagatgcaccctcagctggttggcatggttccgtcctctcgagtgccactgccgatcgagccagccgctgaagagcccatctatgtcaacgcgaagcagtaccacgctattctccggaggagacagctccgtgcaaagctagaggcggaaaacaagctcgtgaaaagccgcaagccgtacctccacgagtctcggcacctgcacgcgatgaagagagctcggggaacaggcgggcggttcctgaacacgaagcagcagccggagtcccccggcagcggcggctcctcggacgcgcaacgcgtgcccgcgaccgcgagcggcggcctgttcacgaagcatgagcacagcctgccgcccggcggtcgccaaccactatcacgcgagagggggcggtgagtagggagccccgacactggcaactcatccttggcttatcagcgattcgactcggctctccctcgtctgaaactgaactctctgcaactactgtaactgtaactaaactgggtgtgcccggattggcggtcgttctgttctactactagtacctgctacgcgtcgttgggttgggtctggactagagagcgtgctggttctttgatgaacttggctggacttgagggtgttgactagcgcgaagctgagttccatgtaaaacttttgcttcaagaccgatgactggcggcataataagtagcagtaataaccaaaaaaaaaaaaaaaaaagctgtg

SEQ ID NO: 19635 - DNA, 1164 bp, Zea mays
aggccctcctctgtctgtgggccccccgggctgtttgggtgccgcacggggagagagagggaggagaccttgcagaggagcgaagcaagcaaggtgggaaagaggcagcagcaagggcggcgggctgccggaaggggaacatgctccctcctcatctcacagagaatggcgcggtgatgattcagtttggccatcagatgcctgattacgactccccggctacccagtcaaccagtgagacgagccatcaagaagcgtctggaatgagcgaagggagcctcaacgagcataataatgaccattcaggcaaccttgatgggtactcgaagagtgacgaaaacaagatgatgtcagcgttatccctgggcaatccggaaacagcttacgcacataatccgaagcctgaccgtactcagtccttcgccatatcatacccatatgccgatccatactacggtggcgcggtggcagcagcttatggcccgcatgctatcatgcaccctcagctggttggcatggttccgtcctctcgagtgccactgccgatcgagccagccgccgaagagcccatctatgtcaacgcgaagcagtaccacgctattctccggaggagacagctccgtgcaaagctagaggctgaaaacaagctcgtgaaaagccgcaagccgtacctccacgagtctcggcacctgcacgcgatgaagagagctcggggaacaggcgggcggttcctgaacacgaagcagcagccggagtcccccggcagcggcggctcctcggacgcgcaacgcgtgcccgcgaccgcgagcggcggcctgttcacgaagcatgagcacagcctgccgcccggcggtcgccaccactatcacgcgagagggggcggtgagtagggagccccgacactggcaactcatccttggcttatcagcgattcgactcggctctcgctcgtctgaaactgaactctctgcaactactgtaactgtaactaaactgggtgtgcccggattggcggtcgttctgttctactactagtacctgagtacctgctacgcgtcgttgctggttctttgatgaacttggctggacttgaggtgttgactagcgcgaagctgagttccatgtaaacttttgcttcaagaccgatgactggcggcataataa

SEQ ID NO: 19636 - DNA, 1368 bp, Zea mays
gaaagggcccaacagctcaacagaaaagccaagcaaaggctgctgctgcatacagaaaggccctctgtctgtgtgcgagcgcaagagaaagggagtcagagagagagagagagagggaggagaccttgcagaggagcgaagcaagcaaggtgggaaagaggcagcagcaagggcggcgggctgccggaaggggaacatgctccctcctcatctcacagtacgaactgaaaaacaagagtaaagaatttccgtgagatgagacagaatggcgcggtgatgattcagtttggccatcagatgcctgattacgactccccggctacccagtcaaccagtgagacgagccatcaagaagcgtctggaatgagcgaagggagcctcaacgagcataataatgaccattcaggcaaccttgatgggtactcgaagagtgacgaaaacaagatgatgtcagcgttatccctgggcaatccggaaacagcttacgcacataatccgaagcctgaccgtactcagtccttcgccatatcatacccatatgccgatccatactacggtggcgcggtggcagcagcttatggcccgcatgctatcatgcaccctcagctggttggcatggttccgtcctctcgagtgccactgccgatcgagccagccgctgaagagcccatctatgtcaacgcgaagcagtaccacgctattctccggaggagacagctccgtgcaaagctagaggcggaaaacaagctcgtgaaaagccgcaagccgtacctccacgagtctcggcacctgcacgcgatgaagagagctcggggaacaggcgggcggttcctgaacacgaagcagcagccggagtcccccggcagcggcggctcctcggacgcgcaacgcgtgcccgcgaccgcgagcggcggcctgttcacgaagcatgagcacagcctgccgcccggcggtcgccaccactatcacgcgagagggggcggtgagtagggagccccgacactggcaactcatccttggcttatcagcgattcgactcggctctcgctcgtctgaaactgaactctctgcaactactgtaactgtaactaaactgggtgtgcccggattggcggtcgttctgttctactactactagtaccttagtacctgctacgcgtcgttgggtctggactagagagccgtgctggttctttgatgaacttggctggacttgaggtgttgactagcgcgaaactgagttccatgtaaacttttgcttcaagaccgatgactggcggcataataagtagcagtaataaccaaaaaaaaaaaaaaaaaaaaaaaaaaaaaaaaaaaaaaactcgaaaaaaaaacccgggggatcca

SEQ ID NO: 19637 - DNA, 880 bp, Zea mays
  misc_feature (8)..(9): n is a, c, g, or t
ccactacnntttttttaacgaaccatacatgattattatagtttacggggcgcataggtgacagcaagttacagcccatgtaccaagggcacgaaaatataacaacaacaatagataagttaagagagaagaacacagaaataagcactgcatgagtccatcgaaaacgaagaggagtcacgtcacgctcacgcctttggttccccagccgctcttcaccggatcgagctcccatttccagcctccaggaagcatgcggcccacgccgaccaatcagacgctctctctccagttcggagagggctacctgggccctgaacaccaggtttatccactactataccagcttatccccttcacgcgacatcaaactgcacagaacgatagatacgcggcgggccaaggcagaaggcctctacgcgaagttgaggcgggaggtgtaggtggccttgggggcccagttcttggggatgacgtcctgggccgtgagcgtctgcttgcccgacagggtcgtcagccgcacggagaagggcccgacgagcgggcccgggcccgggctccccgcccccccccgcacgtgctgcatgtctcgccactgcgccgagttggcctgcggtccacatcgaggttgcaacttgagccattcattccagttccaattccagataaaaacgaaggtgcaaaggctgtttcagttttcattacacgaatttcacccccgcaaagaaagagactaattaaaggctgaggaggaagtcgctactgctcctcatagctgatggagtagcccagttaaaagataggagtactggcattattgcacaggcagaggggtcactggaattattaactccggatcctgaccaaaatgaacaggggc

SEQ ID NO: 19638 - DNA, 1600 bp, Zea mays
ctcgtcaacctccctcctcctcgtccccccctcctgcggcgcacttatatatatataataccaccacgtcgatgcgtcgcacgtcgatgcgccactcagctggcatcgccatcgacggcgtgccgccatagacggcctgacatcccccccccgcccccgccctattaatcccttcatcatcccaattcccaaaaacctcgcgcgcggcggagggagaaggaaggatggcgtcggagccggtggcgcgggcggtggcggaggaggtggcgcgctggggcgcgatgcgccagaccggggtcagcctgcgctacatgatggagttcggggcgcgccccacggagcggaccctccttctcgccgcgcagttcctgcacaaggagctccccatccgcatcgcgcgacgggcgctcgacctcgactcgctccccttcggcctctccaccaagcccgccatcctcaaggtgaaagattggtatgtggagtcattccgtaaaatccggtcctttccagaggtgaggaaccagaaagatgagctcgccttcacccagatgatcaaaatgatcagggttcgacacaccaatgtggtgcctgcgattgcattgggagtgcagcagctgaagaaggacttgggcggtccaaaggcgttcccccctggaatccatgagatccatcagtttcttgaccgcttctacatgtcaaggattgggatccggatgctgatagggcttataaacacaaaaatgtcacccatgacagttgctcgaattgctagtgaagatgcacgtgctatttgcatgcgagagtatggatcatctcctgatgtcgacatatatggtgatccaggttttacatttccatatgttacaccacatctacatctcatgattttcgagctggtgaagaactcccttcgtgcggtacaggaacggtatatggattctgataagcttgcacctccagttcgaatcatagttgctgatggagcagaggatgtaactattaagattagtgatgaaggtggtggaataccaaggagtgggctctcaaggatttttacgtatctctatagtacagcagaaaaccctcctgatctggatggacataatgaaggagtaactatggctggatatggttatgggatccctattagtcgcctttatgctcgatatttcggtggggacttgcagatcatctctatggaaggatatggaactgatgcttacctccacctttcacggctgggagattcggaggaacccttgccgtaatttattcaaaagaaccattcctgtaattaggatattgcttctgtgctggtatgcaagtatagttctgaaggccagccacctgttcagctgttggtgtccctacttgttgtctttattgttcattcatcatctcaatggaatgtgatcgtaattcataatcgttttatgactgatttgtactgtcattataattgtcgaacctccaaaaaaaaagttgccgtcgagcatccgaggtatttattagtttgagtgagtaatgggattcaccataacactgtaagcctgttactccaatgcctctaaagcatgtttttcccaaaaaaaaaaaaaaa

SEQ ID NO: 19639 - DNA, 1523 bp, Zea mays
ggcacccgccccgcgggccggcacccatattccattttggttatcctcttgcgtcacacctcctccctcctggcctcctcctgcggcccacttatatataccaccacgtcgatgcgctgctccgccggcatctccatcgccgtcgcgccgccgtagatggcctgacatttttcacttcatttgtcatcccaattccacaaacctcgcgcgcggcggcggagggaaacaaaaaaaaaaggaaggatggcgttggagccggtggcgcgggcggtggcggaggaggtggcgcgctggggcgcgatgcgccagaccggggtcagcttgcgctacatgatggagttcggggtgcgccccacggagcggaccctcctgctcgccgcacagttcctgcacaaggagctccccatccgcatcgcgcgacgggcgctcgacctcgactcgctccccttcggcctctccaccaagcccgccatcctcaaggtgagagattggtatgtggagtcattccgtgacatccggtccttcccagaggtgaagaaccaggaagatgaactcgccttcacccagatgatcaaaatgatcaaggtgcggcacaccaatgtggtgcctgcggttgcattgggtgtgcagcagctgaagaaggacttgggtggtccaaaggcgttcccacctggaatccatgagatccatcagttccttgatcgcttctacatgtcaaggattgggatccggatgctgatagggcagcacgtcgctttgcatgaccctgatccagagcctggtgtgatagggcttataaacacaaaaatgtcacccatgacagtagctcgaattgctagtgaagatgcacgtgctatttgcatgcgggagtatggatcatctcctaatgtcgacatatatggtgatccggggtttacattcccatatgttacaccacatctacatctcatgatttttgagctggtgaagaactcccttcgcgcagtacaggaacggtatatggattctgataagcttgcacctccggttcgaatcatagttgctgatggagcagaggacgtgactattaagattactgatgaaggtggtggaataccaaggagtggtctctcaagaatttttacgtatctctatagtaccgcggccgcccccccgcttcttgatgtacataatgaaggagtaactatggctggatatggttatgggattcctattagtcgtctttatgctcgatatttcggcggggacttgcagatcatctctatggaaggatatggaactgatgcatacctccacttatcacggctgggagattcggaggaacccttgacttaatcgattcataagaagccattcctgtagttaggactctattgctttctcaattaccgtgctggtatgcaaatattgttctgaaggccagtcacctattagttcagctgtccatgccctatttgttatctttgttgttcattcatcatctcgatggaatgtgatcataattcagaatagttttgcttctg

SEQ ID NO: 19640 - DNA, 1339 bp, Zea mays
atcctcttgcgtcacacctcctccctcctggcctcctcctgcggcccacttatatataccaccacgtcgatgcgctgctccgccggcatctccatcgccgtcgcgccgccgtagatggcctgacatttttcacttcatttgtcatcccaattccacaaacctcgcgcgtggcggcggagggaaacaaaaaaaaaaggaaggatggcgttggagccggtggcgcgggcggtggcggaggaggtggcgcgctggggcgcgatgcgccagaccggggtcagcttgcgctacatgatggagttcggggtgcgccccacggagcggaccctcctgctcgccgcacagttcctgcacaaggagctccccatccgcatcgcgcgacgggcgctcgacctcgactcgctccccttcggcctctccaccaagcccgccatcctcaagggcagcacgtcgctttgcatgaccctgatccagagcctggtgtgatagggcttataaacacaaaaatgtcacccatgacagtagctcgaattgctagtgaagatgcacgtgctatttgcatgcgggagtatggatcatctcctaatgtcgacatatatggtgatccggggtttacattcccatatgttacaccacatctacatctcatgatttttgagctggtgaagaactcccttcgcgcagtacaggaacggtatatggattctgataagcttgcacctccggttcgaatcatagttgctgatggagcagaggacgtgactattaagattactgatgaaggtggtggaataccaaggagtggtctctcaagaatttttacgtatctctatagtacagcagaaaaccctcctgatcttgatgtacataatgaaggagtaactatggctggatatggttatgggattcctattagtcgtctttatgctcgatatttcggcggggacttgcagatcatctctatggaaggatatggaactgatgcatacctccacttatcacggctgggagattcggaggaacccttgacttaatcgattcataagaagccattcctgtagttaggactctattgctttctcaattaccgtgctggtatgcaaatattgttctgaaggccagtcacctattagttcagctgtccatgccctatttgttatctttgttgttcattcatcatctcgatggaatgtgatcataattcagaatagttttgcttctggtttgtactgtcattataattgttcaacctccaataatggtatctgtcgagcacccgaggcattgaatttgagtaatggaattcaccataattgttcaacctccaaaaaaaaaaaaaaaa

SEQ ID NO: 19641 - DNA, 1466 bp, Zea mays
ctcagctggcatcgccatcgacggcgtgccgccatagacggcctgacaccccccccgctcccgcccccgcccccgccctattaatcccaccccccccccaatttccacaaacctcgcgcgcggcggagggagaaggaaggatggcgtcggagccggtggcgcgggcggtggcggaggaggtggcgcgctggggcgcgatgcgccagaccggggtcagcctgcgctacatgatggagttcggggcgcgccccacggagcggaccctccttctcgccgcgcagttcctgcacaaggagctccccatccgcatcgcgcgacgggcgctcgacctcgactcgctccccttcggcctctccaccaagcccgccatcctcaaggtgaaagattggtatgtggagtcattccgtgaaatccggtcctttccagaggtgaggaaccagaaagatgagctcgccttcacccagatgatcaaaatgatcagggtacgacacaccaatgtggtgcctgcgattgcattgggtgtgcagcagctgaagaaggacttgggcggtccaaaggcgttcccccccggaatccatgagatccatcagtttcttgaccgcttctacatgtcaaggattgggatccggatgctgatagggcagcacgtcgctttgcatgaccctgatccagagcctggtgtgatagggcttataaacacaaaaatgtcacccatgacagttgctcgaattgctagtgaagatgcacgtgctatttgcatgcgggagtatggatcatctcctgatgtcgacatatatggtgatccgggttttacatttccatatgttacaccacatctacatctcatgattttcgagctggtgaagaactcccttcgcgcggtacaggaacggtatatggattctgataagcttgcacctccagttcgaatcatagttgctgatggagcagaggatgtaactattaagattagtgatgaaggtggtggaataccaaggagtgggctctcaagaatttttacgtatctctatagtacagcagaaaaccctcctgatctggacggacataatgaaggagtaactatggctggatatggttatgggatccctattagtcgcctttatgctcgatatttcggtggggacttgcagatcatctctatggaaggatatggaactgatgcttacctccacctttcacggctgggagattcggaggaacccttgccgtaatttattcaaaagaaccattcctgtaattaggatattgcttctgtgctggtatgcaagtatagttctgaaggccagccacctgttcagctgttcgtgtccctacttgttgtctttattgttcattcatcatcttaatggattgtgatcgtaattcctaatcgttttatgactgatttgtactgtcaaaaaaaaaaaaaaaaaaaaaaaaaaaaaaaaaaaaaaaaaaaaaaaaaa

SEQ ID NO: 19642 - DNA, 4807 bp, Zea mays
  misc_feature (2067)..(2067): n is a, c, g, or t
  misc_feature (3731)..(3731): n is a, c, g, or t
ctgtttttttctatgattataaaaaaactcacccggggtcctcccagtatattatattaagaagagaccgaaacaatggttccggccgagaaaatccccgaacccttgccatcactaacgggccggcgtcaaccatccactctgcattggtccaaccggagggtggcacacaagacatcgtaacccgagagtggataagacatagcgaggggatttttttaaccaagtaaaaaaaatttttgcccccgaggggaatcaaacccatgtcttggaggtgctactcggaaacctttaaccactaggcttgaggatcttccgttttttctctgattgtagccaaatacaactagccgagacgtaaatcaagcgccctttatgatgctaacaaatagccaatccaactaattgatcaaagccttttgttagaattttctcattagttgtgatagttggacgacaaatttgtatctgctgcacctatatcagcaaaaatcaatagtttcaattattcatgatctgttatgctatgaactgtttgactaaaccatatttttgcagattagtgatgaaggtggtggaataccaaggagtgggctctcaagaatttttacgtatctctatagtacagcagaaaaccctcctgatctggacggacataatgaaggagtaactatggctggatatggttatgggatccctattagtcgcctttatgctcgatatttcggtggggacttgcagatcatctctatggaaggatatggtatgtacatacttaacctttattatattcagatattgagcacactgaagaatgcggctgtattcatctctctttgattttcataaatcagtatgaagttaattttctgaacgctgattattcctgttttgtaaagtgcaagtgaaggttaaaatatttacacatagaccttgggaagttaagcataaatgccaattcttgcacattattttagcttttctaatttgctatgggaacttataacgcctgaaattcagatttccattagcattaggatccaattgctatattgctgcaccagtttccttgcagaaatacagcatagctacactcttgtcgtttagttgatcaatattttttttctcttttaatgtaggaactgatgcttacctccacctttcacggctgggagattcggaggaacccttgccgtaatttattcaaaagaaccattcctgtaattaggatattgcttctgtgctggtatgcaagtatagttctgaaggccagccacctgttcagctgttcgtgtccctacttgttgtctttattgttcattcatcatctcaatggattgtgatcgtaattcctaatcgttttatgactgatttgtactgtcattataattgtcgaacctccaaaaaaaaagttgccgtcgagcatccgaggtatttattagtttgagtgagtaatgggattcaccataacactgtaagcctgttactccaatgcctctaaagcatgtttttttcagtctcagcttgttcgatataatatgaggaatgatctttcactgaaattattcgatgaatattaatgttaaaatggatcgattcaatgcagaatgtgtaattctttgaaccaaatgcctgccaaaagtgtgtcattggttggagggagggtgagaagtgagattgtttttcccagtgcagctgatttcatcctctcgtcgatgtgtcagcttcagaatgcaacatttctggtgtccagttatcgtgcacatagcgtggatttggtcaagtttattcggcgtttgtttttgttggatccttttccatccctagctaaaataataccgacccattttcatccctagctacaataataatgggctgaaaaatagctcacgttcatgaactggctcgagcttagaacgttatggctcggctcgtagtggctcgtgagctcatgctaagctgagccgagtttgattctcaggtttcgttgcttgatcgagctgagtcgagccagctcgtgaaggagaaatcttatttggctagttatcattttgactcacggatctncatatctcatcttgctatctcatcttttctcatattaaccctaaaatccggagggtttgggttctagggttagggtttaggctccaaaaccttggctctaataccatggttagactctatagcctatagggtctagcacttgatcagtaaccactagaacatatagaacgggctctattagcttcgatcttagagttaatcgaagtagacatgctaaagcctacatgtccgcgtgagtgcgggcgtcataattgaaccgtagatgtacaatggctccggggcatagagcagacaagaccaatggtggtgagagactagctaaataacccgccaagctaaattttggctactcaatagcaaaataactctccaacagattatctatctaactcgccaagctatctagctcttcaaattgactctttcactagccaaatttggctagccacctgactagctaaactagatagatagtctgttggagtgagatgctacatatagagtgtaatctttatgaaaagttaaatagatagtcaaatatagagctaaaaatgaggagtttcttggagatgctctgagtcggtgtagtagtgcaaagctgatggtctttctcttactaagcatgttagagtagatcaagtctaatttaggtttgttgggacgagaatgcaccgataaatgttggttgctatgttggtctcgtccactcttttatctatacgcggtgaagggtcctttaatcaagaacaagacttgattctctaacaagtttaacttaagattaaaataacaaactgtaaaaccacattagttaaactgtccagttgattgttgacgatcaatctttattagtgcaggatattgtttttactttctttagagagccgttgatgcgtctttggctggacgacgattttgctggtgaaactcttttgggcgtgacattttttttactttaattaaacggtgttcttttcttctctacttctatttaattgaaaattatactttaacgtccctgtcttaaaaataaatgtacgtctcacttttccaaaactaaactttttaatataatatatatataggtcctgtttggcacaacttatttttagcttcttcacaaatttaagccgaagttctgtcaaacagatagcttctgcagcagcttatcagttcagctgcttctcaaaatgaactaaaagcatccaataagtagaagctgctttttaccagcttatcatgctttttcaacaagcagcagctgtgccaaacagggtcatattaatctttatagtctataataaatgttattagatcaatagtaaatatatttttacaataaataagataatatgtactatatttaagtataagtttctttgtgtgtcacctcctcaaatgcagcgcgagcgattaaacttagtataaaacgtttgacttttaccactataactcatgtcagtttgtattatataaagtagataatgtaaatatataaaataaagaatataattgtgtttgaataaatatatcatttaaatatatagttatatagaaactatatcatatcaatgtatgatcaactaactagtctataaattaaatctagaaaagtgtaattgatgcacatttattttgaaacgaaagtgtttagcggacttttntctccggctgaccggttgaattttgaaattgcgtaaaataaaacaggcacgaattgatctgatccactcaattaaacgggtcaccctagggctctggttcctcatatttggctctgcctcctcttcgttccttggcggagacggcgccggcttcaaataaattacaactccacccgccccagacggctccaccgccggcgaaactctaaaccatccctgcgatttaccgccataggacccgcggatgcaatgggagagtgcgctcatacggcggcggtcgcgacgacggccaagacgtcagtgtggtggaacatcgacaagtgcgcggtgccccgcggccgctgtaacccgcaccgcatcgcccacaacctcatcgccgcgctcgccgttgcggggtacgtcggccccgtctcgatcgctgcctatggcgacgccgcccaggtccccccgcccgtccttgcagcgctctccgccaccggcatatgcctcaaccacgtccccgccggtacagtactgactctgcccctcctgctctcagcacattaccgcctagttgaattcccgctgctaatcgaatccctctcacggtttcacctgacatttgcagggtgcaaagacaccagtgagaagaggatgcttgtcgacatgttgttctgggcattcgacaatcctccaccgggcagctacttgcttatatccggcgatgaagatctctctgatctccttcaccgacttaggatgaaacgctatgatatcctgctagtacgacctcccagtgcatcatctcaggtacccgctgctgcacctactaaggtctggctctgggaaaaccttacagcaggagagctgctgctaccagagccgccacctgcaagaagtgtgctaggttgcaagctgcatccgaatagttcagataccttgaagtgttcaaatagtaaggttcgtttcggttatggtaagagtgattgtaacggaaaggaagacagtcaaattagagtgaaacctcttcaaaaggatgttaagaaggcaagtaagtcatctgcaactgaaattagtcaagatcgaaggcgatcgcg

SEQ ID NO: 19643 - DNA, 1631 bp, Zea mays
acgcgaccactctgatacaggtcaccagcggtgggccccactacccagacgggtcctggttcctccccctccaagccggctctgaaatttgaggcccatagccccgtcggcccccatcgccacgccgccggccacgccccagacgaccccgcccgccgccgccgcctcccgctccctccgcgcgcagccctcgtccggccgcccgggtccgagcccgctcgctcctcctccccacgttggacagtttaagtgtggcttcattgcatgagtagttgcagttagcgtggcttttctccgtgcttgctcctggtcgtgctttgccttgcaaaggaaggaatcatgacatctgttgttcacagtgtttcaggtgaccacagggctgaggatcaaaatcaacagaagaagcaagctgaacctggggaccagcaagaagccccagttactagttcagatagccaaccaacagtaggcacaccatcaacagattatgtggcaccctatgcccctcatgacatgagccatgcaatgggtcaatacgcttatccaaatattgacccatactatggaagcctttatgcagcagcttacggtggacagccattgatgcatccaccgttagttggaatgcatccggctggcttacctttgcctaccgatgcaattgaagagcctgtgtatgtaaatgcaaagcaatacaatgccatattaagacggcgtcaatctcgggctaaagctgaatcagaacgaaagcttatcaaggggcgtaagccctatctccatgagtcacgtcatcagcatgccttgaaaagggccaggggagctggaggtcggtttctcaactcaaagtcagatgacaaggaagagaactccgactcgagtcacaaagagaatcagaacggagttgcgccccacaggagcggccaaccgtcaacccctccgtctcccaacggtgcatcgtcagctaatcagggcaggcagtcgtgaatgatgattcaaaactcacagctgaagagatttcagcccctgagctagatatggcagcagttttgtacagaaaacgctagtgggcagcagcaacatggtgtcgatcggtcggtgggtcggttgttgtaggacatgttccatagaaaaagcatagacgagtctacaggttttggagccttggtttggtcctctgtgtattcacctttctgtacaatcttagtagcgttgtgtaccttcccctggaaggatagcttcagttagcgcttcagaaagtcaagtgtgtagcatattggcttattgtttgctttgcttggacaatggagatttgggagtggagttcataaccctgctgaataaatgctcttagctggctatgtgtatgttggacgacaatatgatccctaatgtagtacacgtgaccacctcaaactgaatctggctttgtttaaatgacaccctcacaattggtcacaggttcagagatcatctcacactttgtcctgcaatgcatgtttcgcttcgtctttggagtgtcctggcacgtacgatgtttccgttcatctgttgttcgatgaattgcgtgatgattgccggacgccatgtgcgtttttgaacgaaagaacgtttgggtttggcaggggtaccga

SEQ ID NO: 19644 - DNA, 760 bp, Zea mays
gtaatgaaatcccattcttatgttaattacagtcttacaccacagaggagaaagcagagtgacccatccacagcagaagcagatggaagcactggagcagcaccaggcaagagatcgcattcacctcgcatggcgccaaccacagcgaaacaagagaggagagagggccacaacaactcacgagacgaccgcacaggaaagaaccaaagctgctgcattcaagtgccagctgccagccgggacacggtggacgcatgctggtcgacgactccctatccccagcagcatcacttgcttcctcccgcttggcgatggcgtcgacggccggggcaggctccagcacctcctggatctcctcggcgacggcggcgaagcggccgctcagcagcaggtacctggacgagccggcggggctgacgaggccaccaccaccggcgttcgcggggacgacgacagccttgtgctgcggcggctgccctttcttgccgtcaagccggtgcgtcctggtcctgggctcggcagcaggaacgggagccagggggctggcgccggcgctggccttgtgtgggcggggcgtcgggtgccgctccaggctcgggcatgtcgccgtggacgcctgggacgagcacgagagccccttcatgtccctgaacagcagaggagccatggcgccgcggctaactagctgggaacagagctgagatgccgctgctttggctgctgtgttgcttaaatggtggcggtggagttgaatggactt

SEQ ID NO: 19645 - DNA, 1427 bp, Zea mays
atcataactcttttcggtgttctttgagttaagattcgagacaagagaaatatccgtctctgccaccattcatgatgtgtgagctaaaacttcttgatttcatatctttttcagtttcccacacaccaactacatgccactcattttcccatgaagaacagacaacaatgcagtgccatgcattcttaatattaattacaggctcgcagcatagaagggaaaaaaaggcagagttacctgttcatcataacagaaacagatgaaagcactcaagcagcagcaagcaagatcgcatccaccaccaccaccactgcatgtcgccaaccaaccacagcaaacaaggagaggaaaggagggtcacaacacaactcacaagacgaccacaggaaagaaccaaatctgcattcaagtggcagcacacggacacgcggtggacgcatgctggtcgaggagacacaccagcgcaggctcacagtgtcgcactggcccagcgtgctggccggcagtgcccccacacgcgtcacgcgtgccgtgcctggctacgtacgtacggacaccttctccagctacgcctacgcacgcactcctcttcctccccctcccaccagccacggccggccaaccgcaacggatagggggggctaaaaggctgctgattcggtttccgggcccccgtttccttctcgtccttccttcaggcggctatcgccggcggcgccgcccagagctgggcgttcttcaccttggacacgctgctgagcacgcccagcggcgtgacgtcgccgaccaccgtgaccttcttcgccgcgaagtcgatgttgaacgacgtcacgccttccatcttggagaggtgcttcttcactttcccggcgcatgctttgcagtgcagggataccttgagcacaaccacctgctcttgcgcctgctcttgcgcctgcgcgctcttcgcatcagcagcagcttcacctgcttcctcccgcttgggcttgacgtcgacggccggggcagactccacctcctggatctcctcggtggcggcgaagcggccgctcagcaagtagcgggacgagccagccgggctgacgaggccaccggcgtttccgacgacgacagcctttcgctgctgctgctcctcctgctgccgccctttcttaccgtcgtgccggtgtgtcctgggcgcggcagggacgtgagacagggggctggcactggcaatggctttgtgtggccggaccatcggctgccgctccaggctcgggcatatcgccgtggacgccggggacgagcacgacagccccttcatgtccctgaacagcagaggagccatgggaacaggccgagctgctgtgctgctgccgcctctttgggctttggctgtgttgctggtgctgctgaaacggtggagtggaaatgtggagtggactggc

SEQ ID NO: 19646 - DNA, 4095 bp, Zea mays
  misc_feature (2985)..(2985): n is a, c, g, or t
tcggcgcatagatatcataactcttttcggtgttctttgagttaagattcgagacaagagaaattatccgtctctgccaccattcatgatgtgtgagctaaaacttcttgatttcatatctttttcagtttcccacacaccaactacatgccactcattttcccatgaagaacagacaacaatgcagtgccatgcactcgtagttctctcgcgttttttttttttttttttgaagggaaaaaaaggcagagttacctgttcatcataacagaaacagatgaaagcactcaagcagcagcaagcaagatcgcatccaccaccaccaccactgcatgtcgccaaccaaccacagcaaacaaggagaggaaaggagggtcacaacacaactcacaagacgaccacaggaaagaaccaaatctgcattcaagtggcagcacacggacacgcggtggacgcatgctggtcgaggagacacaccagcgcaggctcacagtgtcgcactggcccagcgtgctggccggcagtgcccccacacgcgtcacgcgtgccgtgcctggctacgtacgtacggacaccttctccagctacgcctacgcacgcactcctcttcctccccctcccaccagccacggccggccaaccgcaacggatagggggggctaaaaggctgctgattcggtttccgggcccccgtttccttctcgtccttccttcaggcggctatcgccggcggcgccgcccagagctgggcgttcttcaccttggacacgctgctgagcacgcccagcggcgtgacgtcgccgaccaccgtcaccttcttcgccgcgaagtcgatgttgaacgacgtcacgcctgcttgcatcccacaggccaatgattagttgtgatctatgaactccgaacagaagtttcagatcctgaaagaaatacagtagtagctgccaggctcaccttccatcttggagaggtgcttcttcactttcccggcgcatgctttgcagtgcagggataccttgagcacaaccacctgctaagatgccaatgcatgctttcttagctaggcgaatctagcaggaggcatatgtttccttcacaggtactactgaactaaacgaaacgaatcagcaggcttgaaacctaagaagcgcctttgtttacatattattgtttaaaaaaaatcagagacgctatgtttatcaagttctgataacgatcctgtaagccataaagctacgatttttctatcacataatctcaaagcccccacgctgatatgattgttgtcactggtcacatcatctcacttttgatttctcttatcattttctaatcaagaagagtagggccaaaagctaaaaataacaataataaaaggaatcacacaagtactgcacgctagtcataactcatactagtgagtattcagtaacttcacctgctcttgcgcctgctcttgcgcctgcgcgctcttcgcatcagcagcatcacctgcttcctcccgcttgggcttgacgtcgacggccggggcagactccacctcctggatctcctcggtggcggcgaagcggccgctcagcaagtagcgggacgagccagccgggctgacgaggccaccggcgtttccgacgacgacagcctttcgctgctgcagctcctcctgctgccgccctttcttgccgtcgtgccggtgtgtcctgggcgcggcagggacgtgagacatggggctggcagtggcactggcaatggctttgtgtggccggaccatcggctgccgctccaggctcgggcatatcgccgtggacgccggggacgagcacgacagccccttcatgtccctgaacagcagaggagccatgggaacaggccgagctgctgtgctgctgccgcctctttgggctttggctgtgttgctggtgctgctgaaacggtggagtggaaatgtggagtggactacggggtaaggaaatactgccttatatatacaagagactaagagagcacaactttgctttacatgccagtaaagagtaatctcaaataaactcctctcaaatccatcccaaaaaaagaactatgggtgaaaaacaggtcttcttgaaagtgctgctggttgaattcacgggtagtattggagtatcagacaaaatagctcagtgatggtatgcaacaaacatgttcctgtgtttagcgctcacatcagccccaacccatgtagtgttactacctgattcatttgttctttcgtgaataacagagattgaaatgcagagttaggcacagtagcaggccgggatctccagtatcttttcacccagaaagaagtagatagagctgtcacagtagtaagcaagtagcttggaggaaaacgacacattttttttaatcggaaccattgctgccaggccaccgtgaaagtcctgacgtgtttcagatttttccgcccacgttgcggtgaggttcagacgtctgtatttgcaccacagaaaggcctttcaggaaattaatattgtagttaacgttgatgtaacacgcggtactgaattattgctacgttggtagacgtagaagagtctgcgactaataataactcccatcggatttgaatactcaactgccagcacggctatgactaaccgtttgcatggagcatcagttcattaaccttcttagctctttcagcaggaacaaatacgtgataaatgtatgaaacgattgcgattttttttcttcgtccggaaagagagagatcaacatgcgattatattgcggtcataaataaagtccttaatgatccagggaatcctaaaaaaacggaagggttggttcagataacgttcataagcatcccgcattcccgcaatgcaagacgggcagcgagaaaagaaccccagcgtcctggtcgacggaagaaaccgttcgtatctccatgcatgtccatttcgcacgtagcggaagagtccacagctagccgcgacttttctatgncacaacaatcacacagatgcaagagttgggattgcattgcatgatccgctattctcatgggtgtgggggtagagatggggatgggcctcacaccgacccgttaaggcgatggcctcacggctgccgccttctcgccaacgccatggccggcagctccttcctcgtccgctacgtttagggtctagtgtttattatggtttaggcggaataccctagcaaatcctcgctgctgcgcgtcagcgcggggcagcaagccgtccgtcactcaccagtagtccgctgcggatgcatgcagcaaggtgccgttgcgtgtgtcagccagactgcagcggcggccgcggtggcaagttgcagagggcgagccgagcagcgtgcacgtgacgagcgtcgtcgtcttgtgtcgcgcagggccccggtctgacagcctttttttggcaggctccgccctgaacggggccagggcactggttggtgttggtggtcactctgctactcactagtgagtagtgacacatgcctggttttgccgttttggctagtggttcgttcagaaatcagaactttgagatcgtcgtacgctctacgctccgccaacggccgtttcggctcggctcctagaggtgccagttcccaacggcgtctgcccagaaatacatgcgcgtttattacatctgatgactgctgctgggccaggctgattttttttttgcaccccgttccgttccgatgagcgcgtgtggccgctgaccactagagcgctccctctgtccaaaaaaaacgttgtaggaattcatagttttattaaaacattagcaattcatagttttaacagctactgcatgttttcttaataaatgcactgataaaaaaaaagacttgcacaaatatactcatcctgccaacatgaactttaaggtagtgtttggttgaagagccaagtagaacggaaccgttctgtcctagttttgttgttgtttggttacaaagtaactagaacggaatggctccaattagggaatattctgctcagatccggaaccattccgctcaaaaaaatcaatgggacggagccgctccgttccaatcccgctctcacagtcacgctccgtt

SEQ ID NO: 19647 - DNA, 1122 bp, Zea mays
cgtgccgaattcggcacgagggccttaggggcctttttttttttttttttttttttttttgacagcaatgaaatcccattcttatgttaattacagtcttacatcacagaggagaaagcagagtgacccatccacagcagaagcagatggaagcactggagcagcaccaggcaagagatcgcattcacctcgcatggcgccaaccacagcgaaacaagagaggagagagggccacaacaactcacgagacgaccgcacaggaaagaaccaaagctgctgcattcaagtgccagctgccagccgggacacggtggacgcatgctggtcgacgactccctatccctagcagcagccacggcccacggccaaccgggatacggctcccttcattcaggcggcggctatcgccggtggcgccgcccagagctgggcgttcttcaccttggacacgctgctgagcacgcccagcggcgtcacgtcgccgaccaccgtcaccttcttcgccgcgaaatcgatgttgaacgacgtcacgccttccatcttggagaggtgcttcttcactttcccggcgcacgctttgcagtgcagggataccttgagcacaaccaccacctgctcttgcgcctgcgcggtcttggcatcagcagcatcacttgcttcctcccgcttggcgatggcgtcgacggccggggcaggctccagcacctcctggatctcctcggcgacggcggcgaagcggccgctcagcagcaggtacctggacgagccggcggggctgacgaggccaccaccaccggcgttcgcggggacgacgacagccttgtgctgcggcggctgccctttcttgccgtcaagccggtgcgtcctggtcctgggctcggcagcaggaacgggaggcagggggctggcgccggcgctggccttgtgtgggcggggcgtcgggtgccgctccaggctcgggcatgtcgccgtggacgcctgggacgagcacgagagccccttcatgtccctgaacagcagaggagccatggcgccgcggccgactagctgggaacagagctgagatgccgctgctttggctgctgtgttgcttaaatggtggcggtggagttgaatggactt

SEQ ID NO: 19648 - DNA, 5415 bp, Zea mays
  misc_feature (5413)..(5414): n is a, c, g, or t
catttcaggaccagagcagaattcctcgtttctttcaaaccgcaagaaaactaagcagcacataattaccatttctgccctccgtcccctctcaactccgtcgtcgcgacctgccgcgccgtcatcgccggcggacccagcgcgtgcagtggaccagtcgccgaacgaaccgcgcagaagagaagggtaaaaacaggactgttggaagtcgagtcgagaagcaacagcaagcagcagcttggggggtaggtggggcaacgcagcagagatagtccaattcgccgccttgccggccactgacctgccggcggcggggtcccctctgttggagccgacggatccgttgccccctcctatccgaacctgatccacccatgggaactccagttggtatcatcgttggttctcatgtttgggtggaagacccaaatctagcttggatagatggagaagttattagcataaaaaacaatgaagtacatgtgcagacatcgaatgggaaaaaggttaccacagacaggtcaaaagtatttcccaaggatatggaagctccaccaggaggagttgatgatatgacaagactttcatacttacatgaacctggtgttctacagaatcttgctacccgctatgaactgaatgaaatatatacttacacaggcagcattttgattgctgtaaatccatttcaaagattgccacatctttatgatacccacatgatggaacagtacaagggtgcagattttggggaattgagtccccatgactttgctatcgcagatgttgcttacagggcaatggataatgaagggaaaagcaactctatattggtcagtggtgaaagtggtgctgggaagactgagacaacgaagatgcttatgagatatttagcacatttaggtgggcgatctggagtagaaggacgtacagtggaacaacaagttttagagtccaacccagttcttgaagcttttggtaatgctaaaactgtgcgaaataacaactcaagtcgctttggcaagtttgttgagatccaatttgacaagactggacggatctcaggagctgctatcagaacttacttgctggaaagatcacgtgtgtgccaaattaattctccagaaagaaattaccattgcttttattttctttgtgccgcaccacctgagtacactcagaggtacaagctgtctgatcctagatctttccattacctcaatcagtcgagctgtattgaggtggatggaatcaatgatgctgaagagtatttagcaacacgaagagctatggatatagttggaatcaatgaggaagagcaggaaggtatattccgggttgtagctgctgtacttcatcttggaaatataaattttgccaagggaacagaaatcgattcttctgtaatcaaggatgataaatccaggttccaccttaatatcgcagcagaacttttgaaatgtgattgccagaatttagagaaggcgctgataacacgagttatagtcacgcctgaagaagttatcactagaacacttgatcctgcttctgcagttgctagcagagacgcattagctaaaataatatactcccgattgtttgattggattgtggaaaaaattaatgtctcaattggacaggacccaaactcaaaacagttaattggagttcttgatatctatggttttgagagcttcaaagttaacagttttgaacagctatgtatcaattatacaaatgaaaagctgcaacaacattttaaccagcacgtgttcaaaatggaacaagaagagtataccagagaagagataaactggagttacatcgagtttgttgataatcaagatgtgctagacttgatagagaagaaaggtggattgattgcacttctggatgaagcatgtatgtttcctagatctacacatgagacgtttgcgcagaagctatatacaacatttaagaataacaagcggtttgccaagccaaagctttcacgcactgattttacagtagtccattatgctggcgatgtgacataccaggctgattatttcttagacaagaacaaagattatgtagtggctgaacatcaggatctgctgaatgcttcttcatgcctattcgtagctggtttattccctcctctcccacaggagacagcaaagtcttcaaaattttcatccattggatcacgttttaagcttcaacttcaatccctcatggaaactttgagctctaccgaaccccactatattagatgtgtgaagccaaataatctccttaagccagctatttttgagaatacaaatgttatacaacaactaagatgtggaggtgttctcgaagctatcaggatcagctgtgctggatatcccacaagaaaaacattttatgaatttgtcaatcgttttggtgtccttgctcctgaagttttagaagggagcaatgatgataagattgcgtgccaaaagattttggaaaaaatgggtctggagaattaccagattggaaaaacaaaggtgtttctaagagctggacagatggctgatttggatgctcgtagagctgaagtattaggaagagcagcaagaatcatacagaggcaaatacgtacatatattgcaaggaaacagtttgctgagcttaaaagatcagcaacacagctgcaatcttttgtcagaggaaccttggctcgtaagttgtatgagtgcatgaggcaggaagcagcagcagtgaaaatacaaaagaatatgcgacgccacaaagcacgggaatcttatttacaattgcaagcagctgcaatcacattgcagacaggtttaagggcaatgtctgctcgcaaagaattcaggttcagaaaggaaacaaaagctgctgtccacatccaagctcaatggcgccgccacagagactactcacattacaagaatctgcaaggagcagctcttacttaccagtgtgcctggaggcaaaggcttgccagaagggagctcaggaagctcaagatggcggcaagagaaacaggagccctaaaagaggccaaggataaacttgagaagcgtgttgaagaactcacctggcgcttaggattggagaagcgattaaggactgaccttgaggaagcaaaagcccaggaaattgctaagctgcaagagacgttgcatgatatgcagcttcaagttgaagagtcaaaggccatggtagttaaggagagggaagctgctagaaaggcaattgaagaagcacctccagtaattaaagagactcctgtgctagtcgaagacacagaaaagattaactcactgacgaccgaagttgaacaactgaaggctttgctgctaactgaaagacaagcaacagaagctgcaaaaagagaacacgctgaatctgaactgagaaatgaagaactaattaagaaatttgagagcgcagagaaaaagattgagcaacttcaggaaactgtccataggctggaggagaaagcaaccaacatggagtctgagaacaaagtgctccgtcaacaagctgttgcaatttctcctacgtcaaaatcattagctgcatatcctaagtctcctttccagctgaaaactccggagaatgggaatgctctaaatggagaagtgaagtcatcaccagatatcacccctatcttaccaaaccccaaggagcttgaggctgaagagaagccacaaaaatcacttaatgaaaagcagcaggaaaatcaagacctactgatcaagtgtgtatcacaagatctgggattctccagtggcaaacctattgcagcttgccttatctacaggtgtcttctacactggagatcattcgaagttgaaagaactggtgtttttgaccgtattattcaaacaattggctctgctattgagtcccaggacaacaatgacaagttggcatattggctctcgaattcatccacactgctgctgctgctgcaacgaacactgaaaacaactggagcagctggattcactcctcaaaggcgcaggtcatctgctgcatcttttgggagggtgttttcggggatgcgagcctcaccacaaagtgctgggcgtgcttttatgggaagtcgcttgattggaggtctaggtgaccttcgtcaagttgaagccaagtaccctgccctgcttttcaagcaacagctcacagctttccttgagaagatctatggaatgataagagacaatttgaaaaaggagatatctcctttgcttggcctttgcatccaggcaccaagaacatcccgtgcaagcctaattaaagggtcacgttcccaagcaaatgccttagctcagcaaactctgattgcacattggcagagcattgtgaaaatattgacaaattacttgaatgttttaaaagcaaattatgtcccttcagtcttaatcagcaaagtgttcactcaaatcttttcatttattaatgttcagttatttaatagtcttcttcttcgacgggagtgctgttcatttagcaacggagaatatgtgaaagctggattggcagaattagagcagtggtgcatttatgcaacagaagagtatgcaggttcttcctgggaagaattaaaacatattaggcaggctgttggattccttgtgattcatcaaaagccaaagaaaacattgaaagaaattaccaacgatctgtgccctgtccttagcatacaacagctatatcgaatcagtacaatgtactgggatgataagtacggtacccacactgtttcatcagatgtcatctcaagtatgagagtaatgatgacagaagattctaataacgcggtcagcagttcgttcctgttggatgatgattccagcattccgttttcggtggacgacatctcgaagtcgatgacagaaatcgaggtaacagatgtcgacatgccacctctgatacgggagaattctgggttcaccttcctacaccagagaaaggactaacagggtggtccttccagctgcatgtccctttttgcacattcttttctccgctcaacctgtgcataactcgtgtacatacgctcgtgccttttgctctctggccagggcttgttagatgtattgtctttggtttgattggttggttggttctttcatcgatcctctcccaattttgttgggcgaagggtccacaatctatgtttctccatactgtagtgaaaaggggccggatgcccctggtcagttccccgagctgcttttggaaaagctcgtggtcattaagcagttaagcgtgtggaaaaggttctccgcatctaccgagtcgttcgttgtgtcgccttcttcatatggatcatcgccatattgtaaattgcaaagacgattatagttgaaaaaagagatattacagtgatattacatatggatattctgctgttcatcttggtttnna

SEQ ID NO: 19649 - DNA, 5423 bp, Zea mays
  misc_feature (24)..(24): n is a, c, g, or t
  misc_feature (4375)..(4375): n is a, c, g, or t
cgtcggctcaacgcaatccgggcncattgtatttattcaggagtcgaccaaaacgaaccagtagaagatacatatcacaactgagaaccatattcagctacgatgtgacttacagttacaccctactccagccttatctatctatcgccttccagagcacagaagtgcccggaccaggtcggcagtcggaccacccaaggcccaagacgaaacgcgctgctaaatccactggagaccaaccacccatcggcgatcgagggcaagaatctcgctcttgtattctcgttgctaaacacggcacgagccttatcccgaccaaacatgattagaccggcagaacaacctttgcccggataggcaacaggataaggctaccgcccgcgactgttgctgtgcggagggtcagcaagtgcaaccaccacctccactcccctcccctccactgcactgttgctcgccatcattagctgcagcgagggctacgagggtcaccaccccacccgacccacagacagaaggaatgcaacgcgacccgcagcgtctcggcgacctttggagcttcagggcggcagatcgacgtgaccggcgacctcgacgagtgccttatgtttatgtacacagtgcggtggccacgcgacgaggacgaggcagcacgaacaaggacattcccagaccacaacattcctagagcattttgtacaccacctgcgaacagtcgcgagcgacggtcccttccactagttccaccacaaccacaaggtctcatgccgcctagagctaactgcaccgcacccccgcacgccgacacggttcacctcggcacggtgtccgccgccgtcgtcgccgccgagggaggcggcggcggtggggcgtgcgtctggtcgtcgtcggagacgctggcgaggccctggacgaggcgcacgatgtccgcggggtcgtccaggtagtacttggccttgctgggcttgcgccccaccgtgcacgcgaacacctccgcctccgcctgcagggaggacacgcccctcgcggccgccgccgccgcgatcacctcgaacatgtcctcgtcggaccggtcgtcgcccacgcacagcacgaagtccggcaggtcgtcgtcggcgtcgccccgctcctgcgtcgtcgacaggatccgcttcgccaccaggcccttgcttacgccctgtggcttcacctcgacgaggttgggtccagctttcactgagaccggctcgtttgcaagcacgctctccagatggtcgtggagctccttggcctggcaggatccgaaatctggatcggcgtcctcgtagcaccacacgatggcagtctccttgtcctcaatagtcgacccgtccgtagtctcggtataggtcttcatcacaggctctgcgatctgcttccagctgcagtctatcaccggaacgcatgtctcccattctgcgtctcttctcagcctgaggaagcagccgtgttcagctgctagtccaaggctctcacatggtaagaaccattcgttcagagtcatccggctctttgcgctcacaaggaagaccatgttgttcctgtcgcggcaaaggctgttcaacatgtctatcgtccttgaggtaggactcttaccgagcgaagtctgcggcatcagcgtcccatcgtagtctaagagaatgacgcgcttcttcgtcctccggtaggccaagaccaagtgctccaccgcaagcttcttgaagtttgggtcgagggccacaaccctgaacttcagcccaaaccctatgccccagcaacgcctcctgttatggtcgaggcaaatccgctcaagatcttgcaggaagctgttcgcccagtacccgacgtcgtgcgtgctcacgtatctgtggtgtttctcatgtctcaacaccttctccccttccggcatctccagcgcgtagtccattgcgtcggctactgaatcgatgttccaagggttcacacggatagcgccgctcagggagggcgagcagccgatgaactctgacacgacaagcatgctcttcttccttgaagccggaccaaggcctagaatactatctatcctctcattcccttgtcgagcaattacgtactcgtatgggatcaggttcatcccgtccctcactgcagtgaccaaacagcactccgcgacgacatagtaagccatcctctcatagaactgcagaggctggtcgatcagtatcaccggctggtaacctggctgcccgaacgcgtcgttgatgcgcctcaccattgcatcgctctcttcctgtacctccctcacatcctttccccgcccccttgctggattggcgatctgaacaagcaccacccttccccgccactccggatgctgcattaggagctgctcaaacgccaaaagcttcaagctaattcctttgaagatatccatgtcatcaacaccaagcaacagcagacggttccgatgacagaactgtttcagaagctcggccaccttgaccccaagctccgggaggttgaggactgaccgtagctgctccaagtgtactcccacaggcaagatcttgatagtaactgtccggccatagtactccagagcaatgtagcccctctgcgactcatacttgagcccgagcatcctgctgcagcacgacaagaagtgtctggcataatcaaaagtgtggaagccaatcagatcggcgttcagcagcgaccggagcagctcctcacgcacaggcagggtcttgtagatctccgacgacgggaaggggctatggaggaagaacccgagcttgacccggttgaagcgcttccgcaggaatgtggggagcaccatgagatggtaatcgtgcacccagacgaagtcttcgtcggggctgatcacctccaggatcttgtcggcgaagatcttgttgaccgacacgtaggcctgccagaggaggcggtcgaagcggccgcctagctccggcgacagtggcagcatgtaatggaacagtggccagagctgctgcttgcagaagccgtggtagaagcgggagcggaggtcggcgggcaggaaggtgggaacgcagcggaagccctcgaggaggtcgtgcgcgacctggtcgtgctcggctgggggcacgtcgtcgcggaggccgccgacgtagacgaactccacgtccgcgcggccgtggtgcgcgcggaggctgtccttgacctgcaggaggaggctgtcctggtcccacgcgaagtcccacccgccgccgccggcgccggcggcggcgcggcgggaggcgcggacggggagctggttggcgacgatgatgacgcgctcccgcggcgcgtgggaggactggtcggcggcggaggcggcgtcggagacgtcgaggtccggcacaatgccggaggccgtcacgacgcgcggtatccggcggcgccccagcgacggcagcggctcgccgccgctgccgccggcggcgagctccaggaggttcgagtaggatctggacaccatgcccgcacgggcgacgtcacagcgagctgcctgccgctgaacctccaaacaaggattcgatctttcaccgctcgccctccaaaccaagatccggcgaacagtactctggagagggtctcaagaaaaagcttcgcaggcagcttaagaatgaacggccggcggagatggaagaggatctgctgtccaccagtctccggcggcgaagagataaatctcggcaagggaatcgaatccgcggagcaactagtaacaatcagaaaaccgaaaaggctgccctccctccctccctccctttccggaaaaaaaaacccacaagcagctttcggccgaaatcaatccggacgaccgagcaacgacgtctcaggtgctccagctgggacggccactaccactaccacacctcgacagaccggcggcaggggggagacagagtctcgcgcgctcgccgacgacgacgacccggtcctggaccggcatttggccacctccgcctcgccctcgctctgcaacgcacggcagcgccaggcagccgctgccgcagccgcagccggcaggatgggtaggaaccggctggatggagaagaaaggatttggcggggcagggaaagcaaaccccgtttccaggaaggaggagggattcgagcgaggcgtgggctggcagcgccgctcgctggatataggaggcggcgcggaacggaagcgattcttggcctcgggtcgcgtgcagggggcgtggtggactggtggtggtggctcttgagcgatcgcaagagacgctgagatgtgtttgtttaagtagcaagcagcaggagcagcagccgagagaacgagttgcgataagctttagcgttttattttattttagtttagtagcagagacgccgatccggagccgancagccgagccgagtggcctcgcgatggagacgcgccgaataaaatactagtaatacaactcgggcgatttgctggaaacaaccctgtgttcttgttgtttatcgcttgggtggccgcttgccctctgcctgccgtcctgtcctgctgcccacgcccacccacccgcccagcagctgttcggatcacgattatggtatgctgctgcctcgaacgaaagcgttatcctgtttgctggtttttagatagcgagcacacgttttggtcgctcaaagagcgtgttgggggaggtggggatttgttcctccggactctctaccaaggcaagcaggaacgggacggaagcgttccttgcgaaacctggagtcttatctgtcgcccgcctgctccgtctccaatttatttatttatttatttatttatttccgttcgtagctgcacgcctgcacatacatgcgatcttttgacttcaattgtttttccaagaaaggactggataatgacgcgttgttttttctcctgccagccagcaactcttaagcccgtccgccgccgccccatccgcgcactgctaaaaactggacaaggaatcaatcgctcctaaacaaatcctgtgcctgcagcgcaggagtttttatttttttatttttttattttttttgccccccgatccgcctcgatcggcatgtgaataacaggaggccgagggaccaccgtgaaaaaaaaagttgggttgttcacacgcagagacagcgcagtacagggggagctagctggaagcgtgagttcccacgatctgcatctgcctgccagtgccaaggcgagcgaaaaaggggaccacgccgcgctgagccctatccacttccggaccctctcgcgccgtccgatccccatcgggcggccggggcagcccgcgtgggaaaatatccgcccgcgtcggccgtgtgagatcgccgctcccgcgcacgtgcggccgcctacgtgtcgcccgggaagggcgccgcggcacgtgccgcggcccagctgtcgctccccccgggcaggaagaaag

SEQ ID NO: 19650 - DNA, 1526 bp, Zea mays
caccacctgccaacagtcgcgagcgacggtcccttccactagttccaccacaaccacaaggggtctcatgcctcctagagctaaacgcaccccgcgcacgccgacacggttcacctcggcacggtgtccgtcgtcatcgtcgccgccgccgagggagggggcggtggggcgtgcgtctggtcgtcgtcggagacgctggcaaggccctggacgaggcgcacgatgtccgcggggtcgtccaggtagtacttggccttgctgggcttgcgccccacagtgcacgcgaacacctccgcctccgcctgcagggaggacacgcccctcgcggcggccgccgccgcgatcacctcgaacatgtcctcgtcggaccggtcgtcgcccacgcacagcacgaagtccggcaggtcgtcgtcggcgtcgccccgctcctgcgtcgtcgacaggatccgcttcgccaccaggcccttgcttacgccctgtggcttcacctcgacgaggttgggtccagctttcactgagaccggctcgtttgcaagcacgctctccagatggtcgtggagctccttggcctggcaggatccgaaatctggatcggcgtcctcgtagcaccacacgatggcagtctccttctcctcaatagtcgacccgtccgtagtctcggtataggtcttcatcacaggctctgcgatctgcttccagctgcagtctatcaccggaacgcatgtctcccactctgcatctcttctcagcctacacaaccgtcgacagcatcagcgattagtgtgtgcgctctccagcagtagcagatcacgaactgcttgggagacagcaggaagttattattttacctgaggaagcagccgtgttcagctgctagtccaaggctctcacatggtaagaaccattcgttcagagtcatccggctctttgcgctcacaaggaagaccatgttgttcctgtcgcggcaaaggctgttcaacatgtctatcgtccttgaggtaggactcttaccgagcgaagtctgcggcatcagcgtcccatcgtagtctaagagaatgacacgcttcttcgtcctccggtaggccaagaccaagtgctccaccgcaagcttcttgaagtttgggtcgagggccacaaccctgaacttcagcccaaaccctatgccccagcaacgcctcctgttatggtcgaggcaaatccgctcaagatcttgcaggaagctgttcgcccagtacccgacgtcgtgcgtgctcacgtatctgtggtgcttctcatgtctcaacaccttctccccttccggcatctccagcgcgtagtccattgcgtcggctactgaatcgatgttccaagggttcacacggatagcgccgctcagggagggcgagcagccgatgaactctgacacgacaagcatgctcttcttccttgaagccggaccaaggcctagaatactatctatcctctcattcccttgtcgagcaattacgtactcgtatgggatcaggttcatcccgtccctcacgcca

SEQ ID NO: 19651 - DNA, 1721 bp, Zea mays
gccggccggggggcccctcgaggctcgtgccggggttccaccctaaacagaggcaggcatcgcagtgcgctccctcctggccgcctctcgagcgagtggcgacgacggcgccttcgctgcgcctcagtcttcttaggcggcgcccctacccctcgaagccttccgccccacctagctcccgtgctcgccagcgtccactgaccagcaggctcccagcccccagctcccaagcagccgcagtgcccctgcaggccgcggcctagcccttgcctgtttgcgtcttgctgctgcacagtgagccagacagcaagctttgtttccttccattcacttcgttgtagtgtggagatcagactaaccaagggcaacccaaatttggggattctttaagtgaagcctctgtatagagatagtttgaagatgatgaaccagcacagggaggaggatgcattgagaggtcaagcagtcaaaaaccagaaggcgatatgggacaagaccctggaaatgagattcttgctgcagaaggcattttctacttccaacaagttgccccaggaacccatcagagcaaggttttgcaatcatgataagcagatagaacaagcctatgatgatctgttgaattcatcgaagcagactttgagcagcatgatggagctgcaggaggctatgctcgagagtaatcaggctacaaagggtgccaatgaaattccttctgcctcaaatggagacaacgacgagtggtcagaagtacagagattgcagacaaggataacaacattcagaaatactgagatagataaatggcagaggaaaatacaggtgacaacgggtgctgctgcacttaaaggaaagctacatgcatttaatcagaacattagtgaccaagttgctggttacatgagagatccaagccggatgattaacaggatgtacttgaccaactctgctgttagtgtatttggaaaggatgtgggagaacctggaacagctgaggaggggcacaatatggaaggtgatcctgaacttattgacgattctgagttttatcaacaacttctcaaggagtttcttgaatcatgtgataagggggcctcagagtcggcaatttatgctctaaaaaagcagcaggttaaaaagaggaagcttgttgatcgtcgtgcttcaaaaagcagaaagatacggtaccatgtccatgagaaggtcactaatttcatggccccagagcccatggttcttcctccaatggctccgaagttgtttgagaatttatttgggaatgccagctagaattcattaaagcttggattcactaaagcttgaattcattaaagcatggattcgttaaagcttgaattcattaaagcttggaacgtcagctagaattcacattacttgatgcagcttttttgtacttttgtagactgcaagtaggtcagtaggtatgatgttttgagtcgaaagttttgatggcctcaccagttttgtgcgagacaagcacagataagtgccatggataggtgggtcctcgctgaatcgatgttacctacaagattctcaaaaatgagagggagcctacgaaattcttagagtttggaagcagcgcatctcctagaatttgtatctagagccagcattctcaattttgataccgttcagctgtgggtttgtgtcgtcataatacaccacgctcactggcttaaaaaaaaaaaaaaaaaaaa

SEQ ID NO: 19652 - DNA, 1992 bp, Zea mays
  misc_feature (1920)..(1920): n is a, c, g, or t
aaatcccgagtctcgagcgagtagcgacggccgcgcctgcgcctgcctgcgtcttccgtggcggcgcccctacctctcgaacccgtcaggcggtctggccgacctcgcttcctcggctagctacctactcgccagcgtctatcggccagcaggcgcccagctcccaagcggccgcagtgcccctgcttctgcccttgcacgttcggcccctgtgctgcactgcacagtgagccagacagcgagtaaggtttgttttcttccattcagtttgttgtactgtggagatcaaactagctaagggcagagccaaatttggggattcttcaactgaagccttgtatagatatagtttgaaagatgatgaacgaacacagagaggaggatgccttgagaggtcaagcagtcaaaaaccagaaggcgatatgggacaagaccttggaaatgagattcttgctgcagaaggtgttttctacttccaacaagttaccccaggaatccatcagaacaaggttttgcattcatgataagcagatagagcaagcatatgatgatcttttgaattcgtcgaaacatactttgagcagcatgatggagctgcaggaggctttgcttgagagtaatcaggctacaaaggatgccaatgaaattccttctgcctcaaatggagacaatgacgagtggtcagaagtacagagattgcaggcaaggataacaacattcagaaataccgagatagataaatggcacaggaaaatacaggtgacaacgggtgctgctgcacttaaaggaaagctacatgcatttaatcagaacattagtgatcaagttgctggttacatgagagatccaagccggatgattaacaggatgtacttgaccaactctgctgttagagtatttggaaaggatgtgggggaacctggaacagctgaggaggggcacattgtggaaggtgatcctgaacttattgatgattctgagttttatcaacaacttctcaaggagttccttgagtcatgtgatagaggggcatcagagtcggcattttactctctaaaaaagcagcaggttaaaaagagaaagcttgtcgatcgtcctgcttcgaagagcaggaagatacggtaccatgtccacgagaagatcactaatttcatggcaccggagcccatggttcttcctccaatggctccgaagttgtttgagaatttatttgggaatagcagctagaatccataaactgcagttggtttacatttctttctgttgccttttctacttctataaactgtagtaggtataatgtcactagacttagactgaattgtaagttttgatgagcgtagacaagcagagcctagttcaccaatcaaattatgcttcgatttgggcctgatgagtgccatttaccggtggaccagcggtgagtcgtgatatacgtgattatcgaaaaatgagttttccgaaaaaaaaaaaaaaaaggccgcttggaccccttcggaactatgtcatcgggtcttaaagacaaaacccgtggactggcgtgttgagtggtttcgaggtttaaccagtgttgagtggttttgaggtttaccatcgaaacccttgtgggtagtgtatgaaaacttcatacgtgacccatgttttagacacgtgttctgttagtgtgtaacgtaaccgtgtcggtaacatgatctgctctaatatccttgcacatgttagtgttcgatcaagtcctagtgcttatccttaccgttttcgatccattgacaagaatccacatgacttttatcttcgtatcaccattttcaactccacgctacaagccaagagatgtgttgtacaaatactctcatgcccaattagtccacccatctcaatccaagacactacttactcgtcacaatcgaaacacaccttatngttgcaaaatgcctaataattggctcacaatccaataattatggactaacaactagttgagtaaattttagc

SEQ ID NO: 19653 - DNA, 1327 bp, Zea mays
  misc_feature (1312)..(1318): n is a, c, g, or t
aggcgcccagctcccaagcggccgcagtgcccctgcttctgcccttgcacgttcggcccctgtgctgcactgcacagtaaggtttgttttcttccattcagtttgttgtactgtggagatcaaactagctaagggcagagccaaatttggggattcttcaactgaagccttgtatagatatagtttgaaagatgatgaacgaacacagagaggaggatgccttgagaggtcaagcagtcaaaaaccagaaggcgatatgggacaagaccatggaaatgagattcttgctgcagaaggcgttttctacttccaacaagttaccccaggaatccatcagaacaaggttttgcaatcatgataagcagatagagcaagcatatgatgatcttttgaattcgacgaaacatactttgagcagcatgatggagctgcaggaggctatgctcgagagtaatcaggctacaaagggtgccaatgaaattccttctgcctcaaatggagacaacgacgagtggtcagaagtacagagattgcagacaaggataacaacattcagaaatactgagatagataaatggcagaggaaaatacaggtgacaacgggtgctgctgcacttaaaggaaagctacatgcatttaatcagaacattagtgaccaagttgctggttacatgagagatccaagtcggatgattaacaggatgtacttgaccaactctgctgttagtgtatttggaaaggatgttggagaacctggaacagctgaggaggggcacaatatggaaggtgatcctgaacttattgacgattctgagttttatcaacaacttctcaaggagtttcttgagtcatgtgataagggggcctcagagtcggcattttatgctctaaaaaagcagcaggttaaaaagaggaagcttgttgatcgtcgtgcttcaaaaagcagaaagataaggtaccatgtccatgagaaggtcactaatttcatggccccagagcccatggttctttctccaatggctccgaagttgtttgagaatttatttgggaatgccaactagaattcattaaagcttggattcactaaagcttgaattcattaaagcatggattcgttaaagcttgaattcattaaagcttcgaactgtcagctagaattcccattacttgatgcaacttccctgtccttttgtagattgcaagtaggtcagtaggtatgatgttttgagtcgaaagttttgatgacctaccagttttgtgcgagacaagcacaaagtgccatggacaggtgggtcctcgctgaatcgatgtnnnnnnnaagattctc

SEQ ID NO: 19654 - DNA, 915 bp, Zea mays
tttatccattttactttatgcgttcatttgtgagacaatttctcattgtgcatttaaacgtattgcttacgttggcgtttcaaatatagggtatcaaagatgatgtaaagtgttgtgcgaaagacagatttagaaaggaggtaggtctaggatgctgcccccacctcccatgagaatgcagatcaaatttaagcgggctccttgaaatgttccaaatcttgttcaaccatggaacatgagcaatttaaggcgtcattatacactaggaacaataaacaaactactgttttgggttcgtcttcaataacacaaggcttcaaatcgtgcataaacaaattgcgtagggtgccctcgtctgctgcttttttcctacagggaaaaaaatacatatcacccagaataggcactattgtatcactacacaacattacatataactgttgtaaaatgtcggctcgctgtgatacagtagcaaaccgcaaaaaaaaacatggcactcagcatataactggtgcataacacaataacactaggttatacaaactttacactccaaaatcaggaatcggtgcaactatacaaccaaaactaatggaaatatggacatttggtgggaacctgcaactgaaagaatgaatcattcacatgctacctaatttctggcttgttacagttctatcatagctcggagagtatagcagggatataatgagatagctcagcggtgagtgactggaacccattgacaagttgggtgtggaattcctggtcttcttcccctatcaatctgaaatgcacacggattgcacgcttgcagacagccatgaattcaagcaatgcggcggtgagctgctgcagttcttgggatctgagcctagttgctggctcgccagataagatcccggcccggccggc

SEQ ID NO: 19655 - DNA, 3622 bp, Zea mays
ggtttgggttttttttttaaaactgcaaaagggccgctagttgtgacatagtagcaaactgcaaaaaagaaggaactcagcatataactggtgcataacagataacactaggtattatacagactttacactccaaaatcaggaatcggttctgcaatacggtacagaacttcgaagactagttaatttccggttcctagaactatacaaccaaagctaatggaaatatggacatttggtgggaacctgcaactgaatgaatgaacaaccattcacatgctacctaatttctggcttgctacagttctatcatagctcggagagtatagcagggatatagtgagatagctcagcggtgagtgactggaacccattgacaagttgggtgtggaattcctggtcttcttcccctatcaatctgaaatgcacacggattgcacgcttgcagacagccatgaattcaagcaatgcagcgatgagctgctgcagttcttgggatctgagcctagtcgctggctcaccagataagaatgcagtgcacacacttaataccccactgttgacctgcacagccacacttccttggagtatcctttgcaagctctgaagccttgggagttgatcaccttcagaactccgtggttcttctagctcatttctcaatgcagctgtccttgtttcgatcattccaatcgcattctcgacaggagagaactccagagattcagatttgataactggcagacggttcaccaaagcgggaaaggaaccctctgtttggagcactgtgcgcctcttccactggtcttctagaccaccttgtgtttttccattttttgtgaatggtgtatcgaaaagaaaacggtcaaaaacacgtgcacgaacagtaccagtagataaagaaaatattctttccctcctgctacccaagtcctcatcctccatcacaggatcaacagcagtgatctgtaaatagcagaagccaggctgcaactcatcagcgttgacttgtctagagtctggaattatgtgtaaagtgtgacttccatctattttagcctcatatatatgactaagcttctccataatatcaccaagacgtacatcccgtggttctctaaatacatactcctttttattgagcttgccaaaacgctcaccatagaaaccaactcggtagtatgtggcatcaatgaatggtatagggctagcctcctgttcaagaattgactcatagatgtttgtgagcgatgtgtggcatttggccagctgtccataagcccttctgcttttatacacaggaattatgagttcctgaatgcttgcacaaaaatggtagagttcagcttgtgtgaaaagtttattggctagttgaagatatttgaccgctgagtccactgttaatttggatgcaccatatccctcgacttcagctgcagatgcttctgcactcacatcagtgttgacaatagggcaaatcttgcgcagcgaagcaacatgctccttgctccacacagcatcattccttccaacaagtgcctgcatgatcacgccagctacagcaactgcacattgtgctgcttcagcccatgattgcatctcctggtgtgcatcacacagatgaagcaaccacataatgtgaagatctggaacgggtgcataggccatagctagtttatagaaaccctcggcagctgcatacctgtctacagtcactacagaacccaggagggcgtgttccagaccagcatcaagggcctggactagacatttagacaaatgtttcacctctacccaagaccacctattatcagaggagccttcaggggccgcctccaatgcagtaacagggaggccacaatcttttaacagatccttgcttctcacatcagccatttcctccagtgatttcctaaggcgccgagcttcaccactttcttcaagagaaccatcgaatttcatttgagttacttgcacgtcggacatcaactcggacaaagtaattgtcaacatgacccttaaccttgtagtgtttttgaaatagttgaatgagttcctaacaagaatctgcagcccaacaacagctctttttctaatcgaatcgtttcggaaaacagcaagccgcaaaagatgaaaagcaatttgcttcaagaagcggtcattctcccttgccattagtgttgcaccatgaacattaaatatattgtagaccacaggaaggaaagccttccaaaaagccaaggattggttcctagataaaagacccattaagattgatgttacacaatctagcttcgcgtaatcagtagtgatgcttcgagcgcctgcagcaactgaaaacttctcagttattcccaacacttcgaggctcacggcagtactgagattttcttcccaaagttccattttttgtctcagcactggatgtagagactctctcaatgccctggcggttgacccgattcttgaagattgtgcttgagcaagtgcttctctcaatgaatagggctgattaggggaacttaattgagggctaaccctgttccacatgtatccattttctggtgttccctgaggccttatttcatgcctcgaagcctccgacaaatatgtgttgaccgatggggacaatcgttcagagtactttggggatgcaggatgctcgacatctgggctccgagaactagcaccaagtagcatgttgtctcctgttttgttgtgctcgaaatggattatacattcttcaagaagcttgaagaacaatctggttctagcaatgctttgttgccatgctttgataagagttgcatcatccaagttcctcacaatttgcaaaatgacaactagcacttcacgcttttcaatggcattcagattatagaaaacaggcatctcatcaaggatctgccctataagaggaaaatacagctgagcaatgtacaatttgtcttcgcttttttgatagcgtgcatcaaattcatgtttgcatataaggacaaccaaaatccgagcagccttcgctcgttgagataaatcatcatggtctaaggtcagaaagatctcttggatgagaactgacgagagatagtttctatcagaaggatcccgcccaggcatctcaacgaatagatcatggtcgcatattatctgcaggaatgtcaatttgcagtcatgaaggactgattgacaaactcctgcaaacttgtccatgtacaacgaaaccagctcaaaaacttggcgaggctcaataattgataaaagatcatagcaaaagaaagcaagtgtgctgttcaagcgttttgccaagcttaaaccctttttacaacgctcatgaacctcagttagaaggcaatcaaagagctgcatgatgcacctgaagacaccttctttcaattgcagcggtgggacatcttcacctagtggaaggttgtggtagaagagacgactttgttccaatcccattgattttacaataagctccagaaaaaaccaagccattgccaacacatcatcatacacaggaccaactctataacctttcgccttactcctagcaagacttccccaaacagtagacagaccaggatacacaggtgcttgccgaccgccgaagtcatcaaaa

SEQ ID NO: 19656 - DNA, 2463 bp, Zea mays
  misc_feature (2)..(31): n is a, c, g, or t
annnnnnnnnnnnnnnnnnnnnnnnnnnnnnggcttcaaatcgtgcataaacaaattgcgaggatgccctcgacagcagcaaaggccgcccctttttttttttttttttcacccagaataggcactattgtatcactacagaacattacatataactgttgtaaaatgtcggctcgctgtgatacagtagcaaaccgcaaaaaacatggcactcagcatataactggtgcataacagaaaacactaggttatacaaactttacactccaaaatcaggaatcggtgcaactatacaaccaaaactaatggaaatatggacatttggtgggaacctgcaactgaaagaatgaatcattcacatgctacctaatttctggcttgttacagttctatcatagctcggagagtatagcagggatataatgagatagctcagcggtgagtgactggaacccattgacaagttgggtgtggaattcctggtcttcttcccctatcaatctgaaatgcacacggattgcacgcttgcagacagccatgaattcaagcaatgcagcgatgagctgctgcagttcttgggatctgagcctagttgctggctcgccagataagaatgcagtgcacacacttaataccccactgttgacctgcacagccacacttccttggagtatcctttgcaagctctgaagccttgggagttgatcaccttcagaactccgtggttcttctagctcatttctcaatgcagctgtccttgtttcgatcattccaatcgcattctcgacaggagagaactccagagattcagatttgataactggcagacggttcaccaaagcgggaaaggaaccctctgtttggagcactgtgcgcctcttccactggtcttctagaccaccttgtgtttttccattttttgtgaatggtgtatcgaaaagaaaacggtcaaaaacacgtgcacgaacagtaccagtagataaagaaaatattctttccctcctgctacccaagtcctcatcctccatcacaggatcaacagcagtgatctgtaaatagcagaagccaggctgcaactcatcagcgttgacttgtctagagtctggaattatgtgtaaagtgtgacttccatctattttagcctcatatatatgactaagcttctccataatatcaccaagacgtacatcccgtggttctctaaatacatactcctttttattgagcttgccaaaacgctcaccatagaaaccaactcggtagtatgtggcatcaatgaatggtatagggctagcctcctgttcaagaattgactcatagatgtttgtgagcgatgtgtggcatttggccagctgtccataagcccttctgcttttatacacaggaattatgagttcctgaatgcttgcacaaaaatggtagagttcagcttgtgtgaaaagtttattggctagttgaagatatttgaccgctgagtccactgttaatttggatgcaccatatccctcgacttcagctgcagatgcttctgcactcacatcagtgttgacaatagggcaaatcttgcgcagcgaagcaacatgctccttgctccacacagcatcattccttccaacaagtgcctgcatgatcacgccagctacagcaactgcacattgtgctgcttcagcccatgattgcatctcctggtgtgcatcacacagatgaagcaaccacataatgtgaagatctggaacgggtgcataggccatagctagtttatagaaaccctcagcagctgcatacctgtctacagtcactacagaatccaagagggcgtgttccagaccagcatcaagggcctggactagacatttagagagatgtttcacctctgcccaagaccacatattatcagaggaaccatcaggggccgcctccaatgcagtaacagggaggccacaatctttcaacagatccttgcttcttacatcagccatttcctccagtgattttctaaggcgccgagcttcaccactttcttcaagagaaccatcggatttcatttgagtcacttgcacatcagacaacaactctgacaaagtaattgtcaacatgactctcaaccttgtagtgttcttgaaatagttgaatgcgttcctaacgagaatctgcaacccaacaacagctcttttcctaatagaatcatttcgaaaaacagcaagccgcaaaagatgaaaagcaatttgcttcaagaagcggtcattctcccttgccattagtgttgcaccatgaagattaaatatgttgtagaccacaggaaggaaagccttccaaaacgcaagcgttcggctccgacgtaaaagccccattccgatagatgttccccaatctaggcttcgcataatcagtagtgatgcttctagtgcctgcagcagctgaaaccttctcggttattctcaacacttcgaggctcacagcagt

SEQ ID NO: 19657 - DNA, 3925 bp, Zea mays
ttggtgtttttttttttttttaagggaaacttattttagcatatactgaagatattcaaattatttacagcagtaccttgaacaagtcgcatgcgtgctataaacgaattagcacggctttgaaacacttctctttcttgctgccaccatctctccttttcaacatcagtcccataagactcggctgatttccccatcaaaaggttccaaaccctcgtcgtctcaaaatccaagtcaaccttagcacgaggccgctgctttttgactaactgcaagggcctctcattgggaaccatcaccacaccaccatatgggacaagagcatttgaaggaccacttgttccctcaaaagaaataacagctggtgtggtcagagataaatgcatctcagttctctgcacctgttcagtattcaaatcaagatgcttcaactttgatgcaactccttgaacgtaatccacgttgcggccggttgatgtgttggttgatctcccttctgctacttcacaatgagtatcaacgttgattcttttattgtccatggtctgagatgaaaagtttggagaactctcttctgatattttgcatccattagttgcgccataaaaagtgcttccagctgaaagcctgtccttcagctcatcacttggttgaattacactggaacagtgcggtcttgccttttctgaacgttttttggtcaaaaacttaatgcaagaacttctatgcagcgcatccatgcatggctgtggcagtcttgttgatgcttgtagagtattattcttaagatccatagtataaaagggggaatttctgcggagtcgggcagatcgcttcttttttattgcacccgcttggaaaaatgcgaacatctcagctgcagccctcaagacaacagagtcccgtgtgccaggtagcgaaccattgctatggtgtgtggggttttccacttccgacaccttacccatctgacttcttgtgggatccatttgaggtaaagacctagctgaggaaacaagaccatcagcatcagaatagtttaattccaagtcctttttgttcccttctattgtggggtttaccaccctttcatcagcaaacaaactgcacttacttttgccatcaggtttgcaagttcttcccacattatcttcttcccttgccagttccgtactaaatgatgcagaagttgcagccgaaacttcttgtgtaggttttagcatatctggcaaatgtatgtactcatctaaaaatttgttcagtctgcgactcatgtcgaaagctaattctcctggtgaattctccataccttcttgcatcacacgcccagtctgcacttctgactctgagtagaaagaactttgagcatggccaggtttctcatagttgtgatggtgtatgttggccattgacgaatggcctccctgcaatccttgttctttggattcaaattgcagacttcgtcgaactgatgatgttctgcttctagctgcaactcctgttgctccagagattgattgatcgctaacaggaccagaccaattctccagagagctgaggtttcttttcttccggacataacttctcttgaccttttggttcggagattttccatctggtgttgaatcaggttttggcactttggctggcttattttctctgattacctttggtctgtgttttttcttccgagccttcattttcagcgctggggtttcctcattcctgaacatttcggttttctcggcacttgctagctgcgtctcaatttgagttagtgttttctccttgggtacagttggtgccgacaatggtgtgtgttcactcttgttgatttgtgtcttgagccttttttgcatagattggtacatatgaatgttgtcatcagtggtactttctgcaagacaggtggttgattcttgagaatgttgcactcgtgtttcccaggtagctgcaggcacccctgattccaaatcattgtagctgtcacggaaaattgctgttgctaattgtggaagttgggtacttccttttccattttcagtcttggatgcttcatcatgtaaacaattcatccgatgctctgaatcgtgcttgcctgcagtggctagctgtgaagaattcgttgtcatatcacctgcaacgatgctaggtgttcttccatgtgacaagaaattactcccagcaagccgaatggaagctccttcggaatacatagagcaacagaaaacaaagagcgttcagtgcattcataatgtatgataatatggccacacaaaacagaaccagcatgacacctagaaagaacaacaagatggggggacatgcttaccctctgaaacatcaggtaaggcagtggccgacggcgacaactgcggcctcgaaccccttctagtgagttccctatggaacactatgatattaataggcacctgcgtgcaacccccaggcatattccaggatggctggatgcagggcacatcaccttgttcagttgcacggtttatcggactcaacagagcagattgtggagcaggaacctcctgaatagtattcaggacagacgtggagcatggggagaataagacttgcgaggcgatcgagccgctgttgcctgctgcagctggagctgcaacattgtgacagcctaagttgggcaccccagcactcaggaacagaggcctgttggcaggggtgtttggatcgcctctccccgcagacatggcttcaccgggtcttcgggagttgcgttcagtttcgagcttgagggtgaatccttgcttcttccagggcctgcaggaagaacatcatcagaatacggataaataaccacaacatttcgaattgtgctcaaatatccccaaaacccctgggaaaaatcacaccaaaagcacttgatacaaagtttgtaaactgtttgcatctgataaccaaacttgcggtactcaagctggattcatgttactgaacagaaaaaataataataaagacgaaaaagagatgagcaaattattccagctagttgtctaagggacaaaaggacaaggggcacaaaatcacacgcaagaaaaggctagaagattccttcctgtgcttgttctagcaaaaaaaaaaaccgcagaagtgtaagtgcaacaaccattctatctttctaaaatattggggaaaagaaaattctcccttggtggaaaaaaaacacgattttatactgctctcaatccagtggcaggcatcagaaggcatgcataaacttgtaaatagatcagatccgatgacagatagccaaatagctcaagttagggattgggagctcggtttcgcacaggaggaagggaagaaatggggtgcgcatacttggtgggtgctcgtcgccagcgaaggaaccgtcgatggcggggccccccgccgcgcggcggcggcggtcgcccagttgtcgcacgagaggaagaacgcgcacgcggggtgaacagcagaacagaaggcaggggtgaattccggggatgttactggatggtgatagctgcgccgttgggccaccgggctgaaaccgtgtgtgtggatcatctgctcttggaatgtgccttctcccatgcgacgtgtgctatactattggattcatggcgccagagtttcccaaactcggaagaggtccggcgagcggtgtctcggagaggacgcaccaccgtgggcgctggacggctggaggggacgagcaaactcggttttggacggaagcagacgtcgcaggtattttattttaaaagctgcgattggcgccagacgtatcgtctgagcgccaaacggtaataggaatgacaatggatcggattcgatttagatatagtaaaacttatttatgattatacctatgaatttacttaaatctacccacaatcgtatttgtcggtgcaattccaaacttgca

SEQ ID NO: 19658 - DNA, 1460 bp, Zea mays
cggagccacccagggacaccacgaaaacaccatttcctttcttgccgtgcaggaaagaaaccattcactccccgctgctccggttccgccacaccgtccgcttaaaatccaaaggctccggtcactcgccgcccttcacaagaccgcacgctccccctctagtcatctcctcaaacaaaaaccctagccgccgcgccgccccgctccctagtggtcctccctcccccaccactgcagctccgtcccggcggccccaagagttgcggcgaggatgaacgtgaagggcggcagccggattccggtaccccctccgggggccagcgcgctggtcaaggtggccgtgttcggcggcgccgccgtgtacgctgccatgaacagcctctacaacgtcgagggtgggcaccgcgccatcgtcttcaaccgcatccaggggatcaaggacaaggtataccccgaagggactcactttatgattccatggtttgaacgaccaatcatttatgatgtccgtgctcgaccgaatcttgttgagagtacttctgggagtcgggatcttcagatggtgaaaattggtctccgtgtccttacaaggcctatgccagagaggctaccacatatctacagaactctgggagagaacttcaatgagagagttttgccttcaatcatccatgaaacactgaaagctgttgttgctcaatataatgctagtcagctgatcacacagagagagactgtgagtagggagattaggaagatactgactgagagggctagattcttcaacattgctcttgatgacgtctccatcacaagcctgagctttgggaaggagtttactcatgccattgaagcgaagcaggttgctgcacaggaagctgagcgtgctaagttcattgtcgagaaagctgaacaagataagagaagtgcaattatcagggctcagggagaggctaagagtgcggagctgattggtcaagccatagcgaacaaccctgccttccttgccctgaggcagattgaagctgcaagggagatctcccacaccatttcggcctcagccaacaaggtgttcctggactccaacgacctgctgctcaacctccagcagctgaatgtatcgagcaagcagaagaaatgatgtcacaacgttatcccctttcttctgagtttgcagtcagtagtggatgcctttgtaccagacattgtgaggaacgctcggttttggatgtagtttcgccaatcttcctgttatgtggaacttgcgagtatttgctcaaaggcaagcaagctgacaggttttgtttaaacgtaactacaggatgagaaagttttcaataaggaacaaattctgttatgccaccaggaattacccctattgagagaaaattctcaacatgccactataattttaccaaaaaaaaaaaaaaaaaaccggccgccactgttgtgctacaaaa

SEQ ID NO: 19659 - DNA, 854 bp, Zea mays
  misc_feature (649)..(649): n is a, c, g, or t
  misc_feature (745)..(745): n is a, c, g, or t
  misc_feature (815)..(816): n is a, c, g, or t
attggtacctcgagccggccgggaaaacaaaaaccctagccgccgcgccgccccgctccctagtggtgctccctcccccaccactgcagctccgtcccggcggccccaagagttgcggcgaggatgaacgtgaagggcggcagccgggattccggtacccccgccgggggccagcgcgctggtcaaggtggccgtgttcggcggcgccgccgtgtacgcccccggggcccatgaacagcctctacaacgtcgagggtgggcaccgcgccatcgtcttcaaccgcatccaggggatcaaggacaaggtataccctgaagggactcactttatgattccatggtttgaacgaccaatcatttatgatgtccgtgctcgaccaaatcttgttgagagtacttctgggagtcgggatcttcagatggtgaaaattggtctccgtgtccttacaaggcctatgccagagaggctaccacatatctacagaactctgggagagaacttcaatgagagagttttgccttcaatcatccatgaaacactgaaagctgttgttgctcaatataatgctagtcagctgatcacacagagagagactgtgagtagggagattaggaagatactgactgagagggctagattcttcaacanttgctcttgatgacgtctccatcacaagcctgagcttttgggaaggaggttactcatgccattgaaagcgaagcaggttgctgcacaggaaagctngagcgtgcctaagtccattggccgagaagcctgacaaagataagagaagtgcaattatcagggctcaggnnagagctaaaagtgcgggagctgattggtcaagcatagc

SEQ ID NO: 19660 - DNA, 5123 bp, Zea mays
  misc_feature (1333)..(1336): n is a, c, g, or t
ctttatccgcacctccgtatccacgcctcgcacttcccacgccgcccgcccaacacccttggtgtgcggcccctcgccgcccttcacaagaccgcacgctccccctctagtcatctcctcaaacaaaaaccctagccgccgcgccgccccgctccctagtggtcctccctcccccaccactgcagctccgtcccggcggccccaagagttgcggcgaggatgaacgtgaagggcggcagccggattccggtaccccctccgggggccagcgcgctggtcaaggtggccgtgttcggcggcgccgccgtgtacgctgccatgaacagcctctacaacgtcgagggtgggcaccgcgccatcgtcttcaaccgcatccaggggatcaaggacaaggtataccccgaagggactcactttatgattccatggtttgaacgaccaatcatttatgatgtccgtgctcgaccgaatcttgttgagagtacttctgggagtcgggatcttcagatggtgaaaattggtctccgtgtccttacaaggcctatgccagagaggctaccacatatctacagaactctgggagagaacttcaatgagagagttttgccttcaatcatccatgaaacactgaaagctgttgttgctcaatataatgctagtcagctgatcacacagagagagactgtgagtagggagattaggaagatactgactgagagggctagattcttcaacattgctcttgatgacgtctccatcacaagcctgagctttgggaaggagtttactcatgccattgaagcgaagcaggttgctgcacaggaagctgagcgtgctaagttcattgtcgagaaagctgaacaagataagagaagtgcaattatcagggctcagggagaggctaagagtgcggagctgattggtcaagccatagcgaacaaccctgccttccttgccctgaggcagattgaagctgcaagggagatctcccacaccatttcggcctcagccaacaaggtgttcctggactccaacgacctgctgctcaacctccagcagctgaatgtatcgagcaagcagaagaaatgatgtcacaacgttatcccatttcttctgagtttgcagtcagtagtggatgcctttgtaccagacattgtgaggaacgctcggttttggatgtagtttcgccaatcttcctgttatgtggaacttgcgagtatttgctcaaaggcaagcaagctgacaggttttgtttaaacgtaactacaggatgagaaagttttcaataaggaacaaattctgttatgccaccaaaaaaaaaaaaaaacggcannnnccaccgcgctgcagtggatcatggccgagctggtgaagaacccggacgcgcaggagaagctctacagcgagatcagggcaacgtgcagcgacgaccaaccggaggtcggcgaggaggacacgcacaggatgccgtacctcaaggccgtcgtgctcgagggactgcgccggcacccccctgcgcatttcgtgctgtcgcacaaggcggcggaggatacggaggtgggcgggtacctgatccccaagggcgcgacggtgaacttcacggtggcggagatgggctgggacgagcgggagtgggacaggcccatggagttcgtgccggagcggttcctgtcaggcggcgacggtgagggcgtcgacgtgactggcagcagagagatcaagatgatgcccttcggcgccgggcggcggatttgcgccgggctcggcatcgccatgcttcacttggagtacttcgtcgccaacttggtcagggaattcgaatggaaagaggtgcccggcgacgaggtggatttgtctgagacgcgcgagttcaccaccgtcatgaagaaaccgctccgcgcgcagctggtgcgcagaacaacttgtgtatgaatggcgattaatggcccatcaccgcgtctgtagaaggccaaaaaaaccatccttctggctcttggctcttctctcatcaagggtcaccaaaccgcttgataaatccggctaaccggtaattggcgtcggctggtaatttgaaaacttttaatgtcaatttttgtactatggattatttgaagacttgctactgaaaccaaatttcaaaatgcacaacggatttcaaacttggccccttgggcccttcgaaaaaaagagaaaaactgatatataggttaggattgctgattaattgctccctaaagttgataaatcgatgtgtaggaccgattagttggcggctaggtagaaggtagagtatgaaagattttacccctttttactagaaatcttttcaaattactaatgatacttgcaatatcggttaacaatacttgtactgataaatcatattattggtagctaggaatgttctaatttttggtagcatcatggttatctttatcccttcttctatatgtgaattattcggtcgctgaagtgattcgacaatcaatgagctgggtgtatcaatgggaggagcctgagtactaccaaatgttgatggactcgtgtagtacacttatatgtggactagatagacttgggcgaagtacaatgcgtaatagatgcatgagcaaggtattatgttactcttatcagaggagtgtaatacaacacaaaaccagtggaatgcacacccgtgggaatggtcttcaccggatggtgtattgtatcttcgatgatatttatgaactataaaactgtgatatataatatatttgaaccatgaaactgtatcatgcaatgcattttgaacaatgtttttattggacttgtgctaacatttaggccattttttgtttaaattttgtgacctaaatatgctttttttttgccaaaaacacgaggttcagtttctcacgtacggccgacagtttgtcaaattggtgaccgatatcagtttcgagccgtttgaattcaaaactggatcgattttgaattcaaacggtttctaccggtttctatctatttatcacgattaatcggatatcagtcccgaccgattttagctaaggatccagtttggttaaccatgcttctcatagtccttgttctagctcctgtagcagtaaaccggcttaacatcacagtacccaccttcacttgcaaaatactcctgttttttttatttatcttgttttaattttaaaataaactagtggataacaaatattcgagaatacagttaatataaacaacggttgctttgattcttatattgccgggctccttagatgtagggggcctgggctcagaaccatgtgcaacgtagagcaccaagcgaagaaaagaataggaagtatttgttcatctgaatatctccggagcttgaataagttgagatgtgacatttatctccgtaatccacgtgttttgcactggtttagaataaacttgtttttttatatttttttatctaggattagaaccatataattgataataataggaacaccatatatgtatgtaatgtaacgtagagcaccgatgaaaaaaatacggagtatggttcatccgcatatcaccggagctaggataagaaagttgaggtactcgcccatgtatcctcttaattcgtgtgttctgcagtagttttgtgtaaaatgattttctatttatttttctctctaggattagagccatataactgttaataataggaacgacatattatggcaaaaaggaaaagtttgattcaaaggagaacatgcggcaaaaatagaaaaatatcatttatttcgtcgatcctaaaaggatactccaaagtttactctttgagtttaagtgaaaaaatatgcatggattgaagtggtatatatatagatgaccaataagcacgaggcccgtgagcccggcataaagcccgctgtttaggtccggtccgagcccgacacgacccggttctatgtaggctcgagccggtccgacacgaataagcgagtcaggctcggacaggaaactaggcacagtgggctagcccgacaccgtctgtttacctctaagcccgttaaactcgctttttttacactaaaacgtgtttactggcccgcttagcttgcttttcagtccgcttttttcgtgctacctggcccgtttaggcccgctgcggaccgggctcgaacaggaaattgagcccgcgtgcttagacggcctggcccggttttctaaccgtgtctgacgggctggacccaaaacgggccggacacggtgcgggcttcactgtgcccgggccgggccgggcgacccgtttgaccatctctaggtatatatgcatggattttcttccaattcttgaagctgcagaatcttcttgatgcaatctagtcccatagggcgcaactccaatagttaaataaaaagtcgtttcttcaaaagctctctaaatagacttctaaatatagcagttcgtgcagccgggacgcacgcgccgttagggagaccaggccttctcttccgtgcgtcaagaccagtgttcttgccgacgcgccgccagggtgaccaggtgcgtcaggacctcatgtgataaatcgatgtaaggaatcctccacagaacatggttgtgattcttattattcagccgttccaccagattggtcccatagatacatcgatttactatgattgagtagtttttgtcggggtagggagaactgcagggtatgtagaactgatgaattgaagctatgttttatttttcatttgatggatgcaatctttataccaatacgtgtgcatttttttgtatgcatatgcagaagcaaccattagaagcaatggaaggaaggggatggttgtactttcaccggtctgctggaacaagccttatatgacgagagtttcacagacgcttgcaatacacaatatgagtggcagcagccaccacctataaagattagcagtcaaacatcaaagcaaaaccagaagcaaaaaggaaaaaaaaacttcaatgatgacgaagacatacttctcattggagcacggttgaatgtcagtatggatccaacaaaagggacgaatcaaactaaggctacattttggcaaagagttcatgttgtaagcttagagaaataagtgacatgctttctaca

SEQ ID NO: 19661 - DNA, 2925 bp, Zea mays
ccgggctcacttcgcgcatctcccccctccctgcgcacagccgcacaccaccaacacctttcaccagacgccgccgccgccgccgccgccaccccccatccctgtcccgtcccgcgcgcggccgccacatccgtccgggcctcctcgtctccccagccccgctgccgcagggttcatcagcagaagttgcttgctccgccgccgccgccctcttcctcctctactgattttgcttcggggttcggctaaatttcgtcggatggatatcgatgccagcgccagcgtcatgtgccagctgctgagccccgagggagaccctttaggctctgcgctctatctgccccagaacgtcgggcccccgcagctccaggagattgtcaatcagctcctccacaatgaggagaagattgccctatgcattctacgttggagacgaggagctctctgtccacctgggtgcttacatgcggcagaagaacgccaatgttgaggttactctgcgcatagtatgccaaccacaagcacttttccggatcaggccggtcaaccgatgctctgccacgattgctggccacacggaagctgtaattgctgtttcttttagccctgatggaaagagtttggcgagcggttcaggtgacaccactgttcgcttttgggacctgagtacacagactccactgttcacatgcaaaggacacaaaaattgggttctctgcattgcatggtcacctgatggaaaacatcttgttagtggaagcaagtcgggagaacttatattatgggacccaaaaactgggaaccaattgggcactccacttatgggacacaggaaatggattactgctgtatcatgggagccagttcatttgcagtctccgtgccgccgctttgtaagtgcaagcaaggacggtgatgctcgcatttgggacatcaccacaaggaaatgtgttatttcccttacaggtcacactagttcagtgacctgtgtcaagtggggtggagatggtttgatttatactggttcccaagattgtttaatcaaagtatgggaaacttctcagggaaagttggtcaaaacattgaagggtcatgggcactgggtgaattcgcttgctttgagcacggaatatgttctccgtactggagcatatgaccacactggcaagacattttcaactgcagaggaaatgaaagaggctgctcttgcgagatacaagaagatgaggggtaatgctccggagagactagtttctggttctgatgattttacaatgtttctttgggaaccaacaattagtaaacaacctaaagctcgcatgactggtcatcagaagcttgtaaaccatgtttacttttcccctgatggacaatggttggcaagtgcatcctttgataaatctgtcaagttgtggaatggtatcacaggtaaatttgttgcagcattcagagggcacgttgcagatgtctaccagatcagctggtctgccgacagtaggcttctactaagtggaagcaaggattccactctaaagatctgggatattcgaacacacaagttgaaaatggacttgccgggccacgcggatgaggtgtacaccgtggattggagccctgacggtgaaaaggtggcgtctggtggcaaggatcgggtcctcaagctatggatgaactgattgattattatatatctatgcttgggcgaattatatattgtagtgatgataattttgaaggtatactgagatcaattaattgtacaagatccatgcttggctcaaaactggaagaagctagctggaaatcatgagttcagttggtggtgctcttcttcttcttcttgttcttcttcttgaggtccgtggcatagtagttgcatgtgatgaagacgcctcccttgaagcactctgctcgtgcgcatcccaccttggtgctcctcttgccgaccatgagcgcgaagtggccgcactccttgtacgccctgccgcctgtgcactgctccgtgttcctgtcgtagatggactcctccttgccccaccagaagacggcctccttggcggtggcgttccagtcgtcgtggctcctgaacaggctctcgccgtacttgtggccgctgtggacgagctcgcagtccttgcgcatgcggttggaccagcgccgcgcctgccgcgccagcttcctgtcccacttcatgggcggcacgccgtagcgcgcgcggagctcgttgtgggcgtccacgaactcccgggcgatgcccttgtaccaccccgtgccgttggtcggtgacacgatgcccttctccttggcgtacttgagcagctcctgctgggcagccttctccgccgcgaccgccttctccatctcctgctccttctccttctccttctcgccggcctcttccgacgacgacgacgaagaagattctccgctgctactgtcggtctcagtctcactctcagacggagacgactggtgcagcagagacgacgacgaggaggccagggcgcccgaggaggggacgttggagaggacgacggcgacgacgaggagcagcagtactgctatgctgctgctgggcgccatgctggctagctatggttcaagatcgagctaggcacgccgacgccggccctcctctcttgccaacgtcgtcgggcgtgcgctcgaccctaagggctgccggcaggggccttttatgcatgcatgccaacagctagctagcggtcctccattcttggctctgctccaacgcacgcatgcatggccttttttcgcgcggtttcgctggttcgttggacggttcgtcttcatcgattgtcctgttgcttcaatcatcgtagctaggtgtctatatatagctgctaccttgcttctctagctttatatatatatatatatatatatatatatatatatatatatata

SEQ ID NO: 19662 - DNA, 1247 bp, Zea mays
ggccgcaaatttttgctcggttcccctggaatgaactgatcaattggctgtctgctgtactcgatcgtgtgtatatatatagatatagatacaatctgcttgactgattgggctcaaaattggaagaacaaaattaaaaaacaaaaaagaagaagagggaggaggatcctctcgtacgtagcagtcgtcgtcttcttcatcatcatcatctccaacctcggaatcaggcaattgcttcagtagtaattaattaacaatccaatcatcactcagtaaataagtcagcgctactacgtacgtacgtagataggaacgaacagatgggtggatggagtcagttatcgtttggtgttttgttcttgttcttgtccaggtccgttgcatagtagttgcaggtgatgaagacgccgcccttgaagcactcggctcgtgcgcagccgaccttggtgctcctcttgccgaccatgagcgcgaagtggccgcactccttgaagaccttgccgtacttgcacttctccttgtccttgtcgtagatggcctcctccttgccccaccagaagacggcctccctggcggtggcgttccagtcgtcgtagctcctgaacacgctctcgccgtactcgtggccgctgtggaggatctggcagtccttgcgcatggcgttggaccagcgccgcgcctgccgcgccagctggttgtcccacttcatgggcggcacgccgtagcgcgcgcggagctcgttgtgggcgtccacgaactcccgggcgatgcccctgtaccaccccgtgccgttggtcggggacaccagacccttctccttggcgtacttgagcatctcctgctggacgaccttctccgccgcgtacgccttctccttggccagctgccgctctttctccttgttctcgtcttccggcggggcttgctgctcgctgccgccgcttgtctcatcactctcaggaggtgagtgcagaagcgaggacgaggaggacagggcggcggaggggaggacgacgaaggcgacgaggaggagcagtgctgccatgccgctgctggtgggcaggcgggccatgctgcaggttatggtggttaggaacgccctcctctcttgccaacgttggagttgggaaggagggggccggggtccgtccgatccggcgtgacgggagagcgcgagggtgaccgcgggcggccggcggggaggagtcccggccgggggcgaggaaccccccctccggggtgggggg

SEQ ID NO: 19663 - DNA, 1561 bp, Zea mays
atttgactaagactggatttcattccactttcctatttctcaacaacaacttccctcatcagctatttcgcgttttcaaagtcattaattgccccataccccttttatatttagattgtatggcgtaatgtaccttatgcaaatggaattctagggttcctttattttcttatggaataagaagaattcttccattctctttttattttggttttccccaaagaaaaacttttcgagggagcagaattcctagtaaaaaaatacaggatccctccacttagatgaaaaggaatttttccatccaatccaatagagccatggaattcccgagccgttgtggctgtacctgtactgcaggaatacgaaaactcgctattcactcagtttattttccataataagattatgtaggagagatggccgagcggttcaaggcgtagcattggaactgctatgtagacttttgtttaccgagggttcgaatccctctctttccgtttctcttaattcatcaatgttagcgatcacaatgtatcaaattaaataacaatttattccaacaataatacctttaattaatagaaattctctatagcaaattactgtggtatgtaaaatacacatcgaggaaataacaaaaaagaaaaaagtatcctagggttaatctatttctgctaggtgaacgggaaaatacgaattaagagccttaggtcgatttagttcggggaaaggggaaggggaaaaaaattctatgaacctttccttttttcgttaagttcaagtctggcgagaataatattctacaactaacaactcatttattttgagaccgacccacttcctatctagaattttttttactagtcctttatattgcaatgtgtcaaccgtcaaatgctttggtaatttgcccggatcggatgaagcaatataattttgaaccaaacgttttgatcgttggttatccttcgtagtaataatatctcggggtttgcaacgaaagcttggtatatcaactatacgaccattaactaaaatatgtctatggttaactaattgtcgggccccaggaatggttgaagccatacccaatcgaaaaaggatattatccaaacgcatttcaagtaattgtagtaaaacctgacctgtggatctttttgcttttccagcgatatgtacatatctaagtaattgtcgttctgtcagaccataatgaaaacgcaatttctgtttttcttgaagacgaatacgatattgctcttttttcccagaatggaatttctttttctgattacttccggatttaggcgtttttctagtgagtcctggtaaagctcccagacggcgtattttttttaaacgaggccctcgataacgggacatgaagactccttttttattttattgaaatttcattttacacaataaatttcgttctatttacattacagaatacagcgatgtacgaacagcagggaacccaaggataaacagagtaaaatctactaaagtaacacaaaaaatggagtaacacaaaaaatggaatttcatcaactatgga

SEQ ID NO: 19664 - DNA, 2762 bp, Zea mays
  misc_feature (2029)..(2029): n is a, c, g, or t
  misc_feature (2294)..(2294): n is a, c, g, or t
gtacagattttcataattataagccgcctgcgctgcgccgccggttgccccctcacttcgcgtgctccattcccatctcccccctccctgcgcgcagccgcacaccaccaacacctttcaccagacgccgccgccgccaccccccatccctgtcccgtcccgcgcgcggccgccacatccgtccgggcatcctcgtctccccagccccgctgccgcaggtgagctacgcctcctcctcgctttctcctccttttccttccttcctgtgctggcgcctcctcctctctttatcgctggattcggcgctgaaaattcgatggagggaaacgccttggctctagggatgcccgcggatgctacttgtgcgtgcatgcgttgcaactctggcaccgattccgttccttccttgcggcggcggcggaaaaacaggagtctctccatccttcccttcgttcgtgctcttcttcttgttattccgtttatcggtctggcgcagaaagaaacaagagatgcgatctagtctgctaccggagtccccgtacgtacccagtgctccgcggcttcggcaggggtgctgctggctgcagacgctgatctgtatccaccggccaccgccgttcgtgtttctccatgtaaacggtggaggattttgtgtctgttggctgctgcttccaatgcgctccacgagagacgagaccctctctgccagttcccttgtgtttcaaaacagagctcgagttcaaattgcttatttagtttcctttttctcttcttacttattgacaacttgttcacagggttcatcagcagaagctgcttgctccgccgccgccgccctcttcctcttctactggtacgctcgctcacttgcatcggtttcttctcttcccacgcttctattcagagcataacagttgctaatccccttgttgcgctagcttaatcttagattttgcttcgggttcggctaaatttcgtcggatggatatcgatgccagcgccagcgtcatgtgccagctgctgagccccgagggagaccctctaggctctgcgctctatctgccccagaacgtcgggcccccgcagctccaggagattgtcaatcagctcctccacaatgtattactgtgctctaattgttttctttcccatctatccaattctttcatcttatcttgcttccctcaaccttacctttccatcctcctattgttaactcactcgtgcattctattcattcaggaggagaagttgccctatgcattctacgttggagacgaggagctctctgtccacctgggtgcttacatgcggcagaagaacggtgagatgagatcactcagcagttcatctactgcgctgcgcatttccctttcgtctcctgatttttgatgaaaggtgaaccgtgtcgtctgtgctgccatctaattcctatttccatctctttctttttttttccttcttaaactctagccaatgttgaggttactctgcgcatagtatgccaaccacaagcacttttccggatcaggccggtcaaccgatgctctgccacgattgctggtatgtctagcgacctgttgttctgttaattatccctcctagctattattttggcgcccaattattcatttgcttgtcacatccagttaattcaataatatcttgttctactcttacatttcttttgggcgtttttggttgccgaccacaacatgccacagctcggccttgccctaacctttggcatgtttagccaccacttagtggaaactttggcatcttttgtgtgtttttagctgccactccttcccaaaagtttggtgcagaatttaagcgccgcaacttgcaataggttgggcgagctgcattttaattttggccggttgctgcatgcaaccaaacaatatgtttctccttgaatggtctattcacaatcttctctttctgcaggccacacggaagctgtaattgctgtttcttttagccctgatggaaagagtttggcgagcggttcaggggtcaccantgttcgcttttgggacctgagtacacagactccactgttcacatgcaaaggtgaatgctcagtaccctatccttgtttaccagtgattttactgcaatgctgttcattccttaaattctggtccttgagtaggttgcatatacccatattggccaatttaatcttagttgcacgccaaaccactaagatgaatgatgtaccaaagacaccagtgtatcaatagtaccaaaagatagttagggaagcagggagtgagtcctgaaanagtagagtatgtctacgaagtcatgacatcacaacctaatatacacagatttttagatgtttgggccatagtgtgcgtaatacgccttgtcctcctaatctcctatcgatcatagattgttgtatgcagatgatacacaaggttatgagctccaacccagtgagaaatagtccgtcttagttgaggagggatgaggcaagctagactagttctaactgttgctctctttgctcagttgaattgaactcctttgggttcggtttgttggatcttggaatgatactttgtggtgtgtctaacctgaattaaacgctgatctaccatctcttttatactccaaagaagttgcaagtttacatttatatgttatttgcgggccctgcttgtcattgggccaaccgtctctgtcccatgcttcgtaatcatgtagcatgtgtcagtgtaatcataccccctgaaaatgacaac

SEQ ID NO: 19665 - DNA, 1921 bp, Zea mays
gcagttgccaccagaacaatgtccacatgggacttcaaaattttgtggaccaaccaacaccaagcagctgctgttggttccaaactgtccgagctacaagttacgacctgaaatacaagacccattgataatacgacaaatgctttttttttttttttttagaggatgcccaattactacaaatattttaatttcaaaggcgaaatttacactaaagagtagcctccacccttcttccaagtatactcagccacaatgtcataccatcaccctcgtgggttgtgggttctctttgccattcaaaatttctctatacaagatataaaataggccatacttcccacagttgcatagctgcaatcacttgtagctaagcagaaccgagttaattacatgcatgatcacacggatactggtgccatctgatgcggtcgtggggagtgtccgttggtgggccaattggctgtagacttgctcaaagattggtcgcacatgcaccgcgatgatctggtctgctgggttgattgccatggcaacatctgtcatccattgaaccttccgtgatgtctcattgtgaatgtcaattgctagctgctgcaataaggccagaaggaccccctggttaagaggtactggaaccattgcacatagtgcccgcaaatcaacctgggagcacagccacgacactatggaaacatcactcctttgaagagccattgtaaatgcttcgtcaaacttgcgttcagatatcagtctgctcagctctctcatcggatctaacggagcctcaacctcttggggaccacccataggaccattaatgggctgcaaagcactggtattatgtgccttggcattcccagaagtaacaagtgccaatagcttgcgattgccatcaagtaactccgatgaaaaactctgggtgattgatgaagcagaattgatggtttcttttagagttagcgctaacggagtatgtgcagcctcaacttgctgctgaatagcattggagtgctcagacattcccttttgaaatgcaccatctacttgctcaaacattgtcttgcatgcttgctcaaatgctggaacaagcaatgatcaaaagctaggacctttgcatttgcttcatgcacaaattgctccccatacccgctgatcctagtagccttcttaatcaaagctttcacagtgtgccacagcatccaacatcttcaaatcaatatatgcctaagtgaatgataatccaaaatggaggggcatccatggatattgttcaacctggtccagcttgcctaaaacctctttctcgcaagattagcctcatcttgcctctcatagagtcgtgcatctgaaaggtacttttcaacctcaactgtctgcataaggtacttctcagtcggcccactcagcgagattggctcagtgactccatgataaccattattgttcttcaccttcgacattccacagccctcacaaactctccaaacactcaacttcagaattacaaattctcacacagctctttggaattgttaggtagtacttttagcaaattttgtctttcctcctcaaatttcagctgggtttcttctagcacagtctaaatgtctgttgccacactacaggtttagaaacaattaacaacaaactgtactgatacagatgaaggaacatgactttcagatttgatcagagcaaccagttagcgtattcagttgaaagttagtcctttccatagaaacaaaaggttaatagtagctttgcactcttgatgtacttgagggtaggaaagggtaagtagatgaattttcgatccaaccatgcggaaaatgatagccagcactgtattaggagtatggtagaaccgcgtggttagcgagtgcacctccacatctgttgcatcttaccttttttttcc

SEQ ID NO: 19666 - DNA, 884 bp, Zea mays
cttcagctgcggtggttgcccttccccgggaagcctcgagtcaacatcgtgcaccgcccgttccccggtgccaagtaaccgccccgtaggcaccttgctgttggtgctgctcagcatcctgcccgccggcgcgcatggcatcgctgggagcgactgcagttgtgcgaactcccatgtgggcggcggcatgcagacggcggtctcgaactgtgtcggcccggagttcccgagcagctgcatgaggcgcgcgccggggttggggcccggggcgacggcgttggggttagcgttcgggttggggttgaggtttgggtttggcatggggaaggagacaactgggcgggtcatggcgtgggggtcctgcgggtagtggatgtagggtccgcggtggaagggcggggtcaccggagggtaggagtaggggccggatggcgccgggcctccagcgacgccggggaagatggggttgggggtggcgttgggcatgggattcgttggcctgaaaagcttcccgatctcaaatggtgtattaggattagggttagggttttcgctcggagacgtcatgagaagcggctcgggagaggaaggtggcagtggagtagatctgaactggggaagggaggaagacgaagtggactggaggtggcagtggagcaatcccgtccgcgagcagcgattccgctcgctttgggcgccggtgtagagcgcgggagcaggaattggtctcagagcaagggtcgcccgccggctacagaatgtggagagggtataaaaaatcctccccggatttaataaaagagattagaatgaattatttacatagataagttttacattttatatcatatatatcatcaaactaagtcgaattcactattcac

SEQ ID NO: 19667 - DNA, 2472 bp, Zea mays
ctgctctcttgttctaatgataccctgtcctaaattaaattttattttagaatgttaatggatttagagaatacttatgtagattcatcatcatgtaaatatgagcaaaaaataagagctaaaacaaatactaatttaggacgaggagtaattagtaagaaaaagttgcaacaaggcctagaagaacgttgagctaccgcaattgagatgtccgcccaaaaattcgagaatacaatataccgattcgcattttagcagcttgacccagtgggcacttggcgactcctgaataatcctgatcgaatgccgagttgttgcctcagatccctcaaaagcacgctaattccacatcgtcacaagaacatgtcaaatccatcgtcgtcgagtagccaaacagattacctccaattttgcagttgcgacccgacaatgtctacattggacttcaaaattttgtggaacaaccaccaccaagcagctgctattggttccaaactgtccgtgctacaaggtccaactgatatattcgacccatttccattaaggtatgacggaaatacaagacccggtgatcatgtcaaatgaagaattcgatgatgcccaattactacaatagtccgaattcacgagcgacagaagccaaatttacaccaaggagtaacctccgccctcttgcaagtattctcggccacaatgtctcctgggttgtgggttgtggccattcaaaatttctctatacaagatagaataggccatacttcccacagttgcgtagctacaatcacttgtagctaagcagaactgagttaattacatgcatgatcacacggatgctggtgccatctgctgcggtcatggtggggagtgtccgctggtgggccagttggttgtagacttgctcaaagataggccgcacatgaaccgcgatcatctggtctgctgggttgattgccatggcaacatctgtcatccattgaacctttcgtgatgtctcattgtgaatgtcaattgctagctgctgcaataaggccaggaggaccccctggttaagaggtactgggaccattgcacataatgcccgcaaatcaacctgggagcatagccacgatactatggaaacatcactcctttgaagagccattgtaaatgcttcgtcaaacttgcgttcagatatcagtctgcccagctctttcataggatctaacggagcctcaacctcctgggatccacccataggaccattaacgggctgcaaagcactggtattatgtgccatggcattcccagaagtaacaagtgccagtagcttgcgattgccatcaagtaactccgatgaaaaactctgggtgatggatgatgcagaattgatgatttcttttagagttagcgctaacggactatgtgaagactcaacttgatgctgaatagcggtggagtgctcagacattcccttttgaaatgcaccatctatttgctcaaacattgtcttgcatgcttgctcaaacgctggaacaagcaatgattcaaagctagtacgtaaagcatcctgaagagcctgttttccagatgtatggaactggatttggatttgcctggcaagtgtagcttcaagttttccagtaatagacttttccagctgattgaacaacttgtcacccaaccctttctgaactgaatcagaaacagcagaggttagacacttctcaataataggcgtaattgcacgagcaacaacaggcccaagtgaagaaatttctttcttaagtgacttctccagattagaaggtaagtccttatttattgagcttgtaatgagagtaacaaattgctgcattcgctctctatcagccttttcacgcttagtgttttcctcctggagacgagcccaaaacgcatcaatattagctttgatcgacttctccacagtgcgccctaatgatgtctcaagtcttttgccctcctttgcgatggatgcagggacaacagtactcagctgcttttccatgtcctcctgcctccctatgagctgttgcagcatcccttgtgtggcaccaacttctgggtaggagctgactgtgactggtaggtatgtggagctcaaaggctcatgtgactcagttgaattgaaagcactcacaggaggtgacggttgaccagatgtttgaggatgcaaaattttctcctctttcgtaaatgaagatgattgctccctagaagcagaggaatccccgccggcctcgggcatttccccaaacttcttcagaacattttcactgataccagtctggtctgatgtcggtcgatcagatgatgactgtgattcttccacgctgtacttatcagttgtaactgagcgctcactgatcatttcaacagtttggtccaaggaactccgagttttatccatattctcacaaacaatctgagtttctttgacagcttcgagtcccaaattttatctgttagtctccg

SEQ ID NO: 19668 - DNA, 1936 bp, Zea mays
gatgagaaactagatttatctagtttacattcatttcgaacttaattgggtttgcacagggttatcccttctcatgtaaataaactaaaccagggaacctgacaatctccactttcagtataatgctaaaaaaattagccagcacttctagaacttgggcattaaaatttgaaagaaaatgacttgtcgtttgtttggtactatctctgtccacaaacgaatgcaattccagatgcattcttggttgaagtgcctaaagtttgaccaaatatataagtaaacatgtatgtttgtgacaccaaataagtatattatgtatttaatgacaatctaattagatttatttgatataataaatatttgcgttttttatatataggtagtcaaactaaagatactttaacaggtactgtaccagaattgcattcttttctggacgaagggagtacataaagtcagtaagatgttataaggtattgtctaaagctaaaaaatactcaaaccgtacaatagtacagaatgtcctgggtcgtttttagaatttatatgatgagtaccagtaagtcattgctctagtagaagactgttcacatgtatttataaagcattaagaaaatttatccctataatgacatgtacttgcaaccagtactaatgctagaatagagagagaaagaggaggattgactatagtctaagattaacttcaagtagtggcactgcaagcctataaaaaattagggctgcatgagtatgaacattatttatttcttcgaattaaaaatgactgatgtataacctcccagattcccagctcaaaagatgaaattacagtaaaattagggcctgttcgctgcagcttgttgaactaaaaaatgtacaagatacctgctgtggctgcaagctgcagcgaacaatgttgcactaaaatgtttaacaatttctgtaaaataaaacagataaaactgtaacaaatgtcaaatggaaaatccgataatatttgtgcttcactcagggtgatacaaagttcatacctgttgcagcattccttgtgtggcagcatcttctgggaaggagctgacaggtaggtatgtagagctcaaaggctcatgtggctcagttgaattgaaagcactcacaggaggagatggctgaccagatgtttgagggtgcaaaactttctcttttgtaaacaaagatggttgctccctggaagcagagtaatcaattttctcaggcatttccacaaacttcttcagaacattttcatcagtgccacaagtctgatctgatgctggtcgatcagatgatgactgtgattcttccacactgtgcttatcagttgtaactgagcgcttagtgatcatttcaacagtttgctccatggaagttttcgccatgttctcacaaacaatctgagtttccttgactgcttcaagtcccaagttttgatctggtttactctcatcaatatgctttggttccacttctgcaacccaagaacttccgctggaaacatctcgattttccccaccagattcagaaacatcattgttttcagcagatgagagagtacccgatattatttcagatggagtaaccaagcgtgtagcattccctccaacttgaaacaccatatggggatttggaagcattggaacattactttgaccatctcttggctcatcttttcctaagatatcctttctaatgggcatcggggtatcttgtcttttcagagcatcacgctccatgtttctgtttgtcgtattcgtatagttaaaagctgattgctctatatcacgagttccaggtgctggtcctgatccaggaacctcaatcttaggtgcaagagctgtaaatggaagaggcatggaactatcaccttctgagtatgcaagcggtggagctgatggtttcagatcaagctctgcag

SEQ ID NO: 19669 - DNA, 3407 bp, Zea mays
  misc_feature (388)..(394): n is a, c, g, or t
  misc_feature (409)..(427): n is a, c, g, or t
  misc_feature (564)..(568): n is a, c, g, or t
  misc_feature (728)..(732): n is a, c, g, or t
  misc_feature (816)..(838): n is a, c, g, or t
  misc_feature (1266)..(1270): n is a, c, g, or t
  misc_feature (1280)..(1285): n is a, c, g, or t
  misc_feature (1509)..(1513): n is a, c, g, or t
  misc_feature (1564)..(1587): n is a, c, g, or t
  misc_feature (1596)..(1600): n is a, c, g, or t
  misc_feature (1694)..(1698): n is a, c, g, or t
  misc_feature (1795)..(1824): n is a, c, g, or t
  misc_feature (1827)..(1831): n is a, c, g, or t
  misc_feature (1837)..(1837): n is a, c, g, or t
ctgccgattcccggacgccgcaacatactcatcactagcgcacttgcgtacgtcaataatgtcccgcacctagggaacatcatcggctgggtgctcagcgcagacgtgtacgcgcggtactgttttctccggcgctacaacgctatctacatatgcgggacggacgagtatggcaccgccaccgaaacgaaggccatggaggagaagtgcacgcccaaggagatctgcgataagtaccatgctatccacaatgaagtttacaagtggtttaacataaaatttgacaagtttggacggacctcttctcctgagcagacagaagtctgccatgcaattttccataaattgatggaaaacaattggctcacagaaaataccacgcgtccgnnnnnnnagcagctgataggcnnnnnnnnnnnnnnnnnnngaacaaagtctgcaacgcatcagcaagaggagatcagtgtgaaacatgcagcaccttgttgaatccaactgaacttattgacccaaagtgcaaggtttgtaagaacactccacgtattcgtgacacggatcacttannnnnggagcttcctctattgagagacaagctggtaaactacatcaatgaaacttcagttgctggtttgtggagtcaaaatgctattcaagcaacaaatgcatggctgaaggaagggctaaagccacgctgcatcaccagagatcttaaatggggtgttcctgtnnnnnatgagaagtataaagacaaggtgttctatgtttggtttgatgcacctatcggctacgtgtctattacggcatcctatacacctnnnnnnnnnnnnnnnnnnnnnnntcctgataatgtagaattgtttcagtttatgggcaaagataatgtgccgtttcacacgatcatgttcccttcaacgctactcggaactggggaaaagtggacaatgatgaaaacgataagtgttactgaatatttgaattatgaagcaggcaaattttccaagagtaaaggtattggagtctttggtaatgatgcaaaggatacaaatattcctcctgaagtatggcgatactatttgcttatgaatcgccctgaggcatcagatacactctttacttgggctgatttgcaagccaaattgaacagcgagttgctgaacaacttgggaacttcattaatcgtgtgctaagttttgttgcaaaaccagctggagctggatatggttctgttgtacccgatgcacctaatgcggcgcgcacacattgacnnnnncacttgcagnnnnnnccagtaaatgggttgaacaatatctcgacgcaatggaaaaggttaaactgaaacaaggactcaagagtgcaatgggcatttctagtgatggaaatgcatatttgcaagagagccagttttggaaactttacaaggaagatcctgcagcatgtgcaatcgtgatgaaaacttcagttggccttgtttacctgcttgcctgtctgctggagcctttcatgccctcnnnnnctgatgaagtgttacgtcaactaaatttatctccagaagaaaatctgtcannnnnnnnnnnnnnnnnnnnnnnngcgaaggcnnnnnctccttggaattttgtaccagcaggtcacagaatagggaaacccgcacctctgttcaaggaattgaaagatgaagacgtagctctccatagagnnnnntatgcagggagtcaagctgagagaagctcaaaagcagcagctgatgctgaagccaacaaagttgctaaccagctcaagggcacaaaattatctgatnnnnnnnnnnnnnnnnnnnnnnnnnnnnnnctnnnnnctcaanaatcgaagacagctgaggctgacattacagttgcaaagttggatattagagtggggcttatcagaaaagcagagaagcatccagatgctgattccctttacgtggaggagattgatgttggagaggacgcgccgagaacagtagtcagtggccttgttaaattcatacctcttgaagaaatgcagagccggaaagtttgcgtgctctgcaatctgaaaccggtggcaatgcgtggcataaaatcacatgcaatggttctggctgcatcgaatgaggaccacacgaaggttgagttggtggaacctccagagtctgctgctgtgggcgagcgtgttacctttgctgggtacgcgggtgagcccgaggcttccctcagtggcaagagcaagacgtgggagaagctggccgccgagttgcacagcaacggtgagctggtggcgtgctacagagatgtgcccttcactacctcggctggagtctgcagggtgaagacaatagcgaacggagagattcgctagtaccaccacatcaccgaactgcagccagcggagccagtctgtctggtttcgctgaaagctattgttcctgatttttattttcgaaaattttggtatttccatttgttcaaataccgcaaagcaaccatgatttagaaaaacacagagagtgccctttccgcatcctcttttttatcagttagtacttggctcctgttgtctcactcggaggctccatgcttcttgctgtatctgtatttccttagaagtgattctttacctgctcttatagtcttatttatagttccatatgaaatgaacaaagtgtatcagaacatcactttatatataggagggcctgtctgtccccgccccctgtcaatgcatggaaaggagcaagcaaggaagcttgaaggaactgtaaacagagcttggccaatgggcagcgcccgctagattcacgaacgaacgaccatgattgccgggtagttgtaaggcgtacaagtgtcatttgttgcgcgcctgatggaagcgcggggcatcaagtgttgtacactgttaatgtgtgggtcgcgggtccctccttgtcctgcccccacgtaatttattattattaataatttggcccctttctacctttgctctccgagtgcgtctccggtacgcctgggcggctggcgcacaccatactatgctgccgctgctgcaccaggcgaacacaggctggactggaacgccgctgctgtgcccctggggcagtgccaatgccaggcgccagtcgtcgtcacactcacaccccggccgctccacgagctggtggtagcagttgctcggggatctaggactggggcctgatgcaacagcgagtcagcgactgcgtccagccaagtacgtcccccgcctacgcagagaagagaaggcaacaagccttgtctccgcaccatcttttcgccatgaattaataatgagctcccttccggcctccagcataaatacgatcgatgtatactgcgcaatgatattactgaatcagaaacacagtactacttgagaaggctgcagtcgatctagag

SEQ ID NO: 19670 - DNA, 2667 bp, Zea mays
acatcgcgccatcctgttagcttagccctaaacccttctttcccgatggcgtcgtccccgccgccgcctaagctgccgattcccggccggcgcaacatacttatcaccagcgcacttccctatgtcaataatgttccccacctcgggaacatcatcggctgtgtgctcagcgccgacgtgttcgcgcgatactgccggctccggggttacaacgctatctacatatgcgggactgacgagtatggcaccgccaccgagacgaaggccatggaggagaagtgcacgcccaaggagatctgcgataagtaccatgctatccacaatgaagtttacaagtggtttaacataaaatttgacaagtttgggcggacatcttctccagagcagacagaaatctgccatgcaattttccataaattgatggaaaacaattggctcacagaaaatactatgcagcagctttactgcgatatgtgccaaaaatttctagccgataggcttgttgaaggaacatgcccaaacaaagtctgcaacgcatcagcacgaggagatcagtgtgaaacatgcagcaccttgttgaatccaacagaacttattgacccaaagtgcaaggtttgtaagaatactccacgtattcgtgacacggatcacttatttttggagcttcctctattgagagacaagctggtaaactacatcaatgaaacttcagttgctggtttgtggagtcaaaatgctattcaagcaacaaatgcatggttgaaggaagggctaaagccacgctgcatcaccagagatcttaaatggggtgttcctgttcctcatgagaaatataaagacaaggtcttctatgtttggtttgatgcacctatcggatatgtgtctattacggcatcctatacacctgaatgggagaagtggtggaagaatcctgataatgtagagttgtttcagtttatgggcaaagataatgtgccgtttcacacgatcatgttcccttcaacgctacttggaactggggaaaagtggacaatgatgaagacaataagtgttactgaatatttaaattatgaagcaggaaaattttccaagagtaaaggtattggagtctttggtaatgatgcaaaggatacaaatattcctcctgaagtatggcgatactacttgcttatgaaccgtcctgaggtatcagatacactttttacttgggctgatttgcaagccaaattgaacagcgagttgctgaacaacttggggaacttcattaatcgtgtgctaagttttattgcaaaagaagctggagctggatatgattctgttgtacctgatgctcctaatgcgggtgaacacacattgacaaagatacttgcagaaaaaacaagtaaatgggttgaacaatatctcgacgcaatggaaaaggttaaactgaaacaaggactgaagagtgcaatgggcatttctagtgatggaaatgcgtatctgcaggagagccagttttggaaactttacaaggaagatcctgcagcatgtgcgatcgtgatgaaaacttcagttggccttgtctacctgcttgcctgtctgctatcacctttcatgccctccttttctgatgaagtattacgtcaattaaatttatctccagaagaaaatttgtcattaagtgaagaaaagggagaaattgcaaaggcaaaatctccttgggattttgtaccagcagggcacagaatagggaagcctgcacctctgttcaaggaattgaaagatgaagacgtagctctccatagagaaaaatatgcagggagtcaagctgagagaagctcaaaagcagcagctgatgctgaagccaacaaagttgctaagcagctcaagggcacaaaattatctgatggaggaacaaaaaaggaaccaaagaaacaatctggtggttcaaaatcgaagacagctgaggctgatattacggttgcaaaattggatattagagtgggccttatcagaaaagcagagaagcatccagatgctgattccctttacgtggaggagattgatgttggagaggacacaccaagaacagtggtcagtggcctcgtcaaattcatacctctcgaagaaatgcagaaccggaaagtttgcgtactctgcaatctgaaacctgtggcaatgcgtggtataaaatcacatgcaatggttttggctgcatcgaatgaggaccacacgaaggttgagttggtggagccacccgaatctgctgccgtgggcgagcgtgttacctttgctgggtactcgggggagcctgaggcttccctcagtggcaagagcaagacgtgggagaagctggccgccgagctgcacagtaacggtgagctcgtggcgtgctacaaagatgtgcccttcacaacctcggctggaatctgcaaggtcaagacaatagcaaacggagagattcgctaggcacatctccgaactgcagccagctgacccaatctgggaagtgctaaactttagcatcatgaacctaaacaagcctaaagccttttatgtttgaaaagtcgtgtacaagacaaactctccgtgaagagatgctttttttttacttactctactagagactcctaaaacatacccatattaaatgggcttataaaaaatacgagggggggcccggtaccc

SEQ ID NO: 19671 - DNA, 2869 bp, Zea mays
acgagacggagtgacccactagcagtctcgtacaacgaactatcctgttagccagccctaaacccttctgtcccgatggcgtcgtcgtcgtcgccgccgccgccgaagctgccgattcccggccgccgcaacatactcatcactagcgcacttccgtacgtcaataatgtcccgcacctagggaacatcatcggctgtgtgctcagcgcagacgtgttcgcgcggtactgccggctccggggttacaacgctatctacatatgcgggacggacgagtatggcaccgccaccgagacgaaggccatggaggagaagtgcacgcccaaggagatctgcgataagtaccatgctatccacaatgaagtttacaagtggtttaacataaaatttgacaagtttggacggacctcttctcctgagcagacagaagtctgccatgcaattttccataaattgatggaaaacaattggctcacagaaaatactatgcagcagctttactgcgatacatgccaaaaatttttagctgataggcttgttgaaggaacatgcccgaacaaagtctgcaacgcatcagcaagaggagatcagtgtgaaacatgcagcaccttgttgaatccaactgaacttattgacccaaagtgcaaggtttgtaagaacactccacgtattcgtgacacggatcacttatttttggagcttcctctattgagagacaagctggtaaactacatcaatgaaacttcagttgctggtttgtggagtcaaaatgctattcaagcaacaaatgcatggctgaaggaagggctaaagccacgctgcatcaccagagatcttaaatggggtgttcctgtcccccatgagaagtataaagacaaggtgttctatgtttggtttgatgcacctatcggctacgtgtctattacggcatcctatacacctgagtgggagaagtggtggaagaatcctgataatgtagaattgtttcagtttatgggcaaagataatgtgccgtttcacacgatcatgttcccttcaacgctactcggaactggggaaaagtggacaatgatgaaaacgataagtgttactgaatatttgaattatgaagcaggcaaattttccaagagtaaaggtattggagtctttggtaatgatgcaaaggatacaaatattcctcctgaagtatggcgatactatttgcttatgaatcgccctgaggcatcagatacactctttacttgggctgatttgcaagccaaattgaacagcgagttgctgaacaacttgggaaacttcattaatcgtgtgctaagttttgttgcaaaaccagctggagctggatatggttctgttgtacccgatgcacctaatgcgggcgcgcacacattgacaaaaacacttgcagaaaaaaccagtaaatgggttgaacaatatctcgacgcaatggaaaaggttaaactgaaacaaggactcaagagtgcaatgggcatttctagtgatggaaatgcatatttgcaagagagccagttttggaaactttacaaggaagatcctgcagcatgtgcaatcgtgatgaaaacttcagttggccttgtttacctgcttgcctgtctgctggagcctttcatgccctctttttctgatgaagtgttacgtcaactaaatttatctccagaagaaaatctgtcattaagtgaagaaaagggagaaattgcgaaggcaaaaactccttggaattttgtaccagcaggtcacagaatagggaaacccgcacctctgttcaaggaattgaaagatgaagacgtagctctccatagagaaaaatatgcagggagtcaagctgagagaagctcaaaagcagcagctgatgctgaagccaacaaagttgctaaccagctcaagggcacaaaattatctgatggaggaacaaaaaaggaaccgaagaaacaatctggtggctcaaaatcgaagacagctgaggctgacattacagttgcaaagttggatattagagtggggcttatcagaaaagcagagaagcatccagatgctgattccctttacgtggaggagattgatgttggagaggacgcgccgagaacagtagtcagtggccttgttaaattcatacctcttgaagaaatgcagagccggaaagtctgcgtgctctgcaatctgaaaccggtggcaatgcgtggcataaaatcacatgcaatggttctggctgcatcgaatgaggaccacacgaaggttgagttggtggaacctccagagtctgctgctgtgggggagcgtgttacctttgctgggtacgcgggtgagcccgaggcttccctcagtggcaagagcaagacgtgggagaagcttgccgccgagttgcacagcaacggtgagctggtggcgtgctacagagatgtgcccttcactacctcggctggagtctgcagggtgaagacaatagcgaacggagagattcgctagtaccacatcaccgaactgcagccagctgagccggtctgtgtctggtttcgctgaaagcgattgttcctgactttcatcttcgaaaattttggtatttccatttgttcaaataccgcaaagcaaccatgatttagaaaaatacagagagtgccctttctgcatcctctttttatcagttagtacttggctcctgtcgtctcactcggaggctccatgcttcttgctgtatctgtatttccttagaagtgattctttacctgctcttatttatagttccatatgaaaggaacaaagtgtatcagaacatcactttatatataggagggcctgtctgtcactgccccctgccaatgcatggaaaggagcaagcaaggaagcttgaagg

SEQ ID NO: 19672 - DNA, 2456 bp, Zea mays
ttgggtacctcgaggccggcccgcgcgacccctaaatttcccaaccttccctttccccttcctcctccagtccaccgcatcaccacaccccgtctccaccccgtacaaatccaaaagagggcgaggagggaaacagatcggctggcggcaatcggtagccggcttggctggcacgatgggcggcgaggccgagggcggggagcggcggctggggcgggtgctgagctttgggatcccggacacggcgctggggctagtgatggggtacgtggaggatccctgggaccgcgacgccatctcgctggtgtgccgacactggtgccgcgtcgacgcgctcagccgcaagcacgtcacggtcgccatggcctactccacaacacccgagcgcctgttccggcgcttcccgtgcctcgagtcactcaagctcaaagcgaagccccgcgcgtccatgttcaacctcatctccgacgactggggcgggtctgcgtcgccttggatccgacagctctcggccaccttccacttcctcaagaagctccacctgcgcaggatgatagtatccaacgaagatatcaacatccttgtgcgtgccaaggcgcacatgctcgtcgcgctgaagctcgaccgctgctccggcttctccactccctccatcgcactcgtcgcccgttcctgcaggaaactggaaacacttttcctggaagaaagcacaattgatgagaaagaaaatgatgagtggatccgtgagcttgctacgagcaattctgttcttgagacactgaatttctttctaacagatctcagggcatccccagagtatcttaccctccttgtgcgcaactgtcaacgattgaaaactctgaagattagtgaatgtttcatgcccgatctggtcagtttgttccgaactgcacaaacactacaagagttcgctggtggttcctttgaagagcagggtcaacctgtggcaagtagaaattatgagaactactattttcctccttcactgcaccacttgagtttgctctacatgggaacaaatgatatgcaaatactgtttccatatgctactgcacttaagaagttagaccttcagtttacattcctttccacagaggatcattgtcagatagttcaacgctgctccaatctggaaaccttagaggtgagggatgtcataggggatcgtggactacaagttgttgcacagacctgcaagaaattgcataggctcagagtagagagaggagatgatgatcaaggaggtcttgaggatgaacaaggtaggatttcacaggtggggttgatggctatagcccaaggctgccctgagttgacatactgggcgatacatgtatcagacattacaaatgcagctttagaggcagttggtacatgcagcaaaaatcttaatgacttccgccttgtcctccttgatagagaagcacatataaccgaattgccactggacaatggggttcgtgctttgcttagaggttgcaccaaactacggaggtttgcattttatgtgagacctggggccctatctgatgttggtcttggctatgttggagaatttagtaagagtattcgttatatgttgcttggtaatgttggtgaatctgataatggaatcatacaattatcaaaaggctgcccaagcttgcaaaaactggaggtgaggggttgtctctttagtgagcatgctttagctttggctgcactacagcttaagtcactgaggtatctgtgggtacaaggattcaggtcatctccaactggaactgatattatggcaatggtacgccccttctggaacattgagtatattgttccagatcaagatgaaccttgcccagagcataagagacagattctggcatactactcccttgctggcaggaggacagattgtcctccatcagtaactctgctttacccggcattttgagtgtagatacttgctttttgccagactgaatctcatggtactaagttccattggtcccactatctgtgaagtaaatggtccctgttcttccaattgatgaggacatgcagacgttccagtgcaaagaaccccaaaggtaagctttaagcaggacggccagctctgaactgaggctagctgagaacaatcatgaatacctgaaggcagcacttatgtcagcttggcctagctgtccagtatgggcatgtaagctttaccatcttttgtagttttggagaaacaattttgcaataactacccttgtttagtgtatattatcgattttcgttcatatgctgttgtattgttgtattgaacaattatgtcaattaattagtctacactctacagtctaacttgctgtgattcgatgaatagtgtttatatcacccacaaaaaaaaaaaaaaaaaaaaaaaaaaaaaaaaaaaaaaaaaaaaaaaaaaaaaaaaaaaaaagggcggccgc

SEQ ID NO: 19673 - DNA, 2425 bp, Zea mays
ccggggaaaaggttccaccgtctaccttgccccgaccggatctggaacccctaaaaatttccctttcgtacctttccccttcctcctcccgtccaccacaccccggctccaccccgtgcaaatccgctggccgcagcaagagaggtcgaggagggaaacagatcgggtggcggcaaccggtagccggttccgctggcacgatgggcggcgaggccgagggcggggagcggcggctggggcgggtcctgagctttgggatcccggacacggcgctggggctagtgatggggtacgtggaggacccctgggaccgcgacgccatctcgctggtgtgccgccactggtgccgcgtcgacgcgctcagccgcaagcacgtcacggtggccatggcctactccacaacacccgagcgcctgttcggccgcttcccgtgcctcgagtcactcaagctcaaagcaaagccccgcgcggccatgttcaacctcatctccgacgactggggcgggtctgcgtcgccgtggatccgacagctctcggccactttccactccctcaagaagctccacctgcgcaggatgatagtatccaatgacgacatcaacacgctcgtccgcgccaaagcccatatgctcgtgtcgctgaagctcgaccgctgctcaggcttctccacgccctccatcgcactcatcgcccgctcttgcaggaaactggaaacacttttcctggaagaaagcatgattgatgagaaagaaaatgatgaatggatccgtgagcttgctacgagcaattctgttcttgagacactgaatttctttcagacagatctcagggcatccccagagtatcttacccttcttgtgcgcaactgtcaaaggctgaaaaccctgaagattagtgagtgtttcatgcctgatctggttagtttgttccgaactgcacaaacactacaagaattcgctggtggttcctttgaagatcagggtcaacctgtggcaggtagaaattatgagaactactattttcctcctttactgcaccgcttgagtttgctctacatgggaacaaatgagatgcagatactgtttccatatgctgctgcacttaagaagttagaccttcagtttacattcctttccacagaggatcactgtcagatagttcagcgctgccccaatctggaaaccttagaggtgagggatgtcataggggatcgtgggctacaagttgttgcagagacctgcaagaaattgcagaggctcagagtagagagaggagatgatgatcaaggaggtcttgaggatgaacaaggtaggatttcacaggttggggtgatggctatagcccaaggctgccctgagttgacatactgggcaatatatgtatcggacattacaaatgcagctctagaggcggttggtacatgcagcagaaatcttaatgatttccgccttgtccttcttgatagagaagcacatataactgagttgccactggacaatggggttcgtgctttgcttagaggttgcaccaaactcaggaggtttgcattttatgtgagacctggggtcctatctgatgttggtcttggctatgttggagaatttagcaagagcattcgatatatgttgcttggcaatgttggtgaatctgataatggaattatacaattatcaaaaggctgcccaagcttgcaaaaactggagctgaggggttgtttgtttagtgagcatgctttagctatggctgcactagagctcaagtcactgaggtatctgtgggtgcaaggattcaggtcatctccaaccggaactgatcttatggcaatggtacgccccttctggaacattgagtatattcttccagaccaagatgaaccttgcccagagtataagaaacagattctggcatactactcccttgctggaaggaggacagattgccctccatcggtaactccactttacccggcagtttgagcgtagatacttgcttttttccagactgaatctcatggtactaagctccattgctcccacaatctgtgaaatcgatggttcctgttgatggggacatgcagacgttccattgcacataaccccagagctaagctttaagcaggacgacagctcggaactgaggctagctgagaacaatcttgaatacctgaaggcagcactttgtggatcagattggcctagctgtccagtatggaaatgtaaacttcaccattttgaatagttttggagaaacaattttgtaataatttacccttgtttagtgtacattattgattttcgtttatatgatgttgtattgctttatttaacatttaagtcaactagttaatctacagtctgacttgctgtgattcgatgaattaatggattttccttgctgcccgaaaaaaaaaaaaaaaaggccccta

SEQ ID NO: 19674 - DNA, 1493 bp, Zea mays
tttttttttttttttcctttttttttttttttttttttttttttttttttcagatgaacattgaagtgttttgtttgtatcagtctcagttcagctctcgattcttatcgactaaatattcatttataagatttcatggccccatacatgtaacagtgccgccaacaacaatattgattgataaatacaatgtgaggcgtcctctgttaggttacctgtggagttctggatatcctttccggtagcaaccaattacagatttacaattgatctagcaaagggctcccctctttggcaagaataaacaagcctccatcgcctctcgagatccttaagtctttgtccaggtaggtagtcaagagccaggatcgagctctgttgttgccgggaattggtaccttgaggggtggctgcccagaaatggacccagcaatgctagcaaatgcttgctgcaatggattcagtgcctgctggactggccccaggctgatcttctgcccaaatatatcaacttgttgaggtagatccacggatgatgatattgtcggaggctgaaagctcccctccttaaattggacctctatccttgatgggctttgaacctcgaaagaggcggttgcgctgaatgaaaatgaagcgaatggagtcgtaagggtcgaagcattgactatcgtcatgattttggagtcaatttcttgggatatctgctttactttgaccaaaggtgttgccccagcagctagaataggcagaagctcagaatatgctgtatatatgaggatccagttgccgtcgaggagatccggcgactcgacgggagcagtagtagggttaaccgcctcgagctgggtgactagctcgacgacctcacctctgacctccgtggacgcccggaagccgaggtcggagccgtacaccgtgtccaccaggcaccgcttgagctcctccctcttcacctcctgctcgtcctcctccgccgccggagcaggggccggcgccggcgcctccggctcctttccccagtcgtcgtctgcggaggggctaggcgggtccgcggcggagggcggctcgggctcaggcaccccgggctcgccccactcgtcgacgacgatagggcgtgagttgccgtcggcagagtcgtcgcggccccactcgtcttcgtcgatgggaggatcgggctgcgcggggggctcggggttggccggcggcgagcgctcgccccactcgtctgggatgccccctcggccacgcccgcggccgcgcccggttgcccccggggggcggcgcaggcggaggctcgaggtgcggggcctgagggtgccacggactaggtggccggcggcggggcggtcgagggaggagagggggaggagggacgcgtgggacgccgcggcgaagaggggagccattcgatttcgctcgcttgactgacggactgggatgggaacttgggagatgggaagagtggtcgctcaagggaggtaaagtaactc

SEQ ID NO: 19675 - DNA, 1523 bp, Zea mays
gcttcgacgtatttctctatctatctatacggttcaagggaccgaagaaggtagagagagaaacttgaaggggagaggaaggagatacaggttcatgttcatttaggtgtcagttcatctgatttctcagaagcaaaatgttgtttggagctcagtgacaccatcttgtaatgcatgtgccttttacgggaaatggaggatcattctgtccatcccaagtctaagtctaaccatggctccttgtcaggaaatggttatgagatgaaaaatccaggccatgaagtttgtgatagggattcatcatcagagtctgatcgatctcacccagaagcatcagcagtgagtgaaagcagtctagatgaacacacatcaactcaatcagacaatgatgaagatcatgggaaggataatcaggacacattgaagccagtattgtccttggggaaggaagggtctgcctttttggccccaaaaatagattacaacccatcttttgcttatattccttatactgctgatgcttactatggtggcgttggggtcttgacaggatatgctccacatgccattgtccatccccagcaaaatgatacaacaaatagtccggttatgttgcctgcggaacctgcagaagaagaaccaatatatgtcaatgcaaaacaataccatgcaatccttaggaggaggcagacacgtgctaaactggaggcgcagaacaagatggtgaaaggccggaagccataccttcatgagtctcgacaccgtcatgccatgaagcgggcccgtggctcaggagggcggttcctcaacacaaagcagcagccccaggagcagaaccagcagtaccaggcgtcgagtggttcaatgtgctcaaagaccattggcaacagcgtaatctcccaaagtggccccatttgcacgccctcttctgacgctgcaggtgcttcagcagccagccaggaccgcggctgcttgccctcggtgggcttccgccccacagccaacttcagtgagcaaggtggaggcggctcgaagctggtcgtgaacggcatgcagcagcgtgtttccaccataaggtgaagagaagtgggcacgacaccattcccaggcgcgcactgcctgtggcaactcatccttggcttttgaaactatggatatgcaatggacatgtagcttcgagttcctcagaataaccaaacgtgaagaatatgcaaagtccttttgagatttgctgtagctgaaagaactgtggttaggttatgagtttcttcctggagactgatccatacatgacatgctacctcgtgctgagtttctgaggtgaagccatcgaaacatgaccgtgtggttcagtacccttgctgccttcagtgtctgataagctagctctccagtttgcagtttctctgaattccagcatgtctagtctctgcttatcttttgcatgtaacgtgatggtgacttagcatacacatctattcatccatctatgttctcaaagcagcacctgcaggcatgcaagc

SEQ ID NO: 19676 - DNA, 1681 bp, Zea mays
  misc_feature (1014)..(1016): n is a, c, g, or t
  misc_feature (1664)..(1680): n is a, c, g, or t
cccgggattcggccttatggccggggagcggagggggcggtaaaacatttcttgtttgtttattgcgccggaaaaaactaacagacccagaaaaggacagaaagaggctgtacagtaggcgcgtatatttggcagtaggagcggtcttgttgtgccccgtatcctctcctcagttgcttcgacgtatttctctctctatctatacggttccgaagaaggtagagagagaaactcgaaggggagaggacagaagagggagatacaggttaatttttaggtaccagatcatctgatttctcagaagcaaaatgttgtttggagctcagtgacaccatcttgtaatgcctgtgattttacgggaaatggaggatcattctgtccatcccatgtctaagtctaaccatggctccttgtcaggaaatggttatgagatgaaacattcaggccataaagtttgcgatagggattcatcatcggagtctgatcggtctcaccaagaagcatcagcagcaagtgaaagcagtccaaatgaacacacatcaactcaatcagacaatgatgaagatcatgggaaagataatcaggacacaatgaagccagtattgtccttggggaaggaaggctctgcctttttggccccaaaattacattacagcccatcttttgcttgtattccttatactgctgatgcttattatagtgcggttggggtcttgacaggatatcctccacatgccattgtccatccccagcaaaatgatacaacgaacactccgggtatgttacctgtggaacctgcagaagaaccaatatatgttaatgcaaaacaataccatgcaatccttaggaggaggcaaacacgtgctaaattggaggcccagaacaagatggtgaaaggtcggaagccataccttcatgagtcccgacatcgtcatgccatgaaacgggcccgtggctcaggagggcggttcctcaacacaaagcagctccaggaccaaaaccagcagtttcagnnngcgtcgagtggttcaatgtgctcaaagatcattggcaacagcataatctcccaaagtggccccacctgcacgccctcttctggcactgcaggtgcttcaacagccagccaggaccgcagctgcttgccctcagttggcttccgccccacaaccaacttcagtgaccaaggtcgaggaggcttgaagctggccgtgatcggcatgcagcagcgtgtttccaccataaggtgaagagaagtgggcacaacaccattcccaggcgcactgcctgtggcaactcatccttggctcttgaaactttgaatatgcaatcgacatgtagcttgagatcctcagaataaaccaaaccttcagttatatgcaagccccttttgaggttgctgttgctgtacctgagaactgtggttaggttatgagtttgttcctgaagactgacccatacatgacatgctaccttgtgctgagtttctgagacaaagccatcgaaacatgatcttgtggttcagtacttgctgccttcagtgtctgataagctagctctccagtttgcagtttctctgaattccagcatgtctagtctctgcttatcttttgcatgtaacgtgatggtgacttagcatacacatctattcatccatctatgttctnnnnnnnnnnnnnnnnng

SEQ ID NO: 19677 - DNA, 1835 bp, Zea mays
ggtcagttctgttcttgagcgcactgccaccacagattggacggcttgtctgctctccgttcccgagtggcgtcgtgctcactctgctgggttgctttgccttatagtcttgctctgcggtttgatttgcttcatctttttttttcttcaatcttgtcactcctaaggtttcccccctctggttttcttgattccccgcttgggaatttgtgaagtttaacaggatttttttggctgagttcgcatgtttctgttcttggccatgcccatgctatgcttgcttggataagctttggcttcagcctagctcgcattgcacgatgcgttgttcctacttcctagaatccgatcgcaagtcctatgagctgaccactatttcgtggattgcccggggcgtgggctgctgatggtttcggcaatttgggttaatttttaggtaccagatcatctgatttctcagaagcaaaatgttgtttggagctcagtgacaccatcttgtaatgcctgtgattttacgggaaatggaggatcattctgtccatcccatgtctaagtctaaccatggctccttgtcaggaaatggttatgagatgaaacattcaggccataaagtttgcgatagggattcatcatcggagtctgatcggtctcaccaagaagcatcagcagcaagtgaaagcagtccaaatgaacacacatcaactcaatcagacaatgatgaagatcatgggaaagataatcaggacacaatgaagccagtattgtccttggggaaggaaggctctgcctttttggccccaaaattacattacagcccatcttttgcttgtattccttatacttctgatgcttattatagtgcggttggggtcttgacaggatatcctccacatgccattgtccatccccagcaaaatgatacaacgaacactccgggtatgttacctgtggaacctgcagaagaaccaatatatgttaatgcaaaacaataccatgcaatccttaggaggaggcaaacacgtgctaaattggaggcccagaacaagatggtgaaaaatcggaagccatatcttcatgagtcccgacatcgtcatgccatgaaacgggctcgtggatcaggaggacggttcctcaacacaaagcagctccaggagcagaaccagcagtatcaggcatcgagtggttcattgtgctcaaagatcattgccaacagcataatctcccaaagtggccccacctgcacgccctcttctggcactgcaggtgcttcaacagccggccaggaccgcagctgcttgccctcagttggcttccgccccacgacaaacttcagtgaccaaggtcgaggaggcttgaagctggccgtgatcggcatgcagcagcgtgtttccaccataaggtgaagagaagtgggcacaacaccattcccaggcacactgcctgtggcaactcatccttggctcttggaactttgaatatgcaatcgacatgtagcttgagatcctcagaataaaccaaaccttcagttatatgcaagccttttttgaggttgctgttgctgtacctgagaactgtggttaggttatgagtttgttcctcaagactgacccatacatgacatgctaccttgtgctgagtttctgagacaaagccatcgaaacatgatcttgtggttcagtaccttgctgccattagtgtctgataaactagctccccagtttgcagtttctctgaattccagcatgtctagcctcagccaacgttttgcatttgatgtgacgatgacataccatacacatttgtgcattcatctatgttctcaaagcagcactgca

SEQ ID NO: 19678 - DNA, 981 bp, Zea mays
ttttccatgtccacaggtccttcgaagaatagcaacttactccaatgatgtcaaccttaccaatagaccataacttccaacatgcaccctagcaacttggcctcaccaacgatgtcaaccctgtctgctcccttcctatgagctctgtaggttttgccatccttattctccccgtagaagaaataggtggtggtcctcttatcatagaggacacctcctcccatgagcttgaattggttttccgtcagtgtccaaccaaattctgcctgggtagtagaagtacttgctgccatttgcaccattgattggatctacagccgtattcagttctgggaagaacatgtcatgcacagccgaagactcatccaggaactcatccactattgtaggcttcttcttctctcccttgcggcgcacagcccggggattcctccggctccggggaggagctagccggaacttctcctcctccaccacctccagctccctcataatcgatcggcggatctcgtgtgtgctcatactctcatcgtcctccttatgaacgatgagaagatggaaattcacaacgacgaccaatgccgctaggctccatagtgccagagttagggaccggtggcttgccgggtggcaacggaaacccaacgcctttgggtgcctgctcctcatacccatggcgccgcttatctactccaaccgatacgcgcatgggctagtccttatcgagatcttggacagaggtggttgggggcgcctcgattagcttagcacgagccgcgatgccagagagattaggggggtctgtctgtctgtctgtcttggtttgtgcggctggcaacgcgacctgatgagtggttttggtaattggtatggccgggtgtctggcttccttggctaacagcgagcagcggcgtcactctggaaaggtcgcccgtcacattgcggtgggttcggcgtggcgtcgtgggaaaatgagtggag

SEQ ID NO: 19679 - DNA, 1892 bp, Zea mays
  misc_feature (993)..(993): n is a, c, g, or t
acctcgcccaaaaggccacaaaagttttatttgatttgagtgcaaactcaaaaaactaaacatttacgaaccctgcatctacatctgacctatacaatgtagaccaacgtgtcaaatgtcaatactttactttggtatctatcaatgtaacagcgtataagaccttcgattcttatgagagaaaaaaaaacttcaaataatccctccactcctcagggagacgccaccgtctgtgccagtaaatggacacccgggaccagagagggaacatgaagctgtagtctgcggcttcatcagggactcccccgatcgtcagtggcagccaaacataccgcgaatctctaagatcagatgggttccaccgatcagccatgaagatgaatgagcccggcagccctggaactggcaagacaaatgtgctctgggaaaagaatgtcgttgatctgaagacctcattccctcccacacaggggttccccagtgtctcccaaggtcccatcactgatgtcgctgcgtgagccagcgcagtgtttggagcccagcttgtacagccagaggtcaccatatagtaggtgccttcatgcttgaagagcgcaggtgcttctcgatgctgcgcgatgagaagccttcgcatcgcatcagtgacgtcaaggtagtcatcggttagcgggccaatgtggagctcgctgttgtcctcggaagagtatatcaggtaggccttcccatcatcatccttgaagatggtcatgtctctactctcacagtcatgcggacgcttgctgtagaggtaagtgaatgggcctgtcggagagtcactgatggccacaccaactgaagctttggtgtagttagcatcatctacgtgcatccacatcacatacttgccagtccgatcattgtatatcaccttgggtctctccaggacattggatttgtgaagatcatgtgttacattcttctcctcgccacggaggacaagcccttcgtttttcncatgtccacaggtccttcgaagaatagcaacttactccaatgatgtcaaccctgtctgctcccttgctgtgagctttgtaggttttgccatccttgttctccccgtaccagaaataggtgttggtcctcttatcatacaggacacctcctccatgagcttgaattggttttccatcagtgtccaaccaaattcttcctgggtagtagaagtacatgctgtcatttccaccattgattggatccacagccgtgttcagttctgggaagaacatatcatgcactgcagaagactcatccaagaactcatccactattgtaggcgacttcttctctcccttgcggcgcacagcccggggattcctccggctccggggaggagctagccggaacttctcctcctccaccacttccagttccctcataatcgatcggcggatctcgtgtgtactcatattctcaccctcctccttatgaatgatgagaagatggaaattcacaacgacgaccaatgccgctaggctccacagtaccagagttagggaccggtgggttgccgccgggtaccagcggaaacccaacgcctttgggtgcctgctccgcatacccatggcgccgcttaactactccagttgacacgcgcatgggctagtccttgtcgagatcttggcgagagatggttggggcgccccgattagcttagcccgagccgcgatcccagggagattagtggggctgtcttggcttgagcggctggcaacgcgacctgatgagtggtttggtaattggtatggctgggtggctgccttccttgcgaacagttcgcgaactgcggcgttgctctggaaaggtcgcccgtcacatgtcccggacggcctcccggccgccctcgagggtcccaa

SEQ ID NO: 19680 - DNA, 1377 bp, Zea mays
ggccctaggggcctttttttttttttttttggatcaaacggtaagaccaatgcggaatgggcaagcagattattcttgaaagtaagacgagtggatcgccacaacacctcgcccaaaaggccacaaagttttatctgatttcagtgcaaactccaaaaactgcacatttacaaaccctgcatctacatctgacctatacagtgtagaccgacgtgtcgtatgtcgatactttggtatctatcaatgtaccacatcttgaattattctaaaagaacttcagatttttcaagaatccctccactcctcagggagacgccaccgtttgtgccagtagatggacacccgggaccagagagggaacatgaagctatagtctgcggcttcatcagggactccccctatcgtcagaggcagccagacataccgcgaatctctaagatcggatgggttccaccgatcagccatgaagatgaatgagcccggcagccctggaaccggcaagacaaatgtgctctgggagaagaacgttgttgatctgaagacctcgttccctcccacacaaggattccccagcgtctcccaaggtcccatcactgatgttgctgcgtgagccagcgcagtgtttggagcccagcctgtgcagccagacgttaccatatagtaggtgccttcatgcttgaagagcgcaggagcttctcgatgctgtgcgatgagaagccttcgcatcacatcagtgacatcaaggtagtcgtcagttagcggaccaatgtggagctcgctgttgtcctcagaagagtatatcaggtaggccttcccatcatcatccttgaagatggtcatgtctctactctcacagtcatgtggacgcttgctgtagagataagtgaatgggcctgtcggagagtcactgacggccacaccaactgaagctttggtgtagttcgcatcatctatgtgcatccacatcacatatttgccagtccgatcattgtatatcaccttgggcctctctaggacattggatttgtgaagatcatgtgttccattcttctcaccacggaggacaagcccttcatttttccatgcccacaggtccttcgaagaatagcaacttactccaatgatgtcaaccatgggctagtccttgtcgagatcttggcgagagatggttggggcgccccgattagcttagcccgagccgcgatccccagggagattagtggggctgtcttggcttgagcggctggcaacgcgacctgatgagtggtttggtaattggtatggctgggtggctgccttccttgcgaacagttcgcgaactgcggcgttgctctggaaaggtcgcccgtcacattgtggtgggtacggcgtgagagt

SEQ ID NO: 19681 - DNA, 893 bp, Zea mays
gtgcaaagggcatcccaaggtgcagcttccccagatcaatagtccactcctcataatccttgagtgtctcagttggaaacttattgtccatcagagcatgtgccagtgcatcctcactcaaagcatgggacacccgcccgggccggaagatgctgtgcccaaccgagtagctgcccacaatgacaggccctttgagaccaggatgtccaagcatgccagtgcgggagtcactgttagagccaacactgctgttgttgtccacagacatggtgatggatccgccatgcatgctggtctgcatgctgttgaggctgtcaaccgacatgttggagccctcccctagcttctggtagaaggccatgtcacagaagttcccgccaaagttcacaccgccatcatggccacccacggcgccaatgaaaccagggaaattggcgccttgcgccatcactcgacaacctaaatgttagcctctgcagtaacttcactcttccccccggtccccccaacacagctcccaaaaagcctgacgattgattgcctgcaatcacggaataaaacctttcgaaagctggctgggaacgcgccgccgccgcttccgatgccaaccgatggaggacgaggtcggagcggagccgcgcgcgaaggtacctccgatccgggggttccgatcgaggtcgagtgaggacggccgtgggagcaggcggtgatgtggtgcggcgtcgggaccggacggacccgctcgccgctggaccgaggaggccggggcgacggggtggggttagcgggagaggatggcgagggccgggggaggggaatgtgggagactggaaggggaaaagatcaacaaaggcgaggcagaagaaagcgagtgaacgaacgagaggctcagt

SEQ ID NO: 19682 - DNA, 1302 bp, Zea mays
tgacttcaaatcctagccacaccaaagtcggcaatcttaatggacttatcaccagaaatcaggaggttgtccgacttaagatctctgtgaatgaacccaaggccatggacataggccatgccgcgtgcaacatccaatgcctgcttgactgccaacttcagtggaacagacctgttctgcctcctgctcaagaaattcttaagagatccaccctttgcatactctgtcacaatacaccaaaccaatggcttcctgcatgcaccaatgaacttgacaatattcgggtgcctcagtgttgcaagcatcataacttcttggacaaactgctgctctaacagttgagctttctcagggtcagcctcaggtcgctccaaaagcttaatagcaacatccatcccattatatgttcccctgtagagcttcccaaaggcaccttgtgcaaagggcatcccaaggtgcagcttccccagatcaatagtccactcctcataatccttgagtgtctcagttggaaacttattgtccatcagagcatgtgccagtgcatcctcactcaaagcatgggacacccgcccgggccggaagatgctgtgcccaaccgagtagctgcccacaatgacaggccctttgagaccaggatgtccaagcatgccagtgcgggagtcactgttagagccaacactgctgttgttgtccacagacatggtgatggatccgccatgcatgctggtctgcatgctgttgaggctgtcaaccgacatgttggagccctcccctagcttctggtagaaggccatgtcacagaagttcccgccaaagttcacaccgccatcatggccacccacggcgccaatgaaaccagggaaattggcgccttgcgccatcactcgacaacctaaatgttagcctctgcagtaacttcactctcccccccggtccccccaacacagctcccaaaaagcctgacgattgattgccctttcgaaagctggctgggaacccgccgccgccgccgcttccgatgccaaccgatggaggacgaggtcggagcggagccgcgcgcgaaggtacctccgatccgggggttccgatcgaggtcgagtgaggacggccgtgggagcaggcggtgatgtggtgcggcgtcgggaccggacggacccgctcgccgctggaccgaggaggccggggcgacggggtggggttagcgggagaggatggcgagggccgggggaggggaatgtgggagactcccggccggcctccgagggcccaagatgcaacaaaggcgaggcagaagaaagc

SEQ ID NO: 19683 - DNA, 2061 bp, Zea mays
gctagttactaataatacatatatcatatatatataccattaagcaaagcttccacatgctgccgcccgccgcttttttttttttttttctagcagcaagagcatgcacttgttataacggaagggtatttagtcaagcataaagctacctctattacaaccactggtgacgacagctaggtgtactctacgataacatgtcaaagacagaaggcagactgaggagcagactgaggagtcagccttctgtttctgaagcacaagtctattgggattataaacacataggattaaacccctctccaggttcttttcctggattgcggacgactcagtccgtcagtccagcgtcatcggttgggcgatgcaacagcggaagcgagccttacggacagtggtcagaacctccacctccacctgctccagcatcctcacaatctcagcgaatgggggacggacttcagggtttgtgtcccagcacatggtcatgatctccgcaagggcagggaggcagtcgtggggtatggctggtcgcacgcccttgttaaccacagcaaatgcagcttgcactgcgctcatgtttgcaaaggggacattcccagtcactaactcccacaggacaatggcaaaactgtagacatcaactttctggttgtatggcctatgctggatcatttcaggagccatccagcggtatgttccagtttcaggtgtcatcccctcagtcttgacttcaatcctagccactccaaagtcagcaatcttaatggacttatcaccagaaatcaggaggttgtccgacttaagatctctatgaatgaacccaaggccatggacataggccatgccacgtgcaacatccaatgcctgcttgactgccaacttcagcgggacagacctgttctgcctcttgctcaagaaattcttgagagatccacccttcgcatactccgtcacaatacaccaaaccaatggcttcctgcacgcaccaatgaacttgacaatattcgggtgcctcagtgttgcaagcatcataacttcttggacaaactgctgctctaacagttgagctttctcagggtcagcctcaggtcgctccaaaagcttaatagcaacatccatcccattgtatgttcccctgtagagcttcccaaaggcaccttgtgcaaagggcattcccaagtggagcttccccagatcaatagtccactcctcataatccttgagtgtctcagttgggaacttattgtccatcagagcatgtgccagcgcatcctcactcaaggcgtgggacacccggccagggcggaagatgctgtgcccaaccgagtagcttcccacaatggcaggccccttgagaccaggatgaccaagcatgccagtgcgggagtcactgttagagccaacgctgctgttgttgtccacagacatggcgatggaccccccatgcatgctggtctgcatgctgttgaggctgtcgaccgacatgttggtgccctcccctagcttctggtagaaggccatgtcacagaagttcccaccaaagtccacaccaccatcatggccacccacggcgccgatgaagtcagggaagttgatgccttgcgccatcactcgacaaccgaaatgttagcctctgcagtaacttggctcttccccccggtcccccccaacagagctcccaaaagtctggcgattgattaccctttcgaaggctggccgggaacacgccgccgctgccgatgccagtcgatggaggaagatgaggtcggagccgcgcgcggaggtaccagcgatccggggggcgcgatcgagggagggcggacggacggtgggagcaggcggtgtgtgatgtgatgcggttgcggtgtggcgtcggaacggcgcggaccccctcgtctctggaccgaggaggacggggcgacgggggcggcgaccggtgggtgtgggggaggaagaggaaggcgaggggaacgcgagagaggaaaagatcaacaaaggcgagggcgaggcgagacagaagaaagcgagagtcccggccggcctcgaggggccccatgg

SEQ ID NO: 19684 - DNA, 1546 bp, Zea mays
tgcagctgaatgtgatactctgcactgtctccatccttgtgtaatttcagagatcctttctctagtgtatcttcgtcttgttgctttcaacatgtacagttctgccacattgcttcaaagaactcatgcatgaccatccgaatccttctattgcatattatgaataaaaaaatggagaaccctgtaacaccttcagttaaagccgttgcagcaacaaacctgaaaacatttgcaattgttacgcatgcagtggctttggaaaacagaagcaacatcaatagtaatcatgatctgcttcagatttgctcaccccaaaaaagagggaaactgatgctgaccaatgcaaagatgattctgttagcacggccgctttcttctgtcttcttgggcagcaaatccatgctagttacttaataaaacatattatatataccatgaagcatcaagactcccacatgttgccgcatgatgataaacacgcaaacagcgaccagcaagaacaggcacttttacaacggagaagggtatttggtcaagcataaagctacctctattacaaccactctggtgtactctacggtgacatgtcaaagacagaaggcagactgaggagtcagcttcctgcttcttctgaagcacaactctaataatatatattataaatacataggagtaaacggcactccaggttattttcctggattttgtggatgactcagtccagcgtcatcggttgggcgatgcagcagcggaaccgagcctttcggacggtggtcagaacctccatctccacctgttccagcatcctcacgatctcagtgaatgggggacggacctcagggtttgcgtcccagcacctggtcatgatctccccaagggcagggaggcagtcgtggggtatggctggtcgcacacccttgttcaccacagcaaatgcagcttgcactgcagtcatgtttgcgaaagggacattcccagttaccaactcccacaggacaatggcgaaactgtagacgtccactttctggttgtatggcctgtgctggatcatctcgggagccatccaacggtatgttccagtttcaggtgtcatcccctcagtcttgacttcaatcctagccacaccaaagtcggcaatcttaatggacttatcaccagaaatcaggaggttgtccgacttaagatctctgtgaatgaacccaaggccatggacataggccatgccgcgtgcaacatccaatgcctgcttgactgccaacttcagcggaacagacctgttctgcctcctgctcaagaaattcttaagagatccaccctttgcatactctgtcacaatacaccaaaccaatggcttcctgcatgcaccaatgaacttgacaatattcgggtgcctcagtgttgcaagcatcataacttcttggacaaactgctgctctaacagttgagctttctcagggtcagcctcaggtcgctccaaaagcttaatagcaacggatccatcccattcccggttccggccttgagtgaaccaatggccctataggag

SEQ ID NO: 19685 - DNA, 3227 bp, Zea mays
gccggccgggcctgtcaaacgccgcggcccccgcccggccggcacctggtcctcctctccactctctcttctccctccaataattctctccacccctgcttgctgcagcttcaagcactaccgaatcagggcgagtgggagcagaggagggaatcccatgtctccgcccctcgctggagcagatcgttgtcgagccgacgtggagctgctgcggtagaaagctagcggagcctgcgagctagcctgatccgtccgcagtccgatcgggatcgatgggtggggaggcgccggagccgcggcggctgacccgggcgctgagcatcggcggcggtgacggcggctgggttcccgaggagatgctgcaactcgtgatggggttcgtcgaggacccgcgcgaccgggaggccgcgtcgctggtgtgtcaccggtggcaccgcgtcgacgcgctctcgcggaagcacgtgacggtgcccttctgctacgccgtttccccggcacgcctgctcgcgcggttcccgcggctcgagtcgctcgcggtgaaggggaagccccgcgcggccatgtacgggctcatacccgacgactggggcgcctacgcccgcccgtggatcaccgagctcgccgcgccgctcgagtgcctcaaggcgctccacctccgacgcatggtcgtcacagacgacgacctcgccgagctcgtccgtgccagggggcacatgctgcaggagctgaagctcgataagtgcaccggcttctccactcatggactccgcctcgttgcccgctcctgcagatcactgaggactttatttttggaagaatgtcaaattgatgataagggcagtgaatggatccacgatctcgcagtctgctgtcctgttctgacaacattgaatttccacatgactgagcttgaagtgatgccagctgacctaaagcttcttgcaaagagctgcaagtcactgatttcattgaagattagtgactgcgatctttcagatttgatagagttcttccaatttgccacagcactggaagaatttgctggagggacattcaatgagcaaggggaactcagcaagtatgtgaatgttaaatttccatcaagactatgctccttgggacttacttacatgggaacaaatgaaatgcccattatgttccctttttctgcaatactaaagaagctggatttgcaatacactttcctcaccactgaggaccattgccagctcattgcaaaatgcccgaacttactagttctcgcggtgaggaatgtgattggagatagaggattaggagttgttgcggatacgtgcaagaagctccaaaggctcagaatagagcgaggagatgatgaaggaggtgtgcaagaagagcagggaggggtctctcaagtgggcttgacggctatagccgtaggttgccgtgagctggaatatatagctgcctatgtgtctgatataaccaatggggccttggaatctatcgggacattctgcaaaaaactatacgacttccggcttgttctacttgatagagaagagaggataacagacttgccactggacaatggtgtccgagctttgttgaggggctgcaccaagcttcggaggtttgctctgtacttgagaccaggagggctctcagatgcaggtctcggctacattggacagtgcagcggaaacatccagtacatgcttctcggtaatgttggggaaactgatgatggattgatcagcttcgcattgggttgcgtaaacctgcgaaagcttgaactcaggagttgctgcttcagcgagcgagcactggcccttgcaatactacatatgccttccctgaggtacgtatgggttcagggctacaaagcgtctcaaaccggccgagacctcatgctcatggcaaggcccttctggaacatagagtttacacctcccaatcctaagaacggaggttggctgatggaagatggggagccttgtgtagatagtcacgctcagatacttgcataccactccctcgccggtaagaggctggactgcccacaatccgtggttcctttgtatcctgcgtgagtgtaaatagactaagctggtgtctttccttagcctcctggtcaacaagaatggtgttgataactcgatatatgcggttattgtatggatctagatggctagctgctacgtactgtaataagctactagtagctgagagatgtcctggaataagcccttgctatttttgcctgtactgctttctaatcctagggagatgtatactgctaagcaacgatggaagatgtgagtctgcttgctcgccctgatttgatttgtaccactggaggtataagaatacctgggttttggccgcctgcttagagcattgagttgttctctgccgtatgtggtggttgctcatgagttgacgatgagacaaccaggactgattttgtatgctgtacgaactgagtgtatgaagttactgtgccagggcggccatgaactctctttatgataaaagccctttgcagtgatggccccccccccctatccttagaaacacccatttgattggagttgcaggtgccgcggctattattgccaattggcatctcctctggtttgtttccagatctcagcatcaaggaggatatgctatcgcagatgtggctccaagaagacgaccttctgtcatcaagaccaaaaggccgtgtgaaaaaaaagtgtcctctgttatatcattatatgggctggcggcccactgtctccactctccagtccacagtagaaacaagctctattgtctgccactgtgccgccgcacagtagaaagttagaaaccctaaaacagtaaaaccctaagccgccgcctctgccccctctcacactctgctccattgctgccctgcggccctgccctctactccggtggtcctcagctccggtggccctgccctctgccctttattgcgcttgcctctgctcagctccggtggccctgccctctgccctctgttgcactcgcctctgctcactgctcagctccagcgctcgcctctgctcactgctctgctccggcaatcgtctgcaccaatatgttctgaactctgttcagagttcagtgttcagtgctcacttcactagtctgttctgaacttaaccgaaatgagcacctctacagatggtaatctctgtgttcttttggttcttcaattgttcatttggtgctgc

SEQ ID NO: 19686 - DNA, 3752 bp, Zea mays
atggagtccccagctggatgcctccggcccgcagaagtaaacgccgcttcccaaatccccaccccacctcgtgctcctctccactctctcttctccctccaataattttctcctctctgcttgctccagttccaagcaccaccgaatcagggcgagtgggagcagagggaaccccatgtctccgcccctcgctggagtagattctcggcgagccggcgtggagctgccgcggtagaaagccagctgagcctgcgagcgcctgatccgcccggagcccgatcgggatcgatgggtggggaggcgccggagccgcggcggctgacccgcgctctgagcatcggtggcggtggcggcggctgggttcccgatgagatgctgcaactggtgttggggtttgttgaggacccgcgcgaccgggaggccgcgtcgctggtgtgtcgccggtggcaccgcgtcgacgcgctctcgcggaagcacgtgacggtgcccttctgctacgccgtgtccccggcacgcctgctcgcgcggttcccgcggctcgagtcgctcgcggtgaaggggaagccccgcgcggccatgtacgggctcatacccgacgactggggcgcctacgcccgcccgtgggtcaccgagctcgccgcgccattcgagtgcctcaaggcgctccacctgcgacgcatggtcgtcacagacgacgacctcgccgagctcatccgtgccagggggcacatgctgcaggagctgaagctcgacaagtgcaccggcttctccacggatggactccgcctcgtcgcccgctcatgcagctcactgagaactttgtttttggaagaatgtcaaattaatgataaaggcagtgaatggatccgcgatcttgcagtcaactgtcctgttctggcgacattaaatttccacatgactgagcttgaagtgatgccagttgacctagagcttcttgcaaagagctgcaagtcactgatttccttgaagattggcgactgtgatctttcagatttgatagggttcttccaatctgccacatcactggaagaatttgctggagggacatttaatgggcaaggggaactcaccaagtatggggatgttaaatttccatcaagaatttgctccttgggacttactttcatgggtgcaagtgaaatgcctattatatttccttttgctgcgatactaaagaagctggatttgcagtacactttcctcaccaccgaagaccattgccagctcattgcaaaatgcccgaacttactagttctcgcggtgaggaatgtgattggggatagaggattaggtgttgttgcagatacgtgcaagaagctccaaaggctcagaattgagcgaggagacgatgaaggaggtgtgcaagaagagcagggaggggtctctcaagtgggcttgacagctatagcggtaggctgtcgtgaactggaatacatagctgcctatgtgtctgatataaccaatggggccttggaatctatcgggacattctgcaaaaaactctatgacttccggcttgttctgctcgatagagaagagaggataacagatttgccactggacaatggtgtccgggctttgttgaggggctgcaccatgcttcggaggtttgctctgtacttgagaccaggagggctctcagatgcaggtctcggctacattggacagtgcagtggaaacattcaatacatgcttctcggtaacgttggggaaaccgatgatggattgatcagtttcgcactgggatgtgtaaacctgcgaaagcttgagctcaggagctgttgcttcagcgagcgagctctggccctcgcaatactaagtatgccttccctgaggtacgtatgggttcagggctacaaagcgtctcaaacaggccgagacctgatgctcatggcgaggcccttctggaacatagagtttacacctcccagttcccagaatgctggtcggttgatagaagatggggaaccttgcgtagatagtcatgctcagatactggcatacggctctcttgctggtaagaggttggactgcccacaatccgtggtcactttgtatcctgcgtgagtgtaaatagactgagggcccgtttggtgcccatggaaccgttgtctggaacaatttctggtaggattgcttgctgatttgtataggctttgatcagctggaaacaaatgaacaaggcctaagctcgtgtctttctctcacgtccttgctttcttagcctcatggtcaacaagaatggtgttgataacacgatatgtgcttattgtattgatctagatggctagctgctacgtactgcaatcagctactagtagttgagatgacctggattctggaataagcccttgctatcttcgcctgtactgctatctaatcctaggaagcatgtatatgtatactggtaaaagtaacgatggaagatgtgagtctgattgcccgccctgatttgtctcatgggaggtataagactatctccagcaacttacccatctctgtacttatattcaaactttattgagcgaacagtgcagtctatagtgcaggagtcggtcaaagattgtttttaagatattttacattgcatattgcatcgatcataaagtagagattaaaataggagatatgatgtgtaagctcctccctaagaatacgtgggttgcgagatgttccttatatgtggttgctccagtgttgatgatgagaaggcttatatttttttatgttgtatgtgctgagtacatgaagttactatgccacggccatgatctctctttatgataaaagtattttgcagcgatgctattgatccgtatctgagaacagggtggtgaacacccatttcattgcaggtgccgtagctatgattggtaattgggttaaaagggattgaagtggattgaagtgtattttagggattgaaagggaaattagttcatattacacttcaatatgccttattccacctcaatccactccaatccaagattacccaaacaagccctcaggtgtgtttctagctctcagcatcaaggacgctatcgcagacgtggctccaagcaggcgacctccaactcctatcatgaagacgcattggccgcgccaaacaacaggcgcaatcgcatagcggagcgccacacggcatgatgatttggccactagtttaaactttaaaggctagcgtacaaaagttgcgtaggatggtgtctgcatctcccatgacgagttgggaagaagccgacctcaccgcgacaacgacgaggcgtgtgaccgtgtccagcgctaccgagacgcctaggggaggcgagtgaggcaactcattgcaatcagttgtcttcgcctcgtcgtacgcacgaaatgctactgcacgaagctattttagcttttcttatccttacgaatcacgtaattagtaatatgttgtaagcaaaaaaaggaaataatgcaactacgtcaaggtagtagacagctgggccacgttcatcattctacttaccaccgtgaggaccggaggaatccggatgcaatgcatgtgatcccacgccgacgatccggaccatggttgccttgcgagactgcatctgtcggtttgtattctagacacgggcggatcaagatcactagggcttttttcggttgtgctggattgtgttgaataactacattaccaaatatcatctgatccgctctcttctcttccatatgcaatacctattccatattgtggt

SEQ ID NO: 19687 - DNA, 4018 bp, Zea mays
ctgcagccggccaggggcgtgtgcgtgcagtcccccagccagcgacggccagaagatcacctgacaattccggcccgccgcctggtcgcctgcgtcacggtcacggtcgcgaaaaaaacacccgttgcggcgttgctcgaaccaccctcgccgcgccccgtcccgtcccgtcccgtccaacccaacccaaccccccgccgcccaccggcctcggccccggccccgcggatagacacccgcggcgctgcctgtgccttctgcgcggcgctgccagctgcctcgtaatcacgcgcccctgccctgtcctgccggctgccgtgccgagccccacgtccacctgcgcccgcggccgcctttccgcccgcggcccaacagaaaaaaagagagagaggaaacgggcgcacgcggccttcctccccctccgcctcctctcctcggccgcgccttggacgcgtccgacgccgagccttcctttcgttcctctccaatcgagccaaaaggactcccgtctctttccctcctcctttctcgcctcgccccccttttccagcctaaaccccctcgcccccgcacctctttcttccccatatggccatactatcacactagactcctctcctctccgctccgcgccggcatggcctcctgttcccagcgcctctcacctaccgtgtgccagtccccctcacgcgccacgccccccctcgggtaactactagttgccgtaccgtgggagcgccgcctcgagtctcaccaaccaccacctgctggtgcgtagccgcgcccgcgcccccgccgcggctctctggttggattcccgtgcgggatcggcgggcgaacctccgactcaccgccgcgaccgttcccgcattacaggggcgtccgtgcgtgcgtgctccggatgggggcgtcccacgacgacgaggcggggccgctggcgagcctcctggcggcgcgccgcgcgctgcgggccggcctggacaagtcgcgcgcgctgagccgcgcgctggcgccccggctggaggggatccaggcgcggctgccggccatggaggcgtcagtgcgcccgatccgcgcgccgccggaggcgctcgccacggcggggcccaacatcgaccgcgccgtgggccccgccgccgccgtgctcaaggtgttcgacgccgtgcacggcctcgagccgccgctcctcgaccgcgccgccgccgccgccgacctcccgggctacctcgccgtgctcgcgcagctcgaggccgcgctccgcctcctctccgacaactgcggcctcgccacgcagtggctggccgacatcgtcgcctacctcggggagcgcaggctcgccgacgcccgcttcgtggccggcctcgccgccgcgctcgaccgcctcagggacgacgcctccgccggcctcgacgccgggctgctcgccgccgcgcttgacatgctccaggctgagttccgccggctcctcaaggaccactccgcgccgcttgctatgaaggaccccgacggctctggctccgacccgccccccgtcgtaccttctcggatccctgccgcagtcgtgcacaagctcagcctcatccttgaccgcctcgctgccaacggccggcttgaccactgctcctcggcgtatggggacgcgcgaggggataccgtgtgcgccagcctccgcgcgctcggccttgattacctcaaggagacgtcgggggacgcgcaggcgctcagcccgagcgtcgagcgctgggcccggcatctggagtttgcggtgcaccacctccttgaagctgagagaaagctctgtgtcgcggtgtttgaacggcggcctgaggccgcgcccttgtgctttgctgagattgcagctcgtgctggcattcttgatttcctcgactttggccgtgccctggctgatgccaggaaggaccccatcaagctattgcggctgctcgatgtgttccattgtttgaacaagctgaggctggatttcaaccgtttgttcggtggaaaggcctgcgtagagatccaaagcaggactagggagctcgtcaagagggtcgtggatggtgctgttgagatctttgaggaattgcttgttcaggttgagctgcagcgcactataccgccaccagttgacggcggggtgccacgcctagtgagctttgtcgctaagtactgcaatcagcttcttggggagcagtatcgatctgtgctaacacaggtgatcaccatccaccgcagctggcgcaaagaagtgtttaatgacaagatgcttgttgatgcggtgcttaatatcgttaagacacttgagctcaactttgatacatggtcaaaggcttatggagatacaacactgtcgtctctcttcatgatgaacatacactggcacttcttcaaacacctaaagggtactaagctgggcgagctgttaggtgatccatggctccgggagcatgaacagtacaaggattactactcagcgatgtttctgagggagagctggggaacacttgcacccctgttgagcagggagggcctgatcatgttttccaagggccgggctactgcaagagatttagtgaaacagaggctcaaatcattcaatgctagcttcgacgagatgtttcaaaagcagtctaaatgggtgatatcggatagggatttgcagcagaagacatgccacctcgtggtgcaggccgtagtgcctgtttacaggagcttcatgcagaattatgggccgcttgttgagcaggacgttagtgcgagcaggtatgtgaagtacagcgccgaggatctggataagatgctcaacacgctcttcctgtccaagccaggcaggccaatgagagctggaagcttccaaatcaaaaattcgaatgacaagattaccagtgcaatgacaggattgtatcggagtgcttctactctgaagtagcttcagtggcagttgggaaatactgaatgcacaatttgtgcaataagccaataacttcgtaggcaaaggtggttcgggccagtaagtcaagatccccacttatgtggggggtgcaataatggttccatgattagagcagctggagcataagatgaacataaaactcttccagaactgatattgtgggggagaaagatgacaggagtgtttcctcagcgggtctccttcctgtcgatcatcttttcaccttctattgcattcttatctgtagcaagtatactcaattcattttaggaacttgtgtgggagcagaggatgtgtaatcagttatctggtacatggtagaagattggttgtattataggaggtgttaagttgttgcatatggttatggtatactatgttttagatctcatgaacatgcagtgaattatatggagtacattataactggtggcgaatggtaattacagcagttaattatatggaatccggcacggccggcggggatagcttcaattcgtctatataccatatatctccctagccaacacacacataatactctccattccattccgttccatctcaaaggatagaacaatgggcggtctctccaccaagcttttcgtggtcctcctcctgctcgtttgttacaccgggacgcaaggcgggccggtgactatggtgtcggcgaggaagtgcgagtcgcagagcttccgcttcaagggaccttgctcgagggacgccaactgcgcaaacgtctgcctgaccgaaggtttcaccggcggcgtgtgcaagggcctacgccaccgctgcttctgcaccagggactgctagtactgcctcgtctcgcctcgcctcggctcgtgtcctgcgtgtgcatagccgcagcggatcagtaaaacatgcatgcatgcgttaccgaatatttggcagtaccagcaagttaatggattaaataatatgtaatggaacaaagcctgttttgaacgttgaactgctgagtgctagcagcgctcgtgtttattggcatatatgaactctatggcgcgtttggacttaaaaatttaaaaaaaaaaaaataaa

SEQ ID NO: 19688 - DNA, 740 bp, Zea mays
  misc_feature (47)..(47): n is a, c, g, or t
  misc_feature (55)..(55): n is a, c, g, or t
gcggccgcttcgaaggccggcccgggcccggagaatctaagatatantgtttgcngggggcatcccgtcgggcgggccgggccgatagcttcaattcgtctatataccctatatctccctagccaacacacacataatactctccattccattccgttccatctcaaaggatagaacaatgggcggtctctccaccaagcttttcgtggtcctcctcctgctcgtttgttacaccgggacgcaaggcgggccggtgactatggtgtcggcgaggaagtgcgagtcgcagagcttccgcttcaagggaccttgctcgagggacgccaactgcgcaaacgtctgcctgaccgaaggtttcaccggcggcgtgtgcaagggcctacgccaccgctgcttctgcaccagggactgctagtactgcctcgcctcgtgtcctgcgtgtgcatatatagccgcagcggatcagtaaaacatgcatgcatgcgttaccaaatatttggcagtaccagcaagttaatgaattaaaatattaaataatatgtcatggaacaaagcctgttttgaacgttgaactgctgagtgcgagcagcgctcgagtttattcgcatatatgaactctatggcgcgtttggagtgcgaggattttttttacctgttttcttgtgtttctcatagcaaaaaataaaataaaataaaataaaccgatacactgcggccaaaaaaaaaaaaaaaagccccta

SEQ ID NO: 19689 - DNA, 738 bp, Zea mays
gcgcccgccgcccccatagcttcgtctgtataccctatatctctatagccaacacacacacaaatactctccattccattccatctcaaaggatagaataatgggcggtctctccaccaagcttttcgtggtcctcctcctgctcgtttgttacaccgggacgcaaggcgggccggtgactatggtgtcggcgaggaagtgcgagtcgcagagcttccgcttcaagggaccttgctcgagggacgccaactgcgcaaacgtctgcctgaccgaaggtttcaccggcggcgtgtgcaagggcctacgccaccgctgcttctgcaccagggactgctagtactgcctcgtctcgcctcgcctcggctcgtgtcctgcgtgtgcatagccgcagcggatcagtaaaacatgcatgcatgcgttaccgaatatttggcagtaccagcaagttaatggattaaataatatgtaatggaacaaagcctgttttgaacgtggaactgctgagtgctagcagcgctcgtgtttattggcataaaaaaaaaaaaaaaaaaaaaccgatacaaaaaaaaacaaaagcggaaaaaggcaaaaaaataaaaaaaaaaacaaaaaaaaaaaaaaaaaaaaagggcaaccaatataaaataatgcaaactaacaatacgggacaatccaacatatggatcttctttttggaggacctaaatttaaatgaaaggccctcattataaaataaaa

SEQ ID NO: 19690 - DNA, 739 bp, Zea mays
  misc_feature (666)..(666): n is a, c, g, or t
cattgggtcccccgccggccggcgacatagcttcgtctgtataccctatatctctctgacacacataatactctccattccattccattccattccatctcaaaggatagaataatgggcggtctctccaccaagcttttcgtggtcctcttcctgctcgtttgctacaccgggacgcaaggcgggccggtgactatggcgtcggcgaggaagtgcgagtcgcagagcttccgcttcaagggaccttgctcgagggacgccaactgcgcaaacgtctgcctgaccgaaggtttcacgggcggcgtgtgcaagggcctacgccaccgctgcttctgcaccagggactgctagtactgcctcgcctcgccttgtgtcctgcgtgtgcatagccgcagcggatcagtaaaacatgcatgcatgcgttactgaatatttggcagtaccagcaagttaatgaattaaataatatgtaatggaacaaagcctgttttgaacgttgaactgctgagtgctagcagcgctcgtgtttattcgcttatatgaagtctatggcgcgtttggacttataaaatgaaaaaaaaaaaagaacagcggccaactgaacactcagttggaaggagttctgagaagaagaagaaaaaaactgctccgggaagaacaaggctntgcagtggcttttgctttggagagcacaggctcatcatcaagtgatggccaagtcaggggcgctacaacttgc

SEQ ID NO: 19691 - DNA, 919 bp, Zea mays
  misc_feature (906)..(907): n is a, c, g, or t
  misc_feature (909)..(909): n is a, c, g, or t
ccggccggggcgtctctgctcttgtccggaaggttctcgcaggcgcggcgacctcggttttgaacacctgctcttcttcctccttccaatccaagcttcgtacgggacgaggagaaccgaagaaggaattggacgcgaggagactcgagtactcgacagggaaaagtcgaggcctcggatccatcgactcgtgaagatgtcctcgcccgccgagtactacaaatcacttccacctataagcaaggcatatgggacattgtgtttcttcaccactgtgctagttcggctccatatcctgaatccgctgtttctgtacttatattaccctcgggtgttcaagaagtttgaggtatggaggatatttacaagtttcttcttcctgggaccattttccataaactttggtattcgccttctgatgatagcaaggtatggtgtcatgttggaaaagggagcatttgataaacggactgcagatttcttgtggatgatgatatttggtgccatctcactattggtgttgtctgttattccccaattgaatacttatgtcttgggattacctatggtcagcatgcttgtttatgtctggagccgagagaatccaaatgcccagataaatatatacggcatcctccaattgaaggcgttttatcttccatgggttatgctcttattagatgtgatatttggatcaccattaatgccaggccttctgggtatcatggttggacatctatactactactttgcagtgttgcaccctctcgccaccggaaagaactacctcagactccgaaatgggtacataagattgttgctcgattcagaataggtatgcaagccaacgctcctgtccgcgcaccagctaacggcaacgctgggactggtgccttcagaggaagnngngatagactca

SEQ ID NO: 19692 - DNA, 1709 bp, Zea mays
ctcgaggccggccgggatgacccatcgcctgcgccccagcgcgcacacctacgtgtcgagccgtcttcatccctccgaccggaaatcaacggtgcgtttgcttctctcctccggaaggttctcggcttctcgcaggcgcggcgaccggcttcaaccccaactcttcttcttcttcctcgcaaacttcgaacgggacgagaaggaagcggacgcgagaggagactaaccgacctcggatccatcgacgcgtgaagatgtcttcgcccgccgagtactacaaatcacttccacctataagcaaggcatatgggacattgtgtttctttaccaccgtgctagttcagctccagattttgcacccattatttctttacttagattaccccttggtgttcaagaagtttgagatatggaggctattgacaagtttctttttcctggcaccattttccatgaaatttggtattcgccttctgatgatagcaaggtatggtgtcatgttggaaaagggtgcatttgataagcggactgcagatttcttatggatgatgatatttggtgccatctcactattggtgttgtctattattcccctattcaattcttttttcttaggaatacctatggtcagcatgctcctttatgtctggagccgagagaatccaaatgctcagataaatatatacggcctcgtccaattgaggtccttttatcttccatgggctatgctcttattggatgtgatatttgggtcatcattaatgcctggacttctgggtatcatggttggacatctctactacttctttgcagtgttgcaccctcttgccaccgggaagagctacctcaagactcctaaatgggtacataagattgttgctcgattcaggataggcatgcaagcgaactcacccgtccgtccaccagccaatggcaacagcgggtctggtgtgtttagaggaagaagctataggctcaatcaatagattcacccacctcgtaatgtgatccatggtcggagtggcaatgtagaagcaaagaccagaacgcatagtagggtcaatcaaaattaagggttacccgtcagagattttcttaaaaaacctggacggacggaatggagaacccttccatttgctcatttagttgctaacaatgttcatcgtccatgtttacacatgaatataattctgtaatgacaatttgtgtacacttatgctggacttattgtcgcctctttttagctaggataagaacaaaagatgatgagtttgcccatgctggtgcttttggtccttactgggtggatttgtgcatgctgaacagcagaaggctagatctcgggttattgtcatctggcccaaaaaatgacatcaacaggtttccgtcacacaagatcggagtttgctgataatattgtagagacaatttagactttgcttgatggttgtcatacgtcaatgacgtcgaaagaaaatctgagaacaatacggctgtaaatttcacctttgtgtaattgtatcatagatatcgtcgagaaatcccaaatgcagtaatggctcgttgagcagaacttcaacactttttgcgctaggttctgggcattcatcatcatgttaacatacttcaagaaacaaagatgacaacgagcaagttagccgacagtgcctcggggaaacaaatcttctgcactcgaggatttcctgcag

SEQ ID NO: 19693 - DNA, 3329 bp, Zea mays
ggagaggaaatcggtgtaggagaaggtacgaaggtgtccctgaaccattcgtttgtgattcgacgaccagaaaaataaaggatgacgtggacaccgtctgcattgctgtttttgcaccgtctttcatatataggaaataatcgggtcatgcctgctcgcctactaaccatgtgtttggttgcgtgaaagaccaggatgatggcacttggtttaaggtatgaaatcatcaatggtattgtttggttctgagggtgggacgatccatgttttctgattgatttgagggataaataggggtatattgaacatgttctttatttggttggggagacaaacaagacttcggagaagaaacacacgtgtgcgggacgtgagtagcctcatcacctgaagaacggactcgtccgctcaattccaatgggtcgttaggaacgacatcaaatggtaatattcttcaagagatggtcctacctctgccctgacttagaaccaaataacctcatctgagtgataactcatcctatcaaaagcatggaaagtgtgagaacacacagggtcaaacctaggatgaaacgagagtgaggatacacttgaaagatcactaaaataataaagcaaggacatctaagtttgactgagcaaagtacttctaagcagggacatctaagtaagttcgtatatttattacgaatttaaaactatagtatgtacccatccattgcatttatcagattaggtcgaattttttagatagattaggtgacccatacccatattcaggtctattttattttataggttttgcatttatatgccttcatcttttggacattttcagtgtttacttggatttaattcgtaccagtttctacaacttctacaatattttgtctttatgtattacagctataacatttgtctttatgtattacagctataacagtataaacaactagctttaatctggagctagctttaatcgggaacttttttttttttttttttttttttttttttgagcgtaaaaaataaaaatgtagcaacttagcaagtataaatcgtctacatattttttccacatcaaatctgcatcccaaagctgtatctgcagctatgtgagacatgaaaaaacaaaacaacacataccaccacgtttagtatgaatctaccgtgctacaactcacagcatatacatacgagaaaggccggaagggcagcacaagttccggcaacgactaccaatgttgtttctaaggttttcaaactctcgtatgctcagtactcctttcttccttccatcgaagtagcttcagagttcagccgttgctacagtaagaggtcccatgcccttgcccatgtgtgccggggttgtgcgagcagtaaaagttggggcatcagaccctgccacttaaagagcccgtggacaaattaactgcgggtttctggtacactcttacaactgctgttccgtcgccaccatcattgccaaccctccaggaccgatccttcttccgctggggcttcttgtggtgcttgtgggacgcctctttcttctttgctgtagttttggaccctccattacccaagtcaaaagattcaaggtcatctaggacatctctcatgtttgattcagcaggatcaactgcatcatcatcctcttcatcgagatcatcagtaactgattcattagctgctgaagtagttggactttctgatccagcgatttgttcaaagtccacctcagggcctgtcacgccaggagggagctcaaagtgtgggattttaccatcaatgtaatccttcagtatttgtcgagcagccctggtctcatcaggcagcccagcatggctgacatgcccacgagacgcgcagtaggcccgcaacagctcagcagcagttggcggccgggactggggttcatatggctttggctttggcaatgcaattttgtaaatctgctcaaggatgtcccttgggacacgatctgccaccacttgaatagcttcccggtgctttgtcatcctatcaatcggcaacacaccacatgccaccatctcatgccttgagcttgaaaaggaagggaagaccagaccagggcaatcacaaagagtgagctcttcagagattatcagtgtctggaaatgttttgtcttgccaggtgtgtgagtaacaccagtcctcttctcgccaaccaaagcatttatagttgaactcttcccaacatttggatagccaacaaatccaacaactacatgcttagtcactgaagaaacagaatctgaagaactggcttcgtgatcatctacagtaggtgagatcctcctctgagctacaatagattctgcctcagcttgcagcttcatcaagagttcatccctttcatatatcttggtatccaaatcaagtgaagcagattctccttcagagtatccacttaactttttgccttctaatgtggcagtggcagccttagccgaccagaacacatagagaatgtcatgtgccttaaaataatcagcccatctcttcctgatatttaacggcaacagatcagccttgttaacaaggagtattgttctcttgtgttcatcaatttcctttgcatatgcctcaaggtcagggcagcggtagaacaaaggatcccgagcatcaaccaccataaccaacaaatcactgcgttcaagcactctccagagttgtctccagatgtcaatattcttctcaaagggagtcaggataagcttatcattctcttccaatcttgcaagattcctgcgccacaccagaaaggcccgacgctcgttcacatcaagctcctccacagtcatctgactatgccatggcggtcgcctggggaccctgaggctgctggcgtgcagggcctcctgctccttgcgaagccgccgcctgtcgtcttccgtctcccccgtcgcatccaggtcgatgacgaggtcggagtcggaagagacggacgcggcctcagcgagctggtcggcctctgcggcccgctggagcacggcatcgatgtcactgacgtcaatgacagactcgagcggcatcgcgcggcggcggccaaaggcgagcgcctcgccccgttccttagcggccgcggccgccttgttccgctgccggatcagcgcgcgcccgagcccctcacccttctccttctttccgccgcccgccatcaccttcgagcccgtggccgatgccttggagagatagagataggtcgcggatgagaaccgtggaggcggagggagttgcggctagggtttttgcatttgcagtgggtgttttcgattaggatgttctaggtaatggtctcgtgc

SEQ ID NO: 19694 - DNA, 1276 bp, Zea mays
aatcgaaaacccatccgcatcacagcttgccacttcagactcctctgcgctccatccctctgcactccggtccgcgcgagacgagcagcttctcccagacgctagacacgccaccgcatcgtctgcgccgcgagatcgagaatgtccatctctatgcggctcgcgatccctgctcctgccgtcaccgccgccgcgccgacgcggctgagggtgcgagcggcagcggcggggaaccgcggctctctctccgtcgcgcgcgccgccgtacgggcggagacgggcgcgctcaggggatgcgcctggctgccaccgaagccgctgggagcgggccagccgtaccggagcaggggggccgccgccgtgtgtcactcgtcggcgcacctcagcgcgcgcaccatccagtggatctccgccggagccagcgcagtgctattagttgctaaaggcactgccatacacaaatctttccttgtgccattttttgctcttcaggcaccttgcagcataatctcatggatcaagggtgactatggtcagtggactgcttttcttgctctgttggtgcgtctattcttcttcattccaggtagagtagcaaacatggttcatataagagtactttttagattcattctgtctgctaataatcaaatgtgtacttcttttttgagataattgaatactatgtttttcgaaggaacaaagtagaccttgtgcccaacctgaacaaattttattacttctttgaaatcattcatttgtatgattcaagaaaaaaggaaaatggagattataaagtatctatcataatcatatgatagcaaacttgaaggcagttcacctatttgtagcatcggttctgaaccaatctatgtttaggtctacccagttgtttattattgtaggtgaactggagcttccactgtcaacaatgctgcttgtgagtgttgctccttaccaattcatggatctgaggggaactcaaggtggtgccgtactgtcactggccatagctgcgtatttcgccttccagcacttcactagggtgggcggcccaggcaaagccttcgagcagggatccattgttgcgaccttggccatcatctgcatcatgattgtgcccttgatgctgctattctgatttgcattaagttgaaatgaatttgcttctcattatgtgcgtatagaaggacaaataaatttaaccttgtaatgcagcatccgagttttctttcccaaaacgtatgcactgaaaaaaaaaaaaaaaaaaaaaaaa

SEQ ID NO: 19695 - DNA, 978 bp, Zea mays
atccgcatcacagcttgccacttcagactcctctgcgctccatccctctgcactccggtccgcgcgagacgagcagcttctcccagacgctagacacgccaccgcatcgtctgcgccgcgagatcgagaatgtccatctctatgcggctcgcgatccctgctcctgccgtcaccgccgccgcgccgacgcggctgagggtgcgagcggcagcggcggggaaccgcggctctctctccgtcgcgcgcgccgccgtacgggcggagacgggcgcgctcaggggatgcgcctggctgccaccgaagccgctgggagcgggccagccgtaccggagcaggggggccgccgccgtgtgtcactcgtcggcgcacctcagcgcgcgcaccatccagtggatctccgccggagccagcgcagtgctattagttgctaaaggcactgccatacacaaatctttccttgtgccattttttgctcttcaggcaccttgcagcataatctcatggatcaagggtgactatggtcagtggactgcttttcttgctttgttggtgcgtctattcttcttcattccaggtgaactggagcttccgctgtcaacaatgctgcttgtgagtgttgctccttaccaattcatggatctgaggggaactcaaggtggtgccgtactgtcacttgccatagctgcctatctcgccttccagcacttcactagggtgggcggcccaggcaaagccttcgagcagggatccattgttgcgaccttggccatcatctgcatcatgattgtgcccttgatgctgctattctgatttgcattgagttggaatgaatttgcttctcattatgtgcgtatagaaggacaaataaatttaaccttgtaatgcagcatccgagttctctttcccaaaacgtatgcactgatatatccttatgccttgttagtgctcttcggtggttaaacaaaaaaaaaaaaaaaa

SEQ ID NO: 19696 - DNA, 858 bp, Zea mays
  misc_feature (788)..(788): n is a, c, g, or t
  misc_feature (806)..(806): n is a, c, g, or t
  misc_feature (842)..(842): n is a, c, g, or t
cattgggtacctcgagcccggatgacccctcgcgctcccacctactgacccaccccacgccgcctcctctcccagtgggtcctccgcatctcccatctcccgtctcccctcttcctcctcccctgcgatctccaccgcatcacctccctcgaaccctagacccacccacgcgcccattgccttcggtcgccatgtccgccgctcagcttctccgtcactcgcgcaagctgcggagtttgcaaaatcctgtaggttgtgagaattttagttttgttcggcatttctccagcggttctgggtcctttatcgccagggaaaatggtattggaaaaagaaccagaggtaccagattttcccagcataaccagcctgcaaaacagctcgagacattctcagcaggagtaaatggaagctgcacatggagaatagcatccaacagccttaccccaagtgctgctagctggctcagtggttcattctcatgtggacaggtagtctcagcgcggccattctcaagtagtgcagacctgcctccacatcaagaaattgggatgccgtctctttcacctacaatgactgagggaaacattgccaagtggcttaagaaggaaggagacaaggtctccccctggtgaggttctctgcgaagtggaagctgacaaagccactgtggagatggagtgcatgggagagggctatcttgctaagattattcatggagatggtgcgaaggagatttaaagttggtgaggtcattgctataactgtagaagaagagggtgacatcngagagttggaggattatnagccatcatcttcagctgaacctgtagctcctgctngaccaaaggctgaacc

SEQ ID NO: 19697 - DNA, 687 bp, Zea mays
  misc_feature (664)..(667): n is a, c, g, or t
ggacttggtacaattgctgaggaggtgaagcagttggctcaaaaagcaagagacaatagcttaaaaccagcagattatgagggtggcaccttcacgatatcaaacttgggaggtcccttcggaatcaaacaattctgtgccatcataaatcctcctcagtcagcaattttggctattggttctgccgagaagagggtgatacctggttccgccgatggtctgtatgagtttggttcgttcatgtcagccacactgagctgtgaccacagggttatagatggtgcaatcggtgcggaatttctgaaagcattcaagggctacatcgagaacccgacttcgatgctgctgtgaagttaggatcgatgacctaacacaattcttgtcaagttgtttaaataaccaggccacccaaaggtggcgtctccaaagttccaaaccaatagcacagagccgttatgatattcccagtgttaattaggatcaacgtatagaggcctgaagtcatttttgggattgttctcacgggcaattgatgggaataaatatgaaagcagccaacatgggaaataacttttgattttttttctttggaacatcgctatgcgatttaaaaaaatttgtgtaaatctgttgagcttctccacaaaaaaaaaaaaaaatgcgnnnnaaaaaaaaaaaaaaaaaaaa

SEQ ID NO: 19698 - DNA, 2136 bp, Zea mays
tcgagccggccgggtaactccgacgcagcgtaccttgccttgccgggccggccgccccctcgcgcggtcccgccccctcccccccccccccctcctcggccagtgtcctccgcatctcccgtctctcctgttccgcctcccctccgatctccgccgcatcacctccctcgaaccctagacccacccgcgccccccattgcctccggccgccatgtctgccactcagcttctccgtcgctcccgcaagctgcagagtttgcaaaatgctgtaggttgtgagaatttttttctttttcggcatttctccagtggttccggatcctttatcgccaaggaaaatggtgttggaaaaagaaccagaggtaccagattttcccagcaataccagcctacaaaagagcttgaaccattctcactaggagtaaatggaaactgcacttggagaagagcatccaacagccttaccccaagtgctgctagttggctcaatggttcattctcatgtggacaggtagtttcagcacggacattctcaagtagtgcagacctgcctccacatcaagaaattggaatgccttcactttcacctaccatgactgagggaaacattgccaagtggcttaagaaggaaggagataaggtctcccctggcgaggttctctgtgaggtggaaactgataaagcaactgtggagatggagtgcatggaagagggctatcttgctaagattattcatggagatggtgcaaaggagattaaagttggtgaggtcattgctataactgtggaagaagagggtgacattgagaagtttaaggattataagccgtcatcttcagctgaacctgtagctcctgctgaatcaaaggctcaaccagaaccttcacaaccaaaggtggaggaaaaaaagcttacccaggctcctgaggttaaggccccaaagattgaagaagcttctcaatctggagatcgcatatttgccagccctcttgcccgtaaactggctgaagataacaatgtcccactatcaagtgtgaaaggtactggtcctgatgggcgtattttgaaggcagacattgaagattacttggccaagggtgggctgagggaggcttttgcagctccagggttaggttacgttgatattccaaatgcacagataagaaaggttaccgcaaaccgcttgctagcatctaaacagaccattcctcattactacttgacagtagatgcacgtgttgacaaacttgtcaagttgcgaggtgaactgaatccactgcaggatgcttctggtggaaagaaaatatctatcaatgatcttgtcatcaaggctgcagctttggctcttagaaaggtccctcagtgtaacagctcatggatgaatgattttattcgccaatatcacaatgtgaacatcaacgtggctgtgcagactgaacacggattgtttgttccagtaattagggatgcagacaagaagggacttggtacaattgctgaggaggtgaagcagttggctcaaaaagcaagagacaatagcttaaaaccagcagattatgagggtggcaccttcacggtatcaaacttgggaggtcccttcggaatcaaacaattctgtgccatcataaatcctcctcagtcagcaattttggctattggttctgccgagaagagggtgatacctggttccgccgatggtctgtatgagtttggttcgttcatgtcagctacactgagctgtgaccacagggttatagatggtgcaatcggtgcggaatttctgaaagcattcaagggctacatcgagaacccgacttcgatgctgctgtgaagttaggatcgatgacctaacacaattcttgtcaagttgtttaaataaccaggccacccaaaggtggcgtctccaaaccaatagcacagagccgttatgatattcccagtgttaagtaggatcaacgtatagaggcctgaagtcatttttgggattgttctcacgggcaattgatgggaataaatatgaaagcagccaacatgggaaagaactcattgatatatttctttggaacattgctatgcgatttaaaaaatcgtgtaaaaaaaaaaaaaaaatccagaaaaaaaaaaaaaaaagcggcc

SEQ ID NO: 19699 - DNA, 2154 bp, Zea mays
atttcggcacgaggccctaacccggccgcgaatgacgcctcgcgctcccacccactgacccaccccacgccgccgcctctcccagtgggtcctccgcatctcccatctcccatctcccgtctcccctcttcctcctcccctgcgatcttctccaccgcatcacctccctcgaaccctagacccacccacgcgcccattgccttcggtcgccatgtccgccgctcagcttctccgtcactcgcgcaagctgcggagtttgcaaaatgctgtaggttgtgagaattttagttttgttcggcatttctccagcggttctgggtcctttatcgccagggaaaatggtattggaaaaagaaccagaggtaccagattttcccagcataaccagcctgcaaaacagctcgagacattctcagcaggagtaaatggaagctgcacttggagaatagcatccaacagccttaccccaagtgctgctagctggctcagtggttcattctcatgtggacaggtagtctcagcgcggccattctcaagtagtgcagacctgcctccacatcaagaaattgggatgccgtctctttcacctacaatgactgagggaaacattgccaagtggcttaagaaggaaggagacaaggtctcccctggtgaggttctctgcgaagtggaaactgacaaagccactgtggagatggagtgcatggaagagggctatcttgctaagattattcatggagatggtgcgaaggagattaaagttggtgaggtcattgctataactgtagaagaagagggtgacatcgagaagtttaaggattataagccgtcatcttcagctgaacctgtagctcctgctgaaccaaaggctgagccagaaccctcacagccgaaggcggaggaaaaaaagcctacgcaggctcctgaggcgaagaccccgaagattgaagaagcttctcaatctggagatcgcatatttgccagccctcttgcccgtaaattggctgaagataacaatgtcccactatcaagtgtgaaaggtactggtcctgatggccgtattttgaaggcagacattgaagattacttggcttctgtagccaagggtgggttgagggaggcttttgcagatccagggttaggttatgttgatattccaaatgcacagataagaaaggttactgcaaatcgcttgctagcatcgaaacagaccattcctcattactacttgacagtagatgcacgtgttgacaaacttgtccagttgcgaggtgaactgaacccactgcaggatgcttctggtggaaagaaaatatcaattaatgatcttgtcatcaaggctgcagctttggcccttcgaaaggtccctcagtgtaacagctcatggatgaatgattttattcggcaataccacaatgtgaacatcaacgtggctgtacagactgaacatggattgtttgttccagtaattagggatgcagacaagaagggactcggtgcaattgctgaggaggtgaagcagttggctcaaaaagcaagagataatagcctaaaaccagcagattacgagggcggcaccttcactgtatcaaatttgggaggtcccttcggaattaaacaattctgcgccatcataaatcccccccagtcagcaattttggccattggttctgctgagaagagggtgatacctggttccgctgatggtcagtttgaatttggttcattcatgtcagctacactgagctgtgaccacagggttatagatggcgcaatcggtgcggaatttctgaaagcattcaagggatacatcgagaacccaacttcaatgctgctgtgaagttaggatggatgagacctaacacaattttttgtcatgttaaataaccaggccaccaaagagtggcgtctccaaaccaagagcacagagccgtcttctccgttttgatattgccattgttaagtaggatcaacgtatacatgcattattgggggtcatttttgggtttgtcctcacggataattgatggaaataaatatgaaagaagccaatcttggaaaaaaaaaaaaaaaaaaggtcccagaaatgcgtttaaaaaactgcagatccgttgaggctctcgaaaaaaaaaaaaaaaaaaggcccctagggcc

SEQ ID NO: 19700 - DNA, 1085 bp, Zea mays
  misc_feature (459)..(459): n is a, c, g, or t
gccggccggggccggggatactacgtatcaagacggatatgtgtgcagtgccgatcgtctcgtttcgtacttgtatcgctgtctcctctacttttcccccctccctgcatcagagccgctcaccgttcaccggaacacacagcagcgtatcgatggctgtagcgcttacacaacgagcgtgccgtggggatggtgaggcgccttgttgaacaatgggcaccaccttcacgcaacctgaccttcgagtttaaacagaagatgtctgtcctggacaactttgggaagccagccatgacagcggcagacagcacaaacccatggtggacgttgctcgaagaagctgtgaagagcgctgacggcaaactcggcaagccggagatattcccagcctctactgacgctcgctacttccggaaaatcggattaccagcatttggcttttcacctatggcgaacacnccgatactgctccatgaccataacgagtttctgagcaaagacgagtacctcaagggaatcgggatatacgagtccatcatcagggcactggccactcatgaagatggcggcaaagatgacgaatccagggcagagctgtgagcctgtgactgaggagaaccttgaaccttacctcgcttttgccgcagaccaaatggagcactggaagtcatgtttcggcattatgcagctgcctgtgcttctgctgcggcgtcggagcgatagaaccacaaacatcatctttgtacattctcgcaagagggcttatgcgcttaataattgatgaaattgagatatgtagttcgtctgcgcagttcagggctcaccctgttcctacttgatgctgctttggcattggttgttgtatcaaaacttatattcacgtcgcttcgtgcttcattgcttttgtgcctttgttttcatttcatatggtagcatgacagtcgattatgcacaaaatcctcacaggggctcgtttagaaactcattctcttgggatgctctttcatttactagggtgagcaatcccaaagatatcatttgaatctatctatactactattatataggaggtgtttagtttctat

SEQ ID NO: 19701 - DNA, 1949 bp, Zea mays
aaacaaagtggaaaagaaattgggccccgtcacttcatgaccaccctgcattcccatctagccgtcgccactcgccgcggctaacccagctcccagcccccgtctcgtcgccatgggaaccaggaatcttacgcggaaccgcgccgcttccatggcgacggcatccactacgctgctcctctcccttgccttcctcgccttcgcctgggcggcgtcgccgtcgccggatgcggaggcgatctcccggttccaggagtacctccgcatcgacacggcgcagccggcgccagattacgccgcggccgtggccttcctccggaaacaggccgccgaggctggactcgaggcgcgcacgcttgagctcgtcgccgggaagcccctgctgctgctgcggtggcccggtcggcggccgtcgctcccctccatactcctcaactcccacactgacgtggtgccgtcggagccgaacaagtgggaccacccgcccttttccgccgccctcgatgagccatccggtcgcatctacgcgcgaggctcccaggacatgaagtgtgtggggatgcagtaccttgaagccattcgccgtctccgttctgcaggatttgttccagatcgaaatatctatataacatttgttcctgacgaggagattggtgggcatggcggtgttgaaccatttgtttcatccaaggagttcaaagatatgaacgtggcattagtccttgatgaagggcttgcctctccaggggaggagtaccgtgtgttctatgcagagcgtagcccttggtggcttactataaaagcaacgggcgcaccagggcacggtgcgaagttgtatgatggtagtgcaatggagaatttgatgaagagcgtggaggctattaggagattcaggacatcacagtttgatctagtgaaatctggagagaaggctgaaggagatgttgtatcggtgaattttgcgtacctgaaggctggcacacctacaccaacgggttttgtcatgaatcttcaaccatctgaagcagaggtaggtcttgacatccggatccctcctagtgcccatgtggaagcactggagaggcgccttgttgaagaatgggcaccaccttcacgcaacctgaccttcgagtttaaacagaagatgtctgtcctggacaactttgggaagccagccatgacagcggcagacagcacaaacccatggtggacgttgcttgaagaagctgtgaagagcgctgacggcaaactcggcaagccggagatattcccagcctctactgacgctcgctacttccggaaaatcggattaccagcatttggcttttcacctatggcgaacaccccgatactgctccatgaccataacgagtttctgagcaaagacgagtacctcaagggaatcgggatatacgagtccatcatcagggcactggccactcatgaagatggcggcaaagatgacgaatccagggcagagctgtgagcctgtgactgaggagaaccttgaaccttacctcgcttttgccgcagaccaaatggagcactggaagtcatgtttcggcattatgcagctgcttgtgcttctgctgcggcgtcggagcgatagaaccacaaacatcatctttgtacattctcgcaagagggcttatgcgcttaataattgatgaaattgagatatgtagttcgtctgcgcagttcagggctcaccctgttgctacttgatgctgctttggcattggttgttgtatcaaaacttatatttacgttgcttcgtgcttcattgcttttgtgccaaaaaaaaaaaaaaacagcctccccggtcggtcgattatgcacaaaatcctcacaggggctcgtttagaaactcattctcttgggatgctctttcatttactagggtgagcaatcccaaagatatcatttgaatctatctatactactattac

SEQ ID NO: 19702 - DNA, 903 bp, Zea mays
cacgtcacttcataaccaccctgcattcccccccggcggccggcactcgccgctgctaacccagctcccagcccccgtctcatcgccatgggaaccaggaatcttacgcggaaccgccccgcttccatggcggcggcatccactacgctgctcctctcccttgccctcctcgccttcgcctgggcggcgtcgccgtcgccgtcgccggattcggaggcgatctcccggttccaggagtacctccgcatcgacacggcgcagccggcgccagactacgccgcggccgtggccttcctccggaaacaggcctccgaggctggactcgaggctcgcacgcttgagctcgtcgccgggaagcccctgctgctgctgcggtggcccggtcggcggccgtcgctcccctccatactcctcaactcccacactgacgtggtgccgtcggagccgaacaagtgggaccacccgcccttttccgccgccctcgatgagccatccggtcgcatctacgcgcgaggctcccaggacatgaagtgtgtggggatgcagtaccttgaagccattcgccgtctccgttctgcaggatttgttccagatcgaaatatctatataacatttgttcctgacgaggagattggtgggcatggcggtgttgaaccatttgtttcatccaaggagttcgaagatatgaacgtggcattagtccttgatgaagggcttgcctctccaggggaggagtaccgtgtgttctatgcagagcgtagcccttggtggcttactataaaagcaacaggcgcaccagggcacggtgcgaagttgtatgatggtagtgcaatggagaatttgatgaagagcgtggaggctattaggagatcaggacatcacagtttgtctagtgaaatctgg

SEQ ID NO: 19703 - DNA, 1205 bp, Zea mays
  misc_feature (15)..(15): n is a, c, g, or t
  misc_feature (22)..(23): n is a, c, g, or t
  misc_feature (34)..(34): n is a, c, g, or t
ccgtccggtccatgnattacanngctatctcagnaaaacccagcaaatttcaaggtaatatgtgcagtgcaagtattttctgcatttgctactgccgctattgaatgccatttcttcctttttttgtagattgccttttcttctctctgatagtggaatatattgtttcagagcaagttttgcattcttatgacaaatcattttattgctctgatggtttcaacagggaaaggtagtagtgatccgaggagaaggaccaaaaggcgggccagggatgcccgaaatgttgactccaacaagcgcaataatgggtgctggtcttggaaaggagtgcgccctgctgacagatggtagattttctggagggtcacatggatttgttgtcggtcacatatgccctgaagcacaggaaggtggtccaattggccttgtccagagtggtgatataatcaccatcgatgtaagtaagagggtaatcgatgttgaccttaccgaacagcagctcgaagaaaggcggaggaaatggaccccaccgccatacaagtcgaccagtggagctctttggaagtacatcaagcttgtggctccagcgtctagaggatgcgtcactgatgaataggatgtgttacattctgttaggttgtgcacacgatgtgtttgtcaatcaaaagctgttgccaggaacaattgccctgttagagtgattcattgtagtgcggttttgcatgtggcaggtatgacaataaattgccggtttctaagagcttagcaatgctgcagaaactgctgaataatcgagtgtaatcgtggtccgtgagcaatcacatctttgtcagtttcccttaaaaaaaaaaaaaaaaaaaaaaaaaaaaaggggaaaaaaaaaaaaaaaaaaaaaaagtgcctctggcgcgacacccctctgggggagttttgtggatatatatatcactgtggggggctctagaatatgtatataggggccccaattccctctatagagaggcgtttcacaatactgtgcgcggttttcacaacggtgagtgtgaaaaaactgtggtgtcccaaattttaatcgttttggaacatatccctttttccacatgtggtattatagaaaagagccccacacatatcgcttttcaaaagatttgcacactctatatggaaagtgcacgccctctgtagcggcattttaagcgcgg

SEQ ID NO: 19704 - DNA, 2379 bp, Zea mays
cctcgaggcctgccgggaaaaaagcccccagcccagctccacttgtccctgtccatccattcatcattccccgtcactccaccaattcaccacccaaaaccctaaaccccattccgtacctcaacgccgccgccgccgccgccgccgctgcgatgcagtccatggcgctcacctccccctcactcccggaggtcggccccgtttccggccgccgtctccagcgcatccgtgccaccgcggtatccgacgagctcaagctgaacaagtacagcgcgcgcatcacggagcccaagtcgcagggcgcctcgcaggccgtgctctatggggtcgggctcactgacgctgacctccgcaagccgcaggtcggcgtctcgtcggtgtggtacgaggggaacacctgcaacatgcacctgctccgcctcgcggaggccgtccgtgacggcgtccgcgaggccggcatggtcggcttccggtttaacaccgtcggtgtcagcgacgccatttccatgggcacccggggcatgtgctacagcctccagtcccgtgacctcatcgctgacagcatcgagaccgtcatgggagcgcagcactacgacgccaacatttccatacctgggtgcgacaagaacatgccaggtacaataatggcaatgggacggcttaatcgacctagcataatgatatatggtggaactattaagcctggtcactttcagggcaattcctatgatatagtatctgctttccagtgctatggagaatatgttagtggttcaatcactgatgagcaaagaaagaacgtcctccgcaattcatgtccaggagcaggtgcctgtggtggtatgtacacagcaaacactatggcatctgctatcgaaactttgggcatgagtcttccatacagttcttcgacacctgctgaggacccactaaaactagaagagtgccgtcttgctgggaagtatcttttagagttgctaaagatggatttgaagcctaaggacattatcactgagaagtcattgcgaaatgcaatggttattgttatggcacttggtggttcgactaatgctgttctgcatttgattgccattgctcggtccgttggtttgcatttgactcttgatgatttccagaaggtcagtgaccaagttcctttccttgcagacctcaagcccagtggcaaatatgtcatggaggatctacataagattggtgggacacctgcagtcattcattaccttttggagcaaggtcttcttgatggtgattgcatgactgttactgggaaaactctagctgagaatgctaaaatcttccctcctctgtctgaagggcagcaaataattcgaccacttgacaatcctatcaaaccaactggccatattcaaatactttatggaaatcttgcaccggaaggttctgtcgcaaaaataactggcaaagagggactgttcttctcaggtcccgcattagtttttgagggtgaagaatccatgatcacagctatctcagaaaacccagcgaatttcaagggaaaggtagtagtaatccgaggagaaggaccaaaaggagggccagggatgcctgaaatgttgactccaacaagcgcaataatgggtgctggtctcggaaaggagtgcgccctgctgacagatggtagattttcaggaggctcacatggatttgttgtcggccacatatgccctgaagcacaggaaggtggcccaattggccttgtccatagtggtgatgtaatcaccatcgatgtaagtaagagggtaatcgacgttgaccttaccgagcagcagctcgaagaaagacggaggaaatggaccccaccgccatacaagtccacctgtggagctctttggaagtacatcaagcttgtggctccagcgtctagaggatgcgtcactgatgagtaggatgtgttacattctgttaggttgtgcacatgatgtgtttgtcaatcaaaagctgttgccaggaacaatttccctgttagagtgattcattgtagttcggttttgcatgtggcaggtatgacaataaattgccggtttctaagagcttagcaatgctgcagaaactgctgaataatcgagtgtaatcggggtccgtgagcaatcacatctttgtcagtctcccttgttttgtttgtctcattgtttgtagtaccttgttcaaagagatgataatgtcgattattctttggtcctcctgtaaccacttagcgtctggtgtgtttaaggtagtgttcggttccggagtatagtgggctgaagccgtttcattcctaatttgttattgtttagattgatttcagatagaacagaacagaaaattatgtttaaacgttgaaccattcagttctcc

SEQ ID NO: 19705 - DNA, 2274 bp, Zea mays
cattgggtacctccaggccggcccgcgccggcccagttctcaacccggctgtgctgtctcgtcgccttcctcccctcctgccggctgctgccgccgccagccgctgcaggcacgcttgccctctgctccctgtccatccactcatcattccccgtcatccaccaattcacaacccaaaaccctaaacccatttacctcaacgccaccgccgccgccgcgatgcagtccatggcgcccacctctccctcactcccggtggcaggccccgttccccgccgccgcctccagcgcgtccgcgccgccgcggtctccgacgagcccaaactcaacaagtacagcgcgcgcatcacggagcccaagtcgcagggcgcctcgcaggccgtgctctacggggttggcctcaccgacgccgacctccgcaagccgcaggtcggcgtctcttcggtgtggtacgaagggaacacctgcaacatgcacctgctccgcctcgccgaggccgtccgcgacggcgtccgtgaggccggcatggtcggcttccgattcaacaccgtcggtgtcagcgacgccatctccatgggcacccggggcatgtgctacagcctccagtcccgcgacctcatcgccgacagcatcgagaccgtcatgggcgcgcaacactacgacgccaacatctccatacctgggtgcgacaagaacatgccaggtacaataatggcaatgggacggcttaatcgacctagtatcatgatatatggtggaactattaagcctggtcactttcagggcaattcctacgatatagtttctgctttccagtgctatggagaatatgttagtggttcaatcactgatgagcaaagaaagaatgtgctccgcaattcatgtccaggggcaggtgcctgtggtggtatgtacacagcaaacactatggcatctgctattgagacattgggcatgagccttccatacagttcttcgacacctgctgaagacccgctaaagctagaagagtgccgtcttgctgggaagtatcttctagagttgctaaagatggatttgaagcccaaggacattataactgagaagtcattgcgaaatgcaatggttatcgttatggcacttggtggttcgactaatgctgttctgcatttgattgccattgctcggtccgtaggtctgcatttgactcttgatgatttccagaaggttagtgaccaagttcctttccttgcagacctcaagcccagtggcaaatatgtcatggaagatctacataagattggtgggacaccagcagggtaacaacgcagagtacgcgggggtcttcttgatggtgattgcatgactgttactgcaaaaactctagctgagaatgccaaaattttccctcctttgtctgaagggcagcaaataattcgaccacttgacaatcctatcaaaccaactggccatattcaaatactttatggcaatcttgcaccagaaggttctgtagcaaaaataactggcaaagagggactatacttctcaggtcctgcattagtttttgagggtgaagagtccatgattacagctatctcagaaaacccagcaaatttcaagggaaaggtagtagtgatccgaggagaaggaccaaaaggcgggccagggatgcccgaaatgttgactccaacaagcgcaataatgggtgctggtcttggaaaggagtgcgccctgctgacagatggtagattttctggagggtcacatggatttgttgtcggtcacatatgccctgaagcacaggaaggtggtccaattggccttgtccagagtggtgatataatcaccatcgatgtaagtaagagggtaatcgatgttgaccttaccgaacagcagctcgaagaaaggcggaggaaatggaccccaccgccatacaagtcgaccagtggagctctttggaagtacatcaagcttgtggctccagcgtccagaggatgcgtcactgatgagtaggctgtgttacattctgttaggttgtgcacatgatgtgttttcaatcaaaggctgtttgccaggaacaaccatcctgttagagtgattcatgatagtgcggtttgcgtatggcaggtataataataaaatgccggtttctattagcttagcaatgctacagaagctgctgaataatcgagcgtaatatgtctgtttaagcttgtgagcaatcacatccttttcagtcacaaaaaaaaaaaaaaaaaaaaaaaaaaagtactctgcgttgttaccactgct

SEQ ID NO: 19706 - DNA, 1205 bp, Zea mays
ttcggcatgagagagaggagagaggtcccatagttcccccccccccccccccgggataaaaagtagtactcgtgtcttactcgtgccagccactcgcatttctccagattttattatccttcctcgaaacaagagcttagctaagatgacgaagaactacccaaccgtgagcgaagattacaagaaggctgttgagaagtgcaggaggaagctcagaggtttgatcgctgagaagaactgtgcacccatcatggtccgactcgcatggcactctgctggaactttcgattgtcaatcaaggactggaggtccattcggaacaatgaggtttgacgctgagcaagctcatggagccaacagtggtatccacattgctcttaggttgttggaccccatcagggagcaattccctaccatctcttttgctgatttccatcagcttgctggtgttgtggccgttgaagttactggtggccctgacattcctttccaccctggaagagaggacaagccccaaccacctccagagggtcgtcttcctgatgctaccaagggttgtgaccatttgagagatgtctttgctaagcagatgggcttatctgacaaagacattgtcgctttatctggtgcccacactctgggacgatgccacaaggataggtctggcttcgaaggtgcatggacatcaaaccctctaatcttcgacaactcttacttcaaggaactcttgagcggagagaaggaaggccttcttcagcttgtctctgacaaagcactattggacgaccctgttttccgtcctttggtcgagaaatacgctgctgatgaagatgcctttttcgctgattacgctgaggcccacatgaagctttctgagcttgggtttgctgatgcttaagctgtgacgtatgctctgtgtgtgtgtgtgtgtctccccgagagtcatggctgtttttggttgggggctggaggggtcgcattgcatttgaactttgtcatatgattgcttaatgtactctcggatttacgtatctgtttttttcggtgggttgtgatttgaacacatccgttgcgcttttgctgcttagacacattaataaaattaatttctctcgaaaaaaaaaaaaaaaaaaaactcgagggggggcccggtacccaatcggtttaaacacaataaagttggaactggaggggggaaaggagtt

SEQ ID NO: 19707 - DNA, 1712 bp, Zea mays
cattgggtacctcgagccggccggccggagatttggattgtcacgtaattcgtttccctgtcctccccctctcgctgagctgagcccacctactccctcccaccacttgcattcacacactcgattccgctgctctctccctcttcctctcccccgcggcggagccataaaccctaggcctcgccgtcgtcggaggcgccgccgcgatgtcgcactttggaaggacgggtccgccggacatccgcgacaccttctcgctgctcgtcctcaacatcagcttccgaaccacggccgacgaccttttcccgctcttcgagcgctgcggcaaggtcgtcgacgtcttcatcccgagggaccgcaggaccggggactcgaggggttttgcgttcgtgcggtacaagtacgccgacgaggcgcagaaggctatagatcggctcgatggccgtaatgtggatgggaggaacatcatggtgcagtttgcaaagtacggccccaatgctgtgccaatccacaaaggaagggtcaaagagggggttgagaaatcaagagacaggtcaaggagccgtagtccaaggccaaggcacagagacagagatgatagaaggcgaagtcgcagcaggagcaggagcagagaaaggcatgtccatgatagagatagggactatcgtcgtcggagcagaagtagaagccgaagtatgagttcaagccctgaccacaaaagtcatcgtagagcaagagatgatgttaagcgcaagagcagaagcaagagtagaagcaggagcaggagtagaagccgctcataccacagttcttcacctgcccggcgcagtgctagccctcccaagagcccaccgccacagaggagccccactcctgaaaagcatgccaatggaaaagattcacctctgtcacgcagtgtatctccatcaccgaagcgtgcaagctcccgcagcccaggcagcgatagcaaggaataaagcttgttgatctggtgatgcttaaagagcagtcttcccatgggattgcagaacgttgagaaggctgtttgaacatgatggcagtagcaatctgcaatcaaccgctatccaaggttgctagttgttcttttaatgacttctagaattgtgttttccagttgtcaaaatatgctgttggtttgtatttcgacctctattgtcttttaatacccttgtactgcatcatctactttatgtgcatccgtttcttgactccatattaatttgttaaaacatttgtgcattttctagttaaaaaaaaaaaaaaaaaattgctgtttaccgggagaatggtattgctcgggaccgactatggtggatgatgtcttgctgttagtctttgtcattggtgttgatatggggatgacacagctgatgatgtgacggtgctgatattgtatcgatattgatgctgatgctgcttacagtgaccatcttgatgcagtctatatttttgttcaagaggttctgaatcaaatcatgaaattccagatggatctcatgattggtaagaaaacttgtacaataatgccttacatgctatgttggttcttacccctaccctactttggcaaatgctttgcatcagttctagttggaacaaggtgcagactggcagagatgctgaggggtgtgtgtactcatagtaacaatggtactcgtcgtcgtcgtaatatggctaataatctctacggg

SEQ ID NO: 19708 - DNA, 1221 bp, Zea mays
ggctagtggataagctaagctctccctctcgctgagctggctgttgctcttccccaaccccgcgcgcgggggagcgataaaccctagtcttcgccgtcgtcgcaggaggacccgcgatgtcgcacttcgggaggtcaggcccgccggacatccgcgacaccttctcgctcctcgtcctcaacatcagcttccgcaccacggccgacgacctcttcccgctcttcgagcgctacggcaaggtcgtcgacgtcttcatcccgagggacaggaggaccggggactcgaggggtttcgcgttcgtgcggtacaagtacgccgacgaggcgcagaaggctatagatcggctcgatggccgtgatgtggatgggagaaacatcatggtgcagtttgcaaagtacggccccaatgctgagccaatccgcaaaggaagggttaaagagggggttgagaaatcacaagacagatcaagaagccgcagtccaaggccaaggcacagagatagagatcatagaagccaaagtcgcagcaggagcagagaaaggcatgtccgtgatagagacaggggctatcgtcgtcggagcagaagtagaagccgaagtcttagttcaagccctgacaacagaagtcatcatagagcaagagatgatgataagcgcaagagcatgagtaagagcaggagcaggagcacaagtagaagccgctcatactatagtgcttcacctgcccggcacagtgctagccctcgcaagagcccaccgccacagaggagccccactcctgcaaagcatgccaatggaaaagattcacctctgtcacgctgtgtttctccattaccgaagcgtgcaacctcccgcagcccaggcagtgatggcaaggagtaaagcttgctgatttggtgatgcctagaaaacagccttctcacggagtcacgggattgcagaaccttgagaaggttgattgagcacaatggaagtagcagtctgcaatcaaccgcgatccaaggttgctagttcttttaatggcttatagaattgtgttttccagttgtcaaaaatatgcgctggtttgtatttttggcatatactgtgtttttatacccttgcactgcatcatcatctactttatatatgcatcagtttctcgaaaccatcatattaatttgttaaaacatttgtgcatattctagttatctggtcgcgagctccgctgctgtttactggt

SEQ ID NO: 19709 - DNA, 838 bp, Zea mays
gtggatgggagaaactcatggtgcagtttgcaaagtacggccccaatgctgagccaatccgcaaaggaagggttaaagagggggttgagaaatcacaagacagatcaagaagccgcagtccaaggccaaggcacagagacagagatcatagaagccaaagtcgcagcaggagcagagaaaggcatgtccgtgatagagacaggggctatcgtcgtcggagcagaagtagaagccgaagtcttagttcaagccctgacaacagaagtcatcatagagcaagagatgatgataggcgcaagagcatgagtaagagcaggagcaggagcacaagtagaagccgctcatactatagtgcttcacctgcccggcacagtgctagccctcgcaagagcccaccgccacagaggagccccactcctgcaaagcatgccaatggaaaagattcacctctgtcacgctgtgtttctccattaccgaagcgtgcaacctcccgcagcccaggcagtgatggcaaggcaattcacgtcaggagtaaagcttgctgatttggtgatgcctagaaaacagccttctcacggagtcacgggattgcagaaccttgagaaggttgattgagcacaatggaagtagcagtctgcaatcaaccgcgatccaaggttgctagttcttttaatggcttatagaattgtgttttccagttgtcaaaaatatgcgctggtttgtatttttggcatatactgtgtttttatacccttgcactgcatcatctactttatatatgcatcagtttctcgaaaccatcatattaatttgttaaaacatttgtgcgaaagcggcc

SEQ ID NO: 19710 - DNA, 2719 bp, Zea mays
cacttgcacacgcggccgccccccctccgccccaggggctagtggataagctaagctctccctctcgctgagctggctgttgctcttccccaaccccgcgcgcgggggagcgataaaccctagtcttcgccgtcgtcgcaggaggacccgcgatgtcgcacttcgggaggtcaggcccgccggacatccgcgacaccttctcgctcctcgtcctcaacatcagcttccgcaccacggccgacgacctcttcccgctcttcgagcgctacggcaaggtcgtcgacgtcttcatcccgagggacaggaggaccggggactcgaggggtttcgcgttcgtgcggtacaagtacgccgacgaggcgcagaaggctatagatcggctcgatggccgtgatgtggatgggagaaacatcatggtgcagtttgcaaagtacggccccaatgctgagccaatccgcaaaggaagggttaaagagggggttgagaaatcacaaggacagatcaagaagccgtcagtcccaggccaaggcacagagatagagatcatagaagccaaagtcgcagcaggagcagagaaaggcatgtccgtgatagagacagggggctatcgtcgtcggagcagaagtagaagccaaagtcttagttcaagccctgacaacagaagtcatcatagagcaagagatgatgataggcgcaagagcatgagtaagagcaggagcaggagcacaagtagaagccgctcatactatagtgcttcacctgcccggcacagtgctagccctcgcaagagcccaccgccacagaggagccccactcctgcaaagcatgccaatggaaaagattcacctctgtcacgctgtgtttctccattaccgaagcgtgcaacctcccgcagcccaggcagtgatggcaaggagtaaagcttgctgatttggtgatgcctagaaaacagccttctcacggagtcacgggattgcagaaccttgagaaggttgattgagcacaatggaagtagcagtctgcaatcaaccgcgatccaagttatctgttcgtgagatgggtctgctgtcttccgcggcccgagaacggtattgcacgggaccaactatggtggatgatgtcttgctgtcattggtgttgatatggcaatggtgcagctgatgtgacgatgcagatgccgatgctgctgacagtgaccatcttgtttgcacaatgatcccttacaagttatgttggttcttatccccccttctcgcagatgcttttgcatcagtgctagttggaacatggtgttgaggggttaattatgacgggcatgggtcctgtttatcatgtggtggtgttgagtgactccttttgctatctgtggccctagctttattcattattgtaagcaaccattaataaaatccatgaactcaattattaatttgttagccgaaacgctatatacaggtgacgttgtagtcgtaagcatgtagcaatgtattgactttttggtgattgaattgatagttttttgaaacaatcgattgaattgaatgtcgcttgaactccaagagactgtttccactgaagttgtttactttttggtggcacacgagagtttagcaaacaaaccttgcaaacgtttcatggactgggcgtgccaccaatgagtaaagagaacgcaaaaaacagcagtcacgctgactcagctccaccaatgagtaaagagaacgcaaaaaacagcagtcacgctgactcaggtatgtagtagctccgatgtgcacatcactggctaattaattatcaatgtttggccttcaaaagatgcttagttaggagtatgaactctacagacgagcctaataatttttaatgttggccaaaattacctttgttttgcctaaagatagaataatctagttacctagtaggatatatatgtgctgctcctccaaatttgaggcatgcatatgttttgaaggaaaagggcagagaagagaagagaagttgggtacaacacgggaggaagaacatgctgcatgcgtacgtgtatatccaatcagcaaatggcaggaagagaaagcaaagaagaagaagaagaggaagggacatgctgcgtgcgtacccgtccatagcgaccggtggggtcagtctcgacgtatccgttggcgttgtctcccgccgccgccctatccagccgatcgccggaccgcccccgcaccgccgtgccgccgacatggtggtcgtcgatcggctcgagacgacggagctttatttccttcccttaattagctttcttggtttgggtgtaccgcagctaaggctaataagctagctagcagcagttgtattgatgagttgcagcagctgacactgacagacggcggagagagaactcaactaactaactaacctagctatgtgtggatggagcaaattggtagaagtggagggagtaagagctgttggcggcagcaggcagacaggcctgctgtgtctgtgtctctgtgtgtgctagagggcgccggcggcgaggaggaggaggttgtgggtgtcgtcgtcgtcgtaggcggagacgcggaagaggagccagctgaggcaggagaagtccgtgccggcacgcggctccatggacgtggacgacggcgccccggaggagcagagggcgtgcgcgtggtgcgcggcgccgaggccgcagcggcaggggcagggccgtgcactccccggccgg

SEQ ID NO: 19711 - DNA, 743 bp, Zea mays
tcaacccagcttcagctggtggattcatggtagcatttgccggcaggaagtatgcagctagatctctgccgatatttgtatccaacacctcagtcacagtgtccagcttcacactggtacttgagttcaacaaaggcagactccaaaacttgcactggaagaaggacggctgtggcgcttgctccggcaagtcgaacttcgtctgcctgggcaaacagacatgcgccatcaggacgcagagctgcaagagccaagggcccgtcgactgcagcgttggcatccagctggctttctctggcacggacaagcacgagtcggttctgaactcgtggtacgaggtgtccaacctgaggcagtactccctctatgggctctactccaacctcaaggacaccctgagcggccagttcaacaagatcttctaggctgttttggcaacctcaaggacaccctgagcgtccagttcaacaagatcttctaggctgttttggtgctgccattgtttattctctcctgctcccatcccgatctttcttaatcctgttttggtgcttgtatccagaccagttttaaccctgtctcagctctaccgtatgtaccattgcccgttggtgtcgttttagtgcctaacaatatttatgaattttgtgatgagcaagcgaccgtcctgccgggcccctttgtttgcttccaaaggacacgggcttatcgacgcttgttaaaaaaaaaaaaaaaagcgggcc

SEQ ID NO: 19712 - DNA, 1959 bp, Zea mays
tcttcaacgtaacagcagcaaacttccgaagcccccccgtcgccaaacctcagctccaaataactctaccgctgacgctcacgagctctccgctcaacagaaacggcggtggttactggaagccagcttgaccggttcggttgccaccaacgcgacccgcaaaatctcgtcgccgaccgccatggcagccgccgacgcgtcgcgtacgctgcttgctgcagtatctctcgccttagctgcctgctgcctcgcgcagctggcggcgggggacacgaacggcgtctacgagccgtgcagcgacgcacggatccagcgcggggacggcttcaccttcggggtcgtcttcgcgggatacaacgccttcttttccggcaacacacagctctccccctgcgaccgccgcctcaacctcgctgcctccgggcagctcgccgtcttccgccccaaggtcgatgagatctctctcctcaccatcaacaccaccactggattcaacccagcttcagctggtggatttatggtagcatttgctggtaggaagtatgcagctagatctactccgatattcgtatccaacacctcagttacagtgtccagcttcaccctggtgctcgagttcaacaaaggcagacttcaaaacctgcactggaagaaggacggctgcggtgcctgctccggcaaatcaaacttcgtctgccttggcaaacagacatgcgccatccggacgcagagctgcaagagccaagggcctgtcgactgcagcgtcggcatccagctggctttctccggcacggacaagcacgagtcggttctgaactcgtggtacgaggtgtccaacctgaggcagtactccctctacgggctctactcaaacctcaagggcaccctgagcggccagttcaacaagatcttctaggctgttttggcgctgccattgtttattctcccccctgctctctttctgtcggctgctccggttcctcatgttgtgcttgattcacattcttttagttgccgcccgcccaggttgcttgtatccagattccagacctgttataacgctgtctgagctctaccgtatgtaccgttggtgtcattttagcgccctttttttcgtcaccacttgcgcgcggcctttagttttgtgatgagctgtctgctgtcctgctgatgactgttgtgtttggcccaaaggaagcgtcatattgccctgtctgctgcagagctgtgcagagttgcttggtcctcgtgataccgacagcatgtatacctatcatcgacccctcaagggttctgaaagtgtcatactatcgtccggctgttgagctagtccagattcccacttggttttgcaacttttttttttcctttcaattttgcccagacttgctgagtagctttcatctttcttgcaattgcgtatttgagggccacctggaatagggatttcgtggggatcgtatatgaatagtccagaaaatttcctgtgttacaggcagggtcccttctatctgggattctgagtatacaaggaaaatgtcatttctgagggccagtttggaacacaaatttcacaggattcgtacaagaatttcatacaaaaactcatccattccttgcttctatctgagtttacaaggaaatcccttgttctaagaacatgtctgaatacaattacgctgccccgtttgaaaccaaaagctcttgtagaaattacagtctcatgcaaaaaccaggagtcaatcatatgcgaaggaaacatgaatattggcgacgcgagaaacggggtagattctgaagggagcgaaagcgagctgtctcccctttggcaacagatcgtggaagcaacaaaaaaaaaaaaaaaacaaaccatggcgatgggatgacagacagagatggaaaaggacggagagacgctcagctggtgaaactgaatattctcgccgcaatatacaatgc

SEQ ID NO: 19713 - DNA, 1122 bp, Zea mays
gcacggcacgagaccattacctagaacatcctaatcgacagtctcctctcttgagaaactgcggtcgttcttcactggagccagcttggtcggttcgtttaccaccaaagcgccccgcaaaatctcgccgccgaccgccatggcagccgccgaggcgacgcgtccgctgctcgttgctatatctctcgccgtagccgcctgctgcctcgcgcagctggcggtgggggacacgaacggcgtctacgagccgtgcagtgacgcacggatccagcgcggggacggcttcaccttcggggtggtcttcgcgggatacaacgccttcttctccggcaacacacagctctccccctgcgaccgccgcctcaacctcgctgcctccgggcagctcgccgtcttccgccccaaggtcgacgagatctccctcctcaccatcaacaccactaccggattcaacccagcttcagctggtggattcatggtagcatttgccggcaggaagtatgcagctagatctattccgatatttgtatccaacacctcagtcacagtgtccagcttcacactggtacttgagttcaacaaaggcagactccaaaacttgcactggaagaaggacggctgtggcgcttgctccggcaagtcgaacttcgtctgcctcggcaaacagacatgcgccatcaggacgcagagctgcaagagccaagggcccgtcgactgcagcgtcggcatccagctggctttctctggcacggacaagcacgagtcggttctgaactcgtggtacgaggtgtccaacctgaggcagtactccctctacgggctctactccaacctcaaggacaccctgagcggccagttcaacaagatcttctaggctgctttggtgctgccattgtttattctctcctgctcccatcccgatcattcttaatcctgatgttgtgcgtaacattattttggtttgccgtccgggttgcctgtatccagaccagttttaaccctgtctcagctctaccgtatgtaccattgcctgatggtgtcgttttagtgcctaacaagatttatgaattttgtgatgagctaaaaaaagtcaaaacgaaaaaaaaaaaaaaaaaagcggcc

SEQ ID NO: 19714 - DNA, 1882 bp, Zea mays
catcagagcgaaagttattttgaatgagcctccaaaatagtttcaattcctttttttattgaaaaatagttttagataacttctcttacaacccatcttggcccacaatttataggttagaaccgtgccaaacatgtcctaaaagaccttatttgatagagaccctccatttaagggcttatccatagtagtgaaaaccatttggacgagcctccaaaatagctccagttccttctttttattggaaaatatctttagatagcttctcttgcttcccatcttgacccacaatttgcagatcagaaccgtgccatacatgtcctaaaataccttatttgatagagatccttcatttaagggcttctcctgaaagccattttggatgatcctctctaattcctttttcttttttttattgaaaaatagctttagatagcttctcttacagcccgtcttggcccatagagacgctcaaaggcccatcgctcagccgaaagtgatgccccaccactttcacctagtcaccttcaacctcagctccaaataactctaccgctgacgctcacgagctctccgctcaacagaaacggcggtggttactggaagccagcttgaccggttcggttgccaccaacgcgacccgcaaaatctcgtcgccgaccgccatggcagccgccgacgcgtcgcgtacgctgcttgctgcagtatctctcgccttagctgcctgctgcctcgcgcagctggcggcgggggacacgaacagcgtctacgagccgtgcagcgacgcacggatccagcgcggggacggcttcaccttcggggtcgtcttcgcgggatacaacgccttcttttccggcaacacacagctctccccctgcgaccgccgcctcaacctcgctgcctccgggcagctcgccgtcttccgccccaaggtcgatgagatctctctcctcaccatcaacaccaccactggattcaacccagcttcagctggtggatttatggtagcatttgctggtaggaagtatgcagctagatctactccgatattcgtatccaacacctcagttacagtgtccagcttcaccctggtgctcgagttcaacaaaggcagacttcaaaacctgcactggaagaaggacggctgcggtgcctgctccggcaaatcaaacttcgtctgccttggcaaacagacatgcgccatccggacgcagagctgcaagagccaagggcctgtcgactgcagcgtcggcatccagctggctttctccggcacggacaagcacgagtcggttctgaactcgtggtacgaggtgtccaacctgaggcagtactccctctacgggctctactcaaacctcaagggcaccctgagcggccagttcaacaagatcttctaggctgttttggcgctgccattgtttattctcccccctgctccctcctcttctttctgtcggttgctccggttcctcatgttgtgcttgcttcacattcttttagttgccgcccgcccaggttgcttgtatccagacctgttttaacgctgtctgaactctaccgttgcccgttggtgtcattttagcgccctttttttggtcacaaaaaaaaaaaaaactttagttttgtgatgagctgtctgctgtcctgctgatgactgttgtgtttggcccaaaggaagcgtcatattgccctgtctgctgcagagctgtgcagagttgcttggtcctcgtgataccccaccgcctgtacctatcatcgaccgctcaaggtttctgaaagtgtcatactatcgtccggctgttgagctagtccagattcccacttggttttgcaacttttttttcctttcaatttcgcccaggctcgctgagtagctttc

SEQ ID NO: 19715 - DNA, 3977 bp, Zea mays
  misc_feature (1325)..(1330): n is a, c, g, or t
aattcggcacgaggcagctggccactaaaccctcgtcttccccttccaagcgaatcccattccctacccttcgccgccgcctacgcaccatcgctcgaaaccctagccccattccccgtctcgctcggaatcccagctacctccagcgccgccgcgactgcaggataggaggccatggacgacgtgtgcgaggggaaggacttctccttcccggagcaggaggagggggtgatcgagctgtgggcgaagctcgacgccttccacgagcagctccggcgcacggagggcggcgaggagttcgtattctacgacggtccccccttcgccacgggcctgccccattacggccacatactcgccggtaccatcaaggacgtggtcacccggcaccagtcgatgcgaggccgccacgtctcgcgacggttcggatgggactgtcacggactccccgtcgagttcgagatcgataaggcgctcggcatcaccaaccggcagcaggtgttcgacctcggcatcggcaagtacaacgagacgtgccgcagcatcgtcaccaagtacgtctccgagtgggaggccatggttacacgcacggggaggtggattgacttcaagaacgactacaaaaccatggacctcaacttcatggagagcgtctggtgggtgtttgcccagctatgggagaaggacctcgtctataggggtttcaaggtcatgccttacagcacaggatgcaaaactgcactgtcaaactttgaggcagcactggactataggactgttcctgacccagcggtgatggtatccttccctattgttggcgatgcggacaatgcagctcttgttgcatggactacaacaccctggacacttccaagtaacctagcgctgtgtgtcaatgccaatcttacatatgcaaaggttaaagacaaatcaaatggagcagtatatgttattgcagaatccaggcttgggcagttaccagttaaggccaaagcttcaggaaagaagcaggcaccttcaaagggaagcaatattgaagctgttcaggatggtttggacaaggaatcatatgagctgttgtcaaagattcctggggtatccttggttggcttaaaatatactcctctatttgactttttcattgaacttcaagggactgcctttagagtgattgcggataactatgtcacggatgatagtggaacgggtgttgttcattgtgctcctgcttttggtgaagacgaccatcgtgtttgccttgctgctgggatatttgagactgctggacttgttgttgctgttgatgacgacggatgttttattgnnnnnntatctgtcggcacggggcgatatgtcaaagaagccgacaaggatatcatcaatgctgttaaggataaaggaagactcattagtaaagggagtattgagcactcttatccattttgttggcgatcgggcactcctcttatttatcgggctgttccaagctggtttgtcaaggttgagaagattaaagaccagttgctggaatgtaacaaggagacttactgggtgcctgactatgttaaggaaaatagatttcacaactggcttgaaggtgctcgtgattgggctgttagcagaagtagattctggggtactccacttccactgtggataagtcaagatggtgaagaaattgttgttatggattctatagagaagcttgaaaaattatctggagtcaaggtcactgatcttcaccgacactatgttgatgatattacaattccctctaagagaggacctgagtttggggtgctcaaacgtgttgatgatgttttcgactgctggttcgagagtgggtcaatgccatatgcctacattcactatccatttgagaatcgggaactatttgaaaagaactttcctggcaattttgtggcagagggtttagatcaaacccgtggatggttctatactctgatggttctctcaacagcactgtttgggaagcctgcatttaagaatcttatatgcaatgggcttgtcttggctgaggatggtaagaaaatgagcaagagtaaaaagaactatcctccacccaaggatctcattgatgagtttggagcggatgctctgcgactatatttggtaaactccccagttgtacgtgcagagtctctacgattcaaacgtactggtgtctttgctgttgtgaaagatgtcttcctcccatggtataacgcgtacagattctttgtccaaaatgcaaagagactggaagtcgagggtcttgcctcattttctccgatggaacaagcggtacttctgaagtcatccaatgtgttggatcactggataaactctgcaactgaaagtctagttagctttgttcaccaggagatggatgcatatcggctttacacggttgtgccgtatttggtaaaatacattgactatcttactaacatatatgtgcgtttgaaccgcaaacggttcaaagggcgtactggagaagaagactgcagaatttctctttcaacactctaccatgttcttgtaacaacttgcgtggtgatggctccatttacaccattctttactgaagttctttatcaaaatttgcggaaggtgtcaagtaattctgaggagagcatccacttttgcaagttcccttccacaactggcgagggaaatggtggttgtgcatccagacaatgacttccttgaagacatcactggcaaactaaaggagtatgtcatggaggaaatcaatgttaagaatgtcactccatgtaatgaccccttgatgtatgcttctctgcgagccgagcctaatttcagcgtgctaggaaaaagacttggaaaagacatgggaaaagtatcaaatgtggtgaagaagatgactcaggagcagatcttagcatttgaaaaaagtggagaggtttcattcttcggccattgcttgaagctagatgatatcaaggttgtccgacaattcaagcgtcctgaaaatgtgtcagagaaggagattgatgctgcaggagatggtgatgttttagtcattttggatctacgaaccgaccagtcattgtttgaagctggagtggctcgagaggttgtgaacaggatccagaaattacgaaagactgctcagcttgaacctgctgatccagttgatgtgtattacgaatctgtgggcaatgacaaaaacactctggaagagatattgaagtcacaggatcagtatattagagacgcacttggctcaccaatcgttccaaaggaaatggcaccaacggatgtcgtagtacttggcgaggaatcgcacaacgtacatgacatgtcatttgtcatatgcatcgcaaggtccaccccaattatttcaccagatcttctttctcatgcctcaggcaacagcaatcatgtcgaggcgttgagagtatatcttctgtcaaaatctctatccagattgaagaaccagttccaaagtggaaatggcgtgattacggtcgactgcatcgaaggttatccactaatcaggttacagctaggaaagcatgtttttctaagtgcaggggatttttatctggctagtcgatcctaatttttgtgtgcagcatcccaattttgactgattcacccatcattttgccgcaatcggcttaaacagcttggttccatttatgcattcagattcacttgttaaaggtgaaaaatcccaatttatgatataccatggtactctccgttctttttttatttgtcgtgtcttcgccccaaaatgaactagccggtgacaaattttttttttattttgtcgtgttttagttcaaaaataattagccggtgacaaatattcgagtaagctataggttcccatacccctagtgaattatgagtagataacatgtatgtttgtaatctcttgggtgtttggtttttgaggattgatgtggtccatcagattttgatgaatgaatgcatttcatttt

SEQ ID NO: 19716 - DNA, 1161 bp, Zea mays
  misc_feature (1137)..(1137): n is a, c, g, or t
tgcatatcggctttcacggttgtgccgtatttggtaaaatacattgactatcttactaacatatatgtgcgtttgaaccgcaaacggttcaaagggcgtactggagaagaagactgcagaatttctctttcaacactctaccatgttcttgtaacaacttgcgtggtgatggctccatttacaccattctttactgaagttctttatcaaaatttgcggaaggtatcaagtaattctgaggagagcatccacttttgcaagttcccttccacaactggcgagagagatgagcgtgttgagcaaagtgtaaggaggatggtgaccataattgatcttgcacgtaatattcgtgagcggcataacaaagctctcaaaacaccactcaaggaaatggtggttgtgcatccagacaatgacttccttgaagacatcactggcaaactaaaggagtatgtcatggaggaaatcaatgttaagaatgtcactccatgtaatgaccccttgatgtatgcttctctgcgagccgagcctaatttcagcgtgctaggaaaaagacttggaaaagacatgggaaaagtatcaaatgtggtgaagaagatgactcaggagcagatcttagcatttgaaaaaagtggagaggtttcattcttcggccattgcttgaagctagatgatatcaaggtcgtccgtcaattcaagcgtcctgaaaatgtgtcagagaaggagattgatgctgcaggagatggtgatgttttagtcattttggatctacgaaccgaccagtcattgtttgaagctggagtggctcgagaggttgtgaacaggatccagaaattacgaaagactgctcagcttgaacctgctgatccagttgatgtgtattacgaatctgtgggcaatgacacaaacactctggaagagatattgaagtcacaggatcagtatatagagacgcacttggctcaccaatcgttccaaaggaaatggcaccaacggatgtcgtagtacttggcgaggaatcgcacaacgtacatgacatgtcatttgtcatatgcatcgcaaggtccaccccaattatttcaccagatcttctttctcatgcctcaggcaacaatcatgtcgaggcgttgagagtanatcttctgtcaaaatctctatcca

SEQ ID NO: 19717 - DNA, 3193 bp, Zea mays
tactgctcctaatcttttatttatttgtttctggcagcgtagcagccccggattatcatatccttttatatatctatgaaaataaatgtagactctactatacagtcgactctgtctgaagccggtagctggactagctgctggagtgtggaggaagactagggaggctgccttcatatagcggctagttgggccggccgggccgccattgcaagccttcccggttacttgttcactaacaaggtcgggacggcatggcccttggagctgcgtaccatcactacctgcagctcgccggcgaccatggcaccgccacacacgcactgctcctcggcgtacttatcttcctcgtcatccgcctagtatccgcaaggcgaaccggcacaacctcagccaacaaacgtaagcagcaacagcggcttccgctcccgccttcgcccccgggcaagctgcccatcatcggccacctccacctcatcggcgccgagacccacatctcgatccgggacctggacgccaagcacgggcgcaacggcctgctgctcctccgcatcggcgccgtgcccaccctgttcgtgtcctcgcccagcgccgccgacgccgtcctgcgcacccaggaccacatcttcgcgtcgcggccgccgtccatggccgccgagatcatccgctacgggccctcggacgtcgcgttcgtgccctacggcgagtactggcggcagggcaggaaactcctcaccacgcacatgctcagcaccaagaaggtgcagtccttccgccatggccgacaggaagaggcaaggacgacgacgaacacgcagatccaactctctctctctctctctcacacacacacgcacctgcacgtacatttttcctccgtttatctatgcaatagaacagaatatactgacgttcactgcaggtgcggctcgtcatggacaagatccgcgcggctgccaccgccgcgcccgccggcggcggtggacctgagcgatctcctgtccgggtacaccaacgacgtggtgtgccgcgcggtgctgggcgcgtcgcaccggaaccaaggccggaacaggctgttcagcgagctgacagagatcaacgtgtccctcctcggcgggttcaacctcgaggactacttccccccgaatatggccatggcggacgtgctcctccggctggtgtccgtcaaggcccggcggctcaaccagaggtggaacgacgtgttcgacgagctcatccaggaacacgtgcagagcaggccctccggcgagagcgaggagagcgaggcggacttcatacacgttctgctctccatacagcaagagtacggcctcactacggacaatctcaaggccatcttggtggtaagtccagctactgtttttactgctttaccgattaccgttttaccatatcaagctacagtgattattattcccctgtttatatactaataatatatgatactaacttaggagatcgatcatctgatatgtgtcattaacaggacatgttcgaggcaggtatagagacatcttacctgacgctagagtacggcatggccgagctcatcaacaacaggcacgtcatggagaagctacagacggaggtgaggacgacgatgcgctcgccggacggcaagaagctggacatgctagcggaggaggacctcggcagcatgccctacctcaaggcgaccatcaaggagacgctgcgcctgcacccgccggcgccgttcctcctcccgcactactccaccgccgactccgagatcgacggctacttcgtcccagccgggacgcgcgtcctcgtcaacgcctgggcgctcgggagggaccgcacgacgtgggagaagccggaggagttcatgccggagcggttcgtgcaggaaccgggcgccgtggacgtccacatgaagggcaaggacctcaggttcatcccgttcggctccggccggaggatctgccccgggatgaacttcggattcgcgaccatggagatcatgctggccaatctcatgtaccattttgattgggaggttccgggctctgcagcaggggtgtccatggacgagtcctttgggctgacgcttcgccggaaggagaagcttctccttgttccaaggattgcttcctgataatcctacatctgtaaaacttgtgtcttgctagctgtaccgggaacaagattaaataatgcaaggaataaagtgactctgttcttcgtcagtaactatatatttgtaggagtcctgatgatgaataatgggatgtcgtgtggtcgtgtgttgcaactagtattattggtgatatttctatgtaaaaagtggtgtagcgatgtatgtaaaatattatatttgtcagatctttttataccaataatatttactccatctgtcccaaaatatcttctttttctggtctacatacaaataaatgataacaaatatagacatacatacatataacattattcataagttaactaatgaatggatgtttattttaaaatgaattatattttgagacgagtggagtggagtatatatgaagcctttgtagaaaaatgttgtccaaaactaatgaaactaaaggagttcccgcaacttgcaatatatagatccactggtatgacgacaaaaaaaaatgttgcactatgtcaatcaattatattgaggttgttagctgcactcgtcacgtgggccttgtggccggccggtttaagaccgtgggcctgctgctaagtaccgtgtagattcatggcctatttatgtccacgtacgtagcgggggtgatgttcaccaattcagtttggcaaagagtttggtgatgcgtaaataagcccatttattgctagcatgatccgataacaataacaataaaaataatatcatctctgcattctttgtacgtagctaaatacatgcatgcaaacgtatgttttgcatcggaccttcgcttgatcggatgacagcagatgatacttgtatattgatgacattaattccgagactgtacaatgtactccttaattacaaactgcatgctaccatatattgtgtctatatactatattgttctgccttggccttaccaaagcttgagtctttttttgttgccatgaacgacgcaagaagaacttcaatttaggggaagagagcctctcactagacaagactgcaaatatttgttgg

SEQ ID NO: 19718 - DNA, 1941 bp, Zea mays
acgtattatcttatccttttatatatctctcgaggccggccgggccgcgactatacagtcgactctgtctgaagccggtagctggactagctgctggagtgtggaggaagactagggaggctgccttcatatagcggctagttggagcccaacgctcgccattgcaagccttcccggttacttgttcactaacaaggtcgggacggcatggcccttggagctgcgtaccatcactacctgcagctcgccggcgaccatggcaccgccacacacgcactgctcctcggcgtacttatcttcctcgtcatccgcctagtatccgcaaggcgaaccggcacaacctcagccaacaaacgtaagcagcaacagcggcttccgctcccgccttcgcccccgggcaagctgcccatcatcggccacctccacctcatcggcgccgagacccacatctcgatccgggacctggacgccaagcacgggcgcaacggcctgctgctcctccgcatcggcgccgtgcccaccctgttcgtgtcctcgcccagcgccgccgacgccgtcctgcgcacccaggaccacatcttcgcgtcgcggccgccgtccatggccgccgagatcatccgctacgggccctcggacgtcgcgttcgtgccctacggcgagtactggcggcagggcaggaaactcctcaccacgcacatgctcagcaccaagaaggtgcagtccttccgccatggccgacaggaagaggtgcggctcgtcatggacaagatccgcgcggctgccaccgccgcgccgccggcggcggtggacctgagcgatctcctgtccgggtacaccaacgacgtggtgtcccgcgcggtgcttggcgcgtcgcaccggaaccaagggcggaacaggctgttcagcgagctgacagagatcaacgtgtccctcctcgccgggttcaacctcgaggactacttccccccgaatatggccatggcggacgtgctcctccggctggtgtccgtcaaggcccggcggctcaaccagaggtggaacgacgtcttcgacgagctcatccaggaacacgtgcagagcaggccctccggcgagagcgaggagagcgaggcggacttcatacacgttctgctctccatacagcaagagtacggcctcactacagacaatctcaaggccatcttggtggacatgttcgaggcaggtatagagacatcttacctgacgctagagtacggcatggccgagctcatcaacaacaggcacgtcatggagaagctacagacggaggtgaggacgacgatgggctcgccggacggcaagaagctggacatgttagcggaggaggacctcggcagcatgccctacctcaaggccaccatcaaggagacgctgcgcctgcacccgcccgcgccgttcctcctcccgcactactccaccgccgactccgagatcgacggctacttcgtccccgccgggacgcgcgtcctcgtccacgcctgggcgctcgggagggaccgcacgacgtgggagaagccggaggagttcatgccggagcggttcgtgcaggaacccggcgcggtggacgtccacatgaagggcaaggacctcaggttcatcccgttcggctccggccggaggatctgccccgggatgaacttcggcttcgcgaccatggaggtcatgctggccaatctcatgtaccattttgattgggaggttccgggctctggagcaggggtgtccatggaggagtcctttgggctgactcttcgccggaaggagaagcttctccttgttccaaggattgcttcctgatcatcctccatccgtaaacttgtgtcttgctagctgtaccgggcagaaataaagaatgcaagaaaaaagtgactcgattctttgtcaaaaaaaaaaaccaaaattttcgcacgcgtcggtcgt

SEQ ID NO: 19719 - DNA, 2271 bp, Zea mays
gaattccgctgccttcatattgcgtccctcgaggccggccgggccggcattgcaagccttcccggttacttgttcactaacaaggtcgggacggcatggcccttggagctgcgtaccatcactacctgcagctcgccggcgaccatggcaccgccacacacgcactgctcctcggcgtacttatcttcctcgtcatccgcctagtatccgcaaggcgaaccggcacaacctcagccaacaaacgtaagcagcaacagcggcttccgctcccgccttcgcccccgggcaagctgcccatcatcggccacctccacctcatcggcgccgagacccacatctcgatccgggacctggacgccaagcacgggcgcaacggcctgctgctcctccgcatcggcgccgtgcccaccctgttcgtgtcctcgcccagcgccgccgacgccgtcctgcgcacccaggaccacatcttcgcgtcgcggccgccgtccatggccgccgagatcatccgctacgggccctcggacgtcgcgttcgtgccctacggcgagtactggcggcagggcaggaaactcctcaccacgcacatgctcagcaccaagaaggtgcagtccttccgccatggccgacaggaagaggtgcggctcgtcatggacaagatccgcgcggctgccaccgccgcgccgccggcggcggtggacctgagcgatctcctgtccgggtacaccaacgacgtggtgtgccgcgcggtgctgggcgcgtcgcaccggaaccaaggccggaacaggctgttcagcgagctgacagagatcaacgtgtccctcctcggcgggttcaacctcgaggactacttccccccgaatatggccatggcggacgtgctcctccggctggtgtccgtcaaggcccggcggctcaaccagaggtggaacgacgtgttcgacgagctcatccaggaacacgtgcagagcaggccctccggcgagagcgaggagagcgaggcggacttcatacacgttctgctctccatacagcaagagtacggcctcactacggacaatctcaaggccatcttggtggacatgttcgaggcaggtatagagacatcttacctgacgctagagtacggcatggccgagctcatcaacaacaggcacgtcatggagaagctacagacggaggtgaggacgacgatgcgctcgccggacggcaagaagctggacatgctagcggaggaggacctcggcagcatgccctacctcaaggcgaccatcaaggagacgctgcgcctgcacccgccggcgccgttcctcctcccgcactactccaccgccgactccgagatcgacggctacttcgtcccagccgggacgcgcgtcctcgtcaacgcctgggcgctcgggagggaccgcacgacgtgggagaagccggaggagttcatgccggagcggttcgtgcaggaaccgggcgccgtggacgtccacatgaagggcaaggacctcaggttcatcccgttcggctccggccggaggatctgccccgggatgaacttcggattcgcgaccatggagatcatgctggccaatctcatgtaccattttgattgggaggttccgggctctgcagcaggggtgtccatggacgagtcctttgggctgacgcttcgccggaaggagaagcttctccttgttccaaggattgcttcctgataatcctacatctgtaaaacttgtgtcttgctagctgtaccgggaacaagattaaataatgcaaggaataaagtgactctgttcttcgtcagtaactatatattgtaggagtcctgatgatgaataatgggatgtcgtgatttgttgcaactagtattattggtgatatttctatgtaaaaagtggtgtagcgatgtatgtaaaatattatatttgtcagatctttttataccaataatatttactccatctgtcccaaaaaaaaaaaaaaaaagggcccaaaaaaaaaaaaaggcccccaaatatagacatacatacatataacattattcataagttaactaatgaatggatgtttattttaaaatgaattatattttgagacgagtggagtggagtatatatgaagcctttgtagaaaaatgttgtccaaaactaatgaaactaaaggagttcccgcaacttgcaatatatagatccactggtatgacgacaaaaaaaaatgttgcactatgtcaatcaattatattgaggttgttagctgcactcctcacgtgggccttgt

SEQ ID NO: 19720 - DNA, 2263 bp, Zea mays
ctcgaggccggccgggattctcgtgtccctctccagactcccaccaccaccaaactgccctcgcggcctcgcccgtcgccccctcgaggccctcgatcacttctctcccgatcctcactcccgtgtcgtgtctagcgccgacggcgttgctaccggagccggccagcggccacgatgcctacaatgcacgcgctccgcctatgcccgctgctctccaccatccgatccacaccaccgcgggccactgccgcagcccgccagggcgcgctcttcgtcgcccgctgctcctccgccgggacgccgtcagccgcccaggcgctcaagatcagttcgatcccgaccaagccagttgaggggcagaagactgggactagtggcctgaggaaaaaggtgaaagtgttccagcaggagaactaccttgctaattggattcaggctctattcaattccttgccccctgaagattatgtgggtgcaacccttgtacttgggggtgatggccggtactttaacaaggaggctgctcagatcatcattaagattgcagctggaaatggagttcagaagatcatagttggcaggaatggtctactgtcaacacctgctgtatctgctgtaattcgtaaaagaaaagccaatggcggctttatcatgagtgcaagccataatccaggtggaccagacaatgactggggtattaagtttaactacagcagtggacagccagcaccggagacgattactgatcaaatttatgggaacacactatcaatttctgaaataaaaacagcagacattcctgatactgatttgtcctctgttggagttgtaagctatggtgatttcgccatagaagtgatagatcctgtttcagattaccttgaactaatggagaatgtgtttgacttccaacttatcaaggatttgctttctcggcctgatttcaggttcatattcgatgcaatgcatgcaattactggtgcttatgcaggacccatttttgttgagaaacttggagctgatccggactgcatattaaatggggtgcctcttgaagattttggaaatggtcatccagatccaaatctaacttacgctaaggagcttgtttttactatgtttggaacccatgcacctgactttggtgcagcaagtgatggtgatggtgatcggaacatgattcttgggaaaaggttctttattaccccatcagactctgttgcaataatcgcagccaatgcacaggcatcaattccttatttccagtttggtacataaggactcgcgagatcaatgccaaccagtggtgctcttgatcgtgttgccgagaaattgaatgttccattctttgagggaaaattgtctatttgtggagaggaaagttttgggactggatctgatcacatcagagagaaggatggcatctgggctgttctggcttggctttccatacttgcacaccggaacaaggataagaaggtcggagagagattagtgtcagttgaagatattgctatggagcactggaaaacctatggcaggaatttcttttctagatacgattatgaggcgtgtgaatcacacagtgcaaaccagatgatggatcaccttagagatgttatggcaaatagcaagcctggagagaaatacggaaattacaccctccaatttgctgatgatttcagctatactgatcctgtagacggtagtacggtatcaaaacaaggacttcgatttgttttcactgatggatctaggattatcttccggctttcgggaaccggatctgctggagctactatccgcctctacatagaacaatttgaatctgatatctcgaagcatagtctcgatgctcaaacagctttgaagcctttaatagacctggctttgtctgtttcgaagctcaaggacttcacaggaagagagaaacctactgtcataacataatatttagatgttgttgtcctcggccataccaactgagcagcatgggccaagaattgaactgatggcaaatatgtatcattaggacaaattccgccagaataagttgttcctcggaagtgttttgagcacctccagcatcttccaaatatatctccaataagatattagtgggataacatatggcagatgttatcaaataatgtaaatatagatcgaacacgagacatgttttacgtggagaactcttgtatgaaaaaaaaatcatggatgctaactcgtgattttcattgtattcataaaaaaaaaaaaaaaa

SEQ ID NO: 19721 - DNA, 2379 bp, Zea mays
  misc_feature (15)..(51): n is a, c, g, or t
  misc_feature (205)..(228): n is a, c, g, or t
  misc_feature (234)..(255): n is a, c, g, or t
  misc_feature (344)..(348): n is a, c, g, or t
  misc_feature (2204)..(2263): n is a, c, g, or t
ccacgcgtccgcacnnnnnnnnnnnnnnnnnnnnnnnnnnnnnnnnnnnnntcacttctctcccgacactctctcactcccgtgtcgtgtctagcgccgacggcgttgctaccggagccggccagcggccacgatgcctacaatgcacgcgcttcgcctatgcccgctgctctccaccatccgatccacaccaccgcgggccacnnnnnnnnnnnnnnnnnnnnnnnncttcgnnnnnnnnnnnnnnnnnnnnnngacgccgtcagccgcccaggcgctcaagatcagttcaatcccgaccaagccagttgaggggcagaagactgggactagtggcctgaggnnnnnggtgggggtattccagcaggagaactaccttgctaattggattcaggctctattcaattccttgccccctgaagattatgtgggtgcaacccttgtacttgggggtgatggccggtactttaacaaggaggctgctcagatcatcattaagattgcagctggaaatggagttcagaagatcatagttggcaggaatggtctactgtcaacacctgctgtatctgctgtaattcgtaaaagaaaagccaatggcggctttatcatgagtgcaagccataatccaggtggaccagacaatgactggggtattaagtttaactacagcagtggacagccagcaccggagacgattactgatcaaatttatggaaacacactatcaatttctgaaataaaaacagcagacattcctgatactgatttgtcctctgttggagttgtaagctatggtgatttcgccatagaagtgatagatcctgtttcagattaccttgaactaatggagaatgtgtttgacttccaacttatcaaggatttgctttctcggcctgatttcaggttcatatttgatgcaatgcatgcaattactggtgcgtatgccggacccatttttgttgagaaacttggagctgatccggactgcatattaaatggggtgcctcttgaagattttggaaatggccatccagatccaaatctaacttacgctaaggagcttgtttttactatgtttggaacccatgcacctgactttggtgcagcaagtgatggtgatggtgatcggaacatgattcttgggaaaaggttctttattaccccatcagactctgttgcaataattgcagccaatgcacagacagcaattccttatttccagtttggtacaaaaggactcgcgagatcaatgccaaccagtggtgctcttgatcgtgttgccgagaaattgaatgttccattctttgaggttccaacaggctggaaattttttggcaacctaatggatgcaggaaaattgtctatttgtggagaggaaagttttgggactggatctgatcacatcagagagaaggatggcatctgggctgttctggcttggctttccatacttgcacaccggaacaaggataagaaggtcggagagagattagtgtcagttgaagatattgctatggagcactggaaaacctacggcaggaatttcttttctagatacgattatgaggcgtgtgaatcacacagtgcaaaccagatgatggatcaccttagagatgttatggcaaatagcaagcctggagagaaatacggagattacaccctccaatttgctgatgatttcagctatactgatcctgtagacggtagtacggtatcaaaacaaggacttcgatttgttttcactgatgggtctaggattatcttccggctttcgggaaccggatctgctggagctactatccgcctctacatagaacaatttgaatctgatatctcgaagcatagtctcgatgctcaaacagctttgaagcctttaatagacctggctttgtctgtttcgaagctcaaggacttcacaggaagagagaaacctactgtcataacataatatttagatgttgttgtcctcggccataccaaccgagcagcatgggccaagaattgaactgatggcaaatatgtatcattaggacaaattccgccagaataagttgttcctcggaagtgttttgagcacctccagcatcttccaaatatatctccaataagatattagtgggataacatatggcagatgttatcaaataatgtaaatatagatcgaacacgagacatgttttacgtggagaactcttgtatgnnnnnnnnnnnnnnnnnnnnnnnnnnnnnnnnnnnnnnnnnnnnnnnnnnnnnnnnnnnnataatatttagatgttgttgtcctcggccataccaactgagcagcatgggccaagaattgaactgatggaaaatatgtatcattaggacaaattccgccagaataagttgttcctc

SEQ ID NO: 19722 - DNA, 4338 bp, Zea mays
  misc_feature (2674)..(2674): n is a, c, g, or t
  misc_feature (2719)..(2719): n is a, c, g, or t
  misc_feature (3650)..(3650): n is a, c, g, or t
tgtagttgcacaagcaactaattattagttggacatcaaatcactaggtcgcgggttcgaaaccgtctttccgtatttgagaaaggtttgtctcggtttatccctttcctagccttcgggcactgggtctgccctttttacttttgacataacttgctattcatatatgagctggtagcatctttgcgtattatatttttagataataaaaccaaacataggcttctgtttgggcatattttctgctcttttctacttctgtgaatatgcactgaccattgtcaaaatattacactgagtgattgaagaatatgcttcaatgattattgagcttgttcattacttgatatatactataacatttttccttatgacatgtgtagttccttataactttgaactaaaatataactcgtaggtaccttcatgaaatatgttctccatccatcatccataagaatttcaagtcgtcaaacattttgctggactcagaattcaatccacacctttcagatgctggacttgcaagcgttattcctgatgctgaattccaggcagcggtcactgtgccggcttccctgtcgagaagactgattgcatagtttacctgaatgaacttcagcacatggagaaactttggtagttaagctattaaaatgaacggtttaatgagtctatataagttcatgtatatatattgtaaaatgatggaaaaccaaaaaaaaaatgtgtcctcttggctatctagggatatatcatctatgcaattcttacctagcctttcagacactgtctcactaactatcttcacaatgttgatcaccaaatgaaacttgtgtaggcagcagaacaaagtgccggatacactgccccagaagttggacatgaccggtcagtacaccctcaagaggtgatgtctacagctttggagttgtcatgcttgaactattgacaggacgtagaccccatttgacaaggtacactcccattcattctgtttttaagctttcttttagttataaatttggtattgatgatcagatatgccactgtttccattacagctctagacccaggtcagagcagtcacttgtgcggtgggcaacaccccagctgcatgacatcgacgcattggacaggatggtcgatcctgcactcaagggtctatacccagccaaatctctatcccgatttgctgatgtccttgccctgtgtgtccaggtagcagttccattcatcatccatgcaggatagccatagcatatccatctaaatagaacctgaacccgatttgctgatgtccttgccctgtgtgtccagcctgaaccagaattcaggccaccaatgtcagaggtggtgcaagcattggttcgacttgtgcagagggccaacatgacgaagaggatgcttgatggggatacttctcggcgaccagatgacctggaccaagatttcatatgacaagctgaactcttgtcagattgtatttatttcgttcgactagcggcccagcagagacataatcacacaagaggaagaaacagaactctgtcagcttcgccagtacataatcacaagtttttcttggtagcaaagttgtgctatatggttgtactgtgtctacaaaatagtaccttgatcttacgctaatggcatattgttataattctttggtaacttatatgcaaatgccccagataaacaaaactatggtgaagtgtgccgaatgttaaaataactgattagtccagtactgctgcatcaactgaaacaagttgcacagtggaaatatttatcttggtccctcaactatccccttgaggcttattttcgaccttgaactttcaacatgactttcagacttcatcggttcttaaactttactcttgggtcagttttatcctaaaactatcaaaataactgttttggtcctcgaactttgcattgttagttcaattttatatgaactatcaaagtaaatttcagacctcaaacttttttttattcaacgagccgctgaaaaaaggttttatgtatgaaaacaacaacttcactgcttgttaggtaaatggataaacaaagcgtcgctgcactcctacggcaaatctccgctccgtctattcctgcacacggggaagcagctgcgtcggctgaaacgattgagcgagcacgacagtggtattgggccgttgggctcaaagaacgagccaaaaaacagggtggggatattttgactcttgatactaaagtatagtgatgacaatggatcggattcagatttggtattacaaatatccactcgcaattatataaatagttgcaactattatccgttatcgatcatatccacaggtagaaatttatatttatgtttgtgtccattgaattttggacggggttcggacattcatcggatatgacaaacataatcaattttcaacaattcaatagcataattaatcaatttttttctcaattcactatcatatataatttaaaatttaataagagaattattatgggcccgcgggctacggctaaaggtactagagcttgaaaagggcagccaccagctgtgttgcggcctataagacttagaaatggcacaaggcatagcgcaggaagccaacgaggctaaaaggggcgaccaaccgtggagaattggaagagttanggtttactctttgctatgtaatatggattagaccaaaaaataaantaaagtcaattttggatatctaacagataacctgtgggtgagaggtaatattctaattcatgctcgtccgactttgactcaaatatgggtttaatacacgggtctaaaaatgtattatactcagcttcatcggatcagatatacaacgaatatccaaatccacgttttaaattgtcatctctaagtatacatggcatgattggttagcagcctaattcgcaataatttacttaatattctttactaaagttaattctataatttagccgactaattttagatgagttgtaaataatctttagttccgtgcccccgcctgcgcgtgcaggctcaccccgacgtgccccctcccctgccctccgcgcgcgatgcccccatggccccacaccgacgcagagctcgcccatgccaccgtgcacgtgccccggcggcgtcgcgatgcccgtgtatccccgccgtcgcgcgcctacgtcagcatgtacctggagcagaagcgatttcgacagcattgccgaggagctcaccgctgtgaaagtgtgttagtcccgtcccctccaggtcctgactctacaattcacttgtgtattcccccgaagcattacgagacagtctgcacggctcctatcaaggtcagcatgtacccaataccctgttttgtttaacttgaccttgggtactattatagcactctagagtttcagttcgagtgttagaccctgcaactgttctctctctattcagaagaatgattgatgatgttggtgccaattttcatcctccaagagtcttaataagtgaagaaggtaccataatgtatcagatataaggttatttttatgtggtttgctactcctgttttagtgctcaatgacactaggacagtcaagtgagctggagaaaacattaaatgtatctaacaagtttccccaanccacattggttgcattgcattagatgctattttccaatttgaactcattgcagttttattgacattttttctctttttattttattttttctgtaggattgtgaattactaaaccttggcgataggccacagaaactaattgtgacagtgccacctatttctatacggccttctgttgttgttggtaatagtagaacaaggtttgctttctgtttcttaagagctactgtgcttatcctcatttttgtttggtgattcagaatagccttgtgatcatgagttgccttacttattgcagcaatgaagacaacatcatggtttgctttttcaggagcttgaagtatggtgatagaaggactactgctcagtatttaaagtgtggatgtatagttgaaaaacatttagaagatggagacgttgtcctctttaatagacaaccgagcttgcttttgtacttgaacacatgcaagtataatgccatggagaacactcagatttgatgagtctgcttgcaacccttacattgctgattttgatggaggtgaaatgaatttgcatgtcccttagacagaggaagttcgcactgaagcgtttatgctcatgggggtagcatttgctttccttctttcttaagttgagcaaactcacttttatgtgctagcacctaacacaaattcgatagctgata

SEQ ID NO: 19723 - DNA, 2518 bp, Zea mays
gcggtccgggcgcggcggctgctgctgctgtccctggcctgctgcagcagcatttggccaggcggacggatcttcgctgctgcggacactgaccccaacgatcttaacgtcctcaacacgctcttcaccagtctgaattctcctgggcagctcacaggttggcaggcgaatgggggtgatccttgtggccagtcatggaagggcattacttgctcaggatcaggggtcactaaaatccaattaccaaacttgtcactcactggaaatttggcctacaacatgaataacttgggttcattagttgagcttgacatgagccaaaataaccttggcggtggaggtcaaatacagtacaatcttcccaatatgaagcttgagaaactcaatcttgcaggaaatcaatttggtggaaatttaccctactcaatttcgacgatgcctaatcttaagtatttaaaccttaatcataaccaactacaaggaaacatcagtgatgtattttccaacctttacagtttgtcagaactggatctgtcctttaattcccttactggtgatctaccacaaagtttcactggattgtcaagcctgaaaaaagtgtatttgcagaacaaccaatttactggtaatatcaatgtcttagccaatctcccccttgaaactttgaatgttgcgaacaaccatttcactggttggattcctagtcagcttaagaagataaacagtctacagactgatggaaattcttggagcacaggaccagcgccacctccacctccatacacagcgccgcctcctcctccaaaccattggaatgctgatggttcatcaagttcatcaagttctggtggaagatctgggataggtggtggaggtgtagcaggaatcattatatcgttgctggttgttggatcagttgttgcatttcttgtgatcaaaagaagaaaacgcaaagctgctatgaaagaacattttgaacagcaccagccattcacttccttcccttcaaatgaagttaaagacatgaagcctgtctacgaggccaccacagtagacatagagtctttggcttcacctgcttcagttaatctgaaaccacctccgaagatagaacgaaacaaatcatttgatgatgacgatgatttttcaaacaagcttgttgcaaagaaaagtaatataacacctataaatgcaactgtttattcagttgcagatctacagatggcaacagatagctttagcttcgacaaccttgttggagagggtacttttggacgtgtttacagggcacaattcaatgatggaaaggttctggcgatcaagaaattagatagtactgtgatgccatttcaatcatctgatgactttgctgaactggtctcgaacatttcaaaattgcaccatccgaatctgaatgagcttgtgggctattgcatggaacatggccagcacttgcttgtgtatgatttccacaggaatggatcacttcatgatctactccacctttcagatgagtacagcaagccacttagctggaacactcgtatcaagatcgcactcggctctgcccgtgcactggagtaccttcatgaaatatgttctccatccatcatccataagaatttcaagtcgtcaaacattttgctggactcagaattcaatccacacctttcagatgctggacttgcaagctttattcctgatgctgaattccaggcagcagaacaaagtgccggatacactgccccagaagtggacatgaccggtcagtacaccctcaagagtgatgtctacagctttggagttgtcatgcttgaactattgacaggacgtagaccatttgacagctctagacccaggtcagagcagtcacttgtgcggtgggcaacaccccagctgcatgacatcgacgcattggacaggatggtcgatcctgcactcaagggtctatacccagccaaatctctatcccgatttgctgatgtccttgccctgtgtgtccagcctgaaccagaattcaggccaccaatgtcagaggtggtgcaagcattggttcgacttgtgcagagggccaacatgacgaagaggatgcttgatggggatacttctcggcgaccagatgacctggaccaagatttcatatgacaagctgaactcttgtcagattgtatttatttcgttcgactagcggcccagcagagacataatcacacaagaggaagaaacagaactctgtcagcttcgccagtacataatcacaagtttttcttggtagcaaagttgtgctatatggttgtactgtgtctacaaaatagtaccttgatcttacgctaatggcatattgttataattctttggtaacttatatgcaaatgccccagataaacaaaactatggtgaagtgtgccgaatgttaaaataactgattagtccagtactgctgcatcaactgaaacaagttgcacagtggaaatatttatcttggtccctcaactaaaaaaaaaaaaaaaaaacaccc

SEQ ID NO: 19724 - DNA, 2393 bp, Zea mays
tcagtcggatttggaggagtcgaataaacaaggaaactcctcccggcccagaaagcacttcacttgcaacagtccccgtcagggagggagcattgctgtgcgggatggcgataaggaagagcggaggcggtggcggggtggggggtgtggcgcggcggctgctgcttctggcctgctgctgcatttggcctggtggacggatcttcactgctgcggacactgaccccaacgatcttaatgtcctcaatacgctcttcaccagtctgaattctcctgggcagctcagagcttggcgggcgaatggcggtgatccttgtggccagtcatggcagggcattacctgctcaggatcaggggtcactaaaatcctattaccaaacttgtcactcgccggaaatctggcctacaacatgaataacttgggttcattagttgagcttgacttgagccaaaataaccttggcggtggaggccaaatacagtacaatcttcccaatgtgaagcttgagaaactcaatcttgcaggaaatcaatttggtggaaatttaccctactcaatttcgacgatgcctaatcttaagtatttaaaccttaatcataaccaactacaaggaaacatcactgatgtattttccaacctttatagtttgtcagagctggatctctcctttaattctcttactggtgatctaccacaaggtttcactggattgtcaagcctgaaaagaatgtatttgcagaacaaccaatttactggttatatcaatgtcttagccaaccttccccttgaaaccctgaatgttggaaacaaccatttcactggttggattcccagtcagcttaaggagataaacaatctacagaccgacggaaattcttggagcacaggaccagcgccacctccacctccatatacagcgcctcctcctccaaaccattggaatggcgcgggtcagaatggtgatggttcatcaagttctggtggaagacctgggataggtggtggaggtgtagcaggaatcattatatcattgctgattgttggatcagttgttgcattttttctaatcaaaagaagaaaacacaaagctattatggaagaacaatttgaacagcatcagccgttcacttccttcccttcaaatgaagttaacgacatgaagcctatctatgagtccaccacagtagacatagagtctttggcttcacctgcttcgattaatctgaaaccacccccgaagatagaacagaacaaatcatttgatgacgatgatgatttttcaaacaagactgctgcaaatagaagtaatataacacctatgaaggcaactgtttattcagttgcagatctacagatggcaacagatagcttcagcttcgataaccttgttggagagggtacttttggacgtgtttacagggcacagttcaatggtggaaaggttctggccatcaagaaattagacattactgtgatgccatttcaatcgtctgatgactttgctgaactggtctcgaacatttcaaaattgcaccatccgaatctgaatgagcttgtaggctattgcatggaacatggccagcacttgcttgtgtatgatttccataggaatggatcgcttcatgatctacgccacctttcagatgagtacagcaaggcacttagctggaactctcgcatcaagttcgcactcggctctgcccgtgcactggagtaccttcatgaaatatgttctccatccatcatccataagaatttcaaggcatcaaatattttgctggactcagaattcaatccacacctttcagatactggacttgcaagcttcattcctggtgctgaattccaggcagcagaacaaagtgccggatacactgccccagaagtggacatgaccggtcagtacaccctcaagagtgatgtttacagctttggagttgtcatgcttgagctactgacaggacgtagaccatttgacagctctagacccaggtcagagcagtcacttgtgcggtgggcagcacctcagctgcatgacatcgatgcattggacagaatggtcgatcctgcactcaagggtctatacccagccaaatctctatcccgatttgctgatgtcctcgccctgtgtgtccagcctgaaccagaattcaggccaccaatgtcagaggtggtgcaagcattggttcgacttgtgcagagggccaacatgacgaagaggatgcttgatggaggagatacttctcgtggaccagatgatcaggaccaatatttcatatgacaagctgaactcgagcttttcagctacctctcagattgtatttatctcgtctcgttccactagcgcccggcagagacataatcacacaagtggaagagacagaactctgtc

SEQ ID NO: 19725 - DNA, 2491 bp, Zea mays
ggaagggcggaacagcggctttaaggggggtgtttagggggagccccggagaagggttgattataaaggggttttagtttttcaagatatgagggaaggggtttttctaaagttcaagtgtacccaaatccagtaagaactttttcagggttttcaaggaaaatattaaaaatagaggttcagggtcctcaattatgacaaaagtcggctcgacatattaggaggggcaatgtgcggctcaaatttccgttcgactattccaccgatgggtagcaaaataggtgagttcaaaaggcttctccagcttttctaatatggagagagccaccgaggtccatatcggcaaacgtagcatgagctgctaatatgatctttctttgttaatatgtcttttcaagcttgttatgactaacataacctagagtctaagctgaatgcaaacttaagttagacgatcatattaccaaaagaaaaatatcttgagttagaagatcagattatcccatgtgagtaagcataaaaacgatatcaatgttcataaatatatcccatgccagttatcccatgcaaaccaaacatacaaaataatagaaggtcaagttctatgctaagattcaccaaaataattggagcacagaaaggatgaattaaaacaagataaccagggtgtaaaaaaattctactatcatggtgtaccttgtccatcattctgaaaacatagaaaaactgattcaatggacgatttatttgatatcaatgcaaaaaaaattcaatctcagtagggataatgatttagtagctccatacaataataaaggcatatataacagacagggaggataaaagactaatccatcaatgcatcagaacatgcagttagcatctccattacttttcctcgcatacctaaaaatatgcaggattagttgaacatctaggcacaattgaatactaggaaatatattctaaactctccctagaattcccaaaaattcttttatgcctccacatatatattgtataggtgccaacctgatcgtgtagataaaggtgatataaacattttcatgaccagttgtttcaggcaatttataatcatggtttcatttagtttaatccagttcggtatatggcacacatggataaaaaacaaaatcatcagagaataactctaatcatgacgttggagtagctaagtgctcaacgcttggtcgatagtggaagcaggcaacagaaagtgtctaaatgtaattcaaactcacgcaatgatatgtaaagcatcatgagacaactgccaattggtagcaaaatgtgccgaaaggctccaacaaatgaggtaagcagaaagggcattcctttgatatgattgctcttgctgcccaatatcagtagggataatgatctagtagctccatacaataataaagacatatataacagacagggaggataaaagactaatccatcaatgcatcagaacatgcagttagcatctccattacttttcctcgcatacctgaagaaacacttcgagcaccctggtccagcacagcgaaatagaatggcattccttcagcacggagaagacagtccacccgccagtgcccaactgcccacccactgtctccagcgaggatgagaactttgagatggtgctcaccacatcaacattcttgtatttcttcgcacatggcgcctccaccatctcatacatgagaagacagtcatgcagcagccctatccagcgaacccccaataatccaaaacgaggggcagcatcgcgaggagtggagaatcgaaacgagggtggacgggatgaagcagacgcacccaccgtcgctggcaccggatctagcgtgggccttcagcacggtgccgtagtcgccgccaccggatctagcgtgggccttcaacacagtgtcgtagtcgccgccaccgctgtcctcttcctccatggcggcactgtcctgccccaagcgacgcttgtccacccccagcagcatcacgcgaagccgattgggcgagaacccattgcccctgttacaacaaagcaagcgaggcacacgcgggcgtgtcgtccacgaccgtcgctaaatcatgtgcagggccatctcgccccgatctcgcccagatctggccgacacagaacacctctgcctccaagcgccgccggagcaaagaaggaaccgatgccctagaagcggtttgtgagcgcccagatgagctcgccgtcatatcgtcggctttgagggacgtgctgccatagtggaggcgggaagaggggttggcggaggcatatgaactcatcggagtaggagcctgcggcggcgtggaacaccatcgtgcgggcgcagatcgcccagatgcggttgcgcagtgcgagacagacggaggtggatggcgaaaaaacggcgacggttgtgtcccggccggccgcgtgggtcccgggcttttaaatgggccaccccggccggcctcgaggtacccaatg

SEQ ID NO: 19726 - DNA, 1686 bp, Zea mays
  misc_feature (15)..(15): n is a, c, g, or t
cattgggtacctcgnagccggccgggcggctcatcccctatcccctcctcccccgctccgcaccaccacccgcccatgccccttcttcctctcctccccgtcatggcttccaccttctcccccacttccgccgcgagggccctcctcccgggctccacctcccgcccactcttcctcgccgcttcagcttcctcagggcgcattcaaccatccaggaagggactggacttccgccgcggccgattcaccgtctgcaatgtcgccgctcccaccgccgccgaacaggaggcgacggcgacggcgtcggccgcgaaggagacccagcgccccgtgtacccgttcgcggccatcgtggggcaggacgagatgaagctctgcctgctgctcaacgtcatcgaccccaagatcggcggcgtcatgatcatgggcgacaggggcacggggaagtccaccaccgtccgctccctcgtcgacctgctcccggacatccgcgtcgtcgtcggcgaccccttcaactccgacccggacgaccccgaggtcatgggccccgaggtccgccagcgggtcctgcagggggacaccggcctccccgtcaccaccgccaagatcaccatggtcgacctgcccctcggcgccaccgaggaccgcgtctgcggcaccattgacatcgagaaggcgctcaccgagggcgtcaaggcgttcgagcccggcctgctcgccaaggccaacaggggcatactgtacgtcgacgaggtcaacctgctggacgaccacctcgtcgacgtgctgctggattccgctgcgtcggggtggaacacggtggagagggagggtatctccatatcccaccctgctcgcttcatcctcatcggctctggtaacccggaggaaggggagctcaggccccagctgctggaccggttcgggatgcacgcgcaggttggtaccgtcagggacgccgagctcagggtgaagatcgtggaggagagggctcgtttcgacagggatccgaagacgttccgtgagtcgtatcatgacgagcaggagaagctccagcagcagatatcatctgcacggagtaaccttggcgctgtgcagattgaccatgacctccgtgtcaagatatccaaggtgtgctctgagttgaacgttgatggactcagaggtgacattgtgactaacagggctgccaaggcgctggctgcgttgaaaggaagggacagcgtcaccgtggaggacattgctactgtcattccaaactgcttgaggcatcggctccgcaaggatccgcttgaatccattgactcgggtttacttgtcattgagaagttttatgaagtctttagctagattgttcttgaggtaaatgttccttagtcacaatttttggcgggaaccctcttgttctgttactttcataatgttctgctgtttaataatatctggagcttgaattggtatcaaaaaaaaaaaaaaaaaaaaaaaaaaaaaaaaaaaatggcttgcgtcccggcagcgccgcaggggccgaacacgaagccggagagcgcgtggcggctgtgcacggtggccgaggtgcagcaggcaaagacgctcctcgccgtgacgcccatcttcgcgtgcaccatcgtcttcaacaccgtgctcgcgcagctgcagacgttctcggtgcagcagggcagcgcc

SEQ ID NO: 19727 - DNA, 2169 bp, Zea mays
caaaatttatgtatggctaggatcacaaatgaattatgaaatatttttcttataacaatataagacacattttgtatataaattatcatgatattatgtgttcccgttgcaacgcacggatattgacctagttgattgaaaaattaggggctctaaaaaaatggagtcatgcgcgggcctggccctaatagtcactaggactagatagatgctgtcatgctgaggacgaaggcaagcatgttgggcacagcgccatagtatcaaactatcattttgagccgtttcgcgtaccctaaaatcagtggcaacagcgccatagcatcgtcaactccatcaagccgttaccatcaacaacgattgcttgctgccgactgccaagcggggccggtcaatccagaagttggcagcctccaatcgcagcatccctccgagatcgctgccccgtccccctcccccggcttatcccctatcccctcctcccccgctccttccacacaaacctccatgccccttcttcctctcctccccgtcatggcttccaccttctcccccacttccgccgcgagggccctcctcccgggctccacctcccgcccactcttcctcgccgcttcagcttcctcaggtaaccgtcatctcacatttccctccccctactcactctgtttcccagctcgctcatcagcgagcgccgaatccaacacccccccttaccgcccccccggtacactcgcagggcgcattcaaccatccaggaagggactggacttccgccgcggccgattcaccgtctgcaatgtcgccgctcccaccgccgccgaacaggtacgcccccgttctccaatcccgcagcccgcaggaaccggtcggtaatccttcctccgcaaccccgcattttcgatgcctgcttctgcttccgcgcgggcgggagcgacggcgtcggccgcggaggagacccagcgccccgtgtacccgttcgcggccatcgtggggcaggacgagatgaagctctgcctgctgctcaacgtcatcgaccccaagatcggcggcgtcatgatcatgggcgacaggggcacggggaagtccaccaccgtccgctccctcgtcgacctgctcccggacatccgcgtcgtcgtcggcgaccccttcaactccgacccggacgaccccgaggtcatgggccccgaggtccgccagcgggtcctgcagggggacaccggcctccccgtcaccaccgccaagatcaccatggtcgacctgcccctcggcgccaccgaggaccgcgtctgcggcaccattgacatcgagaaggcgctcaccgagggcgtcaaggcgttcgagcccggcctgctcgccaaggccaacaggggcatactgtacgtcgacgaggtcaacctgctggacgaccacctcgtcgacgtgctgctggattccgctgcgtcggggtggaacacggtggagagggagggtatctccatatcccaccctgctcgcttcatcctcatcggctctggtaacccggaggaaggggagctcaggccccagctgctggaccggttcgggatgcacgcgcaggttggtaccgtcagggacgccgagctcagggtgaagatcgtggaggagagggctcgtttcgacagggatccgaagacgttccgtgagtcgtatcatgacgagcaggagaagctccagcagcagatatcatctgcacggagtaaccttggcgctgtgcagattgaccatgacctccgtgtcaagatatccaaggtgtgctctgagttgaacgttgatggactcagaggtgacattgtgactaacagggctgccaaggcgctggctgcgttgaaaggaagggacagcgtcaccgtggaggacattgctactgtcattccaaactgcttgaggcatcggctccgcaaggatccgcttgaatccattgactcgggtttacttgtcattgagaagttttatgaagtctttagctagattgttcttgaggtaaatgttccttagtcacaatttttggcgggaaccctcttgttctgttactttcataatgttctgctgtttaataatatctggagcttgaattggtatcaaaaaaaaaaaaaaaaaaaaaaaaaaaaaaaaaaaaaaaaataaaaaaaaaaaaaaaagcatgttatgagc

SEQ ID NO: 19728 - DNA, 794 bp, Zea mays
  misc_feature (2)..(2): n is a, c, g, or t
gnccgcaaatttgccattgaaatgggggattccaagccattttagggcgtttttgctaaaaccatactgacaagttatccaaggaacacaacttgataacgtaaacaccacacatggagatttccaaacttgtcccatgagcagcgacttcccagggggcgataatgaagaaaaggatgcagcagcaatgaaaagaaaactagccatgcaattctgttgcggaaatagacaactttgtgaatacaaaaggttttgctgttgcaaatacaaactaggaactctctaaagatgtagataacgcgacagcttaatcggtatcgtcaacgaccttggtccccagccctttcaagccctcggcggggatctccgcgacggtgacaagggagtagagctcctccttggcatcctcctcgtcgttcctcttgcgggcgatcctcacacgaaccctccgcggcacgctcctgatcccgctgctccagatgtgcttgttgagcttcacatcaatcctaatgtccgtggtgcccatggccttctgcgcaaacttcctgatctccttgatggcgttgggtgccttcttcttgaatgtgcagccgtggaggcgcttgtggaggttgatggtgtactccctggtgaccacctcctccttcctcgacgctcctcccttcccctgcgacatatctcctctgctccgggtgcgggtgggcggattccgctgggtagtgtggtgcggtgttgtgttccgcggcggcgcgagagcccggccggccccgaggctcccaatcgcccttaggagt

SEQ ID NO: 19729 - DNA, 791 bp, Zea mays
ggccctggccgcttttttttttttttttatcattgaaatgggggattccaagccatcacagggcgaagttgctaaaaccatactgacaaattatcaaggaacacaacttgataatgtaaacaccacatgagcagcgacttcccagggggcgataaagaagaaaaggatgtggcagagatgaaaagaaaactagccatgcaattctgttgcagaaatagacaactttgtgaatacaaaaacttccttggatacaaaaggttttgctgttgcaaatacaaactaggaactctctaaagatgtggagaacgcgacagcttaatcggtttcgtcaacgaccttggtccccagccctttcaagccctcggcagggatctccgcgacggtgacaagggagtagagttcctccttggcatcctcctcatcgttcctcttgcgggcgatcctcacacgaaccctccgcggcacgctcctgatcccgctgctccagatgtgcttgttgagcttcacatcgatcctgacgtccgtggtgcccatggccttctgtgcaaacttcctgatctccttgatggcgttgggtgccttcttcttgaatgtgcagccgtggaggcgcttgtggaggttgatggtgtactccctggtgaccacctcctccttcctcgacgctcctcccttcccctgcgacatatctcctctgctccgggtgcgggtgggcggattccgctgggtagtgtggtgcggtgttgtgttccgcggcggcgcgagagcccggcccgcccggcctcgagggtccc

SEQ ID NO: 19730 - DNA, 784 bp, Zea mays
aggttgataagtgttttttttaattttttttttgtttttggctaaaaccatcctgacaagttatccaaggaacacaacttgataacgtaaacaccacacatggagatttccaaacttgtcccatgagcagcgacttcccagggggcgataatgaagaaaaggatgcagcagcaatgaaaagaaaactagccatgcaattctgttgcggaaatagacaactttgtgaatacaaaaggttttgctgttgcaaatacaaactaggaactctctaaagatgtagataacgcgacagcttaatcggtatcgtcaacgaccttggtccccagccctttcaagccctcggcggggatctccgcgacggtgacaagggagtagagctcctccttggcatcctcctcgtcgttcctcttgcgggcgatcctcacacgaaccctccgcggcacgctcctgatcccgctgctccagatgtgcttgttgagcttcacatcaatcctaatgtccgtggtgcccatggccttctgcgcaaacttcctgatctccttgatggcgttgggtgccttcttcttgaatgtgcagccgtggaggcgcttgtggaggttgatggtgtactccctggtgaccacctcctccttcctcgacgctcctcccttcccctgcgacatatctcctctgctccgggtgcgggtgggcggattccgctgggtagtgtggggcggggttgtgttccgcggcggcgcgagaccccccgggcgagtaaagtcacgccgctctcggcgccgcacag

SEQ ID NO: 19731 - DNA, 2014 bp, Zea mays
ctcacgggtcgatgcgccccccgaaattgtgcttcccatccgattcaactacaaaccttgcgggcaaaaatggcaaaggctctcctaggtggcctatcggcgatcctcgtcgtggcggtggtcgtcggtgtggtcgccaccgtcacccgctccggcaagaaggccggcgacaacttcacggtcccgggggaggcttcccttgccacgtccggcaagtcggtcaagtccctgtgcgcgcccaccctatacaaggagtcgtgcgagaagacactgtcccaggccaccaatggcaccgagaaccccaaggaggtgttccacagcgtggccaaggtggcgctggagtcggtccagacggcggtcgagcagtccaagtcgatcggcgaggccaaggccagcgactccatgaccgagagcgcgcgcgaggactgcaagaagctcctggaggacgccgccgacgacctgaggggcatgctcgagatggccggcggcgacatcaaggtgctgttcagccggtccgacgacctcgagacctggctcacgggcgtcatgacgttcatggacacctgcgtcgacggcttcgtcgacgagaagctcaaggccgacatgcactccgtgctgcgcaacgccaccgagctcagcagcaacgcgctggccatcaccaacagcctcggcgggatcctgaagaagatggacctcggcatgttcagcaaggactcgcgccgccgactgctgtcgtcggagcaggatgagaagggctggcccgtgtggatgcggtcgccggagaggaagctgctggcgtcgggcaaccagcccaagccgaacgcgatcgtggccaaggacggcagcgggcagttcaagagcatccagcaggccgtggacgccgtgcccaagggccatcaggggaggtacgtcatctacgtgaaggccggcctctacgacgagatcgtcatggtccccaaggacaaggtcaacatcttcatgtacggcgacgggcctaagcaaagccgcgtgaccggccgcaagagcttcgccgacggcatcaccaccatgaagaccgccaccttctccgtcgaggcgtccgggttcatctgcaagaacatggggttccacaacacggccggcgcggagcggcaccaggcggtggcgctccgggtgcagggggacctcgcggcgttctacaactgccggttcgacgcgttccaggacacgctgtacgtgcacgcgcggcggcagttcttccgcaactgcgtggtctccggcaccatcgacttcatcttcggcaactcggcggcggtgttccagaactgcctcatcatcacgcggcggcccatggacaaccagcagaactcggtgacggcgcacgggcgcaccgaccccaacatgaagtccgggctcgtcatccagaactgccgcctggtgcccgaccagaagctgttcccggaccgcttcaagatcccctcgtacctgggccgcccctggaaggagttctcgcgcctcgtcatcatggagagcaccatcgccgacttcgtcaagccagaggggtacatgccctggaacggcgacttcgccctcaagacgctctactacgccgagtacaacaaccgcgggcccggcgccggcaccagcaagagggtcaactggcccggcttccacgtcatcggacggaaggaggccgagccgttcaccgccgggccgttcatcgacggcgccatgtggctcaagtacaccggcgcgccgcacatacttggtttcaagttctagaggccgcatggcatggcatacatcacatcatatatagtgaggtggcatacgcgcgcgcgcacacacacatgtttgtgtgtatgtacaaggactgagacttgcaaacagaggggtcgcagaacaggagggctgacatttgtacctttaccgtttgcattcctttggctgtttctcctggtgaaactcgaaaaagtcttttggagaatgatttgttgcgacattgcccaaaaaaaaaaaaaaaaaaggggcggcc

SEQ ID NO: 19732 - DNA, 2495 bp, Zea mays
  misc_feature (149)..(149): n is a, c, g, or t
  misc_feature (288)..(288): n is a, c, g, or t
acccttagtctgacttaccactcgaatgaggtagcaattcattattaccatctaagccaatggctatggtaacatgcgaacaaatagtgacgagtaccaacaataataagcaacttcatatttggggaagatcatatatactaagcaanttgagcaaagacaaaaaaaaagctaagcccaaaggaaaaaaaaatatatacttaatgaagatctctgactctccgtccaatctaggctcatcacaataccgtttgtcctccagaattagcacagcccattttagaaaangtgctacaagacactgaaacgtaaaagagctacccaaatatccagaacggaaaacctattgaccacgtcctttacctctcaaatagacgatgctcttctgcacgtcaaaatatagcgactcccaacgaacacgggccgccacacaacattgaaaccatgcatccacgtccgtacgcagccatttgatcgtcatggtcgctataaatttgctccccgtccgcggcatcaccgctcctcttccccaagatggcaaatgctctcctaggtggcctgtgggcgatcgtcgtcgtcgcggtggtcgtcggcgttgtcgccaccgtcacccactccggcaagaaggccggcgacgacttcaccgtcccgggggaagcctccattgccacgtccggcaagtcggtcgagtccctgtgcgcgcccacgttgtacaaggagtcgtgtgagaagacgctctcccaggccaccaatggcaccgagaaccccaaggaggtgttccacagcgttgccaaggtggcgctggagtcggtgaaaacagcggtcgagcagtccaagacgatcggcgaggctaatgccagcgactccatgaccgagagcgcgcgggaggactgcaagaagctcctcgaggacgccgttgacgacctcaggggcatgctcgagatggccggcggcgacatcaaggtgcttatcagccggtccgacgacctcgagacatggctcacgggcgtcatgacgttcatggacacctgcatcgacggcttcgtcgacgagaagctcaaggccgacatgcacaccgtgctgcgcaacgccaccgagctcagcagcaacgcgctcgccatcaccaacagcctcggcgggatcctgaagaagctggacctcggcatgttcaagaaggactcgcgtcgccggctcctgtcggagcaggacgaaaaaggctggccagtgtggatgaggtcgccggagagaaagctcctggcggcgggcaaccagcctaaagcgaacgcggtggtggccaaggacggcagcggccagttcaagaccatccagcaggccgtggacgccatgcccaagggccagcaggggaggtacgtcatctacgtggaggccggcctctacgacgagatcgtcatggtccccaaggacaaggtcaacgtcttcatgtacggcgacgggcccaagcaaagccgcgtgaccggccgcaagagcttcgctgacggcatcaccaccatgaagaccgccacattctccgtcgaggcgtccgggttcatctgcaagaacatgggcttccacaacacggccggcgcggagaggcaccaggcggtggcgctccgcgttcagggagacctcgcggcgttctacaactgccggttcgacgcgttccaggacacgctgtacgtgcacgcccggcgccagttcttccgcaactgcgtcatctccggcaccattgacttcatcttcggcaactcggcggcggtgttccagaactgcctcatcgtcacgcggcggcccatggacaaccagcagaactcggtgaccgcgcacggccgcacggaccccaacatgaagtcggggctcgtcatccagaactgccgcctggtgcccgaccagaagctcttccccgaccgcttcaagatcccctcgtacctgggccgaccctggaaggagttctcgcgcctcgtcatcatggagagcaccatcgccgacttcatcaagcccgagggctacatgccctggaacggcgacttcggcatcaagacgctctactacgccgagtacaacaaccgcggccccggcgccggcaccagcaagagggtcacctggcctgggttccacgtcatcggccggaaggacgccgagcagttcaccgccgggccgttcatcgacggcgggttgtggctcaagttcaccggcacgccgcacatcctcgggttcaagttctaaagaccgcatgcatggcatggtatatacagcacacgctagggaggtggtacatacatgtttgtacctgaggtgtcgcaggacaggagggctaacgtttgtacctttaccctttttttcttttctttttgattcctttggttgtttctcttggtgaaaattttcaggaaacgaaaaatattttggacagtgatctgatgcgtcattgattaatgcatagtttgtgtgttttaaaaaaaaacactgactctgttgttgcagggcaggggtaccga

SEQ ID NO: 19733 - DNA, 1106 bp, Zea mays
  misc_feature (544)..(544): n is a, c, g, or t
  misc_feature (703)..(703): n is a, c, g, or t
  misc_feature (745)..(745): n is a, c, g, or t
ccggcctctacgacgagatcgtcatggtccccaaggacaaggtcaacatcttcatgtacggcgacgggcctaagcaaagccgcgtgaccggccgcaagagcttcgccgacggcatcaccaccatgaagaccgccaccttctccgtcgaggcgtccgggttcatctgcaagaacatggggttccacaacacggccggcgcggagcggcaccaggcggtggcgctccgggtgcagggggacctcgcggcgttctacaactgccggttcgacgcgttccaggacacgctgtacgtgcacgcgcggcggcagttcttccgcaactgcgtggtctccggcaccatcgacttcatcttcggcaactcggcggcggtgttccagaactgcctcatcatcacgcggcggcccatggacaaccagcagaactcggtgacggcgcacgggcgcaccgaccccaacatgaagtccgggctcgtcatccagaactgccgcctggtgcccgaccagaagctgttcccggaccgcttcaagatcccctcgtacctggngccgcccctggaaggagttctcgcgcctcgtcatcatggagagcaccatcgccgacttcgtcaagccagaggggtacatgccctggaacggcgacttcgccctcaagacgctctactacgccgagtacaacaaccgcgggcccggcgccggaccacagnaaagggtcaactggcccggcttcacgtcaatcggacggaggnaggccgagccgttcaccgtccgggccgttaatagacggcgccatgtggctcaagtacaccggcgcgccgcacatacttggtttcaagttctaaaggccgcatggcatggcatacatcccatcatatatagtgaggtggcacacacgctcgcgcgcgcgcgcacacatgtttgtgtgtatgtacaatgactgagacttgcaaacagaggggtcggagaacaggagggctgacatttgtaccttcaccatttgcattcctttggctgtttcccctccccaaactcgaaaagtcctttggccaatgatttgttgcgacaatgcttaatgcatggtgtgcgtgcgttttgtcgaaaaaaaccaaa

SEQ ID NO: 19734 - DNA, 832 bp, Zea mays
cggacttcccgggtcgacccacgcgtccggcgtggtctccggcaccatcgacttcatcttcggcaactcggcggcggtgttccagaactgcctcctcatcgcgcggctggcatccctggaccgccagcagaactcggtgacggcgcacggccgcaccgaccccaacatgaagtccgggctcgtcatccagaactgccgcctggtgcccgaccagaagctgttcccggaccgcttcaagatcccctcgtacctgggccgcccctggaaggagttctcgcgcctcgtcatcatggagagcaccatcgccgacttcgtcaagccagaggggtacatgccctggaacggcgacttcgccctcaagacgctctactacgccgagtacaacaaccgcgggcccggcgccggcaccagcaagagggtcaactggcccggcttccacgtcatcggacggaaggaggccgagccgttcaccgccgggccgttcatcgacggcgccatgtggctcaagtacaccggcgcgccgcacatacttggtttcaagttctaaaggccgcatggcatggcatacatcacatcatatatagtgaggtggcacacacgctcgcgcgcgcgcgcacacatgtttgtgtgtatgtacaatgactgagacttgcaaacagaggggtcggagaacaggagggctgacatttgtaccttcaccatttgcattcctttggctgtttctcctggtgaaactcgaaaagtcctttggacaatgatttgttgcgacattgcttaatgcatggtgtgcgtgcgttttggcaaaaaaaaaaaaaaaaaaaaaaaaaaaaaa

SEQ ID NO: 19735 - DNA, 1702 bp, Zea mays
atatcaccacaatgtatatgtacaacaatctggcagatgatacatagtctgtccttattaacaccaaacatgtgatgtgcaacactgtcagcagatagggcacaccagttacaatgcacacattaacgtccaaatcaagcccagtgtttttggggaaaatagggattatgttattttccccttccattttttttcttccgaagagccaacacagctacaatatatactgtaaaatatatattgtaggagtaagtacactcgaagcttggcgatgacgaatatggcctgcactacctaccaccagtacggagactgcaactacaagcccttacaaaattactagtacttattagtataataactaatcaatgaaggaacagaaaccctgcactgaaccaatcatgtacagtatgtatatgtacagccacacacacacatgccgcgcacgatccaccacacccgatgcactgcgccatccgtctccgtctccgtctcacttccgcggcggggccagacggtctcattgccgcctctccatgtaatccagctatagtttcatattatatcctccttgcaagtcaacaatggcggctcgcctgactcaagcccacaccgtgcggttgcattgcattgcgctgcccaagacagatcaatcaaccaaccaaccgcagccgaggatgcttcgccacccccacctcccctcaggacatgatgggcggcgtcgtctagaacggcttgccccagtacatgaggatgtcctgcagcagcgggtcgccgccggcgtggccgacgacggggtcgagcatggagcccgcggggttcacggggtcggaggcgaaggtccgctcccactcgctgatcttgggctggctctgcacctcccggtcgcacgccagctgctccggggacagcacctgctccgagcagctggagtagtccgcgtgcagccgcggcatcgagtccgacggccggtcgtagtacgccgccagctccgggaacgccgggggcagcccgcccgccgccgccacgaacggcttctgctccggcggggagctcaccgccgccgtggcgaacacaggcttgtggtcgccgccggccgccggcgccttctccagcccgccgcccttcttgttgtagatgcggcacaggacccagtcatccaacctgaggctgttcttcttgcgcgccgagcggtcgacgtcggcgaggcggtactcgtgcatgatccagttggtcttctcgcccttgggcgccttgccggcgtagaagacgagcgccttcttgatggccagcggcttgggcgtgcccacgggcttgtcagcgccggtggccttccagtacccagccccggcggcgcggttgggcctggacccgttcgggtacttgcggtcccgcggggagaagaagtaccactccttctcgccgtacagcgccatcctggggagctgccatgggtcgaacttgtagaggtcgatctcggcgatgatggggacggcgatgggcaggccggcgcagcggcggcagaggtagtgcatcaccagctcctcgtccgtcgggtggaaccggaaccccggtggcagctgcagatccggaccggcgccgctcatcgtgttcctccctgctgtctgctggtgctggctgtggctactgctgcagtgctgctgctaatggtaggaagaggggaggagagcttcccggccgg

SEQ ID NO: 19736 - DNA, 2126 bp, Zea mays
agtaggtgctgtgtgtaggcttcggtatactccagcgtgctttagataccgaagtcgtttgaaagcgtagttacgaagaccgcaacggcggggagcagctattgtgcactactagacacttttttttttttttttttttttttttttttttttttttttttttttttttttttttttttttttttttttctagcagaataatcaaaataacttccattttttttccgaagagccaacagctacaatatatactgtaaaatatatattgtaggagtaagtacactcgaagcttggcggtgacgaatatggcctgcactacctaccaccagtacggagactgcaactacaagcccttacaaaattactagtacttattagtataataactaatcaatgaaggaacagaaaccctgcactgaaccaatcatgtacagtatgtatatgtacagccacacacacacatgccgcgcacgatccaccacatccgatgcactgcgccatccgtctccgtctccgtctcacttccgcggcggggccagacggtctcattgccgcctctccatgtaatccagctgtagtttcatattatatcctccttgcaagtcaacaatggcggctcgcctgactcaagcccacaccgtgcggttgcattgcattgcgctgcccaagacagatcaaccaaccaaaccaaccgcagccgaggatgggtgtttgcatgcatgattcgtctagaacggcttgccccagtacatgaggatgtcctgcagcagcgggtcgccgccggcgtggccgaggacggggtcgagcatggagcccgcggggttcacggggtcggaggcgaaggtccgctcccactcgctgatcttgggctggctctgcacctcccggtcgcacgccagctgctccggggacagcacctgctccgagcagctggagtagtccgcgtgcagccgcggcatcgagtccgacggccggtcgtagtacgccgccagctccgggaacgccgggggcagcccgcccgccgccgccacgaacggcttctgctccggcggggagctcaccgccgccgtggcgaacacaggcttgtggtcgccgccggccgccggcgccttctccagcccgccgcccttcttgttgtagatgcggcacaggacccagtcatccaactgcacccgtcaacacaatagagaacttagtttgtcatccgtgcagctgacaagaaatggatgagcttaagaatcacaaagcgtcatttcgatgtctaatcccagaccccactggctctccgtcgccgtcgcagtcgcaggggcgcgacgggcgaaaatgatctgtacaccatgacccatgggcatcgaatacttgcgcgccgaggactgcgacgcggtcgaatcattgggcacggtgcagccccccaccccacctagcatggcccacgtaaaaaaaattcagcggcccaaaaccatgggccacgcttatccccgcgttcattacgaaagcgacacattatcgccgagttctttttgtttgatttggacggtgacgacgccaacggacggacggacggacggcggcggagcgcgcttgttcttaccctgaggctgttcttcttgcgcgccgagcggtcgacgtccgcgaggcggtactcgtgcatgatccagttggtcttctcgcccttgggcgccttgccggcgtagaagacgagcgccttcttgatggccagcggcttgggcgtgcccacgggcttgtcagcgccggtggccttccagtacccagccccggcggcgcggttgggcctggacccgttcgggtacttgcggtcccgcggggagaagaagtaccactccttctcgccgtacagcgccatcctggggagctgccatgggtcgaacttgtagaggtcgatctcggcgatgatggggacggcgatgggcaggccggcgcagcggcggcagaggtagtgcatcaccagctcctcgtccgtcgggtggaaccggaaccccggtggcagctgcagatccggaccggcgccgctcatcgtgttcctccctgctgtctgctggtgctggctgtggctactgctgcagtgctgctgctaatggtaggaagcggggaggagagcttcccgg

SEQ ID NO: 19737 - DNA, 1489 bp, Zea mays
  misc_feature (190)..(190): n is a, c, g, or t
  misc_feature (203)..(203): n is a, c, g, or t
  misc_feature (252)..(252): n is a, c, g, or t
  misc_feature (256)..(256): n is a, c, g, or t
  misc_feature (304)..(304): n is a, c, g, or t
  misc_feature (314)..(314): n is a, c, g, or t
ttcttccgaagagccaacacagctacaatatatactgtaaaatatatattgtaggagtaagtacactcgaagcttggcgatgacgaatatggcctgcactacctaccaccagtacggagactgcaactacaagcccttacaaaattactagtacttattagtataataactaatcaatgaaggaacaganaccctgcactganccaatcatgtacagtatgtatatgtacagccacacacacatgccgcgcncganccaccacacccgatgcactgcaccatccgtctccgtctcccttccggngggggggagngggtctcattgccgcctctccatgtaatccagctatattttcatattatatcctccttgcaagtcaacaatggcggctcgcctgagtcaaagcccacaccgcgcggttgcattgcattgcgctgcccaagacagatcaatcaaccaaccaaccgcagccgaggatgggtgtttgcatgcatgcttcgccacccccacctcccctcgccctcaggacatgatgggcggcgtcgtctagaacggcttgccccagtacatgaggatgtcctgcagcagcgggtcgccgccggcgtggccgacgacggggtcgagcatggagcccgcggggttcacggggtcggaggcgaaggtccgctcccactcgctgatcttgggctggctctgcacctcccggtcgcacgccagctgctccggggacagcacctgctccgagcagctggagtagtccgcgtgcagccgcggcatcgagtccgacggccggtcgtagtacgccgccagctccgggaacgccgggggcagcccgcccgccgccgccacgaacggcttctgctccggcggggagctcaccgccgccgtggcgaacacaggcttgtggtcgccgccggccgccggcgccttctccagcccgccgcccttcttgttgtagatgcggcacaggacccagtcatccaacctgaggctgttcttcttgcgcgccgagcggtcgacgtcggcgaggcggtactcgtgcatgatccagttggtcttctcgcccttgggcgccttgccggcgtagaagacgagcgccttcttgatggccagcggcttgggcgtgcccacgggcttgtcagcgccggtggccttccagtacccggccccggcggcgcggttgggcctggacccgttcgggtacttgcggtcccgcggggagaagaagtaccactccttctcgccgtacagcgccatcctggggagctgccatgggtcgaacttgtagaggtcgatctcggcgatgatgggcacggcgatgggcaggccggcgcagcggcggcagaggtagtgcatcaccagctcctcgtccgtcgggtggaaccggaaccccggtggcagctgcagatccggaccggcgccgctcatcgtgttcctccctgctgtctgctggtgctgcctgtggctactgctgctgcgctgcggcgg

SEQ ID NO: 19738 - DNA, 1618 bp, Zea mays
ggtaccgggccccccctcgagtttcctttttttttttttttaatcaaaataacataatccctattttccccttccattttttttccggaagagccaacacagctacaatatatactgtaaaatatatattgtaggagtaagtacactcgaagcttggcgatgacgaatatggcctgcactacctaccaccagtacggagactgcaactacaagcccttacaaaattactagtacttattagtataataactaatcaatgaaggaacagaaaccctgcactgaaccaatcatgtacagtatgtatatgtacagccacacacacacatgccgcgcacgatccaccacacccgatgcactgcgccatccgtctccgtctccgtctcccttccggcggggccagacggtctcattgccgcctctccatgtaatccagctatagtttcatattatatcctccttgcaagtcaacaatggcggctcgcctgagtcaaagcccacaccgtgcggttgcattgcattgcgctgcccaagacagatcaatcaaccaaccaaccgcagccgaggatgcttcgccacccccacctcccctcaggacatgatgggcggtgtcgtctagaacggcttgccccagtacatgaggatgtcctgcagcagcgggtcgccgccggcgtggccgacgacggggtcgagcatggagcccgcggggttcacggggtcggaggcgaaggtccgctcccactcgctgatcttgggctggctctgcacctcccggtcgcacgccagctgctccggggacagcacctgctccgagcagctggagtagtccgcgtgcagccgcggcatcgagtccgacggccggtcgtagtacgccgccagctccgggaacgccgggggcagcccgcccgccgccgccacgaacggcttctgctccggcggggagctcaccgccgccgtggcgaacacaggcttgtggtcgccgccggccgccggcgccgccgccttctccagcccgccgcccttcttgttgtagatgcggcacaggacccagtcatccaacctgaggctgttcttcttgcgcgccgagcggtcgacgtcggcgaggcggtactcgtgcatgatccagttggtcttctcgcccttgggcgccttgccggcgtagaagacgagcgccttcttgatggccagcggcttgggcgtgcccacgggcttgtcagcgccggtggccttccagtacccagccccggcggcgcggttgggcctggacccgttcgggtacttgcggtcccgcggggagaagaagtaccactccttctcgccgtacagcgccatccttgggagctgccatgggtcgaacttgtagaggtcgatctcggcgatgatggggacggcgatgggcaggccggcgcagcggcggcagaggtagtgcatcaccagctcctcgtccgtcgggtggaaccggaaccccggtggcagctgcagatccggaccggcgccgctcatcgtgttcctccctgctgatgctgctgtctgctggtgttctggctgtggctactgctaatggtaggaagaggggaggagagcttcacgcccggcccgggccgccccgccctacccaatg

SEQ ID NO: 19739 - DNA, 2695 bp, Zea mays
  misc_feature (1555)..(1555): n is a, c, g, or t
ttaaaaacggcccccccgttttaaagaggaagggtaccgggccccccctcgagttttttttttttttttttttaatcaaaataacataatccctattttccccttccattttttttcccgaagagccaacacagctacaatatatactgtaaaatatatattgtaggagtaagtacactcgaagcttggcgatgacgaatatggcctgcactacctaccaccagtacggagactgcaactacaagcccttacaaaattactagtacttattagtataataactaatcaatgaaggaacagaaaccctgcactgaaccaatcatgtacagtatgtatatgtacagccacacacacacatgccgcgcacgatccaccacacccgatgcactgcgccatccgtctccgtctccgtctcccttccggcggggccagacggtctcattgccgcctctccatgtaatccagctatagtttcatattatatcctccttgcaagtcaacaatggcggctcgcctgagtcaaagcccacaccgtgcggttgcattgcattgcgctgcccaagacagatcaatcaaccaaccaaccgcagccgaggatgcttcgccacccccacctcccctcaggacatgatgggcggtgtcgtctagaacggcttgccccagtacatgaggatgtcctgcagcagcgggtcgccgccggcgtggccgacgacggggtcgagcatggagcccgcggggttcacggggtcggaggcgaaggtccgctcccactcgctgatcttgggctggctctgcacctcccggtcgcacgccagctgctccggggacagcacctgctccgagcagctggagtagtccgcgtgcagccgcggcatcgagtccgacggccggtcgtagtacgccgccagctccgggaacgccgggggcagcccgcccgccgccgccacgaacggcttctgctccggcggggagctcaccgccgccgtggcgaacacaggcttgtggtcgccgccggccgccggcgccgccgccttctccagcccgccgcccttcttgttgtagatgcggcacaggacccagtcatccaactgcacccgtcaacacaatagagaacttagtttgtcgtccgtgcagctgacgagaaatggatgagctaaagaatcacaaagcgtcatttcgatgtctaatcccagtgagaccccactggctctccgtcgccgtcgccgtcgcagggcgcgacgggcgaaaatgatctgttcgctatgacccatgggcatcgaatacttgcgcgcggaggactgcgacgcggtcgaatcattgggcacggtgcagccccccaccccacctagcatggcccacgtaaaaaaaattcagcggcccaaaaccatgggccacgcttatccccgcgttcattacgaaagcgacacattatcgccaagttctttttgtttgatttggacggtgacgacgccaacggacggacggacggcggcggagcgcttgttgttcttaccctgaggctgttcttcttgcgcgccgagcggtcgacgtcggnccaggcggtactcgtgcatgatccagttggtcttctcgcccttgggcgccttgccggcgtagaagacgagcgccttcttgatggccagcggcttgggcgtgcccacgggcttgtcagcgccggtggccttccagtacccagccccggcggcgcggttgggcctggacccgttcgggtacttgcggtcccgcggggagaagaagtaccactccttctcgccgtacagcgccatccctgcacacagagagttagcaatcgatcgattagctcgccatcgtcacggccgcacaggaaattggttcacggctgctactgctgctgcaagaagaccgaggacgacgggacgtacttgggagctgccatgggtcgaacttgtagaggtcgatctcggcgatgatggggacggcgatgggcaggccggcgcagcggcggcagaggtagtgcatcaccagctcctcgtccgtcgggtggaaccggaaccccggtggcagctgcagatccggaccggcgccgctcatcgtgttcctccctgctgatgctgctgtctgctggtgttctggctgtggctactgctaatggtaggaagaggggaggagagctgtgccgcttgttccgagtgcggagccgggcatttatagccgcggtcgaccgcgacacgtgtggcccgtgcgccgggcccctgcggtagcgcacacacggagccccactctgacaggttgaccacgacacgtggacgccgagaggcggcgccaattctgtcactgcttacgtcaggtttcttggacggacgcgcgcccgcgtcagcgtggcgtgggtccaccgctgcaggcgctctgcccgcccgacggcccgggaccttccggtggcggcgcgacacgtcggggcggccagcggtggggcggccgggaaagtacggatggcgcggtgcgggcgcggggtgagcgtgatggggaggataaggatgagtcgacggcgacgcggaggtgatgagggcaggcggccatgagttatgcgcgcggtaggtgcgtagtaccacaagcggtcgctttcttttcttttcttttttttttcttttcattgcaggagaaggaggaaaaacgaagataagggagagccagctagctgattttggagcattca

SEQ ID NO: 19740 - DNA, 661 bp, Zea mays
  misc_feature (661)..(661): n is a, c, g, or t
gaagattcctctccccgtgattccccgtcccgtggccgcagcccccgtcggcgtcctcgcggctgcagccgaccatagccgccgcgcccgcaaatcacgcgcccccttccatccatggcaggtccgcgcccctgcggcccaaatcgcgcggatggaaggtacgcgcgtccgctaggcctacaactcctcctcctctccccattgctcagtgtaggcagtccccaaatccacgcgtccgcgccctcatcctctccccagcaatgcgccgccacctcctcctcggacgcgcggtggaaggttcgcgcctttgcgccccccaaatcgcgcggatggaaggtccgtggtgtggggaaggcctgggcgggggtgctcatcctgctcatcgttgtgtacggggccgggttcggctggtcctggggccccctcgggtggctggtccccaacgagatttcccgctggaggtgcgcgctgccgggcagagcgtcccgctggaggtgcggttgccatgcctggacctccgtcgccgccatagaaggtaaacggcccaccgattgaagtacctccctaggggctgactcgtcgggttcgtcccgccaaacggcaagctgcgacgcctgtccttgccataccacggctcttcaaggtcatggtagaagtgttn

SEQ ID NO: 19741 - DNA, 1571 bp, Zea mays
gaaaattaagccccgtaaaaccaatccaatcgggtggcagtttttaaggaaaccagggaccgcagcagcaagccgccccagccgacgaggcgaggagcgtgcaattccgtagctgcaacgaactccctcgaccgtatcgcccgctgctcctctatccctttcctgctgctgctactaccttaagctatcactatcatggccttgatgctgctagcgcgcaacctgcgctcccgcctccgcccaccgctcgccgccgccgcggcgttctcgtcggccgcggcggaggcggagagggcgatacgggacgggccgcggaacgactggagccggcccgagatccaggccgtctacgactcaccgctcctcgacctcctctttcacggggctcaggtccacagaaatgtccataaattcagagaagtgcagcaatgcacacttctttcaatcaagactggtggatgcagtgaagattgttcttactgtcctcagtcatcaagatacaacactggattgaaggcccaaaaattgatgaacaaagatgctgtcttggaagcagcaaaaaaggcaaaagagtctgggagcacccgtttttgcatgggagctgcatggagagaaaccattggcaggaaatcaaacttcaaccagattcttgaatatgtcaaggaaataaggggtatgggcatggaggtctgttgcacactaggcatgatagagaaacaacaagctgaagaactcaagaaggctggacttacagcatataatcataacctagatacatcaagagagtattatcccaacattattaccacaagatcatatgatgatagactgcagactcttgagcatgtccgtgaagctggaataagcatctgctcaggtggaatcattggtcttggtgaagcagaggaggaccgggtagggttgttgcataccctagctaccttgcctacacacccagagagcgttcctattaatgcattggttgctgtaaaaggcacacctcttgaggaccagaagcctgtagagatctgggaaatgatccgcatgatcgccactgctcggatcacgatgccaaaggcaatggtgaggctttcagcaggccgagtacggttctcgatgccagaacaagcgctgtgcttcctcgctggggccaactccatctttgccggcgagaaacttctcacaaccgcaaacaacgactttgatgcggaccaggcgatgttcaagatccttggcctgatccccaaggctccaagctttggcgaggaagaggcgtctgcggcggctcccacagaatccgagaggtctgagcaagctgcttcgatgtagaatatatacatatcattaccgattatccgtatcacggttggggcgaaactagaactaccgttgtagctagagcattggattgtagaaaccacaacatttcattattttgtaattgcttgagactgaatgggggatacccatgtcgggctagatcaatggacaacttccacacaaccaaacgcaaacattgaaactcatttttcatcacagttttaataagctgcccccgccttttaagttgc

SEQ ID NO: 19742 - DNA, 3373 bp, Zea mays
ccggccggatgcattcgtgtgagtaagggtctaccgcgatcgcgacccgcacaggccacagcctctctcccctctgctcccgcggcccgcgcaccggcacggcatacagcgcaccgagctgcggccaccgcagcgaacagcaaagcacctccgactccaagtcgcgagagccttctcattcgtcttcctcctcttccacccatcctgcctgctcacttccgttccgtagcccagctagatccccgggctaccgatccaccgagaagcttgtggttgtggcggcggcggagagggaagcggggagcgggaggtcggaggtaggcgcggatgccactgttgtgccggcgccggcgggggccggtgatgcccgcttgacctgggcctccgtgcgtcggaggtggacgagggagcgaggcggcgccagaccgaggttgcgtcgggctcgatttctactgggctgctgtctgctgagtttacggaagtgtttggccctagaagagttgaagataaggagtggagctaggtttaaactctggtgacttggttgttgtgtgcaacgaatcaactatgctgagtttttctgtagagtaacagaaattggatcaattcaagtagaggtctaggaggagatatgaggtactacttgcgtcaggtccagcgtttggttggagatatggaaggaggagctctcttgtttatagacgacctcaactccaagtgacaaagcgaacagctgttgaacgtttcccttctatttctgtttctttttgccggatttggagatggagatgaattcctctggcgaggaaactgtggtaaaggtaagaaagccgtacacaataacgaagcagcgggagcggtggacagaggctgaacacaaacggttccttgaagccttgaaactttatggcagagcatggcagcgcatagaagagcatgttgggacaaagacagccgtgcagatcagaagtcacgctcaaaagttcttcactaagttggaaaaggaagctatgaacaatggtacttctccggggcaagcccatgacattgacatacctccaccacggcctaaaagaaagccaaacagtccatatcctcgaaaaagttgtctcagctccgagacacaaaccaaagaacttccaaatgacaagtcaacaaaaccaaatatgcccttgagcaatgggcatgtaaaaatggtaggcgatgcatctcttcagaattttcaaaggaaggagttgtctgaaaaaggaagtcgctcggaagttcttaatctcttccgtgatgccccatctgcatcattttcttcagttaacaaaagctcttcaaatcatggggcacccaggaggaccgaggcaagtaaaacagaaagccgagatatgtccatcatggaaaataattcttttaaccccaacacccaagaggatgtaaaggtgatcagtgatcaggaaatggaaaggcttaatggtatccagatcagatctaaatgtgaacattctcatgaggggtatttggacatctcaacgcaacaaatgaagctaatgccaaagtctgtggagacaacatatgtggatgaacaaactgcaagagcttcacacaccctagcagagagcaacgggacagctagcgttccagtgactgtacctgaaggaactcatcctgatcaaacaagtgatcaagtgggaatcaatggaagcatgaacccatgcatccatccaatggtttctgcagacccaaaatttggtagtagtgccacaccacagacttttcctcataattatgctgcctttgctccaatgatgcagtgcaactgcaaccaagatacgtacaggtcattcaccaacatgtcatccacgttctccagcatgcttgtttccacgttgttgtcaaaccctgccatccatgcagctgccaggctcgcagcatcatactggccagcagctgaaggtaacactcctattgatccgaatcaagaaaaccctgcagatggcgtccaaggaaggaacataggctctcctccaagcatggcttctattgtagcagctacagttgctgcagcatctgcatggtgggcaacacaaggtcttctccctttcttcgctccacccgtggcttttccatttgtaccagctcctagtgctgcctttcccacagttgatgttccacgaccttcagagaaagacagagattgcccagttgaaaatgcacagaatgaatgccaagaagctcgaaaacaggtacagttcgaaggtttaagagttgctgcttcttcagagtctgatgggagtggaaaaggcgaggtgtctctccatacggagttaaagctatctcctgcccagaatgctgatgccacacctaccacaggagctggcacaaatgatgcattcaggaataagaaaaagcaggatcgctcttcatgcggttctaacacaccttcaagtagtgatgtagatgcgggcaatgttcctgaggaggacaatgctaatgagaaggcgaagcaagcctcctgcagcaactcttcagctggtgacactaaccaccgcagatttagaagcaatggaagcacaagtgattcatggaaggaagtttccgaagagggtcgtctggctttcgatgcgctgttcagtagggaaaagcttccgcaaagcttttctcccccacaagcagtagactcgaaggaggttgccaaggaggaggaagatgaagtgaccacagtggcagttgacctcaacaagaatgccacaagcattgatcatgatgacctcgacacaatggatgagcccagggcttcctttcccaatgaattgtcgcacctgaagctgaaatcgcgccgtacaggcttcaaaccatacaagagatgttctgtggaagcgaaggaaaaccgggtgccgactagcgacatggttggtaccaagaggattcgtcttgatagcgaagcatccacataattgatttcttcaaagttatatttacatctaagctactataggacttcagatcttgcaatgcagtgcttcattaaaactcaatctgttgtgtgctgtattttaatgcttgtcaagcagcccgctagactgctttaaaaccttatctcgtagactctgatttaagcatcatgcaactatcaaacttttttttttggtcaaaatgtattttccttatgttttatatttttggaaaggaaaataattgaaatattatttattttgaaggctcaagcaaaagtttatttgatcaaggtgtaggggaataggctgagcgagagggtgaacattatgactaatatagggcagaaaatatttgaccattgtcatgtttgctgttgctagaagattgtgtagagaaagtactcacataaatgtttcacttctatttt

SEQ ID NO: 19743 - DNA, 2943 bp, Zea mays
gcaaagcacctccgactcggagtcgcggcgagagccgagaaccttctcattcatcttcctcttctatccatcctgcctgcctgcttgcctccgtattccagctagatctccgggcagccgattgaccgagaagtttgtggttgtggcggcggcggagagggaaacggggagcgggagggcggcgcggatgccactgctgcgccggcgccggcggggccggtgatgcccgccgtggcggtcgcttgaggccgccgtgcgtgggaggtggacgggggagcgaggcggtgcggaccgaggttgcgttgggttggattcgattgggctgcgtctgctgagaaggtctaggaggagctatgaggtactacttccgtcaggtccagcgtttggttggagatatggaaggaggagctctcttgtttatagatgacctcaactccaagtgacaaagtgaacagctgttgaacttcccgtctatttctgtttctttttgctggatttggagatggaggtgaattcctctggtgaggaaacggtgataaaggtaaggaagccatacacaataaccaagcagcgggagcggtggacagaggctgagcacaaacggttccttgaagccttgaaactttatggcagagcatggcagcgcatagaagagcatgttgggacaaagacggccgtgcagatcagaagtcacgctcaaaagttcttcaccaagttggaaaaggaagctattaacaatggtacttctccggggcaagcccatgacattgacataccgccaccacggcctaaaagaaaggctaacagtccatatcctcgaaaaagtggtctcagctctgagacaccaaccaaagaacttccaagtgacaagtcaacaaaaccaaatatgcccttgagcaatgagaatgtactaatggcaggtgatgcatctcttcagaaatttcaaaggaaggagttgtctggaaaagaaagttgctcggaagttcttaatctcttccgtgatgccccatctccatcattttcttcagttaacaaaagctcttcaaatcatggtgcaccgattgaggcaagtaaaacaaaaatccgagatatgaccattatggaaaatagttctcttaaccccaacatgcaagaggatgtaaaggaaatcaatgatcaggagatggaaaggcttaatggtacccaaatcagctctaaatgtgaacactctcatgagggatatttggacatctcaatgcaacaaatgaagctaaagccagagtctgtggagacaacatatgtggacaaacaaaccgcaagagcttcacactccctagcggagagaactgggacaactagcattccggtcactgcaactgaagaaactcattctgttctaacaagtgatcaagtgggaatcaatggaagcatgaacccatccatccatccaatgtttcctgcagatccaaaatttgatagcagtgccacaccacagccttttcctcataattatgctgcctttgctccaatgatgcagtgcaactgcaaccaagatacccacagatcattggtcaacatgtcatccaccttctccagcatgcttgtttccacgttgttgtcaaaccctgccatccatgcagctgccaggctcgcagcatcatactggccagcagctgaaggtaacactccgattgatccgaatcaagaaaatcttgcagatggtgttcaaggaaggagcatagggtctcctccaagcatggcttctattgtagcagctacagttgctgcagcatctgcatggtgggcaacacaaggtcttctccctttcttcgccccacccatggctttttcatttgtgccagctcccagtgctgccttccccacagttgatgttccacgaccttcagagaaagatagagattgcccagctgaaaatgcacagaaggaatgccaagaagctcgaaaacagggacagtttgaaggtttcagagttgccgcttcttcagagtatgatgggagtggaaaaggcgaggtgtctgtccacacagagttaaagatatctcctgtccagaatgctgatgccacgtctgccgcaggagctgacacgactgatgcattcatgaataagaaaaagcaggaccgctcttcatgcggttctaacacaccttcaagtagtgatgtagatgtggacaatgtccctgagaaggagggcaatgctaatgagaaggcgaagcaagcctcctgcagcaactcttcagctggtgacactaaccaccgcagatttagaagcagtggaagcacaagtgattcatggaaggaagtttccgaagagggtcgtctggctttccatgcgctgttcagtagagaaaagcttccgcaaagcttttctcccccacaagcagaaggctcgaaggaagttggcaaggaggaggaagatgaagtcaccacagtggcagttgacctcaacaagagtaccacaagcattgatcatgacctcgacacaattggtgagccaagggcttcctttcccaatgaactgtcgcccctgaagctgaaattgcgccgaacaggcttcaaaccatacaagagatgttctgtggaagcgaaggagaatagggtgccggctagcgacgaggttggtaccaagaggattcgtcttgatagtgaagcatcaacatgagcgatttctacatggttaccgctcggacttcctctgccgccatgaagtttatgacaaagttgtatttacatctaaactagtataggacttaaagaccttgcaatgcaatgcttcatgaaactgttgtgtgctgtattttagtacttgtgaagcagcccggtagactgcttttaaacctttatctcgtagactctgatttaagcaccaagcaactattgaactttatatttttggcgggaaggaaaataattattttttgatttaaaaaaaaaaaaaaaaggaaa

SEQ ID NO: 19744 - DNA, 3880 bp, Zea mays
  misc_feature (1155)..(1159): n is a, c, g, or t
  misc_feature (1448)..(1461): n is a, c, g, or t
  misc_feature (1473)..(1473): n is a, c, g, or t
  misc_feature (3850)..(3854): n is a, c, g, or t
cgagcggaaaagcgtcccccaacccagcacgcgctgacgacacaccggcgaggcagacaggcagatcagccgcacctccccagtcccccttccccacctacgacgaccgccgcggacgaatcaaaaaagcttcctcctcccggcgtcgcctccgcgcgtggaggcgacgatccattccgccccccgtaggattttgctcctcccgatccggacgtcagatctcgagtggcggcacgcggatctgggggtttctctagaggcggcggcggcggccggaacaggggcagatggcgctctcggggatgcgggggctctcggtcttcatcagcgacatacgcaactgccacaacaaggagcaggagcgcctccgcgtcgacaaggagctcggcaacatccgcacgcggttcaaaaacgagaagggcttatcaccatacgagaagaaaaaatatgtatggaaaatgctttacatttatatgctgggttatgatgttgattttgggcatatggaaactgtctcgttgatatctgcaccaaagtatcctgagaagcaggttgggtatattgtgacatcttgcttactgaatgagaataatgatttcttaagaatggtaataaatacagtaaggaatgacataatcggacgaaatgagaccttccagtgcttagcattgacaatggtaggtaacattggtggtaaagaattttctgagtcactagccccagatgtccagaaacttcttatttcaagcagttgccgtcctgttgtcagaaagaaggctgctctatgccttctgaggctttataggaagaatcctgatgttgtgaatattgatggctgggctgaccgaatggcacaacttctagatgagcgtgatttaggtgtgctgacatctgtcacgagtctttctgtttcactagtatccaacaatgttgaagcatattggaattgtcttcctaaatgtgtgagaatattggagaggttagcaagaaatcaagatattccacaagagtacacttactatggaattccatctccttggcttcaggttaagacaatgagagctcttcagtacttccctaccattgaagatcccaacgcaagacgagctttgtttgaggttttacagcgcattttgatgggtactgatgttgttnnnnncgttaacaagaacaatgcctcacatgctgttctctttgaagctcttgctctggtcatgcatctggatgctgaaaaggagatgatgtcacagtgtgtggctcttcttgggaagtttattgcagtccgggagccaaacattcggtaccttggtctggaaaacatgactaggatgctgttagtaacagatgtgcaggatatcattaaaaggcaccaggctcagatcatcacatctttgaaggatccagatatcagcattaggagaagggctcttgatttattatatggcatnnnnnnnnnnnnnntaagctcggaanttcggctcgagaggagttgttgcagtaccttgatacagcagaatgtgcaatgcgtgaagagttgtctctgaaggcagctattcttgcagaaaaatttgctccgcaactattgtggtatgttgatgttattcttcaacttatagacaaagctggagattttgtaagtgatgatatatggtatcgagtggtacaatttgttacgaacaacgaagacctacagtcatacgctgcaactaaagcgagagaatatcttgacaagcctgctttacatgagacgatggtcaaggtgagtgcctaccttcttggggagtatggacatcttttggcccggagacctggctgtagccctaaggaattgtttgctattataaatgataaacttcctacagtatcggcaagtactgtagctattcttctctcaacctatgccaagatattgatgcacactcaacctcctgatgttggactgcaacaacaaatcctcacaatatttaaaaagtacgagagctatattgatgttgaaatacaacagagagcagttgaatattttgaactaagcaggaaaggtcctgctttggcagatgtgttggctgaaatgccaaaattccctgaacgtgagtctgcactgttgaagaaggctgaagacgctgaaattgacacagcagagcaaagtgccataaagctacgcagtcagcaacaaacatctagtgctcttgttgtagctgatcacccccctgcaaatggatctgcaccaccagttaataatctcactcttgtgaagatgccaagtcaaactgtttctgacactcaggagagtggagtaagttatgaagaagctcctaagcctcctgttgaagctcccaaagaaaatgggactcctgtcgaagtgcagaacagggacacaaacattactgaaatcaacaatgagattaaagctgaacctccctctacatcccattctacctctcccggagacctcctcctggcagatcttttgggtcctcttgcgatagaaggccctcctgctgtagagcaaaatcctgcccaaggattgaatgctaatcaaagtccagctggtgacttggcacttgctacccttgatgatcagtccaactcagttcagccaattgtcaacgtcgaggagaagtttcatattttgtgcacaaaagatagtggggtgctgtacgaggatccttacatccagattggcttgaaagcggagtggcgtgcccatcatggccgtcttgttcttttcctgggtaacaaaaatacttcagcccttacgtcagtgcgggcgctgattttgcctcctagtcatttgaaaatggaactttcgtcagttcctgatactattcctccaagagcgcaggtgcaagttccccttgaggttgcgaatctccttgcaagtagagatgttgcggttctagatttctcgtatgcttttgggacttcactggtggatgccaaacttcgactccctgttgtattgaataaatttttgcagactataactcttacccctgaagaatttttctcccagtggaaagcgcttactgttcattcgctgaaggttcaagaagtggttaaaggtgtgaaacccatgcctctttctgagatggctaatcttttcatgagccttcacttggcggtcgctcctggacttgataacaacccgaacaatctggttgcatgcacgacattcttttctgaagcaacacgtgccatgctttgtctgatacgagttgaaacagatccacaagacaggacccaactgcggctaacagttgcctcgggcgaccaatatttgacattcgagttgaaagagttcatcaaagaacatctggttgatatcccaaggactcaggtcgccccacctcgcgcagcagtccagccacagttgcctactacagcacctgccacatacaatgaccctggtaccatgcttgctggattgctatgagaagtaacccgaaggaatagtgttttgatgtacatgacagttatttaatacgaggatctaacatctccacaagcatcttgctgccaagacgtacacgtggagcaaccaagaaagagctggcggagtgtagtctccatgaggattctaaaccgagaaagagcttagattctttttgtgcggtttgaaggccccctccctctccatgtagcagttgccgtattgtgtaagcgtaacttgttgtttctcattattatcatccccttttggtccatttgtataacctgtatcgcccatgtctggtggtggacaatcggtagtttttgtgtgttaatataaggtgctaggttttcccaccatgccgattgtaaagttgccctggtgcgcattgcactgcgatttgtacggaatagggaaggnnnnntttataggttttgctttgtgcatgtt

SEQ ID NO: 19745 - DNA, 1390 bp, Zea mays
  misc_feature (5)..(5): n is a, c, g, or t
aaacnaggtccgggacggcggtgctgattttgcctcctagtcatttgaaaatagcactatcgtcagttcccgatcccacgcctccgaagggcgcaggtgcaagttccacttgaggttgcaaatctccgtgcaagtagagatgttgcggttttagatctctcatatacttttggaacttcactggtggatgccaaacttcgacttcctgttgtattgaataaatttttgcagcctataactcttacccctgaagaatttttcctccagtggaaagcgctgactgttcacttgctgaaggttcaagaagtggttaaaggtgtgaaaccaatgcctctttctgagatggctaatcttttcatgagccttcacttggcggtcgctcctggacttgataacaacccgaacaatctggttgcatgcacgacattcttttctgaagcaacacgggccatgctttgtctgataagacttgaaacagatccacaagacaggacccaactgcggctgacagttgcctcgggcgatcaacatttgacattcgagttgaaagagttcgtcaaggaacatttgattgatatcccaaggactcaggctgccccacctatggcaatggtccagccacagttgcttactgcagcacctgccacatacaatgaccctggtgccatgcttgctggattgctatgagaagtaaaaaaaaaaagagccatagtgttttgatgtacatgacagatgttgatctaacatctccaaaagcatcttgctgccaagacgaacacgtggagcaacgaaagggctggcggagtagtcttcagctggattctaaaccgagaaaaagctagattcttttgggcggtttgaaggcctccttcccctccatggagcagtccccatattgtgtaagcgtaatttgttgtttctcatttatcatccccttttggcccatttatataacttgtattgcccaggtctgttggtggacagtcggtagttatgtgtgttaatataaggtgctaggttttccaccatgccggttgtaaagttgagttggtgcgcattgcattacgatttgtaccaataaggtcgaaatagggaaaggaaattaatagggttttgttttgtgcatttcctgcggtctgcatagttccgatcccttggactgtctgtttctttcctggtggcggtgggtgtgtgatggcacaagcacgaggttcacgaggctcgattacataatctaacctggttgacaccggcgcgtcatctttttgcctctttgaagattctaatttctcgttgctgcggcacaacatgatgctctttgcctctttggagttcccagttcctagctactatgacacaacatgcatccgcttctactaggtggttggca

SEQ ID NO: 19746 - DNA, 1714 bp, Zea mays
ctgtctttgcctgcggctgctgctgctctgggacaggtgggagaggaggcgccacacccagacgagaggcttcccgagtccaccgccagcacgagtccaccgccggcactttgactcggagccggagattcttgcgaggaactggcagggatctgctgcccatccgcatatcatgctgcaacagtagttcactcgtcggaggaaggcgcatcacacgaactaggtggaaggaaccggacggagcttggagagggcaagcgggcaaggggagtgagtagtggttctcggtgtcttctttaaccactctgtccgatccgctggtgtgtctgcgcgatcctgttgacgaatcaatcgccgggacggttaattaagcattccaatcctcagccatggccgtggacactactcaaccggagtactggctcaactggaggttcttgctgtgcgcgctctgggtctactcctgcatggccttggcattcttcctgattaagaagtacgagggggccagttcaccggacagcaatggcgatgacggtggagacagagaagaggcgttaccacgtgtcagacctggtgttgtttatcttgaagattgctggaagacatgccaaacttcgactccctgttgtattgaataaatttttgcagactataactcttacccctgaagaatttttctcccagtggaaagcgcttactgttcattcgctgaaggttcaagaagtggttaaaggtgtgaaacccatgcctctttctgagatggctaatcttttcatgagccttcacttggcggtcgctcctggacttgataacaacccgaacaatctggttgcatgcacgacattcttttctgaagcaacacgtgccatgctttgtctgatacgagttgaaacagatccacaagacaggacccaactgcggctaacagttgcctcgggcgaccaatatttgacattcgagttgaaagagttcatcaaagaacatctggttgatatcccaaggactcaggtcgccccacctcgcgcagcagtccagccacagttgcctactacagcacctgccacatacaatgaccctggtaccatgcttgctggattgctatgagaagtaacccgaaggaatagtgttttgatgtacatgacagttatttaatacgaggatctaacatctccacaagcatcttgctgccaagacgtacacgtggagcaaccaagaaagagctggcggagtgtagtctccatgaggattctaaaccgagaaagagcttagattctttttgtgcggtttgaaggccccctccctctccatgtagcagttgccgtattgtgtaagcgtaacttgttgtttctcattattatcatccccttttggtccatttgtataacctgtatcgcccatgtctggtggtggacaatcggtagtttttgtgtgttaatataaggtgctaggttttcccaccatgccgattgtaaagttgccctggtgcgcattgcactgcgatttgtacggaatagggaaggaaaaatttataggttttgctttgtgcatgttctatggtttgcatagctcccatctcttgatttcctttttcttctgctgctatgtggtggtgtgtgatggttcacgaggctcgattgtataatgtaacctggttggaaccggtgctccttttcttttggagttcccaattcatgtaaaaaaaaaaaaaaaa

SEQ ID NO: 19747 - DNA, 784 bp, Zea mays
ccggccggatctcctcgcgagcaccgctggcctcgcttaacggcctgatctcccagccgccgcttccgcctcgcgtcccaccggtctccatctacatgcagccgcgctcgccaccgccgtcggaggcgcctgcgccctccgacgccatcatgatgcccggcgtgggcggcgtggagccggccgtcacgttgggccaggtgccgcgctggagcgaccccgaccagcgcatcttcctcgcctccacgtccgaagaggcgtccgcggaggacgacggatccggcacgacctctgcgtctggcttcatctctttctccgacccgctcacggtcgacgacggcgccgtcgggggtggccacgccgggggtgcctcgcgcttccccgtcgaccaggagatcaactctaggatctatctctggcgtggccagccctggaacctcgaggtcgacgcggtcgtcaattctaccaacgagagcttggacgaggcgcacagtagcccggggttgcatgctgctgccgggtcagggctcgccgaggaagtgcgccaccttgggaggttgccgaactgggatggccaagatgaccaatgcctacgatctgcctgcaaggaaggtcatccataccgtgggccccaaatatgctgtcaagtatcacacagctgcagagaatgcacttagtcactgctatcggtcctgcttggaactgctcattgagaatggtcttgaaagcatcgcaatgggttgtatatacacagaagctaaaaactaccctcgtgaaccagctgctc

SEQ ID NO: 19748 - DNA, 2527 bp, Zea mays
ccccattattttttgtttccttttagcatgtcttttttaggtacaattggcggccacctcttacgatcggcttggttgagcaaataagaagcgaattgaatcatttgatctgtattctaaaacttacaaatgtactatgcagctggctatggacagtgttttgaagggagaaacgttgaactatacactcgtgttacagctaactatgattacaacaaacaatagcctctggagcaacaaaatactttactgccacccgctatgcaacatcaaaagtaaagacctttgctgtgtatctatatatcaccgtccgctaaagattactccaatctgtggttcttaaaggaacgtactttgaacggtcatcttcaattcctctgaagccggttgttcttgatgagaccataggcatggcaagcacggacgaagcgcttattgtgtcctccccaaggccaagggacatggagcatgcagactttgccttcaacagtacacgttttgcttttgcttttacagaagtgacaaacgagttgctatcatctgtgtctgtctcctccatctgcatctttccatttctgtccatatcaattatagattcctcggcagtgctcgaaccatctttcgtatcagctttagtgtcatcgggtgctagcaaggagatcccaacaaagacaaatgtcatgcccaatacaaccataattatcctgagcgtatcaaatacttgatattcttgaaagtaaacaaatcctgtacagatagagaagaaggtccaagcaatttgaaacattggaacaatcagtattgcatcaaataatgacaacccttcattcaatcttcccatccaaaatccagcggtacacagaaacagaagaacaattgagtatgtgaaccagctatgaaactcgtatctgctgttcatagtcagcctcatcatgttagacaatgactttgcaaacaagactgagcaagacccaatagcaccagatacaacagcataagaaaatggcaacattgttcgccaatatgtgccagcattttttgaactatttgaaataatagtttctccactcctgtagagatagtggttaaatgcaacaacaaagaccaatgacatgcaataaagaacaaacaccaaattgctgtattttgctatcagctgctccggcgtgtaaacaggtgattgatggttgccacccggcccgccgcgggggtccccatggactataaatgttgtggctaccatgactctggaaagaatagcagaagcttcatagtcacatgattccatgtagttattgtaattttcattccagctaccagaaagtgagaatcatacatacttcactgaaatagtcttgttcaaaacaaagtaggcaaaagcaatgttggacacaaactggattgatccaagagctgcaagtagtgactgtaatatagcaagtaaataatcaatgttcaaaccaaaacactgggctagaaagagaaaagaaaatatgattggatggcattattagctctaagaaacaaggagagatggaaactgtatgactgataagctcttatctttttacccccaagaactaatggaaaaaaaacagggcgcaaatacagggcgcaaatacagtctccatgagagttttattctttacatgtttacacaaccattcatgagtttcccatattatattacatcctacatgttaaactaatttttcttttgaggtctcgaggacaacgaaaagaacctgtgcagcataagcaaatgacatgaagttgaggcagttcccagcagcaaaaaaaagtatacctgaatgcagatgtagcattaaagttggtcttgattaaaagactctaaaattagtaaataaattctagcagacagggttacctattctccaagtctggaaatgcattacagactttggaacgaatttttcatttccctcgctgttgttaattaaggaaagcttttctctctgatcatggcccaacttcagaaggttggtaccaaagtttatgccaacactccccacgatgtttatcaacgcccctataatccagtcgcccatgaatcaagtgtaaagttatctcctacaaatatatgatatgctccttccacaagccacttgtacaacagctccttgctcttgtttttgacatagggacttcaattcattgagaacattctctctttccctttttctcttctgcataggtctattcaccacagtagtgtgtcacaaacctctccaagatccccttttctcttctttgtgtaggtgtattcagcctagtagtctatcacagacctctccaagaaccactgtggagctcagcctggtgctgctcgacgctggcgaagggcccggagaagacctgggcaccaagtgtatggcggcagcgacctcggcccgaagaagacctgggcacctggcgtaatcgtcggcaagggagagaagaagggggggaagggaggagatctcgggagggagatagagctagccctgggcgttcgggattacccccg

SEQ ID NO: 19749 - DNA, 1584 bp, Zea mays
catccatttcttgatctacatcattttgtgcatcatgaaatccattgcccttggcttcaaaataccattcgccgccgcccgcgccggtaccactatcttcaatttgaggttcaggtgacaaggaacatctgaggtgttcatcatgaaaaatgccctcatattcctccaagagagttgcgacaattccttgagcactgtttgcggcgtttgcggcagcaagaagctgcgcagaatcatcaccatccatatcaaatacctcatccatctcacattcaccagccagaagtggacgcaacagaagaggcgccatacaggcagcaactgccgatgcagtcattcgattttcagaggtgtgagatgcaacagtgtgcatcatttttaaaattctctgcagcaacctccgattgggctcaggaaatgtctcagatatagctgaacgcatagcatttatcctagcatccttagtctccaggcgaaacgcttccaataatgctgtacagcaagaagcaggcacgggggatgatggcagctctcggagaacatgctttacacagtcaccgacaacatgagcgtcttcatctgctgaaaactcagtccttccttgttcatattcttgcaacctcctgtcaacttcttccacatctgcagactgcctcaaaattccttccacctttattccatgtttctcaagaaagcgcagggctttttctaaaaaagaagggctgccatcaatatcctcaagtgcaagcagaattggcctgcctgtcaccaatgacttgatcggtctcttctctctccaatttggaatagctccttcatatgtgtcacctgtgtcatccccaaatatcccattatgtcccatcacaagagctgcatttggagcttgtgcaagagcttcttccaatgctgttttccactcaaacaagtcttcagaagtttctgccttaagagtgaatgcacgaccatcacggccatctgggaaaagtacagtcaataacttcttgtcttctctgactaccacactcccagaattgttcaaatcaatccctcctagagtaacattcacttcaccacctctctggggcaaggtactaggatcactcttgaagaaaaccaatgatgttcttgtgaggatgaaccaacgtttcttccatgatttccatccaatccctttggatgatatgaaaagaggcccactcttgaaaaccgtgttgccgttggccgccgcggggccgccacctccgcgctgctgataccgctcgaacgccgcccccgccaccggcgcagacgacatccctgtcccacctgcgccagcgccgccgccgccgccgccgccgccgcctcagatcggcagctcccgcgctacggcagccgctgcattggatccggagcagcagcagtgggcgccgccgccgatctggcgcgcctcggaggggcggcggttagggtttgggttttgtgcggcggcttctgcagggggaggcagaggcggagaggaggagcgggtggtggtacggcggggaaagggaggaaaggaaagcgacgcagacggccccgccccgaatgcgatcctcgtgccgaatt

SEQ ID NO: 19750 - DNA, 2654 bp, Zea mays
ctatctatgtcgcctctagatgcccaggtcttcgtcgtgttcttctccggcaacgaataggcatgtccgcctcttccattctcttcctgctctacattctaattatttataattaaagaaaaaaaagtaaaaaaactgatattcgaataagtatccgtttacctccatgtatatattgtaaaaagagaattcagcattctttctctaaaatttggcagaaaatatcagcgtagaataactctgacctatcacatattcacagcaagacaaagaagttacatatcttggcatgttccgcatgtacaagcagattagcatagagccaagtccctaattggagttcggcgcgtcccctgagttggaaccttgcacgctcggcagtggtgccctagactccaagtaaaagaccgaaagcaacagccattattgccgtgcgctgttcttggcagacagccaagatgcgaacgccactgcggcaccggggatccgaatctgatacagtcctcgagcctatacttgtagcctgtacaagtaagtgcatggcgacaggttctacgtcagacgccactacggtggtcggactcgccttgaagcttcagctagctgccaacctctgttctgacctgacctctggatgcctctccctttcagagatcagcatcggcgtaaaaatgactggcacaggagagagccgcactgccagccacggaactgtcgatctatcattgctggacatgaaaaatgccacggaaaattcccttcgtaggagttgcattggatacaaggaagggcaaagatgctggtgcttatgcgtatatccgtttcttctgcctgctaatttgttggccttagccgattagtctgcagtcagcacgaatccaggatcagaatctgtaaaataccctaccctggcccaccaacttttacaagtctattacagccaccatatgtgatttatcccaacgatgtgaagtctgaagtgctccaatcacaggccaggcttagtgtcaactccaagcatatgtgcagagcgtgcagtatctgcaacccctgctactgtgtggcccacgtttcaaacttgctatttgaaattcctaggcccaactttggattctgtcacagacacacagccatatcctaattatcagaagaatcttaagagctccagtcagatgacatccttcatatgtgttaacttaggaagtatggtaccaaataaatctggataccaagattcttccaacagtgttagcaaacacattccctaccatggaacacgttgaaaactcagctgcttctagaccttaataattccaagcatgcttcaccacaagttcccaaacatgacagcaacgacaaattggtcggtttcatggaagtctcaatcagacccgtgttgcacaaaacttgactgaaagttgaactttgtaaccaagtatccatgtttcacaggttctatggctgcactgctagctacagcaaattgatatgataataatttgcagtctgagacaagaaaattggcattacaatctccatacacacctcgtgggcattggtttgaggcatttgttgcattcaggcgcaatgtccatgcaaatgccagaactgacctgaagacgttgccacccacaacagattttttttttttttttgtcaacagacagacttctgattttactagccaggaggggctcttgctgcatgaatgactgaaaacatacaatgcacttacaagcaacgctaccacattgccagctatggagtatttcttagtccgattcgtgtccaagcaagcaatcaacccaaaagatgcatggcgatggatgattatttcagatcacaggtctgaactgcgcttcaagtcttcaactgatgatgcattagtcagaccgcgagttttcacgcaacggcataccggcgcatgagcccggccacccgctcggcaacgtcaacccggccgtgcacgcggcacgcggcgaggagcgccgcgaagatgaccctgtccgggcgcgcctccatcccggccacgagtcgctcggcctcctccacctccccggcgcgccccagcatctccaccatgcacgtgtagtgctgcagcgcggggcggcgcaccctcgcgaacacgcgcctcccctcggccaccatcccggcgcgcgcgcacgccgtcaggagcaccgtcaccgccctgtcgtccacctctgcctccgggacattgagcagatccagagcctccgcgcaccggccgtgcgccgagagcgcgccggcgagagcggtgcgggacgagagcgttgggggcgtttcgtcgaacagggcgcgcgcggagtcgaggtctccgcaagcggagtagccttggatgagggacgacgcgaggagggcggggactccgcggcggagcacggcggcgtggagggaagccaccagcggcagggacggcagggctgatgcccggcggaggaacgcagcgtagcgcccctgcaaccgcattgatggatacaggatgctgttggcacggacatttgccctgttttgcttgcgcaaagataaaggggttaaaaatgttgtggtcggcccatgggctattagtggcccgtggattggaccaatagcaatagtatgaaaaagactatggagctgcttgaaattcaaatagc

SEQ ID NO: 19751 - DNA, 1434 bp, Zea mays
aattcggcaccaggttcacatgtaaacacaaaaataatagcccaaattcaactcatatttcagtagcaacaagctaaaagctgacaaatgctactccatctaatcttaatcttccaaaaatttgttgtattctaaaacttacacatgtatatgcagctaggtatggacagtgttttgaagggtacaacggtgaactatacactcgtgttatagctagctacgatcacaacaaacagttgtgcctttggaagcaacaaaaaaacttcactgccattcgctaggcaacataaaaaacaaagacctttcctgtgtacctatatattaccatcggctataggttactccaatcagtggttcttaaaggggcatactttggacggtcatttccgattcctctgaagccggttgttcgttcttgacgagaccataagcatggcaagcaccgatgaagcgcttatggtgctctccccaaggccaagggacatggagcatgcagattttacagaagtaacaaaggagatgctatcatctgtgtctgtctcctccatcggcatctttccatttctgtctatgtcaattatggagtcctcggaggtgcttgaaccatctttcctttactggcatcgggtgctagcaaggagatcccaacaaagacaaatgtcatgcctaacacacacataattatcctgagcgtatcaaatacctgacagcagaaaaacagattcatcagtttataattaggaaatgcatgattcacttcattatccgattataataaacaagaacttacttgatattcttgaaagtaaacaaatcctgtacaaatagagaagaaggtccaaacaatttgaaacattggaacaatcagtattgcatcaaataatgacagcccttcattcaatctttccatctatcacatagggcatacggaacttgtagtgctagcaaatagtgttagcaaatacattccctaccatgtaacatgttggaaacttagctgcttctaaaccataagttcacatacatgacagcaacgacaaatcgatcagtttcatggaagtctcaatcagacccttgttgaacaaaacttgactgaaagttgaattttgtaaccaagtatccatgtttcataggttctatgcttgcactgctagctacaacatagagaagacagtgaaatcatagtttttatttataggatagtcttacataaaatcacaagatcacatgaattcaatatagttttattttataaggtagcccatgaattcatcaattcaaccttttcttttgtacaacagcactaataaatggcatcaaagtgacaccttttctagaccccgtacatccagtgcaataacttagctccttcctttcattccttcatctagagattgatcggacgcgtgggcggacgcgtgggcggacgcgggg

SEQ ID NO: 19752 - DNA, 1335 bp, Zea mays
agatccctctcagcttgtagttgttcttgcaacctggagacatccggtccaaagccaatctgcgttcatgtagcgcttgttttcttctttccaaactcgcctgtagaattgcattccctctagcctcttttgcaattctgttttgcagatcattcttcgcaatctctagtctttgaatagcaagctcttcttctccagatgaatcgactgattcagagttttggcccttccttgcattattcctcccccaaaaattactccgtttcacatgtgggtgagatccattagttttgtttgtctgtctctctacagaatattcaggactatgggtcggtacagaaattccaggatcaaaagaagaaaggatctcccccatagacaaagtctcatgaccaactgttgggttagaaggattattttcgcttagtaagctatccacattcgctgaaccgttttcagttgaaaggctgttctgtactttgctcaaattcaaatttccttccaacatcttcacagggcgttcagcatctgactcctcagcattgactgccttgtagtcatagaggtcactgccagcatatccactgctctcactcaatttcccactaagtatacgctccacgccattgtcatcatccatttcttgatctacatcattttctgcatcatgaaatccattgcccttggcttccaaattaccatcatcagttgatgcttcagtaccactatcttcaatttgagattcaggtgacaaggaacatctgaggtgttcatcatgaaaaatgccctcatattcctccaagagagttgcgacaattccttgagcactgtttgcggcgtttgctgcagcaagaagctgcgcagaatcatcaccatccatatcaaatacctcatccatctcacattcaccagccagaagtggacgcaacagaagaggcgccatacaggcagcaactgccgatgcagtcattcgattttcagaagtgtgagatgcaacagtgtgcatcatttttaaaattctctgcagcaacctccgattgggctcaggaaatgtctcagatatagctgaacgcatagcatttatcctagcatccttagtctccaggcgaaactccaaggtccagcctggctctgacctgcaccacattcaacaggccttggaggctttcctgagtccattgctgatgaaccccgcttattgaagccattacatgatgacacctctgcctcctttactatagtagtaggaggggaccgtggtgagcatgttctacttttggcttgcccctgaacctgatggcccttagcagtcccttgcagaatctgaatcatatc

SEQ ID NO: 19753 - DNA, 2023 bp, Zea mays
ggccgcttttttttttttttttttgtaaaagattttgcaattctatataagatggttacaacatgcaaccactgaaatggttgcgcaattcagaggcgaatcgaatcatttgagttgtattctaaaacttacacatgtatatgcagctaggtatgggcagtgttttgtagggtacaacggtgaactatacactcgtgttacagctagctacgatcacaacaaacagttgcctctggaagcaacaaaaaaaacttcactgccatccgctaggcaacatcaaaaacaaagacatttcctgtgtacctatatattaccaccggctataggttactccaatctgtggttcttaaagggacatactttggacggtcatttccgattcctctgaagccggttgttcttgacgagaccatcggcatggcaagcaccgatgaagcgcttatggtgctctccccaaggccaagggacatggagcatgcagactttgcctttgaaagtacacgttttgcatttacttttacagaagtaacaaaggagatgctatcatctgtgtctgtctcctccatcggcatctttccatttctgtctatgtcaattatggagtcatcggcggtgcttgaaccatctttcgtatcagctttactgtcatcgggtgctagcaaggaaatcccaacaaagacaaatgtcatgcctaacacaaacataattatcctgagcgtatcaaatacttgatattcttgaaagtaaacaaatcctgtacaaatagagaagaaggtccaagcaatttgaaacattggaacaatcagtattgcatcaaataatgacagccccttcattcagtcttgccatccaaaatccagcagtacacagaaacaggagaacgatcgaatatgtgaaccagctatggaactcgtatctgctgctcatcgtcagtctcagcatgttagacaatgattttgcaaacaagactgagcaagatccaatagcaccagatacaatagcatatgaaaatggcaacattgttcgccaatatgtgccagcatcttttgaactatttgaaataatagtttctccactcctgtagagataatggttaaacgcaacaacaaagaccaatgacatgcaataaagaacaaacaccaaattgctgtattttgcgatcagctgctccggcgtgtaaacaggcgattgatggttgccgaaggatactaagaagatgttgccaaagacaataaacgttgtggctaccatgactttcactgaaatagtcttgttcaacacaaagtaggcaaaagcaatgttggaaacaaactgaattgatccaagagctgcaagcagtgactgtgcagcatacgcaaatgacatgaaattgaggcagttcccagcagcaaaaaagagtatacctattctccaagtctggaaatgcataacagattttggaacgaatttttcatttccctcactgttgttaattgaggaaagcttttctctctgatcatggcccaacttcagaaggttagtaccaaagtttatggcaacacttcccacgatgtttatcaacgcccctataatccaatcgcccatgagtcaagtgcaaagttatctcctacaaatatatgatatgctccttccacaagccccttgtacaacagctccttgctcttgtttttgacatatggacttcaattcatcgagaactttgtctctttcccattttctctctttttttttttttgagtaggtgtattcaccccagcagtctgttacaaacctgaaacctctgcaagaaccactgtggagctcagcctggtggtgcacgtcgccggcgaagggaccggagaagacctgaccacctggcgtggggcggcagcgacctcggccgaaaaagacccgcgtacctggcgctggtgagcgtaaacgtcgccaagagagaagggagggagggagggaagaagagaggagagcgcgggagggccggccgccccggccgagatagagcgcgcacgctgaaaggaaatggaac

SEQ ID NO: 19754 - DNA, 3119 bp, Zea mays
ctgcagtggcacgtcctgcactaaacaaatccaacacggcgtgctctctcgccattaaaggcacggtctttctctctccttcgctcctttctgtttctctctccagagtggagtggttggtgctctcagtcccaggacccagggtggccgtggcctctgccaatagggccgggccggggctccaccgcacaccgggagggagagatggtgggaacgagcccagggggaggagtgttctgtttctcctccatggtctcctctcctcggctcctcttcctgctcctcgccggcgcctcgctatgctgtgtggcggcgcagaagacggacacgctgcggcagggggagtcgctgtccggggcggcgacgctggtgtcctcgccggagggggtgttcgaggcgggcttcttcgcgccggaccccaagcagccttctcgccagtacctcggcatctggtaccacagcatctcgccgcggaccgtcgtctgggtcgccaaccgcgtcgcgccggccacctcggcctcgccgtcgctcacgctcaccgtcaccggcgagctccgcgtcctcgacggcacggcggccaacggcaccgccgacgcgccgctgctctggtcctccaacaccacctcgcgcgcgggcccgcggggcggctactcggcggtgctccaggacactggcagcctcgaggtgcgcagcgaggatggggtgctctgggacagcttctggcacccgacggacaccatcctgtccgggatgcgcatcaccttgcaggcgccagggaggggccctaaggagcggatgctgttcacgtcctgggccagcgagacggacccttcgccggggcgatacgcgctcggcctcgacccgggcaactccggtcaggcctacatctggaaagatggcaacgttacgtactggaggtcgggacagtggaatggggtgaattttataggcattccatggaggccactctacaggagtgggttcacaccggcaattgatccagtgcttggaaattattacacatacactgcaacaaacacttctttgcagaggtttgttgttttgccaaatggcacagacatctgctacatggttagaaaatcttcacaagattgggagcttgtctggtaccaaccatcaaatgagtgtgaatactatgctacatgtggtccaaatgcaaaatgcactgcatcgcaagatggcaaggcaaaatgcacctgcctaaaaggttttcatccgaagttgcaggagcagtggaatgcaggaaattggagtcaaggttgcatcaggagcccacctctgggttgtgagaccaatcagtctggggatggatttcttccaatgggaaacataaagtggcctgatttctcatattgggtatctacagtgggagatgagcctggatgcagaactgtctgccttaacaactgctcatgcggtgcttatgtttacacagctacaacagggtgcctagcctggggtaacgaactaattgacatgcatgagttgcaaacaggggcatatactctaaacctgaagcttcctgcttctgaattgcgaggacatcacccaatttggaaaatagccacgataatatcagccatagtgttatttgttttggctgcttgccttcttctgtggtggaagcatggtagaaatattaaagatgcagtgcacggaagttggagatcaaggcattcgtctacccaatcccagcagaatagtgctatgctggacatctcgcagtcaattcgttttgatgatgatgtggaggatggaaaaagtcatgaactcaaagtgtactcgctggaccgtataagaactgctacaagtaattttagtgactctaacaagcttggagaaggaggatttggtcctgtctatatgggaactttacctgggggagaagaagtagctgtgaagaggctttgtaggaattcaggtcaaggccttgaagaattcaagaatgaggtcatacttattgcaaagttgcagcaccgcaatcttgtaagactactagggtgctgcatacagagggaagagaagatcctggtgtatgagtacatgcctaacaaaagtctagatgcattcctctttaatcctgaaaagcaacggcttctagactggaagaaacggtttgatataatcgaaggcattgctagagggctgctatatctccaccgggattcgaggctgcgagttgttcaccgtgatctcaaggccagcaacattctcctggacgcggacatgaaacccaagatatcagattttggaatggcaaggatgtttggaggggaccaaaaccaattcaacacgaatcgggtcgtcggtacatttggctacatgtctcctgaatacgcaatggaaggcattttttcagtcaagtctgacgtctatggcttcggagtcctgatcttggagatcatcacaggaaagagggctgtgagcttccactgtcacgaggactccttgaacatcgctggatatgcgtggcggcaatggaacgaagacaatgctgcggagctgatcgatccagtgataagagcatcgtgctcagttcggcaggtgctgagatgcatccatattgcgttgctgtgcgtgcaagatcacgcagatgagcgacctgacatccccactgtcatccttatgctgagcaacgacagctcgagccttcctaatccgaggccgcctacgctgatgcttcgaggccgtgagatcgaatccagcaagtcaagcgagaaggaccggagccactccattggcactgtgacaatgacacagttgcatggaagatgaagtataacacgaaaaatatactgaatttgtgatatatttggttttttttgttctcccttcctgatgttgataatttgccatttgtcgcggattagtttcctctttttctccttttcatgacggcgaccgcgaagttgtatgaaaatcacattagcgtcatacattaagtgacaattaattttgcaaaggtgagatatttaccaaaaaaaaaaaaaaaaaaactcgtgttgttcggttatttcaattccatatggattgaaagtgtattaggatgtattttgatttgctatggatttaaaccgtctcaataaattatctcaaaa

SEQ ID NO: 19755 - DNA, 911 bp, Zea mays
  misc_feature (21)..(21): n is a, c, g, or t
  misc_feature (55)..(56): n is a, c, g, or t
  misc_feature (59)..(59): n is a, c, g, or t
  misc_feature (860)..(860): n is a, c, g, or t
aaatctggagctccccttggnggggggggggggtttactgtagtttttgaggggnnggngataacacaccccaccatgggctagaacagcctcatcctctccagccgtcggacgccgctagctcctgcgttgggcatccgggcatctgcctcaatgctgtcgttcgaccctcgccccaccttcgtgctcgtccctggagttcacccaggctgcgcctcctctcgccggagctcaccggatgccgctccctggacgggctcccctgcagccacatcgtccgcaccccctcctgctcactggcgctggtgacctcgccgtgccaaagcgtcgagctcctcccgtccgtggcggttgccagttgtcgaccctgcttggactccacctcgccaagctgcatgggacgcgctccctatcccagcgctgcccccttcccctgctcggtttcaacaccggcgcccatccccagcgctcacctctgctcctgccatggtcgtccatggtgtgtcaacacccaagattgtgcatccctccttgttcggcctcggtaaaactctagacgctcggacttcaccttggcactcctctctgtttcctctatgccgcttgtcgtcggctagattcacccggtcatagcgccctgtgacatctagcaagccgtgcgtcgtcgatcgtcgtcctcctccgggctgcgcgctttgcctgaactgctcggtggtgatcctgtttaggccccaacatcggcaccacacatccctttttttggtgttcgttgccatcgactcagcacagtctgtcgagcttggcgtcctcgacctcaagccttgccaagtcgtgagaggggagaaatcctgaatgtttgngagaaagtgaaggataggcgtgcacgcctgccaggtgttcggtgttatgca

SEQ ID NO: 19756 - DNA, 2162 bp, Zea mays
gaatacgctggtagcaatttttagtatggtatctgacccccctcgaacttaaacaaacataatttaacgttatgaatgaaccaaccagtgaagccagatacagaaccaatagcgcacaactcaaatctgcgttcccaaatggcctactctactgaacaaaaaaaaaaatgcatcggcatcatcgatcacgatatacgtttacagagaatcgttttatcggctgtaacaggttcctctgtcatcacagttaaacaaggtttaagtagcaacagaaaggatttggactcggtgtaacaaagctctctttcgcaagtggccaagtatgcaaatttggcgcgaacttatttacgtccctgaggagcttcgtaactgccagcattggagcctgctcgcccagatccataggctggaggctgcgcagccaacccatagggcgaggacccctgcgcagcggtgaagggagactgcgcctgtgctagactgtaggatgatggtagctgtgtgtgcccatacgcagatggtgcctgcgtttgtccatatgatggttgcgcctgagctgaaccatagggacgcactgctgctgctgctgctgcgccataggatgtgtttgacccagatgcgtaggatggtggcacctgtacagatccgtagggcgatgcagattgtccccacgcatgtgctgcctgattggacccgtagtaaccagcaatgcccccatgagccgctgtagctgacgcctgtccagttacatgcgcctttgaagcatcatacccagaacccttcagagagtcaaagccagtggcaccccttgatgcatcatgggtcccagtttttgaagagctgagattggcaacatgagaaccatcatatgcattgcctcttgatgggtcaaatccagaacgaaggccagcgcctccagggactccacttaagtctgccagaccggtaggagttgcccttgcctgtgtacttccatagccagtatcataagcaatttgtccaacagaaagatggctagatataccatcggccttttgggtggtgctattgtagaaaaaaccacttttgtcaagattagatgtgtccctcaactcagcacgaagtttttcaagctccgtaaccatggagtcataattcctcttcatcgtctgcaaagattcggagtgatccaccctgagtttcctttcgtaatcataagtactcctgagatgctgattttcttgccttgcaacatcccgttcagccaagagcgcggggagctggtgtgcctcaccgaggttcctctgcaggtccttgctcagcttctgcacgtctgccaccatgttctgcctcatggccacaaggctctgcgcctcagcatgagcctgctgcagctccaccttcacggactcacgggccttcaggtcggcctccatcttcccaaccttgtcaaggaggcccctcatctcctcctcctcagcggctttcgcggcctccccctgcgcctgcagcctctgcagctcctgctgcgccgcggctagctctttcctcagcgaggcgtggcttgcagcaagccggccgttctctataaccagcttctgcatttccccgtgctgtgccacaagcttctgctccaggacctccggtgggggcagcggaggcagcatgtcgtaggggaacggagcgggcccgtgccccagcggtggtaggtgcatcctcggccccggcggcccgtactgatcacggacctcccggtgcatcatcccatgtcccgtgggaactggaccctgcccggggccagggagcgcccggtggtggtaagggggcaggccggcggcaggcttaacgtggggcatagggttcgactcgatctgcaaatcttctggaaaataattctgcgagaacaccctagggcaccgattctcttctggcgtcaactcgggtggagcttccgcgatggagaagagaacgagcaaaggaaggaatggacctagcctggatgaatgcccgctccacggtggtccagtacccacagaggcggggaggagggacagattccggcgaaaggagaactggcctgttgtgccccggcggtgagtttggggataaaaatcagggacgaagaataatagtcccgcgccgacgcgaaggtcccctgtcaagtatttagactagtttaaaat

SEQ ID NO: 19757 - DNA, 2280 bp, Zea mays
ttttttttttttttttttttttttttcggttgaacttaaccaaacataatttaacgttatgaaccaaccagtgaagccagatacagaaccaatagcgcacaactcaaatctgcgttcccaaatggcctactctactgaacaaaaaaatgcatcggcatcatcggtcacgataatacgtttacagataatcgttttatcggctgtaacaggttcctctgtcatcacagttaaacaaggtttaagtagcaacagaaaggatttggactccggtccggtgtaacaaagctctctttcgcaagtggccaagtatgcaaatttggcgcgaacttatttacgtccttgaggagcttcgtaactgccagcattggagcctgctcgcccagatccataggctggaggctgcgcagccaacccatagggcgaggacccctgcgcggcggtgaagggagactgcgcctgtgctagactgtaggatgatggtagctgtgtgtgcccatacgcagatggtgcctgcgtttgtccatatgatggttgcgcctgagctgaaccatagggacgcactgctgctgctgctgctgcgccataggatgtgtttgacccagatgcgtaggatggtggcacctgtacagatccgtagggcgatgcagattgtccccacgcatgtgctgcctgattggacccgtagtaaccagcaatgcccccatgagccgctgtagctgacgcctgtccagttacatgcgcctttgaagcatcatacccagaacccttgagagagtcaaagccagtggcaccccttgatgcatcatgggtcctagtttttgaagagctgaaattggcaacatgagagccatcgtatgcattgcctcttgatgggtcgaatccagaacgaaggccagcgcctccagggactccacttaagtctgccagaccggtaggagttgcccttgcctgtgtacttccatagccagtatcataagcaatttgtccaacagaaagatggctagatataccatcggccttttgggtggtgctattgtagaaaaaaccacttttgtcaagattagatgtgtccctcaactcagcacgaagtttttcaagctccgtaaccatggagtcataattcctcttcatcgtctgcaaagattcagagtgatccaccctgagtttcctttcgtaatcataagtactcctgagatgctgattttcttgccttgcaacatcccgttcagccaagagcgcggggagctgctgtgcctcaccgaggttcctctgcaggtccttgctcagcttctgcacgtctgccaccatgttctgcctcatggccacaaggctctgcgcctcagcatgagcctgctgcagctccaccttcacggactcacgggccttcaggtcggcctccatcttcccaaccttgtcaaggaggcccctcatctcctcctcctcagcggctttcgcggcctccccctgcgcctgcagcctctgcagctcctgctgcgccgcggctagctctttcctcagcgaggcgtggcttgcagcaagccggccgttctctataaccagcttctgcatctccccgtgctgtgccacaagcttctgctccaggacctccggtgggggcagcggaggcagcatgtcgtaggggaacggagcgggcccgtgccccagcggtggtaggtgcatcctcggccccagcggcccgtactgatcacggacctcccggtgcatcatcccatgtcccgtgggaactggaccctgcccggggccagggagcgcccggtggtggtaagggggcaggccggcggcaggcttaacgtggggcatagggttcgactcgatctgcaaatcttctggaaaataattctgcgagaacaccctagggcaccgattctcttctggcgtcaactcgggtggagcttccgcgatggagaagagaacctagtcgaggaatggatggatgaaaggggttgtaatagtagtagggcatgaatccgcaaatgcggagtgggatttagattcaatggagcacgaaacaaactcgtagagcaaaaatcagggtcacttacgagcaaaggaaggaatggacctagcctggatgaatgcccgctccacggtggtccagtacccgcagaggcggggaggagggggaggagggacagattccggcgaaaggagaactggattgttgtgccccggcggtgagtttggggataaaaatcagggacgaagaagaatagtcaagcgaaaacgggaatttcttctgtcaagtatttagactagtta

SEQ ID NO: 19758 - DNA, 695 bp, Zea mays
cctgcgcctgcagcctctgcagctcttgctgcgccgcggctagctctttcctcagcgaggcgtggcttgcagcaagccgcccgttctctataaccagcttctgcatctccccgtgctgtgccacaagcttctgctccaggacctccggtgggggcagcggaggcagcatgtcgtaggggaacggagcgggcccgtgccccagcggtggtaggtgcatcctcggccccagcggcccgtactgatcacggacctcccggtgcatcatcccatgtcccgtgggaactggaccctgcccggggccagggagcgcccggtggtggtaagggggcaggccggcggcaggcttaacgtggggcatagggttcgactcgatctgcaaatcttctggaaaataattctgcgagaacaccctagggcaccgattctcttctggcgtcaactcgggtggagcttccgcgatggagaagagaacgagcaaaggaaggaatggacctagcctggatgaatgcccgctccacggtggtccagtacccgcagaggcggggaggagggggaggagggacagattccggcgaaaggagaactggattgttgtgccccggcggtgagtttggggataaaaatcagggacgaagaagaatagtcaagcgaaaacgggaatttcttctgtcaagtatttagactagttaaaaaat

SEQ ID NO: 19759 - DNA, 3000 bp, Zea mays
atatatatatatatatatatatatatatatatatactcgtatctatttaaatcatgtccgacacaattcgataatatttgtatctaatccgaatttgaagataagatatgaatatacaactatggaacaagcaatatcaattcatatgtccgccatcgtaagtctttaatcgtagcttaataacaatgcacacagctgtggccgcttgtttttttttttttgtcggagcagtagaaggcggtatagattaaagcgaagcaaaaacgctaaaaaatccagacaagaatatgcacaaacaaataagagcagcttaaacaacacacgaaattattgcagtactgactacagctgaaccaacaagccaaaagcgttcacaacaattgccagtcaccactttacaatggacttaaaccagtacaacatgaaggttgaaatgtttatctagacaagaaaaggcacaataagaatacaatgggccgaaacgcggcctgtttatgtacaaacaaactgaccgaatctgctgatggaaaagcactagctttgaagcttctccaaatcggcgttcctgaagctgccaccgataagtgacaggaggccaccaccatggaccctcccctcgggaacaacatgacctccctctctgcctccatctacaggctcagtcgaccaagaaggcatcatagagcgaggaaccagcacctgtggaggaatcattgattggctcctcacagtgccgtcgcagtcggaagcggtgctgacaccagaggacgagtgctcgttcgtcatgctgcttgctgcggtggcagatgacacaacaatgccgctgaagagacctggtccaatcatgcttcctacattcttcgccgcctcttgttctcgctgcctggccatcaaggtaccatgtgccgcacagaagccactcttgccacgggagaatttttcacagcctgtgccccatgtgcaccgctttcctccgccatgggctttgcagaagtccgtgctcccctgggcgctcttgccacagttctcaaccttgcaccgcttgccgccaccgtgcttcacacagcagtcagtgcggccacgagcactcttggtgcagccgggcacggaacagcgctttcctcctccatgcgccacgcaatattcagtagccccgtgcacactttttgcacagacaccacctccttcaaacatgcaccgcttcccgccaccatgtgctttgcacagaggtgtgctaccctctgcgcctttgctgcaaccatcgaagacgcacctcttgccaccaccatgtcccttgcagtacaatgtgctgccctgtgcccccttgccacaatctggatactggcaccgtcgaccaccgccatgagaaatgcacaatccagccttcccctccgcactccgaatgcaacctttaaccaaacacctcttcccaccaccatgcttgatgcaccgcccagacttaccccgggcagctttaggacagccaggatgttcgcagcggcggcctccaccatgagcgggggggggggactagtgagctcctgcgcttttggtacaaccaagttcctcacaccgacgaccgccaccgtgggctttgcagtatgcagagctgctctcggctcctttatggcatccaggtttatgacatctctgcccacctccatgggcaatacacaatcctgatgcgcctcttgcacctttggaacatcccttgaacctgcatttcttaggatgtcgagaatggctacgttctgatgtagttgttgcggtgacaacatcagaactcacaccaaatgaagactcggtcattgcagagggttcagggctgaactggaggtgacgttgaatatgctgactgttgctggtgctgtgcgtgaggtttagagaatctgggatttctaattgtgtctcattggcagtaggattggagcggggagcaaagagtagggatggcatgtaaccacccatgctccttacagtagtagatgttgaagcctcgtcgacaatacctaaagaatggagtgctccattcggtgcttgcagacattgaattgctcccccaccatcggtgtgaaggccaagcctcagcatccctgaatcagtgaaagttgaactctggcctgacaatctctgagcttgttttgagccagtggacactgcagaataaaaattcggtgttggacccaaaccaaggactaacctgctgccatcatctctcgctgttatgtcattcattatctgtgtatttccattaacatggctgcaattaacaattgctgggttcaggccatccatacagagtgtgctttggcccatgttctccaccgtggagcttggcgctgagcatcccactaacacaaaggggtcattcatcagaggcggatgggggatgtccatgaagccgttatccatcacagttaagacaatataccgatggtggaaaagaaaatgagataaaacaccagagatctcaaagaacagggggcctgatgatatttctgcccaggcagctgcagcgttactgacgatctttcagacacggactgtagaatagacgaaatgaaagaatatcagcaggagtgtagtaccaaagcaaccaccactgacaaaccctgatgtgtctgcacggtccataattatcttgtctatgtagaatttatgatccaaaactgcataactttcccagcactaaacaatatctctggtggttgacatcttgcataggcaggagcatccaaattatgtgtctgcacaatcttaaagctctcgctgggacggcggacggaggacgggcggcctctcggcgggcgaggaggggaagaggaaatcgctgggaagaggagagatggagtggtgttttgttttggtggactacctccggtgcctcctgtattctgatgaaccgagcagggaccacgaaggctctccgcttacaggtggaattggaatgcagctgtgccgccccgccgccagaagcgagattgatcctcgtgccgaatt

SEQ ID NO: 19760 - DNA, 6627 bp, Zea mays
  misc_feature (5597)..(5597): n is a, c, g, or t
  misc_feature (6506)..(6506): n is a, c, g, or t
tgtaagcgtggtgtgtttctaacaagtagtagctgtgccaaacggtattattaacattttgcgcttatcattataaaaccatagtgccaaagaagaatgaaacgtcaaaaaaaggcaggatcggttatatggaattcatgaccaccgcaaacgaagtccaataaaattaataacagtgcacaaatagaaagtcgtttaaatacaactttgcatttgtagagtgcattgtttaaagagtgaggtttgaaataaagagtggaatataaaggctacttgagacagactaacctgggccgggaggctgtttttttcctgttttttcagaaaattgacattcgacactttgcaatagaaagtccagacgagtttcttaagaatacgcacaaacagacagactacaaccgaaccgaaccaacaagctaaaagtgttcacgacaattgacagtcaccactttacaatggactaaaccagtattgatttaaccggtacatgaaggttgaaatgtttatctagacaagaaaaggcacaataacaattctataggcgggaacgcggcctgtttatgtacaaacaaactgacaaaatcttcaaagcttttccacgtcggcgtccctgaagctgccaccgagaagtgacagtaggccaccaccatggaccctcccctcaggaacaacatgacctccctctctgcctccatctacaggctcagtcgaccatgaaggcatcatagagcgaggaaccagcaccagcggaggaatcattgattggctcctcaccgtgccgtcacagtcggaagcggtgctgacaccagaggccgagtgctcgttcgtcatgctgcttgctgcggtggcagatgacgccacaatgccgctgaagagacctggtccaatcatgctccctacattcttcaccacctcttcttctcgctgcctggccatcaaggtaccatgtgctgcacagaagccactcttgccacgggagaacttttcgcagcctgtgctccatgtgcaccgcttccctccgccatgggctttgcagaagtgcgtgctcccctgggcgctcttgccacagctgtcaaccttgcaccgcttgccgccaccgtgcttcacacagcagtcagtgcggccacgggcacttttggtgcagccgggcacggaacagcgcttccctcctccatgcaccacgcagtattcagtagccccgtgcacgctttttgcacagacgccgcctccttcaaacatgcatcgtttcccaccaccgtgtgctttgcacagaggtgtgctaccctctgcgcctttgctgcaaccatcaaagatgcacctcttgccgccaccatgccccttgcagtacaatgtgctgccctgagcccccttgccgcaatcaggatactggcaccgtcggccgccgccatgagaaatgcacagcccagccttcccctcagcgctcctgatgcaacctttaaccgagcacctcttcccaccaccgtgcttgatgcaccgcccagacttaccccgggcagctttaggacagccaggatgttggcagcggcagcctccaccatgagcgatgcaataatctgtttttccttccgcgcttttggtacaaccaagctcctcacaccgacgaccgccaccgtgggctttgcagtacgcggagctgctctcggcacctttatggcatccaggtttatgacatctctgcccacctccgtgagcaatacacaatcctgatgctcctcttgcacctttggaacatcccttaaacctgcatttcttaggatgtcgggaatggctacgctctgatgtagttgttgcagtgacaacatcagaactcataccaaatgatgactcggtcgttgcagaaggttcggggctgagctggaggtcatgttgaaggtgctgactgttgctggtgctgtgcgtgaggtctagagaatcttggttttctacttgtgtctcattggcaatagaattggagcagggagcaaagagtagggatggcatgtaaccacccatgttccttacagcagcagatgttgaagcctcgtcaacaatatctaaagaatggagtgctccattcggtgcttgttgcagatattgaattgcttccctgtcatccgtctgaaggccaagcttcagcatccctgaatcaatggaagttgaactctggccagacaatctctgagcttgttttgagcccgtggacactgcagaataaaaattcggtgttgggcccaaaccaaggagtaacctgctgccatcatctcttgctgttaagccgttcattatatgtgtgtttccattaacatggctgcaactaaccattgctgggttcaggccatccatacagattgtgctttggcccatgttctccatcgtggaggctggcgctgggcatcccactaacacaaaggggtcattcaccagaggcggatgagggatgtccatgaagccgttatccatcacagttgagacaatataacaatggtggaaaacaaaatgagataaaacaccagagatctcaaagaacaggggcctgatgatatttctgcccagacagctgcagggttcctgagggtctttcagacatggatcgtagaatagacaaaatggaagaatatcagcaggagtgtagtaccaaagcaaccaccactgacaaagcctgatgtgtctgcgcggtccataattatcttgtccctgtgtaatttatgatccaaaattgcataacttgcccagcactaaacaatatctctggtggttgacatcttgcttgcataggcaggagcatccaaactctgcggtcgcacaatcttaaagttacaagaaaaaataatgttagataagatccatatatagtaggcatgatcttatttactgattatcagtaacagagtttgccaaagctcaagcaagtgaaatcctggttgtaatgtttacaaagcttaagtcaatacaaagtgaacaatacatgatagaagaaacagtcgagggctagagcctgggacttcggaaataatattattctgaactgaactaaaattaagtcagagcccatcagtaacagtgttcaacagattgatttttttctgtactcaaaatcatttaacagaggtaactaacatgagcggaacctttatttctcaggcatatccccttgagatacccggaacaataatttgcacagatggaatctaaaggagtgtaaattttgacagaatttgttttgttttccggcacttggatgttatctttattagcttaatccagaaaggagtcctgcctagttctatctcagtgctctctgtcagggtttgataatgatagaatcagcaaaccactgtgccgtatgcacataccacatatttctcaagaaaaattggaaacaggataagtaagaaccactggagctacctagagttcagcacacaaaataaggttctccattctccataaggaacataaagcgagagtccatcggaacgcgagctaacaggttgactaaattgagctcaaatgtctgcttagacgatgggcaaactgaagctcttgggatttaggagccactaaaaagaatgcccaataagatgaccagctagttgtaagaagataacattttgggggctgacaaaaataggatttgcttgcaagaactcagaagtgcttagcagtaccatgaaactgttgaccagagagtacagccagctgagaacaaaagcagtaccgtccgaattaaagaacaccccccaaagcagaggccgcctactccatcctaggaccctaaatctcgcagctatcgttctcctcgcaaaagtgtacaaggagagggcacggagtcacgggcacggtcacacagcagatctaataggcgaatagcgccaccgcccaccattagatggaacgcgggagaaaattccccaagcacacgaggtaccccgaagaggggacctggcacccttaatcccgaaagctctcgtacacgtaacaggtaacaccctggcgtagaagcatgcatgcgcatcgtggcctaaggaatgaaggaaaggaagaaaggaggagggagggattgggacggtaggaggcgggagtaagcatcacctcccgcggggacggaggacgggcgggctcgctgcggcctcggcgaacgaggtggggggatcaggaaaccgctgggaagaggagagacggggtggtgttttgtttcggtggactacctacctgcgggctgtggcctgccttctgtgttctgatgagctgagcagggcagggaccacgaatggaattggaatgcagctgatacgaaacgggggcgagattggtagggctccttctcggtgcgggtggggacgtggggtgggagtgggacggcggaacgggtggatgacgacggagttacctgtcaagcctgctggcggccggctccgcggcaccaaacaacggctgtccagctgttcgccggtgagcactaattttcaattgtcgccttttgcctttgacttggcttcaagttctctccccctcccccacctcatgctctgacaacagactcctaggtcgcctcgtctaggcccaaaaaaatacagatccggctgtcccgagctcccgcctcccggggcgtatttttatcagtaatttaaaatttttcaaatttgactaaatatttatataaaaaatacaaatgctcacaatgtgtaataagcataatgatatatctcagagaacatgtttttttttacaaaaaaaaaaccttattcgaagttataaatattggtactgttttttatatgcctggtcaaatttgactccttaagaaacgtggtgtgcgttcgttttgagatggagagagtacaaactaaagcgacctagctcaataacactaaaaacatataattcggtcactaatggtgataaaatagttgcgggagtatataagtggggcatgttacgtgtttctacaattctactatatatttgcaacaaaatcttataaattattataacagaaagtaaaactcttaaggcaagggctgcagcgtgaagtccggtagatttgctcttagatgccagctagcttacgtctttttgctgttgaccccctccaatctatgcgcacgagccggcccctcgctgacccaacggcggcttcgttctccttggagcgctcttctcgtcccctatcattgtcgccaacggcaccgcccagcttcgttctcctcggagtgctcttctcctcgtcccccatcattgtcgccaagcggccgcctgcccaacaccgccatctacatattgtaactagtataatacacggaacactgagcctacacagaaataaaattaccaaattcacaagcaggtaccctgattagaacatttcatcgttggattagtgcaaagtccaaacaattcactacatggaggagcagcgaggctcctgggaggcggctccttggcggcaatgatggcgacgaggagaacaaagctgatggcaccgttgggcaagcgactccttggcagccatgatgggggtgcgatgagaaagaagagcgctccgaggagaacgaagctaacggcaccgctgggcaagcgaggggacaactcantgtgtatagattggagggggttagcagcaaaagatacgttgcacacgatacatcagtcgtttgcacagctgcaatggtgtagctggttgcacacgatacgttgccaacttttaaagggccgctcgaaggtggcgtacagccaagctgtaaaccaagagcgagcaagaaatagcaagagaattttttttatgcaaggacagaggtcgaacccgtgatcagtgaaaggccttgtggaaccttgtgctagagatctccctaagatttctcacttttgtggaaccttctaacatctattctatctcatccactatttcaaatttcacaccacaaacactgttatttgcgatgtaaatctcctatttacgcacgtcatacatcaataataaacataccaagttagaaaaaagttagactaactaaacagtcttacaaacaagctctgtatggacttctgtttcctgtcgatgaactagcatttgggactttctatttgacaatgcgttataccttagttaattacatgagcacttatacatgtttttcctgtttatatagacaattttcgcggagctgcgctctcattcgattgacagcttctacgtgtacagtcttcctcctccgtaggtaagttcaaaatagtgtttcattttatcgtgaacatttatgattatgtgcttttttatgtggactattattactgccgccgtaatgttcattgctttgtatgttgctcagagatagatgtattttttaaaaaaatgctttcaaagttgcttatttgaagtcttgtgatgtcacttttccatgtcgagttaggatatttgttcgtacattgcatctgaaaagcttttcacagatttacctccatgggctttattgtccccatatgagaagtggtttgtgacagtnagcagaaactagataaagcctgcaatggcacagtgattgaatatgttttatgtcaagtcatatacactatttatatataatttaagaatccaaaatcatttttacatcgtaaacagggcgc

SEQ ID NO: 19761 - DNA, 1783 bp, Zea mays
ccatgagaaaacgtcctaccttcaattcggattgttcacggtcttgcaatgcaatggcacgatatgaatattttgtgtggtatttcaaatacacaataataactagtcaaacaaactgattgatggagcacatatatgtagtacgaaaggcaaaactggagctcaactcccaaaggaaacatcatgtattctctcaactccatcgcctcagaaacacaaacgtgtaccacgaccatgcaatgcaaaccgcatgtctactcaacttctctgatgattctccgcttcctgaagggctgcacaggcatgctcccgggagcactgtgctttcgcctcctttcctctttacggctttcagcttcgatcatcgtacgccgtaggttggctgccttgtagattggcttcggtagatgtctatgccttacaatccgcttgacttctgggagatgcttgtaccgctccttcaaagcatcctggtactcttgctttttgcgctcccgtggaagaagaactccaagttgttctgaagctttggacttccacagacgaagatttgtatcatcactgccagagactaaataggtcccatcataggtgtacttcacacaaaacaccctttgcatcctcttggtgtggtaaatctctctgctgtggtctccaagataattaaaaatccttactgttctatcatatgaaccagtgacaaattcacgccctgttggtgagtagtcaatatccatcactgctgaaacatggcctttgtgaacaatttttgcttcatctaattttctagcatcaaaggagtaacagtttgtgtcttcatttgcagcagtgaagttcataggctctctagggttccagcatactgaattgcaccttgtcttcattatcagctttctagctggagatgacatacgcaagtcatagagtgtcagactccgatcactgcccgacgtaatcaaaatattagagtctccaggatcaaatcgcacagaaagaaccgtatctttaccccattcgaagctatttattggctctgacctgtcaggatcccatatatcaacttgagcaccaacagttgcgaaaagattgccgtcccactggtgatcagcaccccagaatgcatgcttccaggtgtaaactgctgatggctgggaattatctccagcacgctcactagtatccaccattttaagcatcggaactttccagagtcgaacagtgcagtcaacgccacatgatacaagaagatcaccatctgtggatgttgttaaacctcttacagcaccctggtgcccggggaactgacaaactgtcttcctcgcagcaatatcccaaaggcgaacatctccatccattgaaccagaaaatattgctttcaaatgattggggtttttggccatgcacgataccgcgtcaatatgcccatccatagctccgataaatggcttagcaaatatcttctctaacttggcagcattgagtgcccgagtatactcaacagctttctcttgactacgaagcgctggatcatagttgcggaatactttctgcaggtcctggctgcgctcgcgcgtgtagtcgtcggtggaacgcgaaatcaccttcaccctcatcgcgccctcaaaccggagagcacttgacgccggagaggagctaagctagggttttccgccgcgcgccgccttttcgtctcctaaaccagcgcccaacgccgccgggggaaatcacagaagtagacgttagtcgactggccgttaggatgttctaggtaatggtctcgtgc

SEQ ID NO: 19762 - DNA, 1786 bp, Zea mays
tcgcccacgcgtccgcccacgcgtccgcgctcccccgcacagcagagagattactacgatccaacagttctagagcaagagagaggaagacacaccgcagagttagcaggctaataacttgcaggagcagcaggaatggcggcgacgcgtcgcctctcttgctttctcctcgccgtgcttctggcaggagtggccgctgccaccgccttcgacgaagcggctgctgccggcttcgggcttggccacggcgcgcgtttcgcgcgcaagcatggacgtgctgccgctgagatgccccagccggagccacaacctataccgaaaccggatgccccatctcagagccaaagcctgaacctcaaccaaagcccaaccctgaacctcaaccaatgcccaagcctcaaccaaaatccaaaccagagccattgcctacaccgaagcctgaacctaagcccgaacctaagccagagcctaagcccgaacctaaaataaaaccaaagccaaaacctgaaccaaaaccagagcctaagccagagcataaacctgagccaaagccagagcctaaacccaaaccgaaaccagagccaaagccagagccacaaccaaaaccagagcctaagccagagcctaaacccgaaccgaaaccggagccaaagccagagccccaacctaagccagagcctaagcctgagccgaaaccagaaccaaagccagagccacaaccaaagcctgagcctaaaccagaaccaaaaccagagccaaagccagagcctaagcccgaaccaaaaccagagccaaagcctgagcctaaacccgaaccaaggccagaacctaagccagagccaaagcctgagccgaaaccgaaaccagatccaaagccagagccacaaccaaagccagagcctaagccagaaccaaaaccagagccaaagccagagcctaagcccgaaccaaaaccagagccaaaaccgaaaccagaaccggagccacaaccaaagccagagcctaagcctgatccaaaaccagagcctaaacccgaaccaaaaccagagccccaaccaaaaccagaacctaagcccgaaccaattccgcagccagaacctaagcccgagcccaaaccaaagcctgaccctccacacatcccaccagcagctatcaactgaggaagtggctattaacaattattgtagtgtttaaataaaatgccatgttgcagcgtgcttttgtaggtgctgctacttgttgtatctatcctatcttttctttgtcattttttgtatgttatgctattatatgatcttagtgcagtttagcttgttccgtgtatacacgcatttatgcactcagtgggtttttgttatatgttggttgttatgtatatatgttcgctgtttcgagcagctaactaacagaaaccattgttttaatacacaaaagatgattaaatacataattcattcggccttattattgtgcacaaaagcaaaaagggtaaaaaaaggaacaaatgaaacgtgccattcatagtttagtatgttgattttatatgcatctatgcactcgtgaaattttgctatatattcgttgttatgtatgttagctgttttgccggcagctggctgggtcctctcactgttgcagtacgccacatttgattaaatacaaatatccttcttctagtacacaaaagcaaacatgtgaaaaagaaacaaaaagaaacgtgtgatccataaagagcatggacccactgcagtccttttctttctctctctgtgctacattttcataa

SEQ ID NO: 19763 - DNA, 1409 bp, Zea mays
ttccattgggtacctcgcggccggccgggatccacaccacacacagcagagagattacaaccagcacttctagagcaagagagaggaagacacaccgcagagttagcaggctaataacttgcaggagcagcaggaatggcggcgacgcgtcgcctctcttgccttcttctcgccgtgcttctggcaggagtggccgctgccaccgccttcgacgaagcggctgcttccggcttcgggcttggccacggcgggcgtttcgcgcgcaagcatggacgtgctgccgctgagatgccccagccggagccacaacctaaaactaagccggagccccatatgcagccactgccccagccagaacctaaaccgaaacctatgccacatccagagccaaagcctgaacctcaaccaaaacccaaccctgaacctcaaccaatgcccaagcctctaccaaaatccaaaccagagccattgcctacaccgaagccagaacctaagcccgaaccaaagccagagcctaagcccgaaccgaaaatgaagccaaagccaaaacctgaaccaaaaccagagccaaagccagagcacaaacctgagccaaagccagagcccgaaccaaaaccagagcctataccagaaccaaaaccagagccaaagccagagccgcaaccaaaaccagagcctaagccagaacctaaacctgaaccgaaaccagagccaaaaccagagccccaacctaagccagagcctaagcctgagccgaaaccggaaccaaagccacagccacaaccaaagccagagcctaagccagaaccaaaaccagagccaaagccagagccccaaccaaagccggagcctaaaccgaagccagagccagagcctaagcctgaaccaaaaccagagccaaagcctgagcctaaacccgaaccaagaccagaaccaaagccagagcctaagcctgaaccgaaaccaaaaccagagccagagccacaaccaaagcccgagcctaagcccgatccaaaaccagagcctaaacccgaaccaaaaccagagccaaaaccagagccccaaccaaaaccagaacctaagcccgaaccaaaaccacagccagaacctaagcccgagccaaaaccaaagcctgaccctccacacatcccaccagcagctatcaactgaggaagtggctattagcaattattgtagtgtttaaataaaatgtcatgttgcagcatgcttttgtaggtgctgctacttgttgtatctattctatcctttctttgtcatttttgtatgttatgctattatatgatcttagtgcagtttagcttgttccgtgtatacacgcatttatgcactcagtgagtttttttaaaaaaaaaaaaaaaaaaccgacccgaaaaaaaaaaaggccccta

SEQ ID NO: 19764 - DNA, 1613 bp, Zea mays
ggcggccggttcgtcgcgccgggcccggccgggatccacacacacacaacacagcagagagattactacgatccaacagttctagagcaagagagaggaagacacaccgcagagttagcaggctaataacttgcaggagcagcaggaatggcggcgacgcgtcgcctctcttgctttctcctcgccgtgcttctggcaggagtggccgctgccaccgccttcgacgaagcggctgctgccggcttcgggcttggccacggcgcgcgtttcgcgcgcaagcatggacgtgctgccgctgagatgccccagccggagccacaacctaaaactaagccggagccccatatgcagccactgccccagccagaacctaaaccgaaacctatgccacatccagagccaaagcctgaacctcaaccaaagcccaaccctgaacctcaaccaatgcccaagcctcaaccaaaatccaaaccagagccattgcctacaccgaagcctgaacctaagcccgaacctaagccagagcctaagcccgaacctaaaataaaaccaaagccaaaacctgaaccaaaaccagagcctaagccagagcataaacctgagccaaagccagagcctaaacccaaaccgaaaccagagccaaagccagagccacaaccaaaaccagagcctaagccagagcctaaacccgaaccgaaaccggagccaaagccagagccccaacctaagccagagcctaagcctgagccgaaaccagaaccaaagccagagccacaaccaaagcctgagcctaaaccagaaccaaaaccagagccaaagccagagcctaagcccgaaccaaaaccagagccaaagcctgagcctaaacccgaaccaaggccagaacctaagccagagccaaagcctgagccgaaaccgaaaccagatccaaagccagagccacaaccaaagccagagcctaagccagaaccaaaaccagagccaaagccagagcctaagcccgaaccaaaaccagagccaaagcctgagcctaaacccgaaccaagaccagaaccagaaccaaagccagagcctaaacctgaaccaaaaccgaaaccagaaccggagccacaaccaaagccagagcctaagcctgatccaaaaccagagcctaaacccgaaccaaaaccagagccccaaccaaaaccagaacctaagcccgaaccaaaaccacagccagaacctaagcccgagcccaaaccaaagcctgaccctccacacatcccaccagcagctatcaactgaggaagtggctattaacaattattgtagtgtttaaataaaatgccatgttgcagcgtgcttttgtaggtgctgctacttgttgtatctatcctatcttttctttgtcattttttgtatgttatgctattatatgatcttagtgcagtttagcttgttccgtgtatacacgcatttatgcactcagtgggtttttgttatatgttggttgttatgtatatatgttcgctgtttcgagcagctaactaacagaaaccattgttttaatacactaaaaaaaagattatcccgggctctagggccaaaaagcggcgcttttttttttttttttt

SEQ ID NO: 19765 - DNA, 2401 bp, Zea mays
cgggacgcccgccaccccatccatcgaccgatcgatcgccacagccaacaccacccgccgaggcgacgcgacagccgccaggaggaaggaataaactcactgccagccagtgaagggggagaagtgtactgctccgtcgaccagtgcgcgcaccgcccggcagggctgctcatctcgtcgacgaccagtggattaatcggcatggcggctctggccacgtcgcagctcgtcgcaacgcccgccggcctgggcgtcccggacgcgtccacgttccgccgcggcgccgcgcagggcctgaggggggcccgggcgtcggcggcggcggacacgctcagcatgcggaccagcgcgcgcgcggcgcccaggcaccagcagcaggcgcgccgcgggggcaggttcccgtcgctcgtcgtgtgcgccagcgccggcatgaacgtcgtcttcgtcggcgccgagatggcgccgtggagcaagaccggcggcctcggcgacgtcctcggcggcctgccgccggccatggccgcgaacgggcaccgtgtcatggtcgtctctccccgctacgaccagtacaaggacgcctgggacaccagcgtcgtgtccgagatcaagatgggagacgggtacgagacggtcaggttcttccactgctacaagcgcggagtggaccgcgtgttcgttgaccacccactgttcctggagagggtttggggaaagaccgaggagaagatctacgggcctgtcgctggaacggactacagggacaaccagctgcggttcagcctgctatgccaggcagcacttgaagctccaaggatcctgagcctcaacaacaacccatacttctccggaccatacggggaggacgtcgtgttcgtctgcaacgactggcacaccggccctctctcgtgctacctcaagagcaactaccagtcccacggcatctacagggacgcaaagaccgctttctgcatccacaacatctcctaccagggccggttcgccttctccgactacccggagctgaacctcccggagagattcaagtcgtccttcgatttcatcgacggctacgagaagcccgtggaaggccggaagatcaactggatgaaggccgggatcctcgaggccgacagggtcctcaccgtcagcccctactacgccgaggagctcatctccggcatcgccaggggctgcgagctcgacaacatcatgcgcctcaccggcatcaccggcatcgtcaacggcatggacgtcagcgagtgggaccccagcagggacaagtacatcgccgtgaagtacgacgtgtcgacggccgtggaggccaaggcgctgaacaaggaggcgctgcaggcggaggtcgggctcccggtggaccggaacatcccgctggtggcgttcatcggcaggctggaagagcagaagggccccgacgtcatggcggccgccatcccgcagctcatggagatggtggaggacgtgcagatcgttctgctgggcacgggcaagaagaagttcgagcgcatgctcatgagcgccgaggagaagttcccaggcaaggtgcgcgccgtggtcaagttcaacgcggcgctggcgcaccacatcatggccggcgccgacgtgctcgccgtcaccagccgcttcgagccctgcggcctcatccagctgcaggggatgcgatacggaacgccctgcgcctgcgcgtccaccggtggactcgtcgacaccatcatcgaaggcaagaccgggttccacatgggccgcctcagcgtcgactgtaacgtcgtggagccggcggacgtcaagaaggtggccaccacattgcagcgcgccatcaaggtggtcggcacgccggcgtacgaggagatggtgaggaactgcatgatccaggatctctcctggaagggccctgccaagaactgggagaacgtgctgctcagcctcggggtcgccggcggcgagccaggggtcgaaggcgaggagatcgcgccgctcgccaaggagaacgtggccgcgccctgaagagttcggcctgcagggcccctgatctcgcgcgtggtgcaaagatgttgggacatcttcttatatatgctgtttcgtttatgtgatatggacaagtatgtgtagctgcttgcttgtgctagtgtaatgtagtgtagtggtggccagtggcacaacctaataagcgcatgaactaattgcttgcgtgtgtagttaagtaccgatcggtaattttatattgcgagtaaataaatggacctgtagtggtggagtaaataatccctgctgttcggtgttcttatcgctcctcgtatagatattatatagagtacatttttctctctctgaaaaaaaaaaaaaaaaaaatgatcgtcgtgcccgcaaaaaaactcgagggggggcc

SEQ ID NO: 19766 - DNA, 1101 bp, Zea mays
ccgtcacatccatccatcgaccgatcgatcgccacagccaacaccacccgccgaggcgacgcgacagccgccaggaggaaggaataaactcactgccagccagtgaagggggagaagtgtactgctccgtccaccagtgcgcgcaccgcccggcagggctgctcatctcgtcgacgaccagtggattaatcggcatggcggctctagccacgtcgcagctcgtcgcaacgcgcgccggcctgggcgtcccggacgcgtccacgttccgccgcggcgccgcgcagggcctgagggggggccggacggcgtcggcggcggacacgctcagcatgcggaccagcgcgcgcgcggcgcccaggctccagcaccagcagcagcagcaggcgcgccgcggggccaggttcccgtcgctcgtcgtgtgcgccagcgccggcatgaacgtcgtcttcgtcggcgccgagatggcgccgtggagcaagaccggcggcctcggcgacgtcctcggcggcctgccgccggccatggccgcgagcgcgcgcaccgagacatgcatccgttggatcgcgtcttcttcgtgctcttgccgcgtgcatgatgcatgtgtttcctcctggcttgtgttcgtgtatgtgacgtgtttgttcgggcatgcatgcaggcgaacgggcaccgtgtcatggtcgtctctccccgctacgaccagtacaaggacgcctgggacaccagcgtcgtgtccgaggtacggccaccgagaccagattcagatcacagtcacacacaccgtcatatgaacctttctctgctctgatgcctgcaactgcaaatgcatgcagatcaagatgggagacgggtacgagacggtcaggttcttccactgctacaagcgcggagtggaccgcgtgttcgttgaccacccactgttcctggagagggtgagacgagatctgatcactcgatacgcaattaccaccccattgtaagcagttacagtgagctttttttccccccggcctggtcgctggtttcaggtttggggaaagaccgaggagaagatctacgggcctgtcgctggaacggactacagggacaaccagggtaccg

SEQ ID NO: 19767 - DNA, 1700 bp, Zea mays
  misc_feature (21)..(25): n is a, c, g, or t
  misc_feature (48)..(72): n is a, c, g, or t
  misc_feature (79)..(84): n is a, c, g, or t
  misc_feature (114)..(187): n is a, c, g, or t
gcacgagctccatccgaccannnnngcgagcttcgacagttcgacacnnnnnnnnnnnnnnnnnnnnnnnnngccacannnnnnggaggcggcgatgcagatggcagcggcagnnnnnnnnnnnnnnnnnnnnnnnnnnnnnnnnnnnnnnnnnnnnnnnnnnnnnnnnnnnnnnnnnnnnnnnnnngcggtggcggccgcgtcgcctcacccgcacgcactgcatccgcatcaccatatgccgcaaccgcggtgggtggtcatcccataccctcctccacaccatcccatggtggccgcgccgccgccaccttctctgcagtttgtgaagcattttacgccgccgtcctcggtaacaccgccgccgccgactggatccggcgggaacgggggcgaggataaccggaccatctgggtgggcgacctgcagtactggatggacgaaaactatcttcacagctgcttcggctctagcggcgaggtggtgaatattaaagtcattcgcaatagacactcgggagtttctgagggttatggttttatagagttttatactcacgtttcagcagagaaggcactgcagaatttttctggtcacgtaatgcctaatactgaccgggcttttaagttaaactgggcatcatatagtatgggagaaaaacgctcggaaatttcgtctgatcactcgatatttgttggcgatttggctgttgatgttactgatgcgatgttgctggaacttttttctaacaaataccgatcggtgaaaggagctaaagttattattgatgcaaacacaggccgttctagaggctacggctttgttaggtttggagatgataatgacaaaattcatgcaatgactgaaatgaatggtgtttactgttccacaagaccaattcgtgtaggaccagcgactcctagaagatctcaaggtgattctggcacttctccaccaaggcaatctcatgttgactctactaacaggacggtatatgttggtgggcttgaccccaatgttagcgaagatgaactgaggaaagcatttgcaaaatatggtgatcttgcctctgtcaaaattccttttgggaaacaatgtgggtttgttcaatttgtaaacagagttgatgctgaagaagcactgcatgggttgaatggatcaactattgggaagcaggcagttcgactttcctggggccgcagccctgcaagtaaacagtctaggggtgattctggccaccggcgcaatggcaactgcaacggcatgtactacgggacaccattctacggtggatatggctacgcctccccgattccgcacccaaacatgtacgccgcggcctacgaagcctacccgtactatgggaaccagcagctagtgagctgatgtagtgatgtggcgagatgctctctgctcagttttcctcccttggaggaaacgagtttttggtcccagtaaaagcatagtagctatgatgagatatatgataggtggccataaaaatgggcgcgagagacgagacaggcatatgatggtaacgctacctgcagatttgtgctgctagtagaacctaaaagagcttgtagtagacaaataaaaccttttcttttgtcttggaaattttgactcgctaataaaaagtgaagctatctgttgttgtggcaaaaaaaaaaaaactcgagggggggggccgtgtacc

SEQ ID NO: 19768 - DNA, 1699 bp, Zea mays
  misc_feature (7)..(10): n is a, c, g, or t
tagaagnnnntcgagtttttttttttttttttttgagacggggaacaagcattcgataacatcgtctcgttccatgcagttcactacaagtgtttattactgcaccattacaaacatctcagatctaagtgaatggggaaagcggaaagataacacaactgccatccagtatatccccatttgtatctacagctcaccacctaaaattagcatctactccgtatattttactaccacgtggtgggaggttactgaagagataaatgagccgctacaaacttgtgacaggaatggactgcttggcagttgaatgtcgatgaaacggtaggagcttggccccttgttttctgggaccaaatgcatgttcgacggatgagtagcaaacgaaaagcctgcagatggctactgaactatgccatcaagcttctgtctgtactgagccaaattcttggtataagcatagacacctgcttcagaaggtccagcggggcttcctcgcctgatgaatttaccttccttaaatatatacagcataggaatgccagtagacaactcaaggctgataacctcttgagaagtcagcttgtccaaatgcattatgatcgaacgaagtgaattcccatgggccgcgatcattacatgctttccatccacaagtttaggtataatttggtctttgaaataagcaactgctctctctgcacacatctcaaggctctcgccatttgggggaggaatatcataactgcgacgccattcatgaacttgttctttaccaaatcgatcggcggtttcttgtttgttaaggccttgaagctcaccatacatccgttcattcaattgccaagctgttatgacaggaatggactgcttctttgtctcttcactgtatatctgactccacatgtgagcttgttcactctcgttgtgcaaaatgattggaaccttctttcggcgatgctgcatcatggcaagcatagcggtcatctgagcccgaatcagcgacgaagtgtatattacatcgactgggatattgcatatccttttccccgcctcaattgcctcgtcaacgcccttaggggtcaggggaacatcgacacatccagtgaacaggttcttctcgttccacaacgattctccatgccgtatcagaatgagtgcgctttcacctgatttctttggagttacgccacttttagggctcctcggtagctggaccggctcaatcactgaagattgagagtttgaagcacaaagtagacccaaattgcgggcactgggacagcgacgccctactgaaacagaaagcacgcggcaatttctcttatcgggatgcaagcagcctgtggacagcaatttgatggatgaaagcgcatgctgagatgtggaagtggccatgtgggcaaccaaagatgccgaatcctggcagaacagcgcctcgggaactccacaggtagcgcaggccctcgttttacaggtccagttgatctggcggcggcaccgatacctgtcttctcggcgagatctgcggcggcggcaccgggtcgctgtcgcggagatcgccgggtagcggcgacgaaaccgaggggcaacgggcaagaggcgaaagggactcgttgttgtttgctggctccagtgggtcgtgctcccgacttcttgcccggccggccgggaggcacccaatgcgaggtacccaatg

SEQ ID NO: 19769 - DNA, 1274 bp, Zea mays
  misc_feature (1270)..(1271): n is a, c, g, or t
cattgggtacctcgaggccggccgggctcttctgtcctctgtttatataataataataataacttgccaggcgcgcgccatctcgctccgtccatccctgtcgccaccaatccatcgcttccgcttcggcctcaacgacggccgccaccaccgctcccctccctctcctcctcctcgcccagcggccattaccacagcctcccccatcaagccgggatggctgcacagcctgcactcaaggcgtcgttccgaggggagctcaacgccgtctccttcctcgactccagccggggacctttcggccaacacaaagtggattttacgtttcaaaggaagggcaaacgagctatttcactgagaaggacatgctgttccatgcaacaggctccaccaccggcatggcctgggcgagctgttgctgagcctggccggaggtcattggatggcccaaagcctatatcgattgttggatccactggttccataggaacacagacattggacattgttgcggagaatcctgataagttcagagttgttgctctttctgctggatccaatgtcacgcttctagctgatcaggtcaaaacattcaagcctaagttggttgctgtaagaaacgaaacattagttgatgaactaaaagaagctttagctgattgcgaagagaagccagaaattattcctggggagcaaggtgtcatagaagtcgctcgacacccggatgcaattacagttgtcacagggaatagtaagggtgtgcagggctgaagcctacagttgctgcaattgaagctggtaaagacatagcattggcaaacaaagagacacttattgcaggtggtcctttcgtgcttccccttgcacacaaacacaaagtgaaaattcttccagctgattctgagcactctgcaatatttcagtgtatacaaggcttgtccgatggtgcacttcgtcgcattattctaactgcatcaggtggtgctttcagggactggccagttgacaggctgaaagatgtaaaagttgctgacgctttaaagcatccaaactggaatatgggaaggaagatcacagtagattctgctactttattcaacaagggtttagaagttattgaagcacattatttatttggtgctgaatatgatgacattgagattgtgattcacccacagtctatcatacactctatggttgaaacccaggattcatctgtcctagctcagttgggatggccagatatgcggttaccaatcttatacacctnntca

SEQ ID NO: 19770 - DNA, 1908 bp, Zea mays
gtccacgctcctgagtcgcaactcacacaagtcaccaagcgagcaatacaaaatcagcgggcaccccggcgccggccgggcggttgcggtggcatccataggactctcagattcccatctcgtcttcttatctccacttctccctccacacacatcccctcctctctctcctctgtttataaaactcgccaggcgcaatctctctcgctccgtccatccccgtcgccagcatcgcttccacttcggtctcagcgacggtcgccaccaccgctcccctccctctccccctcctcgcccagcggcaattaccacagcctccccagcaagccgggatggctgcactcaaggcatcgttccggggtgagctcagcgccgcttccttcctcgactccagcaggggacctctcgtccagcacaaagtggattttacgtttcaaaggaagggcaaacgagctatttcactgagaaggacatgctgttctatgcaacaggctccaccaccagcatggcctgggcgagctgttgctgagcctggccggaggtcatgggatggcccaaagcctatctcgattgttggttcaactggttccataggaacacagacattggacattgttgcggagaatcctgataagttcagagttgttgctcttgctgctggatccaatgtcacgcttctagctgatcaggtcaaaacattcaaacctaagttggttgctgtaagaaacgaatcattagttgatgaattgaaagaagccttggctgattgcgaagagaagccagaaattattcctggggagcaaggtgtcatagaagttgctcgccatccagatgcagttacagttgtcacagggatagtaggttgtgcagggctgaagcctacagttgctgcaattgaagctggtaaagacatagcattggcaaacaaagagacacttattgcaggtggtccttttgtgcttccccttgcacacaaacacaaagtgaaaattcttccagctgattctgagcactctgcaatatttcagtgtatacaaggcttgtccgaaggtgcacttcgtcgcattattctaactgcatcaggtggtgctttcagggactggccagttgacaggctgaaagatgtaaaagttgctgacgctttaaagcatccaaactggaatatgggaaggaagatcacagtagattctgctactttattcaacaagggtttagaagttattgaagcacattatttatttggtgctgaatatgatgacattgagattgtgattcacccacagtctatcatacactctatggttgaaacccaggattcatctgtcctagctcagttgggatggccagatatgcggttaccaatcttatacaccttatcatggccagatagaatctattgctctgaggtcacctggccccgtctggatctttgcaagttgggttcactgacattcagagctccagacaacgtaaaatacccatcaatggacctagcctatgcagctggccgcgctgggggcaccatgacaggagtcctgagcgctgctaatgagaaggccgtggagttgttcattgacgagaagattagctacctggacatattcaaggtggtggagcttacatgtaacgcgcatcggaacgagctggtaacaagcccgtcactggaggagatcgtccattacgatctgtgggcgaggagatatgcagccagtctacaaccatcttctggcctgagccctgtccctgcataataggtcgtcacgacaacgttgtacagcaggagttctaagatatgatgtgtttgtggctcctgtttccatgttcaattttcaggcctccacatgaataaaatgcatctattccatgtgaaaaaaaaaaaaaaagaaacaaaaaaaaaagctcgcggcc

SEQ ID NO: 19771 - DNA, 3059 bp, Zea mays
  misc_feature (923)..(923): n is a, c, g, or t
  misc_feature (1737)..(1737): n is a, c, g, or t
agtcctctctgcggccaggcgcgggccgagcgcgcgggcgtcgtgcagctcgcgggaccagtccgtcgagcggctgctagaggcgaacgcagccctcgcacggaagaagtgcaccgagaagagcgcgccggcgtcgaggacgccgccgggcaacaggtcctccggcgtggcgaggtcttggtcttggtcttggagcagggtcttggtcttggagcactgcacgaggagcacatcagcatgggagatagtggataaagagcttcgaaaagaaagaccctctattgataaccaaagacttctaagtaggagagtagatggagatgattttgttttgaacaaggcacaacgtttggcgttgaaacgcaacttgggaaactgagatgttcgccaatctgtgggccaaaggcttcagtttgctaggtgagcatctgcacagttctgaaattggcgcctattgttgcacagtttttttactacagcaattattccacactcaagctaaatttggctcagttggttacaatgtcatggtgattggaatctaccatttgtgaatctgtggtctacaacttatctggtagggttatatttgataaatgtgttcaatacacaaaaacttgtactatctatatgatactagagattagtgtgccagattgttaaaagctagataatctactgctaccatttaaaagtaactgctggattaattttataggtggattgtgctcaaattgcaatatggagcgacagcaacgaaatctgtgcaccagaatggccctggctgatctttattaggcttgttattcatgttcttctattttcccaggattcatctgccctagctcaattgggatggccagatatgtggataccaatcttatacaccttatcatggccagatataatctattgctctaagntcatgtggccccgtctagatatttgcaagcatgacatcttcacaactcctgggctacttttacagtacatttgatgcttttatttggaaatgacctcgaagaattcaagtctttttttcttgattacagtatggggttgttctaataagctactggtatatgatggtaatacttgataaatttgtatggatcaagggaatctaagtccgttgttggtatgtgcatctgtgattaaaactgatgggtttttaatcagaaaaattatgacaaccatcttataaattttaggaaagaaatatatgactgtacttaaaaataaattttctaaacaactcatcaaacttgaaccttgacctaaactcatttcaattctggtgtcattttgaatagttatatgtaagagttgagctagataccatggtaaggttgctaaacatgaatatgctttcgaaaaaaggatgttaagtaacttagtgactctgcataacactgtaggatttgaggctatcatagtatgctctctgaccgtgctgacaaaaggaaggaggtgtgtatatagttttcttgcattattttcctgtggctattctcatccctcccatgtgttcttttcagatgatttaagttctcggtgtttataactagaaataagaggataatcgaatcatggtaactaaacattaggtagtaatgtttcacggtaaatcacagtgctgaaatgcaatatgatctttgactcggagtattgaagactaatttagtttgagtttgagattagttgtttttgtcattaataaactcacattagtgtctngttacgagctcactactagattttagatctcctgctttggtgtacttttgctgcatgtgcctcccagagttgcggatttgcaggtagcacctgattccttttgatttttggattgagatacaatgaaatttatatttgcctgtttccaccacactgtatctggtaggtttcctaaccctaccagggagctgccatagggagtagggatgagagcgagctgggcgggttggttgctggcgcagagacgtcgtcgctgtcaacagaaggttagggcacatggaggtaaaggcagcttggacaataatagacttgatctctcaatcttcgagctccctaggtgaagccagaaataatatatttctgcttaattccacaaataacctcttacatgtatttatgtcccagttgatgcttatctgatctaaggataagagctatgagatctcttctaatccctatccaactaactagatataatctctcctttttattagctaatccttatctaatctatcctagccgatctcctggccgcatgtgtcctgtggcctagccgtgggccttagccctcctagccactaatggccctatgcgtggtgtaggagatgcagtcataacagtatcatacaactaaacatgaatacaaagctggcttgatctggcaagtgctctccattctatgggcccatcacgcttttcgattacactatttgatcacaaggagcagtctgctgccaccaaacttcaagttgttgatcataatggcctgaaaaattatcgggtaaattacttctctactatttgaattaactgatgctcactaccgaaatcgtgttctttgccgagtgtctaaaacacacggcaaagaccattttacactcggtaaaggctttaccgagtgtaacactcgacaaacattttatcggcaaaaggttctttgccgagtactttttttggacactcggcaaagactttgccgagtgttgaaaaacactctcgacgaattaagaatcgaaaaagtccaaaaaaaactgcaaaacattttttaaaattataggaacaactctccaaccactatgtattaccatacccatcaccctatcatttttcactattattttgaatcaaatttacaagttttgtgaatggtgagattcgaactcgcaatctctctcgcgcataccgtcctataccactacactattacattaattatgtctatattacgttttcattcatcatgtactataacaaatcgaaagtaatttgattatttaaggcactaaatgaattcatttgaaaatgtgaccaactataaagtg

SEQ ID NO: 19772 - DNA, 1247 bp, Zea mays
aagaccccctaaattccagctcccgcgccgctctaccgtcgtcgcttgagctctctcgctggcggaccgcccccctcatccctgcggtcacgcgcgacctccatgacctccaccgctgcagaaggtgcaggaagcggtagcttgaaccctccgcattcgaaccctagcggcgatggcggccctaggatccggtcgccgccggggaaagggaataagcccgtcgctctcgccgacatcactaacactgggaagcccaacgccgccagatccatcaccgtccccgacctcgttaaggagaacaccaagttgctgactctgctcaacgagaagacaaagattattgacctcagcagggttgagatatacaagctccgtcttgccctgcaagcatcaaagcaacagaatctacaccttacacaaaccaattcgcagatgcttgcggaaataaacacagggaaagatcgtattaagatgctgcagcatgagctttcttgtacaacagcactgcttaaagtaaaggattcagagcttgatagaaagaaaaacgctggtaatgtacagcagaagggagtaaaatctcaggtcttgaaaaccaaagcttccacagtagcagtagaggctcaccacgttggtgactcagtaaccagtggtgttgaacaccatgtggttgaatctcaatctgccgtatcatcaaatactgtctgccaggagccaccacaagatggaaagcaaaagagaatgcctcaacggagaaggtcttcaagactgaaccaaggttcctgtgagatcaggggagtatctcagaacacactgcatgagaaccctgtagtgcctgtagctccttccactttaagtcttgagaaacagtatggacaaaccactggaaaacatatgaagtcactgcaaaatgagtgcagtgcaactgtgcatgaagtaataatggcttcagaattcgagaaaactgagataaatgagctaccacaaaaaacagatctgaaggagataccagaagcatgttccagtgaaactgaagttcagtctcataaaattggtgataaggccttcaacagtaaacaaaaccatttgacaggaagccaatcatctttgtcattcaataccgttgacacccccgagccaccagaagacaacactgtcaagcggtgctcaaaaaaacggtcatccatagaggatgtaaatgccaaactagacacgattaccagtgagccattgcgacatgaagaaaagag

SEQ ID NO: 19773 - DNA, 1360 bp, Zea mays
gaggtatagaatggatccccagatgccatgaaagcgtagttgattgaatataatacatatgaatccttttctcgaacgaatacatatgaatcctaaactaccaaatatattcttcagtacgaaatccagatatagggaagagaggtaaaacgacaggttgtggtacggccgcccctactcgcgccgttttttttttttttttttcctttaaaacaaggtgcaatgacttatgagcacatgcatttctaccaggggtacaactaaaattgttcacattacaacacagaaacctgaatccaagcaattgcatttaaaagctagacgagaacgatgacagccagataaaaggtacgtagaagggtaaattacaaagtatggtatcgcactatttatcttccttgtgacaatgtaaccccgtcacgatccgcagcaagctgatttttgtgacgctgaagcctcaccaccctcaggtctgttgatactgatcgtgcgatcctctggctttgaatcagattcagcaagcctttgcttgatatctcttgctatggagaagaaaacctgctccacattcaggttggtcttcgcactcgtttcaaaaaatttgatgccatactcgtcagcaagagcctgcccttttgaagtcggtacagcgcgtttgctttcatccatgtcagctttgttgcctaccaaaattttattcacattgtcggaagcatgttgctcaatgttccttatccagtttcttatattattgaaagatgactcatcagtaacatcatagacaagcaaaattcccattgcacccctgtagtaggcggttgtaatagttcgaaaacgttcttgaccagcagtatcccatatctgtaactttatgcgcttaccatcaagctcaactgttcttattttgaagtcaatcccaatggtggtgatgaagctagtagtgaaggagccatctgagaaccgtaaaaggagacaacttttcccaacaccgctatctccgatgaggagcagcttgatgaggaagtcgtagtcggcccgggccctcgccggaggcgccgccatctccgagacccaggaaaggttccgcctgcctccagccgagcccacgcgacgcacagcaagcgcccgctgcagcagcgagcggccgtcggattcgaccgagcggaacactatccgggtcggaggcgcgtcctagccggtcggcgcgccgtcgaagcggcggcggggcgatgaagtgaggtacgagatcggatgcggtgggagagaggagagaagtcccggccggcctcgaggtacccaatgggaagtggtccaccgtgacttgaacggaccgtcccggccggcctcgaggtacccaatg

SEQ ID NO: 19774 - DNA, 1338 bp, Zea mays
cagaggctgggcgtttttttttgaggtatagaatggatccccagatgccatgaaagcgtagttgattgaatataatacatatgaatccttttctcgaacgaatacatatgaatcctaaactaccaaatatattcttcagtacgaaatccagatatagggaagagaggtaaaacaacaggttgtggtacggccgcccctaaactctgcagcgattttgctagcatttccattaacacaaggtgcattgacttacgagcacttgcattgctaacaggggggtacaactaaaattgttcacattacaacacagaagtctgaattcaaggaattgcaattaaaagttagaagtggacgattaagccagataaaaaggtagaagggtaaattacaagcatggtatcacactatttatcttccttgtgacaatgtaaccccctcacgatccgcagcaagctgatttttgtgaagccgaagcctcaccgccatcaggtctgttaatactgatcgtgcgatcctctggctttgaatcagattcagaaagcctttgcttgatatctcttgctatggagaaaaaaacctgctccacattcaggttggtcttcgcactcgtttcaaaaaacttgatgccatactcgtcagcaagagcctgcccttttgaagtcggtacagcgcgtttgctttcatccatgtcagctttgttgcctaccaaaattttattcacattgtcggaagcatgttgctcaatgttccttatccagtttcttatattattgaaagatgactcatcagtaacatcatagacaagcaaaattcccattgcacccctgtagtaggcggttgtaatagttcgaaaacgttcttgaccagcagtatcccatatctgtaactttatgcgcttaccatcaagctcaactgttcttattttgaagtcaatcccaatggtggtgatgaagctagtagtgaaggagccatctgagaaccgtaaaaggagaccgcccggccccgcggtatcgccgatgaggagcagctttatgaggtagtcgtagtcggcccgggccctcgccggaggcgccgccatctccgagacccaggaaaggttccgcctgcctccagccgagcccacgcgacgcacagcaagcgcccgctgcagcagcgagcggccgtcggattcgaccgagcggaacactatccgggtcggaggcgcgtcctagccggtcggcgcgccgtcgaagcggcggcggggcggggcggggcgatgaagtgaggtacgagatcggatgcggtgggagagaggagagaggagagaagtagagaaggaaggtcccggccggcctcgag

SEQ ID NO: 19775 - DNA, 1059 bp, Zea mays
cggcttatgagcacatgcatttctaccaggggtacaactaaaattgttcacattacaacacagaaacctgaatccaagcaattgcatttaaaagctagacgagaacgatgacagccagataaaaggtacgtagaagggtaaattacaaagtatggtatcgcactatttatcttccttgtgacaatgtaaccccgtcacgatccgcagcaagctgatttttgtgacgctgaagcctcaccaccctcaggtctgttgatactgatcgtgcgatcctctggctttgaatcagattcagcaagcctttgcttgatatctcttgctatggagaagaaaacctgctccacattcaggttcgtcttcgcactcgtttcaaaaaatttgatgccatactcatcagcaagagcctgccctcttgaagttggcacagcccgtttgctttcatccatgtcagctttgttgcctaccaaaattttattcacattgtcggaagcatgttgctctatgttcctaatccagtttcttatattattgaaagatgactcatcagtaacatcatagacaagcaaaattcccattgcacccctgtagtaggcggttgtaatagttcgaaaccgctcttgaccagcagtatcccatatctgtaactttacgcgcttaccatcaagctcaactgttcttattttgaagtcaatcccaatggtggtgataaagctagtggtgaaagagccatctgagaaccgcaaaaggagacaacttttcccaacaccgctatcgccgatgaggagcagcttgatgaggtagtcgtagtcggcccgggccctcgccggcggcgccgccatcttcgagacccggggaaggctccgcctccctccgggctccggccgagcccacgcgacgcacagcaagcgcccgctgcagcagcgagcgaccgtcggatccgaccgagctgatcacgagccggtcggcgcgtccaagccggtcggcgcgccgtgaagcgaagctgggcgggacggaagtgaggtacgagtcgggtccgttgaggagagagaggagagaagt

SEQ ID NO: 19776 - DNA, 768 bp, Zea mays
gccggcagctccagccgcacgcgcacggagcgggagagggaccggtcgtggatgggctgcagcgacaggggtacgccgcggcagagctcggcccatgaggacatgaagtgccacgtggaggtgccgtccagcaccgcgtggttgaaggcgcaccccaccgccagaccgtccttgagctttgtgaattggacggcgagaagcgggcggcggaggccctcgaggttcatgacgccggtgtagggcacgaggtgctgcaagaccttctccgcctcgtcgctgcagtcccctccggcgaggtcgtcgacggcgacgccctgggcctcggcctcgaagacctcggcgccctcgtcgccctcgactgccagcgcgccgccgtcgtcgtcctggcggatgcggccggcgagcgggtagaagacgcggagcgcgtcggcgagcgcggccgtcatgcgcgccacggcgtccggaaagtcgggggcggcgcggtacaggagcagcttctggttgtagtagaaggtgatgtaggggaggtcgaaggtggcgagcgtgcagcggttcttggccggcgccacggtgcgggcgccggtcacggtcaccgccgccgcctcgtcggcgctgccgttctccacggccattgctgctgctgctggggcttgttcctggctaacagtactagcacgtaccgtacgtagccagcccagtagggagtgtgaggagtctgtccgccccggccgaggcgcggtggatgggtgagtgatatagggaagccag

SEQ ID NO: 19777 - DNA, 1047 bp, Zea mays
  misc_feature (5)..(5): n is a, c, g, or t
  misc_feature (49)..(49): n is a, c, g, or t
  misc_feature (55)..(55): n is a, c, g, or t
  misc_feature (82)..(82): n is a, c, g, or t
ctaanattgttcacattacaacacagaattctgaatccaagcaattgcnattaanagttagaagtggacgattaagccaganaaaaaggtagaagggtaaattacaagcatggtatcacactatttatcttccttgtgacaatgtaaccccctcacgatccgcagcaagctgattttgtgaagccgaagcctcaccgccatcaggtctgttaatactgatcgtgcgatcctctggctttgaatcagattcagaaagcctttgcttgatatctcttgctatggagaaaaaaacctgctccacattcaggttggtcttcgcactcgtttcaaaaaacttgatgccatactcgtcagcaagagcctgcccttttgaagtcggtacagcgcgtttgctttcatccatgtcagctttgttgcctaccaaaattttattcacattgtcggaagcatgttgctcaatgttccttatccagtttcttatattattgaaagatgactcatcagtaacatcatagacaagcaaaattcccattgcacccctgtagtaggcggttgtaatagttcgaaaacgttcttgaccagcagtatcccatatctgtaactttatgcgcttaccatcaagctcaactgttcttattttgaagtcaatcccaatggtggtgataaagctagtagtgaaggagccatctgagaaccgtaaaaggagacaacttttcccaacaccgctatcgccgatgaggagcagcttgatgaggtagtcgtagtcggcccgggccctagccggcggcgccgccatctccgagacctaggaaaggttccgcctgcctccagccgagcccacgcgacgcactgcaagcgcccgctgcagcagcgagcggccgtcggattcgaccgagcgggacactagccgggtcggaggcgcgtcctagccggtcggcgcgccgtcgaagcggcggcggggcggggcggggcgatgaagtgaggtacgagatcggatgcggggggcggggagagcccggccggcctcgaggggcccgtcccggccgg

SEQ ID NO: 19778 - DNA, 879 bp, Zea mays
ctgatgcgcgccacgtgggctccgggaacgagaagacgcgggccaccagcgcctttcttcggcccgttcgggtccgtcttctcgtgggcctcggcggacgccggcagcttccagccgcacgcgcacggagcgggacagggaccggtcgtggatgggctgcagcgacaggggtacgccgcggcagagctcggcccatgacgacatgaagtgccacgtggaggtgccgtccagcaccgcgtggttgaaggcgcaccccaccgcccagaccgtccttgagctttgtgaattggacggcgagaagcgggcggcggaggccctcgaggttcatgacgccggtgtagggcacgaggtgctgcaagaccttctccgcctcgtcgctgcagtcccctccggcgaggtcgtcgacggcgacgccctgggcctcggcctcgaagacctcggcgccctcgtcgccctcgacggcgagcgcgccgccgtcgtcctggcggatgcggccggcgagcgggtagaagacgcggagcgcgtcggcgagcgcggccgtcatgcgcgccacggcgtccgggaagtcgggggcggcgcggtacaggagcagcttctggttgtagtagaaggtgatgtaggggaggtcgaaggtggcgagcgtgcagcggttcttggccggcgccacggtgcgggcgccggtcacggtcacggtcacggtcgccgccgccgcctcgtcggcgctgccgttctccacggccattgctgctgctgctgctggggcttgttcctggctaacagtactagcacgtaccgtacgtagccagcccagtagggagtgtgaggagtctgtgaggtgcggccgatgcctgctccttgggtgagtgatatagggaagcc

SEQ ID NO: 19779 - DNA, 1164 bp, Zea mays
tcggcccgttcgggtccgtcttctcgggggcctcggcggacgccggcagctccagccgcacgcgcacggagcgggacagggaccggtcgtggatgggctgcagcgacaggggtacgccgcggcagagctcggcccaggaggacatgaagtgccacgtggaggtgccgtccagcaccgcgtggttgaaggcgcaccccaccgcccagaccgtccttgagctttgtgaattggacggcgagaagcgggcggcggaggccctcgaggttcatgacgccggtgtagggcacgaggtgctgcaagaccttctccgcctcgtcgctgcagtcccctccggcgaggtcgtcgacggcgacgccctgggcctcggcctcgaagacctcggcgccctcgtcgccctcgactgccagcgcgccgccgtcgtcctggcggatgcggccggcgagcgggtagaagacgcggagcgcgtcggcgagcgcggccgtcatgcgcgccacggcgtccgggaagtcgggggcggcgcggtacaggagcagcttctggttgtagtagaaggtgatgtaggggaggtcgaaggtggcgagcgtgcagcggttcttggccggcgccacggtgcgggcgccggtcacggtcacggtcaccgccgccgcctcgtcggcgctgccgttctccacggccattgctgctgctgctgctggggcttgttcctggctaacagtactaagtgtgaggagtctgtgaggtgaggtcgaagcgaggtggatgggtgagtgatatagggaagccaggaggaggaggtgggtggatcaggcatttaatggtggatcttctcagcggtggccggagaggcgacgggcaggatcgagcaccgcacaacggcacgacacgagagggacaggcagaggcctgaccatatagtgagggaagaaaaagaagaaatcaggaggaaaaaatggagaccgggcaacgaagacgacagcgcgatggaattgaattggaggtggaggaaagcgatggaggtggtagatggttcggttgggaggacccggatcggaggaggcgcacatttatggcctgccgcgcggccttcatggttaccacgcgacgcgatcgacacacgagtctactctgcactgccgctcttttttcttcgattcgaatcagctg

SEQ ID NO: 19780 - DNA, 1413 bp, Zea mays
ctcgaggccggccggggcattgtgtaatccatctacaagatgtcctcgtcgccgcccgggcccggatcctcagcactactacgccatggccaccaaagcaggctcctcactgtcgccatgcatcaggctcgtggaggaatccctgctcctcccgacgcaagacgccggcctcttcgcaaaggccttcgtgctcatcttcgcccacaccttcctcttcatcgcggtcgccgtccacttcgctcacccactcgccacggacatcctcgccgacatcaaagcacaaaggagcagcagcaggaccactaccactaccggcgccgcgagctccaaccactccaaggagctgtcgttactagcgatctacctctgctacctcgcgagcaaactcgccacccagctcgtcaccgccctcgccaccgccacgacctactccggcgagcgcctcacgcgtaaggtggtcatggagaggatcgccggaggcggcggccttctcggcacggctgccgtcgccggcgcgctggagctgtcgttcacggctctactcgcggcgctactcgtatccacgtggacctacgctgacgactcggtcgtaaagtctgtgtgtggctactcgatgttctcggtggcgcttctcgtctacatctacctcgccacggtgatcccggtcagcgtcggcgtgtcggcggtggacagaggctgccacggcgtctgggcgctccgccgggcgtggcggctcttgagagcaagggggaaggaggctgccgtgctcgtgttcgtcgtcaacatcctgcctgctttcatctacccagcccccgtgtacgcgttctcgtacatgtacccggcggacgagtactccctctactacggacaggacatggcggtcaggttttctctccacggcccggcgatgtggaggcagtggagccagggcgtgtgctggttcatgggcgtagttttcggatctggtcttccctcggttggtgcgcagctgttctccatggtggcagccacggtgttctgctgcctctccatagaaaccaacgatgatgcagcgcgcgcagtagtataaaactgcttgacaattttgtattaattgtcgatcacacctaagctagtcaaaatttacctactttaattttcgtcatgttgtggccaagactttatcgttgttttatacgagagagagttttacaatgtttctctccccaaagtgtgtgtagggacttaatgtgttactgtagctactacaaaagagctatgcaatctaggtttcaagcctaacaactaaatttaaaaggtagagcacacaactaaagtacacaaataaatgcaaaagtttaaatacgatagagatacaaactcataaggatgaccacgagagcttcctgttattctcgtggagccacacacaag

SEQ ID NO: 19781 - DNA, 2457 bp, Zea mays
gccggccggccgcggccctcgggattttccccgcagcgacgacgattcagtgaggcacccctctcctggcctcttctcgccttctccgtttccgcgaacccagctgcctcgtagccccaccacaccgccgagcacgcggtctcccgcgccgccttccacccaagcgaagctacccctactcgacccagaattatcttctaccagcgctagtccgctccgcctctctactggctgccgtggagtggggatccgtccggacttccttctttcgctgttgatgtcatcatgctgagcattttgtggtagagacgatcatctctttgggttccagcatataactcatgcccataaaatttgcactagaaaatatgtcgacacaagcctctaaccggtcatacagatatccagacagaacccaactgccgtaccacaatggcaatccaatgcatgttgggggcaatggtaattactgtgtgcaacaaaatcacgatgatgttaactacatttcctctgatgatggatcacagagcagtagttctagagttcaagattttcaagcacagttttgcaccctagattcgtcttcggccaattgtgtttatcctgcacatagttctacctcttctcagagcataagtggaagccctctgtctcagcaggagagccactctgatcatgcatatggttcctctccaagtgcatcgtgcatcactcaggttcccacctggacacttaaggatctagaaaatgtgatgcttggacccgattctgacataggtagccctgacagttcctttctgcttgacactgccttgcatggaaataactggagagaacttttgggaattcaaactggggatttgaggcaggtaattgtagcatgtggtaaggctgttgacgagaatgctgtctatatggatgcattgatgtctgagttaagggagatggtttctgtctctggtgaaccgatgcaacgtctgggagcttacatgttggaaggcctcattgcgaggctttctttcactggacatgccttgtataaatctctgaagtgcaaagagcctgtggctacgagttctgagctcttgtcctatatgcatcttctttatgagatctgtccattcttcaagttcggttacatgtctgccaatggtgccatagctgaagcggttaagggggaagacattattcacatcatcgattttcaaatcgctcagggtagtcagtggatgactatgatacaggcccttgcttcaaggcctgggaggcgaccatacctaaggatcactggcatagatgactcgaattctgctcatgcccgaggtggtggactggatatggttggacagaggttgcacagaatggcccagtcatgtggtctgcccttcgagttcaatgctgtgccagcagctagtcatgaggttgtgtttgaagatctttgtctaagatctggggaggccatcgttgtcaattttgcttatcagctgcatcatactcctgatgagagcgtgggcatagaaaaccatcgtgatagaatactgagaatggtcaagagcctctctcctaaggtggtaactcttgtagagcaggaggcaaacacaaacacagcacctttctttcttagatacatggagactcttgattattacacagcgatgtttgaggcaatagatgttgcttgccccagggatgataagaagcgcattagcacagagcaacactgtgttgcaagggatatcgtcaatttaattgcttgtgaaggtgcggaaaggatagagaggcatgagccttttggaaaatggagggcaagacttgtaatggctggttttagaccatacccgttaagtccagtggtgaacagaaccatcaaaacactgcttgacagttaccacagccattacaggcttgaggagagagatggcatcctttatcttggctggaagaacagaaagctggtcgtatcttctgcctggtgctgatatttccaacttcttctaagaagcattgttaagattctttcgtggcttggggttcaggcgttcagcacatgaatccaaggtggaaccgaaacttcagtatgaagactgcacaatcaaaaaagaacaagctggttgcttccttactatttgttgcccagccttgaaactctcccacgctcaccatcatcgctgatgtacttaccatgactcagttccatccttatatataggtgcaaacaatggtcttaatattgtatgttggtagaatctggtggtattagcttccaaatctggattgctgaatcgtttgtgttactacatttagccaggatttgacagtagacacaaggagtgctgtaagatcctgtatgtacaacgtgcttcagttggtgtattgtacgtacttgggtgctatggctggtttggttatcacagtgctgagtgctgcactgttcggcgttatttaaaagccatgggg

SEQ ID NO: 19782 - DNA, 695 bp, Zea mays
  misc_feature (14)..(14): n is a, c, g, or t
ccggccgggctcgntcattttccccgcagcagcgacgattcagtgaggcacccctctcctggcctcttctcgccttctccgtttccgcgaacccagctgcctcgtagccccaccacaccgccgagcacgcggtctcccgcgccgccttccacccaagcgaagctacccctgctcgacccagaattatcttctaccagcgctagtccgctccgcctctctactggctgccgtggagtggggatccgtccggacttccttctttcgctgattctttcgtggcttggggttcaggcgttcagcacatgaatccaaggtggaaccgaaacttcagtatgaagactgcacaatcaaaaaagaacaagctggttgcttccttactatttgttgcccagccttgaaactctcccacgctcaccatcatcgctgatgtacttaccatgactcagttccatccttatatataggtgcaaacaatggtcttaatattgtatgttggtagaatctggtggtattagcttccaaatctggattgctgaatcgtttgtgttactacatttagccaggatttgacagtagacacaaggagtgctgtaagatcctgtatgtacaacgtgcttcagttggtgtattgtacgtacttgggtgctacaaaaaaaaaaaaaaataaaaaaaaaaaaaaaacactgttcggcgtt

SEQ ID NO: 19783 - DNA, 807 bp, Zea mays
ctcgaggccggccggggtgtttatcaaatacaggggagtgatcaattgtatggaacggtgactcggttggcgaccctatggagatgaggtctcgctcccggagcaactggcgactcggctggcgacccctgccgcccccgtcgtccgcgccgccgccgccgccaccaccgccgctaccgctccctcccctcgtctcttgaccacgccgcactcgataggtcagccaagctcccgcgccaaccaccacaatcgccccccacccccgcccccactgcgcgtctccgccggcttcgcccgcctacaagccaccacttaccactcaggtgtcgacaatctaatcacgctcaagccaggttattgggaacaagtgggatctctacctcgacctcctccaggccgactactcagaaggggatgctctggatgctttggaattgttccgctactgctgcaggcgaatgctcatgacacatgttgacctcattgagaagttgctcaactacaacaccctagagaagaccgagacaagttaagcgagcacatcatgctccaaaaacactactgtttcgcagtatcatagagcttaggtagtatgttgtctcttctctatcagtagaaatgggttgtgagtgtgaacatgcttttgctcatgagcattcaaggacttttcatgcgacagtgcttgttgccacctatgcaacgatgttggatattttaagtgatataattgctaaaagaaagctaatgtatttgtgtgaattgggtcgataatatttcgttgacagatgtgcgtttttggttggcctt

SEQ ID NO: 19784 - DNA, 689 bp, Zea mays
cattgggtccctcgggcccggccggcccggcaatcacaacctccacgaccaacgaggcaacgaccaaacccttccccctccctagctccgtgctccagcgggagtccgcggcggcggtgaagatgattatcccagtgcgctgcttcacctgcggcaaggttattgggaacaagtgggatgtctacctcgacctcctccaggccgactactcagaaggggatgctctggatgctttggaattgttccgctactgctgcaggcgaatgctcatgacacatgttgacctcattgagaagttgctcaactacaacaccctagagaagaccgagacaagttaagcgagcacatcatgctccaaaaacactactgtttcgcagtatcatagagcttaggtagtatgttgtctcttctctatcagtagaaatgggttgtgagtgtgaacatgcttttgctcatgagcattcaaggacttttcatgcgacagtgcttgttgccacctatgcaacgatgttggatattttaagtgatataattgctaaaagaaagctaatgtatttgtgtgaattgggtcgataaaaaatcggccacaggcgtgcgtttttggttggactacatttagtgatgcatgctggtacatattttattattgtattctataactctaatcgtcatttctgatacataggagt

SEQ ID NO: 19785 - DNA, 650 bp, Zea mays
cgggccggccgggacatacaacctgcgtgccggccccgcccccatcttccagcccaaagttccatcccattgctcgctctgtccctccgttcacaacctcctctacgaccgaacgagcagagcagacccttccccctcaccagctccgggttccagcggcggcggcggcgaagatgatcataccggtgcgctgcttcacctgcggcaaggtgattgggaacaagtgggacctctacctcgacctcctccaggccgactactcggaaggggatgctctggatgctttggaattgttccgctactgctgcaggcgaatgctcatgacccatgttgacctcattgagaagttgctcaactacaacacactggagaagactgagacaagttaagtgagcaagcatatcatgctctgaaagcactactgtttcgtagtatcatatatattgtaggcggtatgttgtttcttctctatcaggattcaggagaggattgttgtgagtgtgaacttgcttttgctctcgagcattcaaggactgacaagggcatgttgcatctatgctacgatgttggagattttaatcgatataacggctaactaatactctcaaaaaaaaaaaaacaccagggggggcccggggcctttttacagt

SEQ ID NO: 19786 - DNA, 679 bp, Zea mays
gccggccgggctcgggaagccaatcggcacaatactaggtgcgttcgtagcccggccgaatcttccagcccaaagttccatcccattgctcgctctgtccctccgttcacaacctcctccacgaccgaacgagcagagcagacccttccccctcaccagctccgggttccagcggcggcggcggcgaagatgatcataccggtgcgctgcttcacctgcggcaaggtgattgggaacaagtgggacctctacctcgacctcctccaggccgactactcggaaggggatgctctggatgctttggaattgttccgctactgctgcaggcgaatgctcatgacccatgttgacctcattgagaagttgctcaactacaacacactggagaagactgagacaagttaagtgagcaagcatatcatgctctgaaagcactactgtttcgcagtatcatatatattgtaggcggtatgttgtttcttctctatcaggagaggattgttgtgagtgtgaacttgcttttgctctcgagcattcaaggactgacaagggcatgttgcatctatgttacgatgttggagattttaatcgatataacggctaactaaaaaaaaaaaaaaaaaagcgcccaaaagcccctcgtttgaccttttcaaaaaaaaaaaaaaaaaagcggccc

SEQ ID NO: 19787 - DNA, 2530 bp, Zea mays
  misc_feature (891)..(891): n is a, c, g, or t
  misc_feature (1405)..(1405): n is a, c, g, or t
  misc_feature (1451)..(1451): n is a, c, g, or t
cattgggtacctcgaggccggccgggagccctatcggtacggattgaagccggtaaatacaacctgcgtaagtagccaggccctcgcgcccagcccggaaagtcccatcccattgctcgttctgtcccttcgttcacaacctcctccacgaccaaacgatccgggttccagcggcggcggcggcggcgaagatgatcataccggtgcgctgcttcacctgcggcaaggtgattgggaacaagtgggacctctacctcgacctcctccaggccgactactcggaaggggatgctctggatgctttggaattgttccgctactgctgcaggcgaatgctcatgacccatgttgacctcattgagaagttgctcaactacaacacactggagaagaccgagacaagttaagtgagcaagcatatcatgctctgaaagcactactgtttcgcagtatcatatatattgtaggcggtatgttgtctcttctctatcaggagaggattgttgtcagtgtgaacttgcttttgctcacgagcattcaaggactgacagtgcatgttgcatctatgccacgatgttggagattttaatcgatataataactgctaactaataaaaaaaaaaaaaaaaaaaaaaccaccagcccccttgaccttgcggcctcaagtttgattggctcgtattattgcatcggccgtatgcatactcatgtgcttcgaggtatacaacggccgaaaatggccactcggtccgtcgtcgtcgcgaggtatatacaatggccactcggtcatgtgcttcgagctaggctgtacctgtacgtgctgctatgatttgatgcgtccgcatgtgcttcgcggtgcaacttgcgttgttcctaaatcatgcagcattncgcttcgttgacttccacagcatttcgcttcgttgacttccacaataggctgtacctgtacgtgctgctattattcatctgggactggcatatagtacgttcagattcttcatgttttggcctgatcaggtgtatttttcaccggatctcagtacccgtttggcctgatcaggctatggcgatatgcagacgatgttcaactttactaatctctctctctttttttctgtccaaactgtattattgcatccgtttgtgaatgcacgaattcatttgcaaggaggaacaaaactgtgatcaaagaacaaagaatcaaagagaacgaccgacctatgtacagttgtacacacacacacaaaaatggcgcgcgatccccgcaactgggggatcgagcaggcggcggattcgttcggccgccggccggtcagccctcgaagctggacgagcggctccatctccccctgaggtactcctccaacgacacggcggcggcggcggcgaagatgatcatacnggtgcgctgcttcacctgcggcaaggtaacacgtccctcccgattngctctacagtttgcgcggccggtttgggttaggttagttcctctagggtttggttcgagtcgcgcagcgacaactcggtacccctccgggcctgcagcactcaccgcgagcaccgcttgctaggctgtcagccacgtctcgagcatgtggggaggatacgttgttgtgctagcgagttgaactaaggtgtgtttgtttatcgatattacaggtgattgggaacaagtgggacctctacctcgacctcctccaggccgactactcggaagggtaaaatctcctgtcttttcatctcagggctcttatattgtggttttatcactgcatctcgagtggtgtttctgttgcatcgtgctgtggtgttttaagaggtttaaagcaagaagtttgttttggtgctgaggtaaagatatgtgatgctctgcacaagtctgagttatgccaaaaagggatacggtttctattccttttctccctatataaataaacatatccatttataagttctgtcaaagcagcccctttcctaaaatttgttatggatcctggcatatgagatcaattatgcgttatcttcagtgtggtagctcttgttaattgcaaaactttagtaatcttttttatatttctaaaattcggactctaggctgttaagaatatcaatgcaatatgctgtatatcttgttacagacaaagataaccaatagtgtattgatccatagttattcaataagagattgtgcatgtgcatactgaattactgatttagcagtagtggcattgttaattgtttgtgtccttgactatatgtctgataacgattaacagtttactgaccagagatcactgatctataggtagttttatttgtaccgcattaaaagatttgtagcctctaagctttatttgtatggtatcaaattgtcattgtgtgtcctcggttcgcctacatgttatcttagttcagattagctaagaattaagataaatatgtctgtaacttcagggtttctctttttgtgccctaaaaggatctcatgcttaaccttttgttatatttatacatccctgagtgttgg

SEQ ID NO: 19788 - DNA, 1640 bp, Zea mays
ttttttttttttttttacaacaaattctataacatttttattcacaagaatgaaggatacctagtggatgcagtgcctgtgacatttcccttaaactaactccaggtttagcagtttgaagaataagcaatacaaatgcatttctgaacatgtcagaagaatgtatggctcgtattcagtacaaaaaatgatggtaactgttcgccatatattctatagtgtcccgaggccatcactatgcgcctgattggctagctggatgagcgtagcatggctcatgtgcgcttggcccgccccgccggaaaacgggatttctgtgcgtatcaacgtagtcccatcaagatttcaactcctggctccaagacatgcccaaaccacctgaagctctcgcatgcatccaacgcggacaatcgtggcagcactgtccacatgccatcagccgcatcaaacatgaccagcctccgatccacagcattgtacaagcaaacaatccccaatctgtctgcagcctgaaaatgccagaatctgccaaacctaccagctagcaactcatcgaaaacctccgtcggcatcacgctcacctccctccaccacacctcctccgccttatcgtcgtccaaccgccagaccaccacccgatccactactccaaagctctccataccacctactaagaataggcttccatcaaaaagaaacaggtgcgccgtagtgagaccttgtggcatcacaacaggcagcacctcccatgtccccgtcacgagatgaaaaaccaagagcgcctcggggccacggccgaggacgaagagtttgctgcggtcaccggagaccgcggcgttttccaggagcgtgagagacagcgggagatcgcctctagacgcccactgcggggagggatcgccggtgtccagggtgtaagaacgcgcggctgcgccggtgatgacggcgacaagggtgcaggaggtggaggagccgcctgacgggacgatagcggataggaggtaggctccgtcggggatcggcgggaggaactggagtgaggcgcaggtgataaggagtgatggggacggggaggacacgagcgggtaggaaggaggagagagcgcggcgaacgcgggcatagtgcggacgcggcgggacagcgggtggacggcgagccgtggggaaaggaggaagaaggcgtcgaggcgatgcggggagaggagggcatggaaggtcggggagcgcagaaggcggtggaaggcgcgggacacggcggcaacgggaagtagttcggtgatggggaggagggagaggattcgctcctggaggtgcaacgggagggcatcccacgggcaggtgccggcgtcggcggaggccatggccgcggatggagatggggaggggtggatctgggattccgttttctctctgctgtttgcggtacacaacgaaatgtggggagggctcgggggcccggggccggtgaacgctgaacaggaatagggagaaaagagaagcgaacacggatgtgatcatgggaatagggaagggtgatgccactgggcccacctgtcggcatattagatctccattagtctttaaaaactctagcaagttgctaaatctatattagaaaaaaaataacatcagcttccaac

SEQ ID NO: 19789 - DNA, 675 bp, Zea mays
ctgcctcgcccgccacgcgggcgaaaacaatcacaacctccacgaccaacgaggcaacgaccaaacgtccaaacccttccccctccctagctccgtgctccagcgggagtccgcggcggcggtgaagatgattatcccagtgcgctgcttcacctgcggcaaggttattgggaacaagtgggatctatacctcgacctcctccaggccgactactcagaaggggatgctctggatgctttggaattgttccgctactgctgcaggcgaatgctcatgacacatgttgacctcattgagaagttgctcaactacaacaccctagagaagaccgagacaagttaagcgagcacatcatgctccaaaaacactactgtttggcagtatcatagagcttaggtagtatgttgtctcttctctatcagtagaaatgggttgtgagtgtgaacatgcttttcaaggacttttcatgcgacagtgcttgttgccacctatgcaacgatgttggatattttaagtgatataattgctaaaagaaagctaatgtatttgtgtgaattgggtcgataaaaattcgttgacaaaaaaaaaaaaaaaaaaaaaacacctctagtgatgcatgctggtacatattttattattggattctataactctaatcgacatttctgatacat

SEQ ID NO: 19790 - DNA, 3274 bp, Zea mays
cttcgacactactccttaagcaccaacaacattgacactacataagctcagaagtttaatgcatattgcttaaccattaaaccatattattctgaacacaagcaagatgaaactataaaatcaaacattaaaccacataacgggaacacaaaaggcaatgataagaaattaacagcacctcttcagataaatgaaatgtgaaccacaattgatcaatctccataatgaagatctgatacaatatatgccctctgcaaaaaaatgataaaaagaatgactccggagcaatatgctaccaaatataaaacagcatttatagaacatatacgagatactaatgactccagagcaatatgctaccaaatataaaacagcattcatagaacatattcaagatactagaaaccagccatgtcaaatcttgaagaatagcacaaaaattttgatatgatacacatgtccactgctaaatcaccaccgaaacatactaaagttacgacaataaagccagtttccgaacagaaaaatagaaccaaatctaatcatcatagtttttggacctcataagtacatatttctaaccgtcaaagttttgtacctcataaatactaaactaggtccctccctctggtagaagttgagctcataatagttcaaagatcttcagtctcttctcaggtagattgcttcaatgatttgcaaagactgtatcatttcgccttggaggtcgatcaggaatcgagcctggcttaaattttgatgcctcatgccttgcaagttcaggtggcacaggactgttgctctgtataagcatctgtttcagatcaaagaaaatatcagtgttctctaaagttaaaaatgaagttgccacccccttctttccagcacgacctgttcttccaatgcgatgtgtgtatgtgtcgactgaactaggcatctcatagttaatcacgtgtgcaacatcaggaatatcaataccacgccctgcaacatcagtagccacaagaacattgaaccgacgatttctaaatccatcaaggctgatctctctctggtcttgtgacttcccaccatgaagggttgtgacgcggaagcctgacttgtccagatccttagcacgcatgtccgctgtcttcttagtattgcagaacacaatggctgttttgtctccgagatctgtgagtatcttctggagccgtggcatcttctcagactccttcaccatgatcacattctgggtgatcagatcagtggccttgccagctgtaccaattgtcacaacaactgggtttcggaggtacttcctagcaagacgctccacagcaggaggcatggtggcactgaacatataagtagtcctgtaaatcctcttctcatcaagttcctcatcctcattttcaggtttcaagttactcgatggcatcgcgtcaaggacaccaacaacttgcggctcaaagcccatatcaatcatcctatcagcctcgtcgagcacaacatagttgcactggttgagaacagcatacctcctttccaagcaatcaagaagccgaccaggtgtagcaattacaatctcacagccctgcctaatcttgaaaccctgttcctcaattgactgaccaccaacaattgagacaactttgatgcctagataggttgcaaatttcacagtctcctcctcaatttgttgagcaagctcacgagtaggtgccatcacaacggcatagggaccctcagcctcattctcctcacttatgggcggcaatcgggtaatgtaagacaacatggggagtacaaaggctgcagtctttccagaacctgtctcagcaataccaataacatcacgctgctgtagacctagcggaatggcagccatctggattggtgacggtttttcatatccagccttgtcaatagcacgaagcaactcggtgccaagcttgctttcactccactttcgcatcggtcggggtatgcgagaacccttataggagatattgaaatcctcacggaaaattcgccaatcccgctcagtcatctcctcgagtgccttttcggaccagtgcctgtccacacgcatatcgaaagcatcataaatttcagcagcagcagccttcttcttatctaccgcatcatcctccggacggtcctccacacccgagccttgcgccgcagctctgcacgggtctccttctcgtgcacagctgccgccttcttctgctcacgtcggtcaatgccggcaaggaagccccggccaaagagcagccgggcctcgtgcggcgactggtagagtgcattcatgtcccggctggtgtcctcggtgttttcccagtcgaaggagaagcggaacttctcagagggcttgataacccgcttcttgggcttcttggacccgaggtactgctccttgatcgcgtcgagctccttctcacgctcccgctccgcaatcttctccagccggtccctctcccggtccccgcgatccctgtcgcggtcccggtcccggtccctatcacggtcgcgccggtcgcggtccctgtcgcggcgggaggagtcatctcggtcgcggtccctatctcgatctcgatcccgatctcggtcgcggcgggagtcgtcgtcgcggcggcgttcccggtcttggtcccggtccctgtcccggtcggagtcgcggttggagttggaggagtcgcgacgtgcggggttggagccggacgggggaggaccaccggaagtcggcggcggagggggccggggcagggactggatgaggtcgagcgcggtgcggcgctggtcggagacggcggcctggcggcgctcaagcgcgaggcgctcccgctccgccttggtgaggaacacaggcttcaccggctcagtcatcgcgtcggcggagcgcttcatccccgcggcgccgatgcggcaagtggggagaagggtttgctgagtgtggggcggatgacggtttagggaacaggtcaaccgtaggtccgtagctattcacctacggttaagtcgtgttaagccgtagggctcagattttttttctttcaaaaagagaatctagctataaaaagaatttagacgtgaagaaaatcccagtgtcatggagattagggacgaagtcagaaaaaaattagaaggtgctgaactaaaccactatagtatagaagctcctctacgttgtatatatacgctaaaaatcttatgagaaggtcaagtggagctccatagactcagtagcggtaggaggggcttgagccccgttcgtcccaccgctgcc

SEQ ID NO: 19791 - DNA, 2629 bp, Zea mays
ggccgcttttttttttttttttttagtcaaatcttgcagaatagaacaaaattatgataagctacacatgtccacagctaaatcaccaccaaaacatattaaagttatgacaatgaggccagtttccaaacagaaataaaaccaaagataatcgtcatagttttacaacctcataagtacatatttctaaccatcgaagttttatacctcataaatactaatctagattcctccctctatggtagaagttgagctcataatagtccaaaagatcttcagtcccttctgaggtagattgcttcaatgatttgcaaagactgtatcatttcgccttggaggtcgatcaggaatcgagcctggcttaaattttgatgcctcatgccttgcaagttcaggtggcacaggactgttgctctgtataagcatctgtttcagatcaaagaaaatatcagtgttctctaaagttaaaaatgaagttgccacccccttctttccagcacgacctgttcttccaatgcgatgtgtgtatgtgtcaactgaactaggcatctcatagttaatcacgtgtgcaacatcaggaatatcaataccacgccctgcaacatcagtagccacaagaacattgaaccgacgatttctaaatccatcaaggctgatctctctctggtcttgtgacttcccaccatgaagggttgtgacgcggaagcctgacttgtccagatccttagcacgcatgtccgctgtcttcttagtattgcagaacacaatggctgttttgtctccgagatctgtgagtatcttctggagccgtggcatcttctcagactccttcaccatgatcacattctgggtgatcagatcagtggccttgccagctgtaccaattgtcacaacaactgggtttcggaggtacttcctagcaagacgctccacagcaggaggcatggtggcactgaacatataagtagtcctgtaaatcctcttctcatcaagttcctcatcctcattttcaggtttcaagttactcgatggcatcgcgtcaaggacaccaacaacttgcggctcaaagcccatatcaatcatcctatcagcctcgtcgagcacaacatagttgcactggttgagaacagcatacctcctttccaagcaatcaagaagccgaccaggtgtagcaattacaatctcacagccctgcctaatcttgaaaccctgttcctcaattgactgaccaccaacaattgagacaactttgatgcctagataggttgcaaatttcacagtctcctcctcaatttgttgagcaagctcacgagtaggtgccatcacaacggcatagggaccctcagcctcattctcctcacttatgggcggcaatcgggtaatgtaagacaacatggggagtacaaaggctgcagtctttccagaacctgtctcagcaataccaataacatcacgctgctgtagacctagcggaatggcagccatctggattggtgatggtttttcatatccagccttgtcaatagcgcgaagcaactcggtgccaagcttgctttcactccacttccgcattggtcggggtatgcgagaacccttataggagatattgaaatcctcacggaaaatacgccaatctcgctcagtcatctcctcaagcgccttctcagaccagtgcctgtccacacgcatatcaaaagcgtcatacatttcagcagcggcggccttcttcttatctacagcgtcatcctctggacggtcctccacaccagccttgcgccgcagctctgcacgggtctccttctcatgcgcagctgccgccttcttctgctcacgtcggtcgatgccagcaaggaagccccggccaaagagcagtcgggcctcatgcggcgactggtagagcgcgttcatgtcgcggctggtgtcctcggtgttttcccagtcaaacgagaagcggaacttctcagagggcttgataacacgcttcttaggcttcttggagccgaggtactgctccttgatcgcgtcgagctccttctcgcgctcccgctccgccatcttctccagccggtccctctcccggtccccgcgatccccacgctccctgtcgcgatctcgctcccgctccatatcccggtcacggtcacggtcgcggtcgcgcccgccccggtctcggtctcggtcgcggtcgcgccgggaggagtcatctcggtcgcggtcgcggtcgcggtccctatctcgatcccgatctcggtcgcggcgggaatcgtcgtcgcggcggcgttcccggtctctgtctctgtctctgtctctgtctctgtctctgtcccggtcccggtcccggtcggaggaatcgcgatgagagttggatgagtcgcgaggagcggggttggagccggacgggggagcgccgctgggagccggcggaggaggggcccggggcagggactggaggaggtcgagcgcggtgcggcgctggtcggagacggcggcctggcggcgctcgagcgcgaggcgctcccgctccgccttggtgaggaacacaggcttcgccggctcagtcatcgcgtcggccgagcgcttcatcgcggcggcgccgatgcagcgagaggggaggagggtttgcgattat

SEQ ID NO: 19792 - DNA, 769 bp, Zea mays
  misc_feature (12)..(12): n is a, c, g, or t
  misc_feature (732)..(732): n is a, c, g, or t
gacccacgcgtncgctagttctagatgcgagcggcgcttttttttttttttttgaccaaccatataatctctccttacattgcaagagaaggttacagcaggacagctactactagcacactactagcggcaggattacaactagaggaggcggtggcaagaacacagcaagcaacgggagggggaggagaggaacagagctgctagcctagcgcggacacggattattaactcgccttgttcgaaccgacgagctactacttagccgggaaaacttagcatagatccagacggacggatctgtctggggctcagatcatgccgcacgtccagcgaatcgggccctcctctcctttcgccgcctttgggcgcggcgtctcgggggccggcgcggttgctagccaagtcaggcgtacacgacgccggaggagagcgccatgagcaggatggccgcgcgctcctcctcgcccaggcggcgcctccgccgcatccgccgccgctgcttcagcaccacctccttgccgaaccccaccgcgcggagctccacggtgacctcgtccgcctccttgttccgctcccgctcacgctcccgctcccgcttggaggaggcggcggccgccgccgcggtggccttcttcttccgctgctgctgctggtgctcgctgccgccggcggtggcggccttgctgctggactcgaggcccatggcctcccgtctcttcttccggtacnggatcccgcacgcgttgcacaacgacatgggtccgca

SEQ ID NO: 19793 - DNA, 354 bp, Zea mays
aataccaaaactaaaattcccatatattgttaattgcattacctaccattacaatttatataataacagcgatcttaatttttgtttagaagcaggcatgactacactcagccatcgtagagtagcgagcatgagttcgccccccaatgcaacagtagcacttgttatctttgcatggaggaaaccccacaacgcatcgtgctccgtttccttgcataattccttctttagcctttccatgtgcatgagcagcaaagtatccgaggagaagtaacgagaaaaacactagcgcatccaccctctttctgtactccatgtcgcaagacaatttaaggaactcctcaccctgccccg

SEQ ID NO: 19794 - DNA, 732 bp, Zea mays
gccccccctttgggcccccccggttttccctttttttatccggcccttattttttttgggatttttgtggggtaaaacattttccccgggaaccagtttttccccttttttcccccggggggtattttcccccccttaaagggccaaaaaattggggtcccggggcccttttttttttttttttttggtctatttttctttttttttcttttttttttttttttttttttttttttttttttttttttttttttttttttttttttttttttttttttttttttaataccaaaactaaaattcccatatattattaatagcattacctaccattacaatgtatataataacagcgatcttaatttttgtttagaagcaggcatgtctacactcagccatcgtagagtagcgagcatgagttcgccccccaatgcagcagtagcacttgttatctttgcatggaggaaaccctacaacgcatcgtgctccgtttccttgcataattccttctttagctggagtagaaacaccgacatcatctgtgacatgacccttcccatgtgcatgagcagcaaagtatccgaggagaagtaacgagaaaaacactagcgcatccaccctctttctgtactccatgtcgcaagacaatttaatgaactcctcacgattgatcctagaagagtgtatacttatatatatatttacactctcccggccccggcctcccgggta

SEQ ID NO: 19795 - DNA, 670 bp, Zea mays
ccccccgagttaccccttttacttacgcgctcctatattttgtgcaaaattgttccggttacaatttttcccacaaaacacccctatccccattttcccccaaagcccccttttacccctcttaaaagaacaaaaaaatttgctccccagtcaactttttttttttttttttttttttttttttttttttagattttgtcttttttttgtgttttggttttttgtttaataccaaaactaaaattcccatatattattaatagcattacctaccattacaatgtatataataacagcgatcttaatttttgtttagaagcaggcatgtctacactcagccatcgtagagtagcgagcatgagttcgccccccaatgcagcagtagcacttgttatctttgcatggaggaaaccctacaacgcatcgtgctccgtttccttgcataattccttctttagctggagtagaaacactgacatcatccttcccatgtgcatgagcagcaaagtatccgaggagaagtaacgagaaaaacactagcgcatccaccctctttctgtactccatgtcgcaagacaatttaatgaactcctcacgattgatcctagaagagtgtatacttatatatatatatatactataatcctagaagagtgtatacttatatatc

SEQ ID NO: 19796 - DNA, 1563 bp, Zea mays
ggcgtatgtatacgtatgagcataaggaaaataattaagaaaatatttgtagggattttaaaagtgatttcctgagggtatttttcttaggagaaaaatatttgggagaaatatcgttggaacatttagccagtatttctgaaaagaatttaaggggatcactagggaaatatttgtaggatattttgagaagaattttggagataagtcagaccactatattttctttgttgagatcaactcgcaagaaaacaatttgaaacaaaatttaaaattcattttgaatttagagcgagtttgagaaattttctaggtttggattttcggggtgctacaaggggctgacgtcatagggctgagaaaatagatgtaaggatgcgacaaaaaaagaaagtctaacaaggaagtctaactctcatgatcgtgccatgtgcccccaaaaggtcctaatgaccttatcgttactatttgcgaggagtctccccaatcgggtgacctcttgcgatcgtcgcttgatccaccctcgttcggcgccacctccttccctttctgggatgtttcttggcttggagcaccctcctcctagcgggcaacatcggctttaggagccacttcccctgatgaggcatgtcgcatccaaaagcctctagcatctgtctgagtggacatctggaaccaccttgagcatcaggttgccaccgctccgacctcgcaccaacgacttgttcggctgccctgtaaccacaggacctgcagctgttcggacggctgcagctgcaatccatagagacaaaatactgtacaagccgcagccggattaatgccacagcaagccgcaaaccttctgtgtcgcacgaaacattcgtggtgttgacaccgatatgggaggcaactactgctactcaggatttttccgctaacgtgaccgaatgcacgttctcctagaaacgtcctcattctgtgcagtgtgatttataccgataccgttgtctatccgcaacagcatccgtgagctgatggaggaatcccaaagcattctaatattttttcattaaaatttatagggaaacatactttatatttaagtcctctaaaaaactggttagattttgactaaatttcgtgaattggaaaaaagtataataccaaaactaaaattcccatatattattaatagcattacctaccattacaatgtatataataacagcgatcttaatttttgtttagaagcaggcatgtctacactcagccatcgtagagtagcgagcatgagttcgccccccaatgcagcagtagcacttgttatctttgcatggaggaaaccctacaacgcatcgtgctccgtttccttgcataattccttctttagctggagtagaaacaccgacatcatggcatgacctagtagaaggtaaaggataagagttctattaccaacaaatgcctcgagaataattacattcgaaattatttgagtaatttaacacaggggattgcgatacattagcaattcgccatgatacacacacggtatcatataataacattttctaaattgtc

SEQ ID NO: 19797 - DNA, 1706 bp, Zea mays
  misc_feature (1665)..(1665): n is a, c, g, or t
tagcggccgcccgggcaggtaccatacagcgacttcctggccagcataaacaaggaccaggtgaagaaggttgaggtggacggcgtgcatatcatgttccgactccgcccagaggtggagtcccaggtccgtgttgagcagacaccgacacagcgcggagcagattatgtcattgataatgctggagtttcaaggagaatcgtgttcacgacgactcgtccagtggacataaagacaccatacgagaagatggtggaaaacatggttgaatttgggtcaccggacaagaggtctggcggcatgctcaattctgccctggtaggtcttatctatgttgtattgattgcggtagttttgcagcgcctgccaataagcttttctcagcaatcacccggtcagttgaggaataggaagaattctaattccagcggagcaaaagtttctgaaagttcggatatagttacatttgctgatgtggctggagtagatgaggcaaaagaagagcttgaagaaattgtggagttcttaaggaacccagaaagatatattcgtctcggtgctcgccctcctcgtggtgtcttattggtgggtcttccagggactggaaagacacttcttgcaaaagccgtagcaggagaagcagaagtcccattcataagttgctctgctagtgaatttgttgagctatatgtaggcatgggagcagctcgagtacctcggccgcgaccacgctacaaaaaggaatcgccatcgattatttttatcgatgagattgatgccgttgcaaaaagccgtgatagtcgatatcgcattgtcagtaatgatgaacgtgagcagacattaaaccaattgctcacggaaatggatggctttgataccaactcggctgtcattgtactgggggcaacaaatcgagctgatgttttggatcctgcccttaggcgccctgggagatttgaccgtgtggttatggttgaagctcctgataggtttggaagagaatcaattctaaaagttcatgtgaaaagaagagagcttccactgagtaaagatgtagatctagccaatattgctgcaatgacaactggttttactggagcagaccttgcaaacttggtaaacgaagctgctctgttggctgggcgattaaataaagaaatagtggaaaaggttgacttcatccgtgcggttgagcgatctatagcagggatagagaaaaagcatgcaaaattgaagggtaatgaaaaagctgttgttgcgcggcatgaagtaggtcatgcactcgtgggaactgctgtagcaaacctccttcctggacagccacgtgtggagaaattgagtatattgccaagatccggaggtgcattaggcttcacgtacacccctcccaccacagaggatagatatttactctttgttgatgaactacgtggccgtttagtaacactactgggtgggagggcagcagaggaagttgttttagcaggacgggtttcgactggtgcacttgatgacataagacgtgctactgacatggcctacaaagctgtagcagaatacggtcttagtcagcgcatcgggccaatatcacttgctacactgtcaaatggtgggttagatgactctggtgggctctcccatgggaaaggaccagggacatctagntgatctcgttcagaggggagtaaaagcgcttttacagtcgt

SEQ ID NO: 19798 - DNA, 1092 bp, Zea mays
atagttttccacttgtagcatcggcataggtgccggtggcaacattgaagcccgaagtatattggaaagtagtatatcaatacaggaaccatagtccgtataagcattaattatcctattgatcatctctaggatcatattgtaaagaggaaaataacttctaacagggtgaggacaagaacctagggcaaaaaaagaatcttttacatgtgtaacaccgacccgatctatgaacatgtgaaaactaaccgcttcaaatattcctgaggttgatcttacaatgttacaggtcaatatgaatcatctcttttttttggtactcatgggtccgcgaactgcaatggtaaatatttacatggtcactcgggcatgtagatttccttttctgaaaattctcctctaaggctcgagctcatgattcaacgaacgaagggtgggcgcccaacccaagtttgtcttagcatgagtgggtgggagaggtcatacaatccaccacatggccacagatctgtccccagtatcaaggtttccattgcataccttggaactcgcattgtatgttctaattgctggaagacttctgttaagtaattaattttaagcgcccaaggtgtactcctgacgctaggagcctgcttccagctgaagaacttgctcttgctgtcctctgataaaagaggtcaactcttttgatgcaccaaccgcctttagccactcttcaagttcctcgccttcaaccttttcattctcttctaaatatgctccgaggccttccaaaactgcaggattagcacgaataactgaaagagctacttccagtgccgtctgtaaaagcgcttttacttccctctgaacgagatcaactagatggccctgatctcttccccatggagagccaccggagtcatctaacccaccatttgacagtgtagcaagtgatattggcccgatgcgctgattaagaccgtcttcgtgctacagctttgtaggccatgtcagtagcacgtcttatgtcatcaagtgcaccagtggaaacccgtcctgctaaaacaacttcctctgctgccctcccacccagaagtgttactaaac

SEQ ID NO: 19799 - DNA, 1147 bp, Zea mays
gaagcccgaagtatattgaaaatagtatatcaatacagggccccttgtccgtttttgctttgtcctattgatcatctctaggatcatcttgtaagaggggaaaataatttctaacagggtgaggacaagaacctagggcaaaaaaagaatcttttacatgtgtaacaccgacccgatctatgaacatgtgaaaactaaccgcttcaaatattcctgaggttgatcttacaatgttacaggtcaatatgaatcatctcttttttttggtactcatgggtccgcgaactgcaatggtaaatatttacatggtcactcgggcatgtagatttccttttctgaaaattctcctctaaggctcgagctcatgattcaacgaacgaagggtgggcgcccaacccaagtttgtcttagcatgagtgggtgggagaggtcatacaatccaccacatggccacagatctgtccccagtatcaaggtttccattgcataccttggaactcgcattgtatgttctaattgctggaagacttctgtaagtaattaattttaagagtcctgacgctaggagcctgcttccagctgaagaacttgctcttgctgtcctctgataaaagaggtcaactcttttgatgcaacaactgactttagccactcttcaagttcctcgccttcaaccttttcattctcttctaaatatgctccgaggccttccaaaactgcaggattagcacgaataactgaaagagctacttccagtgccgtctgtaaaagcgcttttacttccctctgaacgagatcaactagatggccctgatctcttccccatggagaaccaccagagtcatctaacccaccatttgacagtgtagcaagtgatattggcccgatgcgctgattaagaccgtattctgctacagctttgtaggccatgtcagtagcacgtcttatgtcatcaagtgcaccagtggaaacccgtcctgctaaaacaacttcctctgctgccctcccacccagaagtgttactaaacggccacgtagttcatcaacaaagagtaaatatctatcctctgtggtgggaggggtgtatgtaaagcctaatgcacctcctgaccttggcaatatactcctggccggcctcgaggtaccc

SEQ ID NO: 19800 - DNA, 1076 bp, Zea mays
ggccgcttttttttttttttttttccaggaaccatagtccgtataagcattatcctattgatcatttctaggatggtatatagaggaaaacaacttccaatagggtgagtacaagaatatattgccaaaaaagaatcttttacatgtgtaacaccgacctaatctatggaacaacatgtgaagctgaatcacttacaatattcctgaggttgatcgtacaatgttacagctcaatatgaatcatctctggatttctttttttgtagtcaagggttcaggaactgcaatgatagatatttacatggtcactcgggcatgtagattttctttttttttcctgaattctcgtatagggctcgatctcatgattcaccgaacaaagggtgggcatccgaccagtttgtcttagcagacccggtttgtcttagcatgaatgggtgggggttcatacaacccaccacacatggccacaggtctcttcccagtatatgaaggtttccattgcataccttgtgtctcatattgtatgttctaattgctgagtcacttttgttaagtaattaattttaagagcccggtgcatactcctgacgctaggagcctgcttccagctgaagaacttgctcttgctgtcctctgataaaagaggtcaactcttttgatgcaacaaccgattttagccactcttgaagctcctcgccttcaaccttttctttctcttctaagtatgctccgaggccttccaaaactgcaggattagcacgaataactgaaagagctacttccagtgacgactgtaaaagcgcttttacttccctctgaacgagatcaactagatgtccctgccccttgccccctggtttgagcttagtgcttgcagatgacaacttacttaatagttcttgaaggtgtaggaaaagtttcgaggcaaacctggtcctttccccatggagagccaccagagtcatctaaaccaccatttgacagtgtagcaagtgatattggcccgatgcgctgactaagaccgtattctgctacagctttgtaggccatgtcagtagcacgtcttatgtcat

SEQ ID NO: 19801 - DNA, 1441 bp, Zea mays
cacttaaacagcatgcatccattacattccactcaattaattcaaaattttgaataatgctacatctatatccccttcttacttctccaaaaagggccttctctgaagtacatcagagccttacaggggatcaatgtctcagatgctatagaacacatctcagctagagccagtgcatgtgagattcacatcaggtattctttttctaaaaaaggagaactacaccagtcattcagcaataagccaatgtggtcacatggagaagaaaatgaacttatttgtaatcacgcaactgtcttcctgttgcgatttgcacttgtgccattgtgcggttgtaaagagtagctgcttgactgtggtacaaaaaaaaaaaggtacaacctctacaaaggatggaacaatgtccttctggcgatcagaagttagttaagattctatcttttgacaaaccatcggcaacaagaactcttgtgatctcctcactcatctgtttatgcccacacaaaattactcccactgatggagggtttacagtattcttcatccttgagaacacattctggatataacctctctcccctgtccattgactatctggtctggagaggacaggtacaattttaactcctctggattcccaatcctcaaacctttcctgatatgccatcctctgaagatttctaaccccataaaagagtcttacatcagtttttttgttttcagcaaaacctgactcaataagtgaccgtatagggctgatcccggatccggtggcgaagacgagaacgtcgagggcatcagatatcctggcgacatcaaatccgcggccgacgacgctggcgccaacatggacaaggtcgccggggcggaggtcgcagaggcgcgcggagggggttcccgggaggcgcttgacgaggaattcgaagcaggaaggtggcccggctagggctagggtctcgagcgcaggtgggggaggaggggatgcgatggcgaggaagatgtggtaggaagaggcggggaggcggaagcggaggaactggccggcggcggtgtgggaggcgaggagcccccggtgcgcggagaggtcgagggagacgtggaagagcgatgcgtcggcggtggcagggcgcacggaggcaagcggagcctcggcccactcaattggggactgggccggggccgggaccgggaccgcggaagcgagcgcggcggcggagaggagccggaggtggtgcgggcggagtaggtggaggcgacgcggcgcggagcgcagaatcatggagggcgtcccgcgtcccctcgagcggtggtcggcgatctgcagggcgtgcaggactcagaacaggacacggcgggcgagccagacgaggagggcgagggacggtgccggcggcaccccgcccgctgcactcccgcgaggccggaaaaccttttttttcct

SEQ ID NO: 19802 - DNA, 3413 bp, Zea mays
cctcgccccgcggccggcccggaaccttcgcctctcctcccgttgtcagccgccgtgcctgttctctctgcctttctaaaagtgcggcgactggttgggctgccgccgactgccggggccttcgccgacctcttcgccggcgaagaggtcccatcaggagaaggagtagatcgtcgacccagaaccctcgctgatggcgactttcgcgaaacctgagaacgcgctgaagagagccgaagaattaatccatgttggtcaaaagcagtcagccctgcaggctttacatgatctcattacctcgaaaaggtacaggtcatggcagaagcctctcgaaaagatcatgatgaagtatgtagaactctgtgttgacctgaggaaaggcagatttgcaaaagatggtcttattcagtataggattgtctgccagcaagtaaacgtgtcatccttggaggatgtcataaagcacttcatgcagctttcaaatgagaaagctgaacaagctaagagtcaggtcgaagcactggaagatgctctggatgtcgaagatcttgaagcagacaagcgtcccgaggacctcatgctcagttttgtcagtggggagaaaggaaaggaccgatcagataaagaggttgtaactccatggtttaagttcctctgggagacatacaggactgttctagagatactaaggaacaattcaaagcttgaagcgttatatgctatgactgctcatagggcttttcaattctgtaaacagtataagagaacaactgaattccgtaggttgtgtgagatcatcagaaatcatcttgctaatctcaacaaatatcgcgatcaaagagatcgtcctgatctgactgcacctgaaagtttacaactgtatcttgatacacgtgttgagcagcttaaagttgctacagaactctccctttggcaggaagccttccgatcggtggaagatatccatggtttgatgaccatggtgaagaaaatgccaaaaccatctatcctggtggtctattatgcaaagttgactgagatcttctggatatcggacagccacttatatcatgcgtatgcgtggctcaagcttttcaacttgcagaagagctacaataaaaacttgtctcagaaggatctacagttaatagcatcttctgttttacttgctgcactatccgtgtcaccttatgacaaaaaatatggtgcatttgagacagagaatgagaaagagcgcaacatgcgtctgtccaaccttgttaacttttcgcttgataacaagcgtgaaaacagggaaatgccttcaagaccatatcttctatcagagttggcctccaaaggagtcctttcatgtgcttcccaagaagtgcgagatttgtacaaccttttggaacatgagtttctacctctggatcttgcatcaaaagtgcagccacttcttttgaagatttcaaagattggagggaagctttcatcagcttcttctgttcctgaggtcaagttatctcagtacatttcagcattggagaagctgacaacattgagagtgctacaacaggcctcttgtatttttaaatccataaagattgatatgctctcaagaatgattccattctttgacttctctgtcgtggagaagatttctgttgatgctgccaaacaaaattttgttgctataaaagttgaccatttatcgggagttgttcagtttggtactgtggacatagaatctgatggcttaagtgatcaccttagtgttcttgctgattcattaaataaagcaaggattcatatctgtccaccagtgaaaaagccatctaaactcggtgaaagtctcattagtttggctgcaatagtggagaatgaacataagaggctgcttgcaaggaagtccatcattgaaaaacgtaaagaagagcttgagcgtcaaatattggagaaggaaaaagaagaagaaaaaaagagaatgagcagtcaaaagaaaactgtggatgaggaaagggtgaggcttctcaatgaacagaggcagagggagcaggaccggattcgtagagagatagaggaaaaaaataaagcagaagcaaaaaagatgctagaagatttgaataaggcagggaaaaaacatgtcgttgttgaaggggagcttactaaggaggccatcatggaattggcacggaatgaacagttaaaggagcgccacgaaatggagaaaaaactgcagaagtttgcaaaaacaatggattatctggaaagggcaaaaaggcaggaagaggcaccactgattgagcaagcttttcaaaaacgtcttgaggaagagaagatccttcacgagcaagagcagcttcgggagattgaactcagcaagcaacaccatgccagcgacttgcaagagaaaaatagactttcacggatgttggagcacaagaatgctttacaggagagaatcatccaagaacgtgcagctgagtttggccgtctgaagaaagagagagatgaacggatgaatcggttgatatcttcaagaaagcatgaaagggagacagtaaggaagttgatgttttatctgaacctggaggaacagcggattgaaatgcttcgtgaggaagaggaagctagaaaacgtgaagcggaagagaggaggaagagagaggaggctgaaaggaaagctaaacttgatgccatcgctgaaaagcagcgattgagagagatagagctggaggagaaggcaaaggcaacaagggagaagctcttaaagggatccgaggctgtgcgcgctccagattctgcacctgttgcacagccacctcgagagtcagcagcagcgcctgcagctgctgcggcggcggctgctcctgctcctgctcctagtaaatatattcccaagtttaaacgcggtggtgatagcagcagcatcccttctggcagccgcgatgaagatcgctggggttcacgtggtccgctcaggcaagatggtcctcctgcacgactggatgcaccctcatcacggcaagatactgatcgctggcgtggatcaagatttccctctaactcaacgtcctcttcatcaacctggagccgttcacggaactgatcctatgctgcaggacttttttctagcccatgtgtcgacctccgtgcacaatgtctaatcgtacctttccaggcactgcactccatgcatattgtcgctgttttgtacttttgtagtaatactctacaatccatgattattgtccctgtttgttagtaatgctgttttatctgtgcatgaaacactctatacctacatatagccaagaattgcaggactatgtatgcatgtaaaacttgcaagattatcaatttttatgagctataaaattaatatctgtgggcaaaaagagttgtaaaaaaagggcggccgctctagagga

SEQ ID NO: 19803 - DNA, 3532 bp, Zea mays
aatgacccacccatcatcaaatgtggaaatatggtatgaggcatacataatcgtagaagatgtacatgctgcgagactcgcacttctagtcattttatgctgtcaaaaatacactacgaactatagatcagcaacagcacaaaaaacatggtttcaaaaatgacaatggtgtgcagcattatgatttatgcgaagatgtgcctaacaatagcaatgaacagaaccaaagcttgtaatagagggaaattccactaattgtagaaggtgctatcaacctgtctaatagttagagtgtcaagatacaaatgactcggaaaataagcaaaatgaacatacctcactcatctgtttatgcccacacaaaattactcccactgatggagggtttacagtattcttcatccttgagaacacattctacaaaatagaaaagaaactctataacacacaaaaacacaacaaactagaaataacatgggactcaaaagatgacagcacctggatataacctctctcccctgtccattgactatctggtctggagaggacaggtacaattttaactcctctggattcccaatcctcaaacctttcctgtcagcgcaacataatcaccagtcattatagaatgaatatgacaatatacaaaactgcacaactaagctgacataaacctacctgatatgccatcctctgaagatttctaaccccataaaagagtcttacatcagtttttttgttttcagcaaaacctgactcaataagtgaccgtatagggctgcaattaacaaatgcggagagacagaataattattatatatcccatgtaagtacatctgcatgtcttgataagtgtacaccatacgcgtttgtaatagatacactatagtcttcttagaacaagtatctcagtatctagagaacaggcttctagacacaatgatgtttgtggctcaatagatctgacaagagctattcatgggaatcatattgctcatccatagaaagaatagagcaatctaatcaagaatagggcattgtcggtaaattgcttgacacgacatgtggcagtagaaaacagacatgcaacaattgatgagtaaaaactgaagtaaaaacctaataaatagtatcttgcggttaatgccttttcatgtttatatcttccacagagtatgtgcatgttccgattatatcccaactcccaagcaggcccgtcccttgcccagcacaagtggaccgacaatataaggccccaatttttgggcaccccaaattcctggctagaaggtttgaacaattattttttacacattgttgatcaagctattatttgttgattaaggtttgagtaatatcatcagggttacaataaaatgattggattttttgtttacttcacataagttgtgctctttagatgacaaaagtttattgtcttcttgtactcaacttgagatggcactaaagagtggccaacattctgatgtcaacggcaagaatttgcatatagtgttaatgttcttccaagattttatctctaacaaagacatgggccctcatgatattctgaagtttgtgaagtggtattctatacaaaattttgttgactattctgcggtcccctgcatctggagaacaaagttttcaaaattgaagtggctcaagtcccacatgcgcagtactatgacacaacagactcaatggattgacaacaattgcacttgaaaatgatgttccagagaagattaaatatgagaatgtaatggaagatttcatttaaaagaacgccagacgcaagagtctctctactagaagttaaatcagtgagtgtgatacacccttctaatttttaacgttaatatctattgctatcctaaataatgagacaaacacagtggaataaaatttatgttatatttatctctatatagtatagtctatatgcttttttttttgcactggggcaaaaacagactagttgaaagtaataccagaatagatactggactatcataatccagatggcagtatggcacccctcacgattatcacaatttaatactattttttttgccacaattcctaattacaccctaaaatgaagcaattgtgcatcgtggagtacaatcgatacgtgtttgacaatggcaggggtacctgatcccggatccggtggcgaagacgagaacgtcgcgggcatcagatatcctggcgacatcaaatccgcggccgacgacgctggcgccaacatggacaaggtcgccggggcggaggtcgcagaggcgcgcggagggggttcccgggaggcgcttgacgaggaattcgaagcaggaaggtggcccggctagggctagggtctcgagcgcaggtgggggaggaggggatgcgatggcgaggaagatgtggtagagaagaggcggggaggcggaagcggaggaactggccggcggcggtgtgggaggcgaggagcccccggtgcgcggagaggtcgagggagacgtggaagagcgatgcgtcggcggtggcagggcgcacggaggcaagcggagcctcggcccactcaattggggactgggccggggccgggaccgggaccgcggaagcgagcgcggcggcggagaggagccggaggtggtgcgggcggagtaggtggaggcgacgcggcgcggagcgcagaatcatggagggcgtcccgcgtcccctcgagcggtggtcggcgatctgcaggccgctgcaggactcagaacaggacacggcgggcgagccagacgaggagggcgagggacggtgccggcggcccggcccgcgctgcactcccgcgaggccggaaaaccttttttttcctgaggccggaaagctgttgaggcgtacaccttcaatttctctttctccctcttttgcagtaaaaaacaataatgcaccgtttgaatcattgtaatttaattccattctaataatagtaatttaggcatatatcaattaagctaattcggttttatgtaaaatatatttgtatattatcattaacaacatgtcagagatatttatgtgctacatttttactatagaagagtgagacgaaaaatgtcatgtaagttatagattagaaaccaattctagtaatgcataaaatcattatcccaccttccaccccattcatttgagatagtcttatatctgaactttagaaagtggtggaatgtcaaattcctaactaaataagttactttattgagtgaattccaatttctctaaaatgaagggatctaaacgccccgtaatatcttatttaggtgtagatattagaacataaaattaggaattggaatcggttttataaaattctattgtttggttttagagactcaattttctagaattgtactaaaactaaaaacgccatctctcaatacacacatcatcctttttatgttgcgtggaattagaccacacaattccaaactttcaaatttttagtgatatctaaacaatagaattagaagtacatctcattttaataatatgattg

SEQ ID NO: 19804 - DNA, 2763 bp, Zea mays
taaccgccagccgcgccttttcctctcctcccggtgccagccgccgtgcgcgctctcttcgccctacggaaggtgcggaggtgccgagatcttgctcgatctcttcggcggcgaagagcgccaaccagatccgccctgtttgttggtgtggcgccggagcaggagtaggtcgcggccacagaaccctaggagcgaccatggcgactttcgcgaagcctgagaacgcgctcaagagagccgaagaattaatccatgttgggcaaaagcaggcagcactgcaggctttacatgatctcattacctcaaaaaggtacaggtcatggcagaagcctctcgaaaagatcatgatgaagtatgtagaactctgtgttgacctgaggaaaggcagatttgcaaaagatggtcttattcagtataggattgtgtgtcagcaagtaaacgtgtcatccttggaggatgtcataaagcactttatgcagctttccaatgagaaagctgaacaagctaagagtcaggtagaagccctggaagatgctctggatgttgaagatctggaagcagacaagcgtcccgaggacctcatgctcagttttgttagtggggagaaaggaaaggaccgatcagataaagaggttgtaactccatggtttaagttcctctgggagacatacaggactgttctagagatactgaggaacaattcaaagcttgaagcgttatatgctatggctgctcatagggcttttcaattctgtaaacagtataagaggacaactgaattccgtaggttgtgtgagataatcagaaatcatctcgccaatctgaacaaatatcgcgatcaaagggatcgtcctgatctgactgcacctgaaagtttacaactatatcttgatacacgtgttgagcagcttaaagttgctacagagctttgcctttggcaggaagccttccgatccgtggaagatatccatggtctgatgagcatggtgaagaaaatgccaaaaccttctatcttggtggtgtattatgcaaagctgaccgaaatcttctgggtatctgatagccacctttatcatgcgtatgcgtggctcaagcttttcaacctgcaaaagaactacaataaaaacttgtctcagaaggatctacaattaatagcatcttccgtcttacttgctgcactatctgtggcaccttatgacaaaaaatatggtgcatctcatcttgagacagagaatgagaaggagcgtaacatgaggatggccaaccttgttaacttctcgcttgattccaagcgtgaaaatagggaaatgccttcaagagcatctcttctatctgagttggcctccaaaggagtcctttcatgtgcttcccaagaagtgcgagatttgtacaaccttttggaacatgagtttctacctctggaccttgcatcaaaagtgcagccacttctttcgaagatttcaaagatgggagggaagctttcatcagcttcttctgttccagaggttaagttatctcagtatatttcagcattggagaagctgacagcattgagagtgttacaacaggcctcttgtattttccagtcgatgaagattgatatgctctcaagaatgattccgttctttgacttttttgttgtggagaagatttctgttgatgctgtgagacgcaattttgttgctataaaagttaaccatttatcaggagctgttcattttggtactgtggacatagaatctgatggcttaagtgatcaccttagtgttgttgcggattcattaaataaagcgaagattcatatttgtccaccagttaaaaagccatctaaactcggtgaaagtcttattagtttggctggaatagtggagaatgagcataagaggcttcttgcaaggaagtccataattgaaaaacgcaaagaagagcttgagcgtcaaatattggagaaggaaaaagaagaagaaaaaaagagaatgagcagtcaaaagaaaaccgcagatgaggaaagggtgaggcttctcaatgaacagagacagagggagcaggaccggattcgtagagagatagaggaaaaagaacaaagccgaagcaaaaaagttgctagaagacttgaagaaggcagggaaaaaacatgtcgttgttgaaggggagcttactaaggaggccataatggaattgacacgaaatgaacagttgaaggagcgccacgaaatggagaaaaaactgcagaagtttgcaaaaacaatggattatctggaaagagcaaaaaggcaggaagaggcaccactgattgagcaagctttccaaaaacgtcttcaggaagagaagatccttcacgagcaagagcagcttcgggagattgaactcagcaaacaacaccatgctggcgacttgcaagagaaaaacagactttctcgaatgttggaacacaagaatgctttgcaggagagaattgtccaacttcgtgaagctgagtttggtcgtctgaagaaagagagagacgaacggttcagtcagttgatatcatcgagaaagcgtgaaagggagagagtgaggaagttgatgtattatctgaaccgggaggaacagcggattgaaatgcttcgtgaggaagaggaagctagaaaacatgaagaggaagagaggaggaagagagaagaggctgaaaggaaagctaatcttgatgctattgctgaaaagcagcgattgagagagatagggttgggggagaaggcaaaggcgaatagggagaagctctta

SEQ ID NO: 19805 - DNA, 1793 bp, Zea mays
ctccgcccccgtagcaccccgcgcgcccagccgtcgccgcgatcgcgagactgcgagagccttccgccttccccttcccttccccttccccggccctgccgcgctgttcggcccgtcctcctcggtccttccatccactcacgcgaagcttccagcagaggcgaccgccgcatcgagtctcggctgccgaggagtcgagtcatggaagtggtggcgtcggcgccggggaaggtgctcatcgcgggaggatacctcgtgctggagcgccccaacgccggcctagttctcagcaccaccgcccgcttctacgccgtcgtccgccccctccgcgacagcctcccagccgactcctggacctgggcatggacggacgtcaaagtgacttcccctcaactctcgcgggtggccacatataaattgtccctaaataaaacgacgctgcaattgacgtcttcaagggaatcgacaaacccttttgtggagcaggccatacaattctccgtagcagctgctaaagcgaccattattgataaggagaggaaggatgtagtagataagttactgctgcaagattggagcacgtggtctccctcttactccggaggacaatcttctggcgacaatgcaagtgaacgagaacttgacttggttcacgctattgcccaaagtgcacattgtttagcacaagggaaaattggcagtggttttgatgttagtgctgctgtctatgggagtcaacgctatgtaaggttttctccagaaatactctcctcggctcaggctataggtgggactgtcttgccagatgtagtatcagatgttctaacacaaaggtgggatcatgagaataaacagttttcattacctcctctgatgacccttctccttggggaacctgggaccggaggatcatctactccatcaatggttggatctgtgaaacggtggctgaagtctgaccctgagaaatccagagatacatggagtaaactggccattgccaccccttcgctggagaaccaactgaggatcttaaaaggactttctgaaaatcaccatgaagcatatgagtccatggtgaggtcctgtagtcgtctcacatatgggaagtgggcagaggtggctactaaccaacatcaagaattaattataagatcattgttggctgcaagggatgcttgccttgagataaggcttcacatgcgagagatgggcatagcagctggtgttccaattgagccagattcacaaacacggctactagatgccactatgaatatggagggtgttttactggctggagttccgggagctggtggcttcgatgcagtgttctcagtggttttgggggatgcaagtaatgctgtagcacatgcttggagctctgctggcgttctgccacttcttgttcgagaagactgccgtggtgtttcattggaagacgctgacccgagaacaagagaggtgtcagcagctgtatggtccatccaaattaactgattctactgttaatagttctgtgtttatgcatggtgtaccaataccattattcacgctgttcggattgctgcaatccatagagacaacatggtataaacagtagaagcgaacagtctcataagtacaaaattgtgccgaatgctaggaaatgctaggaagtacgaggtacgtggttaaataagtgctgcacttgcagcaagatagcacatgagcaaattagtgcagaaaataagaaattatatggatttccatggaaaaaaaaaaaaaaaagggcggccgccaccgcggtggag

SEQ ID NO: 19806 - DNA, 2103 bp, Zea mays
cctcgagccggccgggcccggcccatcgccgattcctcggttcctccccgcgggcacgcttcacccccgccgccccgcgcccagccgtcgccgtgatcgcccgagcgttactctgccgagccgttcggccggtccactcccgcgaagcttccagcagaggcgaccttcggatcgagtctcggccgccgaggagtcgaaggccatggaagtggtggcgtcggcgccggggaaggtgctcatcgcgggaggatacctcgtgctggagcgccccaacgccggcctagtcctcagcaccaccgcccgcttctacgccgtcgtccgccccctccgcgacagcctccccgccgacgcttgggcctgggcgtggacggatgtcaaagtgacttcccctcagctctcacgggaggccacatacaagctgtccctaacgaagtcgacgctgcaattgacgtctgcgagggaatctacaaacccttttgtggagcaggccatacaattctcggtagcagctgctaaagcgaccattattgataaggagaggaaggatgtagtagataagttgctgctgcaaggtctgaacattacaattcttggatgcaatgatttctattcttatagaaagcagattgaagcacgtggtctccctcttactccagaggcactgctttcattgcctccattctcttcaattacatttaactcagaggttgctaatggaacaatgactggagagaaatgtaaacctgaagtagccaaaactggacttgggtcatcagctgccatgaccacatcagttgttgcagctcttcttcactatcttggtgtcgttagcctctcatgtccaggacaatcttctggtgataatacaactagacgagaacttgacttggttcactctattgcccaaagtgcacattgtatagcacaggggaaaattggcagtggttttgatgttagtgctgctgtctatgggagtcaacgctatgtaaggttttctccagaaatactctcgtctcaggctacaggtgggactttcctcccagatgtagtatcagatattgttacacaaaggtgggatcatgagaataaacagttctcattacctcctctgatgacccttctccttggggaacctggaaccggaggatcatctactccatcaatggttggatctgtgaaacggtggcagaagtctgaccctgagaaatgcaaagatacatggagtaaactggcctttgccaattcagcgctggagaaccaactgcgaatcttaaaaggactttctgaaaatcaccgagaggcatatgagtcggtagtgctatcctgtagccatctcacttatgagaagtggacagaggtggctactaaccaacatcaagaattaattattaaatcattgttggctgcaagggatgcttgccttgagataaggcttcacatgcgagagatgggcatagcagccggtgttccgattgagccagattcacaaacacggctacttgacgccactatgaatatggagggtgttttacttgctggagttccgggagctggtggcttcgatgcagtattctcagtgactttgggggatgcaagtaatgctgtagcaaatgcttggagctctgctggcgttctgccacttctcgttcgagaagactgccgtggtgtctcattggaagatgctgacccaagaacaagggaggtatcggcagctgtatcgtccattcagattaattgattctactgttaatattctatttatgtattgtgccgaatgctaggaggtacgtggttaaaataagtgctgcacttgcagcaagttagcacgttgtttacaatgactgttcatgagtgtagaaaataaggaattcaatggatttccatggaattagtgcttgtagttgtagctatggaatgtacgtgagaaaatgtcaaggtatccaacaaactcatactgtaaaccttgtatttgtaacttttgcggtttgtatgataattcggcatgtgttaatgtttgataaaaaaaaaaaaaatatccactttgataggtagtggtcgcggctataagtctgtccgtggtcagtggtcagtagccaactgttt

SEQ ID NO: 19807 - DNA, 1978 bp, Zea mays
gacccccgaggttcggccgggctagcccatcgccgattctcctcggttcctccgccccgtagcagcctcgcgcgcccagccgtcgccgcgatcgcgagactgcgagagccttccgcccttccccttccccggccctgccgcgctgttcggcccgtcctccttccatccactcacgcgaagcttccagcagaggcgaccgccgcatcgagtctcggctgccgaggagtcgagtgatggaagtggtggcgtcggcgccggggaaggtgctcatcgcgggaggatacctcgtgctggagcgccccaacgccggcctagttctcagcaccaccgcccgcttctacgccgtcgtccgccccctccgcgacagcctcccagccgactcctggacctgggcatggacggacgtcaaagtgacttcccctcaactctcgcgggtggccacatataaattgtccctaaataaaacgacgctgcaattgacgtcttcaagggaatcgacaaacccttttgtggagcaggccatacaattctccgtagcagctgctaaagcgaccattattgataaggagaggaaggatgtagtagataagttactgctgcaaggtctgaacattacaattattggtcacaatgatttctattcttatagaaagcagattgaagcacgtggtctccctcttactccggaggtactgctttcattgcctccattctcttcaattacatttaactcagaggttgctaatggaacaatgactggagagaaatgtaaacctgaagtagccaaaactggacttgggtcatcagctgccatgaccacatcagttgttgcagctcttcttcactatcttggtgccgttaacctctcatgtccaggacaatcttctggcgacaatgcaagtggacgagaacttgacttggttcacactattgcccaaagtgcacattgtttagcacaagggaaaattggcagtggttttgatgttagtgctgctgtctatgggagtcaacgctatgtaaggttttctccagaaatactctcctcggctcaggctataggtgggactgtcttgccagatgtagtatcagatgttctaacacaaaggtgggatcatgagaataaacagttttcattacctcctctgatgacccttctccttggggaacctgggaccggaggatcatctactccatcaatggttggatctgtgaaacggtggctgaagtctgaccctgagaaatccagagatacatggagtaaactggccattgccaattcaacgctggagaaccaactgaggatcttaaacggactttctgaaaatcaccatgaagcatatgagtccatggtgaggtcctgtagtcgtctcacatatgggaagtgggcagaggtggctactaaccaacatcaagaattaattataagatcattgttggctgcaagggatgcttgccttgagataaggcttcacatgcgagagatgggcatagcagctggtgttccaattgagccagattcacaaacacggctactagatgccactatgaatatggagggtgttttactggctggagttccgggagctggtggcttcgatgcagtgttctcagttgttttgggggatgcaagtaatgctgtagcacatgcttggagctctgttggcgttctgccacttcctgttcgagaagactgccgtggtgtttcattggaagacgctgacccgagaacaagggaggtgtcagcagctgtatggtccatccaaattaactgattctactgttaatagttctgtttatgcatggtgtaccaatatcatttattaacgatgttcgcattgctgcagttacaattcatagagacaacatagtataaatagtagaagccgttacggattaaagccaaactagcaggctctatcttttataagtacaaaattgtgccgaatgctctatcttttataagtacaaaattgtgccg

SEQ ID NO: 19808 - DNA, 1273 bp, Zea mays
  misc_feature (1267)..(1267): n is a, c, g, or t
ttttttttttttttttctttcttttttttttaactgaaggattgaagggcatcattattatcagaaatcatgtaatgtgactgatccaacacagtgaagtagccatctactgggtagaacagaaaccatagtactagcagaacccaatcacatgcatgatccaacataaccaaggtagatactagtagtagctagaacggacacatcaagatttgcgctagggcagtagtaagagcactgtagcagagatccaatcacttggagacttgaggctagtgactgcaaatctgtagacacgtaggtagctaggtgacgatggctaataaggagtggaagcagagaccatgccatcgatgtccgacttgacgttgctgaagacgttgtggagcagcacgaagatcaccactgataagttgctcccgaggccgtggccggcgagcgcctgaccgtcgacaccggtgaggtccaccttcctggcgaacaccgtgcctctgtcaagaggggtgccgccgcaagcgctcgacaccatcttgcgcacgatctccagcttctccatgatctgcagcgccatccaccacttggcacaccccccctcggcagtccacctcactgactcaaataccgggtacagctcaccaaacaccgagaacagtgggcgccttttctccgctgggatgcggcgcatcgcatcaaccaggaggtcgatgcattcgttcgccatctccttgaacttctcctgcacggccttctcctcttcagaaactgcaagcggctttggaaggtggcagctgagcagcatgtcagtcttcttggcgacaacacggtagaaatggtcgaactcatcctcgtctggcatgcgggggttagacacataatcatctccagtaactgcaagcagcttaggagtatagagtccaaactcatattcatcccccgggcccaaactgctgtcatcgacaggaaggccagcgaccttgaactctctgggagaagctgatgtggacgaagaaagcgcgagccgcacgccgtagtgccctgtcccgaccctcaagccggtgagcaccctgctgccgtcgcggcgaggacggagggagggaagacgagcggcggcggcggcacgaacacccaaggacgccatgctttcgcctgctagggcctagggctcgctcaagtgggtagtggctagggggagggagaggagagggatcggagagagacgagaccagatgctatgccagtgcgagtggtttttgggcctacgtagctnactcga

SEQ ID NO: 19809 - DNA, 1769 bp, Zea mays
atcccagtgatctccctttggaggtgcataaaagcgctcgcggacctgctgcacacccggtctgagtctgactgacctgacctcgccgttttcttctcttctcttctcgcctctgccgatccctcctcccctgcttgcttgcttgcattgcaacctctgtctctccatggcagccgtgagcagccaggacaaggagggggctctccagctgaagcaagcaggagagagcaaggtgttctccaagctgttcaccagggagagctcggcagcggcgccgtccttccgggtgtactacggcgtcgcctcggcgggctccgtgcccttcctgtgggagtcgcagccgggcacgcccaagaacgacgccgtctccacggccaccctgccgccgctcacgccgcccccgtcctactacaccgccaggcggcagcagcacgccgcggccgcgcgcagccaccaccgcaggaccatgtcgtcctcctcctcctcctcctccgccgccggcggcaccggcaggaacaagaagaagctgctgtcggccaagcattacaccagaatcttcagcgccatcctgcccaagatgatcctgcacaggtggtcgtcggccacgtcgtcgccctccgcctcctcctcctcctccagcagctcctcgtcctcgcggtcggccttctcctcctcggcgtcggcgtcgttccgcagcgcgcggtcgcccgccgcgtgctcgtcgatgaccatgcggagccgggtgttcgcgttctcggccgcggacgaggacggcggcgaggaggaggaggagcaggcggcggcgccgatgtgcttcagcgtcgtccgccacgagagcttccgggcgttcaggggctgccgcgtcgccatgacggtgaagagcgcgctggcgtccgtcggcgccggcggcggccacgggcacggtgctgggcccgccgctgcacagaaggtgtagtggtaccctttagcctcactgcatgcatgcatgcatgcatgcgtgttgccgctgttgcttggattggattggattgatcgagagctgcgtgttttaacggcgtgccttgttgtgtgtctctttcacggagtaatgttggaatgtgtctcaagaaaaggagttcatcaaagtattttatatactatattatatgatatggtgaattaagtctgatgtaataacagtgtgtaaattaatgtataacgagcgaataacacgcagcatctgtatgtgatgttaattaacaaaaaaaaaaaaaaatgtgtactactagtgtgtggactgctttggtttatgcaaatgattcagttcagacatgatacagagaaacaaaaaaaaaaacgagtttgttcactggacctctctatttagaaattcagggaaggattatgtgagcaacaaaacaatgctgaagcgacagagatcgagcagtttgtttacgggagatggtttgtttaccacctcctaggatggcgggcgctaccaagggcaggacagcagagattgaagctgtgcaggttcaaacacaagtaaaactctggtctcggggtaacactgtaacagtagatagagtgcacaacctgaactctcgatagctagtatttcccttttctttgttatttcagtattctttgtaatttcgtttcagctttattttgattaagagaagtgctgtaggggtctcccctacagcttttcaccgtcaaaaaaataataataatccaaatcatatgcacaaaacttgcactatctgcatttgtatgcaaagtctgga

SEQ ID NO: 19810 - DNA, 1659 bp, Zea mays
  misc_feature (1574)..(1574): n is a, c, g, or t
  misc_feature (1577)..(1577): n is a, c, g, or t
gagctcgcggggaagacggggacttccggagagagagagagagagagagagagagagagagagagagagagagagcaggaagcaggggctagacgcggatcggcgagcatgaggggcggcggcggcggcgggatgatggacgatgaagagagggtgggccatgcggagatcccgaccagtttcggtcccgagctgcgcgcctgcctccgatgccgcctcgtcaagacctacgaccagttcagggagaacggctgcgaaaactgcccgtttctagagatggacagagagcacgacaacgtcgtcaactgcaccacccccaacttcactggaattatctctctgatggaccccagtaggagctgggcagcccgttggttgagaattggcaggttcatccctgggtgctatacacttgctgtctcggaggagcttccagaagagtatcaagggatttgtcaagacaacaacgtgcagtatgtgccgcccaagcgtgtctaagtatcaagacggcaatgttggtgtcttggtgcttgccaagggaactgctccccttatgctttgtatccgagtgctaaggcagtctatttcatgttagtggtaaggcagtctatttaggtggtcaaccggcggtgaatgaatctcccaataaccttgatgcatgtgcttgaaatctgtgaccatgcggctcatgtgcttctgtcatgttctttcgcatctatgtttatatgaagaaaatgtattagctaaaaaaaaaaaaaaaaaaaaaaaaacgcggccgcgtcgacttttttttttttttttttttgtacattgataatttttttcatataaaacacattcactgtaaaaaagatagtaacacaagcgtctccacggcaaataaagtctactctctagtaaaaagatttacagttccaaatggtaatgctcgtaactgcgctacaagcatattgccaaatgaacacctcttaacgaccctctgcttcatataaagctcacaacacaatagctgttctagtcttttaacataatccacaactctgctgcaaaacaatcagtgctgacaacaggatgaacataagagcacagcaacgctgtgcagcacgctcagcgaaaaaaaaatcaccggtgaaaatcagtgctgccaacaggagagcagaaagagcacaataacgttgtgcagcaggctcagcaaaaaacaccacaagtttccgtggttactttaaagtaaacctgcatccttgagagcagcctcaaaatcttcttcacgttgccaattccgaacctcaggcacactgtgctggaaatagtcctcgatcttcttcatcacaacattatcggtttgaccacacagcaagttgaacacagcacctttccggccaaagcgcccagctctgccaattctgtgcaagtacacctcataatcaggttcatctcttgtaccaaatttgattggcatgtcgtagttgatgacaaggttaacctgtgcttggtcaaaacctcgagcaagaacatcggttgatataagaaccttggtgtagccatctttgaattcctgtattatcttttccctnctnctgattggtcaagggatccttgaattgaggagcacacatagtcctccctcgtcaaagcattgtgaacattcttagtctttgc

SEQ ID NO: 19811 - DNA, 2147 bp, Zea mays
cgattgggtaccgggccccccctcgagtttttttttttttttttttgaagtgtacattgataatttttttcatataaaacacattcactgtaaaaaagatagtaacacaagcgtctccacggcaaataaagtctactctctagtaaaaagatttacagttccaaatggtaatgctcgtaactgcgctacaagcatattgccaaatgaacacctcttaacgaccctctgcttcatataaagctcacaacacaatagctgttctagtcttttaacataatccacaactctgctgcaaaacaatcagtgctgacaacaggatgaacataagagcacagcaacgctgtgcagcacgctcagcgaaaaaaaaatcaccggtgaaaatcagtgctgccaacaggagagcagaaagagcacaataacgttgtgcagcaggctcagcaaaaaaaatcaccggtcaattgtcccgagccggagagcgctgctcaccacaagtttccgtggttactttaaagtaaacctgcatccttgagagcagcctcaaaatcttcttcacgttgccaattccgaacctcaggcacactgtgctggaaatagtcctcgatcttcttcatcacaacattatcggtttgaccacacagcaagttgaacacagcacctttccggccaaagcgcccagctctgccaattctgtgcaagtacacctcataatcaggttcatctcttgtaccaaatttgattggcatgtcgtagttgatgacaaggttaacctgtgcttggtcaaaacctcgagcaagaacatcggttgatataagaaccttggtgtagccatctttgaattcctgtattatcttttccctctctgattggtcaagggatccttggattgaggagcacacatagtcctccctcgtcaaagcattgtgaacattcttagtactttgctttgttctaacaaatatgataacctggccaactttctgtccaaattcaaatatcttgtcccttataacctctatttttgccgattcatcaggtacttgaactttgtactgcttaactttttccaaagtaagctcttccttcttcacaaatatctgatttccatccctaatgacctttgtaacaaaatccttcaccctatcattgaaggtcgcagaaaagagaagcacctgacaaccaccagcgcttctttgtatatccctcatcatcctttcagagtcactcctaaagccatcctcagcaagcatatgatctgcctcatcaaacacaagtatcttgatgtcccttgtggccagcttcttatgggtaatccatttgatgagcgtaccagatgtgccgataacgatctggtcagtgatcggagccattttcgagatcggcatgtagtctttttgagctggcgggattgcacaggcgcatgtaatgccagtaaacttgcccatcctcatgagaactgccttattctgctgcgcaagctccctggtggggcaaatgcagatagcctggggtatcttgtgttgcgggtcgacgcggctgagcatgccgaggacgaaacaggtggtcttgccagagccgttgtgcgcctgcgcgacgaggtccttgtagggcggcgtgaggatcatgggcagggtgatcgcctggatcttgctcgggcggctgaaccccatctcgtcgtgcagccccttaagcagctcgggcgacagcttcagatcctcgaacgtggtggccgactcgtacaccgtgccacccgaaatcacggcttggatttgcgagtcgtcggagtcatcgaggaggggcgggccctcttcgcctgcggcgtcgtccaccgacggggcgagggagagcgcctcgatctgcttggcctgctcctccaccgccggctcggtgatggaggaggaagaggacgccgcggcggccgccgccgccgcttcggctgccgcggtcgccttagccttggcctcctcctcctcttcgacgtcggcccatgacttcttctccggggacgccgccttgtcggccatcgcgccgcgcgctggcagatcgagactcgacagcaatcaggagtggtgactggtgagtggaggagaaacggagaggaagcagagagggctagtgggttcgtgttttttttcccggccggccggcct

SEQ ID NO: 19812 - DNA, 2394 bp, Zea mays
ccggaccgcggaccgtcaggcctcagggccggaccgtccggcctgctcaatacgacgctcaacaccctccctctgcgcctcggccatcacccgaaacaatcaaataacctaccttgtcgccgttgccggcgcagtcagcagatggccatcacacggctgcagagaaaaacgaaatgtgtagtgcaggtcagcacgtgtagtttccttaaatgaaaatggaaaaaagcgatttgcgtttgggcctcaacacccacgcgcccgtagatgtccttattgggcttctctgtaagcccaaactaccgaaacagagcccaaaggctacgcgaggagccgagggactagagagtgagagagagcaggaagccggaagcaggaagcaggggctaacctccgagcggcgaggatgaggggcggcggcgggatgattgacgatgaagagcgggtgggccacgcggagatcccgaccagcttcggccccgagctgcgcgcctgcctccgatgccgcctcgtcaagacctacgaccaggaacccttctccgctggcgccgctcccctcccccctcctcacgcctaggcctgcggtctaggttcaccagcctcccgttgaagggagggttcgaggactgggggtttcgtttctcctggtgcggtccgttctcggcggcggctaaggtttagctcgctgcccctctcgattccaaccggtgctagattttatttgtttttttgcgttgtagcattgaatacctattgcaagttgcatcgttaatgccgatggtggccgccttcgcgtgctcacgtgtttgattgctctttgggggtgctgtgtgcagttcaggcagaacggctgaacgtcgtcaactgcaccacccccaacttcaccaggtagctcagcatcatattgctgtcatcttactcttgttgcatactggcatcttactcttgttttgctgtcatcttacagttctcattaaagagggaatgaacttagtaaaatgaaaataatattctgtgctttgacttatctcaaattctcaatgaaagagatgaacgtcacggaactactatgctcctcaggcattgtattttcatcctttgtgattctggagtagctcatgatttttttttcatccttcgtgattatagagtagctcgtcaaaatgtctagcataatggattatgtgtagtatgttaattgaaacaatgagatgaacagatgttgaatgatgtatgatcatcaacagaaagcattgatgtctcctatgttatttagggaattcacctgttgacaagagctaatgaatatgcttttatcttatgcagaattatctctttgatggaccccagtaggagttgggcagctcgttggttgagaattggtgacccttgttctcgtgtatcctgcagtttgtttgcctcttcaatctagtgcgttcatttttgtctttttttttcttcactcgtgcaagggtttagtattttgaactgtgagcgaagtctcacatcaggtgcagtttatattaaatgttgtttatgtagtaactcccttggtttacatggttttccagattagagagcaacatctgtaggaaaggcacttttattttcagttgtcgttcatagcaaaactgcacagctaaggttacctcatgtggcagtgtaaaaagtaaaagagatgaaaaatacatgtttgcattttacttttgtcataacttttaggtggcacctctgtttctgtgcaatacgaattaagagatgttatagtttctacatgatcagcatgtcagttccaaataagtgcctgatgtttatgtttgagcttgtatttagagctaaataaaatcaaggccttgcatcagtttgtttaaagttcacttctgttcttggttcatagtagaatttatttatggatacgtctattcgttgcgctgtggcattattaaccgggatcatgcaaatctgcaggtaggttcattccgggttgctacacacttgctgtttcggaggaacttcaagaagagtatcaggtgaaaactacatacctccattttagaaacggcgatgactaatatacaagcagttatgtgcaagcgtgcaagtagatctctttccgttagatatagatctaaccatatgtcatatttagcatttaaatcctctcactaccgccttaactttataaaaaagctcctaataaaccaaagctcctaataaaccacgattgcacaatacggttggatcttagaacggacaaagagggctacttgcacggcttgcatatttgtcactgcctttagaaacacactctacgatttaatgcactactcgagacacgtcgttgttcatcactgcaggggatttgccagacaacaacgtgtagtatgtgccacccaa

SEQ ID NO: 19813 - DNA, 1047 bp, Zea mays
atctatgagcatgcattgtggctgcttaatacctagcctgaaaaaatctggaagctcaatatacccggaggacaagcaaggcaataaaatccagtccggagatgtccctattgggctgctctgttactctgtaagcaaaaagctccgaaacagagcccaaaagactacgagctcgcggggaagacggggacttccggagagagagagagagagagagagagagagagagcaggaagcaggggctagacgcggatcggcgagcatgaggggcggcggcggcggcgggatgatggacgatgaagagagggtgggccatgcggagatcccgaccagtttcggtcccgagctgcgcgcctgcctccgatgccgcctcgtcaagacctacgaccagttcagggagaacggctgcgaaaactgcccgtttctagagatggacagagagcacgacaacgtcgtcaactgcaccacccccaacttcactggaattatctctctgatggaccccagtaggagctgggcagcccgttggttgagaattggcaggttcattcctgggtgctatacacttgctgtctcggaggagcttccagaagagtatcaagggatttgtcaagacaacaacgtgcagtatgtgccgcccaagcgtgtctaagtatcaagacggcggcaatgatggtgtcttggtcctgaagcagtatagataattaggtagaagtatctgtgcttgccaagggaactgctcctcttatgctttgtatccgagtgctaaggcagtctatttcatgttagtgataaggctgtttatttaggtggtgaaccggcgggtgattgaatcttatccaataaccttgatgcctgttcttgaaatctgtgacaacgcggctcatgtgcttctgtcatgttctttcacatctatgtatatatgaagaaaatgtaatagctaaaggtcgttggaccatgaaccctcggcccctgaagaccctatgtataagggactcaacatgttgaattctgtttcgggaccaagcaaaactggattgtaagtgt

SEQ ID NO: 19814 - DNA, 1743 bp, Zea mays
gatccgaccagcttcggccccgagctgcgcgcctgcctccgatgccgcctcgtcaagacctacgaccaggaacccttctccgctggcgccgctcccctcccccctcctcacgcctaggcctgcggtctaggttcaccagcctcccgttgaagggagggttcgaggactgggggtttcgtttctcctggtgcggtccgcgcccgccggcggctaaggtaggttcattccgggttgctacacacttgctgtttcggaggaacttcaagaagagtatccctgcaggggatttgccaagacaacaacgtgtagtatgtgccacccaagcgatgtctagagctcctgaagcagtatgaataatttagcttatataaaatggtgcatgtgcttgttgccaagcgaactgccctgctttgttgtatctgagtgctaatcaggacccctaattaaccctttcgtgctacgaatgggttttttagccaagatggcataaaacattagcacaaatgtcagacacatgaccaagacaagttcataggccagcaattctgttcaacaaacacctcgtcttcgtcgtacacggatgtggataccaatttgcagattgcgagccacgagcccatctaccagtagcctctccagtgtccatactgagaaatttatcgcaccagcaccactgtcacaatacaatggtacaggtactgcaccgtgcacgtgcccacaagctttcgacatctgcgtgtcagcatcggttatcatcaatcaccaagaatgactggaccgtggcgcgctggtcctctgcgctggtcctccgggaggtcagatgatacgggcgtaacttatctaagaacaatcaaataaataatttaattcggctgagcacaaagtaacatttgacccgattaataatccaacagtcaatgtttaccagtactttaaagagaagaacacagcactaccaaatgctgaagtaattcacacaaacagatcaaaagctagtcttacaaaaccatcggtagttacacagcttgatcggtcgacggactccacaaatgacacggtacgaagtctttgcggcaaatcatcagcattcagatccaggtcaatcgaccagtcagcgattctgttgctagaacctctcccacgccttctattgctgaagaagggtaacgagcaccaaaaaatacaaatactcgcatgcggcatgcaatcatacctttcctactctagatgcattagtgcagtatttcatgcaaaacatgaaccattaacttgcaagcctacgtgggtatgttcaaagaacagttggggtagccagataaggatacccttttatgaccataagcatgtcaataaacttgaattgcgtcacaagtgtgtatacagctttaatactcacctgcttaagacatgcgcttatgcattctcgataagacatgtttggcaaaccgcagaaatgaattgacagcacatccagtgcatgcaacgattaattgtgcacatgcagaccttatgatccaaaaacccaaaacaggactatgatagatcagtgcagacacatctaaatccaaatactataatgggggttaacacctatagcatgtagatgcatggggcgatgcataaatcattggaatcttacttgtcagcataataggtgcagacagcaaatggtgcaggcagctgcagggccaccctcgtcaatcatctcatcagccatcatcaacaaggcaaacagcacagata

SEQ ID NO: 19815 - DNA, 2212 bp, Zea mays
  misc_feature (887)..(887): n is a, c, g, or t
  misc_feature (909)..(909): n is a, c, g, or t
ctctgggatgaaggtcctctcatggtaaaagcgtgtgtgatatgaagatacaacccgaaggtgacatggatgaacgtcgaagctatagctaaaggagtttcggcttagtatgatagcaaaaataaaggacgaaaccgacctaaggggaaaaagactacttagtccttgataacttgtgttatgatcaagaataaatgttaggggcatgaatgtaatcttattcgggctgcgtcccgtgcctataaatagatgaacagtaacactatactgttcatgctggattgtaatcgctctctcgcgtcatctttatattctcatcttctggtgaaccggaggtatcattgtgttattaaatgtcattaatgttaattcttatatgtgaatacaaataaaaatataaattgtgtagatctgatcattatcttccattctttaatgttctttcgcattcttatttatattttatatttgtatttatacttatatgctgagatgatgaaggtatatccttcatgactttcgtctgaagattattatatctaaaataaaataatgtttcgaggacgaatgtctttaaccattaacaattgtgttgtcttgttcttgatttatagtatttgagaacaagtgaccaacactcggctcctaccgctgattgttggactgcgcggtgttggctttcgaacactattccataagtatacgcttcatcatttattaaaagtcaaagtagagtacaaaggttgagatattccatcccaaagaatagacatgcggccgagttaggaagtaagagtcaacgtggtgacacatgcaggcgctcatttgcatggatacaaattgttcatgagaatacgcaagatcctctttgttgcactccgatagtnaaggcgtatgtctacgaggatnggagagcttcagctgtagatattgattgagcttttccggactcaaggtactggcactactagccccgacattaaatctaagtggcaactttcgtagtaaattcgatttttatgtgaccaatacaattggcagtttttcctagcgtctggtgactcaaatttgacatgacatgtctacgcaaaggtcatctccagatgtctcattcattgattattatcgtacgccaaaaggatattcgtatacctaatgtacgcaggaagaataaaagaaatacgccttacctaaaaccaaagaaaatacacaacctagaaaaagtaatagtgctaatacaataacacagttgctataccacatccagcaagcccgttagagtttattcggctcgaggtggattaagggtgattgaagaggattaaacctctcctataggatttaatcctctctgatcccctcaattcatcctaacggaacaaaccctttggtcttaatgttaaaccatatgaattgtatagaattgagtagtcgttttaaatccataacaaatcaaaatacatcttaatttcacccaatccatataaaattaaaataaacaaacaaagactaaaggtttaagagaattgggtggatttaaatccctagtaaatcaaaatccctcccaatcttccaatccccatgtattaggaatccgtatgtattagaaataattgaacaagcctatacgggaagatgtgccccaatcgtcaaccacaaactagcatgacctgcctgcggcacgcagagacaataccgcacatttacatttgtgattttcacttactgcagaatttcacctatatctacaatctgtaaagggaatgaatccacactgcattacacacgtatgaatcattataccaccccaaaccacaacataattccaatgtttattgacatctcaagtaatagtttcagcaccagcacacctgcttatctatccaggtgtgtctacactctattcgtagcaaggccttgcgatttcactacttcaaacataggctgcttgtagcttggatgatatcattcttccaactattacccttttcctgaagaagctcagcaactccagcgatagtaaatcagctctggttacactcgaaactttctgaaaactctcgcatccgaactcgttccaaaaattcaaaaggcagtacaatttgacgcttccgacataacgtccgctggttattctctatggcacttaatacatcaagttctggtccagcaaccatagatgtagcatttgcatcgggtgtccaaagcttta

SEQ ID NO: 19816 - DNA, 1484 bp, Zea mays
  misc_feature (2)..(17): n is a, c, g, or t
  misc_feature (1482)..(1482): n is a, c, g, or t
cnnnnnnnnnnnnnnnnatttaatgaattataaattgggatggaaagagttaacatatttaggaaacataaagtaacacagttcctacaccacatccagatccagcaagtctttaagagaagatataccccaatcgtcagccacaaactagcatgacctacctgcggcacgcagagacaagaataccacacatgtacatctgtgattgtcacttattgcagaatctcacctatctacaatctgtacaagggaatgaatccacactgcattacacacgtatgaatcattataccacccccaaacaacaacataattccagtgtttattgacatctcaagcaatagtttcagcaccggcacacctgtttatctatccaggtgcgtctacactctataatggcaacaaggccttccgatttcactaattcaaacataggctgcttgtagcttggatgatatcattcttccaagtattacccttttcctcaagcagctccagcgatagtaaatcagctctgggcacactcgaaaccttctgaaaactcacgcatctgaaatcgttctaaaaattcagaaggcagtacaaagtgacggttccgacataacttctgctgattattctctatggcactcaatacatcaagttcaggtccagaaaccatagatgtagcatttgcatcgggtgtccatagctttattgtgttatcgattccgcttgttgcaacggcacagtcgaagggatgagactgtatgcagttcacaacagctccatcccctgcaagcattttaataaggccttcctgttctcttctcccatatgaaccatctaccatcatcacttccactggcaatgaactccccttgctcaccaagaaaactggcttgttttatatctgtccctacattgcagtgtgcaacatatctctgtttcatatcaatggcaacatctgactgaaaagcataatcatcttttcgaggggactcaactgacccattctcatcagtgtgtacattggtttgatcctctctttgatgaaattggaaacttaaactacccctgaagacaccttgatcattctctcggctttcatgccacagataccgttgtttcatagtccatttcatcatcatagtctgaatcttctcgtccctcctgtgatgaaccaccaacatcaggtctaaatagtatctcactcaatgagcgtaattttccatgagtatcagcttttgagctcccattttgatccgctctgttcttctcaagctcagctgaagcaatgcgttgcttgaaagcatccacctgctccctcaatggacaatgaggtggaagaagaccatttgccacctctgcatgctcagatgcctccttcagtcttcctaactgcaatagtgcctcagccatatgcaagtgtgcttgatacgatgtgacatcaatcttccacgttctattgcaatctcgaatcgccatgtaaacatctttttncc

SEQ ID NO: 19817 - DNA, 803 bp, Zea mays
  misc_feature (769)..(769): n is a, c, g, or t
tatcccattcccatcttctgacacaaatatccgcgtgagcgtgacacccgacctccccctcccgctccgggcagcagcagcagcagtcatgcggatagccgtggtggctcccgtcgcggcggcctacccatgttcctcctccctcgctgcgccggcgagtgcgacgagccgcgcgcacgttgcggcggccgggatgtcctacagggcgtcctctttcgtcggaggcgggctcgcggcggtggttgcgtcggtagccgcgcggccgaggagggcgggctctgggagaggcgacgctctcgggtgcaagtgcctcttcgggctcggggtgccggagctcgccgtcatcgccggcgtcgccgcgctcgtgttcgggcccaagcagctccccgagatcggccgcagcctcggcaagaccgtcaagagcttccaggaggcggctaaggagttcgaaagtgaactgaagaaagagcctggggaaggtggcgatcagcccccacctgcaacccccacggcaacgggggtaggtggcgcggagaaggggcttgaggcatcaagtagcaaggagagcacgtgaggatctatcaagtgttgttagtgttgttggtgtaaaattgtattctggtcttctggagttagcatcaagttcatgtcctttttaaccacgtcgcggtttcaggccattgtagcgatatgtttgtagtctgtaccgggaataacaaccttccgtgattggattatgaatcggttgtcttgggcattattcattacnaaaaaaaaaaaaaaaaagcggccctcgagctcca

SEQ ID NO: 19818 - DNA, 3114 bp, Zea mays
agatatgtcacccacaggccacagggccacattaccactagtttgataatttcatcattacttagaagaatgatatgcctgcttccttttggtctcacttgtctaagaatttgatgggactgatccaccttagcctgcaccattatactaattgaaagcttgttgagttgcatacacttcgtgctctgtttctgaagatcaagttttctgaccagcattatttccttttccattcagtaaaattgttccgtgatccgtccagcgcctcccgcaggcggctaaggagtttgaaactgaactgaagaaagagcctggggaaggcggcgatcagcccccacctgcaactcccacagcggtaagtggcggggaggagaaggggcttgaggcatctagtagcaaggagagcgcgtgaggatcaggatctatctagtgttgtttatgaaaattgtattctgggcttctcgagttagcagttcatatccttttaaccgcatcgcggtttcaggccatgtagcgatattgtttgtagtttgtaccgggaataacatatttggttgagcttctacgtattgaagaaacaacttatctgtgaagctgacgcgaacaaattctatttattatctatttttagtttgttctgagaagccgctgttgtagaagtctattgtttggtacatattctgcttaaatatgtgaacaaaatgtgaaataagctgtacaaattctgcttaaatatgtgaagtctaatgtaaaataagctgcttggtacagatttacagttttttaagcagaaatgtatcgaacaagatgtttatgtaacatcttactagttcaattgtttcttaaaataaactaaaagcagagaataaacataagtttcttttcatcttcttataagataagctaatttgtcaacgagcagctagggatgacaatgatcagattgggtagagcaaaaccctcccacgatcgcatctataaagtctatttaatcccttctgcgcttgcacctatgagtgcaatttcaaacctgcatccaaaccgtcggatttcaagtcacctacagttttttacccagtctacaattttaacaaaaattcaactataagcaattaaataccagcaataattaagttatatccaccggctttaaaccttctcacgttgattggcaacaaaatatttcgtaaattattagccaacttacttattcaaaataagtattattatatcttaattatttttgcacaaataaagaataaaccacattttacctcaaatgtaagtcaatcgcgggttaaaatataaactcacatcaacacctactaaactttggtcaggtgcgggtgcacttatggatacccgtcgagtggggtacctgttaagtttcggttctgcggcgttggcatcggctttgattgagcggacggtctagactatccgtcggagcggcgcggaccgtgcgtgcgtgcgtaaaatcagttagggttccaggtttctcgcgagattcgcaaagagcaccgtcagacgattcattttctagtgtttgacctctagatcgacaccaatatatgaattagattaaaaattgggctgtatttagtcatcgactgttatgtaagccgtcttcaggtacaaacgtaaccgagccttttggtatgttgtgtcatagatgtagtagtgggcaatccagtgaagtccacctcgcacattccaaatttatcgcttgcaacgtccccaatccggtgaaagccgggaaaataacgccatggctatcctcgccgttgcctctccgttcaaaaccctaaaccctagcccgccggaccacagccgcacccgcaggcgcctcccctcctccattctccaccttccgctaccggtgccacgatgtcgccgcctccggtgctccgctaagtacagtgaagcggcggcgccgtccgcgtcgacaacgacgccgcggccgtctgagataccttggagcaaggatatctgcaattcggtgcggctcattgggactgtgggcaccgatgtcgagctgcggcagctgcccagtggctccgctgttgcgaggggtcgcctcgccgtatggaagtcggccaccgagactacatggtattactgatttgattggcgctaggcaatgttaattcttctaccatttctagcgtcacctatttatgtccatattgttgggggccggcagtggacagtggttcgactatccgggtcattcgcagtaggtgtttgtagctttgtgagtgtgagggatgcgtgattcttgaaaggtcgacgaagacattcggtaatatgttggctagagcagtttgtgcaattgatgtattgtagcaacaagaaagatgattgcccagaccatggaattgagttttgtttatggacagtgtagttgtgccaaattgtcttgctgcttattgggtgatgtcggaaagtgctaatggaactgtaacaattctttgttgtggctgagttacacgcttagttaaataggtaccttattttggagcagtgaatattaaccagtatattcccttaggctatttgctacctgcaaaaaaatttctcacaacctgacaagattaccttacctatttctgttgtactctctgtttcaaaggcgttattaggcttccaggtgtacccagcttgcctccgggaacagtgtccgctctcacttggatgcttagtcacctttgaaaccatggttgtactatgatgataaacaaatgagctttgatttctcaatgcctattgtatcaacagatgaagcattagactgagttctgactcctaaggctctccatcaataattaacactatcttatttgcacacagacaccacacacacacacacacacacacacacagacacacacacacacacacagacacaacaaaagttaactctgaatagccaagcaagtccaagcgtgactgcatgagttgtcgatataaatatttctagctttgcaggtacataatactgccttttacatactctcaaagccataaatgatgagcattttttggtaattgaaaaatacagtcctagaagtagttgtttaagtgtttaatggggtcactgtactatagggtaac

SEQ ID NO: 19819 - DNA, 2272 bp, Zea mays
ttgatctgactagaaaaaataacctggagatcaaattcttggttcacacaactaatatatgaaccgacgtgatggcctgatgggtgacgaggaaggttgctgggccggcgaagctcctgcggggacacagcttgacgatgtagcggctgcgaagggcaagaagacgatgtgttgaggtggatgtggtgccgtctgttggccgtcagcccgtcacccaccgccaccagcgtatgggtttctgctagtccgccgcccggccgccgcacaagctagggttctggcttttgcttgtcgccttgtccgtccacccgcagacacgctggactaaagacagaagcaggcagatagaagcaggcagaggcatgagtccgtggctctaggggtgtaaacagtatggataatatccgagcatccgattagatttctgctttcgggtacctattgccatctctaagcacacacaacgcaaaggaaatttgaaaaatacgaaatatatacgaagaaaaacagatagggctagcatcttcgcataaggaggcccaacttatgcaatttaatatgggcaggctcaaacacacccggcggcccacttatgcatccaacaggcagcgaaataaaaacctcttgatggtcatttattgcaagagaaaagagtttttcttttggataaacaaaattgaaagcaagaaaaattcttttttattgagaagagttttttaagtctagttgcgaggagtaagttcttttcttatccactcagtttatgcatcctcattacttatttttaaactttactctgtaaataaaaaaacattattttacgtaaactgttggaccccatctactgcacagacacgacgggagcggggaagcctgtcagaagtaagaacaactcgttcgtccgtcaccatagaacgctatcccattcccatcttctgacacaaatatccgcgtgagcgtgacacccgacctccccctcccgctccgggcagcagcagcagcagtcatgcggatagccgtggtggctcccgtcgcggcggcctacccatgttcctcctccctcgctgcgccggcgagtgcgacgagccgcgcgcacgttgcggcggccgggatgtcctacagggcgtcctctttcgtcggaggcgggctcgcggcggtggttgcgtcggtagccgcgcggccgaggagggcgggctctgggagaggcgacgctctcgggtgcaagtgcctcttcgggctcggggtgccggagctcgccgtcatcgccggcgtcgccgcgctcgtgttcgggcccaagcagctccccgagatcggccgcagcctcggcaagaccgtcaagagcttccaggaggtgagtcatgagtgtcggggcatgaattcgaatggcgtggtcgatagcagctcgccgatcatgcgtgtggcgtgctgacaatagtttggctggttcggggcccctgcggcaactagtgaccccattctattgctgctcgagatgctaaagcttacgtggtcttcgtagtgcaaaccgtgtctttaccaatctacaatgcgttgctttggtagcaatttcaggtttggaaaaaaaatttggcctgcaacgctgaggattttggcactctagtgtctagtagataataatgtttagtttaggtaccctgtggcttaaatacggtgacctaacatagcgcattcattgcaaatttgcattttggcttagttgtgctgctgaatgcttagtgggataatgccaatggtaagaaatacagtcgcattgctttctcatttttacttatataagagttatgctcttttttataacagtgtgatgggaatttctgcaccttattctttatgaactgcaatggacccttagttccaaaacatactccctctgttcgaaataatatgttttggtttttctacgtacattattttaattatatatctagagaagacaaaatgttttctagatggagctggaaagggtgttgcttgttcttgtctatttcaagttttataatctctcaaaaatgttgcagattatgatttgtgcagttattttgttgcaaatataagagtcgttatctgtacacattacacgtttctgcaacctttatggcctattcgtttcaccgttaaaccatgtggattggatggtattgagccgatttaaatacataacaagtcaaaatacatatcaatccattccaatacactctaatccacatagaattgaaataaccgaacacggcctcacctcagggtaccgagc

SEQ ID NO: 19820 - DNA, 1778 bp, Zea mays
cttcttcatcttgtgcatcccattctgtgtgagaaagagagagagagagagagagagagagagagagagagagagagagagagagagagagagagagagagagagagaggtgaatggcacacttctagcaagttcttgtagcacggacaacgaaagggtgagctttgaaaagtacactccacgaaggatatgcaaaaaaatgaaataggcccgaaagttcaattagacagtccaattccgaagcacccacaaattggttgttggcccatgaagcacccacaacaccctgtatctcgtccagcccactttgcatccaatccaacggcaacgggcaacgaaatggcaccgtgttacacgaacacgcgtcacacgacgggaatgtcagaagtcagaacagctcgttcgtccgtcaccaactcgccatagatgatagaacgctatcccatcttcacacacaaaaatatccgcgcgaccccgacctcccccctcccactccgggcagcagccagcagccagcaggcatggggatacccgtggtggttcccgtcgcggcggcctactcgtgctcctcctccctcgccgcgccaccgagggccgccgccgccgcggcgagggcgccgagccgcgcgcacgtcgcggcggccgggatgtcctccagggcgtcctccttcgtcgggggcagcggaggcgacctctcggcggtggccgcgtcggtagccgcgcggcccaggagggcgggctccgggggaggcggcgcgctcgggtgcaagtgcctcttcgggctcggcgtgccggagctcgccgtcatcgccggcgtcgccgcgctcgtgttcgggcccaagcagctccccgagatcggccgcagcatcggcaagaccgtcaagagcttccagcaggcgagggttggggcatgaatccaaatggcgtggtcagtagaagctcgcggttgctgggggggcgatgctgacaatcgtttgactgctagttagcagctgcggaaacttgtcaccccgttttgctcgagatgctaaagcttaggtcttcttcgtagtgttaccaatctgcaagtcattgctttggtagctatgaatatgcaggcggaggaagtatcctcacccccacacccccggcgcgctgaaccgtataaaaaaagtttggctgatttcggtactctagtagataatattgttcagtttggcagctaatacagtggcccagtaaatcacattcattgcaaatttgcattttggctcggctgtgctgttgaccgcttagtgggatgccaatggtaggatatatggccacattgcttcctcattttgacttatgagcagtgttcttaaggcgcctaggcgagcaagcaaacactccgagcgccttagcgcctacgcgggcaaggcggcaaggtttagccgagcgcccgcctaggcgacgccttaaaaaccctgcttatgagttatgtttttttatatgccagtgtgatgagtggtgtgggtacagggatgtaagattggagtgatagaaatttctgcacctcattctttctgaactgcaatgggaagtagtagaacatatcttccaatttagtactacctcttgtcggatttaggtgacgttttggaaaatcaaaaagattggagcaagtagttgtttgagatggagccaaaatttggtgtggtttgttcttgcccatttggagttgtataatctcttaagagtcctgcatgttatgatatgtgcagggttttttttggtcgccgatgaattatgtcatatac

SEQ ID NO: 19821 - DNA, 983 bp, Zea mays
cctcgaggccggccgggaacgacgttgcatgtcagaagtcagaatagctcgttcgtccgtcaccaactcgccatagatgatagaacgctatcccatcttctcacacaaaaatatccgcgcgaccccgacctccccctcccactccgggcagcaagcagcagccagcaggcatggggatacccgtggtggttcccgtcgcggcggcctactcgtgctcctcctccctcgccgcgccaccgagggccgccgccgccgcggcgagggcgccgagccgcgcgcacgtcgcggcggccgggatgtcctccagggcgtcctccttcgtcgggggcagcggaggcgacctcgcggcggtggccgcgtcggtagccgcgcggcccaggagggcgggctccgggggaggcggcgcgctcgggtgcaagtgcctcttcgggctcggcgtgccggagctcgccgtcatcgccggcgtcgccgcgctcgtgttcgggcccaagcagctccccgagatcggccgcagcatcggcaagaccgtcaagagcttccagcaggcggctaaggagtttgaaactgaactgaagaaagagcctggggaaggcggcgatcagcccccacctgcaactcccacagcggtaagtggcggggaggagaaggggcttgaggcatctagtagcaaggagagcgcgtgaggatcaggatctatctagtgttgtttatgaaaattgtattctgggcttctcgagttagcagttcatatccttttaaccgcatcgcggtttcaggccatgtagcgatattgtttgtagtttgtaccgggaataacatatttggttgagcttctacgtattgaagaaacaacttatctgtgaagctgacgtgaacaaattctatttattatctatttttagtttgttctgagaaaaaaattaaaaaaaaaaaaataaaaataaaaataaaaaaaaaaaattattaaaactaaacatattaat

SEQ ID NO: 19822 - DNA, 1674 bp, Zea mays
gtaaaataaaatgtaactgctagataggagtatatattaaaataaaaccaggtgctttggaagcaaccttttagttaggccaattaattagagagaaaaaaagttgaaaacacagtcaggggttttgattatcatgatttccttttcgttttacatgttccgaataagaatacacacactaggattatatatccataatatagctgctataatttataaattttagaaatgagggtagaccatgcaccgtcaacaaaagaacagccagatacttccaaggaacacgagcggcagggcagacggacataattttccaacggggtacattttgctggtacgttcccacgcctaggacgcagagaccaatccccttctagtttcttccttgccttgcgtggtgggactatgacatgaagcttgaacaactccatcgtccaactggtataaaattaaatccaacaacgacccctttttcagcgtctcgtctctatcatcctcaggacttccttgcccccaccccacccccctcgctaacgtacccatatatcaccaacctcccttctcgcctcctcgccatttgctcaccacgcccagcaccgcagctagtccattgcattgacgcctcgatcagggctagcgacggacgaaagaaagctctgcatgcagcgcctcgccgccgccgtcgtccccagcctggtgccgccgctctacctgtccatggccgcctccgccgctgccggctgttttccagcagaagcagccggcagtagtagccggacgacgacgtcgacgccgacgccgacgcggcggccattattagcgcagccgccgtggcgggtggtgctactgacgctcctgctgctggcgccgagctgctgccaggcgacgcgaggcatgcagccgttcaggggcaagccgctgcggccaggcaccgccaaccatttcctggggttcttgccgcggggaccggcgcctccgtccggcccctcgcggcagcacaactccatcggagcgcaggatcaaagccatccctgacggcgaccgcaggactgaagcgtggaagaagcagggccgccgtcgtgtcgatgttcggatccgaggagtaagatctccaccaaatcaagagagttcgcatcaccatggattaggttccttgtcaaaaggttaagctcgtagtattgattatttagctagtttcgtagcactagcagcaatagatgtatactcggagagggaacgaagaaaaggcacgttctttgtaggacgatgtacatgaggctatattttttttgttggggatgggtgtggtggcgtctcgaaaaaaaaaaaaaaaacgtgccttatttctgttaatttccttccctgccgctgctttttctgagcagggcaagctggatcgatgcttttctgataaaagccaggtacgcagcagagtacgagtgtacaacaaccactgcctaagtggcctgtactcgtactttgtgctttctgatgactattatgggtgatatggatcgagcagagctgtccgtcccgtcgttgatggtgcgccgctgagagcagctgcgtgcatgctgtgattgcttctgcatccgtggaatcaatgggggcgtggggggaggccgggagggggcctcgcagtttcgatcatcgcggttggttgggttttgattt

SEQ ID NO: 19823 - DNA, 1691 bp, Zea mays
gagctcactagtttgttgccgccctttctttttttgcggccgcgtcgactttttttttttttttttcgccagcgaataatggaacctttataaatcattgccaccgttgttcattacatgcatgtgacaaaaaaggaactccaaaaaacatacaataatggatttcatcaataaacttatccatctatggaacattttaaaaaaaaaatcgaagaaatagctattgtgtagagctgcaaaaaaagaggccgccggggtgttcaagcagcttcttgctcagtagcactagccgcgttcaaatcgactgagagatcaagctcctttccagtgatcttgttgtacaaggcgagcacatccttgaccgtcgtctcaaaatgggtggtggagtcatagctatttgtgaggaaacagcagtcgtcgtcagggttgttgacgggttcatatctgtcgtagatgtcgaagaaggtctcctctacagggccaagcaggtcgatcccgggcttgagctcgatctcaggcttgtcggtctcggcctcggtggagacgaaggcgatgaacttgcctttgggcgcgacgttgtgggcgtaggagcagcagaacacgtacatgtcggatttgcgctttagctgcttcttggggaggatgatctgcacggagtgcgagtccttggtgtccgggataggatgcttcatgatgcatatcgcgcgggccacccttccaaccttcttcaccttgtctggcaaatacgaaggatcgcagacgatcttcttgcacttggcggtctccccttcagaagtgactccatacgcttttccactctcatcaaactcgaccttgcattctggcttgttcagcatgtacgtgccaccgtaaacagcgctcaggcgggcaaaggcctgagggagctctcccagaccgtatagagggtagatgtaaggggaccctccttgaaagcgtgcgagtgattctgcatagagcttcatcctcttgacagtgtcgattgcaggctcgtcaaggtagctgtcgtcccggtgaagtgctagcgcatgcccgataaagtcgaccgtatcatcctccaatccgtatttggagatgacttccctggtggtgaccttgttgaggtccaggccctcgtgggacttggggtcgtcctcctcgtagtcctgcacgtatatgaagaacttccgggcgcgccgcttctcgaacaggcccatcaggttcgacttgagggcctccacgtcggttgccgggactttgtggatcttgccattgttgtacacaaagctcccgtcaacagccttgaagttgagatacttggtcacgctggtgcggatcaggacgcggaccagcgcgccgtttgccatcatgaacttgggcaccatgtcgacgttgtactctttgctgacgcccaggtgctcgggagggctgtcgttgcccttgaacctgttccagagcttggttagattcagggacgaagattctcctccgtagtagtcattcctgtccatgtgaaggaccttgaggccatcgacggagaggaggccgctgatgatgcactccttgagccccgtccccaacacgatcacgtcgtactcctcatccatctctctctctctctctctttctctgcctgcttgccttcttctcctcgatctcacgctctcgctcgctagttatctcctgtgcgtttt

SEQ ID NO: 19824 - DNA, 966 bp, Zea mays
aaaggatcccagccaaattgttctagagaaggtagagaaacaggatacatgagaggagagattttttttttttttttttgatggaaaggtagagaggatttagtttgttcaaatggttctttcatatcccttggtctatacgttctccctttttataggcacacatgccacccacttgccatctatccagggtcctgacactgcgcttcattatttcgttacagttacagcagatgccttacgctattcgcagcccagcaacgtctgtgatctactgtcatcctatcttcaatgccctgaacgcactagttacaacaactgtatgcaagaaccaacctgcttttactgtacatgtgaagctacatgacctcaaacaataaattctttttcacgaccttgctgagtcattaactcaacgctcctcggggaaaaaatgcagccaccaagcttttggttgtggctcaggatataatagtcttccagatccagatcaaatgcttgaattatctttaaacagttttgctgggaaacgacagtcaacatgcagtctcctagggccatgtgactccctgtcttggggagcaaggttaatcccttggaagggttggccatcccaatggtgatcatgtggttggtctggtcattgttgaaagaccccggcctcccatgggacccatgccatgaagatccacatcaggctcgtcatcggttgtatcttcaccagattcagcgccagcaatcccaatgcaagcaaacaaagaagaatcgtcaactttcaggtgctcatatgcaatatacagatcctcaatcgttgcattttcatataatgtcggcaattccttgatgcatgatacatcctttcttctggtgccggaagattgtagatgggcaagcaaaccaagccagtaggcgtttgtcttcgtctcagcttcatgtttcatcaccagtgtcctctttgcccgatcg

SEQ ID NO: 19825 - DNA, 1141 bp, Zea mays
aaaaaaacaaaaaaaaaaaaaaaaaaaaaaaaaaataaaaaaaaaaaaaaacaccagggtcctccaagccggccgggatcactaggctgcaaccatcgctcatcggccatctaagcccctcctcctcctctcgagtctcctccccctgccctctaggcgaacgcgcggtggcgccatggacattaggctgctggtatccgccgacgccaacctcgccgccgctctgtcgcgctcccgctcttccaagtccgcgttccagcgccaggttgtcccgggcagccgggcgtcgtcgtgcaggtccgtccgcgcgcgctccgccgcagccgccgcgccggccgcgggaggcatctccgggcatagcaattacacggttggtgacttcatgacaacaagggacaatctccatgttgtccaacctactacaccagttgaccaagccctggagctgctggtgcaacacaggatctctggcttccctgtggttgacgatgactggaacttggttggggttgtatcagattatgatctcctagctttggattcgatgtcaggaaatgaattggccgatacaagtacaaacatgtttcctgatgtggatagcacatggaagacattccacgagctacagaggatattaagcaaaactaatgggaaggtcattggtgatgtaatgacctcttcacctttagcggtgcgtataaatactaatcttgatgctgctacaaggttgctacttgaaactaaataccggagactacctgtagttgatagcatggggaaactagttgggatgattacaaggggaaatgtcgtcagtgctgccctcaaaataaagaagaaaactgaagaaggtgcttgaactagactgctcgtcactgcttgcttggggttaatcatgcagccatttggcattgaattcattgaagcattgattggtgatgttcaaagtgtagctacagaattttgttctcaatactaggtagcatactagtgtagcagtgtgtaggttcatattccctgtttttcatcgtatccatgaacatttttattgatttgcataatggaatcaagagcttgtatccgataaaaaaaaaaaaaaaaaaaaaaaaaaaaaaaaaaaaataaaaaaaaaaaaaaaaaa

SEQ ID NO: 19826 - DNA, 1055 bp, Zea mays
ttgggaccctcgaggcccgcccggcaccagtcagtgggatgtgtggatgctaaccagtgcagtggaggattagcgatcttctagaatcgtgtgcgagctggacagcaggaagagccgtagagttcgacgcgaggagcgagcgagtgattagctcgtgcgtgctgtgcaaggaaagtaacccagcagatcgatcggtcgaggcgggtaggacaggatccagaggtagctagccatggcggaggaagcgtctgcgcctgcggcggggacggaagcgccgccggggaagatgacgatggtggtaggggtcgacgagagcgagcacagcttctacgcgctgcagtgggcactgcagcacttcttcccgccgggccagccgcagcagtaccgcctcgtcgtcgtcaccgccaagcccaccgccgcctccgccgtcggcctcgccggcccaggcgccgcggatgtgctgccgtacgtggaggcggatctcaagcgctccgccctgcgcgtcgtcgaaaaagccaaaggcctctgcacacaggcgagcgacgctgtgtttgaggcgctggagggggacgctaggaacgtcctctgcgaggctgtcgagaggcacggggccgagatgctcgtcgtcggcagccatggttacggagccattaaaagggctgttcttggaagtgtgagcgactactgtgcccatcacgcgcactgcaccgtgatgatagtaaagaagcccaagcagcacaagcactgatcaatgccgactgatcactacgtgtactgcaaataatttgtactactgcaaagttatgtgtgcgtccgtccgtttgtgaataattgggtcatcaaccatcacatcttcggttgcttctacaagtatccgatccaatccttctacgagtggattgggatttacaaataattgattgctctctgaacctgaaaacaatgtatttgtattaatgtgttggaacacgtatatgtagttgcaacttcaaaaaaaaaaaaagggcggccgccaccgcggtggaaaaaagaaaaaaaaaaaaaaaaaagcggcc

SEQ ID NO: 19827 - DNA, 778 bp, Zea mays
ccggccgggaaagagccgtagagttcgacgcgaggagcgagcgagtgattagctcgtgcgtgctgtgcaaggaaagaaaccaagcagatcgatcggtcgaggcgggtaggacaggatccagaggtagctagccatggcggaggaagcgtctgcgcctgcggcggggacggaagcgccgccggggaagatgacgatggtggtaggggtcgacgagagcgagcacagcttctacgcgctgcagtgggcactgcagcacttcttcccgccgggccagccgcagcagtaccgcctcgtcgtcgtcaccgccaagcccaccgccgcctccgccgtcggcctcgccggcccaggcgccgcggatgtgctgccgtacgtggaggcggatctcaagcgctccgccctgcgcgtcgtcgaaaaagccaaaggcctctgcacacagggctgttcttggaagtgtgagcgactactgtgcccatcacgcgcactgcaccgtgatgatagtaaagaagcccaagcagcacaagcactgatcaatgccgactgatcactacgtgtactgcaaataatttgtactactgcaaagttatgtgtgcgtccgtccgtttgtgaataattgggtcatcaaccatcacatcttcggttgcttctacaagtatccgatccaatccttctacgagtggattgggatttacaaataattgattgctctctgaacctgaaaacaatgtatttgtattaatgtgttggaacacgtatatgtagttgcaacttcttttctgtg

SEQ ID NO: 19828 - DNA, 3170 bp, Zea mays
tagttttccagtattatctcattttgctagagatattcttcttgttcctgtttcgacggtttcctctgaagcaacatttagcacagtgggtagaattattgaagaaaggaggccctctctttcacctgagacattggaggccatcacctgccttaagaattggaaaagagaaagcaacatcaacttgaagattatgaggttgaacaagcttttgctgatttcagccatgattagtgttacttttatctagttcatgtggactgttattgtaatatggactattattgtaatatggactggacattaaaactttttccgatctgtactcttttccttacagaggaaggcccacactggggtgtaaggtttttaacgaggcagatcgaggaataaaaacattttccctctaaaatttgtttgtgttgtctaatttattggaactgtttatttaaataaatgacttgtttctgtattttaactgtttttaactggactgttgtctatgttgcgtgacagatttggacttgtttctatatctgacctagtcatatgatgattatcttgcgacccgggtctgggccagcatggtccaatgcaagtctgtcgtgttttatgtccgtgctggacctacgttttagcaggtgagcacgttttggtccagtccgaaagaaattcgtgctagcacgatcccacgtatttaagcccgaagctcgacggacccgtgccgggtccacctggcccggcccggcccaacttgtaggactagatcaaaaggaaacagcggccccgcgatacgtaattacagaaacagctgcgggaggaatcaccgaatcaggacacggccggcggaattccacttcccttgcattattagccgaggcggggccctcctgttggtcccaccagtcagtgggatgtgtggatgctaaccagtgcagtggaggattagcgatcttctagaatcgtgtgcgagctggacagcaggaagagccgtagagttcgacgcgaggagcgagcgagtgattagctcgtgcgtgctgtgcaaggaaagtaacccagcagatcgatcggtcgaggcgggtaggacaggatccagaggtagctagccatggcggaggaagcgtctgcgcctgcggcggggacggaagcgccgccggggaagatgacgatggtggtaggggtcgacgagagcgagcacagcttctacgcgctgcagtgggcactgcagcacttcttcccgccgggccagccgcagcagtaccgcctcgtcgtcgtcaccgccaagcccaccgccgcctccgccgtcggcctcgccggcccaggcgccgcggatgtgctgccgtacgtggaggcggatctcaagcgctccgccctgcgcgtcgtcgaaaaagccaaaggcctctgcacacaggcgagcgacgctgtgtttgaggcgctggagggggacgctaggaacgtcctctgcgaggctgtcgagaggcacggggccgagatgctcgtcgcacacaggtacgagtacatcgaatccctacgatctaccaaaagtgatccagtgaaggtttacatgtgcaaattatgcagcacgtatcatcgtattggaagcttcatcccttaactcgaattgactataaaaaacagcagcaggatatcagcttgtttatgcatcatgtatccccaaccttttttggttatatattccatgtttttatgttgtgtgcggacgggaatgattcaggcgagcgacgctgtgtttgaggcgctggagggggacgctaggaacgtcctctgcgaggctgtcgagaggcacggggccgagatgctcgtcgtcggcagccatggctacggagccattaaaaggtctgtaccatctgacctcactcactgcctcttctctcttctcttctcccctgtttgccgactacatagttgctgccatcttcatttgtcactggctgcaacgactaccactaacgaaattctaatttataagatgaatgaatggaaaccataattgacaggctcatctcctagaaatagatttcacatcgattgatggtgttcgagttagtacctggctacctgctaatgttcttttcacgcgctagggtaggaaaaaaaacgcgccagagtactatcttttttattgtgttttctattcacagggtttgcagctttgtatttctgcggcaaacatatcagtaatgatatctgcacttgttggcaacatacagaacgccaacactttatatgtccatgactaatgaagtaggctttcctcaatgaactaggctaagcaagaattattttgcgtgtatgatttcaaataaaccaacaattgaaggggccttcttgttgaaacgtgatttgataacttagtaacgttcctcacaaacacctccatgtattgagacttgagagcaaaagaaataactattttgaaggatctatacactcagtttagtcgttttgacctgccctaaatacacatatcttcttcactctgtctgcgttctagggaacaatttactacaactacaatggccattgctttgcatttcaactctacatccctttcctcgtctacttcaaatgtcctttattttcgaaagctatagttccaagtgtctttgttttccccgaaagatctacttcaaatttattctggttctcatttcactttcgtattattgattgattgactgtcctcaaccttcctcagggctgttcttggaagtgtgagcgactactgtgcccatcacgcgcactgcaccgtgatgatagtaaagaagcccaagcagcacaagcactgatcaatgccgactgatcactacgtgtactgcaaataatatgtactactgcaaagttatgtgtgcgtccgtccgtttgtgaataattgggtcatcaaccatcacatcttcggttgcttctacaagtatccgatccaatccttctacgagtggattgggatttacaaataattgattgctctctgaacctgaaaacaatgtatttgtattaatgtgttggaacacgtatatgtagttgcaacttcttttctgtgggccgtgggcgcgcgtgcgcgggcccggtgcccaaaatggtataaatcagatgaaagggtgaatgcacgtgatgaactcatcagtctgatacatgctccgaacttgatt

SEQ ID NO: 19829 - DNA, 597 bp, Zea mays
tctagagtactctcgagttttttttttttttttttagtcgtaagcaacaaaaagctttattgcaaacgagggcattgttacaaaatatgttctatggtggacacgttacaaaacaaaatatacatcccatttcaagtcgccagtttggccaaaatcaccatatctaatatcttaacttcgtatgtgtcgtcaagccttactattccgtcagaaccatctatacctataagttttcctgtgtgcccacggaaactaccattcagtatcttgatcctgtcactcttcttcggcctgatgacctcgacctcgttcggaaggaccgtcaccatgtcaccgttgcccgaagacccaagtgcaactcggcaagatccatccccgagtacctccctaaccacaccaggaccgtcatcacctccgctcaacacattgaccaaaacatccggcagcagccatgtagcttcaccctcaccacctattatcggcgacatcatatccattccagcattgcctggggtcattggttgaccaccaggtgtgcctggaagatatgaggctggtaagcgtcattcggacgcgtggtcgagccgggaattccgg

SEQ ID NO: 19830 - DNA, 1476 bp, Zea mays
  misc_feature (2)..(14): n is a, c, g, or t
  misc_feature (18)..(19): n is a, c, g, or t
  misc_feature (22)..(22): n is a, c, g, or t
annnnnnnnnnnnngagnngcnggaagcaacataagcaacaaaaagctttattgcaaacgagggcattgttacaaaatatgttctatggtggacacgttacagaacaaaatatacatccatttcaagtcgccagtttggccaaaatcaccatatctaatatcttaacttcgtatgtgtcgtcaagcctcactattccgtcagaaccatctatacctataagttttcctgtgtgcccacggaaactaccattcagtatcttgatcctgtcactcttcttcggcctgatgacctcgacctcgttcggaaggaccgtcaccatgtcaccgttgcccgaagacccaagtgcaactcggcaagatccgtccccgagaatcgtgtgcgagctggacagcaggaagagccgtagagttcgacgcgaggagcgagcgagtgattagctcgtgcgtgctgtgcaaggaaagtaacccagcagatcgatcggtcgaggcgggtaggacaggatccagaggtagctagccatggcggaggaagcgtctgcgcctgcggcggggacggaagcgccgccggggaagatgacgatggtggtaggggtcgacgagagcgagcacagcttctacgcgctgcagtgggcactgcagcacttcttcccgccgggccagccgcagcagtaccgcctcgtcgtcgtcaccgccaagcccaccgccgcctccgccgtcggcctcgccggcccaggcgccgcggatgtgctgccgtacgtggaggcggatctcaagcgctccgccctgcgcgtcgtcgaaaaagccaaaggcctctgcacacaggcgagcgacgctgtgtttgaggcgctggagggggacgctaggaacgtcctctgcgaggctgtcgagaggcacggggccgagatgctcgtcgtcggcagccatggttacggagccattaaaagggctgttcttggaagtgtgagcgactactgtgcccatcacgcgcactgcaccgtgatgatagtaaagaagcccaagcagcacaagcactgatcaatgccgactgatcactacgtgtactgcaaataatttgtactactgcaaagttatgtgtgcgtccgtccgtttgtgaataattgggtcatcaaccatcacatcttcggttgcttctacaagtatccgatccaatccttctacgagtggattgggatttacaaataattgattgctctctgaacctgaaaacaatgtatttgtattaatgtgttggaacacgtatatgtagttgcaacttcttttctgtgagccgtgggcgtgtatgcacgttttaggtggagaaaatggtataaatcagatgaaagggtgaatgcacgtgatgaactcatcagtctgatacatgctccgaacttgattacacagccatgccatttacatgttcttgcatgttgaagttcgattgaacagcacttcttcaaattcaaaatattgatgtcg

SEQ ID NO: 19831 - DNA, 2000 bp, Zea mays
ttctaatttcatgcatctaaaaaagccacctatgctgcatatagcttatatctccttttaaaggtctacctatgtttcaaaatcattcaagaagtagaaaccatctacctgagttcatttgtccctgatgtacctttttgcgagtaaagaaactattccatattacactgatgtttctcaagtttcttttaataggaatttggtggcaagcaattttgtgataaacaaatataatgataggtcagttcatgttacaatagttcctcgaacgcatctatttgtgctcagagctcatgttttgatacaaaatgccaatgttttgcaactacagtgtcttgcctgttggacttgagaatggaaactatactatggtgtttgcagaatttgactttgcagatcagagcctttaaccatcttggcctccggctctgaaatccaccagcctctggacaatagtcatgcaacctatgaacctacaatcgagtgacgtcgattgacgatcaagtgcagacaaaccacaggcagttaatacaaaggtcactgatggatagatgtattggcaacctcatatcgaaagcccataatcccaacaaaattgactatgcggcagtaaaatctcatatcagaacttgataacttctattgcacgccattttaatcgcttaatttaatcacgcttcaaactacataaccagaagcaagtacaaaatcgtcgtcgaactaaccttgccaactcaacgccgccaccgaacagatacagagagatcgaggcctgtcagattcaattttcgagtccaggcacctgcatgcgccggttggccaccgacttcttgccgccgaggaactcgtcggggacgaccttgagctgcttgcgcttcttggacttggcgatcttctggatcgtctttgggttggtgaccctctgcagtttggtgcccgtgcggagcacgttctcctgcttccgcttctcacgctcctcgcgggccttccgcttggccaccttgttctgccggatctcttccttgagctccgccttgcgggcctggtacgcgcgcttcagcgacttctcccggacgcgctgctccagcggggtcggcttccgcgacaccgccacggccgacgctcgccgggtgcgggcctccttccaccgccgtcccgacaaccgccctgcgatgacgccgtcgtaggtgggctggccgaaggaggccggcttcgaggggtcggagagggaaggcatggcgcggagcttagacggccggtgcgcgtcggcatcgaggtccatggaatccgcggccgccgcctcggcatcctcgcggcgcttgcgcttgccgcgctcgccgccgaggccctcatccaagcagcggaagtcgatgtgggaagccatgcggaaagcggtcgggtgcttggtgccgcgatttgggaggagatggaggacgaaccagaggcggagatgggtttattagggtttgtgatgaagagtagcagcggatggtggatgggccgggcttggacgaatacaaaaacttgtcaggccgctttgcaaggtcgatgttttcttattagtatgccacatcagcacactctctcccctatatctctaccctttataagctatttactctaaattctctcgctataaatcactacctctataaaatatcattttttatacatatttcttatttattacaaatttttactccactagcaaacactttctagcacacacatcgacgctagggtggctactgtcgcacccacacatttggtggtatactgtgctagcagctatcactgtcacagatagtggaggatgtagggggtaccgatgaactatctcttggtgtgatgttgcagcctctacagtcgtgaaggggggcggctgcggtaagcattgaagagagtctgacgagataaggcctggcgacgggtcatgctattaggctatctatagcagcatagccatactcatactaatatttaaacttacgctgcaaata

SEQ ID NO: 19832 - DNA, 2116 bp, Zea mays
agacaagccgaattttaagaagcaagcccaattttaagaagggagaatgtcagggactgcctgcccaaacggcccagatagctcaaactacaaaggcccagtagaggttaccggaaagggcatccaagaattattgagaacccatctcgttctccatttccaggactgcacatctttctccccgcgcgcccgcctgcaggctctagctcgtctccctctgtgttctagtgctcctctcctctatccagattgtcttgcttgctgcaaaccttccttctcttgaggttaccagtgaatctagtaattccgtgtacaagagagaggtgtgtgtgctaacagtcactgatggcaactgaataatagatgcatagaaaactttatatggagagcccggaatacaagcaaaattgggtacacggctttaaaaatctcatatcagaacttgataacttgcgtaccattgtaatcacttaatctgatcatacttcaaactaccataagcaagtagaaaatcgtcgtcgaattaaccactatgaactcaacgcgaccccagaaacagagattgagaattgagattcaattctcaagtccaggcacctgcatgcgccggctggcctccgacttcttgccgccgaagaactcgtcggggacgaccttgagctgcttgcgcttcttggacttggcgatcttctggatcgtcttcgggttggtgacccgctgcagcttggtgcccgtgcggagcacgttctcctgcttccgcttctcccgctcctcgcgggccttccgcttcgcaaccttgttctgccggatctcctccttgagctccgccttgcgggcctggtacgcgcgcttcagagacttctcccggacgcgctgttccagcgggatcggcttccgcgacaccgccacggccgacgaccgccgggtgcggggctccttccaccggcgccccgacaaccgccctgcgatgacgccgtcgtaggtgggctggccgaaggaggccggcttcgaggggtcggagagggaaggcatggcgcggagcttagacggccggggggcgtcagcatcgaggtccatggagtccgcggccgccgccgaggcatcctcgcggcgcttgcgcttgccgcgttcgccgccgaggccctcatccaggcagcggaagtcaaggtgggaagccatgggtttgggagggaggaagcggcgctaggttcattagggtttgcgtgataagtagtagcaggcagcagcggatggtggctggatggatgggccgggctgggacgaatacaaacttgtcagcctgatagccaattttgcctgggcgccgggctgtatagagaatctcttgtatctgaattctgaaggttagcacttcttagctcatctccaacagatagcgtatatagatagactagtatgcaatattgtttttaagttaatttttaatgcttgttgtaatttatatattaccagacgaataaagcgagtgagtttttttaagatgatacagagcatgaaagacggtatagagcacatcagatttatataaaataaaatagagttaagtgagttgtggtagaatgtaatatatatatatatgttgcgatatttgaagctatcttgttatatttacatgaaatgtcttcagaagagttgagcagttatatataattatatagaggacattctacaacctaaaaggctgttgataatcttagaaaatcttcaattcttggaagatctagtgtccgaattttctttgatgtgcaggggtccatgtttgaatctgtatagttgggaaacagagaattttaatttcttcgtttatggaagtagaagagaaagggatgaaagtgttcggcataaatggttaccacaattaatatctattttctatttgcatgaatatgtggtattaaattttggataagttaaatatgaggaaaaattatgtgtgaaagaaatatagttttggataaattcacttctgtagtagcaataattaccaaagaaaaatggaatgatgcttttataatagatagaaaaaatacatgtaagatattgtgtagcagagtataacattttgggtggagaatcaattgtagttgttgaacct

SEQ ID NO: 19833 - DNA, 1381 bp, Zea mays
atcccgcctgcaggaccaagatcaactctagaaccatagatcgttagagttggatcttgtaattaatacgaaataaatatatacatagaagcttcagtcttagcgttagtctcggtcttagttagttttagttagacagggtagtttgctatatcctgtgcatttatgtttgtcatgatgaactatgtttggtttggatctttgtaatgattgtcaccagagtgtgggtatcccctgcattttggtttacatactatgtcaataaagttagttatatagttgggaaacccattattctcctttcctctttatctgagaagctgtgtggtctgtgttggagatcagtgaagatgctcatctgttcagtgctgttggagaattctatactcttttcttatgctgcaagctttgccagatcagttctgatgtgtggttgcgttctgcagatgtcagagaacaggcgtagaggaggaaggcgtgctcagcaggagcgagccgctccgcaggatgaggtgccccagcagcagcacctgccgcccccgcccccgatgtcgattgagcagatgtttctgatgcagactcaggcagttcaagccatcggtcagactctggccgccattcagcagcagcagcagcagcagcagcaagcaccaccccagcctcagatgcctcagatgcctagagataagcgtgctgaattcatgagaggtcatccaccaacgttcgctcattcttctgaccccatggatgctgaagattggctgcgcactgtggagcgggagttgcataccgctcagtgcgatgacagggagaaagttctgtatggtccccgtctgttgagaggagcagcccagtcatggtgggagtcttacctcgccacccatgccaaccccgacaccatcacctgggaagaattcagaggtagctttcgtcagtaccatgtgcctgcaggtctgatgacagtgaagaaggaggagttcctggcccttaagcaagggtcatcgtctgtcagtgagtatcgggacaggtttctgcaattgtctcgctatgctcctgaagatgtcaacaccgacgccaagcgacagtaccgttttctgagaggcttggttgaccctctgcagtatcagctgatgaatcacaccttcccgacattccagcacctgattgacagagcaatcatgacagaaaggaagcgcaaggagatggaagatcgtaagcgcaagatcagtggaccccagcctggaagcagcagccgtcctcgtttctcaggcaatcaacctcagcagttcaggcagaaccagcgtccacctccgcagcatcagcagcgtcagcggcagtaccctcagaatcagtaccagaaccgtcagagcaaccagtcagg

SEQ ID NO: 19834 - DNA, 1592 bp, Zea mays
cttatggcaatcccgcctgcaagaccaagataaatctagaaccatagctcgttagagttggatcttgtaattaatacgaaatatagctcccgtgaagcttcagtcttagcgttagtctcagtcttagttcctcttagttagacagggtagtttgctatatcctgtgcatttatgtttgtcatgatgaactatgtttggtttggatctttgtaatgattgtcaccagagtgtgggtatcccctgcattttggtttacctattatgttaatggagttagttatatagttgggaaacctttttattccactttcctctttatctgagaagctgtgtggtctgtgttggagatcagtgaagatgctcatctgttcagtgctgttgaagaattctatactcttttcttatgctgcaagatttgccagatcagttctgatgtgtggttgcattctgcagatgtcagagaacaggcgcagaggaggaaggcgtgctcagcaggagcgagccgctcaacaggaggaggtgccccagcagcagcacctgccgcccccgcccccgatgtcgatcgagcagatgtttctgatgcagactcaggcagttcaagccatcggtcagactttggccgccattcagcagcagcagcagcaacagcagcaggccccacctcagcctcagatgcctcagatgcccagagacaagcgtgctgaattcatgagaggtcatccaccaacgttcgctcattcttctgaccctatggatgctgaagattggctgcgcactgtggagcgggagttgcataccgctcagtgcgatgacagggagaaagttctgtatggtccccgtctgttgagaggagcagcccaatcatggtgggagtcttacctcgccacccatgcccaccctgacgccatcacctgggaagagttcagaggtagctttcgtcagtaccatgttcctgcaggtctgatgacagtgaagaaggaggagttcctggctctcaagcaagggccattgtctgtcagtgagtaccgggacaggtttctgcaattgtctcgctatgctcctgaagatgtcaacaccgacgccaagcgacagtaccgtttcctgagaggcttggttgaccctctgcagtaccaactgatgaatcacaccttcccgacattccagcacctgattgacagagcaatcatgacagagaggaagcgtaaggagatggaggatcgtaagcgcaagatcagtggaccccagcctggaagcagcaatcgtcctcgtttctcaggcaatcaacctcagcagttcaggcagaaccagcgtccacctcagcagcatcagcagttccaaaggcagtaccctcagcaccagtaccagaaccgtcagagcaatcagtcaggaggtcagtttcagaggcagaatcagcaggcacctcgtcttcctgccccagcaaaccagcagaacagtcaggcagcaccagctcaggttggaaacagggcatgtttccactgtggagagcaaggccactgggtgatgccatgtccggagaaagcagcccagcagcagtcagggcccagtgcccccagcaagcagaatgtgcctca

SEQ ID NO: 19835 - DNA, 973 bp, Zea mays
ttttttttttttttttgacaagaccagcaagatttcctgttccatcaaaatcagtttgacaacttgctggatattataccagattctcctaaagattggatatacaggaagtctgggtggtctatatttacatcatcaaaggcacattggactgtgccagaagttaatttattaggaacaattctttgcatctttttcctctcaaactttgagcacaacttaacaaaccatcttgcaaattccttccgtgtacaaaaatcactggagctaacatctttctcaattatctgtagtttcttcaatacagataaagcctcctcatgcacaggatctgtaggaactccaaatggaaaagggctggcaattgttgttctgtagttttgccttgaatcatcagttattgcttcagccttcttatcatgtgttgcactagaaacttcaatttcatcagattccctgtcacttgcatcctccttggttgtctctgttgactctattgttggcaatttctcttgaacatagtgtaatggagcaacaatgagttgctgtatacgcttctgggaagatgggaagcgccacgccagcccagccaaggcgatcgccgcagaagctcccaacccaaccacgacagctctcttaaacccaatcctccccctcgcctgtttcatcgatttctcgtactcgggaaaccaccagccgccgaccccgtcttcggagtcaccggcggcgggagaccagctggtgccggctgcagcaacccgagcgggcacgcggcggcgtaggtgaggccgcagctgtgggaagaggatggtatcaagccgcggcggcggagagaggccgagagagtagaggccgacggccatgctggtgaggaatcgaggtcgctagggttttgtgaatcgggtttcattcaagtgtccatttcgggtcgagtgtatcatataccacccccggccgccctcgaggtacccaa

SEQ ID NO: 19836 - DNA, 2138 bp, Zea mays
  misc_feature (33)..(33): n is a, c, g, or t
  misc_feature (182)..(198): n is a, c, g, or t
tggatggaaagaatttatttgctatatcccggntgagccaaagagtatgttataaattacagagtaacattgtttagaaatacataaaatcaatttccatctcaccactataaatttgtgataggcttatatttgaactttggaaagttatggaatgttgaatttaaagttaaatagcctannnnnnnnnnnnnnnnntaatccctccaaaatgaagggatacatacggcccctaagatggcaacagattataattcctccaaaatgaagggatacatacggcccctaagatggcaacaagatgccgagaagcaccaaaggatggccgcccttctctttgttctttatggcacgaccattccattccattgagaatttttcagatctgatggcagatgctctggaaccaagtagctccaaaaactttgaacaagacttttcctatgcaaagcacagttagtttggagggatcaatcttctgggattcgccatcttctcaaagccttctgaagtgtctcagctcgttcatggacacgtcctgcttcatcttccacccaagtccttaacatagtaagagcttccttctcagcttcaagatatgatttagcttcattgacagcttgatgcttgctggtcatgtcagacaccaggttttccaaagtctgctgatcagccatgacctcttcgttctcagttgccaatctatcatacatgccgtcaatttctgaccttaaatttatgagttcctgattctggcattctagagctgctctttctttcaacaagtctgctagttcctcttctctgtctgtcctctcatttgcatgctcatgcaatacatgttgaagattattgtcaacttcaagagcccgttcttgctcctttttcatcttttgctcccattgttgttgtatatctcccctactaattaactcttccattatttcagctataagagaaagatgggcttggttttctgcttcaagtttattcaattcttcatgaactgcttccttcattcggccactagtcagtgcagcagctgcttgcgctttagttacaggtttgcccggttgaaggcgtctagtatttccaaaactctgctgatgatgctgttttcaccagccattattctcaatgcgcgtggatgctcaacatgctcaacaagcactttccagttgacaagatcgaatcgagataggtaactatcaggtaggaacaaggtatttcccttggaacaaggagagccacttgtcaacatttccaaggagtttgataacttgctggatacgataccagattctcctaaagattggatatacaggaagtctgggtcgtcaatatttacatcatcaaaggcacattggactgtgtcagaagttaatttattaggaacaatcctgcacatccttttcctctcaaactttgagcttaacttaacaaaccatcttgcaaattccctccgtgtacaaaaatcactggagctaacatctttctcaattatctgaagcttcttcaatatagagaaagcctcctcatgtacaggatctgtatgaactctgaatagaaaatggctggcgattgctgtcctgtaattttgccttgaatcgtcagttattgcttcagccttcttatcatgtgttgcactagaaacttcgatttcatcagattccctctcacttgcatcctccttgattatctctgttgactccattgttgacaatttatcttgaacatagtgtaatggtgcaacaatgagttgttgtatacgcttcctggaggatgggaagcgccacgccagcccagccaacgcgatcgccgcagacgctcccaacccaaccacgacagctctctgaaaccctatcctcctcctcccctgtttcatatgtttctcgtactcgggaaaccaccagccgccaaagctgtcttcggagtcattggcggcgggagaccaggtggtgccagaggcagctacccgagcggagacacggcggcgtaggtgaggccgcaactgtgggaagagcatggcatcgagccgcggcggcggggagagacggagagtgtaggggccgacggccatgccggagggcgggaggaattgaggtcgctactctcgctaggtttatggctcgtgccgc

SEQ ID NO: 19837 - DNA, 1430 bp, Zea mays
tcttgtaattatacgaaatatatacgtagaagcttcagtcttagcgttagtctcggtcttagttagtcttagttagacagggtagggttgtgcgctatatcctgtgcatttatgtttgtcatgatgaactatgcttggtttggatctttgtaatgactgtcaccagagtgtgggtatcccctgcattttggtttacctattatgttaatggagttagttatatagttgggaaaccttttattccactttcctctttatctgagaagctgtgtggtctgtgttggagatcagtgaagatgctcatctgttcagtgctgttgaaggattctatactcttttcttatgctgcaagatttgccagatcagttctgatgtgtggttgcattctgcagatgtcagagaacaggcgcagaggaggaaggcgtgctcagcaggagcgagccgctcaacaggaggaggtgccccagcagcagcacctgccgcccccgcccccgatgtccatcgagcagatgtttctgatgcagactcaggcagttcaagccatcggtcagactttggccgccattcagcagcagcagcaggccccacctcagcctcagatgcctcagatgcccagagacaagcgtgctgaattcatgagaggtcatccaccaacgttcgctcattcttctgaccccatggatgctgaagactggctgcgcactgtggagcgggagttgcataccgctcagtgcgatgacagggagaaagtcctgtatggtccccgtctgttgagaggagcagcccagtcatggtgggagtcttacctcgccacccatgcccaccctgacgccatcacctgggaagagttcagaggtagctttcgtcagtaccatgttcctgcaggtctgatgacagtgaagaaggaggagttcctggccctcaagcaagggcccattgtcggtcagtgagtaccgggacaggtttctgcaattgtctcgctatgctcctaaagatgtcaacaccgacgccaagcgacagtaccatttcctgagaggcttggttgaccctctgcactatcagctgatgaatcatacctttccgacattccagcacctgattgacagagcaatcatgacagagaggaagcgtaaggagatggaggatcgtaagcgcaagatcagtggacctcagcctggaagcagcaaccgtcctcgtttctcaggcaatcaacctcagtagttcaggcagaaccaacgtccacctcagcaacatcagcagttccaaaggcagtatccttagcaccagtatcagaatcatcagagcaatcagtcaggaggtcagttccagaggcagaatcagcaagcacatcgtcttcctgccctagcaaaccagcagaacaatcaggcagcaccagctcaagttggaaacagggcatgtttccactgtgg

SEQ ID NO: 19838 - DNA, 2355 bp, Zea mays
  misc_feature (1387)..(1387): n is a, c, g, or t
agagtactctcgagtttttttttttttttgcggcgtcctttttttttgaaaggggcaaacatccttccaagctgcactgtttcacttaagtatacaccaatgtaccaagatccagtttagacttgatgagaacagctaaaacaccaaggcatgaaaatatctacattgattgcggaaaaagtatggggaaaaggtttccaggtgccagtgttccctcagaatgtggacaagatgtcaagatgtactaaaggaaaataaaccatcgcaaggaacattaaggcacaaccattccattctattgagaattattcagatggcagatgctctggagccaatgagctccaaaaactttgaacaaaactttaccaatgcaaagcacagttagtttggagggatcaatcttctgggattcgccatcttctcaaagccttctcaagtgtctcagctcgttcatggacatgtgctgcttcatcttccacccaagttcttagcattgtaagagcttccttctcagcttcaagatatgatttagcttcattgacagcttgatgcttactggtcatgtcagacaactggttttccaaagtttgctgatcagccatgacctcttcattctcagttgccaatctatcgtacatgccatcaacttctaaccttaaatttatgagttcctggttcttgcgttctaaagctgctcgttctttcaacaagactgctagttcctcttctctgtctgccctctcatttgcaagctcatccaacacatgttgaagattattgtcaacttcaagagcccgttcttgctcctttttcatcttttcctcccattgttgttgtatatctcccctattaattaattcttctgttatttcagctataacagaaagacgggcttggttatctgcttcaagtctatttaactcttcctgaattgcttccttcattcgaccactggtcagcgcagcagctgcttgcgctttagttacaggtttgtgcggttgaaggcgcctagtatttccaaaaactctgctgatgatgctgttttcaccagccattagctctatgagcatggatggagacacatctgggcaagcacgcagatccaaaatgcaaacattttgactcggtatctggactgtaaccagagtcaggatttacaaaacaaaatggaacaaagcatctaactatagctgcaacttgcaacacaaaatatcaaataaaagatatgagtaccttttcgtctattctcaatgcgcgtggatgctcaacaagcactttccagttgacaagatcgaatcgagataggtaactacaaccacaacaaagatcaattaactaaggaacacattccaattatcaaataaacagtaaaaataatcaaatttcntatgtcacgctagtacctatcaggtaggaataaggtatttcccttggaacaaggagagccacttgtcaacatttccaaggagtttgataacttgctggatacgataccagattctcctaaagctttccatcgccaaattagacaattagacttttacagtgtgagcttctcaaatagcaaatctggaacttcaaagcaaaagagaataaaatggacaatatcttaaaagtttcgctacatgttacattggcagatgcaatgtggaatagttagataaagaggattatctctaaaacgtaggaagaccttctagacatccgatatgataaacagcaaaacttacattggatatacaggaaatctgggtcgtcaatatttacatcatcaaaggcacattggactgtgtcagaagttaatttattaggaacaatcctgcacatccttttcctacaaattgcaaaaaataaaaatgtaacaaagaaactagcaaacaccatgcatagcttttaaatatattttatactctcttgccccattacctctcaaactttgagcttaacttaacaaaccatcttgcaaattccctccgtgtacaaaaatcactggagctaacatctttctcaattatctgatcaagcacagcatgaggaaaacataattaacgcattgctttcctaataaatgttgcctacagtataaattaggaatgagtcaaagcatacattaaacaatataaccattgaaacaaccatacatagtgataactttgagaccacttttaatatatttacagcaatacggtgtataattgacttttaacaaatgtgctagcgagctagttgaccatgcaattgaaggtcgggaaccataagaaaaaactggcataagatcctggtcaaaccatagtcataggggtcggagtcaggatcgacgttgtcccgtaaactcgtaaagtgggttcaacccaa

SEQ ID NO: 19839 - DNA, 1359 bp, Zea mays
tagaagctatagtcttagcgttagtctcgcttttagttagtcttagttagacagggtagtttgctatatcctgtgcatttatgcttgtcatgatgaactatgcttgatttggatctttgtaatgactgtcactagagtgcgggtatcccctgcattttggtttaccggttatatgttaatggggttagttatctagttgggaaaccttttattccactttcctctttatctgagaagctgtgttggtctgtgttggagatcagtgaagatgctcatctgttcagtgctgttgaagaattctatactcttttcttatgctgcaagatttgccagatcagttctgatgtgtggttgcattctgcagatgtcagagaacaggcgcagaggaggaaggcgtgctcagcaggagcgagccgctcaacaggaggaggtgccccagcaacagcacctgccgcccccgcccccgatgtccatcgagcagatgtttctgatgcagactcaggcagttcaagccatcggtcagactctggccgccattcagcagcagcagcagcagcagcgcccacctcagcctcagatgcctcagatgcccagagacaagcgtgctgaattcatgagaggtcatccaccaacgttcgctcattcttctgaccccatggatgctgaagactggctgcgcactgtggagcgggagttgcataccgctcagtgcgatgacagggagaaagtcctgtatggtccccgtctgttgagaggagcagcccagtcatggtgggagtcttacctcgccacccatgcccaccctgacgccatcacctgggaagagttcagaggtagctttcgtcagtaccatgttcctgcaggtctgatgacagtgaagaaggaggagttcctggccctcaagcaagggccattgtctgtcagtgagtaccgggacaggtttctgcaattgtctcgctatgctcctgaagatgtcaacaccgacgccaagcgacagtaccgtttcctgagaggcttggttgaccctctgcagtaccagctgatgaatcacaccttcccgacattccagcacctgattgacagagcaatcatgacagagaggaagcgtaaggagatggaggatcgtaagcgcaagatcagtggaccccagcctggaagcagcaatcgtcctcgtttctcaagcaatcaacctcagcagttcaggcagaaccagcgtccacctcagcagcatcagcatcagcagtttcaaaggcagtatcctcagcatcagtaccagaaccgtcagagcaatcagtcaggaggtcagtttcagaggcagaatcagcaggcacctcgccttcctgccccagcaaaccagca

SEQ ID NO: 19840 - DNA, 1429 bp, Zea mays
  misc_feature (703)..(703): n is a, c, g, or t
  misc_feature (883)..(883): n is a, c, g, or t
cgatttgcaggtatcgtcatggattgagcgtcatagattaacaagttagttgtagtgattcatgagaggtcatcccccaacggtctgctcattcttctgaccccatggatgctgaagactggctgcgcactgtggagcgggagttgcataccgctcagtgcgatgacagggagaaagtcttgtatggtcctcgtctgttgagaggagtagcccaatcatggtgggagtcttacctcgccacccatgcccaccccgacaccatcacttgggaagagttcagaggaagctttcgtcagtaccatgtgcctgcaggtctgatgacagtgaagaaggaggagttcctggccctcaagcaggggccattgtctgtcagtgagtaccgggacaggtttctgcagttgtctcgctatgctcctgaagatgtcaacactgatgccaagcgatagtaccgtttcctgagaggcttggttgaccctctgcagtaccaactgatgaatcataccttcccgacattccagcacctgattgacagagcaatcatgacagagaggaagcgtaaggagatggaagatcgtaagcgcaagattagtggaccccagcctggaagcagcaaccgtcctcgttactcaagcaatcaacctcagcagttcaggcagaaccagcgtccacctcagcagcatcaacagttcccaaggcagtatcntcagcaccagtatcagaatcgccagaacaatcagtcaggaggaggtcagtttcagaggcagaatcagcaggcacttcgtcttcctgccccagcaacccagcagaacagtcaggcagcaccaactcaggttggaaacagagcatgtttctactgtggggagcaaggccactgggtgatgcnatgtccgaagaaggcagcccagcaacagtcaggtcccaatgccctagcaaagcagaatgtgtctcagcccggagcaggcaaccgctctcagccgcgttataatcatgggagactgaatcacttggaggctgaagcagttcaggagacccccggcatgatagtaggtatgttcccagtcgactcccatattgcagaagtgttatttgatactggagcaacgcattctttcattactgcatcatgggtaaaagcacatagtcttccaataactaccatgtcaacccccattcaaattgactcagccggtggtagaattcgagccgatagcatttgtttgaatgtaagtgtggaaataagggggatagcgtttcccgctaaccttatagtaatgggtactcagggaatagatgtcatcctagggatgaattggctagataagtatcaggcagttatcagttgtgataagaggacaatcaagttggtgtccccactaggagaggaagtggtgactgaattagtctcgcctgagccgaagaaaggaagttg

SEQ ID NO: 19841 - DNA, 3860 bp, Zea mays
cggcagaggccggatccttttgcgttttctaccaaaaaaaaaggctgaactcatacacgatcacgggacagcctggacagagacgtctcctgacgtcctctctcgtccctccaattttaagggacaacactggaataatactgtcctaacctttgatcctgaaccaaacaaccttatttgagagatcgtctcatctcgtcccgtcctgtcaatccaactaaacgtaccctaagtacacacttgggacatgtatttacaaaacacacacatacacacacggaggaaagaaaggaatgaagatggagcaatctaattacagagaaattaaaccctcaagtccacatattgatctgagaatgaagatgtcccagggcctcacagttctaaattctttttttttctttcaattttcatcaagcacatcatactctgcacttctccctccgcgacatacaacgccggagaagaacagaaaaacacaatcgcaaggagggggaaaaagaacttgactttgaacgcggcatagcagttttccaagaacctaggggctccatgcattggagaacaggtctacgcgtacacagaatgcaatgcaatataatggtccgactcattattcaccggtcaaggggctccgtctggtccatgatgacctggccctcggacacctccgcgagtgaccggaggttgcacttgagcagcgcctccacgaagtagcaggtctcgtccttggtgttgccgtcggggacgtcgacgacgaaggactcgatgacgagcgtccctggccggccgtcgatgaccctccgggtggacggtgaggatggaggagtagttctgcgggcaaaggaaaaggaaggtgagatgcagcagatcgatgaattagactagtcgtcagctttcacacacgctggcgttcttgcaaccaacccaagggggtcagggccggataaacttatatccaggtggcgtccatcgtccattatcccccggcaccgcatgtgagttgtgacacatgggccacttgttgctatcgctggctgatgacgagtgagggcaaacggacggagcacgacaagcgacagcgagtgacaggtgctcatgcgatgaacttggcatgtaaggtcaaaggatggcaagtcagtgccatgcttggagttgagagcatgcaaacatcacccggtacataacaacaacaacaaccgctgcttgttttctggttagatagacgacaagagtttgttggggggctatcactcgaggatggcatcgtcgcagggcagcacatcaagatgcatctggcagaggaactccaggacgcatttgaggtggtgggcaaaatatctcgcatgggcagcacagaatatagatagatgaagaacagagcatacctgcagcctgtgatcgcctccaacgaacctgacgctgagaatgcgctcgtcgtcgtctaacagctcgagcctctccgtgcttcttgtggccggcagcccggacttgacgttgacctccctgacgctaccgatctcgatgttccccttcatctcacaccggctcacgaagggcttgaagagctgtggctggtcgaaccgcctcaccagggaccagacctgagagacaagacaattactcgatcatcaggcacttcaatgtatggttaagctttaagcaggtgaccaagattgattaatccacactttcaatgtaacagacgaaggaataaacaggtccccggttgcttgctattcaagtagtattaagtgttctgcataaacaccctaaccgaccggctaactgcacagctcgaccaggctcagctgaaccatcgccaggaattgtaacaggaaaaatggcatgaacggtgtactgtctacaagtcaactaaacacgcttgaggaatatgacatctcttctaatcagaggcacagtacacagttataaaatgaggcctagagcccttgaggttgctaagcatattcacaagcatccttttggaatatgctgaaaacttgggctggaaagtcagccagaaacgatggttccctctgaaacagtaatcaattcagtgcatcgcatcgcataattatgcaaaagctaatgtgttttttttgggtaagattactagttttgcatctgatcttgtgctgaagctgaaccacgtccaaaaggagtggagtccaagtgaagtgaagcgtatctccctccctcccaccaccaccaccgccgtctgaccgtctcgattactagattacttgcagaataaagcggcaacacttcaaagcctaataacgcgggggatacaggccagcaaaacaatgcatgagcagctagatagaaatctcaaagtaattaatctggcggaaagcagattcagcgagcgggcatctcgcgaggtgcgggtgggggggaagcatcttcccacccacggtgagacgaggttacagtactacagaacggcgaattaaaaatcgtcgaggcttttctgtgtgtatcatttgcctttgcaaccaatcatgcatctctcatgttcatctcgcgagagctcagaaaaaaattcacaggcggtttcttggcaggaaatgcaaatcttagatttcggctaaagcgacgtgggtcctcccagcaatggatccgcccgaccaatcgcgtgaaaagagagaaaggatgacgacgggagagacgagcaagcagaagcagagcagggccggttcaagttcaagacggcatccaaatcgggcatccttgtttcctaatcaaggagccgcgcatcggcactccaaaaccgggggcgccgggcggcgggacccggccagacaaaaggagaaatcgagaaaccgatcgaaacgatgtctcggcggcggatcgactgcgcgagcgcgacacaacaccctacatactctcgccatggaaacgtggaaacggcacggcggcgcggagaaaaagcatagcagagcaggcagtaggcgagggattgatatatctgattcagcggcgtggaatggaaggaagagattgagagagagaggcaggcgctcacaaggtggacaggcgccttgatgtgcttggcgacggcggaggagcactggtggtcgcggggctcgtgccggtggaaccgccgcacgtagtccgtctccatggcgcgcaggtcgcaccgctcgtccgccaagcgccaccgccgcggcggcggcggcgccggcgtctgcgctcctcctcctcctgctgctgctactcccacgcctccgtccatctccaccaccatcaccgccgccgccgcaaagccagacacagccaccacgctcgcagcctcgcacaggcacagcccggtaatggaggcggcaggggcttgtgttccgcaccgaggaaaagcagacgacgaggtgcggagcgaggaggtggggttttgcctttgcctttgccttgctttgcttgttttgtttatgccgcggcgagaccgcgagggcgatggcgatggcgagggcgagagggagagagtgacgacgacgacccctggatggcacaaaggccgcagcctcaggtgtggttgttatgctattgggtgccgcttacaagcaagggcctactagaattaggaatgccagatatgccctccgagttcgccacttttgcttcggtttgctcgtgaaaacatggatggccggatggccccatggcggacggcattatctcgttgccttttttttggtttggagataggtgtagacatgttttttttctaaaacaaggccccatgcacgtcgcataatggtgttgttaagctatcggagagcaatgtacgagcaactccaataataattatctaaattttagctttataaatcacatatttaagaagttgttaaataact

SEQ ID NO: 19842 - DNA, 1213 bp, Zea mays
  misc_feature (866)..(866): n is a, c, g, or t
  misc_feature (880)..(880): n is a, c, g, or t
ttttttttttttttttgaaccctcaagtccacatattgatctgagaatgaagatgtcccagggcctcacagttctaaattctttttttttctttcaattttcatcaagcacatcatactctgcacttctccctctgcgacatacaacgccggagaagaacagcaaaacacaatcgcaaggaggggggaaaaagaacttgactttgaacgcggcatagcagtttcccaagaacctaggggctccatgcattggagaacaggtctacgcgtacacagaatgcaatgcaatataatggtccgactcattattcaccggtcaaggggctccgtctggtccatgatgacctggccctcggacacctccgcgagtgaccggaggttgcacttgagcagcgcctccacgaagtagcaggtctcgtccttggtgttgccgtcggggacgtcgacgacgaaggactcgatgacgagcgtccctggccggccgtcgatgacctccgggtggacggtgaggatggaggagtagttctgcagcctgtgatcgcctccaacgaacctgacgctgagaatgcgctcgtcgtcgtctaacagctcgagcctctccgtgcttcttgtggccggcagcccggacttgacgttgacctccctgacgctaccgatctcgatgttccccttcatctcacaccggctcacgaagggcttgaagagctgtggctggtcgaaccgcctcaccagggaccagacaaggtggacaggcgccttgatgtgcttggcgacggcggaggagcactggtggtcgcggggctcgtgccggtggaaccgccgcacgtagtccgtctccatggcgcgcaggtcgcacccgcccgtccngccaagcgcccacncgccgcgggcgggccggcgccggcgtctgcgctcctcctcctcctcctgctgctactcccacgcctccgtccatctccaccaccatcaccgccgccgccgcaaagccagacacagccaccacgctcgcagcctcgcacaggcacagcccggtaatggaggcggcaggggcttgtgttccgcaccgaggaaaagcagacgacgaggtgcggagcgaggaggtggggttttgcctttgcctttgccttgctttgcttgttttgtttatgccgcggcgagaccgcgagggcgatggcgagggcgagagggagagagtgacgacgacgacccctgat

SEQ ID NO: 19843 - DNA, 3174 bp, Zea mays
acgtggcgtggcacaccagctgatcctgaccggcgcggggtcccaggatcccggtaaacgcttgctggctctctaatccccgtccctcatccctcaccctttgcaaaaatcacagcggcaggggacagcaaaaatctccatgcccacgctcggcctagatctccggcgagccggccccgcgcggtagccgattcactctccgaccccgacccgatgggcggcgaggtgccggagccgcgccggctgagccgctcgctcagcttcggctgcggcggcgtccccgaggaggcgctgcacctcgtgctcggctacgtggacgacccgcgcgaccgggaggcggcctcgctcgtgtgccgccgctggcaccgcatcgacgcgctctcgcgcaagcacgtcaccgtcggcttctgctacgccgtggagcccgcgcggctgctcgccaggttccggcggctcgagtcgctcgcgctcaaggggaggccccgcgccgccatgtacgggctcatccccgaagacttcggcgcctacgcggcgccctgggtcgccgagctcgccgcgccgctcgactgcctcaaggcgctccacctgcgccgcatgaccgtcaccgacgaggacatcgccgtgctcgtccgcgcgcgcggccacatgctacaggtgctcaagctcgacaagtgctccggcttctcaacggacgccctccgcctcgtcgcccgctcctgcagatctctgagaactttgttcctggaagaatgtataattgccgatgaagggagcgaatggctccatgaactcgccgtcaacaattctgttctggtgacactgaacttctacatgacagaactcaaagtggagcctgccgatctggagcttcttgcaaggaactgtaaatcattgatttctctgaagatgagtgactgcgatctttcggatttgattggttttctccaaacctccaaggcactgcaagaattcgctggaggcgcttttttcgaagtcggagagtacaccaagtacgaaaaggtcaagctcccacctaggctatgcttcttggggggtcttaccttcatgggtaaaaacgagatgcccgttatctttccgtattctgcgtcgcttaagaaactggacctgcagtacactttcctcaccactgaagatcactgtcagcttatcgctaaatgccccaacctactggttctcgaggtgaggaatgtgattggggatagaggactggaagttgttgccgatacatgcaagaagctacgaaggctgagaatcgagaggggggacgatgaccccggccaagaagagcagggaggagtctctcagataggcctgacagccgtagctgtcggctgccgggaactggagtacatagcggcatacgtatccgacatcacaaacggggcgctggagtccatcggcaccttctgcaagaacatgtacgacttccggctcgtcctactcgacaagcagaacaaaataacggatctgccgctggacaacggtgtccgagctctactgaggagctgtaccaagcttcggcggttcgccttgtacctgagaccgggagggctctcggatgcaggcctcggctacgtcggacagtacagcgggaacatccagtacatgctgctcggcaacgtcggcgaatcggacaacgggctgatccggttcgcgatggggtgcgccaacctgcggaagctggagctgaggggctgctgcttcagcgagcgggccctggcggtggccgtgctccagatgccctcgctgaggtacgtatgggtgcaggggtacagggcctctcagacgggccgggacctcatgctcatggccaggccgtactggaacatcgagttcgtgcctccccgtcccgagagcgcgtgtcgggtgatggcggatggacagccttgtgtcgacacccatgctcaggttctcgcgtactattccctcgctggaaggaggccggactgtccgcggtggctggttactttgcatcccgcgtgactgtagatacggcaaggtgtccgagtgtggttactgttactaccagctgcttgtgtaccgtaatgaactgtagtgccgacgtactgtagcggaggtgtagtgtagtgcaataataagttgcggtgttgcttgtactggtatctagtcctaggaggatgtatactaagttatgctgtgctttcttctccccggaattgtattctgttgcttccactgtaaatatcagaaatggctttttgctagtttgggttgaaataatggacctcacaggtgcattgcatgcacaacagatgagctgaaaactacgttttgtcatcctcgaaagcatcagtccagctggtccagccccgggaagacgacgacagtcacaatgaaacggatgggtgcgtccctcacttgccacttggagcccctacgtggtctcggtggacagcggaatggagccgtcgccgagtggccggggatctgtcatctctgtggccaccgcgcccacaaggcgacagccgacagcgctgttggataaggctgtgatagttattttttgtttctttttattttcacgcagcgcatgtaaattgatattgaacaaccagtaaggcagtaacaatatatatagaaaggtgcacatgtggatctaatatgtttaatatgagtaaagtaaagacaaaaatagttgaaactagtgaaataagaattatactctagagtagacataatgttggtcgaagtaatcatcctagtcgatgtagtgcagaaatataacagtgacgatcgattagtcgtatcgattataattttctatgtatttatgttgatagctcgttccaatcctaaccatcgggaatttttaatttgttttcatccatctaagcgcttctttattgtctttaagtttaagacaaaatggtgtaagtggtttactccctagttgtcaatgagtacggatacaaataaataactataaataattatccatttcaactcgaatatggtggaatttactatcttcgtctcgaaggatgcggagacctaaccagcccacaacacaaacgaggcctaacaagctattgtctggcccataatggctccgacgctgagtacttaggcaagaggggagaagacatgaagataaccgaactatcagacttgcaactactgcaaatatttgtc

SEQ ID NO: 19844 - DNA, 2564 bp, Zea mays
gggccaacccccgcgtgggcggacgcgtgggcgggtcgccgggcgcgtcggcgcgcgcggccacttgctacaggcgctcaagctcgacaagtgctccggcttctcaacagacgccctccgcctcgtcgcgcgctcctgcaggtctctgagaaccttgttcctggaagaatgtataattgaggatgaagggagtgaatggctccatgaactcgctgtcaacaattctgttctggtgacactgaacttttacatgacagaactcaaagtggagcctgctgatctggagcttcttgcaaagaactgtaaatcattgatttctttgaagatgggtgactgtgatctttcagatctgattgggtttttccaaacctccaaagcattgcaagaattcgccggtggtgccttttttgaagttggagagtacaccaagtacgaaaaggtcattttcccacctaggctatgcttcttagggggtcttaccttcatgggtaaaaacgagatgccagttatctttccgtattccacaatgcttaagaaactggacttgcagttcactttcctcaccactgaagaccactgtcagcttattgctaaatgccccaacctaagtgttctcgaggtgaggaatgtttttggacatctttaatattactcgtgtgtctaaaataagtgactatctaatttcaactgacaaggtagatgctctcgacaggtgaggaatgtgattggggatagaggactagaagttgttgctgctacatgcaagaagctacgaacgctcagaattgagcgtggcgacgatgatcctggccaagaagagcagggaggagtctctcagataggtttgacagccgtagccgttggctgccgcgaactagagtacatagctgcctatgtatctgatatcacaaatggggcgctggaatccattggcactttctgcaagaatctctatgatttccggcttgttctacttgacaaacagaagaagataacagacctgccacttgacaacggcgtccgtgccctactgaggaactgcgtcaaacttcggaggtttgccttctacctgagaccgggagggctttcagacgtaggcctcggttacattggactatacagtgggaacatccaatacatgctgctcggcaacgttggtgaatctgacaacggattgatccagtttgcaacgggatgcaccaacctgcggaagctcgagctgaggggctgctgcttcagcgagcgagctctggcagtggccgtgctccagatgccctcgctgaggtacatatgggtgcaggggtacagagcctctcgaacgggccaggacctcatgctcatggccaggccgtactggaacattgaattcgcgcctcccattcccgagagcgcttatcgggtgatggcagatggacagccttgtgttgacacccatgcccaggtccttgcgtattactcccttgctggaaggaggccggactgccctcagtggctggtgactttgcaccctgcgtcactgtaaatacgtcaagctgtcccgagtgtggtttttgtaccagctgcttgtgtaccgtaataaactctagtactgtagtggtggaggcgtagtgcaataaagttgcagttgttgcttgtactagtgaatctaatcctaggaggttgttgccctgtgctttcttttccccggaattgtatctttgctccactgtaaatatcagaaatggcctgctgctagatgagttgaataatggaaaaaaaaaaaaaacggccggaaagctacattttgtcatcctcaaaaagctgataaggggcaatgcatttggatgtgtactagaatgtcgggactctgaagacgaccgtccaggtccagcaccaggaagacgacggtcaccatgaaacggatgggagcgtccctcacttgctcccccctacgtgaagtacgtggtctcggtgggcagcgatatggagccgtcgccgagtggcggggggacctgtcatctgtgcccactgcccacccagccaccgcggcaccgggcccagaaggcgatggcgtcgcgttacaactgcttggtgaccagtggtaatgtctagcgaacaaaaagcaagcgtagccccgccgctgaatcgacaactgggggcggttttcctcgtcgggaaaaggacgtttctgtcagcttgcccatggattctgaaggcaccatttcacgaataaccaggttgatctgaacatgccaaggacagatacggggtttaattggagcagcggcagtctgttgttacgtccactaacgtaacattccaaccgaaagacgctttgtataataatttgctcctaggattctataatatttaccctatcgatccaaatcttgaaagcagttaaacaaacatgtgtagacgagagtgaagcatctggttctatctgctccaagcagggaaagccacctattatggacataaagagtaaacggtgactcaaacttgctgatgcccccccccccctgaacaataaactgatgtgctgtagtcctagatcatcgaatctcaacaatagcaacaatttg

SEQ ID NO: 19845 - DNA, 2339 bp, Zea mays
ccggccgggttgcaatgataccaaataagggctttaaaaaaaaaaaaagtaccctccccgctggccggggggccgctactactcatccctcgctcttgcggaggcgaggcagaggcttgctcctccctccataattcccttccgcctctcctcccgtcctctcgcaagcccacaccacacctgcagaaatcacagcggcaggtgcagcaaaaatctccatgcccccgctcggctagatctccgacgagccggccccgcgctgtagcagattcgctccccgatcccgaccgatgggcggtgaggtgccggagccgcgccggctgagccgcgcgctcagcttcggctgcggcggcgtccccgaggaggcgctgcacctcgtgttcggctacatggacgacccgcgagaccgggaggcggcctcgctcgtgtgccgcctctggcaccgcatcgacgcgctctcgcgcaagcacgtcaccgtgggcttctgctacgccgtggagcccgcgcggctgctcgccaggttcccgcggctcgagtcgctcgcgctcaaggggaggccacgcgccgccatgtacgggctcatccccgaagactttggcgcctacgcggcgccctgggtcgccgagctcgccgcgccccttgactgcctcaaggcgctccacctgcgtcgcatgaccgtcaccgacgaggacatcgccgtgctcgtccacgcgcgcggccacatgctacaggcgctcaagctcgacaagtgctccggcttctcaacagacgccctccgcctcgtcgcgcgctcctgcaggtctctgagaaccttgttcctggaagaatgtataattgaggatgaagggagtgaatggctccatgaactcgctgtcaacaattctgttctggtgacactgaacttttacatgacagaactcaaagtggagcctgctgatctggagcttcttgcaaagaactgtaaatcattgatttctttgaagatgggtgactgtgatctttcagatctgattgggtttttccaaacctccaaagcattgcaagaattcgccggtggtgccttttttgaagttggagagtacaccaagtacgaaaaggtcattttcccacctaggctatgcttcttagggggtcttaccttcatgggtaaaaacgagatgccagttatctttccgtattccacaatgcttaagaaactggacttgcagttcactttcctcaccactgaagaccactgtcagcttattgctaaatgccccaacctaagtgttctcgaggtgaggaatgtgattggggatagaggactagaagttgttgctgctacatgcaagaagctacgaaggctcagaattgagcgtggcgacgatgatcctggccaagaagagcagggaggagtctctcagataggtttgacagccgtagccgttggctgccgcgaactagagtacatagctgcctatgtatctgatatcacaaatggggcgctggaatccattggcactttctgcaagaatctctatgatttccggcttgttctacttgacaaacagaagaagataacagacctgccacttgacaacggcgtccgtgccctactgaggaactgcgtcaaacttcggaggtttgccttctacctgagaccgggagggctttcagacgtaggcctcggttacattggactatacagtgggaacatccaatacatgctgctcggcaacgttggtgaatctgacaacggattgatccagtttgcaacgggatgcaccaacctgcggaagctcgagctgaggggctgctgcttcagcgagcgagctctggcagtggccgtgctccagatgccctcgctgaggtacatatgggtgcaggggtacagagcctctcgaacgggccaggacctcatgctcatggccaggccgtactggaacattgaattcgcgcctcccattcccgagagcgcttatcgggtgatggcagatggacagccttgtgttgacacccatgcccaggtccttgcgtattactcccttgctggaaggaggccggactgccctcagtggctggtgactttgcaccctgcgtcactgtaaatacgtcaagctgtcccgagtgtggtttttgtaccagctgcttgtgtaccgtaataaactctagtactgtagtggtggaggcgtagtgcaataaagttgcagttgttgcttgtactagtgaatctaatcctaggaggttgttgccctgtgctttcttttccccggaattgtatctttgctccactgtaaatatcagaaatggcctgtgctagatgagttgaatcaaaaaaaaaaaaaaaaaaaaaaaaaagg

SEQ ID NO: 19846 - DNA, 2290 bp, Zea mays
aatcggtttttttttttttttttttcttttttttccggtttttttttatagcaacggtgcatccgcattcattcagttaaaacctcagagcaaacatccgccaagcaaactccgatacctacaccaccctttttcgcctatatccttttactttgtgcacatgtcaatctacagcacacacatcaatgcaatgcaatgcaaatgcacggcccgaaccagtcacccccaacaaaccaggtttcatccaggggccgtgccttccagccggcagaaaaccgcgcctccaccactccgctcacttcacgttaggcttcggcgagtagcggaacggggacgcgcggggcccgtcagagaggctcctcacgggcggcggctgcccatgccgcccaaacgggctctgcgtcttgaagccgccgttcatgctgctcctcccgttcatgctgctcgagtgcgccatccgctcggcctgcatcgtctggaagaagtaggaggcgctcgccatgtccttgaggttctgcagcggcttcaggacctccaccacctggctcatcaggggccgcgccttggggtcccggctcaggcacacgcgcgctagctgcgccgccttctgcgcgcccttcaccgagaagttgccctccaggcgagggtcgattagcttgtagaaccgctgcctctcgcctaggagggggcgcgcccattccaccaggttgtgctccccgttcgggcggttcttgtccatcgacctgcgccctgacatcatctcaagaagcaccaccccgaagctgtagacatcactctttgatgtcagatgaccagtcatgacatattctggtgctgcatatccataggttcccattactcgagtagaaacatgagttttatcacctacaggtccgtctttcgcaagcccaaaatcagagagctttgcgttatactccgcatccagcagtatgttagatgttttaaaatcgcgataaatgactggtctttctgcttcttcatgaaggaaagccagaccctttgctgctccgagtgcaaccttcattctgattgcccatgggagaggaagagaccttctaaaaagatggttatccaaactgccacgaggcatgaattcatagaccagcaacctttggtcatcttcaacacaatatccaatcaatctgaccaaattgggatggtgaagatttccaagaaaatcaacttcagccacccattctttatgcccttgaagcccgtcatggttcagcgtcttgacagcaactgtgagacctgtaccaggtttcacaggtgcagttccattttcttcaatccaccctttaaaaacacatccaaaacccccttctccaaggagactttcaggcctgaagttccgggtagcacattttagatcattgaatgcaaacttgcgcagctgggaggcaacttttatctcttctccgactttagatgcagatgaactgctttcagcattactagtagttgtagaacctgagactaccaatgccaccggttgattcctactaccattttctgttgacttctctgccccgtgcgtgctggcgctgctggtggaggtgtcgaccttggacctctgcggcggcggagggcatgtcccgacgggccagaggcggatgcagcagccggtgtcgaccgcggtgtcgtcgtcggtgcccttgggggccgcgcggcgcctgctgctgccgcggcggctgcggcggcaccagccccaacgctcccgctcccgctcctcctccccggagctctcccacccgtcgaactggcccagctccggcggcgcgagccccatgagacgagggacttacctcctccgcctcctactaagcagaacccggcagtgggcccagcaccacctctccgggcggcgagagcaccagatcggctaacctccggcctcccgcgctgacgtgcaccaagcggcccgccgctagccgccggggaagagaagacaaaaagaaaactcactggttcccgcacgcggaagcaccgagatccagcctccccgcagaatcacggcaggccccgggcgccggccgcgcgatcctgacgcatcgggcgcgtgtcacgcacgaggagcgcccgcggagcccagcaccaggtgcgcgcgcgagcccaccagccggcgacgccgccgccgagcaggagcgaatccgagccgagcgcctcccgaggaaggacgccgccgtggacccttctccggaggcggcggtgtggaagggaagtgagtgggggaataagcgaagcgaagggggaaggaataatggattgt

SEQ ID NO: 19847 - DNA, 3366 bp, Zea mays
tagtgcacaacaaatgtgtataaattggggaatttagtggttcttctcacaaatcgataaattgagaattaaggttttcatctcaaaaacacatagtttcaaaataaaacaaattcatctcacatatagaaaatacctcagatcaaataaattgcaagttcatttcttacaaaataaagtcctcacgcgtcataaaacatcattcatttgatatgtagctttgtttttggggccatcttctttagcatccatgttgggaaatcattaagaaaactcataacttggctactatccaattattagatggtattatagttttcaccattattatagaaacacaagtatgttgaccaattaaaactttaaactatataaattacaaaaccaatggcatttatgtttgctagcagaatcctccaatcttatctaacttctctatccccaatgcaaacttctcattgatggcaaattgcggcactgccattcgaaaactgtccattcatggataaatagtgtcaatactcatttttttgtggtccagtcatatgaactatcgattcatctggtataaaattgctaataggaatgatagcaccatcattgtcaatattttggtcaacaaatcttaggttcgtttgatgctatcacatttctggtctcatttctcaagcctaaaagcacctacgtcatttaaaagttcattctttcgtttcgtatcatgcgtgtcaactatctataagctatcccaatcggcacatgggacatattctagaaactccaaattagtgtaaaataaatacagccagtaggcccagtacagtatgctgctaacaatgttctgtactgtacaaccagtacagtacttatagaccagaattcgtagagcagtaccaaaagcagcttttagatgcacaataaaatctatcatgtctaaaacgacttctttcctttcctttctttcgcaaaaaaaaaatgttaaaacaaatgcaggtaacaattttcttttcactgctattcttttgtggtgatatatctcaaagacctctttccttgttctacaaagaaataagcctattttctttttcttggatgaaataaatgtggtaacctcaccagtcctttctgtgattccgaggagtgcacgttagcctaggaactcacaagtcagtgctcttctgttctcgaatagcaatagcaatggaggacgacgatctggcacaggagacggcgattgccatttccgtcgatttcttggcgacgaagaccggagcagacacacacagctgagcaacccccacccacgttgccaagaacgtttgcttgcttgcttcgaaaggcagggatcgaagcatttctcttcggccgccctccgttctcgtgcttctccgaccatcaagattcatgaggcgcccgcacactgcaaggccaaggaaaatcacctaagcctaccatacttgtttggggcaaaaaattttatagcaacggtgcatccgcattcattcagttaaaacctcagagcaaacatccgccaagcaaactccgatacctacaccaccctttttcgcctatatccttttactttgtgcacatgtcaatctacagcacacacatcaatgcaatgcaatgcaaatgcacggcccgaaccagtcacccccaacaaaccaggtttcatccaggggccgtgccttccagccggcagaaaaccgcgcctccaccactccgctcacttcacgttaggcttcggcgagtagcggaacggagacgcgcggggcccgtcagagaggctcctcacgggaggcggctgcccatgccgcccaaacgggctctgcgtcttgaagccgccgttcatgctgctcctcccgttcatgctgctcgagtgcgccatccgctcggcctgcatcgtctggaagaagtaggaggcgctcgccatgtccttgaggttctgcagcggcttcaggacctccaccacctggctcatcaggggccgcgccttggggtcccggctcaggcacacgcgcgctagctgcgccgccttctgcgcgcccttcaccgagaagttgccctccaggcgagggtcgattagcttgtagaaccgctgcctctcgcctaggagggggcgcgcccattccaccaggttgtgctccccgttcgggcggttcttgtccatcgacctgcgccctgacatcatctcaagaagcaccaccccgaagctgtagacatcactctttgatgtcagatgacctgaaaagtggaacagaaagacaaaagtgcatgtcaagcaaagaccagatgtgtaaacagtagagtaaaagggtgtttgaatcttaagagagcaaggtagtcaaattattctttcaatattatggatttgaagccaatccaaacctaggtaagcactaagcacttcaccccaaacaaattctatgtaaacataaatgattttatcttgggatatgtgattgctggggtcaactcactgagaatacctacattctacatgaactacccatgcccatttccacagttaatttagctgataaaccttttcaatttgcccctgccagtgtgttttaagcttccactacataaaggtcttgtagcacaaagacacatgtaaagttgcaagtgtggtaactacgtgttccgcgtattcctgtgtatattaggattgtatggttctgaacaaacccctctgcccgccttagacagatatggtaaacatcattacctcggtacaaacataccactaatggaaacttatcatattatccaaacaagtatggcatgtaacgtaaagcattacaacgtctcccaacaagcatagcttccaaccttaaatgtcttcaatgaagcatcaaataatggagaactgattatatcccagcatacttaaacatcgatttggatacgcaacaagcagataaagctgaatctagtgaatggttcgttgttttttgattaggatgttctaggtaatggtctcgtgccaccagagttcgatggacacagtcatggcaaatatgacaagatacttaccagtcatgacatattctggtgctgcatatccataggttcccattactcgagtagaaacatgagttttatcacctacaggtccgtctttcgcaagcccaaaatcagagagctttgcgttatactcctgtacaagcaatataacatatgatgtagcagtatatagatcatgaagcacacactgcataatcctattcattaacttaccgcatccagcagtatattagatgttttaaaatcgcgataaatgactggtctttctgcttcttcatgaaggaaagccagaccctttgctgctccgagtgcaaccttcattctgattgcccatgggag

SEQ ID NO: 19848 - DNA, 1760 bp, Zea mays
ccgcccgggcggccggcccgccccccccccctcacactttgtcagtttgccgtcgctgtcggcgccgccgcctgtcctaatctcctctgagtccagcggccacctcctccaccgggagctccccgtaccataaccgcagtccgcagccattggaatttccgcttcatgcgtggatcctcgtagaccccgacccgcgtgcactcaatccctaggcggcggcctccggcgcgaggctagcgggcggcacccatggcgtccgtggcggagctcaaggagaagcacgccgcagctacggcgtcggtgaactccctgcgcgagcgcctccgccagcgccgggagacgctcctcgacaccgacgtggcgaggtactccaagtcgcaggggagggtgccggtgagcttcaaccctacggatctggtctgctgccgcacgctgcagggccatagcggaaaggtatattctctggattggacccctgaaaagaattggatagtcagtgcctctcaagatggaaggttaattgtgtggaatgcattgacaagccagaaaacacatgccataaagctgcattgcccatgggttatggcgtgtgcttttgcacccaatggccaatctgtcgcctgtggtggtcttgatagtgcgtgctctattttcaatctcaattctcaagcagacagagatgggaacatgccagtatcaagaattcttactggacacaagggctatgtctcatcatgtcaatatgtcccagatcaggaaacacgtcttattactagttcaggtgatcaaacatgtgttctttgggatgttactactggacagaggatatcaatatttggtggtgaattcccatcagggcatacagctgatgttcaaagtgtgtccatcaactcatcaaatacaaatatgtttgtctctggctcatgtgatacaactgtgaggctgtgggatatcagaattgcaagtcgagctgttcgaacctaccatggacatgaggatgatgttaacagtgtgaagtttttccctgatggccataggtttggtactggctcagatgatggcacatgtagattatttgatatgagaacagggcatcaacttcaggtgtacagtagggagcctgatagaaatagtaatgaactacctactgttacatctattgcattttcaatatcaggaaggctactttttgctggttactccaatggtgactgttatgtgtgggacacacttctcgccgaggtggtacttaatttgggaaacctgcaaaactcccatgatggccgtataagttgcctcgggatgtcatctgatgggagtgcattgtgtacaggaagctgggacaaaaatttgaagatttgggccttcagtggacaccggaagatagtttgaaggccaacttttctcccccatgttgtatgttccttgttgccccttaacaacggacagtggtgattggtgaccaactcgacttgttcctgggaatccctttgttgttttgtaagctctgttcgcgctatgtttaatggaaaaatgtgcaatttgtcagtgtcacggcgctacatcttgttgagttggtaactgtttatactgttattacgagaatatcagtaacgtgtgatctgcccttttctttgtacaaccgtttgatcttttcaggttttgtgaagtagcatgtatttccttaatcaatttatcatatcagtttgtccatttgctgaattaagaccatctggcttcatgggggcgtactatatgca

SEQ ID NO: 19849 - DNA, 1135 bp, Zea mays
cattgggtacctcgaggccggccgggtaaacatactccgtttccgaatcccggccaccattgcctattgccccaccctccccgctagggttttgccagcatggccgccgccgccgcccggaggctcctctcccgccgcgcctcctcgtcctccctctccgcgctcctccgtcgcggcgctgtcccggagcagtcgctggtgttgcgcccggctgttgtcgcggcggcctcccgcctcggcttccagcgcgggatggcgcggcggcctggcggggacggctacgtctcgacgcggtctggcgcgggcggggaccgcgcgcccatggccacggagatggcgccgctgttccccgggtgcgactacgagcattggctcatcgtgatggacaagcccggcggggagggcgccagcaagcagcagatgattgactgctacatccagaccctcgccaaggtccttggaagcgaggaggaggcgaagaagaagatctacaacgtctcgtgcgagcgctacttcgggtttgggtgcgagatcgatgaggagacatctaacaagctcgaggggctccctggtgttctctttgtgctcccggattcgtatgttgatgctgaatacaaggactacggagctgaactcttcgtcaacggtgagattgttcagaggactcccgagaggcagaggagggtggagcccgtgccacagagggcagcagacaggccgaggtacaatgacagaacccgctacgcacgcaggagggagaaccagcgatgaactgtgcgataaaatcataaaaaagaccacagcaacaagtcccaggtggtttcagctctggaattcaaggatcaccgagtatcacctgtattaaattggcaatctcactttacgtgcagtctagagtatcgtttctatgtgctcagcttggacgtattgtattctgtaattacagctacttggagatttggaaggacctggcttgcaacgtagtataatctctagtcttttttctttgtggcaatatataattgctatgaataccagattgagatggttgcatactgttcgcagctcaatgtattttttgccaccgtgggcgacaactgctgcttgcctagatacagtagtagattattccatt

SEQ ID NO: 19850 - DNA, 1059 bp, Zea mays
acccacaagcacttggcatcaaccctaaaccacccactatacccgcccgcccggctagggttttgccaccatggccgccgccgcggccgccgcccggaggctcctctcccgccgcgcctcctcgaactcgctctccgcgttcctccgccgcggcgctgccccggagcagtcgctgctgcgcccggccgtcgtcgcggcggcctcccgcctcggcttcccgcgcgggatggcgcggcgacctggcggggacggctacggcgcgggccgggaccgcgcgcccacggagatggcgccgctgttccccggctgcgactacgagcactggctcatcgtgatggacaagcccggcggggagggcgccaccaagcagcagatgatcgactgctacatccagaccctcgccaaggtcctcggaagtgaggaggaggcgaagaagaagatctacaacgtctcgtgcgagcgctatttcgggttcgggtgcgagatcgatgaggagacatctaacaagctcgaggggctccctggtgttctctttgtgctaccggattcgtatgttgaccctgagtacaaggactacggagctgaactgcttgttaacggtgagattgttcagaggcctcctgagaggcagagaagggtcgagcccgtgccacagagggctgcagacaggcctaggtacaatgacaggacccgctacgcacgcaggagggagaaccagcgatgagatgaaaaaagtccacaataacaagttcaggtggtttgagctctgtaattcaaggatagtgtgctttggatgtattgtactctgtaactacagttactcagattgctcaaaggacctggtttggaatgcatgcactgttactagcgcccgtttgcacatgtaaaatttctttatggaagctgcttaattgactatgaaggcctaacattaggtatttcattcattgccaacaagaaaaaaaaaaaaaaagctatctgcggggcggtggcccggctgcgtagtttacagatgactatatagatgaactaatggatatggttttatgcttagagcgc

SEQ ID NO: 19851 - DNA, 2105 bp, Zea mays
tggtctactgtaaatcttagatttagatccatttttaatggtattagcagagtagcccctcggtcaaaatctagatccaaatttaccgtttttattaacgaagtcctcccaaacatgccgtcattacggtgaaactgaagtagaaaagaccgggagtcacaatgggtgaagggtgttcattggcaacgacgaaatcgtgaacatactccactcactacagaacccaacctttttttttttttttccatttttttttttttgatgagccagttccagtgatcgaactaaccaacacgataaccacaagacttcactgatttttttttttttttttttcatcaaggaagctagaagcgcgcgctttattgccatgagcgcatcacaccagactagttatttacaaaactctgccacacggcggaacagagcgcccgatcgatcgggccggcggagacgacgaccacaacatcatcacgactaccacgctgctagtacttgcaactcctactgctactaccggctagtataatacacggaggcgcgcgcggggggaccaggacggccgccgctaatcaggcgctggccttgttgaccttcttgccggcaccggaagcggcggcgcgggctggcttgggcttgggctgcgcgggcgccggggccaccttcctcgctcgcttcgcgcgcaccttacgtgcctccctcgacggcgccgaggcagcggccgccggcttcatcttggccggcgcggcggccctcttgcgcttggccattcccgccgacgccttcttcttcgccttcgcggccgcggagggcttcctctcctcggcggcggcgagcttgaaggaggccttgaccttgacgaggcggcccttggcggcgaagccgcgcagctgcactgccagcaccttgcggtaattgggcgggagcacgtcccggtgcttctcccccatgtgcttggcgatcgcgtacgggctcgccccgaccttcccgccgtcctgcgacaggatcgcctccttgatcatctgacctcgatcaccccaggtccccagcagaccctcgtgccgaatttcagaatgagaatccaagcacggatgagtaaccgacaagacgacgacgacgacgacggcatctttgctcacctcgaaatagggcgggtggtgcagcccggcggacttgggcttcctgctccgcggcttcctcgccttcttctccttctcggcggcggggtcggccttcttctccttctcggcggcggggtcggccttcttcctctcgtcaccctcctcgtcgggcttcttcccctcctccggcttctccaccacctccttcgccgcttccggcgccggctcctcggagacggtgacgaccggagcaacttcctcagttacggttgccatgaccagaaatcagtgatcactctccgtcagtgtgcgtctgacgcaagcggttgctcctactcggtactcgctgtgacgagtgatcggtggtccgtggcgccgtatttgtagcctccgacggcgcgatccgattggccgcccgcggccgcccgcggatcagcatcctcggtcggtgcatccggagcgtacacgtggccgcgcgatgcggtcgcctgcccccaccccgcccgacgcaccgatggttctcgacttctcgcgcggcctcgcgtggacggacgcctcggctccaggagggtgtgttttcgcgtgtttttgggtgggtggtttggaagacgaattctgcatgactttcagtgatttggttggggaatttcgagttccgctggaattcaaagtcagatgggtgctggggatttggaaattggaaagatgactttgatttgtgggataaattttgaggtttgtgaaagggtgtgttttttgtgtttgtgctgggatgggggctcaaggtttgtacgggttgggtagaggtatcgctatgagtatgacaataagtggtgctcttcgatgccgagatcatacagtggagtctgaaaccgtgaatgagataaaaaaaaattactacttatagacaagttagactgccattccgtgattacatgttctgtgactttttccatcccttctctccgtacattcatgttcttc

SEQ ID NO: 19852 - DNA, 1130 bp, Zea mays
ttttttttttttttttatttttttttttttgatgagccagttccagtgatcgaactaaccaacacgataaccacaagactgcactgataatggatcatggatgtttcatcaaggaagctagaagcgcgcgctttattgccatgagcgcatcacaccagactagttatttacaaaactctgccacacggcggaacagagcgcccgatcgatcgggccggcggagacgacgaccacaacatcatcacgactaccacgctgctagtacttgcaactcctactgctactaccggctagtataatacacggaggcgcgcgcggggggaccaggacggccgccgctaatcaggcgctggccttgttgaccttcttgccggcaccggaagcggcggcgcgggctggcttgggcttgggctgcgcgggcgccggggccaccttcctcgctcgcttcgcgcgcaccttacgtgcctccctcgacggcgccgaggcagcggccgccggcttcttcttggccggcgcggcggccctcttgcgcttggccattcccgccgacgccttcttcttcgccttcgcggccgcggagggcttcctctcctcggcggcggcgagcttgaaggaagccttgaccttgacgaggcggcccttggcggcgaagccgcgcagctgcactgccagcaccttgcggtaattgggcgggagcacgtcccggtgcttctcccccatgtgcttggcgatcgcgtacgggctcgccccgaccttcccgccgtcctgcgacaggatcgcctccttgatcatctcgaaatagggcgggtggtgcagcccggcggacttgggcttcctgctccgcggcttcctcgccttcttctccttctcggcggcggggtcggccttcttcctctcgtcaccctcctcgtcgggcttcttcccctcctccggcttctccaccacctccttcgccgcttccggcgccggctcctcggagacggtgacgaccggagcaacttcctcagttacggttgccatgaccagaaatcagtgatcactctccgtcagtgtgcgtctgacgcaagcggttgctcctactcggtactcgctgtttttcgattaggatgttctaggtaatggtctcgtgc

SEQ ID NO: 19853 - DNA, 3390 bp, Zea mays
  misc_feature (1526)..(1526): n is a, c, g, or t
ctgcagggagctcaagtcgctcagcctcgccagcaccaggctgacgggccagctgccccaggattacagccgcctcgcctcgctgtcgatgctctcgctgtccaacaacagcctgcacaacatctcgggggcgctcggggtgctcggtgcctgcaagaacctcaccacgcttatcctcaccaagaattttgtcggggaggagctgccggacgacggcattggtgggttccgcggattggaggtgctggcccttggtgattgtgctctcaggggaagggttcccaagtggctcgctcagtgcaagaagctggaggtgcttgatctgtcctggaaccaattggttggcgtcatcccctcgtggattggcaagtttgagtacctgagctacttggatctctccaacaatactttggtcggtgaggttccaaagagtttgacgcagctcaagagccttgtcgctgtcacgcggtcaccgggtatggcgttcactagcatgccattgtatgtgaagcataacagaagcactagcggccgccagtacaaccagctctcaaacttcccgccgtcgctgatcctggacaacaacggcctgaatgggactatctggcctgagtttggaagcctgagggagctgcatgtcctggacttgagcaacaatttcatatctgggagcattcctgattcgctgtcgagaatggagaatctggaggttcttgacctttcatccaataacctcagcggcgtgattccgtcgtccctcacggagctcaccttcctgtccaagttcagcgtggctcacaatcacttggtggggcagatcccaagcggagggcagttcctgacgttctccaactcgagctttgagggtaatcctgctctatgcagatcaagttcctgcaaccacctgattttgtccagtgcaactcctaatgacacggacataaagcccgcgccaagtatgaggaacaagaaaaacaaaatactcggggtggccatctgcatcggcctggcccttgcggtgtttttagctgttattctggtgaacatgtcaaagagggaggtctccgctattgagcatgaagaagataccgagggctcctgtcatgaattgtatggctcttactcaaagccagtgctgttctttcagaattctgcagtgaaggagctaactgtcagtgacttagtcagatcgacaaataactttgatcaagccaacataatagggtgcggtggattcggtctggtgtacaaggcctacctccccgatggaacgaaggcggcagtgaagagactctccggtgactgcgggcagatggagagggagttccgtgccgaggtggaagcactgtcacaggctcaacacaaaaaccttgtgaccctcaagggctattgccgctacggagacgacaggctgctgatctactcttacatggagaacggcagcctggactactggctgcacgagaggtcagatggtggctatgtgctgacatgggagtcgaggctcaggatcgcccagggctcanccagggggctagcttacttgcacaaggtctgcgagcccaacatcatccatcgggacgtgaagtccagcaacattcttctgaacgaaaacttcgaggcgtgcctggctgatttcgggcttgcaaggctaatacagccatatgacactcatgtgaccacggatctggttggcaccttgggctacatcccaccagagtacagccaagctgtgatcgccactcccaaaggggacgtcttcagctttggcgtagtcttgctcgaactgctcacgggtaggcgccccgtggatgtgtccaggtccaaagggtccagggacttgatctcctgggttcttcagatgaagtctgagaggaaggaagagcagattttcgacagcctgatatggagcaaagcgcatgagaagcagctgctgtctgtcctggagacggcgtgcaagtgcatcagcgctgatcctcggcagcgcccgtcaattgagcaagttgtgagctgtcttgacaacagtgtgtgagcagcgccatgacaccatgctgattgccagtttcttccttttttttcttaatcagacaaatgctagcctaggaggtattgacatgagagaagaacagagtagagaaaaaggcaatctgagcaaattcagacaatgcaggtgcaggctaggcatggtgccgtgctaggattatattagcttaccagaaaataacttgggtcttgttttccttctcagtaactcagtgctgtgtagaaatatataaacaaaattccccatatcaatccctgttttatgagctgctgtgcctcagatggtttatcctgtgaatacaatgctgaatttcatcatctcagggtagtgatgttttcgccatgaatttttccagttgtgtgataatttcgtacactgatcgttttcctgatttgtcggtgttcccgattagctaggaatccagatactattgtcatgccactggatctggaactgatgttgaactttttggctaacaggcttgagtgtgcaggaggtctaaaactaaggtctatggtcttcacttcacatatttatcaacatcactagatagtctagagtgattgtaacttctatgagagatctacgcttctgtcagttacaaaaggagacaaaagtgtgggatggcaaagggaatgcacaccaatatcacacgcagggaatatagaaagctgacgattcgtttcatcaaaagacagaaagaaaaagcttggaattcgtttccgaaagaaaaaggttgggaacttgctcgaaaacataggagtaccaaaacttaggagcaatttggttgtcgttgttaatgaagctaaaacataggagcatcagtatagcaacagccaacagagagtggagagagaggacataattctatgagaacctcttgtttgtctgtccaaatccaaaagagaggtgtccccacgtagcctgatgacattatccaccaggaaaaggagaagagcccgtggccgtggcctggccccagctcccagccccagccaacaaaagagaagcccggcccgaactctccttccatcggccgtcgaccgatccgtctccactccaggttcacttcgcctctccctcgccctctctctctccttgcttctacccctctcccctccaggctccaggtgccctaccgccggaccggcgcccgcctcatgaaggccaaggcatccgccgccgccgccgaggtaaccatcgcggcccgcatattcatctttctcctttttattttacactccggtcggttcatgaaaacatagctagggtacctacctccggttcttgagaacaaaattgccgctttgtgtactcgtactccagattcacaattattctccaca

SEQ ID NO: 19854 - DNA, 1324 bp, Zea mays
cggccgcgtcgcatcgctttctgctctgttaatatcaacttcaacagtaagctacgtgcatgttgaccgcatatcagccagcacatcttcactgcatcatgtaactagaaaggtgcaagtcaccatgaatagtaagtactaaatactgataagatggtgataactgataataggataatgctaaaacgaaggttaaaagtggaatggaactggtgtacataaagtttttgataagcagttcaggtgccaaacagaagtagtattccaaggttgaagcagcaactgaaagacggcactacacaactttagctgagaagaggccaccatcgagcaaatgcgtacacataggatcagagcaagtccattcatcctgagctactcaagatgctttgcaagtgaattgcgcttatgtcgatgggctccgagagcgtggagatcggtcattgttgcgcctgacgggagatctctcaggagaaggtgacatcttgcgaggtggggagcgactagggctcttacttgctggtgatgcactgtctctgccacgcctcttgtaatcatcaggactgcggctacgacgagggcttcttcgctcaggtgacaaactgtctctcccacgcttcttgtaatcatcaggactgtagctgcgactcgggctacgatggcggtaatccctatccctgtacctgtcacgggtgtatctatctctactccggctacgacttcgccttctataatctctatcatggtcatctcgataatcatcacggtacctccgtcttggactgtgactcctggaacgcccccctggtcttggaactggctccactattctccctttattaatccgttcagcatttgggccgtacttggcaaactgcaccatgatctccctcccgtctaccaatctcccatcgagcctttcaactgccttctgtgcctcgtcctcgtacttgtacctcacgaacgcgaatccgcgcgagtcaccagtccggcggtcccttgggatgtagatgtcgacaatctcgccgtacttgtcgaagagagggaagaggtcatcagcagttgtgcggaaggtgatgttgaggacgaggagtgagtacgtgtcgcggatcggcggcggcgggccggatcgaccgaagcgtgacatctcgccggagccggaggcggcgcgggacgggggtgctcgaggagcggctggtggatgaagggtggaaggctagagagggaagaggggatggggaagaccggaagagcccgtttgcggccgtcctcctattttttttgaatagaaagtcaatgtatctaacccccggccggcctcgag

SEQ ID NO: 19855 - DNA, 1636 bp, Zea mays
  misc_feature (57)..(57): n is a, c, g, or t
  misc_feature (92)..(92): n is a, c, g, or t
  misc_feature (101)..(101): n is a, c, g, or t
  misc_feature (147)..(147): n is a, c, g, or t
ttaaaccaccactctggaccagttcccaaaagtaacactaagcccacgctttacctnacaagacacgtctggcaaatggcagaaatgcattnacagcacanccagtgcatgcaacaattaataatgcacatgcaggcttatgatccnacaaccccaaaaacagatctatgataaatcagtgcagacacttctaaatcaaaatattaaaagggtgttaatacctaagcatgtagattcaagattcgtggtgccatgcattttatgacacgaaaaatgggaacactgaattcagctaaatcattggaatcttacttgtcagcataataggtgcagacagcaaatggtgcagtcagctgcagttccatcatctcatcaatcatctcatcagccatcatcatcaacgacgcaaacagcacagattatatcaacttcaacagtaagctacgtgcatgttgaccgcatatcagctagcatatcttcactccatgtaactagaaaggtgcaagtcaccatgaatagtaagtactaaatactgaaaagacagttataatatggtaatactaatatgaaggttaaaagtggaatgtaactggtatacataaagtttttgataagcagttcaggtgccaaacagaagtagtattccaagtttgaggcagcaactgacagacagcactacaaaactttaactgaaaagtgcccaccattgagcacaagcatagccacacacacataggatcagagcaagtccattcatcctgagctgttcaagatgctttgcaagtgaattgtgcttatgttgaagggctccgtgagcgtggagaccggtcatcattgtgcctgacaggagatctcttaggagaaggtggcgtcttgcgaggaggggagcgactagggctcctacttgcaggtgatgcgctgtctttgccacgcctcttgtaatcatcaggagtgtaactgcggctgcggctatgactagggcttcttcgtgcaggagacaaactgcgactcaggctacgatggcggtaatccctatctctgtacctgtcacgggcgtatccatctctactctggctacggcttcgctttctataatctctatcctggtagtcatctcgataatcatcacggtacctccgtcttggactgcggcttctggaacgacccctgggccttggaactggctccattattctccctttattaatccgttcagcatttggaccgtacttggcaaactgcaccatgatctccctcccgtctaccaatctcccatcgagcctatcaactgccttctgtgcctcgtcctcgtacttgtacctcacgaacgcgaatccgcgcgagtcgccagtcctgcggtcccttgggatgtagatgtcgacaatctcgccgtacttgtcgaagagcgggaagaggtcatcagcagtcgtgcggaaggtgatgttgaggacgaggagtgaatatgtgtcgcggatcggcggcggcggaccggatcgaccgaagcgtgacatatcgccggagcttggggcttgaggagcggcgggtggatgaagggtggggaggcgagaagcaagaagggatgtgaggtgggaggggagggccggaggggagtccggccggccccccccggtcccgt

SEQ ID NO: 19856 - DNA, 1558 bp, Zea mays
  misc_feature (2)..(7): n is a, c, g, or t
  misc_feature (13)..(13): n is a, c, g, or t
  misc_feature (237)..(238): n is a, c, g, or t
  misc_feature (245)..(301): n is a, c, g, or t
annnnnncacagnaagcatatcaaagttcgggttacaaaatccagagcctgatgggtcagcagactccacaaatgacatgactacatgagactaagtctttgaagcaaatcatcagcattcagatccagaagatcaatcaactagtcaggcatttctgtcgctgaaacttctccccacgccttctattgttgtcagcataataggtgcagacagcagcaaatggtgcagacagctgnncagttcnnnnnnnnnnnnnnnnnnnnnnnnnnnnnnnnnnnnnnnnnnnnnnnnnnnnnnnnncagtaagctacgtgcatgttgaccgcatatcagccagcacatcttcactgcatcatgtaactagaaaggtgcaagtcaccatgaatagtaagtactaaatactgataagatggtgttttctgttttttggtggttgcactaatcggaaggttaaaagtggaatgtaactggtatacataaagtttttgataagcagttcaggtgccaaacagaagtagtattccaagtttgaggcagcaactgacagacagcactacaaaactttaactgaaaagtgcccaccattgagcacaagcatagccacacacacaggatcagagcaagtccattcatcctgagctgttcaagatgctttgcaagtgaattgtgcttatgttgaagggctccgtgagcgtggagaccggtcatcattgcgcctgacaggagatctcttaggagaaggtgatgtcttgcgaggaggggagcgactagggctcctacttgcaggtgatgtgatgctgtctttgccacgcctcttgtaatcatcaggagtgtaactgcggctgcggctatgactagggcttattcgtgcaggagacaaactgtctctcccacgcttcttgtaatcatcaggactgtagctgcgactcaggctaagatggcggtaatccctatctctgtaactgtcacgggtgtatctatctctactctggctatggcttcgccttctataatctctatcctggtagtcatctcgataatcatcacggtacctccgtcttggactgcggcttctggaacggcccctgggccttggaactggctccactattctccctttattaatccgttcagcatttggaccgtacttggcaaactgcaccatgatctccctcccgtctaccaatctcccatcgagcctatcaactgccttctgtgcctcgtcctcgtacttgtacctcacgaacgcgaatccgcgcgagtcgccagtcctgcggtcccttgggatgtagatgtcgacaatctcgccgtacttgtcgaagagcgggaagaggtcatcagcagtcgtgcggaaggtgatgttgaggacgaggagtgaatatgtgtcgcggatcggcggcggcggaccggatcgaccgaagcgtgacatatcgccggagcttggggcttgaggagcggcgggtggaccgtggatgaagggtggggaggcgagaagcaagaagggatgtgaggtgggaggggagggccggaggggagtgggggcgcgtcgtgcgccgg

SEQ ID NO: 19857 - DNA, 978 bp, Zea mays
  misc_feature (28)..(29): n is a, c, g, or t
  misc_feature (36)..(39): n is a, c, g, or t
gttgggttttttaagttgggaccccccnngtttgtnnnnctttttttttttttttttttttttttttttttttttttttttttttttttttttttttttttttttttttttttaatatggtaatactaatatgaaggttaaaagtggaatgtaactggtatacataaagtttttgataagcagttcaggtgccaaacagaagtagtattccaagtttgaggcagcaactgacagacagcactacaaaactttaactgaaaagtgcccaccattgagcacaagcatagccacacacacataggatcagagcaagtccattcatcctgagctgttgaagatgctttgcaagtgaattgtgcttatgttgaagggctccgtgagcgtggagaccggtcatcattgtgcctgacaggagatctcttaggagaaggtggcgtcttgcgaggaggggagcgactagggctcctacttgcaggtgatgcgctgtctttgccacgcctcttgtaatcatcaggagtgtaactgcggctgcggctatgactagggcttcttcgtgcaggagacaaactgcgactcaggctacgatggcggtaatccctatctctgtacctgtcacgggcgtatccatctctactctggctacggcttcgctttctataatctctatcctggtagtcatctcgataatcatcacggtacctccgtcttggactgcggcttctggaacgacccctgggccttggaactggctccattattctccctttattaatccgttcagcatttggcccgaactctccttccatcggccgtcgaccgatccgtctccactccaggttcacttcgcctctccctcgccctctctctctccttgcttctacccctctcccctccaggctccaggtgccctaccgccggaccggcgcccgcctcatgaaggccaaggcatccgccgccgccgccgaggtaaccatcgcg

SEQ ID NO: 19858 - DNA, 607 bp, Zea mays
acagtcaatgtttatcagtcctgtaaagaaaagagcagaacaccactaaaccgtctaaacacttatgtaaggttacccattttttcacagaagcatatcaaagttcgtgttacaaaatccagagcctgatgggtcagcagactccacaaatgacatgactacatgagactaagtctttgaagcaaatcatcagcattcagatccagaagatcaatcaactagtcaggcatttctgtcgctgaaacttctccccacgccttctattgctgaagaagggtaaagagcaccaacaaatccaaatactcacatgccatcatacctttcctactctcgatacattaatgcagagaactttcttatttcatgcaaatcattaacttgcaagcataagctggtgagattaatgaacacttggggtaaaagatagccttttatgactcgtgagcatgtcaatgaacttggattgcactacaacggcattctgacacgagtgtgtatacagcttaaacaacactctggaacagtttccaaaagtaagactgagcttatgcttttctttacaagacatgtctggcctggtgccgaattcaaacagcccgggggatcc

SEQ ID NO: 19859 - DNA, 1039 bp, Zea mays
taggggccttttttttttttttttttcttttttttttttttttttttttttttttttttttttttttttttttttttttttttttttttttttttttaagccagcacatcttcactgcatcatgtaacttgaaaggggcaagtcaccatgaatagtaagtactaaatactgataagatggggataactgataataggataatgctaaaacgaaggttaaaagtggaatggaactggggtacataaagtttttgataagcagttcaggtgccaaacagaagtagtattccaaggttgaagcagcaactgaaagacggcactacacaactttagctgaaaagaggccaccatcgagcaaatgcgtacacataggatcagagcaagtccattcatcctgagctactcaagatgctttgcaagtgaattgcgcttatgtcgatgggctccgaaagcgtggaaatcggtcattgttgcgcctgacgggagatctctcaggagaaggtgacatcttgcgagggggggagcgactagggctcttacttgctggtgatgcactgtctctgccacgcctcttgtaatcatcaggactgcggctacgacgagggctttttcgctcaggtgacaaactgtctctcccacgcttcttgtaatcatcaggactgtagctgcgactcgggctacgatggcggtaatccctatccctgtacctgtcacgggtgtatctatctctactccggctacgacttcgccttctataatctctatcatggtcatctcgataatcatcacggtacctccgtcttggactgtgactcctggaacgcccccctggtcttggaactggctccactattctccctttattaatccgttcagcatttgggccgtacttggcaaactgcaccatgatctccctcccgtctaccaatctcccatcgagcctttcaactgccttctgtgcctcgtcctcgccggagccggaggcggcgcgggacgggggtgctcgaggagcggctggtggataaagggtggaaggctag

SEQ ID NO: 19860 - DNA, 1734 bp, Zea mays
ccggccgggaaaaaaaaaaatcttctcttcttcgccgggtccctcgcggccggccgggatctccgctcccactgttccaccaaaccaagccgagaaatttctcctaaatttcagatcaaatcctcctcctcctccccctctccctctccgaggattctgcccagcagcgcggcgatccgcctcgatccggaatggagcgcgtcttctccatggaggagatccccaacccctactgggccccgccgcaccctcaaccggcggccggcggcgctgttgctgcaccaggtggagtaggaggagcgggggacgcggcgggcgcgatgaaccggtgcccatctgagtggtacttccagaagttcctcgaggaggccgtgctcgacagtccgggtcccgtcgccggcgtgggtagaagcagcggacaagctggagttgaggcggcggagagcaagccgctgggcgccgcggcgccggcgtccgtctcgagctcggtcgttgaccccgtcgagtacaacgcgatgctcaagcagaagctggagaaggacctcgctgccatcgctatgtggagggcttctggtgcagcacctccagatctttctgcgactgctgcttccttgccaagtgtcggtgctccgcatgcagctcctcttaaacccgtcggaggtactgaaagtctagttcaaaacatgctagctggtgctccagtaggggggtcaggtccacatgtagtacaaattgctgatatccctgttaagcaaaccactagctcttcctcacgagagcagtcagatgatgatgacatggaaggcgatgctgagacaaatggaaatggaaaccctgttccacaaagacaacagagaagggaagcaatccaaccgggaatcagccaggcgttcgagaagcagaaaggcagctcacttgaatgaactggaggcacaggtagcacagttaagagtcgaaaactcttcgctgctaaggcggcttgctgatgttaaccagaagttcaatgaagctgctgttgacaatagggtgctaaaggcagacgtcgaaaccttaagagcaaaggtgaagatggcagaggactcagtgaagcgggtaactggcatgaacgcattgtaccctgccgtgtctgatatgtcgtccctcagcatgccattcaatggctccccatctgactccgcctctgatgccgccgtacccatccaagatgacctgaacagttacttcgccaatccaagcgagatcggaggcagcaacggttacatgccagatatagcttcctcggttcaacaggacgacaattttgtcaacgggtatcaggctgctggcaagatgggcagaacagactcgctgcagcgggtggcaagcctggagcacctccagaaaagaatgtgcggaggcccggcttcatccggctcgacctcctaggtttcatatgaaaaagtccctggtgcctaacggcaagaatgctaaattaacaatttcaacatgctttgtactggacattgataatcctgcgatgcgcattagtgcgttatggacttgtgggtcaattgctatttggcgtgtgctggctgctcactgtagtgagcagaacaagttccagtttctatcgaagagcaccctctccttttcgctagtgacttatgaatggtcgatggtttattagcaacattgtgtctttcgcaagttcagtaatgaatggtcgacagggatgtatatcaataacttataaag

SEQ ID NO: 19861 - DNA, 1761 bp, Zea mays
gtgttttatctacagccaccgtccacaactccacgcccccatcttctcttcttcgcctcttccctttcaattttttttaatctccgcttccactgttccaccaaaccaagccgagaaatttctcctaaatttcagatcaaatcctcctcctcctcctcctccccctccccctctccgaggattctgcccagcagcgcggcgatccgcctcgatccggaatggagcgcgtcttctccatggaggagatccccaacccctactgggccccgccgcaccctcaaccggcggccggcggcgctgttgctgcaccaggtggagtaggaggagcgggggacgcggcgggcgcgatgaaccggtgcccatctgagtggtacttccagaagttccttgaggaggccgtgctcgacagtccgggtcccgtcgccggcgtgggtagaagcagcggacaagctggagttgaggcggcggagagcaagccgctgggcgccgcggcgccggcgtccgtctcgagctcggtcgttgaccccgtcgagtacaacgcgatgctcaagcagaagctggagaaggacctcgctgccatcgctatgtggagggcttctggtgcagcacctccagatctttctgcgactgctgcttccttgccaagtgtcggtgttccgcatgcagctcctcttaaacccgtcggaggtactgaaagtctagttcaaaacatgctagctggtgctccagtaggggggtcaggtccacatgtagtacaaattgctgatatccctgttaagcaaaccactagctcttcctcacgagagcagtcagatgatgatgacatggaaggcgatgctgagacaaatggaaatggaaaccctgttcaacaaagacaacagagaaggaagcaatccaaccgggaatcagccaggcgttcgagaagcagaaaggcggctcacttgaatgaactggaggcacaggtagcacagttaagagtcgaaaactcttcgctgctaaggcggcttgctgatgttaaccagaagttcaatgaagctgctgttgacaatagggtgctaaaggcagacgtcgaaaccttaagagcaaaggtgaagatggcagaggactcggtgaagcgggtaacaggcatgaacgcattgtaccctgccgtgtcggatatgtcttccctcagcatgccattcaatggctccccttctgactccgcctctgatagcaccgtcccggtacaagatgacctgaacagttacttcgccaacccaagcgaaatcggaggcaacaacggttacatgccagatatagcctcctcggttcaacaggacgacaattttgtcaacgggtatcaggctgctggcaagatgggcagaacagactcgctgcagcgggtggcaagcctggagcacctccagaaaagaatgtgcggaggcccggcttcatccggctcgacctcctaggtttcatatgaaaaagtccctggtgcctaacggcaagaatgctaaattaacaatttcaacatgctttgtactggacattgataatcctgcgatgcgcattagtgcgttatggacttgtgggtcaattgctatttggcgtgtgctggctgctcactgtagtgagcagaacaagttccagtttctatcgaagagcaacctctccttttcgctagtgacttatgaatggtcgatggtttattagcaacattgtgtctttcgcaagttcagtaatgaatggtcgaccagggatgaaaataaataacttataaag

SEQ ID NO: 19862 - DNA, 2170 bp, Zea mays
gcacacctcatcttctcttcttcctctcttcccttccattttttctcttctcttccaccaaaccaagtgcggccagagaaatttctcccaaatttcagatcaaatcctcgaaatctccgacacctagccccccggagacttctcctcaacagtgtcgcgatccgtctcgatccggcatggagcgcgtcttctccgtggaggagatccccaacccctactgggttccgccgcaccctcaatcggcggccgccggcgctgttgctgcaccagcgggggaggcggcggggctgatgaaccggtgcccgtcggaatggtacttccagaagttcctggaggaggccgtgctcgacagcccggttcccgtagccggcgccagtaggggcagcgttggagctggagttgaggctgcggagagcaagacaccgggggccgcggcgccggcggctgcctcgagctcggttgttgaccccgtggagtacaacgcgatgctcaagcagaagctggagaaggacctcgctgccgttgccttgtggagggcttctggtgcagcacctccagatcattctccagctggttcttccttgccaagtgtggatgttccacacgcaggccctcttaaacccatcggaggtactggaagtctagttcaaaacaagctagttggtgctccaggcgggggatcaagtccacatgtagtacaaaatgccgatatccctgttaagcaaaccactagctcttcctcacgtgagcagtcagacgatgatgacatggaaggagatgctgagactactggaaatggaaaccctgttcaacacagattacagagaaggaagcaatccaaccgagaatcagccaggcgttcgagaagcagaaaggcagctcacttgaatgaactggaggcacaggtagcacagttaagagttgagaactcttcgctgctaaggcgacttgctgacgttaatcagaagttcaatgaggctgctgttgacaatagggtgcttaaggcagatgttgaaaccttaagagcaaaggtgaagatggcagaggactcagtgaagcgggtaactggcatgaacacattgttccctgccgtgtctgatatgtcgtccctcagcatgccattcaatggctccccatccgactccgcctctgatgccgccgtacccatccaagatgacctgaacagttacttcgccattccaagcgagatcggaggcagcgacggttacatgccagatatagcttcctcggctcaagaggacgacgatttcgtcaacggggctcaggtcgccggcaagatgggcagcactgactcgctgcagcgggtggtgagcctggagcacctccagaagaggatgtgcggaggcccggcttcatcggggtcgacctcctaggttcctactccatcggatatgataaaggccctgatgcccacggcaagaatatgataaattaacagtttcacatactttgtagtggacattgctaatgctgcgatgcgcattcgttcgttgtggacttacgggtctactgctattgatttattgttcgttcttcaaaaaaaaaaaaaaagtccatttgacgtgtactccgccacctgctgtctgctacacattgctgtggacacagcaagttcggtttccatcgaagagcacgctctgcctctcgctagttctgagtgccactggcttaatgcaaaacataaactcaacacagctcctagccagaagtatagcatatatgtggatataaactgtataacaacagtataaacaaggaacgtttccaaattccaccaccagattataactttgaacatatgattgacacggtacacgctctaacagctaccttctatctatgacgttaaaaaacaaaattcttgccaaaaaaaattgcagtggacgtaaacaataatcaatcaattgggaccgtgacatgtaaggataacctagctacagaaaaagtacccccgtttgaattacaactgaggctttgtgcaggtgccccgccccatactagcagcttcaccgcctctcttcatccaccaaaaagaattggagatacattggcagggcaccatcaaaacatgcccatccaaaggcactaccagatgatcacaattcggaggttaagctttttttccaggcgattttttggtccattcttt

SEQ ID NO: 19863 - DNA, 1804 bp, Zea mays
aagaaaacatatgataacaaaaatctgactatttgcgagaagttatattgtagtagtaccctagtacctactgagcaccttagtgcagataagtgcacagtttcagcacctcggcacggcagcacacctgctttcacagttccaaggattcccaatacattaaccataaccataagtgataggatgcagaacagagaacagcagaaattaacaaaaacaaaactagtcatcctgcatgtttgttcttttttaagggagaagcaggtgaagtccttagtgcagacgccatgtctattctggaacacgaacgccaaagttcccagatatgaatgatgatagattgtagggccaaaagaagggaaacagtacccccccccctcttttgttttttcttttttagaataaagaaacagttactttttattgactcccatgctttatttcacccaagtaggtacaatcatttcacagtcaccaacacacttccaagaggcacactgggttgtttgcagatctagagagttcacggggtcatatgcagatctagagttcactgttcatgcagatctccgcgtcagctgatccttcgatgtactttcgaatatcttgtccgcattgcccacctcaaaaccatcacgcctgtggtattctttcacctcttcatcttgtaaatctttgaactgtggtaacaggagacgttcagcaaattcaatgtatgatcgaggaatagattcagttattccatcagcaaacgtaaacaatgatgagtcagctactgttgaactttgttgaaggagaccatcaggactcactttcagaatccctccttctgaatttaacttgaagccattgtcctccacaaatttgttgaacttattaatacttctgatatctgattctaggcgatgggtggcaattgtggcatgatttagtgcatagccattaacaagagtccatgcagcatattcactttccctagacaaaatctggaaatctgaataaatgggcttctcccatgttagctccccagatgtacttgcaatagcagcatgattatttccattgccagaagttttaatgtatttatgtataatttcctggctttgagtagtcaactcatccacaagaagttctgaaatgaatatccttggcaaaggtccatatgtaccagttccagagtagccatcattagtgggcggggaaaaccatagtgccctaagctttttagctggaaatctgagttcttcgcgaggtaaataaccaaaatcagtgaaaaaatcagaaagtgagtttataccataaccattgaccccaaatgtccggaaagcaaagtgatcatagcaaatatgatcaccatcataagatcgtacaagctccagaatggttttggctgtaggattcctgctcaaataaaccttttccatgttcgagattactgcccggaaaaataaatcagcacccttgggaagcgggtcggtgggggcgcgggcgtgcgccgcggaagccatagctatgtgacggcaaccagagccgacgcggagaccggggaagcgaatgggggcagccgcgggtgcgcggcggcgcaggctgagaagcgcgacagccggggatcgcgcggcggccagggtcgcggtcgcagtggacatggagttcgcggacgcgatgaggcggaatcgagaggcgagcagcgggggaagaggagtggagaacgacaagcaagcgatgcgtgtgcgtctgcccccgtcccggggtgcgggggaccgtgtgtctagcgcggctggcaaggtcacggggaaccaagcct

SEQ ID NO: 19864 - DNA, 1772 bp, Zea mays
ttttttttttttttttatagataggtaaccctaacttaatagctaagcaacataacaaaccctatctgtccggcactgttcacgcgctacagtaaccgcacgtgaacagtggccgcagctaacctagccataatgacatagctgtgaacagtggccgcagctaacctagccataatgacatagctaatgggctaaggcccataacattccatctctccttaaaaacagctcgtccgtgagctgtagtcaagaagaattgacccatactaaactagcacttaatgactcaatactaagtcttttacatctcgacttaatattttattcacctagaaaaaaaatgaaccacgtcagtggtcggatctatcgaaggaggacgtgtcggcggccagatcgactgatgacggacgtggctgcggtggcgcagagggctccctgcgcctagcgaaggtcggtggcaccctccggtgttgtagctcaagtgaccacgccgcggcggtggccaaggtggctgacgtcgaccacagctgcgacgacgcagcagatggctgtccgtggtgcagaagattgatggccacggcgcggaggattggtagttgtggcgtggagggttatcccgcagcagcgcctctacaggttgggccaccatggcggccgattgttgcagattgggcgagcagatccgtgcgcagccgtagtcgggccacgcctggacctccatgagcacggaggcgggctgcagcagtggcacagccacctcaacgtagaacgccgcctccacctccctgggtgtgttgggttgcagcccattgaccccatcgtcctcgactcggccgcctcctcccgtgcccaggccgccctcgctcgcgcccaggcagcccgcggtagaagcagaggggctgacccacgcctgctctagcttggccagacgagcgtcgtgggaatccaaacgggcattgatggcggcaagttgctcgaggatgaggtccatcttggcggagtaggtcacaagatcgtcgtgcgcgccggccatggtggcgatgcgcgcgtagtggctccggtaccaatttgttgtgaactgcgatgcactcgcaagatagtcccggtactcagccctcccgtaggaggccctaggagtaaaccagatctattcttcttgcttatcccaactaacaccctgcgcctctccttatataaggagaggtaaccctaacttaatagctaagcaacataacaaaccctacctggccggcactgttcacgcgctacagtaaccgcacgtgaacagtggtcggctaacctaaccataatgacctagctaatgggcttaaggcccataacaccatgattggctagctagttggctaacaactagttgaagacttggttaaaaggttagcccatctattggcccttttgtttgaatgcactagagctaaatttgagcagaaaattagcccatggtatccaaatgtgccttaagtagtgtggtgggtgatatagagcaacacacagccttttttttttggttcagttgtttcatggcatggcatgatgagccaatgacttcattgaggagcagtaacagtgagatgccaacttcagtatgcgttcaaattatattgctttgtatctgtgcttctattcttcaccccatagcgtggccatttgcgtccaacacatctgatcttccttaacagttacagttgctgataggggcatagggccatcattgccaaaaaaaaaaggaatgatgtccttgtccactgcag

SEQ ID NO: 19865 - DNA, 1033 bp, Zea mays
cgtagcatttctacaaacttacatagcatagctcatagaacgtgtcccctctcaacatgaccaaaactttacatgtgcttatcctaacctaacagcagcaagagaggccccctaactatgtagcatctgtatctatatatatattatatattctcatatagtatattttattgtaacaaggtaccaatggaataaatagaatattttcatcgcggcccctgactttgagaacctttacatgccgacacactttgcccacctgaaccagcacgaaatcttttccggcaatcggtagggttccaaggtagcaggatccacctcgagagatttgggatctgtccaaacgtacacaccgcgctcttgtcggctgcctggcacagtgttgtcaaggatcaacgcgacaaggagagccaccacaacgttgatggataggagcgcattcactgcataattcaacccactgctggctgtgcgaactggtccacttgacgctgcagcataagggagaagatagcttggcaagataagattggagctgggttcgtactgctgaaagtatgcagggattgacagggagatgaatagggtaaatccaactattatcaagtttctggagcttgctgcttgggtgtatcgcaacgtagacaagccaagtgcaacgattagcgcccaggtgaagcacagaacagaggcggccaatgcaagaggtatagaggctaggagagctccgattttaccaaagaaggagcagacgactaaaacggctgccccaagctgcaatgcccttctgctggccattttggtcgtttcaagggtgtgtatgttctctgttaatgttatcgatcctgtacctgtaccccacactccagcaataaaacttgaaatcccttcaagcccaatcgctctgctgacaactccgcgtgttggtggacataaatttaccagcagcgatgcagcatggtacgatgaaagcgaatcaactgaagcaaccagcgacactattatcatgatgatacccgtcttagaatgaaac

SEQ ID NO: 19866 - DNA, 948 bp, Zea mays
ctgaaacttggcaagaccttgttcagttattcctatccatccggagtcgttgggtggggtttttttttaaaaaaatttgacttttttaattaaaacccactcaatccatgtagattgagagcaaaacgaataatctctaactgttatttgaacgtagtattactacaaacttacattacatagcatagctcgtataacgtgttccctctaacatgaccataactttacatgggtatatatatagcaggtaccaatggaataaatagaatcttcaccgccactcctaagagctttcagatgccgacacactttgcccacctgaaccagcacgaaaccttctccggcaatcggtagggttccaatgtagcaggatccacctcgagggatttgggatctgtccaaatgtacacaccgcgctcttgtctgctgcctggcactgtgttgtcaaggatcaacgcgacaaggagagccaccacaacgttgatggataggagcgcgttcactgcatagttcagcccgctgctggctgtgcgaactggcccacttgacgctgcagcatatggaagaagatagctgggcaagattaggttggagctgggttcatactgctgaaagtatgcgggtatcgacaaggagatgaacagggtaaatccaactattatcatgttcctggagcttgctgcttgggtgtatcgcaatgtggacaaaccaagcgcgacaattagcgcccaggtgaagcacagaacagaggcggccaaggcaagaggtatagaggctaggagagctccgattttaccaaagaaggagaagatgactaacacggctgccccaagctgcaaagccctcctgctgcccattttggttgtttcgagggtggtgtatgttctctgttaacgttgtcgatcctgtacctgtaccccacactccacccggcgagcccgagggtcc

SEQ ID NO: 19867 - DNA, 1046 bp, Zea mays
  misc_feature (1021)..(1021): n is a, c, g, or t
ggaaggtagccggcccggccgtggcagcattcaagcatcgacagtcgacgctgcagcaggaagccaaagaggagagaatccatcgagtcgaccaccgagcacggttagggcggcggggctcgccgtggccacagctcaggaatccaatcccccactcctcaccggcgcccgcggttttataaatagattccctcgtcactgtcgcggtcgcggcttgatcggattcaactcacctaccccaccccctcgattccttcccagctctggctacttcctacgccaccaccgcccgctccggcctcggctcctcgagcaagctgccatggctgccgccgcgctgagggagcaactcaacgctctcctctcctccatgttcgcctcgggtctggtggacgagcagttccagcagctgcagatgctgcaggaagacgggggcacgccgggcttcgtcgccgaggtcgtcaccctcttctgcgacgacgccgacaggatcatctccgagctcgccgctctgcttgaccagcccatcgtggactttgataaggtggacgcctacgtgcatcagctcaaagggagcagcgccagtgttggcgctcagaaagtgaagtttacttgcatgcagttccgtcagttatgtcaggataagaacagagacgggtgcatcatggcattggctgttgtgagaaatgagttctatgatctgcgcaataaattccagactatgcttcagcttgagcagcaaatccaggctcaacaataaatcgaagcagaaagcgtagctgcatgtggcctcacatgataagtgtatctttaaagatgtagaccatgttctctgtgttcctacaattgtgacaaaatcatcgtcgttgaggtcggctcacatgcatgtaactgttagctataacaattattgtctaacgttgtccttgttactccacccgtttgtgttggattgccatcgaccatcatatgaaaactttttttttcccaaaaaaaaaaaaaaaaaaaacgataagactgnccctctcgtttttcatccgccttcg

SEQ ID NO: 19868 - DNA, 2388 bp, Zea mays
ggtaaatactcttctagataatatacacatcctgaactgatatctatagagaatggtagaaaaggtttagcaaaactaattaggcagaactgacaaaaaaatcattttgtaaacataggaagtagcgcaaggcatgatttcatcaacagggaacctcctatttaaatgctatgatgcgcatatagttcatgccaaaagattatatagtcggacctcatgtgtgctactgaaataatctaatcagattaatcatttttggggtgtagattaaatacatatcgtgcaggatgtaaacgttatcttcctcatgaagcctttaaaagttatctacctaaaatcctacattaatcattctcatttcagataagactgcacatatacattcccatagaatgtattctaatttctaagcaatgaatttgccaataaactccctatcagcctctgaagtacctcgtgcggtctgtaaatgttatctacctatgataatcatttcgggcgagactatttggcaatctgcataacttttgacttgaggcagaactacattgaatgatatttctatgtattggacatgttcagccatgcattttaacagccaatgccacaattaaaagcctgagaattttagttagttttattccataaacagtaaaagaatttgacagtagatattacataacaaatttcagagaacctggcaaacaataattggatcgttgaataagttttgctacaaataagcttttttggataaaaatgggccgtttacccttgccatgttgaaggatggaaaccgtgaaaatgctttggagagaacatcatcattaacttcgttgcctagatctccacagaacagccggtagtcgtctgcaaattgttaagagttgaaacacaaggaaatgaaataagggagaagcataaaacaaaggaaactggattaataggttatgttggctgctactttcgggccattcagtgagggtaggatcctcccaggattgtccggcagcgcgacgggggatgggcttcttgctggtagagggatcggagagcctggcgttggcggcggcgacggggtcgaggacgtcgctggtggcgagggcagccttgacgctctgcagcgcttcgggggttatggtctgcgcgtcccgctggaagagctgatgggcctgatgcagctgttgctgatactgctgatagctgctcgccgccataggcggcggcacctgcggcggcggcggctggtgctgctgcaggtggaaagggagcgggaagtagctggcccccgccggagccaaagacgacgacccaggaggtggcggaggaggattgacaggcatgacagcgtatcgactcgggactggctcagacgacgccgcccgcaatcaaagcgttagggtttactcgtcgcccgtcaagcgctgccgcccgtgccctcacccctgcatctatgcgcctgctgccgaccttccgctcgatctttctgcaatgtgcgcgcctaggctacggctacggatctatttaggtggagcagaagaattgggggacgagaggaccgggttggatttctaatttccctctggaaacactttttcaggagaaaatgtttttttaaaagatctctcacgtttatttttgggttagttacacggtttatattaaacgtaactacctataatttaaatacaaaaactatatttaattctctattaactcttctagtatttggtttcttctacatctattttttatttatttaacgccacttagtttagttttgtatcacggagggatgctttttagacatgtatcggatgaaagcttcttcagattttacgttctatatatataatataatttttatatcctctaagatatatactatatttaaatatataataaaaaggtatatataaataatttaaaagtattataattgaagggagtactatactatgtttcacgctaattattttcaaagaattcaatttttgcattaaaaagatttcttttcaggtgtttggttttttcgtctcatggatgccactcttcaaaagtcaaataaagtgtcatctatgtattagtcatcagtgattatgagagattttttttcttgtttcttagcaaatttacttatgtggtgaggcgctaaatgttagcagcctactacaactacggtagagaggagaaccagaggtaggagatggaaggagagcaatagtattttcttcattcttagcgttcactgtggccagtcttagttttagtaccccttacagcactcttacacggaccacttgtccgatggatatcgaccactgggcctaggcacacggcggcccagcacttctttctccagcctgtttctgatttccaccgccatcc

SEQ ID NO: 19869 - DNA, 1381 bp, Zea mays
tggagctcaagtacgtgcaggccctcctggcctcctagacgctggcggccgtggatgccgtgctcgacgaccctctttttttttttttttttttttgatagtacaacacgtcatgctattacttgctaaaacccaaactgaaaattccatttggttcttgttcagctcggcttggttagtcagtagccatgacagtactccaacaccacaaatggatgaacgcaaactatgggaaacagtaaaacggagcacaaattgcatcagatggcagcagtagctcgttgcaatttgcatgaaacaacagcccttgcgtgatttccgccccctagtagtgcagagagtgaagacattccagaagtagcatcatcccaaggcagcaacgcatccatgagctgcccttcaccctcggtagggcctatatatctctacttgtgaagaacactcttcttgggaattttaggcttcctttggacatgattcttttgtctttgcagagcctcaacatctgtcctctccttccagttactcttacgcaatttaatagggcgattcccaacatactttccattcatctcttttattgctgcagccaagtcagtagggtttgaaaagctcacaaatccataacctttagtcttgccagtcctcttatctctaacaacccttgccatgttgaaggatggaaaccgtgagaatgctttggatagaacatcatcattaacttcgttgcctagatctccacagaacagccggtagtcgttttcaggccagtcagtgagggtaggatcctcccaggattgtccggcagcgcggcgggggatgggcttcttgctggtagagggatcggagggcctggcgttcgcggcggcggcggggtcgaggacgtcgctggtggcgagagcagccttgacgctctgcagcgcctcgggggtgatggtctgcgcgtcccgctggaagagctgatgcgcctgatgcagctgttgctgatactgctggtagctgctcgccgccataggcggcggcatctgcggctgcggctggtgctgctgcaggtggaaagggagagggaagtagctggcccccgccggcgtcgaagacgccgacccaggaggcggcgggggaggaggattcataggcatgtaggcggatcgattcgggagtgtctcaaacgacgccgccgcgatcaaagcattagggtttactcgtcgctcgtcaagcgctaccgccaaatgctctcaccctcatctatgcgtctgccaccttccgcaagatctttctgcgaagcagaagaccaggctacggatttatgtttcggtggagtagaagaaattgggggtgatgccgtgatgaattgatggccggcctcgagggcccgccgcac

SEQ ID NO: 19870 - DNA, 1374 bp, Zea mays
gctcatcccaacgtacctttttttttttttgtttcatatgttcctgttgcaacgcacgggcacacaactagttacaatatacaatgcaaaacagtactttacacgtccatttacacgatctgctgaagatggccttagacctagtttggaaggggaagtcaaaccagagagagaaaccatctcctaaataactaaatgtcttatttaaattatatccctgggttactcatcctgataaaagacaggtatcccaaaagaatttaagtttccaaactacaccttacatgaaacaacagcccttgcgtgtgattccaccccgagcattgcgtgattccaccccgagcattgcagagagtaaagagattccagaaggtagcatcatcccaaggcagcacatgagctggcattcaccctcggtagggcctttgtatctctacttgtgaagaatagtcttcttgggaattttaggcttcctcttgacatgattcttttgtctttccagagcctcaacatctgtcctctccttccagttactcttacgcaatttaatagggcggttcccaacatactttccattcatctcttttattgctgcagccaggtcagtagggtttgaaaagctcacaaatccatagcctttagttttgccagtcctcttatctctaacaacccttgccatgttgaaggatggaaaccgtgaaaatgctttggagagaacatcatcattaacttcgttgcctagatctccacagaacagccggtagtcgttttcgggccattcagtgagggtaggatcctcccaggattgtccggcagcgcgacgggggatgggcttcttgctggtagagggatcggagagcctggcgttggcggcggcgacggggtcgaggacgtcgctggtggcgagggcagccttgacgctctgcagcgcttcgggggttatggtctgcgcgtcccgctggaagagctgatgggcctgatgcagctgttgctgatactgctgatagctgctcgccgccataggcggcggcacctgcggcggcggcggctggtgctgctgcaggtggaaagggagcgggaagtagctggcccccgccggagccaaagacgacgacccaggaggtggcggaggaggattgacaggcatgacagcgtatcgactcgggactggctcagacgacgccgcccgcaatcaaagcgttagggtttactcgtcgcccgtcaagcgctgccgcccgtgccctcacccctgcatctatgcgcctgctgccgaccttccgctcgatctttctgcaatgtgcgcgcctaggctacggctacggatctatttagggggagcagaagtctagccggccgagcacccggaatccaatg

SEQ ID NO: 19871 - DNA, 2288 bp, Zea mays
taggggccccttttttttttttttttgttgatcgagaaactgaaaatttgcttaagaatcctggtacatccaagtaatttacaagctacaatgtctgtgctctcccaatggctagcaaactcagtagcaactgcctatcaaaatgaagacaacaccagtcaggagaaacggccaggaaagcataactagcaagatgcaacactaattgtcagggtgaaaacataaccaaccactacatggggcaaaatccaacagatgaacaagtacttactgtttcagtacacaggattgtattctatgctataaagcatctctctacggttctcaccacccattcggtagttgaactgctttgccagggactggactttctcgtcactgtcgaagtctgattcacgagagcaccgtcttcgaaccttcctgagggtatccttggaaggagtgaagccagcatcaaccatctcatcaattatggcaagagcagcttttggatctttgtttgcaagatgggcgtcgacaagcaaggagtatgtcgttgcatttggcttaacaccaagagttaatacatgctggaacacattacatgcttctcctgtctgtttcaacttcccaaatgcacacagaagagcattgtatgaatgaatgtctggagtgaggtcaaatttttccttaatagccacaaaagtttcataagctcgattaatatcccaaatgtttgcacaccccaatacaacacagttgagagcagcaagagatttgtacggtggatcagcatgtatcagattctccaactgaccatacaccgaatccaatgtgctaaagccatctttgcagcaagcaacaacaagaggatgcaaagaagtaaatggtgagaagagctctaaatcaatgtcctcagagttcccataggcattttcaaattcacgcaatgtaccaaaagccctttgaagctggccaattgatgaatgagcatagatcttggcaagatatgtctcttgggtgggtgcccttttctggcgcagggatttccgtaatagcgaccaagcagcattcaagaggtcagtattataagttctgccagcagcactcagagctgatattacaagaccttcattaactgacagctgaacaggaggtttaacattctcaccacgagcaatccatcttgcaagatattccaaagcaaaaagagctaatttgctgttgttagcttcaaatgcagcatctgctatgtcaatgcaccaagtccattccggacacaagactttgttcttatcagttgtcttgcatttctctataattgatgtcaacgtgtccaacctcccagatctcatacatgctcggatataatctgtgaaaacagttagtgataacatgtagcccgatttaagcatcagatccaaatacttcagagatgaatcaacgaggttctgtctgataagcaggcctacaaccaaattgtaggattcatcgtctggaaatgttcctgtttgcagcatccgttcaatgagcttctcggcgccctcggtctcctggctggcgaccatgctcttgagcacgaggttgtacgatgcagtgttgggttggagctcgaactcgagcatgtggtcagcgagatcgagcatctcgtgcggcagggccctggtcatgaggttggcgcggaggtagtgattgaagaggtcgacgtcggggtggttgggcttccccgtggcggcgtcgagggagcgcacccagtggtcgaacaggtgcttcatgtcttcccaccgctgctccgccatatacttggcgaacgtctccttgagccccgtgacgtcgggtgcatcgtagaaggcggccatgaagtgctgcgccccgaaggggctgccggcgacgacggtgggcagaagcgaggagggcgggttggcggcggctgggttgcgccagttctgggtgtagaaggggctccccgtgctggggtttggagggagtggggccgcgccggcgaggtcgggggtgccggcggtcgggtcgggggacagctccggctgctggggcaaagcacgggaggatgagatcgctgcgcggaggaggagaaggtgggggttgcggtggtggcgtaggaggtgcgaggtggccgccgcaacagccgccatggcggctagggattagggttttagtgaggcggtgatggggggaggtgcggcggaccgacggagacgacggcggctgagatctttgagatgagcgggcgtcctgaggtcaggaagacaacatatcggatgtcgagatgtcctcccgacccggccggc

SEQ ID NO: 19872 - DNA, 1910 bp, Zea mays
  misc_feature (1804)..(1804): n is a, c, g, or t
ttgcatgcctgcagttccaagtaggcgatcaggtcttaatgaaacttcaaccatacactcgatcctcagtggctactggctaacaggcctttctcaaagctttcttacaagtactttggcctgttcaaagtcctgaaacgagtgggcaatggcttatcgcttggagttaccagttgacattaagattcaccctgttttccatgtcttctagatcaagtcttctgttgcaaatcacacccctgtctactccgatcttcaggacaccaccgacagcgaggctgcctccgcgatacctgagcatgtcctcgatcgccgtccggtgaataagggcaatgcagctgtatcacaggtgctgatcaaatgagcccgtcttccggaggcatccgctacctgggaggattacaatgtgttgtgtgagggcttctcaaacgcccctgcttggggacacgcaggatcttcggagaggggagctgccaagccaactaccacaacagagtgagaaggcacatgagccagcaggtgtcttctaactagagaagcaccgttaccttttatttactgagtctatgacagtagggggccgagaaggtgtactccttaagcttgcgttgtaagactgaaacgctattcgaattcttttttttttttttttactagaagaacgtgtcctcttctcattaccgcatttgagcttgctgcatatcctcacgtcaatgccaaacgtcagtggccaccgggttttacaggttataccattataggtcgtcacctataagtacggtaaacaaaactaggtgccggaacagaaatcagaatgcctcattggcaacgacaatgccgcccgtacaagaatagcgcactcaccgttcaatgagcttctcggcgccctcggtctcctggctggcgaccatgctcttgagcacgaggttgtacgatgcagtgttgggttggagctcgaactcgagcatgtggtcagcgagatcgagcatctcgtgcggcagggccctggtcatgaggttggcgcggaggtagtgattgaagaggtcgacgtcggggtggttgggcttccccgtggcggcgtcgagggagcgcacccagtggtcgaacaggtgcttcatgtcttcccaccgctgctccgccatatacttggcgaacgtctccttgagccccgtgacgtcgggtgcatcgtagaaggcggccatgaagtgctgcgccccgaaggggctgccggcgacgacggtgggcagaagcgaggagggcgggttggcggcggctgggttgcgccagttctgggtgtagaaggggctccccgtgctggggtttggagggagtggggccgcgccggcgaggtcgggggtgccggcggtcgggtcgggggacagctccggctgctggggcaaagcacgggaggatgagatcgctgcgcggaggaggagaaggtgggggttgcggtggtggcgtaggaggtgcgaggtggccgccgcaacagccgccatggcggctagggattagggttttagtgaggcggtgatggggggaggtgcggcggagcgacggagacgacggcggctgagatctttgagatgagcgggcgtgatgaggtcaggaagacaacatatcggatgtccatgccagttgggtctatatgttgcatatattaaggacttgtttggtttcattagttctaggactaaagtttagttcagagattaaattttagtccatactctgtttggctgtagggactaaacagattctaaatatattaaatacaacacataaagactaaaatgccctttttttngtttgatactaattttctagccagggtaattagagtaaatgttgctctttagtcccttttagcactcatatgagggactagagactaaatccaattagtccctact

SEQ ID NO: 19873 - DNA, 2261 bp, Zea mays
  misc_feature (9)..(9): n is a, c, g, or t
caggacttnttctttagttacgagttttaaacagagccgaaaacaactagggagtcacgtaagaagtggagccatgtagagctacagtttatagggggaaaactgacattttcggattttcaagcaaacaaatagtgtcatcttattagcaaatcctaaaacgaaccctgcgagcacaaatgatgatcgagaaactgaaaatttgcttaagaatcctggtacatccaagtaatttacaagctacaatgtctgtgctctcccaatggctagcaaactcagtagcaactgctgtttcagtacacaggattgtattctatgctataaagcatctctctacggttctcaccacccattcggtagttgaactgctttgccagggattggactttctcgtcactgtcgaagtctgattcacgagagcaccgtcttcgaaccttcctgagggtatccttggaaggagtgaagccagcatcaaccatctcatcaattatggcaagagcagcttttggatctttgtttgcaagatgggcgtcgacaagcaaggagtatgtcgttgcatttggcttaacaccaagagttaatacatgctggaacacattacatgcttctcctgtctgtttcaacttcccaaatgcacacagaagggcattgtatgaatggatgtctggactgaggtcaaatttttccttaatagccacaaaagtttcataagctcgattaatgtcccaaatgtttgcacaccctaatataacacagttgagagccgcaacagatttgtaaggtggatctgcatgactcagattctccaactgaacatacaccaaatccaatgtgctaaagccatctttgcagcaagcaacaacaagaggatgcaaggacgtaaatggtgagaagagctctaaatcaacgtccttggagttcccataggcattttcaaattcatgcaatgtaccaaaagccctttgaagctggccaattgatgaatgagcatagatcttggcaagatatgtctctggggtgggtgcccttttctggcgcagggacttccgtagtagcgaccaagcagcattcaagaggtcagtactaaaagttctgccagcagcactcagagctgatattacaagaccttcattaactgacagctgaacaggaggtttaacattctcaccacgaacaatccatcttgcaagaaattccagagcaaaaagagctaatttgctattgttagcttcaaatgcagcttctgatatgtcaatgcaccaggcccattgtggacacaaaactttgatcttatcagctgtcttgcatttctgtataattgatgtcaacgtgtccaacctcccagatctgacacatgcttggatataatcagtgaaaacagttagtgatggcgtgtagcccgatttaagcatcagatccaaatacttcagagatgagtcaacaaggttctgtctaataagcaggcctacaaccaaattgtaggattcttcatctggaactgttcctgtttgcagcatccgttcaatgagcttctcggcgccgtaggactccttatcggcgaccatgctcttgagcacgaggttgtacgatgcactgttgggctcgagctcgaactcgcgcatgtgatcggcgagatcgagcatctcgtgcggtacggcacccgtcatgaggttggcgcggaggtagtgattgaataggtcgacgtcggggtggttgggcttccccgtggcggcgtcgagggagcgcacccagtggtcgaacagaagcttcatgtcctcccaccgctgctccgccatatacttggcaaacgtttccttgagccccgcggcgtcgggcttatcgtagaaggcggccatgcggtgctgcgctccgaaggagctgccggcggcgacggtgggcagaagcgaagagggcgggttggctgcggcggggttgcgccagttctggctgtataaggggctccccgtgctggggtttggggggagtggggcggcgccggcggggtcgggggcgccggtggtcgggtcaggagacagctccggctgctgggacagtgcgcgggaggaggagatcgcggcgcggaggaggaggaggtgggggttgcggttgtggcgtatgaggagcgaggtggcggccggcgccgcagccatggcggcgagggattagggttttagtggcgtggcggagtgagggagaagacggcggctggtgtgatgggatcacgaataaacagcccccggccggcctcgaggtacccaatg

SEQ ID NO: 19874 - DNA, 902 bp, Zea mays
cttttttcttttttttttttttgtggtgactttaaattgtcagtctccattaaatttccataataagaatagcatcttttgaagaagctgcgacccagtcatcccaggacttcttcgttagttacaagtgtaaacaaagccgaaaacacctaggagtcacgtaagaagtggggccacgcagatgctacaatttatgaaaaagaactgacattttcggattctcaagcaaacaaatagtatgcagcttattagcaagtcctaacatcaaccctgcgagcaaaaataatgattgagaaactgaatattgcttaagaatcctggtgcgttcaagtaatttacaagctacaatgtccgtgctctcccaacgaccagcaaactcagtagaaactgccgcttcagtacacaggattgtattccatgctataaagcatctctcttcgattctcaccacccattcggtagttgaactgcttagccagggattggactttctcgtcactgtcaaagtctgactcacgagagcaccgtcttcgaaccttcatgagggtatccttggaaggagtgaagccagcatcaaccatctcatcaattatggcaagagcagcttttggatctttgtttgcaaggggggggggggggggactagtgtatgttgttgcatttggcttaacaccaagagttaatacatgctggaacacattacatgcttctcctgtctgtttcaacttcccaaatgcacacagaagggcattgtatgaatggatgtcaggactgagttcaaatttttccttaatagccacaaaagtttcataagctcgattgggggcccgggccttcgcaccccctaatacaacacagttgagagcagcaagagatttgtaaggtggatctgcatgactcag

SEQ ID NO: 19875 - DNA, 6007 bp, Zea mays
  misc_feature (1620)..(1620): n is a, c, g, or t
  misc_feature (2014)..(2014): n is a, c, g, or t
  misc_feature (4257)..(4257): n is a, c, g, or t
cgctaccattcctactctcaactgtcaatataatgttagtgcgcactggaacattgttcgatcttttcagtcacattgtgagtgggtagtgtagcccatgtgtcaatatgatgttagtgataagttaggacctaggtccatattctgccaccgttttgttctatcggtcctttatgattgttctagcttccaattgtaattgaaagtggacggatgcaaggatcttttgcttttcaaaaattacctgattaagcatgcacattatgttttcatacgaatatttccaaatatttgttaatatacttcaatcaatgcttaactttggtatctgcaagtttgaagataactagaagtcactctaacatgctcttgcgcactcagattaagtcatttttatgactcgcatgcattatgtttctgctagcttgccatgacattcagtaacctttcatgactgtgtgacatataagtaatcaacaagcaatttcattcaataatctttcatgactgcgtgtgacatataagtaatcaactgcatacttgtaacaaaaaaataatgttgattatttacatatacatgtgctacattttatttgcataacagaaatttatgtacctatagaggagccatttattcatgactatattcatcaaatagtttgctagcatccttttgtgaacaaccacaactagcatacacagctcttgcctgatattagcagtttcatggtgggaacctaattaattaactagcaaatattgcttgcattgtagtgtaaactttttatatttgtgcatatgatgtacatggatagcagtaccaccaaacatttgagatagtttgagaaagcaaaatggcactatattactttactggcatatggtattctggtgaattgaaatatttattatttagattgttctagttggttagtttgtgcaagcaaaatgacactattttactttattggtatatggtattctagcgagttgaaatatttattatctagttggttctggttggtctcttaaaataatgtaatgcacttttacttgtgactcgtaagatatctgagcaattggcagatgatttactctatgttcaattttttctcagttacttaggatccattgtagcaggtattttctggctcagattttacagattgaaggtatgagctcatagctgaagctttcacttagatggcatgaacacctattttgtacaattaaatatagctacatcttatgtggtctttttactctggagcacatgaacttctcacgtgatgaaggaaaaattaccaggttaatctcgatgttaattaaataaataaaaatcttatatagttaaggtgcaacatgattttgttgtgaaaggaatgagtatgctctttccttgaaccagaattagtctggtgtaaacagttactaaagtttaataggttccacgtgatggcttcaatattactttatttattgtatgtgctacagtgataatgttacacagttgatgcattatttcccttgttcaggtaagtaacacaagggatattccatgctctacctatgaccgctcttggggctgttttgtgtagttaatttctaacacaagttttnatagccaattcttttgggaccatgtgcaatttgctattaaaatgaggtatgacaaacttgggcttaaaaatgattagtcagcactgatgattgctctgaagtaagacaatggacctttatatgtaaataacttctttagtactcgaaaaccctaaccaattattattaatgatgtacaatgtgctcatccagataatgaagtgcatctgagcatttgaaacgaatctagattctagctctagctaaggttatacagatattgtgctaaaccttgatgctactattatgtgtagtaaaattttgggggtcggaattgaccaaacttatggatttattcaacgtctcaattcagtgacaaatgctactattttctatattcagacacttggtactnatttcttgatcaaactcattaaacttaccattccttatagttatccccaaacactgaggttgcgcttgtgctagggcagaagacacgcctacattcgtggccggatatgcgctgccatggactgacctcagcgcagatcgtgattgatttgtgggtgaccccggtttgatgtctggttgttgggctgcgcaggtgggctgtcacttgggatcgaaaaggatagggcatctactgccgccatggggtttgtcgacgactccaaaggtgatgagctattgtcttttactcatgagcaaaggggcttttgcacattttttactagcgtggatcacctgctaggaactaggaggaaggaatttttacaatcggttttcttgagcaagtagtagaaattgcagctgcaataattcagtgttgaggagaaattagtaagttatcaatcaatggcaagttcagacctgcgctctctccctatccagggcatgctgtcgctaccagaggtggagcgagtgcccatcctcgacgcaggcctccccaccgcgactagaagtaggagtacattgtaccattagcaatatattcagtcgtgaggtcagttctcctgtctacgacatgcagacatataacaaacttgctactcaaatctccctccctccatcttacatagctcctgaggtaaaagttaaaatccatccatacttgcttcttttttctactgtttactgttagtcgtgacttgttctccaccatctattaatgaaaaaaatgataggacactggtaaaattagtggaacaatttggaccgaggaagtggtcttacatagcacaactgctgccagcaagagtggggaagcgatgcagagaaagatggcacaaccatttgaggccaaacatcaaggtaaacttcttcctttattagttcaacttttttttcattctgaggacatccttcgctttgacgtagatgacgcataaccaataaccaataccgttccattgcttctcaatctgtagtgaagataaagtatgtgttcttttcaattatacactactccctctatttttataaggttcattacaatttggagaagtccttagaagtgtactttgaccatctgacaataatcagtaattgttacaaaaacaatctgtatttagaagatgttcatgatgtgaatctagcgatacagattttacctacaaagcatgcacatattttgcagataattgttggtcagactttatgaagtttgactttattgaatcctaatgtgacattctatatgcagtgatgtacatttcttgccttcaatttgtttatccagttctctgattttttttatcttaacactttcagtaatatttggaatggtcataagtcaaactagacttccctagcgacagcgattcaacgaataagaaccaggccagcagttatgtagtgcagagatctactcccagtcccggtgagttggtttaggaatcatgaatgttcagtacctggctcagtttttattagcaatgtagtgagaccgagagcatgaggcttcagtacttgtctactaacatcagatgcatttgctgatgtcttgattagttgtagcaggttaatctctatatctatgtcacaacatcatcaacttcactcttcacttgatgcgctaatgttacatgtaccaatcatctacagggaaccatcttccagtgcctcttgtaccgatcatcggcaagggagtgctagaggaggaggttatggtgagttttgtcgtgactaatggtgagcccacgactacggccacgtcaaagctggtctggtggaacctcgtggagcagatgacgatgacgctgacatcctgcacctctgctgtgacgctgccgactaggacacgggcccctccgtcgcgcgcgctctataagtctggatccatcatcgtgctcggcaagactggcttccttaggccagacatggtacgattcttgccctatcttcttatctatactgtttatcatttctaatccatccatcggcttgatgtttcttgatttctctatattttttctccttgactatctttttcttttgcagttaagatgtcttaaaagagaatcctaggtttatcagaccatgttgtttgacttactacctattgctaatattttgccatagatgcatgcattagtgtcactatccaaatcctactgctttcttatttagatgtgtatctaaatctcgatctcgagntatttcgtttggaacacgtatttgtggccaaggggaggttctcagaagttaatcatatatatatttattcttatgtaatgtgttagttatagaggttttctggcttcaaaatattttgactcctgccaataacttatatgtgttcctgttcttatgttgttttagttcaggacgattttcaattctttgccaacgtgacaacacatatagatactaacagaatttgttgtttgagatagaactatgaaagtagatactaatagagaattcttttttcttgccaaaggcacatgtgctggttgtcgccatagccaggaacactacttgagaactaatctagatattcagttagttcgaaggattgttagttagttcaaaggattggcaagtttctaggttcgactggcagttagaattgagagaattcttgtttgttttattatttttttgcctatcacattccacatagctcttattagtgttagcattgaacctctagatgtggtagatcaggagtatccttagccacatctggtgtggtctgtaacacagcagcgaagatgtgcagagagcaaaggatatatcatccatatcacaaaaaatatgtttgaattttggtttgtaaaatattaggtcaccagctttcttcagatcatttgtcacttgccctttaaacatccttagacaccatgagctcgattagatcatgagcatggtaggcatttctatgacatattaacttagaaatttcactaacaatttaccattcagtaaaactatttgaggcttgcttcagtctaaagcactcttagctagatcttttcctttccatcgtagactgtttggaatgagctgctgctccaccaattcttttgcaacctccttgcttgactcatgatgaaaaccaagacgtaatatgccacaaacctaatctatactacctattaaggctctaaggggtaggctgcctctgcttgttctgccttccgacgatctcaaccgtccaatacgctctagagtctctcagccgtccgatgcgcgcactctcaccccccacgcatcgccccgccccacccgctctagaagaatgccatgttctcaagctgcgccaacatccaggaaagaggcggagaaatgcgactgccttcaaggtcaatttcgttttaaccatcctgaaatgttcattgttagttatctattgacctgaaagcacactgttaattatgtctagggcattgccgcgttccgggggaggtcgggggggcagcctcgctgggttggaggcattggaggaggcgctgcctattcggtgagttattgccagttcatacttgatagattgttttactttttttttgtgatctgggctctgcaggagaatttggttccttgggggaatctgtgaagaagcagctaatttgcgttctttggagtattcccatttgatttctgtatgttattttcctagaaaatattcaggttagtttattggaattgcagagattactctgtgggtgtgattctgccgcttctttctacaaatggtacactgccacgttttgcactcaatgagtatttttgagatattagctttgttatttcataaaggaggaaacgtgagattagagatgacttggatgttaggtagtagaacaacgaattgtcattaggtgctttgtctgatagactagattttgcgatggtttagctaggttgcagataaaaaatgtcaaaactgttttgttgttaa

SEQ ID NO: 19876 - DNA, 2288 bp, Zea mays
  misc_feature (2286)..(2287): n is a, c, g, or t
ctttcccttcctcgtgccgacgaccgggcgaccgccgcgccccggcccgcgcccccttgtctcgggccactcgccggcaacgagcagccaccaggaaatgttgtgaggactgaaaagcaggctcctgcaggaccatggacggatgtgattgcatcgagccactatggcctaccgatgatctccttgtcaagtatcagtacatctcagacttcttcatagccctcgcgtacttctctattccgttggagctcatatatttcgtgaagaagtcgtccttcttcccgtacagatgggtcttgatccagtttggtgcgtttatagttctctgtggggcaacccatctgataaacctgtggacgttcaccacacatacaaagaccgttgcgatggtcatgaccatagcaaaggtttctacagcagttgtgtcctgtgcaactgctttgatgcttgttcatatcatccccgacttattgagcgtgaaaactagagagttgttcctgaagaataaagctgaagagcttgacagagagatgggactgataaggacgcaggaggagaccggtagacatgttaggatgcttacacatgaaatcagaagtactcttgacaggcatatgattttgaagactactcttgttgagctaggaaggaccttgggtctggaggaatgtgcattgtggatgccatctcgaagtggttcaagccttcagctttctcatactttgcaccaccagattactgttggatcatcggtgccaattaatcttcctgtcatcaatcaagtgttcagtagcaaccgggcaattataataccccacacatctcctttggcgcggattcgacctcttacagggcgatatgttccaccagaagtggctgcagtccgtgtacctcttctccacctttcaaacttccaaataaatgattggcctgagctttcggcaaaaagctttgcaatcatggttttgatgcttccatctgatagtgcaagaaaatggcatgtacatgaattggagctggttgaggttgttgctgatcaggtagcagttgcactatctcatgcggctattcttgaagagtccatgcgagcacgtgatttactaatggagcagaatgttgccctggatttagctcgaagagaggctgagatggctatccgtgctcgcaatgattttctagctgttatgaatcacgaaatgagaacacccatgaatgcaataatagccctttcctccttgcttttggaaactgagcttactcctgagcagcgtctaatggtggaaacagtactgaaaagcagcaatctgttagcaacactcatcaatgatgtgctagatctttccaaactcgaggatggaagccttgaactggagattaaagcattcaatcttcatgctgttttcaaagaagtgatgggtttcattaaaccaattgcatctatcaagaggctatctgtatcggttatgttggcaccagatttgccgttatgtgccattggtgatgaaaagagactcatgcaaactattctgaacatctctggcaacgctgtaaagtttaccaaggagggacacatcacacttgtagcttccattgtgaaggctgactctttgagagagttcagaaccccagaatttcatccaactgcaagtgatgaccatttctatttgaaagttcaggtaaaagatacaggctgtggaattggtccacaggatctacctcatgtatttacaaagtttgctcatcctcaaagcggaggaaaccgagggtttaatggtagtggtcttggccttgccatatgcaagaggtttgttagtctcatgggagggcacatctggattgacagcgaaggaaccggaagaggttgcaccgcaacattcgtcgtcaagctcggcgtgtgtgacaacacaaacacctaccagcagcagctgatccctctagtatggccaagcagcgcagactccgatttgcgtgctccgaaacctcttccggacgggagaggatctactcccttgaaatctcggtaccaaaggagcgtatgagcctagtgtaaatgattgacggcatagtgccaagtaggggaccgattagtgccaccgtctaattttgtttgtaaccctgtcatagcaggcatatgatgtacaaatactgtaaagcaaatggagactgcggccgtgtatctgggtggcaacgctgacttgctgcattgagtggtatatacatatgctaccagcggattgaattgcttaaaaaaaaaaaaaaaaaaaaaaaccgtgtgcgaccaccgtnng

SEQ ID NO: 19877 - DNA, 1000 bp, Zea mays
tcgagccggcgagagcgtctctgccttttctggccggggttcaccccgcatgcacgctctttctgtccctcgtgccgacgaccgaccgaccgccgccgccgccgccgccgccaaggtcttcttcaggccactcgccggcaacgagcatccaccaggaaaatgttgtgaggactgatgcaataactaagcttgctggatggacggatgcgattgcatcgagccactatggcctaccgatgatcttctcgtcaagtatcagtacatctcagacttcttcatagcccttgcgtacttctcgattccattggagctcatatattttgtgaagaagtcgtccttcttcccatacagatgggtcctgatccagtttggtgcgtttatagttctttgtggggcaacccatctgataaacctgtggacgttcaccacacatacaaagaccgttgcgatggtcatgaccatagcgaagatttctacagcagtcgtgtcttgtgcaactgctttgatgctcgttcatatcattcccgacttgttgagcgtgaaaactagggagttgttcttgaagaataaagctgaggagcttgatagagagatgggacttataaggacgcaggaggagactggtagacatgttaggatgcttacacatgaaatcagaagtactcttgatagacatacaattttgaagactactctcgttgagctaggaaggaccttgggtctggaagaatgtgcattgtggatgccatctcgaagtggctcaagccttcagctttctcatactttgcgccaccagattactggttggatcatcggtgccaatgaatcttcctgtcgtcaaccaagtgttcagtagcaacccggccttcctgcttccagtagtatgtcctaccagcggattgaattgcttgttctggggtgtgcggcgcgcgccccgttgattgttctgttgtaacttgtaatcccatattaatcgtgtaatatgaaattcaatgcaaat

SEQ ID NO: 19878 - DNA, 2433 bp, Zea mays
tcgaggccggcccgcgagcagccgtccactgccttttctttctcccgttcaccccgccgtgcacgctctttttgtccctcgtgccgacgaccgaccgaccgccgccgccgccgccgccccaaggtcttcgtaaagccactcgccggcaacgagcagccaccaggaagatgttgtgaggactgatgcaataactaagcttgctggatggacggatgcgattgcatcgagccactatggcctaccgatgatcttctcgtcaagtatcagtacatctcagacttcttcatagcccttgcgtacttctcgattccattggagctcatatattttgtgaagaagtcgtccttcttcccatacagatgggtcctgatccagtttggtgcgtttatagttctttgtggggcaacccatctgataaacctgtggacgttcaccacacatacaaagaccgttgcgatggtcatgaccatagcgaagatttctacagcagtcgtgtcctgtgcaactgctttgatgctcgttcatatcattcccgacttgttgagcgtgaaaactagggagttgttcttgaagaataaagctgaggagcttgatagagagatgggacttataaggacgcaggaggagactggtagacatgttaggatgcttacacatgaaatcagaagtactcttgatagacatacaattttgaagactactctcgttgagctaggaaggaccttgggtctggaagaatgtgcattgtggatgccatctcgaagtggctcaagccttcagctttctcatactttgcgccaccagattactgttggatcatcggtgccaatgaatcttcctgtcgtcaatcaagtgttcagtagcaaccgggcaatcataataccccacacatcttctttggcgcgggttcgacctcttgcagggcgatatgttccaccagaagtggccgcagtccgtgtacctcttctacatctttcaaactttcaaataaatgattggcctgagctctcagcaaaaagctttgcaatcatggttttgatgcttccatctgatagtgctagaaaatggcatgtgcatgaattggagctggttgaggtcgttgctgatcaggtagcagttgcactatctcatgcagctattcttgaagagtccatgcgggcacgtgatttactaatggagcagaatgttgccctggatttagctcgaagagaggctgagatggctatccgtgctcgcaatgatttcctagctgttatgaatcacgaaatgagaacacccatgaatgcaataatagccctttcctccttgcttttggaaactgagcttactcctgagcagcgtctaatggtggaaacagtactgaaaagcagcaatttgttagcaacactcatcaatgatgttctggatctttccaaactcgaggatggaagccttgaactggagattaaagcattcaatcttcatgctgttttcaaagaagtgatgggtttcattaaaccaattgcatctatcaagaggctatctgtatcggttatgttggcaccagatctgccgttatgtgcaattggtgatgaaaagagactcatgcaaactattctgaacatctctggcaatgctgtaaagtttaccaaggagggacacatcacgcttgtagcttccattgtgaaggctgactctttgagagagttcagaaccccagaatttcatccaactgcaagtgatgaacatttctatttgaaagttcaggtaaaagatacaggctgtggagttagtcctcaggatctacctcatgtattcacaaagtttgctcatcctcaaagtggaggaaaccgagggtttaatggtagtggtcttggccttgccatatgcaagaggtttgtcagtcttatgggagggcacatctggatcgacagcgaaggaaccggaagaggttgcaccgcaacattcgtcatcaagctcggcgtgtgtgacaacacaaacacctaccagcagcagctggttcctctagtctggccaagcagtgcagactccaatttgtctgctccgaaagtgctgcccgacgggagaggatctgtttccctgaaatctcggtaccaaagaagcgtatgagctcagtgtaaatgattgacggcatagtgccaagtaggggatcgattagtgccattgtctaattttgtttgtaacccagtcatagcaacatatagtgtacaaataatgtaaagccaatggagactgcagctgtgtatctgggtagcaacgctgacttgctgcattgagtagtatgtcctaccagcggattgaattgcttgttctggggtgtgcggcgcgcgccccgttgattgttctgttgtaacttgtaatcccatattaatcgtgtaatatgaaattcaatgcaaatacacggtcacaagctgttttcgctcccctcgctcc

SEQ ID NO: 19879 - DNA, 2545 bp, Zea mays
  misc_feature (2545)..(2545): n is a, c, g, or t
gggtaccgggccccccctcgaggtatttcgtttggaacacgtatttgtggccaaggggaggttctcagaagttaatcatatatatatatatatatatttattcttatgtaatgtgttagttatagaggttttctggcttcaaaatattttgactcctgccaataacttatatgtgttcctgttcttatgttgttttagttcaggacgattttcaattctttgccaacgtgacaacacatatagatactaacagaatttgttgtttgagatagaactatgaaagtagatactaatagagaattcttttttcttgccaaaggcacctgtgctggttgtcgccatagccaggaacactacttgagaactaatctagatattcagttagttcgaaggattgttagttagttcaaaggattggcaagtttctaggttcgactggcagttagaattgagagaattcttgtttgttttattatttttttgcctatcaaattccacatagctcgtattagtgttagcattgaacctctagatgtggtagctcaggagtatccttagccacatctggtgtggtctgtaacacagtagcgaagatgtgtagagagcaaaggatatatcatccatatcacaaaaaatatgtttcaattttggaggatgaggaggaacaaatggtaatagtgaattttttagcattcatttcctttcctttgactgaatacttatatttcactattttttaggatgaaccagattgttgataagttgatagattttgaagttgatggcttgatgtcgaaccaaggtaataattattttagtatcattttctttactttgattaactactaaatacttatattttcttaatttctttgctttgttgtctggtggccaagtggtgtgtggtgttgtctatcaagtgacaagatcaagtatttaagtgtgaagttgctgtgcaagtgaagtgttgctggcgcttgtgcaagtgaagtgttgctagtgccttgttgtctggtgctgccttaacctgttggctctgtattagtcatgggtgttgtctgttcctgttcgcatgttcttgtctgtgtggggtactggggtacttcctattcgcctgttactgttcgcaagtgaagtcatgggtactattgtcgtgttggcttgggcgcttggttgtatgcctgtattcttaattagactattactgtgaggtgtcaacttagttgcagtttctggaatttttgtgaactaaagttgcttgttatgattgctgcacacgttcaagtcatttcctcacgtccatttcagttttcagctatgagtagaactactccttttgtatcgtatgtattacaattgctgctttgtgaacttagttgcttgtattacatgattaccattgctgttaagctttttgatatatgtacctgtgggtatccgatacccgacgagtacgggcacgggtataaatttttatccatgggtacagccatgagtgggtatgaatgagtatggttgtgggtgggtatgaaacatactcgattctaatctgatctgttgctattcctaccgtcaacctgcatggatttgtgacttctcccttgattttgaacaggccaagaacatcaaattcacattggagcaacatatgttctttgcaatattagtttggtaatttaaggtggcaggcgatattgctccaatcaagattgagaacttcgattgatctctgagagagtggtgtctggttcgaggttttgtacacttaacccgattatatgttcagtacattagccattgtagtgtctttttggaatataacttcattttattttagaggattgatcgaaaactcattttgccatgtaactatattgttatgccatatggaaaacatcacacaacgacctagattttacatatcatagtgatgtttgtcgtttcgtatctatattttatactaatttaacttacgtggcaacacactagcacatatctattataataatatttgtcgtccgtatatatgtatcatactattttttttcacttccgtggcaacgcacgtgcactgacctagtatatatataagttgagtagacagggaaatcctttgacctgcctttatatatgttgacaaaagcgagaaattgcaggcggtcaacatcagttgcagttaggaccttgaaggcagattaaaaaaaaaatccataaaggctcggggtggggtgggggggagtgtagggggcagggcagacattggttgaccggagccggaagagatccgactctatcgtgtctttctggtggccggcgactgcaaacaccgtcaggagggctcacatacggcgaccccgccggagtaaacaatataataggcgggaacgggtgattgcgtaagcgaagaagacctgtttgtactcttgctgtcgacgacattatattcagtgaagcacgtcatcaggatagggttccggcggcttaaggacttgttcgtttgtgtcggattgcacccggaaccgttccagctaatcaaagtttatan

SEQ ID NO: 19880 - DNA, 1183 bp, Zea mays
agttttaacatctagatacatgatgcaatagctctaattcttatttggtattacaggtgatgggtttcattaaaccaattgcatctatcaagaggctatctgtatcggttatgttggcaccagatctgccgttatgtgcaattggtgatgaaaagagactcatgcaaactattctgaacatctctggcaatgctgtaaagtttaccaaggagggacacatcacgcttgtagcttccattgtgaaggctgactctttgagagagttcagaaccccagaatttcatccaactgcaagtgatgaacatttctatttgaaagttcaggtaatattctagaagaggcttgtttgaataattttccttgagcttgtcaatgagctcatgatctttccatagtataaataaaacaagaagatttatttgcaaatagttgtatgcattgttccctctttaataacaataataacttaaaagatgacctgcatgcgttgtgcagagctccaaaattcaaaaatgaaactggagccatccatttggttgtcccaagtagcagttttgtaaaaccgaattgcagcctgtcgaaaaatctcgactctttcattgtacaacatttctaatctgttgtcttatctccttatgtgtgactgaatttctcatgcactctggttttggatccatccactatgttcctcataatgaagtatttcatgcttattcagtagcaaaagacaatattttttcttgaaaatcctcttaattaacacgtgcattttcttgtatgaatcgttacctattccttttaatcatgtatcttggtaattaattgcatttgcatcattaaacctggctcgactcttgtgttgcttgatagttcatttgtcttgtctataaactatgtgggtgtcagctctgtataggtccatgtacaattttccaattcttcctatcaagtttacaaaaacaggtggggcctgtccagctgtacctgactatgatttgggggtgggtggggtctgaatctttttctttgttcttataatctcatggtgtagaatttctgctggttgggcctgatgacacttggaatctgattacttctttacaccattgtgacattagttgactgtcattcgttgcttttttatttgagttgcctgggataaattagtctcaggactgacata

SEQ ID NO: 19881 - DNA, 1309 bp, Zea mays
  misc_feature (1062)..(1062): n is a, c, g, or t
  misc_feature (1078)..(1078): n is a, c, g, or t
  misc_feature (1083)..(1083): n is a, c, g, or t
  misc_feature (1133)..(1133): n is a, c, g, or t
  misc_feature (1140)..(1140): n is a, c, g, or t
  misc_feature (1161)..(1162): n is a, c, g, or t
  misc_feature (1167)..(1167): n is a, c, g, or t
  misc_feature (1183)..(1183): n is a, c, g, or t
  misc_feature (1196)..(1196): n is a, c, g, or t
  misc_feature (1200)..(1200): n is a, c, g, or t
  misc_feature (1208)..(1209): n is a, c, g, or t
  misc_feature (1211)..(1211): n is a, c, g, or t
  misc_feature (1219)..(1219): n is a, c, g, or t
  misc_feature (1221)..(1221): n is a, c, g, or t
  misc_feature (1238)..(1239): n is a, c, g, or t
  misc_feature (1241)..(1241): n is a, c, g, or t
  misc_feature (1247)..(1247): n is a, c, g, or t
  misc_feature (1249)..(1249): n is a, c, g, or t
  misc_feature (1251)..(1251): n is a, c, g, or t
  misc_feature (1253)..(1253): n is a, c, g, or t
  misc_feature (1257)..(1257): n is a, c, g, or t
  misc_feature (1267)..(1267): n is a, c, g, or t
  misc_feature (1272)..(1272): n is a, c, g, or t
  misc_feature (1277)..(1278): n is a, c, g, or t
  misc_feature (1283)..(1283): n is a, c, g, or t
  misc_feature (1287)..(1287): n is a, c, g, or t
  misc_feature (1289)..(1289): n is a, c, g, or t
  misc_feature (1293)..(1294): n is a, c, g, or t
  misc_feature (1297)..(1297): n is a, c, g, or t
  misc_feature (1301)..(1301): n is a, c, g, or t
  misc_feature (1304)..(1304): n is a, c, g, or t
  misc_feature (1308)..(1308): n is a, c, g, or t
gccggccgggctcgggaaaaaaagagccagtgaacgcagtgcttagacgacttacagaacagcgccggcctgccggcaccctgcctattctttctcccgttcaccccgcgtgcacgctctttcccttcctcgtgccgacgaccgggcgaccgccgcgccccggcccgcgcccccttgtctcgggccactcgccggcaacgagcagccaccaggaaatgttgtgaggactgatgcaataactaagcttgctggatggacggatgtgattgcatcgagccactatggcctaccgatgatctccttgtcaagtatcagtacatctcagacttcttcatagccctcgcgtacttctctattccgttggagctcatatatttcgtgaagaagtcgtccttcttcccgtacagatgggtcttgatccagtttggtgcgtttatagttctctgtggggcaacccatctgataaacctgtggacgttcaccacacatacaaagaccgttgcgatggtcatgaccatagcaaaggtttctacagcagttgtgtcctgtgcaactgctttgatgcttgttcatatcatccccgacttattgagcgtgaaaactagagagttgttcctgaagaataaagctgaagagcttgacagagagatgggactgataaggacgcaggaggagaccggtagacatgttaggatgcttacacatgaaatcagaagtactcttgacaggcatatgattttgaagactactcttgttgagctaggaaggaccttgggtctggaggaatgtgcattgtggatgccatctcgaagtggttcaagccttcagctttctcatactttgcaccaccagattactgttggatcatcggtgccaattaatcttcctgtcatcaatcaagtgttcagtagcaacccgggcaattataataccccacacatctcctttggcgcggattcgacctcttacagggcgatatgttccaccagaagtggctgcagtccgtgtacctcttctccacctttcaaacttccaaataaatgattggcctgagctttcggnaaaaagctttgcaatnatggntttgatgcttccatctgatagggcaagaaaatggcatgtacatgaattgnagctggntgaggttgttgctgatcaggnngcagntgcactatctgatgcngctattctggaanagtncatgcggnncncgttgatngnctaatggaacagaacgnngncctgcntngntnatgntttgagaggnttagnatgcnncgggngggncngcgnnatngatngcncgtng

SEQ ID NO: 19882 - DNA, 1097 bp, Zea mays
gcctaactaaaactattctttctcccgttcacccgtgcacgctctttcccttcctcgtgccgacgaccgggcgaccgccgcgccccggcccgcgcccccttgtctcaggccactcgccggcaacgagcagccaccaggtccgcaggatggcaccgacttttatggagctagcactcgagcaggctaagtttgcgctggataacctcgaggtccctgttgggtgtgtgattgtggaggacgggaaagtgatttcctctgggagcaacaagacgaatgccactcggaatgctaccagacatgctgagatggaagctattgacgtcctgcttcgggagtggcagagcatgggtcttgatcagccacaggtcgcggagaaatttgcaggatgcgacctttatgtcacgtgtgagccctgtataatgtgcgcgacggcattgtcgataattgggataagagaagtatactttggttgtgccaacgacaaatttggtggatgtggatcaatcatgtcattgcacaatggtgctgcttcgtcgtcagatgatttatcagggagccaagcctctaaaccaaaaggtttcaaatgcactggagggatcatggctgaagaagcagttgctctttttaggtgtttctacgaacaaggaaacccaaatgccccaaggcctcacagaccagtacgaatgcctcaacaataattggtttgttttcctggactacaatcataacgcaaaaacttcaggagtgcagacatacaaacttactgtaaaacttgtttaagattctttgtatgctttaatgtgacgcatgtatgctatttgatagcgtctttttagtctgggagcgcagccacatttcttgatcggaccatgcaagttggtcgatttaaaaggatctgtgacaggagagtttgccagtgtccgcaaaatcagcattatgcaattggagtagattgttttcatcatttgcaatcttgaaagaaatattctgtaatgatgtagatacactgcaacgtcattgactcgtgatatggtatgcttttctttgtacaaaaaaaaaaaaaaaagtactctgcgttgttaccactgcttaaggaa

SEQ ID NO: 19883 - DNA, 1230 bp, Zea mays
aaaaaaaaaaaaaaaaaaaaaaaaaaaaaaaaaaaaaaaataaaaaaaaaaaaaaaaaaaaaaaaaaaaataaaatgctctaccggggtagcgcaactccgcaagcaaatcctcctatctccaagcctccaatctgtgaacggtgaaccccaatcgaatgacgccgacggcgagcctcctcctcccggctcccccattcgtctctatctccgatgtgcgccgcctccagctccccccgcgcggcggccaccggcctcgcccctgctggaagggcttggagtgcggctccgtacagacgcggatggtctcttctttcgttgggagcagaacacgccgcagaaacgttatatgtgcttccctgttcggagttggagctcccgaagcactggtcattggagtagtcgccttgttggtgttcggccccaagggtctagcagaggtagccaggaatttggggaagactttgcgtgctttccaaccaaccattagagagatacaggatgtatcaagggagttcaggagcactcttgaacgagaaatcggaattgatgaggtttcccagtcgacgaattatacacccacgaccatgaataacaaccaacaacctgctgccgactcaaatatcaagcctgcacctgcaccttacaccagcgatgaacttgtgaaagtaactgaagaacaaattgctgcatcagctgctgcagcttggaacccgcaacaacctgcatcgtcgcaacagcaagaagtgtacactactccgagtgaggacgctcctacatcaggaggaagcgatggtcctgctgctccagctcttgctgcgagtgactcggatccaaagcaagtgaatctggacaaggcggaaacacagagatgactccgcttaacagcttgacactggatgggatgagcacactgaacacgtcaggacgagcagtcttattttaattttgtaggcgatggacttcagattaaagccagttatttggactgctgcagctataatctatagagacataacactgtaaaaatagtagaatccgttttagattaaagccaaacgagatgagagcgttttctgtgtttactaggcttgttctgtagcagcatgcatgggcaggttcatacaaaaaggctatgtgtatgcgtaacataaccacgagtttatatggattaaatatatttagccacgttgaaaaaccggttcagttaataaaataatgtcagttggtt

SEQ ID NO: 19884 - DNA, 1128 bp, Zea mays
cctagggggtccacaggcaaatcccctatctccaacctgtgaacggtgaaccccgatcgaatgacgccgacggcgaacctcctcctcccggctcccccattcgtccccatctctgatgtgcgccgcctccagctccccccgcgcgtccgccaccagcctcgtccctgctggaagggcgtggagtggggctccatacagacccggatggtctcttctttcgttgctgtagggagcagaacacgccgcagaaacgttatatgtgcttccctgtttggagttggagctcccgaagcactggtcattggagtagtcgccttgttggtattcggccccaagggtctagcagaggtagccaggaatttggggaagactttgcgtgctttccaaccaaccattagagagctacaggatgtatcaagggagttcaggagcactcttgaacgagaaatcggaattgatgaggtttcccaatcaacgaactataggcccacaaccatgaataacaaccaacaacctgctgccgacccaaatgtcaagcctgaaccagcaccttatactagcgaggaactaatgaaagtaactgaagaacaaattgctgcatcagctgctgctgcttggaatccacaacagcctgccacgtcgcaacagcaagaagaagcgcccactactccaagaagtgaggacgctcctacatcaggaggaagcgatggtcctgctgctccagctcgtgctgtgagtgactctgatccaaaccaagtgaataagtcacagaaggcggaaggagagagatgactccgcttgacagtttgacactggacggaaagagcacagtgcataggtcaggacgagcagtcatgttttttttttttcattttgtagacgatgaaatagttgtatgagagcgttttcgatggttaggcttgttttgtagcagcatgggccaggtagatgaaaaaaaggctatgcgtatattatttcccacgttgtgtggccgcaattgtttttcaatcgtaagagtaacttcaagacactctctgtattctttttaattgctaggaatagatttttttgtaaaaaattttcttcaaaagcttatttaaatgattatctgaatatatctattttttt

SEQ ID NO: 19885 - DNA, 999 bp, Zea mays
cattgggtacctcgaggccggccgggaggcggtccacaagcaaatcccctatctccacctgtgaacggtgaaccccgatcgaatgacgccgacggcgaacctcctcctcccggctcccccattcgtccccatctccgatgtgcgccgcctccagctccccccgcgcgtccgccaccagcatcgtccctgctggaagggcgtggagtggggctccaggatggtctcttctttcgttgctgtagggagcagaacacgccgcagaaacgttatatgtgcttccctgtttggagttggagctcccgaagcactggtcattggagtagtcgccttgttggtgttcggccccaagggtctagcagaggtagccaggaatttggggaagactttgcgtgctttccaaccaaccattagggagctacaggatgtatcaagggagttcaggagcactcttgaacgagaaatcggaattgatgaggtttcccaatcaacgaactataggcccacaaccatgaataacaaccaacaacctgctgccgacccaaatgtcaagcctgaaccagcaccttatactagcgaggaactaatgaaagtaactgaagaacaaattgctgcatcagctgctgctgcttggaatccacaacagcctgccacgtcgcaacagcaagaagaagcgtccactactccaagaagtgaggacgctcctacatcaggaggaagcgatggtcctgctgctccagctcgtgctgtgagtgactctgatccaaaccaagtgaataagtcacagaaggcggaaggagagagatgactccgcttgacagtttgacactggacggaaagagcacagtgcataggtcaggacgagcagtcatggtttttttttccattttgtagacgatgaaataattgtatgagagcgttttcgatggttaggcttgttttgtagcagcatgggccaggtagatgcaaaaaggctatgcgtatattatttccccgttgtgt

SEQ ID NO: 19886 - DNA, 1518 bp, Zea mays
tcgaggccggccggggacgagatgagaccaagaaaagattcgcggcggtggagtcggagctcaactcatcaatagggtttgatcagcgctccgctcgtgctagccacccagcccccccgcgcccacttgcgacggcgatggcttcgccgtactcgctcagctgggccgacgcgccgccctaccactaccacgggagaccccagccagcgcccgactcacccgcatcctccgacggggccgggccccgctcgctctggatcggcggcctgctgccatggatggacgaggactacctctacggctgcttcaccacctcgcgcgagcttctttcccttgtcatcaaacggaacaagcagactggccaatcagagggctttggcttcctcaaattttctgaccataccgccgctgctcatattctcaagtcttacaatggtcagaagatgcctaacgctgttcaagatttcaagctcaactgggccacccaacaacctgctcccaagaaacttcctgatccagatttcaagctcgacctggccacgcagcaggagaggcatgccgccgttgattcctcatctgatcattccatattcgttggggacttggcctacaatgttacaggatacatgctacaccatgtgttcaaggcccgctacccatcagtgaagagcgcaaaaatcatctttgacaagttcactggcctctcaaaatgctatggatttgttcagtttggagatgtcgatgagcagatacaagcactgacagaaatgaatggagcctactgttctaccaggcctatgcggattggacctgttcccaagaagaaaaattctttccgcagcaaacagtggactgagtcttatcacgatgcaaacaattcaaggctatttgttgggcaacttgaccaaagtgtgacttctgaagatctgatgcaagcctttagtccatatggggagcttgttgatgtgaaggcattaccagggaagggctgtgggtttgtcacgtactctaacagggcatcagcagaggaagccattagaatgctgaatggaagtcagctgggaggtaaagccataaaactttcgtggggttacccttctgctgacaagcaggctcaaaggaacagcggcggcgggttcggacgcgactgcttcgtttggtctcctcagtatccctacgcttacgctcagacatgccaaccgggatatggatattaattaccgatagcaagctgcccacagtgcagtgagatcgtgtgaagaaagatgtcagtcacaaggaacagctgctagggtgtagagggatttttggtccatgtttttttttctttttggaaattggttcctcctatggttgcataccgtgaagcatcggcatctggatccatacatgagaatgcaaacaacgattgaatgtacatttacacacatactgctactactatattaattactgtaccttcaaaaaaaaaaaaaaaaaaaattacgccgctcgtccattaatttttatgggttggag

SEQ ID NO: 19887 - DNA, 1960 bp, Zea mays
cattgggaccctcgaggccggccgggaccccccccgccggcagttacccttttggcttttgcgacgcgcacagacgaatcggaatttgatgcggttacacgcctgagagcgagcggtggccggcagccggcacgcatggcggcagagaagcaggcggcgatggacgggcggaaggacggggtggcgcgggaggtcatccggatggaacgggaggccgtcatccccatcctcaagcccaagctcgtcatgcgcctcgcgtatctcatagagcatgaagctgatcggaacgagttcctgaagctgtgcaagaaggtggagtacaccatccgggcctggtacctcctccagttcgaagacctcatgcaactgtactcactgtttgatcctgtttctggtaaggagaggttacagcaacagaacctgacgccggaggaaatcgagaccctcgagttcaatttcatgacatatcttttccaggtgatggaaaagagcaacttcaagttgctatcagatgaagagtttgatattgcgcaatctggaaaatatttgttgaatcttccgatcaaagttgatgaatctaagctagacaagaagttgttgacaaaatattttaaagagcacccacatgacaatctaccagagttttcaaacaagtatatcatctttcgtcggggcattggaattgatcgaacaactgactactttttcattgagaaagtagatgtaatgatatcccgagcttggaggtcattgctcagggttaccaggattgaccggttattttctaagaaacaacatttgaagccaaagaatggtacgaagaagactgatgaaattaatgaagatgaagaagatccagaattgtttgttgagagaattcgattagaaaaaattgaactaagtttgaaaaatctcatgagtaagatgacaattcaagaacctacattcgataggatgattgtggtgtacaggagggctggtacaaagactgaacctgatcggggaatatttgtaaagcacttcaagaatatcccaatggctgacatggaaattgttcttccagagaagaaaaatccatcactaacaccaatggattgggtcaagtttctcatttctgctgttatcggtttggtcactctagttggctctcttgaaatgccaaaggctgatgtatgggttgtaatagcaatcttgtctggtgtgattggatactgtgctaagatatacttcacatttcaacaaaatatgacaatgtatcagaatttgattacaaaatcaatgtatgacaaacagcttgatagtgggaaaggaactcttcttcacttatgcgatgacgtgatacagcaagaagttaaagaggtcataatttgttactacattttaatggagcagggaaaagccactatacaagatcttgatttacggtgtgaagagctaatcaaagaagagtttggcgcagagtgcaattttgatgttcatgatgctataaagaagttagagaagcttagcattgttcatcgggactcgattggaaggatcttgtgcgttccgttgaagcgtgcgaatgagatcattggtacgacgaccgaagaactggtgatgcgagcacaacagaaccttgcttcctgattccatttccagtcacgatggattgctgtaccttccctctcatctccctgcaaagcgcgcaccagaggggaagcttctgatcatcccggaagtctattcctagtctcatctccctgcaaagcgcgcaccagtaataaggaggaagctcctggtcatcctggaagtctattcacctgtacatgtgtgtatctttgcattgcagtgccttccctctcgtttggtttagcacggagtgtatatgtcaaacctggctgttacacagttgtacataacaattatatgtatttttttaatatataacagtacaaattcgttagttctccccaaaaaa

SEQ ID NO: 19888 - DNA, 682 bp, Zea mays
cccacgcgtccgcgccattggcggcggcgacgcgccaaccatcatcagccagggcaaccgctacatagcaccaccaaacatcgccgccaaagtgatcaccaagcactacgcggaagaaggcgtgtggaagaactgggtgtggcacacggaggacgacctgttcatgaacggcgccatcttcaatccgtccggcggcgcccccaagcaggtcgacaccaacgagtgggtaaagcccaagccaggaacctacgttacaaggctcacccgcttctccggcacactgtcctgctgcacgggcaagccgtgctgaaggccggtgggcatcaggctgcttcttctagctcatggcctggccatgccaggtcgcgctggctgcgtttcatttcatggaagaaagcaaggatggatcacaggttgtcgttctgctaattaatctacatacgtttgccttcaagtactgtgttgtggcattgttacacatcacagtacagtttggtcaaattttttttccacagaggaagtagggattgatttaatcattgatttaatcccacacgcgtgtatctacgtatacagtttgtataacatgaaccacctctgtttgcgattggtctaaaaataaatataatacttatatattgaattgttttgcaaaaaaaaaaagtcgacgcggccgcgattc

SEQ ID NO: 19889 - DNA, 1895 bp, Zea mays
gcacgagaccatgaccgagaacgtcctccgcccccgacgaccgagcaatggcgctcaccgccgtcctaccttcatatacctagcagtgtctctgcatagaaagataaaaggtaggaggaggcgcagtgcgtggtgggattatttgtgaggagatattggagttattatatatatatatataggtagacgatagatagacagctagatctatataaccatggtggatgggttccgatggatcagaccgggctctttcgtcctgtacttggtcttcttcttcctgtccgcagccctgtcggaggccaatatcggcgacttcgatgaatactggcagcagcgcaagctcatggccgacgccgcggctgaggccacgtacaagcatgacccggtcgaggtcgccaaccaacttaaccgtgcagtccacagatccgtcgagaaggaggacattggcacgaggcgggagatgatggggacgacgacgaggaagtctaagttcagcgggccgtgcagggcgacgaacccgatcgaccggtgctggcggtgccggcaggactgggcgacggaccggaagcgcctggcgcggtgcgccaaggggttcgggcgcaacaccaccggcgggctggccggcaagttctacgtggtgacggacggcaccgacgacgacgtggtgaacccgcgccccggcacgctccggtggggcgtcatccagatcgagccgctgtggatcaccttcgccaagaccatgatcatcacgcttaaggaggagctcatcatccgcggcgacaagaccattgacggccgcggcgtgcaggtgcgcatcaccaacggcgcgcagctcacgttgcagttcgtcaacaacgtcatcatccacaacatccacatcaacgacatcgtctcctccaacaaggacggcggctacgtccgcgactcgccggaccacttcggctggcgcaccgtctccgacggcgacggcatcaccgtcttcggctccaccaacgtgtggctggaccacctctccctctccaactgccaggacggcctcatcgacgtcatcgccaagtccaccggcgtcaccatctccaactgccacctcaccaaccacaacgatgtcatgctcttcagctccagcgacaagcatcccgaggaccagatcatgcagatcactgtcgccttcaaccacttcggcagaggcctcgtgcagaggatgccaaggtgccgctggggcttcttccacgtggtcaacaacgactacacgcactggctcatgtacgccatcggcggcagcaaggcccccaccatcatcagccagggcaaccgctacatcgcgccgcccaaccttgccgcgaagcaggtcaccaagcagcatgacacgccggagtcggtgtggaagaactgggtgtggcactccgagaacgacctcttcatggaaggcgcctacttcaccgtcaccggcggccagatcaacaggcagttcaacaagaaggacctcatcaagcccaggaacgggtcctacgtcaccaggctcacgcgctacgccggctccctcgcctgcacgcccggcaagccctgctagatcaagccaccagcgaggacggccgacgaccagaggcagaccatgcattcgccggctcgccatgtaagaaacaggggagttgaaagtgcgacacaccagagaacgtgtctgtgtatactgtgtaaaggtcctaaaggaaagagaagatgcacatattcaaagcctcggaactaattgctctgttgtccactatgttatccaagtatatatttgttcttcaaaaaaataaaaaaccgtcccgcgccctggacatggacaaacagtttagcctgcggacagtccgtctttagacacagactgtccacgattagatcataccata

SEQ ID NO: 19890 - DNA, 1212 bp, Zea mays
cgtcgacctgtggcacatcttcgcgcggtccatgatcatccagctctcgcaggatgcttgagcgacggacgcgtcggcgggcgcggcgcgcaggtgcacatcgccaacggcgccgggatcacggtgcagctggcgcaaaacgtcatcatccacaacctgcacgtgcacgacgtcaagcacaccatgggcggcctcatgcgcgactcccccacgcacatcggctcccgcaccagggccgacggcgacggcatctccctcttctccgccaccaacgtctggatcgaccacatctccatgtccaactgcgaggacggcctcatcgacgtcgtgcagagctccacggggatcaccatctccaactgccacttcaccaaccacaacgacgtcatgctcttcggcgccagcgactcctggccgcaggaccagatcatgcagatcaccgtcgccttcaaccacttcggcaggggcctggtgcagcggatgccaaggtgccgctggggcttcttccacgttgtcaacaacgactacacgcactggctcatgtacgccattggcggcggcgacgcgccaaccatcatcagccagggcaaccgctacatagcaccaccaaacatcgccgccaaagtgatcaccaagcactacgcggaagaaggcgtgtggaagaactgggtgtggcacacggaggacgacctgttcatgaacggcgccatcttcaatccgtccggcggcgcccccaagcaggtcgacaccaacgagtgggtcaagcccaagccaggaacctacgttacaaggctcacccgcttctccggcacactgtcctgctgcacgggcaagccgtgctgaaggccggccggtgggcgtcagaggctgcttcttctagctcatggcctggccatgccaggtcgcgatggctgcgtttcatttcatggaagaaagcaaggatggatcacaggttgtcgttctgctaattaatctacgtttgccttcaagtactgtgttgtggcattgttacacatcacagtacagtttggtcattttttttcccacagaggaagtagggattgatttaatcccacacgcgtgtatctacgtatacagtttgtataacatgaaccacctctgtttgcgattggtctaaaaataaatataatacttatatattgaattgttaaaaaaaaaaaaaaaaaaaaagcggccgcgacgacgcggccg

SEQ ID NO: 19891 - DNA, 946 bp, Zea mays
agcgggaatatccaatttttccacacaagggaaaacaggcttatggcccagcccgctctttttcggctctggggccgcctgatcgactgttgtttaagaaatgtgcagcacagtggacatatattacacaacattatatggtgcactacaatggttggaatttggaaataagtaccaactactgaactgaaatggacaggatattaagtacatatgaagggtggaataacagagttcttcgtgtcctacaagtagcatagcgctaatttattattacaaccaccatgcctggtaatagtagattaaagagtgctaaggtctctgccctgtgcagagagagagggagggagtgaaggggggcctggacctaaccatggtagtgacactgagaagtaatgacatctacatgagtggggtgacccaagacaacaaaaattcatctatgggtccattgtgttaatgagttacacagcagtgcttggttactccaaagccttctttggagtccccaatgctgtgtttcgagggacagggggtagtgccaagtgctaaaaacaaacattggcactactctgaacctgtttctgattaggggcacaggctctccttagagccttgaccacctagatgcaagctatcaactgaaagatcaaataaattgttagttggtgcatctaatcttttgcaaagaaaagatgagttggttacactagtcgctggtcatatatcatatgcatttggtctaggtaacaccgtaacagcaggactatagaagggtaggtttgcctaaatggtttatgcttcaacaagaaatgtcaggcctaagctaggtacagtgggggttctaccgtggattgggggggctggcatgctagttcagttatttagctgtcattgtagtccaatttgactagtatcagcatgaaccctccttgggtcatgcttg

SEQ ID NO: 19892 - DNA, 1955 bp, Zea mays
  misc_feature (217)..(217): n is a, c, g, or t
  misc_feature (328)..(328): n is a, c, g, or t
gaactaaaactctagagatgctgcttgtactagtagcagcctagtactagaatctcctattaggtgggggtgttacctcaagattctaaacctttctagtcttaccttgttatatgaagtaaatgctttcaaaggcatactttcgcagatgtaatattgcattcaactggaacatatgcaactgaacggcagatgactagattctggccgccaggantgccaaacgtccagattccgtgagaatcgtccaaatcaacgtgaacacagaatcagccgagtcatgtgatagaagaaatctgtaattttctagatcctaaaccttgtgganaccccccttctctcaaaaaaaatattcagattctctctacacctagtttttcctcataaacaaattctcagaaaacctcggcccgcttttttttttttttttttttttttttttttgtgcagcacagtggacatatattacacaacattatatggtgcattacaatggatggaaataagtaccgactactgaactgaaatagacaagatattaagtacatatgaagggttgaataacaaatagttcttcatgtcctacgagtagcacagcgctactttattattacaaccaccatgcctggtaatagtagattaaagagcactaaggtctctgcgatgtgcagtgagagaggtgggggacgcggttggggaggggggcctggacctaaccatggtagtgacactgagaagtaatgacatctacatgagtggggtggcccaagacaataaaaatttatctgtgggtccattgtgttaatgagttacacagcagtgcttggttactccaaagccttctttggagtcccaatactgtgtttggagtgacaggaggtagtgccaagtgctaaaaacaaacattagcactactctgaacctgtgtctgattaggggcacaggctctccttagagccttgaccacctagatgcaagctatcgactgaaagatcaaataaaatgttagttgatgcatctaagcatttgcaaagaaaagatgagttggttacacaagtagtcgctggtcatatatcaaatgcatttggtctaggtaacatcgggactatagaagggtaggttttgctaaatggttcatgcttcaacaagagatgccatgcctaagctaggtacagttgggattctactaatgacatgtgggagtggcatgctagtcagttatttagctgtcattgttgtccaatttgactagtatcagcatgaaccatccctgggtcatgcttgactgttagtttcttttagctacagcattgtcttggtacggctgaaattaactctcccagataaagtccttccttggactattgttagaatggttggggtttgtacttgtctgttagaacaccccatccttggggcatgaagctttatgcccatcctggggctaaagctaatatccattcaccacatgaccatgtgggatatggaggtgagcactttgactgataagcgtgatctacaatagtgccttttggtgttagagatggatgcatggactcaaacacgtcggaaacgagacagtacaacaacggtgagaagggagaccatggttaggccaagggttgctctggagcagcagaaactgcaaagtgcgagggaatcaaccggtaaggatgagcagcctgtgttggagttggcagggttggagctgtgagtgcccgtcccctgcccctttaatggggatacacactgtcaagatattagtatcacaacttagcagaaagaaattattcaaataattctgagaacatgggaagtgagtttcttatcaaaccaatgcagacatatttttttatcacactttctactgttttcaatgcatgcacaattggttatattcttgcactgtaacttggcagattgacaaacgaatgctggtaggttattagaacaat

SEQ ID NO: 19893 - DNA, 3875 bp, Zea mays
taaaatattaaaaatacatacctctaaaagttaaaaataaaataggtctttaataaaatatttacatataaaggacgagatatgatgccgttaaagagaaatgagataagaaatgagatataaatgaagagttttttttagagaaaaccataaaaaaacgaatttaaagatggaattttggtgatatcgcgggagactctaatgttgggccattaacttcatagttttggttcattaaatcttacgtattagtttttctcgattcgtcggacagtcaggctcgggcttcgtttcagtcttacagatatcaatcgcaattcgcacctcctatcaaaaaaaaaaaaaaaatcgttcgcacctcctttgtgccgccgccgccgccgaagagcgagtgtcccgccgactttgcgctgcgcaccacggggcgccgggagcgtgcttcactagacgccaggtactgaactttcgaatcctctcctctggcctctgcaatctgcatttttggtgaaacccagacggaccaccagtgccaccagtgtatcacaaacatcacggaaaagtattcaatcacgccttctcggtcaagaaagggaaatattttgtcggctacaagcttaagactatactgtatgagtatgaacatggcgaatttacaaggtagatattgaactcttttttacaaacacgcgcgtagacatttactgcagttacattatctgcagaaaattcatgacttcagagagcttatttgccactagtacccatgcgaccttgagaatgcagtgccaattagagaagggaatatgcagtttattagcaaggcgatagagaatgtttataatccttcagtagcagggatgcggcctgcattagcgaacaaaattgctgctcttattgcttgggcatgagacctaatcttcctttttatcggatacttataatctactatcaacgtgggcttgccaggattcatgtccagggatttctgaaattcatcttttacggcctccacctcctcgggcatgatactgtacattgttttaacagagacatgctccagggacatgaggtgctccaaaccaaagttacaatcaccatacttatgcattacctctttcaccccgaacactaaatgaagttctttgaggttttgcatacttcctggtgcgaacaccaccgccatggattcataatcgatttgcatctcagttaggcaccggaatggataacacttgccaatgaccaatctttcatctctggtttccttcacatgtatactgagacaacgtagagatggtatgctcccaaggacatgaaaatcctgtgctcccagagctaatagttcaatgtttatgctagacaagaagcagagcgatgacatccatcttggcactgcagtcgactcaatatcaatggagcaaagatgttgaggaccagggtacaatttgtcacattcggaacataggctgctcaccatggtaccttttatttccatggatttgaggctgacaaggttagatagacattggatgaaaggttcctcatagctctcatcccaatcacaaaagtcgatggccaaggtccggagattggtcagacaccccagattatgcagcatgcttggtaacttgatagttatgatccctttaacttcttgtagagaggttagttttccgaatccatctggcagtcttatgccccacatcggcctaaaacaaagacgcagtagctgtcgcaagtgaataatggttggcatctttactttgtgcccaagattacttatgtcaagtacttgcaaaaattgtagattctgaatctcccgtggcatctcagtaataaattccgcattgagactcaaatatctcaggtgaaacatattgcgaatatctttcacgtggcgattcctcactcccttacatttctttaaattcaatacacgtaagaccagaaaggccgaaagttttggcatcaactggaacactttagtggacacagtaagtgatcttacgtgggagaaactcattgtagccagctgcttgacttcctcttcctggctaatttggagggataaccggtggatctttttaggcagatcaagagatatgggctgttgctcacctacttttgttagaaaatgctcctcatttgacaagaaactgataagatcaaggaccatatcatgtatccgacaagaaacagtcttaccatcacggccaatatctacaggttccaacatacttctgttaattaactcttcgatgtaatcctcgcctacttcatataaggtctttccctgttcttcatggacaaaaccttcaccaatccatttccatatgagacctcttgttttaattctgtagtcttctggaaacaaacttaggtatagcaagcaagtctttagatgtgaaggtaggtcataataactaactgatagtatccttctcatattcttcacattagtactgccatttagaccagaacccatggattggtacacatgtgaccaatagttatgtgtatttatttcctttccagttttatcggctagcatacttgccatggtaatgatagctaatggtacaccaccacatttctgtaagattttaccagccacttcagctaaattatctggaggacatttgtcttcactgccaaaaattctttggcagaataactttgttgagtcactgagagaaagaggttccatttgataaacacttccagcttgttttgcaacatcaatattacgagttgtgataattattatacttccacattcattgtgcatcaaagaaggggggggggggggactagtgagctccttccatatgtcatcaatgacaatgaagtacctcttgtgcagaaggaacttcctcagttcccagattagttgttcttcactccatgttccttgattgatgtccctgtatttgtctccatcaagctggtagagcatgtttttgaaaaccttgacgacatcaggattatgagacacataaacaaatgccccacagccaaattgccctttaatcttctcatacacaagattagcaagagtagtcttgcctaaccctccaaagccagcaatagacagtacaactggctgcttggatgcctccttgtcgccctccatgagccttctcacaaggtcactgctcttctcttcggcgccaacaagttctgtcgcctttctgtaaagagccgacagccgcaggttgtcgatgcttctgccaacaggcttggaaggaaccaaatcaaccttgtacctgtcacgccgttcactcacatcctttatgcggctcctgatctccttgatgtctatgccgatgctgtgttgaatcctgccccttgtcagcaggtggaggcttctatcaatcctccccccgaatctatgtggcttgccatcgccaactcgcaccatgaatctgtcgatgctgtcctcgaggtcgtaggacagctctctcacctcccttgtccagagcttgacttggatgtcaggtgggtggtcgatgggtgcctcggagaccttgatgagagcagcctccatgctcttgagctcagcctccaggaacatgatctcacccctcaccttcttctgcaggttatactcctccttgatcaggttggccagcttgggcaagagagtgcccatcgccccggtgactatctccgccatggttgctcagtcagagctcttaccgaccagcaccactagttgtaaagtattttgttaatgaagaaaggtttatctatacattattctttgtttggttggctcaaagcttttactgttgattcatgatgatatgagcaggtggctagcgataaaattctataatggatggagacagaatccgaccagggatagtggtctc

SEQ ID NO: 19894 - DNA, 1580 bp, Zea mays
ttttttttttttttttttttgagcaaacactagatcataccactgcattaaacctttacaacttatcatctgtttgtttacgacccttccaaaagggacataatactaaccctgattgtcttcagccacttcactaaacattgaacgcttcacttaatcacttctatccccatgcaataaacaccagacaaactgaactgataactacaagaccttcgaaggtcgtttattactgttgttcaagcctgtcatcggagtatattacacgagtaaaggaacaaaggagtgcgggaagagggccaagtaagcaaacaattcttttgaatccatgtatcatcacgcagacatcttagacgctaggaccgagctttgcctcaattgaaggccgatgaagaaaatggaaaggaacaggccataatcttctgggtctacgtcccactgaccatctgattcgtcccagtgctgcatgagatatgatttaagcattagttcgctgaatcattcttgctgctcagatctttggggttaccagttgcaatgcgatagaagtaaaatgctgccaccactccactgagaagaacaatgaagatttttgggaaccaaccattctgaagtagaactgaaaactccctgaagaagatgacaagagctattgcagcttgccctttcaccagaagacgaggccgacgatcgccttctctgtgtgacctcaaacttgagattcccagagtcaacaatgcaaggccaagaacaataccaaaacgaagggcagaggtacttccgggccaacatgaagttgaggaaaccccctacggtaagaaaggtaccaaacggaatgcccacatgataatcctcatactctgatggccaattcaatttcccaagagccctgaacgttgttgtgatatccttgatcgagtctggggagttccgagctgccatcatcagatattcctgtccctcctgaccaatttcggtagctaccacgctcaggtccttctgtgctttgtctgcctgtatcttcagcttctctgatgcttccagcaagacctccctcgtcctctcggagtagacatcataagcctgcattgacagggcctgcatccgcagggcctcggccttgaactgctccagcattaccttccaaatttcctgagcctcctcgggctttatctccccgtttctgtcatcccccacctctgaaccctcggtttgctcccccgctagggcggcgacaacgtggcggtcccggggtgcccccctccccgcgaaacggcgactggccgagatcgcccggagtgaaatctcgaggtggcgattggtcgagaacgaggagcgcgtaaggcgtagggatggggcacacgcgagggggtgaaaggcggcggcgcccgcgcgggcgtgctgggtggaactctggagcgaggcggcggcggcgtggaggagagaggcggccatcggggcttacgcgccgcctctggaagggaggagacgggaggaagtggcgagctggcgagtggtgggggtgggagcggcggacggctcgaaggagagtggccgcgatgggaaacggggagttttgt

SEQ ID NO: 19895 - DNA, 3270 bp, Zea mays
  misc_feature (396)..(396): n is a, c, g, or t
  misc_feature (858)..(858): n is a, c, g, or t
ttctactccattatttaagatcatgaaaagctgcgtaagactagagcctcgccatctctttcagtaaatttcgttttagcgattcgaggctataaatcggattcatagactcccttttttttccctttcttctcgtttggtagaattcacgagccattgtcactcatcgtctgcgcgaccactgcgacggtttcacgctgcgccttccctcccgccaccactggcccacgccggcaggaggtcgaataattattttcccccttgttttcccatcatcatcttcacgtcttgtagcttagccatagccaccataaacacgttggccagctcgggccctgggcaccataaacatcaccgaggagatcaggtgctagccctcaattacccactcaggtnttgttcgagggggattgaagatggaatgcaaagggatttagggtacgtttggttggggaatcaactgagatggagcggctccattccagtttttaagaattgagttatttcattctatgtttgacaatcagaatagagccgttccattttttttaggatttagagtttatgatttgccagagtagtcgaattttttagagtttgtcagagtagtcgaatttatgtgagaacggtttacatgacccccatatattagacatctatctttgatttattttattttaaattatttatttcctaataacatgatttattttctctccatatatcccctccgatttccttatcatcaatccgactctaaatgtggtcctattttaattttgatgactatattttagtgctccatattagagatgctctaatagagcaacgtagagataaaagtttcactcctcagancgccttaaagaatctctagttgagttggttagacgatctgagtaacactcctcagatccttagttcgattctctaggtgagagaaaagtttgaaggttttttttgacatgtgtgagaatgtattcttcttaacatgatgcttgaaagctgtcttagctaggggtgacaatgagttctaaatagtacattatacaatttaaagatcagattaggatcaaactttatttatatttattttcaactaaaatttatttacgaccttaacaaattacgaagaaacatttgaatcacgatccagttgttagggcagctccaacaacaacttacgagctaactcaaaacatatcatttcataatctaatagaagagggtggattatatcttgattcaaagcttgtctcatatatagatatttcaagagtacaagtacatttagatatttccagactatatacgaggatgtcactttaatattattcattttatatttcaagactacacgagaatatcacgtggagcagcaattcatattgcaaggtaatcccttcgttcttttttgtttgttgagttttagtaaaaaattaactaactagcgagcgaccaatatttaagaacaaatgtagcatatggcctggtatggccgtatgggctaaaagtttgtgccatcgaagaggttaacttagagttagagcaaacaactagatcgtaccactgcaggtaccctttacaacttatcatctgtttgtttacgagcaagcgagaaggtacataatactaaccctgattgttttcagccacttcactgaacattgaacgcttcacttaatcacttctatccccatgcaataaacaccagacaaactgaactgataactacatgaccttcgaaggtcgtttattactgttgtttaagcgggcctgacatcttagtatattacacgagtaaaggaacaaaggagtgcgggaagtgggccagataagcaaacaattcttttgaatccatgtatcatcacgcagacatcttagacgctaggaccgagctttgcctcaattgaaggccgatgaagaaaatggaaaggaacagaccataatcttctgggtctacgtcccactgaccatctgactcgtcccagtgctgcatgatatacgatttaagcattagttcgctgaatcattcttgctgctcagatctttggggttaccagttgcaatgcgatagaagtaaaatgctgccaccactccactgagaagaacaatgaagatttttgggaaccaaccattctggagtagaactgaaaactccctgaagaagatgacaagagctattgcagcttgccctttcaccagaagacgaggccgacggtcgccttctctatgtgatctcaaacttgagatacccagagtcaacagtgcaaggccaagaacaataccaaaacgaagagcagaggtacttccagtcaacatgaagttgaggaaaccccctactgtaagaaaggtaccaaacggaatgcccacatgataatcctcatactctgatggccaattcaatcttccaagagccctgaacgttgttgtaatatccttgatcgagtctggggagttccgagctgccatcaccagatattcctgtccctcctgactaacctcggtggcgatcacactgaggtccttctgtgctttgtctgcctgtatcttcagcttctcagaggcttccagcaagacctccctcgccctcttggagtagacatcatacgcctgcattgacagggcctgcatccgcagggcctcagccttgaactgctccagcattaccttccaagcttcctgagcctcctcgggctttatctccccgttgctgttatccttgtcatcgcccacctctgaaccctcagtttgctcccctgctagggcggcgacgacgcggcggccccggggtgctcccctccccgcgaaccggtgaccggccgaaaccgcccggagtgaaacctcgaggcggcgattggacgagaacgaggagcgcgcgaggcgtatggatggggtggacgcgagggggtgaaaggcggtggcggcgcccgcgcgtgcgggctgggaggagctctggagcgaggcggtggcggcgtggaggagagtggaagccatcggggtgggcgacggggcgtccgcgccgtctcggcaaggggggagacaggagggagtgacgaactggcgagtggcgtggtgggaacggcggaatggtggagacggcggaggggtgggccgcgggcggacagctgaaggaagattgtccgggtgggggataacggggagttttgtggggtctctttgggggcttttggccagttttggtggggcggtctgtgtgagcgggtggtttgttcctgggcggctcggcggttcccaagcccggccggc

SEQ ID NO: 19896 - DNA, 1634 bp, Zea mays
  misc_feature (2)..(7): n is a, c, g, or t
  misc_feature (22)..(22): n is a, c, g, or t
  misc_feature (24)..(25): n is a, c, g, or t
cnnnnnnttttttttttttttntnngccatccaagaggttaacttagagttagagcaaacaactagatcgtaccactgcaggtaccctttacaacttatcatctgtttgtttacgagcaagcgagaaggtacataatactaaccctgattgttttcagccacttcactaaacattgaacgcttcacttaatcacttctatccccatgcaataaacaccagacaaactgaactgataactacatgaccttcgaaggtcgtttattactgttgtttaagcgggcctgacatcggagtatattacacgagtaaaggaacaaaggagtgcgggaagtgggccagataagcaaacaattcttttgaatccatgtatcatcacgcagacatcttagacgctaggaccgagctttgcctcaattgaaggccgatgaagaaaatggaaaggaagagaccataatcttctgggtctacgtcccactgaccatctgactcgtcccagtgcattaattcgctgaatcattcttgctgctcagatctttggggttaccagttgcaatgcgatagaagtaaaatgctgccaccactccactgagaagaacaatgaagatttttgggaaccaaccattctggagtagaactgaaaactccctgaagaagatgacaagagctattgcagcttgccctttcaccaaaagacgaggccgacggtcgccttctctatgtgatctcaaacttgagatacctagagtcaacagtgcaaggccaagaacaataccaaaacgaagagcagaggtacttccagtcaacatgaagttgaggaaaccccctactgtaagaaaggtaccaaacggaatgcccacatgataatcctcatactctgatggccaattcaatctcccaagagccctgaacgttgttgtaatatccttgatcgagtctggggagttccgagctgccatcaccagatattcctgtccctcctgactaacctcggtagcgatcacgctgaggtccttttgtgctttgtctgcctgtatcttcagcttctcagaggcttccagcaagacctccctcgccctcttggagtagacatcatatgcctgcattgacagggcctgcatccgcagggcctcagccttgaactgctccagcattaccttccaagcttcctgagcctcctcgggctttatctcctcgttgctgttatccttgtcatcgcccacctctgaaccctcagtttgctcccctgctagggcggcgacgacgcggcggccccggggtgctcccctccccgcgaaacagtgaccggccgaaaccgcccggagtgaaacctcgaggcggcgattggacgagaacgaggagcgcgcgaggcgtatggatggggtggacgcgagggggtgaaaggcggtggcggcgcccgcgcgtgcgggctgggaggagctctggagcgaggcggtggcggcgtggaggagagtggcagccatcggggtgggcgacggggcgtccgcgccgtctcggcaagggggggagacaggagggagtgccgaactggcgagtggcgtggtgggaacggcggaatggtggagacggcggaggggtgggccgcgggcggacagctgaagcctgaaggaagatt

SEQ ID NO: 19897 - DNA, 1218 bp, Zea mays
  misc_feature (1209)..(1210): n is a, c, g, or t
tgatgaaggaaatcgaaagcaaacaggccatagccttctgggtctgcgttcccccatgatcatctgattcatccaagtgcattagttcactgaatcactgttgctgctcagctctttggggctaccagctgcaatgcgatagaagtaaaagcctgccactactccactgaggagaaccatgaagatttttggaaaccagccattctggagaagaactgaaaactccctgaagaagatgacactggctattgcagcttgccctttcaccagaagacgaggccgacggccgccatctctttgtgatctcaaacttgagattcccagagccaacagtgcaaggccaagaatgataccaaaacgaagggcagaggtacttccggccaacatgaagttgaggaaaccccctacggtaagaaaggtaccaaacggaatgcccacatgataatcctcatactctgatggccaattcaattttccaagagccctgaacgttgttgtgatatccttgatcgagtctggggagttccgagctgccatcatcagatattcctgtccctcctgaccaatttcggtagctaccacgctcaggtccttctgtgctttgtctgcctgtatcttcagcttctctgatgcttccagcaagacctccctcgtcctctcggagtagacatcataagcctgcattgacagggcctgcatccgcagggcctcagccttgaactgctccagcattaccttccaaatttcctgagcctcctcgggctttatctccccgtttctgtcatcccccacctctgaaccctcggtttgctcccccgctagggcggcgacaacgcggcggtcccggggtgcccccctccccgcgaaacggcgactggccgagatcgcccggagtgaaatctcgaggtggcgattggtcgagaacgaggagcgcgtaaggcgtagggatggggcacacgcgagggggtgaaaggcggcggcacccgcgcgggcgtgctgggtggagctcaggagcgaggcggcggcggcggaggcgtggaggagagaggcggccatcggggtttacgcgccgcctctgcaagggaggagacgggaggaagtggcgagctggcgagtggtggcactggtgggggtgggagcggcggacggctcgaaggaccgccggcccgcggggtacccgtggggtttgtggggtttcttcccggccgnngccctcga

SEQ ID NO: 19898 - DNA, 1750 bp, Zea mays
cttctcaacccaaggtaacgaaattaaattgcactgaaaatttcaccagtgtagaacattgacataccaaacggaatgccaacatgataatcctcatactctgatggccaattcaatctcccaagagccctgaacgttgttgtaatatccttgatcgagtctggggagttccgagctgccatcaccagatattcctgtccctcctgactaacctcggtagcgatcacgctgaggtccttttgtgctttgtctgcctgtatcttcagcttctcagaggcttccagcaagacctccctcgccctcttggagtagacatcatatgcctgcattgacagggcctgcatccgcagggcctcagccttgaactgctccagcattaccttccaagcttcctgagcctcctcgggctttatctcctcgttgctgttatccttgtcatcgcccacctctgaaccctcctgaatccagcaccaggatatagataatttaagcgccagcgttcagcgactgaatcatgaaatttaccataacaaagtgaacgaaacatcgcgaggagcccagtaatcgcaatcagcatcgccatacgacagataggctacactctacacccgttacttccaggaaagtgaaacgaagcacctgaatcaacattttattgccggaatttttgtggcagcgtagagaaaaggggaaggtgaagctacgaaaaatgacttagggagaaacaaacaaaaaaaaacacacgcctgaggagaggagaatctcgtcgccggaaacggcgagtgtcgcccgcgtcatcgcccacctctgaaccctcagtttgctcccctgctagggcggcgacgacgcggcggccccggggtgctcccctccccgcgaaccggtgaccggccgaaaccgcccggagtgaaacctcgaggcggcgattggacgagaacgaggagcgcgcgaggcgtatggatggggtggacgcgagggggtgaaaggcggtggcggcgcccgcgcgtgcgggctgggaggagctctggagcgaggcggtggcggcgtggaggagagtggaagccatcggggtgggcgacggggcgtccgcgccgtctcggcaaggggggagacaggagggagtgacgaactggcgagtggcgtggtgggaacggcggaatggtggagacgacggaggggtgggccgcgggcggacagctgaaggaagaaggaagattgtccgggtgggggataacggggagttttgtggggtctctttggggggcttttggcccggtcgcgtggggcggtctgtgtgagcgggtggtttgttgcgtgggggctcggctatggcggtgcttttgggagggatctgttggctgttgcactcctatcggcagcggctaccctttttcagcaggttttggagtccggtatttcgctgagggaatgtatcatgtgctggtcgacctcgggtttacaggatcatttttaatctgctccgggcgcaaacctattctggattctgctctgctctttgttaagtcgtgtttggtatggttatagagaaaactacaagaaggagctagtcaaagcttgtcaaacatttaaactctcaaattataaactttatagagttttcatagctatactactaatttttggataattcttttggtactctgaaatctctaaaaaacaacttagatatggaatttggagttattgtttatgaggaatcaatctaaactttaagacaaaactgctccac

SEQ ID NO: 19899 - DNA, 2177 bp, Zea mays
  misc_feature (2167)..(2172): n is a, c, g, or t
cggccgaagaaaaggcccgctagggcgccgagacagcggaacgttctctgagtttgagcacgatctccccgggccccggcgccgccgtacgtcccccttcggcgtcgccagccgcctcctggctccggctccttcatcgcctgctccagcgtgcctgcgtgacataagcgtcgattgattggcgagaaaggggacgaatgcagccgccgttgcaggcgcagggagcaatggctaacgtcgccgctatcctcaccgtcccctgctccgcgggccgccgcccgaagcggagcagccagccccgcggatgcggctccgtctccgtctccgtctccgtccgtgcgtcctccggcgcaaacacggtgactctgctggactacggcgcggggaacgtacgcagcgtgcgcaacgcaattcgctacctcggcttcgacatccgcgacgtgcagagcccggaggacatcgtcgccgcggaacggctcgtctttcccggtgtcggcgccttcggctccgccatggacgtcctcaacaggacgggcatggccaacgcactccgtgagtacatccaaagggaccgccccttcctaggcatctgcctcggtctccagctgctcttcgattccagcgaggagaacggcccggtgagcggcctcggtgtgataccaggcgtggtcaggcgattcgactcctcaaatggcctcatagttccacatattggctggaacgctctccagatcaccaaggacacaccactgttgcagggagctgatggccagcatgtgtactttgttcactcactcgcgtactgccttcagatgctaatagaaactggatttcctccatatgcaactatggtgacagctttatatcctccatctcaatgggcaacattcaggcagttcaatttcacccagaaaagagtggagctaccggactttctattctaaaagaatttctcagacctaactctcttgggaccaaggtcccagcacgtaggaaagcatcaaaacttgcgaagagagtgatagcatgccttgatgttcgttcaaatgataaaggagatcttgtggtaacaaaaggcgatcaatatgatgtaagagatcatactagcagcaaagaggtaagaaaccttggcaagccagtcgatttagcaagccagtactacatagacggtgctgatgaggtcagcttcttgaatataactggtttccgtgactttccattgggtgatttgccaatgctagaggtactgcgttgtgcctctgaaaaggtttttgtgccacttacagttggtgggggcatacgagacttcacagatgcaaatggaagatactactcaagtttggaggtagcatcagaatatttcaggtccggtgctgacaaaatttcaattggaagtgatgctgtttatgctgctgaagcctttttacagactggtgtaaagacagggaaaagcagcttggagcaaatctctagagtatatggcaatcaggctgtagttgtcagtattgatcctcgacgggtatatgtcaaaagtcaagaagatgtgccatttaaaactgtaaaggtgtccactaaaggtccatcgggagaagaatatgcatggtaccagtgcacagtgaatggtggacgtgatagccgagctataggagcatatgaactagcgaaagctgtggaagaattgggcgcaggagaaatacttcttaactgcattgattgtgatggccaaggttgtggatttgacatagatttggttaaaatggtttctgatgctgtgacaatccctgtcattgcgagcagtggtgctggagctgttcaacatttttctgaaatttttgagaaaacaaatgcttctgctgcccttgctgctggcattttccaccggaaagaggttcctatactagcagtgaaagagcatctggtcaatgctggtgtggaggtcagggtgtaacagggagatccttcggtttattgaaatattcttgtttgatgtcacaactgctatcagttctgtttctctgatgtcgcaactgctatcagatctgttggtggcagctggcagtgcataggcccctgtcgagaactgcagtttggtaataaattaataatgtgatgcttaacagattaagcatccgcttcttttgcagaaaaaaaaaaaaaaaacccctcnnnnnnactta

SEQ ID NO: 19900 - DNA, 3801 bp, Zea mays
cttcttttttcatttttgtcttatgaagaaatttatgctctcacctctcaatttctgtagatataagccccttctttgctcagttgacctttcgaaggatttcttcttcagctactcttacaacatcatgcgccgccttcagaagaacataacccagaagaatactgggcaggctgtttatgaaccaatgtgtgtatggaatgaatttctgacacgagcaattcggaatcatctcaagaatacatgttggactgttgccttagtccatggattttttaaacagtcgaagctctccgtatctgggaaggatttttggttgacccttatagctaggcgctcacgacactttgcgggaaccagattcttgaaacgtggcgttaatgaaaagggcagggtagcgaatgatgttgagactgagcagattgtttttgaagacacatctgatggaatcccaactcagatggcttctgctgtacagcatagaggatcgatacctcttgtctggtttcaggaaacttcaagacttaatattagaccagatattatattgaaacctgatgtggactacaaggcgactcgccttcattttgagaaccttgcacttagatatgggaatccagtaatcatcttgaacttaataaagacccgtgagaagaagccccgtgaatctctgctccgtgcagaatttgcaaaggctatccattacattaacaagagcctgcctgatgacaagcgtctaaaatttttacacatggatctgagtaagctttctcgaaggaaaggcaccaatgtgcttgcactgttgaccaaggtggcatcagatgtgttggatctaactgaattcctccactgtgaaataagtacatcaacaaaacctgatgacacctcaagtggagaaagaactgctgccaaaccacatgatgacagaagtagcagtgatcaaactgaatgtgcagctaagttggcacctcttttattacagaagggtgtcctcaggacaaattgcatagactgcttagatcgcacaaatgttgcacaatttgcatatggtttagctgctttagggcgtcaacttcatgcattggggcttactgaagcacagaaaattgaattgcacgatcctctggctgatgatctgatggacttctatgaatggatgggtgatacattagctattcagtatggtggttctgctgctcacaacaagatcttctgcgagcaaaggggtcaatggaaggcagcaacccaatctcaggagttccttcggaccattcaacgctactataataacgcctacactgatcacgacaagcaggatgctataaacatgttcttaggtcatttccaacctcagcaagggaaacctgcactgtggaagctggactcagatcagcattacaacattgggaggcaagggactttaaaagaagagattggaagatcgttcataaagaggtcactatcagatggtaacatactgttggagaacaacttgcctgtaactagctgtaacaatgaaacaaacaacacagaattgcttccaatgcaacagctggatgatattagagaacctaccgactctgcgccagagatctccatatgtgaacctaacccgtgctccagtgtgaactacggcagagtgcctggaagacactctatttcagaagagcggcagagttatttgaaaagattaggttaccctgaattgcattcttcaaatttcctcgaccttgatttgttgtcgtcttctgggaattcctgtgacgaggaagtttttgagaggtcatcactgatcaattcacctatggatgtggtcagcgttgaatcatctacgtcgtacagtgaacaaggacacactgatgagggaagggatgacatggatctttcccgttcaagcagccaggtctcagacgttcgggactattctgaccggtttgcgcactgggtcgcggatggaggcatgctttggtaaaaggccatggacttttgtcttgcttgacaactcggtagaatctgtgaccgcaggaaatggatgcgagcagatgacatggctagatgcagagatggtgggcgtggaaaaagtctcgcatcggtatggttgtgaccactggaaggcttgaacgctgatattcatcggatggggatggagatttcggtggttgggttgagtacaagattcaatttgctgtggtgaaaaattttaccatagtttgtttagacaataaataggcaaaatatatatgattcttttattttagcttacagtgcgtcccccttctccatagaaaattctgaaaagcaaaaaaaaaaaaggaaaatctagaaaaaggaggaaaaaaaacttagataaagaacacttttgctgtaaatagttagtatgttacggaagtataaatattgtgaaattttgctgacgacacgacttcgctcaaacgtgtaatatactgttggacagtgttaacaaaatatatcccgtatcagtacgaaaactgtgtaaatttactgtaacgcacagtatgcattatttatttatttgtttctcagattaaaaaaaaaaaaaaattgcaaaaatatcttaacctctgacttctcacggtgcggccagcctcggtcaagctccccggcggcgggacgaggccggtgtccgcttcctaccacagctagggatggaaacgaaagactcgagctcggtgggttcgctggctagcttcgctcggtttgtctcggctctcaaagagctgtagaaggtttggctcgtaggttatattttgataaataatattgtattatatagtgatttaatagtataaatataaaaaaattatgattattattcaacattataagtaatttaaattataaattattatatatcaatcatcaaaggttaaggaggtttggctcgtaggttatattttgataaataatattgtattatatagtgatttaatagtataaatataaaaaaattatgattattattcaacattataagtaatttaaattataaattattatatatcaatcattaaaggttaaggaataaggcacgtacctataaaattatccaatattcaatattattatataagttgattgttttgatatagctcataagtcagaacgagtcggcttggctcgctgaccaacaagctcgaaaatctggttcgacttgactcactcgaggctcacgagccttgagctttttttgcagccttaaccacaaccattgcaatgtgtatgtcgccagttcaccatttcagtagtcgtgaacggattcgagcttcgtggtgtccatggagagccgtatctaggacagcggcttcgccatccgcggcccgcgtttagcatctatttccatcgtttataattatctttcgaaatcagtcacagaatcgtgcaaccaaacaatctgttacatccaatactataggttggaggagttaaatataaaatagctactcaattcgtagtgatttgattagaatacaattacatcgaaccatcatcgtttgaggttggcgcttttatctagaatataaggttaacaccgtatttactattttaatattagtatttgatatggaacaatacatatctaagttatttaagtgacttaaagcatactttggctatactatacatatatataaattttcatatttatttagggcctatcgttgagttcgcttcggagccccatatttctagaaacggcactgtcggttagaacctaaattgtgtagcagtttttagctaggaatgtgtgtaaccagaggacacgatgagcctcattcatac

SEQ ID NO: 19901 - DNA, 2737 bp, Zea mays
tctgaaaacaatatctaggatttttgatgtatcgaccatggatcagtagaccttatttcaaagctcaaatctataggtctcgagaactgagaacaacaaaaagtgcatttttttaccctgtttccagaagaaccacttcttgttccatgagaactgtgtcaaaaggattatgcaactgatgtaatacttgggaacgctgtatattgtttaaaaatgcaaaatatagggtaacaagaatatttttcctgtctggactcagccaattgtgctactcttgcactggttctttagactgctctaatgtatcaatcttcatcttgttttaccagatcattcataaagaggtcactatcagatggtaacatactgttggagagcagcttgcctgtaactatctgtaacaatgaaacagacaacacagaattgctcccagtgcaacagctggatgatattagagaagcttctgattctgcgccagagatctccatatgcgaacctaacctgtgctccaggtgtgtcattacttgcatgaatttggtggtccacttgaatttgttttctacatgaatgcaatatgagctaattgtgtcttttttttatatattcagtatgaactatggcacagtgcctggaagacactccatgtcagaagagcggcagagttatttgaaaagattaggttaccctgaattgcactcttcaaatttctttgaccttgatttgttgtcatcttcaggaaattcgtttgacgaggaagtttttgagaggtaaaataaatagacttccagtaatttgcatgtcctactactctgcttgcactgttaacatgtatcacatccgtgatttgcaggtcattactgatcaattcacctatggatgtgatcagtcctgaatcatctatgtcatacagtgaacaaggacacactgatgaggttagcctcattatccgaacttctttttatctgacattctgacatcaactaaattgttggttacatggccttcctgagatctgaactttatgctgtgaaccttgttcatttgatgagggaagagatgacacggatctttcccgttctagcagccagctctcagacattcgggactactctgaccactttgcgcagtgggtcgtgaatggagacacgctttgctactaggccctggacttttgtcttggtgacagctcagtagatgtgacacggcaggaaatggaagtctgacggatagagcagatgaaatggctgacgactagccgggctaggtgccgtgcatctacctgcagaggcggcgtagcagaagaggtggtggacatgggagaagtctcgcatcggcatgcttgtggtcactggaaggcttgaacgatgaacgctgatattcgtcggatgcagctttcggtggggtacatgattcaatttgctatggtgaaaattttgaccgtagcttagacaataaataggcaaaatatatctgttcttttagtttagcttaccttgcgtttcccttctccatagaaaagtatcaaaaggaaaaacaatggaaaatctattaggaaaaggaaaaaacaaacaaaccataggtaaagaacacttctgttgtaaatagttagtttgctacagaagtataaatatctggtacttgttgggtttcttggcggtgtctgtttcataattgtttctgtgaaaaagctgaaagaaactcggtatgtcttttaatatgcaccatttttgcttgaggactctccatgacattgcgcagagaggagtgcaagaacttgaatgtctcatgcttctcttgcggtggacatccacgtcgatgacaaaattctagtatatggtacgtagttcattcgaaaggtgcaaggtatccaatttagttttggatatctagagttcacaagatagtacttatctgaaaaatgaaatcaaattaccattgcaaaatataaataattagagttcacaagatagcattataaaattacctagagttcacaagatagtattataaaattacctttaggagggacgagaaaagaagcaaagtttgtcgatgcatgattaaggatctatgtgttgtgtagaacacatccatccaccaaccacaaatgtaaatttcatatcaaagtcacatagcaagtacattctaggatgtatatctataacgacaagtattgttaatcaccttattagccgacacatctaccttaatatgtgatccatctattgctccaatggcacctttaaaataaggcctgcgacgacttcaaggggcttggggctataaaaagaagtcccacacgacctaaggagcacacctttgtagcatacaagtggactaattgtggaacaattctatatccctctcttgtgttattctctgcaagatgtttggcattgttataccccaaacgagagagaggagaggtgctgctgcgagtgagcaagatcttgagcaagtactcggtccgtgacctagtgaaaaacttgagcaaacagagaaagaaattgaaatagactccacaccatgttgactaacttcaatgtggatgtagtcaagcattttaggcttggtcaaaccacgggataaaatctctatgtctctgtctctgtctctctgtgatgtttcttgtttgctttactacttgcacttcactattatctttgtataagttgtttatgaagtgtaggctattggagacagagacttcaattatgctgcaatctatttgactcga

SEQ ID NO: 19902 - DNA, 3308 bp, Zea mays
ggtaccctccgggttcggccgggacatgtcttcccgcggccgttgtttacgcagaatcctcctgttccactcctcgccaaatgtcttgtgttagagttcatatgaaatttctggtcgttcgattttagatcgatttctttacggcgtattttgattgcatcgcgaccggctccggagccatccggtcataagaccgtaccaacgcatttctttggtttgaggtgcgggacggcgggcgccgaacggtcgtgtgccgtagatccaaagtcgcgggaaatctctggtcgaggagtcgatttggatccgtttatcgctagtttggtcgtcgttgatctgaaaggtggagctttggtcgattttctcttccagaagcatttgtgtttctgaggggctaaggtgctatatctgaagcagccgacgaggagctgagtctttgattttttttccgccaatttctgtcgtcgtttgttgatctgatccgatggaggctatgacgggtggcaaattccttcaaaagtttcggctctacgaaaccagatcgaaattttatcttattggaagagacaagagcaggattcactggagggtgctaaaaattgatcggtcggagttcactgagctgggtgtcgaggaggatccaactatttacacagagaatgaatgccaagaactgcttcggcggatccatgaggggaacaggttgaccggtggactgaaatttgtcacaaaatgttacggaatagttggttttgtaaagtttcttggtccttattacatggttataataaccaggagaaggaaaattggcacaatatgtggccatgaaatttattccgttggcaagagcgaaatgattgcaattccgagtgttacagtctggcccaacatggcttattctagggatgaaaacagatataagcacctgctttgctcagttgatctttcgaaggatttcttcttcagctactcttacaacatcatgcacagccttcagaagaacataaccgagaagaacattgggcaggtttatgaatcttcctcgcgtccgaatgaatttatgacacgcgcaattcgggatcatctcatgaatacctgttggactgttgctttagtccatggattttttaagcagtcaaggttctctgtgtctgggaaggatttttggctgacgcttatagctaggcgctcacgccattttgctgggaccagattcttgaaacgtggtgttaatggaaagggcagggtagccaatgatgttgagactgaacagattgtttttgaagacacatctggtggaatcccaactcagatggcttctgttgtacaacatagaggatcgatacctcttgtctggtttcaggaaacttcaagacttaatattagaccagatattatattaaaacctgatctggactacaaggcaacccgccttcattttgagaaccttgcacttagatatgggaatccaataatcatattgaacttaataaagacccacgagaagaagccccgtgaatctctgctctgtgcagaatttgcaagggctattcattacattaacaagagcctatctgatgacaagtgtctaaaatttctgcacatggatctgagtaatctttttcgaaggaaaggcaccaatgtgcttgcactgttgagcaaggtggcatcagatgtgttggatctaactgaattcctccactgcgaaataagtacatcaacaaaatatgatgacatctcaagtgaagaaaaaactgttgccaaaccacgtgatgacagaagtagcagagatcaaactgaatgtgcagctaagttggtacctcttttattacagaagggtgtcctcaggacaaattgcatagactgcttggatcgcacaaatgttgcacaattttcatatggtttagctgctttagggcgtcaacttcatgcactgggacttgctgaagcacataaaattgaattgcatgatcctctggttgatgatctgatggatttctatgaacggatgggtgatacattagctattcagtatggtggctctgctgctcacaacaagatcttctgtgagcaaaggggccaatggaaggcaacaacccaatctcaggagttccttcgaacccttcaacgctactacaataacgcctacactgatcacgagaagcaggatgctataaacatgttcttaggtcatttccaacctcagcaagggaaacctgcattgtggaagctggactcagatcagcattacaacattgggaggcaaggaactttaaaagaagagattggaagatcattcataaagaggtcactatcagatggtaacatactgttggagagcagcttgcctgtaactatctgtaacaatgcggccgcctgcgcagaattgctcccagtgcttcagctggatgatattagagaagcttctgggtctgcgccagagatctccatatgcgaacctaacctgtgctccagtatgaactatggcacagtgcctggaagacactccatgtcagaagagcggcagagttatttgaaaagattaggttaccctgaattgcactcttcaaatttctttgaccttgatttgttgtcatcttcaggaaattcgtttgacgaggaagtttttgagaggtcattactgatcaattcacctatggatgtgatcagtcctgaatcatctatgtcatacagtgaacaaggacacactgatgagggaagagatgacacggatctttcccgttctagcagccagctctcagacattcgggactactctgaccactttgcgcagtgggtcgtgaatggaggcacgctttgctactaggccctggacttttgtcttggtgacagctcagtagatgtgacacggcaggaaatggaagtctgacggatagagcagatgaaatggctaacgactagctgggctaggtgccgtgcatctacctgcagaggcggcgtagcagaagagggagaagtctcgcatcggcatgcttgtggtcactggaaggcttgaacgatgaacgctgatattcgtcggatgcagctttcggtggttggattgggtacatgattcaatttgctatggtgaaaaatttgaccgtagcttagacaataaataggcaaaatatatctgttcttttagtttagcttaccttacgtttcccttctccatagaaaagtatcaaaaggaaaagcaatgcaaaatctattaggaaaaggaaaaaacaaacaagccataggtaaagaacacttctgttgtaaatagttagtttgctacagaagtataaatatctggtacttgatgggtt

SEQ ID NO: 19903 - DNA, 804 bp, Zea mays
tcggcagaggttgttaagggaccctgaagtcatgacatcctacagagagctctcaaagaaagcgcagaacgcaaacaacatctggtggaggctgagcggactgctgggtgaccggaaccggcaggtcatgtacatactgctccaggcgctgttcacagtggcaacaatggccctgacggtccctatattcctgtcctaccggatgcacgtggtgttcctgatactcaaggtgtgcgcctcgacatggaacggtggcagcttcatcttggaggtgatgcctcgacaagtagaacggaagcagcagaagaaactgggcatgaagcccatcgaacaggggagctggacacaaggggcgccggctgatggtacgtacattgggtaaccaccaccaagcacacatctgaggagaaaatccaggagtgaggaaatcgaagctggatgtaacaatagattttactgtttgcaaatgcaacctttgttttttttttctgggtgttcttcgtgttggaggtttttttagctctgccctagttgtgagttgtgacatctttagttttaggctgaagtctgaacgatatggggtgagagatcatgcgtgcccatggttgtcttgggattggacatgcataagttgagatgttctccttttctgtaggagttttcttttcgatgtgaccgttgtgaattgcgtgaagcttttttttcattgttcgtttaattttttttagagagagcccccggggcctattcaagcccgcgccattatttttaaaaaaaaaagaaaaaaaaaactggggggggggc

SEQ ID NO: 19904 - DNA, 1671 bp, Zea mays
gtgtgattatataatggacattgtaaatccaggggagcgaaggaaaggcaaaggagaaaatttcgtagcaataaataaataaataaataaaattaataaaagaaaggtggcgtagaggataggaggagaaccaaggttgcgtctcgaaggttcttgcctcgttgggaagggatggcgtcggaggtggaggacgaggcggcgacgccgctgctcgccaacggtgcagccgacgtccgccggaggagggaccaggcgaaggcaattctgtccacgcaggccgtcaggatcgccaccaaggccgagcagcatgagcgcttcatctttaaggtcacacacttgctgggtgttcttggatttgggggattttgctatctcttgggtgccagaccacaggatgtgccatatgtgtactgcctgttctatgtcatatttgttccgctccgctggatttactaccgctacaagaaatggcattactaccttctggacttctgctactatgccaacacctttctccttgtaatgattctcttctacccagaggatgaaaaactttttatggtttgcttctcgtttgcagagggtccgcttgcttgggcattaattgtgtggcgttgcagcttggttttcagttcatttgacaaacttgttagtgtcctgatacatctcttacctgggattgttctattcactatccggtggtggaatccacaaacatttgctgccatgcacccagaaggaagagatgctagagtcacatggccatatgtggaggacaaatcatatctgtggacatggcttttttttgttccgctagctgcttacaccctgtggcaacttatgtatttcctcatagttaatgtcctgcgtcgacagaggttgttaagggaccctgaagtcatgacatcctacagggagctctcgaagaaagcacagaaagcgaacaacatctggtggaggctgagcggactgctgggtgaccggaaccggcaggtcatgtacatactgctccaggcgctgttcacagtggcaacaatggcactgaccgtacctatattcctgtcctaccggatgcacgtggtgttcctgatactcaaggtgtgcgcgtcgacatggaacggtggcagcttcatcttggaggtgatgcctcggcaagtagtgcagaagcagctgaagaaactggacatgaagcccatggaacaggggagctcgacacaaggtgcgccaggtggtgatggtggcacattgggtaaccaccaccagcacacatccgaggagcatatccaggagtgaggaaattgaagctggatgtaagattagattttgatgttcactgacacaacctttgttgtcatcgagtgcgctttgtgttggagtttttctttagttcttcccagtttgtgagttgtgacatctagtcatctataggtttataggctggacgatatggggtgagagattgtgcgtgcccatcttttgtcgggcttgggcaaagatatgtcgagatgtttactttctctgtagaatttcgtgaagctgttgcattgttcgtttgaagatggcgacgatgttcagatgatgcttcatgttaaaaaaaaaaaaaaaattgcttcattgtacccagattttatttgcttcatgttgaaggacagactatgatgatgcgtgcta

SEQ ID NO: 19905 - DNA, 987 bp, Zea mays
cccacgcgtccgggaagaaagacgtagaatattggatgggttcagattaaaaaggcagtgtgagctcgatggatgcgtgtgatgattatataaaggacattataaatcaatgggagcaaaggaaaggaaaggaaaggaaagggagaaaatttcatatagcaattgtttcgcgtataggagggagaacaaaggtcgcgtctcgaaagttcttgccttgttgggaagggatggcgtcggaggtggaggacgacgcggcggtgccgggcgcgccgctggtcgccaatggtgcagccgacgtccgccggaggagggatcaggcgaaggcgattttgtccaagcaggccgtcaagatcgccaccaaggccgagcagcacgagcgcttcatctttaaggtcacacacttgctgggtgttcttggatttgggggattttgctatctcttgggtgccagaccacaggatgtgccatatgtgtactgcttgttctatgtcatattcgttccgctccgctggatttactaccgctacaagaaatggcattactatctcctggacttctgctactatgccaacacatttctccttgtaatgattctcttctatccgaaagatgaaaaacttttcatggtttgcttctcgtttgcagagggtccacttgcttgggcattaattgtgtggcgttgcagcttggtttttggttcatttgacaaacttgttagtgtcctgatacatctcttacctgggattgttctattcactatccggtggtggggatccacaaacatttgctgccatgcacccggaaggaagagatgccagagtcacatggccatatgtggaggacaaatcatatatgtggacatggcttttttttgttccactagctgcttacaccctgtggcaacttatgtatttcctcatagttaatgtcctgcgccggcagaggttgttaagggatcctgaagtcatgacatcctacagagagctc

SEQ ID NO: 19906 - DNA, 1780 bp, Zea mays
aaacgccacgcagctgcagctctggctgagttcacacttcacgggaagaaagacgtagaatattggatgggttcagattaaaaaggcagttaagctcgatggatgcgtgtgatgattatataaaggacattataaatcaatgggagcaaaggaaaggaaaggaaaggaaagggagaaaatttcatatagcaattgtttcgcgtataggagggagaacaaaggtcgcgtctcgaaagttcttgccttgttgggaagggatggcgtcggaggtggaggacgacgcggcggtgccgggcgcgccgctggtcgccaatggtgcagccgacgtccgccggagggttcgtcgccgggccgctgctgcactgtcgtttaattttcttttttttttctttctttctcggatttgcttctggctacacttatgagtgctgatcttgtccggcgcgagacagagggatcaggcgaaggcgattttgtccaagcaggccgtcaagatcgccaccaaggccgagcagcacgagcgcttcatctttaaggtcacacacttgctgggtgttcttggatttgggggattttgctatctcttgggtgccagaccacaggatgtgccatatgtgtactgcttgttctatgtcatattcgttccgctccgctggatttactaccgctacaagaaatggcattactatctcctggacttctgctactatgccaacacatttctccttgtaatgattctcttctatccgaaagatgaaaaacttttcatggtttgcttctcgtttgcagagggtccacttgcttgggcattaattgtgtggcgttgcagcttagtttttggttcatttgacaaacttgttagtgtcctgatacatctcttacctgggattgttctattcactatccggtggtgggatccacaaacatttgctgccatgcacccggaaggaagagatgccagagtgacatggccatatgtggaggacaaatcatatatgtggacatggcttttttttgttccactagctgcttacaccctgtggcaacttatgtatttcctcatagttaatgtcctgcgccggcagaggttgttaagggaccctgaagtcatgacatcctacagagagctctcaaagaaagcacagaaagcaaacaacatctggtggaggctgagcggactgctgggtgaccggaaccggcaggtcatgtacatactgctccaggcgctgttcacagtggcaacaatggccctgacggtccctatattcctgtcctaccggatgcacgtggtgttcctgatactcaaggtgtgcgcctcgacatggaacggtggcagcttcatcttggaggtgatgcctcgacaagtagaacggaagcagcagaagaaactggagatgaagcccatcgaacaggggcgccggacacaaggggcgccggctgacggtacgtacattgggtaaccaccaccaagcacacatctgaggagaaaatccaggagtgaggaaatcgaagctggatgtaacaatagatttttactgtttgcaaatgcaacctttgtttttttttctgggtgttcgtgttggaggtttttttagctctgccctagttgtgagttgtgggatctttagttttaggctgaagtctgaacgatatggggtgagagatcatgcgtgcccaactgcccatggttgtcttgggattggacatgcataagttgagatgttctcctttctgtaggagtttcttttcgatgtgaccgttgtgaaaaaaaaaaaaaaaa

SEQ ID NO: 19907 - DNA, 1627 bp, Zea mays
aaaaaggcaaaggagaaaatttcgtagcaataaataaataaataaaattaataaaagaaaggtggcgtagaggataggaggagaaccaaggttgcgtctcgaaggttcttgcctcgttgggaagggatggcgtcggaggtggaggacgaggcggcgacgccgctgctcgccaacggtgcagccgacgtccgccggaggagggaccaggcgaaggcaattctgtccacgcaggccgtcaggatcgccaccaaggccgagcagcatgagcgcttcatctttaaggtcacacacttgctgggtgttcttggatttgggggattttgctatctcttgggttccagtaagctactgcagcattgatatatttggaccacaggatgtgccatatgtgtactgcctgttctatgtcatatttgttccgctccgctggatttactaccgctacaagaaatggcattactaccttctggacttctgctactatgccaacacctttctccttgtaatgattctcttctacccagaggatgaaaaactttttatggtttgcttctcgtttgcagagggtccgcttgcttgggcattaattgtgtggcgttgcagcttggttttcagttcatttgacaaacttgttagtgtcctgatacatctcttacctgggattgttctattcactatccggtggtggaatccacaaacatttgctgccatgcacccagaaggaagagatgctagagtcacatggccatatgtggaggacaaatcatatctgtggacatggcttttttttgttccgctagctgcttacaccctgtggcaacttatgtatttcctcatagttaatgtcctgcgtcgacagaggttgttaagggaccctgaagtcatgacatcctacagggagctctcgaagaaagcacagaaagcgaacaacatctggtggaggctgagcggactgctgggtgaccggaaccggcaggtcatgtacatactgctccaggcgctgttcacagtggcaacaatggcactgaccgtacctatattcctgtcctaccggatgcacgtggtgttcctgatactcaaggtgtgcgcgtcgacatggaacggtggcagcttcatcttggaggtgatgcctcggcaaagtagtgcagaagcagctgaagaaactggacatgaagcccatggaacaggggagctcgacacaaggtgcgccaggtggtgatggtggcacattgggtaaccaccaccagcacacatccgaggagcatatccaggagtgaggaaattgaagctggatgtaagattagattttgatgttcactgacacaacctttgttgtcatcgagtgcgctttgtgttggagtttttctttagttcttcccagtttgtgagttgtgacatctagtcatctataggtttataggctggacgatatggggtgagagattgtgcgtgcccatcttttgtcgggcttgggcaaagatatgtcgagatgtttactttctctgtagaatttcgtgaagctgttgcattgttcgtttgaagatggcgacgatgttcagatgatgcttcatgttgaaggcatatctttatttgcttcattgtacccagatcaaaaaaaaaaaaaaaa

SEQ ID NO: 19908 - DNA, 3089 bp, Zea mays
  misc_feature (840)..(840): n is a, c, g, or t
agcacttagtgtgtgtgaagaagctttaagagtgttcaaaccgaacttggaagcttgggcaaatctatttggttcaagtcacatattgagaagctcataaagataacttgcattcaagaagaagacaacaatgcaaatggatatcaaaatctataaagtactatatagactgatatattcctttaattggtattcacaaatggtgtctagatcaaacatacaagtggtaccctacaagacttcaagtgatcctcatctttaagtgattatcaactcaagaaagcaactccacccataataacttcatataagtggtgtcaagatatttaccatatatttggtgtccatcaaaaaatgagtgctttcaagtggtataacattcacaagtgagttcaacctcctcaaagctttggcacaatcattttatggtaattaatgacaaagggagagaagttggaacaaagatatagaaatatgcacaaaagaaacttggacataaatataaacttaagaggagttatcgatcaattaagttagaatgagttcaaatggattaagagccaaataaaggggatgtaattttcttgaacaatagatgcacacaagtaggaggagcaagcttataaatatatgtttgatgtgtttgattatgcattacattttcttgcttgcatcatatttgtcttacattcctacatacttgtgtgagtgtttgctagaattaagacttggatgatgattgatttaatggtatttatagcctaatcttagtgtagcaacgcgtaactagaacctcataattatgttgatctcacatggtatatagcgtcgcttgtttcnagcaaggtgatgttaaggatgtttttgaaaagcagtatacacactacaaaggtacatttctatcttgtatattttaacatcatttagtagtgatattgttaccgcaaaattcatggtgtgtaagcttgaaaccaaaccttttgagcacacatgtagggggaattatcattactaagttgagctttatgatgcttatccaaatttaataaataatcttaaagttagataagaagcataaaaaccaaaccaaactagaaatttacacttatataaagagctagattagaaaaagaataaaaaacaatatacctttatagagttgtcatcaattataaaaaggagggggttataaggacctcatttggttttggtaattaattgatgactagatagactaataaataattatattgagatacatggcgattagttgggccggaaatcttgtccatgggcgcgtccaatatgggtctgcaaagtgcaaactgggcgtcctcgccgccccccggcatttgcgcagcaaaaaggaggaaaaagtgaggagaaagaagagaggaaacaggaaagagtacaactcggcggcgacaccaccgctcgcagcctcccgccgcgatggcgatgcgttcgctcgccaggctccaccgccaactctccccttctctcctccaccgccatagcacacggcgtgggtggcctcccgcttctgacgcggcctttctctggcgcgggctcgcctcgtcatcaccttccgcggccggtcgggagaagagctcgagacggactttggggtaccttctcggcgttgcggtcgccatggtcggcgcctcgtacgccgccgtaccgctataccgtcgcttctgccaggctaccggctacggcggcaccgtccaacgacgcgagggcggggcggccctcatctcccggttggttcgatctagttgttctgtgtgcagatgtgcgctgccaattgttcgtacattaggattaggtgctttattttatcatttggtcggtgctaattgcagtttccaacactccatctgtatcgctggtagggttagtaacataagctgatacggtctgctcaaagtttctttcttgtggtaataggcacatttcgagtatattatcacactcgtggccaccaacgattcatccgtggcccatattgtgtcgagttgtgaggaacgggataagttctcctaatctcctttaccttagctttattttactggtagaaatttgttcagcactctttgtacgcatgccaggtctttaaaccacacacagacactgtataataacgattacacaatcaagtgacagcacgtcaacaaaacaaaccacacaaatgagctgtagcctctccgcttctagcccgctgtccgcctgtctttgatgatccccatgtgtgacacctatgtggtattcagttcatagttatcatgtactccctccgtcccaaaatagtagtcgttttatctcttgatttttatgtctatattcaaatggaagatgatgaatctagacacacatgtaaaacacatatatcaagtattgtacgaatccattaattatttaaaacgaattttaatttggtacagagggagtgcttattatgaggggaatatgatctttgctagagttgtttggagttgtctagttttaaaggttgtgttacccttgttgtcgtgtgcaagcagccggcaatggtaggggcaaaagggagcgttgcgttgtaacagaacacctcttagacatagtaagcccagtgcccgaaccataagatggagaagaggttgagtcaggtcttgtaggcgaggactcctgaccggagaggcagctcctggtgaccagctgtactcctatttctgctattagcttcatttaagcctttgcttgccgccctggactcctggatttatcactggatcagggcttttcattttttacaagtaagcctgaaactgtcctggtcagacaccatggctcatataaaaattgtgaaatagtgtgacacatggaaaatatttactattttaaggaacatggtagcaaatcctttaagccaataggaatatgccaaataaaaaatggtgaatgtaggactgccaaatttttattttcctcacagaggaaaggaatgtcatatcgtatcttgcactccatgtgcactggtgtttgtacactaacctaactcaggaatgtgctccttattttttcttaaaagacattattgttctaattca

SEQ ID NO: 19909 - DNA, 1077 bp, Zea mays
cctcgaggccgggttgcatttgcgcagcaaaaaggaggaaaaagtgaggagaaagaagagaggaaacaggaaagagtacaactcggcggcgacaccaccgctcgcagcctcccgccgcgatggcgatgcgttcgctcgccaggctccaccgccaactctccccttctctcctccaccgccatagcacacggcgtgggtggcctcccgcttctgacgcggcctttctctggcgcgggctcgcctcgtcatcaccttccgcggccggtcgggagaagagctcgagacggactttggggtaccttctcggcgttgcggtcgccatggtcggcgcctcgtacgccgccgtaccgctataccgtcgcttctgccaggctaccggctacggcggcaccgtccaacgacgcgagagtgtggaggagaagatctcacggcatgctcgagacggaactacgacatcacgagaaataattgttcaatttaatgctgatgttgctgatggaatgccgtggaagttcatccctacacagagagaggtcagggttaaacctggtgaaagtgctcttgctttttatactgctgagaatcgcagttcagctccaattactggtgtatccacgtataatgttgctcctatgaaggctgcgatttacttcaataagatacaatgtttctgctttgaggagcaaacacttcttcctggagaacagattgacatgccagtattcttctatatcgatcctgagtttgagacagaccccaaaatggacggggtgaacaatatcgttctttcgtacacattcttcaaggtgaacgatagttagaaaacgtgccaacagcattgttgtattaggaaaacaacacttgaacaatccatatgcagatatgctgcggaatagcatctcatgtaacaccaagagttttttttttgatagttagctcacatttgtctatggagaattttgcaaaaaaaaaaaaaaaataaaaaaaaactggaaaaaaagggcggtgtacccgatggccaagggggtcaatgtggctaccagttttcatatgcaatctcaagaatcctacaggacg

SEQ ID NO: 19910 - DNA, 848 bp, Zea mays
atcccggcctcgtcgtgcgcttgtccctttccacggctccaaacaaatgcggaggtctccactcttctctcttcctccatcttatcatcgcccacgtacacacccaattcctcgcaactgggctcccccgcctccacgacactgccccccgcctcaagtccgccgcctccattcttcagctctcctatcctccgtagtctgcctgtacctattggctgaagcagagctgacccccactttatcaagagttgctcaacaatggacactggctgcctgtcatctatgaatattactggagctagccaggcaagatcttttgcggggcaacttcctcctcagagatgttttgcgagtagtcactatacaagctttgccgtgaaaaaacttgtctcgaggaataaaggaaggagatcacaccgtagacatcctgccttgcaggttgtctgcaaggattttccaagacctccactagaaagcacaataaactatttggaagctggacagctctcttcattttttagaaacagcgaacgccccagtaagccgttgcaggtcgtggttgctggtgcaggattggctggtctatcaacagcgaagtatctggcagatgctggacataaacccatattgcttgaggcaagagatgttttgggtggaaaggtagctgcttggaaggatgaagatggagattggtacgagactgggcttcatatcttttttggagcttatcccaacatacagaatctgtttggcgagcttagagattgaggatcgtttgcagtgggaaaggacactctatgatattcgccatgccaaaacagccaggaggattcagccggtttgatttc

SEQ ID NO: 19911 - DNA, 2591 bp, Zea mays
ctccaaatgcggaggtctcgactcttctctcttcctccatctttatcatcgccccacgtacacacccaattcctcgcaactgggctcccccgcctccacgacactgccccccgtctcaagtccgccgcctccattcttcagctctcctatcctccgcctagaatatcttcatcggtattttaccaacctggatcaatttactcacgatactctgaagcgtatacatatgccatatgggaaatgacttcatagctgtgggttgtcttatggctccttgaatttgcagtagtctgcctgtacctattggctcgagcagagctgacccccactttatcaagagttgctcaacgatggacactggctgcctgtcatctatgaatattactggagctagccagacaagatcttttgcggggcaacttcctcctcagagatgttttgcgagtagtcactatacaagctttgccgtgaaaaaacttgtctcaaggaataaaggaaggagatcacaccgtagacatcctgccttgcaggttgtctgcaaaggattttccaagtcctccactagaaagcacaataaactatttggaagctggacagctctcttcattttttagaaacagcgaacgccccagtaagccgttgcaggtcgtggttgctggtgcaggattggctggtctatcaacagcgaagtatctggcagatgctggccataaacccatattgcttgaggcaagagatgttttgggtggaaaggtagctgcttggaaggatgaagatggagattggtacgagactgggcttcatatcttttttggagcttatcccaacatacagaatctgtttggcgagcttaggattgaggatcgtttacagtggaaagaacactctatgatattcgccatgccaaacaagccaggagaattcagccggtttgatttcccagaaactttgccagcacctataaatgggatatgggccatattgagaaacaatgaaatgcttacctggcccgagaaggtgaagtttgcaatcggacttctgccagcaatggttggtggtcaaccttatgttgaagctcaagatggcttaaccgtttcagaatggatgaaaaagcagggtgttcctgatcgggtgaacgatgaggtttttattgcaatgtccaaggcactcaatttcataaatcctgatgagctatctatgcagtgcattttgattgctttgaaccgatttcttcaggagaagcatggttctaaaatggcattcttggatggtaatccgcctgaaaggctatgcatgcctattgttgatcacattcggtctaggggtggagaggtccgcctgaattctcgtattaaaaagatagagctgaatcctgatggaactgtaaaacacttcgcacttagtgatggaactcagataactggagatgcttatgtttgtgcaacaccagtcgatatcttcaagcttcttgtacctcaagagtggagtgaaattacttatttcaagaaactggagaagttggtgggagttcctgttatcaatgttcatatatggtttgacagaaaactgaacaacacatatgaccaccttcttttcagcaggagttcacttttaagtgtctatgcagacatgtcagtaacctgcaaggaatactatgacccaaaccgttcaatgctggagttggtctttgctcctgcagacgaatggattggtcgaagtgacactgaaatcatcgatgcaactatggaagagctagccaagttatttcctgatgaaattgctgctgatcagagtaaagcaaagattcttaagtatcatattgtgaagacaccgagatcggtttacaaaactgtcccaaactgtgagccttgccggcctctccaaaggtcacctatcgaaggtttctatctagctggtgattacacaaagcagaaatacctggcttctatggaaggtgcagtcctatccgggaagctttgcgcccagtccatagtgcaggattatagcaggctcgcactcaggagccagaaaagcctacaatcaggagaagttcccgtcccatcttagttgtagttggctttagctatcgtcatccccactgggtgctatcttatctcctatttcaatgggaacccacccaatggtcatgttggagacaacacctgttatggtcctttgaccatctcgtggtgactgtagttgatgtcatattcggatatatatgtaaaaggacctgcatagcaattgttagacctttgggaaagcaaaagcgataaagagatctcagatagatattgtgttctttcagacggtggttcctattcccctatcaatcggttaatccatcccacatgggaggatttgtggtaagcttagtcagcaaacctctggtggtccctgaaggcctgaactttatcgggagagctgctgtagcaatccccgaagccgtgtgccgtttatcttgtcgggcatactttatttgctgagttgcagttattaagcatagggaggtgcggaatgcacttcgggcgtcgaagatatttttgctcagattccttgcgtctcaataattgtccttttgaatcccagat

SEQ ID NO: 19912 - DNA, 2169 bp, Zea mays
ccgggacggctccaaacaaatgcggagctctccgccctcggcccctccggcatcttatcatcgcccacgtacacacccaattcctcgcaactgggctcccccgcctccacgacactgccccccgcctcaagtccgccgcctccattcttcagctctcctatcctccgtagtctgcctgtacctattggctgaagaagagctgacccccactttatcaagagttgctcaacaatggacactggctgcctgtcatctatgaatattactggagctagccaggcaagatcttttgcggggcaacttcctcctcagagatgttttgcgagtagtcactatacaagctttgccgtgaaaaaacttgtctcgaggaataaaggaaggagatcacaccgtagacatcctgccttgcaggttgtctgcaaggattttccaagacctccactagaaagcacaataaactatttggaagctggacagctctcttcattttttagaaacagcgaacgccccagtaagccgttgcaggtcgtggttgctggtgcaggattggctggtctatcaacagcgaagtatctggcagatgctggacataaacccatattgcttgaggcaagagatgttttgggtggaaaggtagctgcttggaaggatgaagatggagattggtacgagactgggcttcatatcttttttggagcttatcccaacatacagaatctgtttggcgagcttaggattgaggatcgtttacagtggaaagaacactctatgatattcgccatgccaaacaagccaggagaattcagccggtttgatttcccagaaactttgccagcacctataaatgggatatgggccatattgagaaacaatgaaatgcttacctggcccgagaaggtgaagtttgcaatcggacttctgccagcaatggttgctggtcaaccttatgttgaagctcaagatggcttaaccgtttcagaatggatgaaaaagcagggtgttcctgatcgggtgaacgatgaggtttttattgcaatgtccaaggcactcaatttcataaatcctgatgagctatctatgcagtgcattttgattgctttgaaccgatttcttcaggagaagcatggttctaaaatggcattcttggatggtaatccgcctgaaaggctatgcatgcctattgttgatcacattcggtctaggggtggagaggtccgcctgaattctcgtattaaaaagatagagctgaatcctgatggaactgtaaaacacttcgcacttagtgatggaactcagataactggagatgcttatgtttgtgcaacaccagtcgatatcttcaagcttcttgtacctcaagagtggagtgaaattacttatttcaagaaactggagaagttggtgggagttcctgttatcaatgttcatatatggtttgacagaaaactgaacaacacatatgaccaccttcttttcagcaggagttcacttttaagtgtctatgcagacatgtcagtaacctgcaaggaatactatgacccaaaccgttcaatgctggagttggtctttgctcctgcagacgaatggattggtcgaagtgacactgaaatcatcgatgcaactatggaagagctagccaagttatttcctgatgaaattgctgctgatcagagtaaagcaaagattcttaagtatcatattgtgaagacaccgagatcggtttacaaaactgtcccaaactgtgagccttgccggcctctccaaaggtcacctatcgaaggtttctatctagctggtgattacacaaagcagaaatacctggcttccatggaaggtgcagtcctatccgggaagctttgcgcccagtccattgtgcaggattatagcaggctcgcactcaggagccagaaaagcctacaatcaggagaagttcccgtcccatcttagttgtagttggctttagctatcgtcatccccactgggtgctatcttatctcctatttcaatgggaacccacccaatggtcatgttggagacaacacctgttatggtcctttgaccatctcgtggtgactgtagttgatgtcatattcggatatatatgtaaaaggacctgcatagcaattgttagacctttgggaaagcaaaagcgataaagagatctcagat

SEQ ID NO: 19913 - DNA, 2461 bp, Zea mays
ccccgccggaaggcacacagccgccgctgtttcttcatcttactcgtgctcggcacgcaggcgacggcgacggcggcggcgttcaggctcgggctctcagcgacggtatcagtggtctcccgcctctcgccagtcgcgtcgcgccctcgcctccggtcctctgcacaccgtccggtgaccttgtgttgtaagtttttccagcactgcttgctcacccatttctcaattagaaaacctcaaattctgtccctgagcaccaaatcaagaccataccaatttagtgagtccggacagatggcaatggccgcagttctggccaatggtgattcacagggtcgtcctcagaggaactatcaagttgttgttgctggcactcgtgacatgggcattgggaaggatggggtcttgccatggaagcttcctggtgatcttaaattctttaaagagcttacactaactacatctgatcctgtcaaaaagaatgcagttataatgggaaggaaaacatgggagagcattccggttaagtcaaggccattgcctggtcgtttgaatgtcatacttactcgatctggtagttttgattttgcaacagtagagaatgttgttatctgtggaagtatggagtctgccttagaactgctagcatcaactccatattgcttatcaattgagaaagtgtttgttataggaggcgggcaggtactgagagaatatcttaaaggacctgcatgtgaggctatccatctaactgacattcagtcgagcattgagtgtgacactttcatccctccggttgacttctcagtgttccagccatggtattcatctttcccggtgatagagagcaacattaggcattcgtttgtgtcttttgttcgtgttagaaagtcagtggcagaaactcatgagtcaaatggcaaggaatcaaccgaggttgataccaagaatgacaaatttgaaacagagaatttctcttttctccccaagatggtatatgaccgccatgaggagtaccaatatctcaatcttgttgaagatattataaggtctggtgctcagaaaaacgacaggacaggaactggaacattgtcaaaatttgggtgtcagatgcggttcaacttaaggaaaaattttcctctgctgacaacaaagagggtattttggcgtggtgttgtcgaagaactcctttggttcatcagtggctcaacaaatgcaaaggttttgcaagagaagggtattcatatctgggatggcaatgcttcaagagagtatctcaacagtgttggcttggcacacagggaggaaggtgatttaggtccaatttatggatttcagtggcgtcactttggtgctgaatacactgacatgcatgctgactatacgggaaaaggttttgatcagctaatggatgtgattgacaagatcaagaatgatcctgacgaccgtcgaataattttgtcggcgtggaatccttcagatctcaagaagatggctcttcctccttgccacatgtttgcacaattctatgtggaaaatggggagctatcttgccagatgtatcaacgctctgcagacatggggcttggtgttccattcaacatcgcatcatattctctcctgacatacatgattgctcaagtttgtgatctttctcctggagattttgtccatgttataggggatgcccatgtctatagaaaccatgttcgagcactggaggagcaaattcagaagatgcctaaaccatttccaattttgaagataaatccttcaaaaaaggatatagattcttttatggcatcagacttcaagctggttggctatgatccccaccagaagatagagatgaaaatggcagtgtaatggtggcttggctggagcccccatcctatggactcggtggatgtaatcagtaggactggtactacataaaaattaaccggacaccgcactagcttgtttttggtgatggtgctgaatgttcagtgggagacgttttctctgatttatcagttgcgatttgcgtactatggtcgcttaagtcaactctacaaaatcggctcccttttatctggagccagttgattactcgattgcgagtgtgagggatgatctaggcataccctgttgcaagggcctactgggtgtgtgccggcccccatgaggctgtgacgattgcgccagtccagtacctcgtgagaattatgtaaccgaagttgccgtgtacctgggagaactcccgtactgtttggtgtttgattgcctatttcactttgcagtttggtcacaagataacgacttgctggtagggtttttgagaacacaaacaaattcaaaaaaaaaaaaaattctggggggcagaaagcctagcgccgtgcttgccgaagtcgggctagcgcttgcacttgcagcggcggtgtacgatttggttggagcgtgaagtctcaagtgatcctgc

SEQ ID NO: 19914 - DNA, 3066 bp, Zea mays
  misc_feature (312)..(312): n is a, c, g, or t
cgaccaccactctttcacgtgtcatgtcagcctttcctcatttatcctcgatatcctctgctctcgactttaccgtcagtcaagtccgagaccagtacagtcaaagctagattcaaaatcgaactactacctaaatatgaacaactattagagaccaaactaatttttactttaatagctatttatcaacttgctaaacatgattttaacaatctcctttttaagaactattggagtttataccttattcactatcatgtatcatccctaacccttgatttcaccagtgcactatcaacccaaccgcaaaanaggggcggtaaccctagttttttttggtgggagcagcggcccggcaggataagaccgcgatcgtcatcggctcatcgctcgtgccgagccaggcgctgggagatgcggatgattgctagagaagggggtttgtatccgtcggcccagaccggggagcgacccatgaaactgatcaaacgtgggctgcatccacgagcctggctcggggtcgggccggagaaccaatcagcccgttaactgctccagcgaaggcacacagcccgacagccgccgccgtttcttcatcttcctcgcaacgccgacgctgcaacttccgctccctccccgactcgcgctcggcacgcaggcaggcgactgcggtggcgctcaggctcgggctctcagcaacggcggggcagtcccagactcagcggctccctctctccaatcgccttgcgccctcgctccgttcctctgctcaccggccgattctgcgtgcgcgcctcccgctcccctatcgcctcggtcgaacgtcgacggcgcccggccccggcggctgcattgcgctgcttgcggccggcgggtagcgggagccagcaggctctgctcccccaaggcggccgcgccgctttggtagcgcttatgccccaaacgaagtgttacccatccgcttagcgctcaagcgtgcgcttaatgcgttttttggaaccctgttatttgtagttcttggtccagatgttagttgcagaggtgctcagagctggagcgtacatctctaggttttctcggcgtgcatgcaaagtatacactactagcggaatatattgtggtagcattttgcatctaaatgcttttgagttctaacaaaatgcagtttcttgcctcaacagaagttgtagactgtactttgttgaacaagtcgcactaggaacttactacattcttgctctatagaaactgtcaggcttgtgagagttctgttatgtaccgcttcttttctaaagaaaaatagtagagttttagaaaacataatgaatacagcttcttttattgaactcttagaagtactccagccattgtagtttaatttatctgcatacagttggttgtattgaacactgggacaccctgaggtctttgttgttcaattatgattatatttctgtatactttatttttaatggttaatcaaaatgctagcttatataatgctccctcaaatgcaggttgcaatattttccagcatagcttgctcacctacttctcaatttagaagacttcaatttctggatctgagcatcaaatcaagaccataccactttagtcagtcctgtctgatggcactggctgcagctccagccagtggtgattcacagagtggtcctcagaggaactatcaggttgttgtggctgccactcgtgacatgggcattggcaagggtggggtcatgccatggaagcttcttggtgatcttaaattcttcaaagaacttacactaactacaactgatcctgccaaaaagaatgcagttataatgggaaggaaaacatgggagagcattcctgttaagtcaaggccactgcctggtcgtttgaatgtcatacttactcgatctggtagttttgattttgcaacagtagagaatgttgttatatgtggaagtatgaagtctgccttagagctgctagcatcaactccatactgcttatcaattgagaaagtttttgtcataggaggtgggcaggtactgaggtgagttattagtaccttttgaaacaacatattatacatgtatgctgtcgctgcacgtaactgtgtcgcaatgctattcacccttctgcaatatttttatgtagagaatatttgaatggacctgcatgtgaggctatccatctgactgatattcagtcaagcattgagtgtgatactttcatccctccagttgacttctcagtgttccagccttggtattcatctttcccagtggtagagagcaacattaggcattcttttgtgacttttgttcgtgttagaaagtcagtggcagaaactcatgagtcaaatggcaaggaattaactgagattgataccaagaatgacaaatttgaaatagagaatttctcttttctccccaagatggtacatgaccgccatgaggagtatcaatatctcaatcttgttgaagatattataaggttcggtgctcagaaaaatgacaggacaggaactggaacattgtcaaaatttgggtgtcagatgcgattcaacttaaggaaaaattttcctctgctgacaacaaagagggtgttttggcgtggtgttgtcgaagaactcctttggttcatcagtggctcaacaaatgcaaaggttttgcaagagaagggtattcatatctgggatggcaatgcttcaagagagtatcttgaccgtattggcttggcacacagggaggaaggtgatctaggtccagtttatggatttcaatggcgacactttggtgctgaatatactgacatgcatgctgactatactggaaaaggctttgatcagctaatggatgtgattgacaagattaagaacaatcctgatgaccgccgaataattttatcggcgtggaatccttcagatctcaagaagatggctcttcctccttgccacatgtttgcacaattttatgtggagaacggggagctatcctgccagatgtatcaacgctctgcagacatggggcttggtgttccattcaacatcgcatcatattctcttttgacgta

SEQ ID NO: 19915 - DNA, 2125 bp, Zea mays
gttatctttttcatttttaagtccccgcgggtaccccgaggccgagatttagcacacctagtacttgtttgagcacgtcgcctaataaaattccccattccaatacacagatctcgcacccgtaagtggcgacgaatctcgcggtgcggaggcgcgacagaggcggtgtcgactccgacggactcgcagccaccggtggagacgccccaccggcgcactcctccaacgttcatagtttaagggcttgatttggataattagtcatcaacagaagtgataaaaaatggtggttcttgcagcatcaatcgtttcaaagtcgggaaaagcacttgtttcaagacagtttgttgacatgtctcgcataagaattgaaggattacttgctgcgttcccgaaactggttggaactgggaagcagcacacttatgtcgaaactgaaaatgtgcgatatgtttatcaacctattgaaggtttatatcttctacttatcacaaacaagcagagcaatattcttgaagatctggacactttgaggctcctctccaagctcgtgcctgaatactccccttcattggatgaggagggtatttgtaaaacagcatttgagattatatttgctttcgatgaagccatatctcttgggaacaaggaaaatgtaacagtgcaacaagtcaaacaatattgtgagatggagagccatgaagagaaggcacacaagctgatgatgcaaaccaaaatcaatgaaaccaaggatctcatgaagaagagggctaatgagcttgacaaaatgaggatggaaagaggcaaacttgacaaaggaggatactcatcaatatctggtccacgcgtgattgaaaaaactttcagtgacatgagcatcagtggttctggattaggtggactgagcactgacatggactcatttgctagcaagcccaaaggccgtccatctacagcagctactgcacctggtaaaggttttggtatgaaattaggcaagacacagaagacaaatcaattccttgaatctttgaaagctgaaggagaagtcattttggaggatgtacaaccaagtgcagtttctacaaggtcatctgctcttccaccaagtgaccctgtcacagtaactatagaagagaagctcaatgttgttgttaaaagagatggtggtattaataactttgatgttcaaggaacacttgctcttcaggttctcaatgatactgatgggttcatccaattgcagattgaaagccaagatattcctgggcttagcttcaaaacacacccaaatatcaacaaggatttgtttaacagtcagcaaattttgggagcaaaagatccaaacaggccttttccgagtggtcaaaatgaaactcctctggtgaaatggagaatccaggggatggatgagtcatctttacctctgtcagtcaattgctggccgtctgtatctggaaatgaaacctatgtgaacattgaatatgaagcttctgagatgtttgatctgcacaatgttgtcatatctatacctctgcctgcagttcgggaggctccaagtgtcagacagatagatggagagtggaagttggactcaagaaactctgtgttggaatggtctattctccttattgatcagtcgaatcgcagtggttccatggaatttgttgttcccccagctgatccgtcatcatttttccccatctctgttggattttctgcatcgagtactttcagtgatctgaaggttactggaatccttcctctgaaggaaggcaaccctccgaagttttcccagcgggctcgtttgctcacagctaactatcaagttgtttaatggttgtaccgttgtccgagtgttgatccacttaaatatattcgaatagcatatttttgtgacatggtatgctactggcatgaacttttgcaagtcatgggatggaagatcattttgggttttgaaaatctttactatgtgcttctcattgttagcatgttgcacaaatgttctgatgtgttgctaccagagaaataagtaatgttcttgcctttcgtttgcctgcaaaaaaaaaagccaaaaacccccctagggccaaaaaaaaaaactccagaagggcgcggtacc

SEQ ID NO: 19916 - DNA, 2269 bp, Zea mays
  misc_feature (2212)..(2216): n is a, c, g, or t
attgggacctcgaggccggatcgaccaattcatccaatagtggatactttgtctccaagtctcaaaacccaattcgacccacttggaaccggccttgttccccgttggatccagcctaataaaattccccattccaacacacacagatctcgcatcccggcagtggcgacgaatctcgcggggcggaggtggtggcgcgacagaggcggtgtcgactccgacgaactcgcagccaccggtggatacgcaccagcagcaccggcgcactccaccgacgttcatatttaaggacttggtttggatagttctactcgtcaacaaaagtgattaaaaatggtggttcttgcagcttcaatcgtttcaaagtcggggaaagcacttgtttcaagacagtttgttgacatgtctcgcataagaattgaaggattacttgctgcgttcccgaaactggttggaactgggaaacagcacacttatgttgaaactgaaaatgtgcgttatgtttatcaacctattgaaggattatatcttctacttatcacaaacaagcagagcaatattcttgaagatctggacacattgaggcttctctccaagcttgtgcctgaatactccccttccttggatgaggacggtatttgtaaaacagcatttgagattatatttgcttttgatgaagccatctctcttgggaacaaggaaaatgtgacagtgcaacaagttaaacaatattgtgagatggagagccatgaagagaaggcacacaagctgatgatgcaagccaaaatcaacgaaaccaaggatctcatgaagaagagggctaatgaacttgacaaaatgaggatggaaagaggcaagcttgacaaaggaggatactcatcaatatctggtccacgcgtgattgaaaaaacgtttagtgacatgagcatcagtggttctggatttggtagtggttctggattaggtggactgagcactgatatggactcatttgccagcaagcccaaaggtcgtccatctacagcagctactgcacctggtaaaggttttggtatgaaattaggcaagacacagaagacaaatcaattcctcgagtctttgaaagctgaaggagaagtcattttggaggatgtacaaccaagtgcagtttctacaagatcatctgctcttccaccaagtgaccctgtcacagtgaacatagaagagaagctcaatgttgttgttaaaagagatggtggtattagtaactttgatgttcaaggaacacttgctcttcaggttcttaatgatactgatgggttcatccatttgcagattgaaagccaagatatgcctgggcttagcttcaaaacacacccaaatatcaataaggatttgtttaacagtcagcaaattttgggagcaaaagatccaaacaggccctttccgagtggtcaaaatgaaactcctctggtgaaatggagaatccaggggatggatgagtcgtctttacctctgtcagtcaattgctggccgtcagtatctggaaatgaaacctatgtgaacattgaatatgaagcttctgagatgtttgatctgcacaacgttgtcatatctatacctctgccagcacttcgggaggctccgagtgttagacagatcgatggagagtggaagttcgactcaagaaactctgtgttggaatggtctattctccttatcgatcagtcgaatcgcagtggttccatggaatttgttgttcccccagctgacccatcatcgtttttccccatctccgttggattttctgcatcgagtactttcagtgatctgaaggttactggaattcttcctctgaaggaaggcaaccctcccaagttttctcagcgggctcgtttgctcactgctaactaccaagttgtttaacgcttgtaccgcgagtgttggtccacttgaatgctccaatagcagatgttattgccgtggacttatgcaagccatggcacgggagattattttgtgtttggaaaatttctttactatgcgcttctcattgttatagcatattgcacaaatgttgttctaatgtattgccaccagagaaataagtaatgttcttgcattttgttggcatgcaaaaaaaaaaaaaaaaaaagcaaccgcccttggttttgtaaggacgatgttatcgtctgggcttgtgtaatgtgatctgctggtggaaaagcatttnnnnnggaacccttatcccttttataataactaacaaggaacaaggtcatttcccttt

SEQ ID NO: 19917 - DNA, 1148 bp, Zea mays
ccggccgggccgggatcgaccaattcatccaatagtggacactttgtctccaagtctcaaaacccaattcgacccacctggaaccggccttgttccccgttggacccagcctaataaaattccccattccaactcacacagatctcgtacccggcagtggcgacgaatctcgcggggcggaggtggtggcgcgactgaggcggtgtcgactccgacgaactcgcagccaccgggggatacgcagcagcagcaccggcgtactccatcgacgttcatatttaaggacttggtttggataattctactcgtcaacaaaagtgattaaaaatggtggttcttgcagcttcaatcgtttcaaagtcgggaaaagcacttgtttcaagacagtttgttgacatgtctcgcataagaattgaaggattacttgctgcgttcccgaaactggttggaactgggaaacagcacacttatgttgaaactgaaaatgtgcgttatgtttatcaacctattgaaggattatatcttctacttatcacaaacaagcagagcaatattcttgaagatctggacacattgaggctcctctccaagcttgtgcctgaatactccccttccttggatgaggacggtatttgtaaaacagcatttgagattatatttgctttcgatgaagccatctctcttgggaacaaggaaaatgtgacagtgcaacaagttaaacaatattgtgagatggagagccatgaagagaaggcacacaagctgatgatgcaagccaaaatcaacgaaaccaaggatctcatgaagaagagggctaatgaacttgacaaaatgaggatggaaagaggcaagcttgacaaaggaggatactcatcaatatctggtccacgcgtgattgaaaaaacgtttagtgacatgagcatcagtggttctggatttggtagtggttctggattaggtggactgagcactgacatggactcatttgccagcaagcccaaaggtcgtccatctacagcagctactgcacctggtaaaggttttggtatgaaattaggcaagacacagaagacaaatcaattcctcgagtctttgaaagctgaaggagaagtcattttggaggatgtacctcggccgcgaccacgcta

SEQ ID NO: 19918 - DNA, 1127 bp, Zea mays
ggttttttttttttttttgttttttttttttaaataaaaggcagctgggtttcaatcgtacaattcaacaagcaaccaaatatttaggccgcttcttcaaaataatttaagacttctgaggttatagcattccataggagacgaatttcatatccctgtcaagttacggaggaatgtgctaggcaatcattgcaggtttacatatggtcaattgacaggcgacgttaaacccaagcagcagcaagttacacaactcggcgcagctctcctgtgatgagcgcaaacttacgatgctgtgacagaatggatgccaccatcgtgtctttcacttccaggttggtgagatcgtcagtatctttcaccttcaggttggtgagatcgtcaaggaaagacatgttctccttggctccactgaggacagcttgaaagatttgtagtgggtccccatggctgacaataagaattgcagagccatgaaactgtgtctctgcagataacagcacagctgaaaatctactagcaacatctgcgacgctctcgccaccttcaggagccatacagggatgtgcttcatctactgaccatatgtctgcatacttatcatgtgaaagtaactcatatgatggcccaaagtagcgctcacgaagtcccagcaccgcttcgcaactaggagcttcaaaggggatgccgagcacaccggcgaccactctagccgtctcggtggtccgtgagaacggcgagtaacgaatcttgacggaacccaccggcacaccaatctcgtcaagctccttccggaacttttcgccggccgcgcgcgcctgctcgaccccctgcggggccagcccgaactccggcttcgtgccgttctccagagatgagacgatgagaccgcgctcgttggggacgctgcggccgtggcggaggacccaatacttgttccgtaggacggctggagacgacgagctgccgctcgcatcctccatgtccttggcaaaccggcacccaatcggccgtcccgaagcaggcgagcagcagtagctggagcccagcgcttcagccgctcgatttgggattagggtcctcagtttgtgacggaaagaatttcattccgttctattctttttttt

SEQ ID NO: 19919 - DNA, 5594 bp, Zea mays
gcatttgagaacaagtctccaacagtcgggctccctccgaccaagaaaccaatcacgcggcaagtgaccgccactataaatcaagatttgagtgtcgatataactggaaggtcaccaagacataaatagtgttgacaatggttaagctagagcaaacttgagggttgtgcaattgccttgtgggtgcatagacaccatgtgatggtggtgcatataagataaaaattactctttataactagttttctatttttagggtgcaccccctaaaatatatgtagctttgcccctgagtgttggggccctctcattccgatggtgctcgaaacatcaacttattaattattctttagtaagttttaagtgtagaaggatgaatgtcgaagaacaccttcggctggagatggtgtacgattgtcgtgatcgtgaagacaaagctatgagcttcgaatcagaagtatacacacatagcagggagacggctggagcaagacgaagttctcaagacttgttcagcaagactgtgaagggaaatgacagcagtgcttttagttagtcttataactcgtaagtataggcctgagagcatgattgtaattttgaagttgtatctcacaactataaatagaggaatagtatcatgcactagacacacttttaggccagagggaatcaaatcgctttccatatgaagctatatctctcttacctttttcaaggagccaaagtatatttataatctttgttaaataataaaagaaggaaataatattttataaggttaattatgtgcttcatctttataacatgcaccatttatctttaatgtctctgttaattctttatatcttcatcatttaatcaatttctctttcaaaaaattagattaagggataaagataaagtttgatttaactgtgttaccttattttttatattccgaaagaataaaaaacgagtggccaacaaatagctctggccccgatgattgaagattacaagggcaaacaagccaaatcgctcaagctctgacctggaagtaaaatatgaaccgaagctcaaatcgtaattcgtaagagttttttttttttttttgttttttttttttaaataaaaggcagctgggtttcaatcgtacaattcaacaagcaaccaaatatttaggccgcttcttcaaaataatttaagacttctgaggttatagcattccataggagacgaatttcatatccctgtcaagttacggaggaatgtgctaggcaatcattgcaggtttacatatggtcaattgacaggcgacgttaaacccaagcagcagcaagttacacaactcggcgcagctctcctgtgatgagcgcaaacttacgatgctgtgacagaatggatgccaccatcgtgtctttcacttccaggttggtgagatcgtcagtatctttcaccttcaggttggtgagatcgtgaaggaaagacatgttctccttggctccactgaggacagcttgaaagatttgtagtgggtccccatggctgacaataagaattgcagagctgcaaggaacaaagcacaaaagtcagcttcagcaagacagatccaagcatgacttaacaagtcagcgccaactatgtgaacagtgggtagctttgctatagtaaaaagtatgaatcttaaatatcttctaaatgaacagacattgttacaatgttgacactccagaatcctggtagattgatagctagacaaggaaactctacaaactaagcatacacacgctacatgataatatgaatgtcactacaaagtcacgtctgaatattagcaatttagcgttatgctagtttgtgaatttaccatattctctgtagttattcatcttcatataccatattgactcctgttggagagctgttagtgttatgagaaacaattggtgcctatctctttttcctacttccacagagttattggtcatctgagatgagctaaactaaaacatttgtgtggccattaagatcagaaatctgtttaactagtaatttaaggtcatcaaataaggttcctattataatcgaagtaaccctaggcaatatcatatgcagcagacagcttactcaactacaatttaatcactagatgtaaccaatcccagtcaatttgtgatggcattctgatttttagtcacatatttattgttggccaagaacacaaatgattgggtgtagaattattactagcaggataccatagccttgttaacagatgtgtagtctatttatggatgacattaggttcaaatttcacaaatgtgttcaataatccatcttatatttggtcatgcaaagattcttttccaataggtcatatgggtttctatcaactgcaatcctttattcctcacattctgctgaacaacttttagtaaattacatcattttgatagtagtttcattaaaatggcatgtcgtagaacgtgaaaacaaaagataagaattgaatctgccaatacataagaatacatacccatgaaactgtgtctctgcagataacagcacagctgaaaatctactagcaacatctgcgacgctctcgccaccttcaggagccatacagggatgtgcttcatctactgaccatatgtctgcatactacttaataatatcagattcagtaacggaaagaaacataaaaaatgaaacttatagtggtacacaaaaaataacaactacactatcaattactatgataactgaattatagatatctgagtaagagctgtggttcaacttggactctatcactagacctgttaaatcataataaaaccatcagtggatcagtgctgttggtgtgggagaaaaaagtttccaaaccagagtaaaaaaacttatcttacgaagtctgaaaaaaaaacatatacgacttccaacacaacacatgtgccatgcgaatgggccagggtggcgcagcccaagctggtccatctgaccaagaggcagtagaggacagccacggaggcagctgccctggctaagcacaacacagggggtgcacaccctatgagcagcggctccaacttgccttggtgtcaactagacccagagtttgtccaaatccagagtttgtccaaatgtttctgcatcggaactatctacgcaggggcaaagataattccgatgctaaaacagctggacaaactgtgggttcagatataaccttgttctgtatccgtgactgacaaagttgaaaggataaatacaaggatgatggatgtctataaagacatttttatgtctgacaaagcggaggttgctagaaggactaagatttcttagattatagatgaaaatgcatcacttagatttcaccaaccaattcattttatagaattgaacatgtatcaaatacctcagtagatgctcatatggcttgaatgtcatttcatttctactgaaacaatataactgaaacctaagaaggaaacccaccttatcatgtgaaagtaactcatatgatggcccaaagtagcgctcacgaagtcccagcaccgcctgcaaaagtccttctatgagccaacctgatcataaaattatgtgagatctgatttgaaaatatttggctgcaatatattgacttctaatagcagcactagaaatgtaaaagaggactgatcaaacatttaccactatgctatgaccttataacactaaagcaaattacatccattctgatatacccaggtaatgtttaggctgccttagaaatcataaatcagaacaggataattgaaaaaggtactttgatgctttcatatgtaccatggtaccagttttcatgtcttgtttgctttttacaggtacagtaacattgcaacctagttctgcaaatgacaataaagagaaaagaaaatagaaaggcaaattccatgtttgctcaaatattatgttacagatatagaaggtggcatggcttaatcgtcctagattccataatcattatgcccaattgatcttaaacctatatcaccaatcatccgtatacaagattccattccaactcaggacaaaatgtgctagattcgtattgaaacaaacgcctgcctacccatacacgttaccatcaaaggcagacacagaaaatttgcgtgcactgctaaattggcttatccaggctgaagcctaactcacttcgcaactaggagcttcaaaggggatgccgagcacaccggcgaccactctagccgtctcggtggtcccgtgagaacggcgagtaacgaatcttgacggaacccaccggcacaccaatctcgtcaagctcctgcacacgcaaaacgaaaaatacacgggccagattcactaccgcacatagaatccacagcagtggggcaacgatccggtaccttccggaacttttcgccggccgcgcgcgcctgctcgaccccctgcggggccagcccgaactccggcttcgtgccgttctcctgccgtcgacagaccaggatagcatcggttggagagaattaggttgggacttggggtaggcgatgcttggagcgcgaagccgaaggaaaaaagagcgctcttgggacggggaggttcgcaccagagatgagacgatgagaccgcgctcgttggggacgctgcggccgtggcggaggacccaatacttgttccgtaggacggctggagacgacgagctgccgctcgcatcctccatgtccttggcaaaccggcacccaatcggccgtcccgaagcaggcgagcagcagtagctggagcccagcgcttcagccgctcgatttgggattagggtgctcagtttgtcacggaaagaatttcgttccgttattcttgagaacactaggtgatgctcgtgcgtgcgttgctacggagtgaacatattacgataagatatattaaaattcaaaatactaattactattttatgttcttattaacatcttttaaaagttaagatattttatataccttaaaatccctacacatcaaacaaatctatcatgtgcagtaaaatgcaatagagaagcatgcagatactttcagttttcaagcaactaatgcaaaaccagagaaacattaccagctctagacaataaaaaccatggatttaggtgatcattgtaaatttaatgctgatgctttattagatctgacccaaaaagtacaaatgaagatgatgatcaaaatggcaactcttcaaatatgctaatatttgccagtgtacaccaaagaattcaaaagagcaaaatgtttctgccacgagaactgctttacttttacaaaaaccaaaaccacataaactgaaaaaataaatttcctctcaatattttgattttagaagcactttgagttttacagaagtacttcacggtgcaagttcaacctataagccatgtagtccagtccctcatccctgaatatgagaagaaaaacaccgaaaccctgattttgtgtaatcaggtcactctacggtataacactttagttcactcccctaaaggattatttcatctaacccactgtaagaaatcacataaatgtcaagcatttaatacttctctcgactactacccaacaag

SEQ ID NO: 19920 - DNA, 3763 bp, Zea mays
ccttcctcgctccgccgcccccgaccaccgcggccgccgtgggggcggcgcggcgggagctgtcggccgcgagcctggccgtcgtggacggcgaggcgcggtacctcgtcggcacctacaagcggtcccgcgtcgtcttcgagcacggccgcgggtgcaagctctacgataccgacggccgcgagtacctcgacatggccgccggcatcgccgtcacggcgctcggccacgcggacccagacgtgtgcgccaccatcgcggagcaggccggtaaggtcgtccacgtcagcaacgtcttctacaccaaaccccaggtgggtgctcctgctccctccgatcctccctcccccgcttccctcgccatgtgttcgacgcattgctccggccggcccatttttctctgcttcatctgcagaagcgcctcgctgtcgcaggtggagctagccaagcggctcgttgaggtgtcgttcgcggaccgcgccttcttcgccagcactggcacggaggccaacgaggcggccatcaaattctcccgcaagttccagcgggccgcacacccggagagcggcgacccgcccacggagttcctggcgttcagcagcagcttccacggccggaccatgggcgccgtcgcgctcaccagcaagtcgcagtaccgggagcccttcgcgcccgtcatgcctggggtgaccttcgtggattacggcgatctggaggcggccaagaagttcgtacggtccggcagggtcgctgctgtcttcgtcgagcccgtgcagggtgagggtggcattcacagtgccaccagggagttcttgcaggggctgcgggacgcctgtgacgaggcgggagccctcttggtctttgatgaggtacggtgtactctgtcccatctctcttctctgaatctctgttcatatcgagaacccgatgatattgctagtaattcatatttcgtttacaaagcacgaaacgcgcacaatttagttgtagccatgcattccactatgaactttaggcatacagtccatatacaagagataatgtagcagagtcaagctgtgactctgttctgcattcctatcttcaacccagcgacacatcatggtcacattccttagttttcaggctgcatcaatctgtcagccatcagatgtagtaatggtggtacgtatatgctttctaaacaaacgcaggtgcagtgtggtttcgggcgcacaggccacctctgggcgcatgaggcgtacggagtggaaccagacataatgaccttagcgaagccactggccaacggcattcccatcggcgttgtcctggtgaaggagaagatcgccgcagccataaactacggcgaccacggcacgacgtttggcggcgggcctctcgcctgccagaccgcgataacggtgttcgacaagatcacgagacccggtttcctggccgaggtgtcgaggaaaggggagagcttcaagcagctgctccgcgccaagctgagcgggaacccgcacgtgagggaggtccgcggggtcggccttctcgtcggcgtcgagctggacgtgccagctggtcctctggtcgacgcgtgcttggacgccggcgtcgtcgtgctgactgccggtaagggcaatgtggtgaggctggtgccgccgctcatcgtctcggagaaggagctggagcatgccgcggatgtcataagggactgtctaccggcgctcgatgtcgttgctgctgcctaatgtatatggtggtgcaataggtccggatatgaaacctgattccaaattttggaatcgaataaatttcatgtcgggccaatgttgttgtgttcattgaaacaaactctttttttttttggaatcgaataattattacatgtcagaccgatgctagctgttccgagagcaaagtggttttattatacaaaatggtctgaagtgttaaggaaatcggaattatccggcccttacatctatatatgttgccgaataatgagcaactccaacggtctagctaaatcaactagtatcggtaaaaatagaaaaacgacgtccaaaacttgatccaacagacactctttcttcctcgcttctctatcctgctgggtatcccgtcaaggccgctggtcatctttgacgagcgcgctcgctcgctatctcttcctgttctcgtgcacgtgcctgcagatacaatgaacacgaatagacatgtacaatacagtctgatctagttcaaaagccaaagaagaaaatgagtttgctaggtccatcgtgcgatacatctccccaggctgcttgaagtatgtgtagtaccttgtctcgttggtcgatgatgtggacagtcaatttcgagtagctcggcacagcagggggtttttcatgtgatttgaatatgaatatacaaggtttatagagagtttgttggtttacctcatcgtttatgaagttatctattttttagagtcatcataaaactctaaatttagctagaattatagctaaaagaagaagaaaaagaaaaatgatggagagcccgtgtgtgtcactctcctcagtcagttctgcttcgaaagcctcgcaagcactccgaccatgggggcgacggtgacggtggatggctcggtctgcttatagttcggccgggaatcgtcgtaccggtcgttgccatcggggcccccgacgatggcgccgacgaggacgttggggttgggcgtgtccctgctgtagtacgcgaaccctcccttgcaggtgatcttgccggggctggacttgatggacggcaccgacgcgccgcggtggtgcacctgctccgggaacctggcgccgtacccgaccatgtagctcatcctctccgggttggcgccgaggatgtagtccgcctgggaccgcgcgaacgcgagcagctgcgacggcggcagcgtcgccgcgccgcaccggagcgaggatgccgccgcgcccgccaggtggtcggagtgcgcggcgaccacgaacgccgccgacgtcacgaactgcaggttgttccaagggctccaaccacagcacgccgcccgggctgagcctgccgtcgctggcgttgtgctgcagcacgccgcagaggaaccgctccccctggctcttcagtgccgccgcgttgccggcgtcggccagcttcccttggaggacgagctgcaggcaagaggaaccaaatggccgcggtcgttgttaattagcatcgcagggctattagctgcgcgcgctcgatcgcttgccttggccacgagtgcttgcgcgccgacgaacttgttgtcccatgagaagaaggtctgcgctccgccgacgttgccgtcgccggcgatgaaggccttgtagtcctcaccaccggtggcgatgaagagccagactgcagcccagagcatctcgtcctgttcccattgatcgcatcccaagttcgcaacaaggatattgcgttattccagtgcatgacatgaacattttttttctagaaacaatgtttggatcacagttctccatcggtagtacctcatcgccgctgctggcatagaattttgcagcgcctggcacgctgttctggtagaggccgcggtggttcttggcgaaactgaacagctgcagccacaaatcatcagatccagatataataataactaatgatggtaaatgcacacactgtcatggtaaactaaacgcgtgccgtaggtttttttacctgctcggcgtggccgaggagcatggcgctgtaggcagcgtcgagctggcggaacgcgacggag

SEQ ID NO: 19921 - DNA, 2181 bp, Zea mays
gatctgccatggcctcgctccagtcctttctcgccgtcaaaccggccgccggctgggccgctccgtcccgccgcgcgcgcgtcgcggccttcctcgctccgccgcccccgaccaccgcggccgccgtgggggcggcgcggcgggagctgtcggccgcgagcctggccgtcgtggacggcgaggcgcggtacctcgtcggcacctacaagcggtcccgcgtcgtcttcgagcacggccgcgggtgcaagctctacgataccgacggccgcgagtacctcgacatggccgccggcatcgccgtcacggcgctcggccacgcggacccagacgtgtgcgccaccatcgcggagcaggccggtaaggtcgtccacgtcagcaacgtcttctacaccaaaccccaggtggagctagccaagcggctcgttgaggtgtcgttcgcggaccgcgccttcttcgccagcactggcacggaggccaacgaggcggccatcaaattctcccgcaagttccagcgggccgcacacccggagagcggcgacccgcccacggagttcctggcgttcagcagcagcttccacggccggaccatgggcgccgtcgcgctcaccagcaagtcgcagtaccgggagcccttcgcgcccgtcatgcctggggtgaccttcgtggattacggcgatctggaggcggccaagaagttcgtacggtccggcagggtcgctgctgtcttcgtcgagcccgtgcagggtgagggtggcattcacagtgccaccagggagttcttgcaggggctgcgggacgcctgtgacgaggcgggagccctcttggtctttgatgaggtgcagtgtggtttcgggcgcacaggccacctctgggcgcatgaggcgtacggagtggaaccagacataatgaccttagcgaagccactggccaacggcattcccatcggcgttgtcctggtgaaggagaaggtcgccgcagccataaactacggcgaccacggcacgacgttcggcggcgggcctctcgcctgccagaccgcgataacggtgttcgacaagatcacgagacccggtttcctggccgaggtgtccaggaaaggggagagcttcaagcagctgctccgcgccaagctgagcgggaacccgcacgtgagggaggtccgcggggtcggccttctcgtcggcgtcgagctggacgtgccggctggtcctctggtcgacgcgtgcttggacgccggcgtcgtcgtgctgactgccggtaagggcaatgtggtgaggctggtgccgccgctcatcgtctcggagaaggagctggagcatgccgcggatgtcataagggactgtctaccggcgctcgatgtcgttgctgctgcctaatgtatatggtggtgcaataggtccggatatgaaacctgattccaaattttggaatcgaataatttcatgtcgggccaatgttgttgtgttcattgaaacaaactcttttttttttggaatcgaataattattacatgtcagaccgatgctagctgttccgagagcaaagtggttttattatgcaaaatggtctgaagagtgttaaggggaccggccggatccggcatatacatctatagatgttgccgaataatccatcctctaaagcgcaaactcctggttcctgctaaaagaagaagaagaaaaagaaaaatggtggacagcccgtgtgtgtcactctcctcagtcagttctgcttcgaaagcctcgcaagcactccgaccatgggggcgaccgtgacggtggacggctcggtctgcttatagttcggccgggaatcgtcgtaccggtcgttgccatcggggcccccgacgatggcgccgacgaggacgttggggttgggcgtgtccctgctgtagtacgcgaaccctcccttgcaggtgatcttgccggggctggacttgatggacggcaccgacgcgccgcggtggtgcacctgctccgggaacctggcgccgtacccgaccatgtagctcatcctctccgggttggcgccgaggatgtagtccgcctgggaccgcgcgaacgcgagcagctgcgacggcggcagcgtcgccgcgccgcaccggagcgaggatgccgccgcgcccgccaggtggtcggagtgcgcggcgagcacgaacgccgccgacgtcacgaactgcag

SEQ ID NO: 19922 - DNA, 1553 bp, Zea mays
ctgcgacacgcgaggacccacatcccttcgtcctcgatgttctcgaaggatcatgccgatgccgcagggcgcgggcagaaggccaaggcacacggcggaagcggaagcggaagcggaagcggaagcgggagccggaagccgcgaaaagccatgtgtcgctcacgtgaaaagagcacctcggcttcgcctgctttcgcagctcgcacggcaccttctccaaaagcgagaagcaggaactcggcaaacttcgagggggcaaagcgcaaaaagcgcagaacgccagaggttttctccgcagtctagaaaatgtgccaaacccgtcgcttcgtcttcctctccttccggcttccggccccgctcctccccaaaatcccccaaaacctgacgagctggagggccgatccgcggctccccgccgcctgatccgagcagtctactcggcccagccggggatccaagcgggatggggtacttgagctccgtgatcggccaccccaccgatggatcctccgtcagcggcggcggcctcagccagaatggtagatttagctatggctatgcaagctcccctggtaaaagggcatccatggaagacttctatgagacaaaaattgattgtgttgatggtcagatagttggtctttttggagtttttgatggtcatggtggtgctaaggtagcagagtatgttaaagaaaacctgttcaacaatcttgttagtcatccaaagttcatcagtgatactaaagtcgctatagatgatgcttataaaagcaccgacagtgaattcttagaatctgacagtagtcaaaatcaatgcgggtcaactgcatcaactgctgtacttgttggtgatcgtctcttcgtcgcaaatgttggtgactctagggctatcatatgcagggaaggaaatgctattgctgtttcaaaggatcacaagcctgatcaaactgatgagcggcagcgtattgaagatgctggaggttttgtgatgtgggcaggaacatggcgcgttggtggtgtacttgctgtttcgcgtgcttttggtgacaaactcttaaagcaatatgtggttgtggatccggagatccgagaggaagttgttgatgacacactcgagtttcttatccttgcaagtgatgggctgtgggatgtggtctctaacgaggaagctgttgcgatgactagatccattaaggacccagaagaggctgcaaagatgctcttgcaagaggcgtacaagagggagagcagtgacaacataacttgcgtcgtcgtgcacttcttgcatgggcaaggtagcagcggatacgcttaaagcgtagcagtaaaattattttacgcagtggtgtgctctgatgtacatgcgtcgattgatttcccgatgttaaatggagaaacgtaactacgtaaggtaggaaacgtgtattatgatgggttgaactgggaaatgcgtgtaccctatactatatatatatactgtagtgtggtcgcggacgatgtttgggtcaaaacgcggccttgggtctgaagatagtgttgtattgttgtgg

SEQ ID NO: 19923 - DNA, 1337 bp, Zea mays
  misc_feature (2)..(3): n is a, c, g, or t
  misc_feature (23)..(25): n is a, c, g, or t
  misc_feature (1322)..(1324): n is a, c, g, or t
  misc_feature (1330)..(1336): n is a, c, g, or t
cnncggccgggaaaaaatttccnnnaaaaaaaaaaaaaaaaaaaaaaaaaaaaaaaaaatcctttccggcttccggccccgctcctcccccaaaatcccccaaaacctgacgcgctggagggccgatccgcggctccccgccgcctgatccgagcagtctcctcggcccagccggggatccaagcgggatggggtacttgagctccgtgatcggccaccccaccgatggatcctccgtcagcggcggcggcctcagccagaatggtagatttagctatggctatgcaagctcccctggtaaaagggcatccatggaagacttctatgagacaaaaattgattgtgttgatggtcagatagttggtctttttggagtttttgatggtcatggtggtgctaaggtagcagagtatgttaaagaaaacctgttcaacaatcttgttagtcatccaaagttcatcagtgatactaaagtcgctatagatgatgcttataaaagcaccgacagtgaattcttagaatctgacagtagtcaaaatcaatgtgggtcaactgcatcaactgctgtacttgttggtgatcgtctcttcgtcgcaaatgttggtgactctagggctatcatatgcagggaaggaaatgctattgctgtttcaaaggatcacaagcctgatcaaactgatgagcggcagcgtattgaagatgctggaggttttgtgatgtgggcaggaacatggcgcgttggtggtgtacttgctgtttcgcgtgcttttggtgacaaactcttaaagcaatatgtggttgtggatccggagatccgagaggaggttgttgatgacacgctcgagtttcttatccttgcaagtgatgggctgtgggatgtggtctctaacgaggaagctgtcgcgatgactagatccattaaggacccagaagaggctgcaaagatgctcttgcaagaggcgtacaagagggagagcagtgacaacataacttgcgtcgtcgtgcacttcttgcatgggcaaggtagcagcggatacgcttaaagcgtagcagtaaaattattttacgcagtggtgtgctcggatgtacatgcgtcgattgatttcccgatgttaaatggagaaacgtaaccacgtaaggtaggaaacgtgtattatgatgggttgaactgggaaatgcgtgtaccctatatactatatatatactgtagtttggtctgtattgtggtcgcagacgatgtttgggtctgaagatagtgttgtattgttgtggaaaaaaaggataattcccccttacaaaaaaaaaaaaaaaaggggcggccnnnctcgannnnnnnc

SEQ ID NO: 19924 - DNA, 810 bp, Zea mays
cattgggtacctcgaggccggccgggaaaaaaaaaactcgcatcaactgctgtacttgttggtgatcgtctcttcgtcgcaaatgttggtgactctagggctatcatatgcagggaaggaaatgctattgctgtttcaaaggatcacaagcctgatcaaactgatgagcggcagcgtattgaagatgctggaggttttgtgatgtgggcaggaacatggcgcgttggtggtgtacttgctgtttcgcgtgcttttggtgacaaactcttaaagcaatatgtggttgtggatccggagatccgagaggaagttgttgatgacacactcgagtttcttatccttgcaagtgatgggctgtgggatgtggtctctaacgaggaagctgttgcgatgactagatccattaaggacccagaagaggctgcaaagatgctcttgcaagaggcgtacaagagggagagcagtgacaacataacttgcgtcgtcgtgcacttcttgcatgggcaaggtagcagcggatacgcttaaagcgtagcagtaaaattattttacgcagtggtgtgctctgatgtacatgcgtcgattgatttcccgatgttaaatggagaaacgtaactacgtaaggtaggaaacgtgtattatgatgggttgaactgggaaatgcgtgtaccctatactatatatatatactgtagtgtggtcgcggacgatgtttgggtctgaagatagtgttgtattgttgtgggaaaaaagataattgcgctttaggttttgtttgtttcggattactaaaagggctcgagggggggc

SEQ ID NO: 19925 - DNA, 1259 bp, Zea mays
ggccgctttttttttttttttttttgatttttttttaagaactttctaagcatcatatatataatccataagggtagcattatttatgtacaaatcgaccgtaccactcgaactccctaattgaaaccacctgtatttatccttctaaagtcggagatacctatcgagcactgtagatctttgcaatctaagaactgctaggagcagcctccagtaagctcaagtactctgcgatagcctgtccttcgttactgacatcaatatcgtagtcatccaaggcatcccccttcagttcattggcaagctcactttccatcgacgcatccctggctggaactggatgagagtttgcgtcttcgtcttcatcatctgcagctacttcaccaatcataatttcatcttggtttgcagtttcttcattgttcattggaggagcatctccatctgcagcatgtggaggagcacctccaacggcagcatgtggaggagcattatcaagagtatgagaattgttgattgctggagcagccctggcaacagctgccctggaacgcgaggatcctgcaccaaacccacaagatgcccggcttctccttgcctgaattttactttgtagggtaccagttttgttcaggatttgtcaataggtctaacgctttgtcagcatcattttcatttatgcgcagtgcttctgcagcaagatacttctcaaatccgatagcagtcaagcctttcagcttctgcatgtcaactgccttgttcatgggagttttaccatatgccatttgtttcagaatctctctttgcctcactcgatcctcctctcttctacgaagtttcttttcacgctcctcacataacagttcgactgatgattgaatatcatagccagtcatcttcaatgccctttttgcagaccgtgcttcatagcccatatccattaacattgatatagcttcgtctggcacttggagctgcaggtatttagcatgggcagaagtgagagattcacgcgccttttcaacatgaccattatggtatgccaccactccttccaaaagctccagccttacgagaaatagcaagatcagcttgccggccagcctggagtattctgaagcgggtggaatctttcccatgagaacgctcaaaacctaaccgtgctttttctaggcgggcccctgcgacctctaagcacgatacatcacgaagcacaaaataacaccatactatatctattccgggcattggcacattat

SEQ ID NO: 19926 - DNA, 1128 bp, Zea mays
  misc_feature (13)..(13): n is a, c, g, or t
  misc_feature (185)..(185): n is a, c, g, or t
  misc_feature (192)..(192): n is a, c, g, or t
gggaggggggggngcaaactataaatatggtttttactggcacttctatcaggatgggaaaatagaggcagaagtaaagcttactggaattctcagtttaggggccttgatgcctggggaatcgaggaaatatggcacaactattgcccctggggggggtgggggggttcatcattatttctttnttgcccntatggacatggctgttgattgcaaacctaatgaagctcataaccaggtggttgaggttaatgttaaagtggaaagtgcaggcacacataatgtgcataataatgctttctatgctgaagagaagttgctcaaatctgagttgcaagcaatgcgtgattgcgacccttcatctgcccgccactggattgtacgcaacacacgaactgtgaatcggacggggcagccaactggctacaggctcgtacctggttcgaactgcctgcctttggctctgcctgaggcgaaatttctgaggagggctgggttcttgaagcacaacctctgggtcactcaatacaagcgtggcgagatgttccctggaggggagtttcccaaccagaatcctcgcatccatgagggtctgccaacatgggtcaagaatgataggcctctggaggaaaccgacattgttctctggtacgtgttcgggctcacccatatccccaggctagaagattggccagtcatgccggtggagcacataggcttcatgctcatgccacatggattcttcaactgctcgcctgcggtcgacgtgcctcccagctcgtccgatgcggatgtcaaggaagccgagtcgcccaaggccatccagaatagcctcatatcgaagctgtgagctttgctgttctgccgaggaaaaaggatccgcgcgcggctgctctccctactatttttttatcgtattccgcgagtaaaaaggaaaactgctcgatgtccttttgtttgttgcttggtaataccgttctgtttgctataattgtttgatggttttctatgattatcgatcagcgggatgtgaagtactgtttacattgctcgcgttctaataaagtactgtttggacttgcttaacaaaaaaaaaaaaaaaaagctcaagggggggcccggtaccca

SEQ ID NO: 19927 - DNA, 2240 bp, Zea mays
  misc_feature (9)..(9): n is a, c, g, or t
cggcactgngccgacgcctacttttttggccctttccaaccatcactgctccctagaagcaaaggttctgctgttattccaagcaggctacctcctaggagggccagacttgttgtctataacaaacaatcaaatgagacaagtatttggatagtggaactatctgaagtgcatgccgctactaggggtggacatcacagagggaaggtgatatcatctgatgttattccggatgttcaacctgccatggatgctatggagtatgctgaatgtgaggctactgtcaaaagttatcctccatttattgaagctatgaagagaagaggtgtggatgacatggatcttgttatggtggatgcttggtgtgctggctactacagcgaagctgatgctcctagtcgcagacttggcaagcctttgatattttgcagaactgagagtgatagccccatggagaatggttatgctcgtcctgtagaaggaatccatgttgttgttgatatgcagaataatgctgtgatagagtttgaagataggaagttggttcctctaccccctccagatcatttgagaaactatactcctggggagacaagaggaggtgttgatcgaagtgatgtaaaaccacttatcatcaatcagcctgagggtccaagttttcgaattaatggctattttgtggaatggcagaagtggaacttccgtattggcttcacccccaaagagggtttggttatctattctgttgcttatgttgatggtagccgtggacgtagacctatagcacataggctgagctttgttgagatggttgttccttatggagatccaagtgaaccacattatcgcaagaatgcatttgatgctggagaagatggacttggaaaaaatgctcattctcttaagaagggatgcgattgcttgggctacataaaatattttgatgcacatttcacaaacttcactggtggtgtggagacaattgagaactgtgtttgtttgcatgaggaggatcatgggatcctttggaaacatcaagactggagaactggtttagcagaagtaaggcggtcaaggaggctcactgtttcatttatctgtacagttgcaaactatgagtatggtttttactggcacttctatcaggatgggaaaatagaggcagaagtaaagcttactggaattctcagtttaggggccttgatgcctggggaatcgaggaaatatggcacaactattgcccctggtctgtatgcaccagttcatcagcatttctttgttgcccgtatggacatggctgttgattgcaaacctaatgaagctcataaccaggtggttgaggttaatgttaaagtggaaagtgcaggcacacataatgtgcataataatgctttctatgctgaagagaagttgctcaaatctgagttgcaagcaatgcgtgattgcgacccttcatctgcccgccactggattgtacgcaacacacgaactgtgaatcggacggggcagccaactggctacaggctcgtacctggttcgaactgcctgcctttggctctgcctgaggcgaaatttctgaggagggctgggttcttgaagcacaacctctgggtcactcaatacaagcgtggcgagatgttccctggaggggagtttcccaaccagaatcctcgcatccatgagggtctgccaacatgggtcaagaatgataggcctctggaggaaaccgacattgttctctggtacgtgttcgggctcacccatatccccaggctagaagattggccagtcatgccggtggagcacataggcttcatgctcatgccacatggattcttcaactgctcgcctgcggtcgacgtgcctcccagctcgtccgatgcggatgtcaaggaagccgagtcgcccaaggccatccagaatagcctcatatcgaagctgtgagctttgctgttctgccgaggaaaaaggatccgcgcgcggctgctctccctactatttttttatcgtattccgcgagtaaaaaggaaaactgctcgatgtccttttgtttgttgcttggtaataccgttctgtttgctataattatcgatcagcgggatgtgaagtactgtttacattgctcgcgttctaataaagtactgtttggacttgcttaacaccaaaaaaaaaaaaaaaaaaacagcaaataatgcgctcacacgaccatcagcctctgccgtcacaggaatgactgtttt

SEQ ID NO: 19928 - DNA, 2716 bp, Zea mays
  misc_feature (2269)..(2269): n is a, c, g, or t
gccggccgggcgatcatcgagtcatccatctaaacatccgatccgaccatggcggcagacgcacttcggggccttctccccggcgtttacgccgtgctgatggtaatcgccgtcgcaagcgctgcctccagcgacgtgtcctcggtggtcgtcgggctcgccaaatgcgccgactgcaccaggaagaacttgaaggccgaggcggcattcaagggtcttgaggtggcgatcaagtgcaagaacagcaaaggcgagtacgagagcaaggccatgggcaagattgatggctctggcgccttcagcatcccacttagcacggacctccacggcgctgactgcgttgcacagctccacagcgctgcggggaacccgtgccccggtcaagaaccttccagaattgtgccacaatcgtcaaagggcaacttcgtcgtggtccctggaaagacagactacccatcgaaggaatgtgcgtccgcaaccctgtgcgggtcgatcaagaagcacctactagaccatttccacaagaaacctgtgccaccaaagccaaagccagaacctaagccagagccggagccgaagccagagaaccacccacctacaccaacatacggatcctcaactccgatctaccatcctccatccaggcagttgtttgacaagaaacacatgtttgatcacttccacaagcaccacgactaccatcacttctttgaccacttccacaagaaaccagttccaccaaagccaaaaccagaacctaagccagaaccaaaacccaagccccagccagagtaccactctccaactccaacatatgggtcgcccacaccgatctaccaccctccggctaggcatttgtttgataagaagcccttgctagatcacttccataaggaccatgactatcaccacttcttagaccacttccacaagaaacccgtgccacaaaagccaaagccagaacccaagccacagcctaagcctgagtaccaccctccgacacccacatatgtttctccaactcccatctatcacccgcccgctgagacagaaatgaagtatgacaagaagcacttctttgatcactttcacaaggaccatgactaccaccacttctttgaccacttccacaagaagcccgtgccacccaagccaaaaccggagccagagccaaagccaaagccacaacctaagccagagtacaagccccccatgcccacatacgggtctccaactcctatctaccatcctccagccaagaaagaagtggcatttgacaagaagcacttccttgatcacttccacaaagaccatgactaccaccactttttttaccactttcacaagaagcctgtgccaccgaagcctaagccggagcccaagccagagctcaaaccacaacctgagcctgagtaccacccccctacaccgacctatggatcaccgactcctatctaccaccctccggccaagcattgatcgatggagttgaatggtggtcagtgatcgacgtcgctagctaagagttgcatgtgtggtctagctagcgtggtttgcagtcccgcctttttgtttctacagaataaattatagctttatttgggtatgtatacttatttgtgtatcggttagtatcatataaatgtatgatttgagtgtgcgttgtttttaatatgcatgttctatgatgtactttattccttttaaaatattattatttatatgtagaagttaaaaggtttacagtagtgtgatttgcttcttttcgcatgcccgaaggtctggatgtgtggacgatcaatgtgctgaagtgaatagtgtaatgtatgcccgtctcgatattagtcataggataatattctggatacaaggttgtcctatatattgttttatctacgaagaaaaccatctctagggttagtttggaaattaaactcaaatttagtataacacgacctcattttttttattgtactactaattattagattatgatgaatgaaatgatgatcaactcattctataatctattccacaaaccaaataaaaaactatagaaagttaatggtggaccatttcattcggcttaccaaacacactctagagaaccaataactattgtgaccactgcaaattattagaaacacgtaacaaaagacataaggttgagatcaaggtatttagtgttgaccccatctcagctaatgtgacaaggggatatataatttgtaggatcattggacataatgagatatgtaattagaggggntgaatgattgcggaaaataaaatatattataacaccttctcctaattacaaaaccaatttgattaacttttctaaatctatacagaactcattaaaacaagattgttcaaaatttgtatctctgatcgacctaaattttttaaaaattgaacattaacataaaattacataacttaccaaactggaatcatgttagacttcccagatctaaagatattaatgaaacaagactattgtgataaaagtatgataaaaattaatcaagctctattttcatgattaatcaagaactataaaagattaaatatccaaactttgtagatcactaacttgatgccttagcaattatctagataagccaaatcagtgtaaaatcaaaaataggcatgcaaataaggaacaaagaaagaggaactaagtttacaacactaatcttgcataaacatc

SEQ ID NO: 19929 - DNA, 1831 bp, Zea mays
ttgggtacctcgaggccggcccggtggggacctgccggccggccgggatcatcgagtcatccatctaaacatccgatccgaccatggcggcagacgcacttcggggccttctccccggcgtttacgccgtgctgatggtaatcgccgtcacaagcgccgcctccagcgacgcgtcctcggtggtcgtcggcctcgccaaatgcgccgactgcaccaggaagaacttgaaggccgaggcggcattcaagggtcttgaggtggcgatcaagtgcaagaacagcaaaggcgagtacgagagcaaggccatgggcaagcttgatggcttcggcgccttcagcatcccacttagcacggacctccacggcgctgactgcgttgcacagctccacagcgctgcggggaacccgtgccccggtcaagaaccttccagaattgtgccacaatcgtcaaagggcaacttcgtcgtggtccctggaaagacagactacccatcgaaggaatgtgcgtccgcaaccctgtgtgggtcgatcaagaagcacctactagaccatttccacaagaaacctgtgccaccaaagccaaagccagaacctaagccagagccggagccgaagccagaacctaagccagagccagagaaccacccacctacaccaacatatggatcctcaactccgatctaccatcctccatctaggcagttgtttgacaagaaacacatgtttgatcacttccacaagcaccacgactaccatcacttctttgaccacttccacaagaaaccagttccaccaaagccaaaaccagaacctaagccagaaccaaaacccaagccccagccagagtaccactctccaactccaacatatgggtcgcccacaccgatctaccaccctccggctaggcatttgtttgataagaagcccttgctagatcacttccataaggaccatgactatcaccacttcttagaccacttccacaagaaacccgtgccacaaaagccaaagccagaacccaagccacagcctaagcccgagtaccaccctccgacacccacatatgtttctccaactcccatctatcacccgcccgctgagacagaaatgaagtatgacaagaagcacttctttgatcactttcacaaggaccatgactaccaccacttctttgaccacttccacaagaagcctgtgccacccaagccaaaaccggagccagagccaaagccaaagccacaacctaagccagagtacaagccccccatgcccacatacgggtctccaactcctatctaccatcctccagccaagaaagaagtggcatttgacaagaagcacttccttgatcacttccacaaagaccatgactaccaccacttctttgaccacttccacaagaagcctgtgccaccaaagcctaagccggagcccaagccagagcccaaaccacaacctgagcctgagtaccacccacctacaccgacctatggatcaccgactcccatctaccaccctccggccaagcattgatcgatggagttgaatggtggtcagtgatcgacgtcgctagctaagagttgcatgtgtggtctagctagcgtggtttgcagtcctgcttttttgtttctacagaataaattatagctttatttgggtatgtatacttatttgtgtatcggttagtatcatataaatgtatgatttgagtgtgcgttgtttttaatatgcatgttctatgatgtactttattccttttaaaatattattatttatatgtagaaaaaaaaaaaaaaaaaaaaaaaaaaaaaaaaaaagacccaaaaaaaaaa

SEQ ID NO: 19930 - DNA, 1963 bp, Zea mays
agcatttaacatggacagttttaattcaatagaaagaactgttgtctctttatattgtgtgaacatagtctatagctttttctagcatacaaggggcaatcgcaagcagttagtacaaatagttaaagaacattagaactgcgaagcatagaaaaagcatgcttttttaaaaaaatactggagcagtattcggagcataccccatggtggaggagcaaagaggcctttgatttcttcaacatgaaggcgtgggacaagctcaatcagcaagcggtcgttcaaccatcttcttgatctccggttgctgacctgagtgatataacattgcaatgtgtaaagcattgacctgcagtcactcagcctcgcgagcaatggcctctgcggcagcatctcgatcctcggtgagctcaccagcctggcatccctcaacatctcgtacaacaactcttgacgcgattaacacaacacaaataccagggaggatcttctgtcggttcgggtcgcgatcaaagataaatccgactatattcagatgcacgattaccacatgcaaagctgcaaacttgaaaaaggaatacaggcaatcatcaacttatgacacactcttcaggagcgtatatggttcagcaatcacacagacaagctctactatcatattaacaatgatgaaaaccaaaataagcaaccacacactaatacttcatcttcagcaataaaaaacgattgaatctgaagctggtccggctgttctagaattcttgcgctatggcaacatccatagccatttcattctcgcccatgttctctttatcttcatgggtgatctccttcacaacatcaacagattcctgatctggaagggctgaggatgcatcgctatctccattgctaacttcctcctgacccttggcctctttcttggttttcttaccagtgttcttagcaactacttcctttgcggtggtgcattttactggattcctgttattggagcctctgacccttgcatcaggtttcgctttctgaatgccctctttcttcccagcttccttactttcagtagcaccagagtttagtgaccttggcttcagattacaattggctgacacattggagacagtacgagcagccttgtcagacttttttggttgctctgagggctctgcagagatcttcagcttctcaaaatcgtccacaatatcataaacctgaagaatgtccttgactgggtcctccaattctgtcgctaggcaatggcgggctacataggacttgagttcttccctcatccggtccaaaggctcacattctgattcaagagcaagcttaaagaagcccagagaaactgagtgtttggaagcagcctctgcaagcctgatctgtgtcatccagtacgagattgaagaaagcgtgctgaacttgcgccttgacatggacatggacacttctgatgtcggagtatcaaacctcccctggctgtccgatctctttgaccgaaccccagacaccggagtcacagttccagaaggtattggccttgggctagctcctggcttggtttgtattgagtgcctccgtggaggcttgacaaacttatccttcacagaaaggcctaaacacatgctcttgctgacatctgaagatggttttgcccgacgcggtgcagatatggtggtgggaggcgcatccgccgccgagaaaacggccgcggccttccccttgctcgccgaccgcagcgggtagcgcagcttcgacgccctcgccgcagacccaccgccagccgattgctcgccagaagtggccatcgagctcagacccccgccccgcccgcttgcgaaactatcgagccgacacggaggttgaggaaaccggccacgcgagaggaacttccgagagaggtttggggtttgaggatttcgtttcggttgcgcgtgcattcgtcccgccggctcgaggtcccaat

SEQ ID NO: 19931 - DNA, 1770 bp, Zea mays
agggccgcttttttttttttttttccccttgtccggaggtttttcttttttaaataaaattcaactatattcagttgcacggattagcacatgcaaagccgcaaacttgacagaggaataaaagcaatcatcaacttatgacacgctcttgaagaccgttcaaggtccagccagcaagcaatcacacaaacaagctctactaataacatattaacaattgaaaaccaaaataagcaaccacacgctaacacttcatcttcagcgatagaaaaaaaaggggatcgaatctgaagttggtccggctgttctagatatcttgggctacggcgacatccgctgccatttcaatatcgcccatgttctctttatcttcatgggtgatctccttcacaacatcagcagattcctgatttggaagggctgacggagcctcgctaacttcctgctgacccttggcccctttcttggtttccttaccggtgttcttggcaactgcttcctttgcggtggtgtttttgactggattcctgttacaggagcctctgacccttgcaccaggatttactttctgaatgccctctttctttacagcttccttgctttcagtagcatcagagttcagtgaccttggcttcaggttaccattcggtgacgcatttgtggcagtacgagcagccttgtcagacttttttggttgctgtgagggctctgcagagatcttcagcttctcaaaatcatccaaaatatcataaacctggagaatgtccttaactgggtcctccaattctgtcgccaggccatgccgtgctacgtaggacttgagttcttccctcatccggtccaaaggctgtataaaaacacccaacaatctaatctgatcacatctatgtaacaagcttatttgataaaaaaaattaacaaaacgaataaacaagagatgctcacctcgcattctgattcaagagcaagcttaaagaagcccagagaaaccgagtgcttggaagcagcttctgccagcctgatctgtgtcatccagtacgagatcgaagaaagcgtgctgaacttgcgccttgagatggacatggacacttctgatgtcggggtatcaaacctcccctggctttccgacctctttgaccgaaccccagacaccggagtcacagttccagaaggtgttggccttgggctagctcctggcttggtttgtattgagtgcctccgtgggggtttggcagaattatccttcacagaaaggtctaaacacatgctcttgctgacatctgaagatggttttgccctatatataaagaatcagatgaagaatgttctcttagagcaaaaaaactagtagctcatataaacgttacgatggaagttgagaggtgcccagcttaaattatagacaattgtaggtaaactgacataacaccaaacaatcaaatgcttagttttgaagagatagcctgcacatctctactgtcttgaaggctgacggatgatcttcccatagacagcttgaagttttgatagctcactagctcggcatcgtgatgggtaatgcactagtgctgctgaacaaatcaatgtgcaactacctagacctactacacctaaagctgtacacgcctctactgtatatgaaggagacccacaaagaaacatcacagagttacctgtctaaattagctcctatatatttacaatgagttcagagacttgagctcaggaataggcaaaactaagatatggcaagtgggagtgtgggactgc

SEQ ID NO: 19932 - DNA, 1477 bp, Zea mays
ttttttttttttttttggaggaaccacgagaatagataaattcaactatattcagttgcacggattatcacatgcaaagccgcaaacttgacagaggaatgaaagcaatcatcaacttatgacacgctcttgaagaccgttcaaggtccagccagacagcaatcacacagacaagctctactaataacatattaacaatcgaaaaccaaaataagcaaccacacgctaacacttcatcttcagcgatagaaaaaaaaggggatcgaatctgaagttggtccggctgttctagatatcttgggctacggcaacatccactgccatttcaatatcgcccatgttctctttatcttcatgggtgatctccttcacaacatcagcagattcctgatttggaagggctgacggagcctcgctaacttcctgctgacccttggcccctttcttggtttccttaccggtgttcttggcaactgcttcctttgcggtggtgtttttgactggattcctgttacaggagcctctgatccttgcaccaggatttactttctgaatgctctctttctttacagcttccttgctttcagtagcatcagagttcagtgaccttggcttcaggttaccattcggtgacgcatttgtggcagtacgagcagccttgtcagacttttttggttgctgtgagggctctgcagagatcttcagcttctcaaaatcatccaaaatatcataaacctggagaatgtccttaactgggtcctccaattctgtcgccaggccatgccgtgctacgtaggacttgagttcttccctcatccggtccaaaggctcacattctgattcaagagcaagcttaaagaagcccagagaaaccgagtgcttggaagcagcctctgccagcctgatctgtgtcatccagtacgagattgaagaaagcgtgctgaacttgcgccttgagatggacatggacacttctgatgtcggggtatcaaacctcccctggctttccgatctctttgaccgaaccccagacaccggagtcacagttccagaaggtgttggccttggactagctcctggcttggtttgtattgagtgcctccgtgggggtttggcagaattatccttcacagaaaggtctaaacacatgctcttgctgacatctgaagatggttttgcccgtcgcggagcagagatggtgggaggagcatcagccgccggggaaacgaccgccgccttccccttgctcgccgaccgcagcgggtaccgcagcttcgacgccctcgccgcagacccgccgccagccgattgttcgccggaagtgaccatcgagctcaaaccccgccgcccgctcgcgctgaactaccacggagattggaggaaaccagcgaccggaggtgaaactttcgacagaggtttggggtctccgactctcccggcccgccgcgacccgagcgatcccggccggcctcgaggt

SEQ ID NO: 19933 - DNA, 1070 bp, Zea mays
cctcgaggccggccgggaccatactgtttcgctggcggcaggccgacggctacggagacggaagtggcgaccggttccggcgaggcgcaggcgacagataggggacagggcgaccatttctagcgaggcaggagcggggaagatccggaagctgcgatgtcgaagcggctgctgtcgcggctgctcggcatgttccaatcgcggacgcaggtgggcgtcgacaaggccggcaaccgctacttcacccgcgttgaggaggtcgacggcacaatgaaggagaggcgctgggtggagttcaagggcgcagaccaggactcgaccaccgttccagtcgagtggatttgctggctgaatggccaaaggaagaaagctccaacaccagaggaattggctgagctggaggcaagacgtgaacgtgtcaagcaaaacattcagcttctcaaaaagaaagaagaagaggaaagaaaaactggtatccaaccagtcaagaaaattgggaaagctgaatctccaaatctccaaagtttcgtgaagcagcagttctcgggtactcctccagatcagcagaaaggacctgaggataggcctaaggacacaactcatacagaagatgctacgacagacaatgagaggtatactgaaccaacgggaactggtgccactttcaagccagggacttggcagccaccaacatgaatgccaacatgaactttagaagatgaaggacggtgtaccggagcattttcctttcacctatctgtgtaacattttaacatttgctctgaaagaatcactagcctatgttccttctttcagatggttacccatctgatggagttatagccttaagttccttcttttagatgcttacccatctgatggagttataggtgatcgggggctcccacggtatgctgttttttttgtggctaaattgtcctctgtaatctttactgtgatagcaactgtaataaactggaccagtgttttgcatcagaactctcttagagacacggttcaaaaaataaaaccaaaaaaaaaaaagagtaagaactacaaaaaaaaaacaa

SEQ ID NO: 19934 - DNA, 978 bp, Zea mays
gagcttccagcacggcagtcggttgagtcaccgtccgccactccgttagcagctgccggtcgatcttgccgcgcaagcagccctcaggccggcccagcggcgctttcttcagccatggcgtgcgcggcggcgcacatgttcgtgtacaacgccactctctgcgcctgcgaccctgggtactacctcttcaccaattccagcggcggcggcggcaacgcaagcagcgccagtaccagctgcgtgtcattgccccgcagcggcgacgggttcggcgactggcaggtcggatccgtaggcgcgtcccggaaccagagcttctacttcctgaccccggtcctctctctcgacgtcgtccgccgcctcacccagtcccaggccgtcatcctctgggtcgcgctcctcacgctgctctcctggctcgccttctgcgccgccgccaggttcgccggccaggaccccgagcgccacaagaagctcttcggcgcccggttctgggtcagccgcctcgactgcatcttcgacaacaaccactatgcgaatgatcagcaagtactgaggaaaagaaaaacagagctgggcggcacgttctcagtggctaccttgatactattccttggattagtcatagttctgctgtatcaagccatcaacaggcgtaacgcccaagtacatcgagtgaaaccagctaatgctccggatttgctagatttcgtgaatgaccttgagtttcacataaccactgtctcaagcatgtcttgcgcccaagtagtggcaccttctacaatagcaatgggaactcctgggtttatggacttcagggtactgccactgtcaacactcttgacctacagttgccagaacacgagtgagggcccatcaattacactaaagtgcaatggctgccgaatccctccgggggccctctgtgtccccgcgcagtttgttgacctgccaaggcaaccggctgccgctgttggc

SEQ ID NO: 19935 - DNA, 1092 bp, Zea mays
cattgggtacctcgaggccggccggggtggaccagacacccatactgattcgctggcggcaggccgacggctacggagacggaagtggcgaccggttccggcgaggcgcaggcgacagataggggacagggcgaccatttctagcgaggcaggagcggggaagatccggaagctgcgatgtcgaagcggctgctgtcgcggctgctcggcatgttccaatcgcggacgcaggtgggcgtcgacaaggccggcaaccgctacttcacccgcgttgaggaggtcgacggcacaatgaaggagaggcgctgggtggagttcaagggcgcagaccaggactcgaccaccgttccagtcgagtggatttgctggctgaatggccaaaggaagaaagctccaacaccagaggaattggctgagctggaggcaagacgtgaacgtgtcaagcaaaacattcagcttctcaaaaagaaagaagaagaggaaagaaaaactggtatccaaccagtcaagaaaattgggaaagctgaatctccaaatctccaaagtttcgtgaagcagcagttctcgggtactcctccagatcagcagaaagttaacactctaggacctgaggataggcctaaggacacaactcatacagaagatgctacgacagacaatgagaggtatactgaaccaacgggaactggtgccactttcaagccagggacttggcagccaccaacatgaatgccaacatgaactttagaagatgaaggacggtgtaccggagcattttcctttcacctatctgtgtaacattttaacatttgctctgaaagaatcactagcctatgttccttctttcagatggttacccatctgatggagttatagccttaagttccttcttttagatgcttacccatctgatggagttataggtgatcgggggctcccacggtatgctgttttttttgtggctaaattgtcctctgtaatctttactgtgatagcaactgtaataaactggaccagtgttttgcttcagggctctcttagagacactgttctaccataaaaaaaaaaaaaaaataaaaaaaaaaaaaaaaa

SEQ ID NO: 19936 - DNA, 607 bp, Zea mays
atatataaggctatcttcaccggctttactcatcatttatattttaaaactctactatataaataatacagaatacggtgcaaaataatgttttacacggtcatatgcaccatccgatggtcacatcctaacaaaacaacacattctgggaaccatggatgcaataagagagtaaaactgaggctgatatcgacttccctagtcaggaagttctcatgatgaactcctggtgatgccgataaataatacagactgggatgaaacatctatctgctgttcaggctaagaattcctgatcctcacagtacattgcacagccttacgttaccagaagtttctttgacaaagccagtcagcatgtatcggataacagaggttaagctaattgcccccaaagttacaagccatcagatatgtaaagctgctcagcttaactagaaccgttcggaaggtaaatacgatgaacactattcattttcagccccttcctgcaagtagggcatttcttctgaaccttgatggcctgcttgatgcacgtgtcgcagaagacatggccacaagtcgtcgtggaaggctcctccatctgtgtccggcccatcgcgctggt

SEQ ID NO: 19937 - DNA, 1148 bp, Zea mays
ggtttgggtttttttttttttttttttttttagcatagaatattggaatggctaaatggaatagagtacgttacaaacaaaagcatccaaaaatgctaaacgtttcaactcgccattatcattttacaatgaagcaaatcccagttacactaatccaccacggtaataacctaatacatacaacagcgaaataacattatgaaccacggatgcaataagaggccagtaaaactgaggctgatatccacttccctagtcaggaagttttcatgatgagctcctagtgatgctgttaaatgatacagactaggatgaaacatctatctgctgttcacccaagaacttctgatcctcactgtacattgcacagccttgtgttaccagaagttcctttgacaaagccaatcgaccttaactagaagcgttcggaaggaaaatacgatgaacactattcattttcagccccttcctgcaagtagggcatttcttctgaaccttgatggcctgtttgatgcacgtgtcgcagaagatatggccacaagtcgttgtggaaggctcctccatcttattccaacatattgggcaggtaaaagatggttccttgggaacctccttagcaggctctttgccggtttgtacgccatttggctgcaagctggaccctgctccccaatcgggagagaggtgatctactgccacaaccctctggcgtttgttcccttcctggctagcgtcaacctccaagtcaaccactgttataggttccctcctggttctcctgtccctcctcggtgggggcactcgcgagggagatactgcctgaacttcatcttcgatggcctccacatcaatgggtgagttttgggcgccaggaacaggggtcggtggtccacgacggctccccaccaccggggaggttgcttcgatgatcaccactactttatcagcagacccatcttgcgactgtcttcttggtgcacgccttgtaccactggcagtgctcatgctctcttcgatgcttataccacccacctcaacttcacaatgaacctgccgaatcggaactgagttcgatcgagcggaggagttcaagaagggaggggcaaaaccgcgaccaaactcagaagcgagtgtttcttccccccctt

SEQ ID NO: 19938 - DNA, 867 bp, Zea mays
  misc_feature (12)..(12): n is a, c, g, or t
tttcagcccctnctgcaagtagggcattccttctgaacctgatggccctgctggatgcacgtgtcgcagaagacatgcccacaagtcgtcgtggaaggctcctccatcttattcccaacatatggggcaggtaaaagatggttcctcggggacctccttggcaggctctttgctggtttgtacggcatttgactgcaagctagaccttgctccccaatctggatagaggtgacgtcctactggttcaaccctctggcgtttgctcccttcccggctagcttcaacctccaagtcaaccactgttataggttccctcctggttctcctgttcctccttggcaggggcactcgcgaaggagatactgcctgaacttcatcttcgatggcctccacatcaatgggtgagtttagggcgccaggaataggggtatgtggtccacgacggctccccaccccccgggaacttgcttccacgatcaccactagtttatcaccagacccatcttgcgactgtctccttggtgcacgctttgtaccactaacagtgttcatgctctctttatgcctatacactcacctcagcttcacaatgaacctaaggaccgggggaatcggcggcgcagcgatcgaaattaataccccctccctccccgccgattgcctcgccaaatcaacaccggtagtcaatccacgcaccccggatcagatacaggcgaagcatcgggagggacgaaaaatccgcacgtcgccgaaggacccgagttcgatcgagaaggggaaaggccgaaagggggcaaccgcggtgggcagggagcgcttcttcctttcaattgggtgaatacccggccccccccgaggtcgccaatg

SEQ ID NO: 19939 - DNA, 1043 bp, Zea mays
cattgcggtcgtcggcactgtcgtgtgcccacgcacagtcacacggacatgttaatcctcttcccctggtgaggtctcgcggcggcgggcaaatccattcgacgatcccaatggcggcctcctcgtcgttcaagccgaacccgctgtcgctgagcgtgccggaccccgcgctcgaccgctggctccgggacaccggctacctcgacctcctcgactccaccccaaccggagggccgtcgtcagcctcagccccctccacatccagccccgccgcgggcccggactcatctggcgtcgcggtcgacatcctcaccttcgcgcgcaccctcgcctcgctcctcgcgctcaaccccttcgcgcgcctctccgccaccgacctggccgcgcccaccccttcctggtcgcttgccttcctaggcacccccggcgccgcgtcctactcctggccgcccacacccacccaggccaggctccgcgtccaggagaacgtccgccggtacgcgcgcaactacgccgcgctcaccatcctcgtcttcgcgtgctgcctgtaccggatgccgatggcgctgttggggatgctggtcagcctcgccgtctgggagggcgtgcgctactgccgggaccattggggtcttaccaccagggctccaggggttgcccaggctctgctgcactgtgcgcagattgctaccgccatactcctgtacgtctgcaacctacagtttgctctcgtgtacgccatcggattgagctatgcgttgatgatgttgcacgcctcgcttcggaagttgactccctcgagtctaccagatcccagcagcaagaagaacaggagggcgcagccgagacggatctaggttaaacatgccggacagtacagatgttcatcaggatataaactggagtattatacgcacacactgaagctccgcccttggatttaatcctcagctttcttttgcaatataattttagctggtcgttgatcaaaattaatagaatctgtgttttgcctgtcaaaaaaaaaaaaaaaaaaagcggcc

SEQ ID NO: 19940 - DNA, 1449 bp, Zea mays
  misc_feature (70)..(80): n is a, c, g, or t
cttattatataccaatatagaatacggtgcaaaataatattttacacagtcatatgcaccatctgatggnnnnnnnnnnncacatcctaacaactggttctgggaaccatggatgcaataagagagtaaaactgaggctgatatcgacttccctagtcaggaagttctcatgatgaactcctggtgatgccgataaataatacagactgggatgaaacatctatctgctgttcaggctaagaatttctgatcctcacagtacattgcacagccttacgttaccagaagtttctttgacaaagccagtcggcatgtatcggataacagaggttaagctaattgcccccaaagttacaagccatcagatatgtaaagctgctcagcttaactagaaccgttcggaaggtaaatacgatgaacactattcattttcagccccttcctgcaagtagggcatttcttctgaaccttgatggcctgcttgatgcacgtgtcgcagaagacatggccacaagtcgtcgtggaaggctcctccatcttattccaacatattgggcaggtaaaagatggttcctcggggacctccttggcaggctctttgctggtttgtacggcatttgactgcaagctagaccttgctccccaatctggatagaggtgacgtcctactggttcaaccctctggcgtttgctcccttcccggctagcttcaacctccaagtcaaccactgttataggttccctcctggttctcctgttcctccttggcaggggcactcgcgaaggagatactgcctgaacttcatcttcgcagcctcgccgtctgggagggcgtgcgctactgccgggaccattggggtcttaccaccagggctccaggggttgcccaggctctgctgcactgtgcgcagattgctaccgccatactcctgtacgtctgcaacctacagtttgctctcgtgtacgccatcggattgagctatgcgttgatgatgttgcacgcctcgcttcggaagttgactccctcgagtctaccagatcccagcagcaagaagaacaggagggcgcagccgagacggatctaggttaacatgccggacagtacagatgttcatcaggatataaactggagtattatacgcacacactgaagctccgcccttggattcaatcctcagctttcttttgcaatataatattagctgatcgttgatcaaaattaataaaatttgtgctttgccttgtcaaaacaaacagcccgcgcgatccaaatcccagatacccataaaccactcaacggaacggataaatttccagtacgtgttggcacttgacacagaatgcacccgacattcatttcacagacacacacacacctgatccttatacatgttgatttaactaccagagaaacttgagggtgctatggacaatatacatgttgaatgt

SEQ ID NO: 19941 - DNA, 857 bp, Zea mays
  misc_feature (138)..(138): n is a, c, g, or t
  misc_feature (843)..(843): n is a, c, g, or t
tgacaagccagtcggcagtatcggaaacagagttaagctaatgcccccaaagttacaagccatcagatatgtaaagctgctcagcttaactagaaccgttcggaaggtaaatacgatgaacactattcattttcagcnccttcctgcaagtagggcatttcttctgaaccttgatggcctgcttgatgcacgtgtcgcagaagacatggccacaagtcgtcgtggaaggctcctccatcttattccaacatattgggcaggtaaaagatggttcctcggggacctccttggcaggctctttgctggtttgtgcggcatttgactgcaagctagaccttgctccccaatctggatagaggtgacgtcctactggttcaaccctctggcgtttgctcccttcccggctagcttcaacctccaagtcaaccactgttataggttccctcctggttctcctgttcctccttatggcaggggcactcgcgaaggagatactgcctgaacttcatcttcgatggcctccacatcaatgggtgagtttagggcgccaggaataggggcatgtggtccacgacggctccccaccccccgggagcttgcttccacgatcaccactagtttatcaccagacccatcttgcgactgtctccttggtgcacgctttgtaccactaacagtgttcatgctctctttatgcctatatactcacctcagcttcacaatgaaccccgggagcatcgggagggacgaaaaatccgcacgtcgccgaaggacccgagttcgatcgagaaggggaaaggccgaaagggggcaaccgcggtgggtagggagcgcttcttcctntcaattgggtgaat

SEQ ID NO: 19942 - DNA, 2795 bp, Zea mays
  misc_feature (44)..(44): n is a, c, g, or t
tggataaattggatgggtctaattagcctcaaggcgagcaactngatgttggccctccacttagcattcatagcgccacaagacatgttcggtgtgcaccaactctctacactgtacacatccgatctaatggtttcaaaaattagacattattgtacaaatatttgatgctctatctgatgcctcaccaaatgtctcgtgagtgtaccactcaaatatatagtttcaaaacctctctgagtactcaagtgagtctcatatacaagttatctaggtgtcatgtctagtgcacataagacacttgtttcaactctatttcaaacatggtagtacactatgtgatgcatgttggtgtttcttagcctattaaatataatatatgcaagcaaatagataatgttatagcctttcaatcaagagtattccagggtattgaaatccacgatgaatgaggagtaaagtaattgttagtgtttattagtatattagatataattcacaattgcatagatatacattgtaggctttcacataaacaaatagataacatgtctagtaaaagtttattagtataccagattgcgaattgcaaagtgagcagcgtaggttcattacttcaattatacactcaactttctaagctctatatcgccatctttatttacttttactattttccctcttttttactttactgattgacagtttttcggaactatagacaaatactcgggcaaatcatcagctatgcagataaatcgttgtgcccgttgattaagttaatgtttgattctggagctagttaagatggaacggcttcattctaaaggttgatttgtagggaacacgggagattggaggagattgaagggaaattagtttatttttatctcaatcctctccaattccaccgtgatcctcttgtcaccaaatcaaccctaaagagtggctccataccgaagattttaatgagccaggagattcaacatttaaacatagcttttttttgagccattctatcttttatagaaccaattcaaacaacaacaaactgaaacataatttttcctttttaagccattctatcttgtatagaattaattcaaacaacaacaaattaaaacaaattaaagcggagacactatctaaagtcgggctcttgtttcaatagctgatttttttagaaacaaaaatctcctcatttttaaaggaagcctccctttaactggaaatacatttcctaggggaacctatttttaaaaagaggggaagttaggagagaaccgagaaaagtccctcgtttgatagatcttcaagtctcgtttagtagattttttgagaacctgttagaagagccttcctctcttgggagggtgaagaaacgctggcctaattaatcaagcccgctgcacaccctcttgggagggtgaagagcaaactcgcactcgttcgggatgtgggatttttgcgacaattttctaccatcgggcgaagtatcaaattgcaactacaaacggccgcggggcgtctttttttttttttttttttacataaaacatcataaatccataataataatccctcgtagccggtgagcagtaggtacagaaacgcacataataaataataatagtaataaactaacaccaatcatactaaatcaaatccagcatcaaaatgaaaaaactctccaaacgcccagattcatccatccacccaccacgtggaacaaaaccaaatgcctcatcttcataacactatcaccaccgctacgatacctgcgactaacattagactgcaactctcactaccactgtaccactagatctgaagacgcgcacgcagacggggcggcctcaccgctcagtggcggaggaaagcggcgaggagcgccgcgaggcagccgacggagagctgcgctgagagggcgcccgcgccggacatcggggcgggggccggtgcctcggtggcggaggcggctgtgaacagcgcgtcaacgacaacggcggcggtgatcacggcggcaacgacggcggagatgcgggccatcgaatcgatgcggtcggacgacgaggtggcggcgtcggagcgagggcagcttagggttcttctgttggaggcgtggaggcggcgtgaggaacgggcccggggcccatcgacgcgctccacgctttataggagtgagggcggttaggattattgaccccagttttttgtgggaagatatttagtgcggttgacagatattcttgcgtaattatagtttaactagatgaacgcttgctacggaaacgaacatattatgataacatatattgaaatttaaaaaaattagtcagctaatgttcttatttaaagattgctcgacatttataaaactagatagtatggtatatttagtgtaggatgtatgagacaggtctttcagcaatataccaccttactttactatttttattacaaatttaggtcatacatacacagagaacaaactcaaggcagttttatccaagtatgatgtgtagattcttctaatttacttgtgaagtggatccatagtaatgaaattgcgcatgatgttttatattgttagggcatctgggtttcatgtccttaaaatgcgtagccgtggtggaatgcctctagcttttctgattttacagatacctatctatacctttggggcttattcgtatcctaaggaatggtcacccgtaaccattcctagccagcttatttgtctaatttatatagggtttgatcaattggaacaattctggggtgaattctggctc

SEQ ID NO: 19943 - DNA, 1346 bp, Zea mays
acaataatcccccaattttttttttttttttatataaggctatcttcagcagctttactcatcatttatattttacaactctactatataaataatacataataggatataaataatacataatagggtgcaaaataatgttttgcacggttatatgcatcatcttatggtcacatcctaacaaaacattctgggaaccatggatgcagagtaaaactgaggctgatatcgacttccctagtcaggaagttctcatgatgaactcctggtgatgccgataaataatacagactgggatgaaacatctatctgttgttcaggctaagaatttctgatcctcacagtacattgcacagccttacgttaccagaagtttctttgacaaagccagtcggcatgtatcggataacagaggttaagctaattgcccccaaagttacaagccatcagatatgtaaagctgctcagcttaactagaaccgttcggaaggtaaatacgatgaacactattcattttcagccccttcctgcaagtagggcatttcttctgaaccttgatggcctgcttgatgcacgtgtcgcagaagacatggccacaagtcgtcgtggaaggctcctccatcttattccaacatattgggcaggtaaaagatggttcctcggggacctccttggcaggctctttgctggtttgtgcggcatttgactgcaagctagaccttgctccccaatctggatagaggtgacgtcctactggttcaaccctctggcgtttgctcccttcccggctagcttcaacctccaagtcaaccactgttataggttccctcctggttctcctgttcctccttggcaggggcactcgcgaaggagatactgcctgaacttcatcttcgatggcctccacatcaatgggtgagtttagggcgccaggaataggggcatgtggtccacgacggctccccaccccccgggagcttgcttccacgatcaccactagtttatcaccagacccatcttgcgactgtctccttggtgcacgctttgtaccactaacagtgttcatgctctctttatgcctatatactcacctcagcttcacaatgaacctaaggaccggggaatcggcgcagcgatcgaaattaataccccctccctccccgccgattgcctcgccaaatcaacaccggtagtcaatccacgcaccccgggagcatcgggagggacgaaaaatccgcacgtcgccgaaggacccgagttcgatcgagaaggggaaaggccgaaagggggcaaccgcggtgggtagggagcgcttcttcctttcaattgggtgaatcgggtccacc

SEQ ID NO: 19944 - DNA, 1928 bp, Zea mays
ccacgcgtttttttttttttttttttttttagcacagttaaccttgctactagcgtatataaccttaacagctaatacaatcttggagcctactaattcctcttccctggtctttcttttgcaggcaagggagtggctctggttaactagttacaactactcgtacggaactacggatacaccaggcaacaatcgggcccgaacaagacaaaccaaagcccatctaaaatacccaggcccgtgcgtgcgttcgtcatctatcactctccctaggcttttttcagtcgccgcccgactcggctgggttgggatgtgccgagaagtaggcgaggaggcccatgagcggcgcgttgatgtacgtggtgggctcggactgctggaacacggcgcgcgcgtcggggaaggcgtcggagtcgtcggtgggcccgcccacgacggcgcccacgagcaggttcgggttgggcgccgggctggtgtagtaggcggcgccggccttgcagccgatccgcgccgggtgcgccgccacggacggcagcgagctggcgcggtggtggatccgccgcgggaaccgcgcgccgtaccccaccatgtacgacatccgcagcgggttgtcgcccagtatgtagtccacctgccgcttggccacgcggcggagctgcaccggcgacgccgacgacgagccgcacgagacgcgcccgccggcgtggctcaggtagttggagtaggccagcaggaggaacgacagctgcgtcacgtgctgcatgttgctgctcccgaccttgaacagcagcccgcctggggagtactggatctgggggtgattggagatgccggggaggagggtgcacatgaagttgtcggcgttgacacggaaggactggaagtactcgtccttccccatcagaacctcctttgagatgaggacgttgatgccggcgtgcttgttgtcccagccgaactcgttgatggcgtcgctggcgccgagcaccacctcgttcctcttgatgtactcgcggtactcccgccgccgcgtcgccttgtgcagccacgccgcgccccacagcagctcgtcctggtatccggagtagtcgcagtagcaggggcacaccgccgcgtggaggctgctgctgtaggggccccggtacttgtccgcgaactcgaacacggcgacggcgcggtcgaggaggcgcttggagtaggcggggtcggcgtcgcggaagacgatggagccggcggcgagcgcggcggcggtctcggcggcgacgtcggagcccgggtgggacgggtccaccttgtacacggtgcgcggggtgtccatgtcctcgggccgctcccagcacgcgtggtcgcggaacgcgtcgcccacctgcacgtacaccgtgttccgcttcgccgtcgccttcatcaggtagtccgtcgcccaccgcaccgccttccgggcctcctccctgtggggcccgaagctgcgcccgaagtcgatcaggccccacgacatgagcgtcgccgtgaacgccatcgggaacccgaacttcacgttgtcgccggcgtcgtagtaccctccggtcagatccaccccggccgcggcgccgtcgtggaggccggagtcgcggcgccagcggaggcgctggtccggcgggagcctccccgagcgctgcccctcgaagaagaggatgcacttgtgcagggcgtcgccgtaatcgtgctgcgcggccaccgccgccgcggccgagagcagcattgccacagcggctgcggccgccgccattgccttgacactgctctgcgacgccgccgccgacattgcagctaagagctattgaaagctagcaacggcaatggccactgagtgtagtgaaagctagctctgccgccttgcccgtacacactacgcacggcaggagactgaggtgtgcgcgacctgccgaatt

SEQ ID NO: 19945 - DNA, 3465 bp, Zea mays
cttgggtgacagcaggtactggggatgggctgagaggggattcggccgaccggttaatctctttctctgtcttttttccttttctgttttctcatttcttttttctagatttataattcacatttgatattcaaatcgaactgaaatacaaatgcagaactcaaaaaaatctcagcatgagatgcaaggttcattttatctatctatattattttctccttttaaacaaatgcttcaaataggtgaggcatacacactaatgctactaaaattactctttgaatgcacaagctaattcaaatttcattcaaatattaaataattattatttatttacattattaggaaataaactcttaatgtatcattttttaagagataccctattttaaatctttttagagaatatttcaaaggtttttattgaatcttttaatctcttcttagaaaaatcattttttataaaacttgagagaacattttttttcttctaaatttccaaaataagaatttcaggtgttacagctgccatatttgaagtatctttgcgccaccgccgcatccctatggtgacggtgcttgaaggtgttgaagaagtcttctaggtaatgctctgccaccttgatgtcgtttgcacgcatgcgaaaccggtaacagaacgccctctcgaccgtgcggaggcttgtctcgggtcggactctctcgagccaggccaccacggcatgggtgctcagactgtccagctcctggtccatctcctaggaggagcctgccacagcgaatgtctccttcggacgggagtctgggtcgccgggcttcaccatgacggtctgcagtctgcacaagtggtgggaagcaggggtcgtcgagatgtgggggtggagtggttggtgtgctgctgcttatgctcctctgatagcactgctgagccttatgacctgaacctcgacacttgaggcatgtcagaggatccctgcaatctgcaacaaagtggcctctggacaaacagcgcatgcatttacctctcaagcatgccatcaattcctccctgtccggggagcgcagcgcggagtgccgggttgttgggaggcttgaatgcgcaggtctgttgaccctctggcgacgcttgtatcggaccgttgtccatccatccaactcgtcttcaataggtttacccaggctagcactcagcggcgcctcgtacaggagacttgaatgctgcctcaacgtggaaaggtcaccggtcggatcaaagcgattcatagtgatagaggatctcaagggcacacgacggaattactgttgcgggagtggctgagggatgtagtagagattttgaatcgaacttgcttggcgagggagccagccctggccggcgctgagacagcggatttgaggccggaacgtgccatggctgacagcttcgccggcaaggtggggagctggggagcatgactaggacacgaggcatggggcgagacggggcgcgggcggtagcttgtggactgatctatcgacctatgcggttgtttgaggctggaagccgagcggaagcaagagagattggcggcggcaccggagatagttgtgctcgccataggaggcctctccctgctctttgtgatttttcactcgtttgttcaaatactgtagtggagtatttggttgtcgataatatataagttatgagaatccttttgatttgccgccgccagtaaaagttaaaggtatatggaacaatcatatagagtattgcatgcgtttcattagttgaacttaagatgataatgtgatgatgaaatttaggctgaatctaaattttatcttgttcattaaacgatccgttaagttctaaagtagctacaatttagtagatatagtgcattatttgaataaaactaaacatggccttcgtcgaacttaagaagatattgagatgataaaatctagacccaagctaaatttattctagttcattagttgacgtgtttagttttaaattagctaaaattagtggataatgatgattagctgaacgaaattaaacagggccttcgtcgaactcgatcaacaccttgtatctatctcccagtctaaactcaccgtacatctctctcagtctctgaacatactgaaataaacactatacttttaatccactagaacacgtattctgtatatatacgaaggatggcagtctgtaagctaaccacccagctgaacaaaacacccagcaggccgggaaacacatgttgagcttttataagatacagtaagggcaccaatccatgcatggtacggtcggtcctcctcgtagctagcactggccgtcgtcgtcgacctccaagctcctcggagtcatctggaagaaatggtcccaggcgtactggaagctgacggcggccatactcgcgatcggctcgccgccgttcaccaggtagacgccgctgccgccgccgccgccgtcggcacggaacgcggcctggtccacgtccaccgtggtcgcgaagcccccgccgtcgaggcgcacgttcctcacggcgcatgggcaccggttcttcacctccaccgagaagatggtgtctccccagggtaccgtcgcgccggagttgacggtgtccaccgcgatgctcgacgtgttgcatcgctcgccattcgctcctgacgatggtcatgtaatatttgttatatatatataattaatgtacgtggagactactttgattggttgataaataacacaaccagcttgtacaactgtgagcgaggattaccgaccgtacgtacctatcacaaagatggtgaagaacatgacagcgaggaccggctgaagcttgtgagaagtggccatatgttcaattcctttgtgcttcctttagctaggataggagacttacgtcgtcttctgcttgccttgtattggctgagtcttggtgatgtctctaactctaacaacgttctgttttatagacctcgcggcaaggctctaccgattcgaagggaggagtccgtacatctgaattttaagtgctagctagttgcatataaaaatggcttcaattcctttccttaacagctaaggagatccatgcatgcatatatattgcgatacatgacattggaagcagcaaaagcgacagacgaaaaaaatgtgacatgcgtgatgtttagttccttgcttgcagctcacttttggtgaaagttagtcttgtcctgagggattttaaaaataccagatcttcgtttgaactataggcgtcgtcgtcgtgtaaacgaactcttcattattcattttttttgcagtttctactcagtcagctcattcatttttatcgtgcctcatcaccattgttttttctaacaaatcaaatggacgatgtacaagtatttcatacaaaggcaaccaaagaaaatcatttggtcgaactagtccatcagtatgtgcttttgtaccggatagctaca

SEQ ID NO: 19946 - DNA, 1551 bp, Zea mays
tagaatccataacacgtacatacactgacccctataaacatatactatgcatataaaccatatccctatgaacatcttcgaaggactgaaccgaaagatctcgagattcacaaagtcaccagaggggagagacacacacacattttaaatttgatcataatcttgaaccaatggttgccctatgaacaaaagtatatagtttgatgatataagtatgattttaagtgtttgaagacacacacacatttaactatgtaagtaacagttaaagttttaattcgaaatggaagtgtattgtaatttttagggagaaaaacaactgatgatggcttactgctgcaacatgtcaaaagtaacatgtgccattttctggcctcattatattaatctgcatcaatgatgcagcaccaaataatcctaattctaaactgacatactgctcgaaaattgtgggatggagagagcaaaaatccttgaacatagtaaggaacaggcttcactttttcgcttcactgttccgaaatttcgttttgaacaaaaaaaattgactttcatatttttaaaatgtgataccgggccgagaaatgcttcccctagctgaccgggaacgagaaattggccgaggaaccagacttttcggtcggtaattcgaaccatggataggagtgaccaagatgcgtgtgtgccgccacgatatcactcatgcagtcgaagcagtactctgctccgaggtcggtgctggtacgctggcgccataagctggggcatcaggagacggagcgccgtaggcgggggcgccagccgacgagccgtaccctccgaacggcgccggcgcgtccgacggcggcagtgcgacctcggccgacatggagccggaagcctcggtgatgaggtccagcgtgacgcgcagcagcttctcgaactcgaagctcttggttatgcagacgttcttgatgtcgctgacgggggcgtccttgcaggcgtcctcgcaggtggcggtgccgccgagcgtggaggtgagccaggacttgacctcgaggaacctggcgtcggagaagtcgcgggagagggcgctgaggtgcgccacggcctcctcgatgtcctcggagcaggtgtcgatgcacttgtacaggacgtcgtcgtccttgatggcgttgagctcgtggtgcgcgaacgcggccacggtcatgcccacctcggccgacacgtacacgagcagctcggccagccggcgcggggtgaccgccgtctccgcctggcactctgggttgtccttgagcgcgtgcatgcacaccttggggaacagcgtcttgttgcacgcctcctggaggtatccggggccgccggcggcgtcggtgatggcccgcacggcgggcgcggtggagataaggaggatgggaaagaagaggtgcgcgacggagcgagccatagccatggcgcgtcgcggcgggcgggcggggacggtgtgtgtgtgtgtgtgtgtgtcccctcctttgtggtctgtggttccaggcgatggtgatcccggccggcctcgagggtcccaatcgc

SEQ ID NO: 19947 - DNA, 1950 bp, Zea mays
  misc_feature (1577)..(1577): n is a, c, g, or t
agtttgatgatataagtatgattttaagtgtttgatattatttcctattatcaccttatgttttccaaacaataaattacaaatgtaactatgtaagtaacagttaaagttttaattcggaatggaagtgtattgtaatttttaggggggggggggggggacaactgatgatggcttatcgctgcaacatgtcaaaagtaacatgctgtgccattttctggcctcattatattcatttgcatcaatgatgcagcaccaaaaaatcctaattctaagctgaatactgctcgaaaattgtgggatggaggagagagcaaaatacttggaacatagtaaggagcaggcttcactgttccgaaatttcgttttgaacaaaaaaaatttgactttcatatttttaaaatgtgataccgggccgagaaatggttcccctagctgaccaggaacgagaaattggccgaggaaccagacttttcggtcggtaattcgaagcatgcatgcatagcataggagtgaccaagatgcgtgtgtgccgccacgatatcatcactcatgcagtcgaagcagtgctctgccccgaggtcggcgctggcgctggtacgctggcgccataagctggggcatcaggagacggggcgccgtaggcgggggcgccagccgacgagccgtaccctccggacggcgccgacgcatccgacggcggcagtgcgacctcggccgacatggagccggaagcctcggtgatgaggtccagcgtgacgcgcagcagcttctcaaactcgaagctcttggttatgcagacgttcttgatgtcgctgacgggggcgtccttgcaggcgtcctcgcaggtggcggtgccgccgagcgtggaggtgagccaggacttgacctcgaggaacctggcgtcggagaagtcgcgggagagggcgctgaggtgcgccacggcttcctcgatgtcctcggagcaggtgtcgatgcacttgtacaggacgtcgtcgtccttgatggcgttgagctcgtggtgcgcgaacgcggccacggtcatgcccacctcggccgacacgtacacgagcagctcggccagccggcgcggcgtgaccgccgtctccgcctggcactctgggttgtccttgagcgcgtgcatgcacaccttggggaacagcgtcttgttgcacgcctcctggaggtatccggggccgccggcggcgtcggtgatggcccgcacggcgggcgcggtggagataaggaggatgggaaagaagaggtgcgcgacggagcgagccatagccatggcgcgtcgcggcgggcgggcggagacggtgtgtgtgtgtgtgtgtcccctcctttgtggtctgtggttccaggcgatggtgatggccggccaggcaccacgcgcacgggcttatatacatgctatctagctagcctccttgaattgcaagcggtcaagctaggccggttttctccatggtcgatgacctgttctcctcccggcatgcatgcatggcttgccgctgctataggagagtagaacatgcctgtcgggacatatggtgagccatccgcaaggtgtcttngtttcctttttgttccagatctgtggctaaaaatcgataggccaggccttgtttggctacttttggtttgaggtgcaccagtggaattctataaactttctacagctaaaaaccgctgaaaataagtgtaaaataacttattttatccttcaccaaaagttagttaaaaaacagcgtcgatttttttgaccgccattgtagaaaacttattttcgtggttagaagacaaatgcaaaaaataaatctaacacatctagtttagatagagttagaccaactccatcaattgtgtctccgtatatacttattagtgtgttgccacgagacggaggagcgtggggagcgacatctaggctataaatataatttttgt

SEQ ID NO: 19948 - DNA, 3386 bp, Zea mays
  misc_feature (274)..(274): n is a, c, g, or t
  misc_feature (3380)..(3380): n is a, c, g, or t
cggcggcgtcggactcccagccgtagaggtgggtacgggagtgagggttcccgtagcgagagaggtagaaggggagcatggcgtcgaggacacgcgggtcgacgggggtcgtcgcctgcatgtccatgtagagcgggcggcccgagatgcgcacgcccttgacggtgacggccgcctcgtcctcctccgaggccaccgccgcaggtgcgacagccgtggagagagcgcgggtggggatggaggcgccgcggcggaggaagagcgggaggaggcngcgggagagggccatgttgtggggtggtggccgggtagaacggggtagggttcaggggaggggttgcggccgccgccgctgagctcccgttttgggggagtggcgatatgggaattgctggttaaggccagggggaaggtggggaggactgaggagccaagcagggtatggacgagaacgagcacgacggcacgacgcgtcgacgcgccgacgtccgatgtggatgagactatgagagggggcaagggaagggaagtgcgtcacgcaacggcggcccatatgtgggctgaggagccgagctgattgggctaggacgctaggttgggatcagcttgtttggtttagattttttaactagatttaatattaaaatataaaatcttaactaaacggtataacttcgtaatagaattctgaaaatctatgtattgttctagtttaatttagaataactttctatgctaaaaatttagatttatatcatctatgttaccatatgctcttgtagaattttcagttgacagttgttttaaccaaatatattttaatttttttcatgtccgtcagctcacataagcttttcacagctcacagttaaaatcagatttatatcttgtgtgatcacaccaactgcgtttatgttgtggctactactatgtacgagaaggaataaggtctaccacatttcagttgtaacctcaatagtgtgacaatgggagcatccgaaagaggtaagaagtggagcaccacttaagggcttgttcggttagctctcaatccatgtggattgagtgggattggatgggtttaaatcccaaacaagtcaaacttcttaagaaatttttccaatcccattcaatccatgtgtattgggaataaccgaacaaggcctaagcatgaagatggcctataactatctatagagttacctgactggagcatggccctcgtgtgggctacccttgtgtgaggctccaacgaggattattaagaagcttgtgcacttcttgatacctcagtaaaactatcgagtatcaatgagagtttgtatctttatcatatttaagcttctttatttatattactggatcatgtggcgcccattcgggcgccctatccaacacaaggtaaaacatgagcaaacaattatatatgctatattaaaattcagcaaaggatgattaagtctccaataaaaccgtttagcgcggggagcaacaaagcaactatgagaccaaacatagatagaccgaacataatccgcattaaagttttagaccatactttaacgtgttccatagtaagacggtcagggctattacagcctgaaactgatcccaaataagattataggatcgaagtctacgtttatgggtcgcaagttagggataggtaggcagctacgcgggaggtatatacatagtacggagagctgatgcaacccacatagttatgcacataaatcttacacaactacaattgtagcttcacgcatccacaaaagccaaccacaaaagcgaccaagatgtccatccacaaaagtaaccaagatgtcatctgtcatacgttcaaacttcaggtttgtcgaggcttcctcaagtctgctagaattagaggagcgtcactcctacatattacagatgttcccatgaagccaacttctagctttgctatgtccatctccatctcttacttgttcgtttcagctagaacaacagctacaccaccactgatactcttgtttgctagctgcttcagaagagagccctgttgaatctccatgtggtgatggtgttggtcgacccactgcggcgtcgatgggtcaccacagaagaacatcgtcgcctccctcatctgcctacaccacacgccgacgcccccaccgaccacggagataaaacatcaaggtcgtcgcgagcattcagaatcatgtcatgcagcccctcggcagcggcgtccggaggtaacaaaaaggacagggaggcgtcgggttgcggcttcgccatcccggagacgttgacgaatcgcggggtggtctccttggactcttgcactaaattgttgggaacatgacataattataaatatttgttttcctgtgcaggttgctggagactttgatgcttcgaggaaatttattgtttctgttaaaataccctatcatgcaccttcttttggaggctcgtccggtctccatagcctggtactctggtttggccatctgcgtgtccaccagacagacaagggggtggaaaatagaagtcaggctggctaacataagcaaaagagaaagctgatggtactcatgactatgaatgtctgattgcggttggcgctgatgcagcgaagccgcacttggagctgatgaccttcctgaagggagtcccatttggttcttctcgtcagtatctagatccgttgatgtatcatcagtcgcggggcttacataagccatctcagactcttcacagctctcagtgcttcttgttgtttggagctgaagctaccccatctggttgtgctttattgatgagagatagatctgcaaatctaaaccacataaaagcctacgaagctattttattcttgttctcggaactgggaatagctcgctagagggaaagagggtcccgatcgatgaagaccaaagctttggattatgctccaattttttttttcctttttaaatgcaaaacaccaccttctagaagccatgaccaaacaccgtgttctccagccatccgaactctgaagacaaggagggtggggaagggggtcgagagagttcctcacttagtgaagatgaagaaggatgagagcagcagggtctgccacgtgctcacgtcagcgacgatgccctgattgccggagaggaggaaggctttgtccatcgagaagggctcccggtcggatcgacacctccgtgccgtggttggcgagcacggtcgcaaacaacatgaggcgacatcgaccgatgggagagagagcctggagtggggagatctcgctcgccgggactaccacctgacgacgagcatggtcttgaacaccatgaggtggccggcatccatgggacagagcctatgcgtggtgggcctggtgtgtnccccgg

SEQ ID NO: 19949 - DNA, 1663 bp, Zea mays
gtgaaaattgagttaacaatcaccaactaaacgatatttaggggcaatacattctgataaggtgatgaacctttttcaggatagaatatttcagcaatatttcccagcacaattgaaaagaagcatatctaactgtgaacctctaataggttgttgttcggtgatggtctcctaaatctcttcaataatgtagatccatttgcaaccctgaataaaaaaagttcatcaagccattgcatagaatagagatgatgggatacataccggtgaatctgcatgccaggatacatacctgtgaatctccatgtggtgatggtgttggtcgacccactgcggcgtcgatgggtcaccacagaagaacatcgtcgcctccctcatctgcctacaccacacgccgacgcccccaccgaccacggagatataacatcaaggtcgtcgcgagcattcagaatcatgtcatgcagcccctcggcagcggcgtccggaggtaacaaaaaggacagggaggcgtcgggttgcggcttcgccatcccggagacgttgacgaatcgcggggtggtctccttggactctgagacacataaacaaagcgtccggtctccatagcctggtactctggtttggccatctgcgtgtccaccagacatacaagggggtggaaaatagaagtcaggctggctaacataagcaaaagagaaagctgatggtactcatgactatgaatgtctgattgcggttggcgctgatgcagcgaagccgcacttgaagctgatgaccttccagaagggagtcccatttggttcttctcgtcagtatctagatctgttgatgtatcatcagtcgcggggcttacataagccatctcagactcttcacagctctcagtgtttcttgttgtttggagctgaagctaccagatctggttgtgctttaatggtgagagatagatatgcaaatctaaaccacataaaagcctacgaagctattttaatcttgttctcgaaactgggaatagctcgctagaggggaagagggtcccgatcgatgaagacgggtgggcaccgagctgtcctggccactccatcctactgctgagctactcctacctcttccccatctgcaaacaaagctttggattatgctccaattttttcctttttaaatgcaaaacaccaccttctagaagccatgaccaaacaccgtgttctccagccatccgaactccgaagacaagaagggtggggaagggggtcgagagagttcctcacttagtgaagatgaagaaggatgggggcagcagggtctgccacgtgctcacgttagcgacgagccgacgatgccctcattgccggagaggaggaaggctttgtccattgcgaagggctcccggtcggatcgacgcctccgtgccgcggttggcgagcacggccgcaaacaacatgaggcggcagcgagcgatgggagagagcctggagtggggagatctcgctcgccgggactaccacctgacggcgagcatggtcttgaacaccatgaggtggtcggcatccatgggacaaagcatgtgcgtggtggcctggtgtgtcgtcgagagagggagagggagagagagggggagggcggacgtgatgtagctcggctccattaacttcaagaaaaattt

SEQ ID NO: 19950 - DNA, 1304 bp, Zea mays
  misc_feature (1278)..(1302): n is a, c, g, or t
ctagttctagaatcgcgaggccgcccttttttttttttttttttttttttttagaaaaacccaaagtgatactccctctatttttatttatttggcgttcccaccacgaaatgttatcttgctctagtgcaactgtcttgtatgaaacatgatttaaaacccttagtcattgatacatataaaaatgcactcttgaattataggctaataataataggcattaccaagggtactgcgaccatgaaattgccacttccaattcagcgccattttctccaacaagtcgttccgtgtgctggccgttggtcgcaggattgaactcaaggacccctccaacaatttcatcgccggaacagcgatgcaggtcaagctcaatcgtcagcggcatgtgcagcggcacggcgagcgcttccctcgccaactgaatcagcccccccggtcgcacgctcactccattgtcaccctctttgtagaagagcacgcagccgacgtcgaacagcttgctgcgagcaacgatcctcccgagaatggcggtggcgtcttcttctccagctttggacaccggcaggcgagcaagtttgacggcgacccggccttggacgccgttgctcaggacggcatagatcacttcagcggggccatagcccgtttggacagtctcgactatggccctgttgtagttggagaagtcgtcgccgatgcagtcgcagattatcctcccgatgtcctcgtcgtcctcagcggcttctccggcttgcgggctgccatcatggaggtagagggtgaaggcaattggactgtatgccgaggtggccaatgatggcccagttagcacgaggttaccctggctgtcgcaggtttgcttcgaggtgtcttcttcctcttccagtggactccagctgtaaatgaaatcgctgcagcagtggccgccgtagaaagagatgatgccacggggcggcgggtctcctccggcggtggcggggatgcgcacggcgaacacctccgccatgtcgcggccatgtctgggcagctcagcgtacgccagcagttgctcgtcggttggggcgtcgctgtagccggtggcggccgccatgtcgccgaggaagagaacgcgattggggactgggaagtgggaagagaagacagggatcgattgggccaaaatgtgatttttctagtcgctcgcccccctcagctttcctgtgccttggaggagtggaggactggctgacgaaggctttggcgatggcgtttagggtttaggatctacggaggggnnnnnnnnnnnnnnnnnnnnnnnnntt

SEQ ID NO: 19951 - DNA, 2481 bp, Zea mays
  misc_feature (2464)..(2468): n is a, c, g, or t
  misc_feature (2470)..(2470): n is a, c, g, or t
  misc_feature (2475)..(2479): n is a, c, g, or t
gatcctacattcctagccgcacgctctgggcacacggtcgttgtgaacggatgagtgaggcggagtgggctgcgcgacccgctccccacatggcgccaccgccgctgcccctcttctccccgtccctaaaggccccgccgccgccgccatggctccacgggtcctctacccaaagccgcgactccgcacccccggtgcctccactccccgccgaggcaactccttccaagttccgcatcgacagccccaaaccggcaccggcaaggaaaaacaccaaaacagcagccaagcccctcactgccggagtccccgggggccgcacccaccgagcggtcctcggcatcatccggcgcgtccgctccctcgagctctccgatgctccgagtccgaattccgtccacaccagcaacagcggtgccgccgccgccgcattccaccttacgatcgagctgtccccgccgcgggaaccaggccaatatgtggttgagaaggagaagtcacgggctgttccgtgggcggctgctagggacgagggcctcaaggttgcgctgcggcgggagaagaagccgcgggagccgacgcgcgcggagaccgagctggagacccacgagctgcgtcgcctgcggcggttggcgcgtgggataggcaggtgggcgcgggccaagaaggccggagtcaccgacgaggtagtcaaggaggtgcgtagggaatgggccagtggtgaggagctcgccgccgtgcgcatagtcgagccactccgccggtccatggatcgcgccagggaaattcttgagattaaaacaggaggcttagttgtgtggacaaaaggagacatgcattttgtctacagaggaagcaaatatcagcaaaacgcaaagcatagtcacacttttctaactaatgttcataaagatgatgcttttcaagaaaatgatcaaagcatttgtggccagaaggatgaagaacctgtcaagggtacactatatgagagagaagtcaatagactattggacactttgggccctcgatttgttgattggtggtgggacacaccattacctgttgatgctgatctcctcccagagtttgttccaggctctaagactccatataggctgtgccctcctggggtgagaccaacactagctgatgaggagctgacatacttgcgcaagcttgcacgccttttgccaacacattttgcccttggtagaaacacaagattgcagggtttggctgctgctatactgaagctttgggagaaaagccttatagcaaaaattgcagtgaaaataggtatccagaatacaaacaatgaacaaatggcatggaacctcaagcatcttacgggaggcactgttatattgagaaacaaggattttattattctatatagaggcaaggattttcttcctggtggagttgctcaaactgtcattcaacgagaagctcaggtacatgatgaacaggtgaaggaagaggaagcccgactgaaagcagttgactcacttcagatggttggtgaattatctgaagaaagttctttaggaactttcagggagtaccagggtttccatgctaagtttgtgcatgaaaatactgaaaactctaacaccatgattgaactagaggctgagaagtatagattggaaaaggaactgaaagaccatgagtggaagctttccgttctcaacaagaagattgaaagatctaaccaggcactggcaaagcttcacagttcttggagcccttcagagcagtctgctgatagagaacacttgacagaagaggaaaaaataatgttccgccggattggccgcaaaatggatgggcttgttctcctaggaaggcgtggtatctttgatggtgtaattgaagagattcatcagcactggaaacataaagaggttgtgaaagtaattacaaaacagaatcaaactcgacagatcatgtacgccgcgagtctgctcgaggttgagacaggtgggatattaatagcagtagaaaagctcacaaccagccatgccataatactttaccgtggaaagaactatcgccgcccagcaaaatcatcatttagtaatctcctaacaaaaagagaagcgctccgaagatcaatcgaggtccaacgacgagggtcaatgaaatactttgttcgggagagacagaagtccattttggaattgaaaaggaaactgaggtatgtgacaaggcaaatcaggtatcgaaccccatgatcatgaagagtttggatagcatggttagtaaatgatagttagaatttgcaataatgactgcatccaatttttttccttaatatgggatagccgtgtaaactgtgaagcccaacatgaacaattctgaagtgtacagattatataatagtgtctgttgtacatatgtgacacttttgactttacccatatttcatgaaacaagagatttttcttcaaaaaaaaaaaannnnnanaaaannnnngg

SEQ ID NO: 19952 - DNA, 737 bp, Zea mays
tcactttcaaatgtgacaaaaccaaaccctctagaacgcccagtgctatgatcaagcattatctgatgttcaaccacattaccatatgatgaaaagtgatccttcaattcatcttcagtaagagatggtggtagcccaccgatgaagatctttcttgtcttagggccgtctttggtgatcatctcttccctcgggacagtcctcttaacttcaaccgttctgccatctataacgtgatcatcctccaaaaccttgtctataacagatggatcagaaaatgtaacaaatccaaatccacgaggcatcttagtatgcttgtccttcataattacagaatcagttattgccccatacttctcaaaatgcttggagaatgattcttcagttgtctcccaagcaacgcctccgacaaaaatctttcccaacgagtcgccacccgcccccctcccatcctctccgacagcatcagcgtacccagagcccccatccccggcctacccgcctcccggggtgtccctcctcttcgtcgacctcctcgtcgtacccgttcaactcgtgctggttgtcctccggtaccccgccatacacggaatcagagcaatccaagggtggggttcggggcctgagcaaaccctagcggcgctgctgcggatgcgggtttagagggaaggagacaggcagtagatgatagagagagagacggaagaggagtcggcggcgcccgcgaggttaggttc

SEQ ID NO: 19953 - DNA, 1704 bp, Zea mays
  misc_feature (13)..(13): n is a, c, g, or t
taaccaaatcctntaatgggtccctagttgtaatcaccacatgtggcaacagttaatcttgcaatggcaatgttagagcacggaatatagttctaccgccccgagctcttttttttcttttttatgctcgatctcagggttctaaactctgcatataccaaactaaagaatacaacacaggttttatgtgtagcttgtactgcaaacaaggcaggcagggaggctcagctgcagcaattacacagttctcacggtgacttaattagacccaactacgttccaatgcccactgtttagatggacatgccatgaaatctgaacttctaggagaagaggaacacctgagacccagaaaaatagtttaaactcgtcgcttattttccgtatggatgatacctgctagaaccccgagcacctgtgctcccaccaccagtactacctgctccgccataactgccgtatccgccagtgccataaccacctggggcgccaccataggcagcaccacctccataggcaccgcctccgtaggcacctcctccataggcgccaccaccataggcaccatatgcaccataggcagcacctccatacatggatccaccataaccaccaccaaaactagacccaaagccagcattgcctccatagccataccctctaccatagccatatcctgctcctgcgccaccatcatatccataacctgctgcagcagatcgataagcaccaccatacccataaccaccgccgcctccactgctgccactaccagctccaccaccactacggtaagaattgcggtaagctccacctccgtggtttgatctcccattactgctgtggtcagatccatgtttctttggttcagccttctttatttcaacctgcttcccaccaagatcacgcattctcccctctgatatgaccctttcaacagaatcttcactttcaaatgtgacaaaaccaaaccctctagaacgcccagtgctatgatcaagcattatctgatgttcaaccacattaccatatgatgaaaagtgatccttcaattcatcttcagtaagagatggtggtagcccaccgatgaagatctttcttgtcttagggccgtctttggtgatcatctcttccctcgggacagtcctcttaacttcaaccgttctgccatctataacgtgatcatcctccaaaaccttgtctataacagatggatcagaaaatgtaacaaatccaaatccacgaggcatcttagtatgcttgtccttcataattacagaatcagttattgccccatacttctcaaaatgcttggagaatgattcttcagttgtctcccaagcaacgcctccgacaaaaatctttcccaacgagtcgccacccgcccccctcccatcctctccgacagcatcagcgtacccagagcccccatcccggcctacccgcctcccggggtgtccctcctcttcgtcgacctcctcgtcgtacccgttcaactcgtgctggttgtcctccgggtaccccgccatactgcaaacttcgggaaacagccgccacgaaatcagagcaatccaagggtggggttcggggcctgagcaaaccctagcggcgctgctgcgggtgcgggtttagagggaaggagacaaggagtagatgatagagagagagacggaagaggagtcggcggcggcgaggttcggttct

SEQ ID NO: 19954 - DNA, 2452 bp, Zea mays
  misc_feature (2383)..(2383): n is a, c, g, or t
tttacagaaagagtctttcgtttatgggaaagaatcaatatactttaaatgtcgaatcgggattcactaagacagaaataaagcattgggtcgaactcttctttggtgttaaggtagtagctgtgaatagccatcgactacccggaaagggtagaagaatgggacctattctgggacatacaatgcattacagacgtatgatcattacccttcaactgggtattctattccacttctactttttaaattaaagggtattctgaaagaggtatttcttttattttcacaatagctttcttttgaatccaatttcaagttcgattagaaggatagaaaggcgatgagaatgggaaaagaaaaataaaatattttattttaatgagttccccttttgagttccccttttttgcaattttcttattatcaattccattcatttattttatagaatacttttttattctatatctataaaaaatctttattttgtaaactaaaaaatacaatagtcaatattccttatacctcgtggccggccggatatcataagaatcttaagatatatttcgaatagatagaaatagtaaatttgaattgagacacatattctatgacagattttaacttaccctctattttcgtacctttagtaggcttagtatttccggcaattgcaatgacttccttatttctttatgtgcagaaaaataagattgtctagaaacgacggggccaaattttctcaatgtatttccaggatcataatacagatatttttttgtgtaagtactataatatgatagggtatgtagctctttctacacacaaatgaaaaacgtctatggatgcagatataagctacgagcataaatgcatgcatatgcgtagccgactatagcgagtttttttttttaagtggatccactaattttttttgaatagaaagtcaatgtatctaaccaattatttcacaggagtactagctactgaaggctatttcagaatcaaaaaaagtaaagtaaaaatcatttagcttattctctcaatttcaattgaccgctactggatttagtatatctaatatgaattggcgatcagaacacatatggatagaacttctaaaaggttctcgaaaaagaggtaattttttctgggcctgtattctttttctaggttcattaggattcttagcggttggggcttccagttatcttggtaagaatatgatatctttacttccatctcaacaaattcttttttttccacagggggtcgtgatgtctttctacggaatcgcgggcctattcattagctcctatttgtggtgcactattttatggaatgtaggcagtggttatgaccgattcgatagaaaagagggaatagtgtgcatttttcgttggggattccctggaataaaacgtcgcatcttccttcaattccttgtgcgggatatccaatcaattagaattcaggttaaagagggtctttatcctcgtcgtatcctttatatggaaatccggggccagggggtcattcccttgactcgtactgatgagaagttttttactccacgagaaattgaacaaaaagctgccgaattggcctatttcttgcgtgtaccaattgaagtatttggggtaccaattgcaattttttgcaattgtaaggggattttcgagtatttatctaaagtaaaggaaggaacaaacgaggataagagaaaattgcttcgaatttgttttgtccaagtgagatatatggcatactattcttccatttttatacgaaaggcctttttttatttctctattccactccatttagatctaagaaagaacccaatacaatgaaattccactagtatacaaaaagagaaatagatacaaacacaaggtctcaaaccttgttatagaatttttgcttcaaagaaaagaaatatcatatatattcagcttacagatcaaaaatgaaaaaaaagaaagcattgccttctttcttatatcttgtatttatcgttctttcgccctcggcagtctctttctcttttaacaaatgtctggaactttggattaagaattggtggaataccaggcaatccgaaactttcttaactgatattcaagagaaaaggattctagaaggattcatagaattagaggaactttttctcttggacgaaatgataaaagagaaaccgaagacacatgtacaaaaacctcctataggaatacacaaggaaataatacaattggccaaaatagaataatgaggatcatctccatatcattttgcatttctcaacaaatataatctgtttggctattctaagtgggttcttttttttctgggtaaagaagaacttgtcatcttgaattcttgngttcaggaaatttttctataacttaaatgattcaataaaagctttttttattctttaagttactgaatt

SEQ ID NO: 19955 - DNA, 879 bp, Zea mays
ctgctgtggtcagatccatgtttctttggttcagcctctttattttcaacctgcttcccaccaaagatcacgcattctccccctctgatatgaccctttcaacagaaatcttcactttcaaatgtgacaaaaccaaacccttctagaacgcccagtgctatgatcaagcattatctgatgttcaaccacattaccatatgatgaaaagtgatccttcaattcatcttcagtaagagatggtggtagcccaccgatgaagatctttcttgtcttagggccgtctttggtgatcatctcttccctcgggacagtcctcttaacttcaaccgttctgccatctataacgtgatcatcctccaaaaccttgtctataacagatggatcagaaaatgtaacaaatccaaatccacgaggcatcttagtatgcttgtccttcataattacagaatcagttattgccccatacttctcaaaatgcttggagaatgattcttcagttgtctcccaagcaacgcctccgacaaaaatctttcccaacgagtcgccacccgcccccctcccatcctctccgacagcatcagcgtacccagagcccccatcccggcctacccgcctcccggggtgtccctcctcttcgtcgacctcctcgtcgtacccgttcaactcgtgctggttgtcctccgggtaccccgccatactgcaaacacgaaatcagagcaatccaagggtggggttcggggcctgagcaaaccctagcggcgctgctgcgggtgcgggtttagagggaaggagacaaggagtagatgatagagagagagacggaagaggagtcggcggcggcgaggttcggttccccggccggcctcgaggtacccaatg

SEQ ID NO: 19956 - DNA, 1929 bp, Zea mays
cccttaatccctttcgatttctgtgcaaccggacggacaagggctgcagttaaaacttgcaacggcaagttacagcacaaaatatagttctaccggaccaaatactgtccctaccataaaatgcttgtttctcagggttctaaactctgcataccgaactaaagaatacaacacaggtttcatgtgtagcttgtacagcaagcaaaggctcagcagctgcaattacacagttgttccagtggtgacgtgttcaacccaactatgctccaatgcccctgtttaggtggacatggcatgaaaactgaactaggaggaccagagaaactcccgagacccagaaaacttgattgaacttgtagcttattttccatatggatggtacctgctcgaaccccgagcacctgtactcccaccaccagtaccacctgctccaccgtaactgccgtatccgccagtgccataaccaccacctggggcgccaccataggcgctgcctccatatgcaccacctccataggcaccccctccatatgcaccaccaccgtatgccccatatgcaccatatgcgcctccatacatggatccaccatacccaccaccaaaaccagacgcaaagccagcattgcctccatagccataacctctaccatagccatatcctgctcctgcgccaccatcatatccataactcgctgcagcagatcgataagcatcaccaaacccataaccacccccaccgctgccgctgctgccactaccagctccaccaccaccacggtaagtactgcggtaacctcccccccccttggcttgatctcccattaccgatgtgatcagatccatgtttctttggttcagccttctttatttcaaccttcagtaagagatggaggtagcccaccgatgaagatctttcttgtcttagggccatctttggtattcatctcttccctcggaactgttatcttgacttccaccgttctgccatctataacgtgttcatcctccaaaaccttgtctataacagatggatcagaaaatgtaacgaatccaaatccacgaggcatcttagtatgcttgtccttcataattacagaatcagttattgccccatacttctcaaaatgcttggagaatgattcttcagttgtctcccaagcaacgcctccgacaaaaatcttcctgcagaaagcaaaaataatatatctccttttgacctacatcattaatgttcagaaatcctagggcccagatcgctcaccccgatgagtcgccgcccgcccccctcacatcctctccgccagcatcgccgtacccagacgccccatcccgacctccccgccgcccggggtgcccctcctcgtcgacctcctcatcgtcgtacccgttcaacgcgtgctggttgtcctccgggtaccccgccatgccgcaaacttctgcgcaaccgccgcctgagatcaaaacaatgaaatctgagcaaacacgcagaaaccctagctcgaaccttggaagagggcgcgggggagaaggcgggttacctcggattcggagcaatcagaaggtggggttcgaatcctgagcaaaccgtagcggcgctactgcggcctgcgggtttagagggaggggtgagattgcaggaggacggagatgagagagacggaagaggcggcggcgaggttcgctttgagtccaatgcgcaaacggctctggcattttatatgagccgtgtgcgacgttgcgagtttgggttttggacgaagttgactaaaaagttagagctatgacaaatttctatattaaggatttgttggtttattcacaatatatatggatcggattagattaaaaaaattaaaaaaatttgatttgtttaagattcaaactcatccaatcttactcaatcaatatggattgagagttaactgaata

SEQ ID NO: 19957 - DNA, 1400 bp, Zea mays
  misc_feature (1358)..(1358): n is a, c, g, or t
  misc_feature (1394)..(1394): n is a, c, g, or t
gggccccccttgggtgccgggccccccctcttctttttcttttttttttttttttttagataaaggctgttaccattcgttcgttatatctttggtggaaactgatccagccgaattgttatgcagttacaaaatgcagtggttacgaattaaagttaaggttaaaaaagcaacctacaacgatatgcagtggtttgagcaaacaacatgacaggcagaggtaccaagacgaatcgaatgccaaaaggttgaccacaggatcctagatgttgatggctgagaagttaatgacccttggcaacccatgtgtcgttgcctcctgctccttcaactctgcccttgcgcttctttgagcgacttacatttgctgacgatgggttcacagatgtcccaactgcaggtacaacattgatgcctcgttgaacagctaatgaggaagattcatttggcaaaacaggtgttgtatcatctggtctgccatatgctgcatatgaaacaggccgtgtaaactgtataggagtaaaagtagctggggtgtttccagaagatctgacagcagttataagttgtttcttcgatctaacaattctcaccatacaagtgtcatgcttagctaaaatcgacttgatcacaacacgagctgcattctgctctgcatctttcttgttgggtgcagattcaccatgatatgcatttccatcaaacaccacaattgcagcgaacagggtcaaaggctttttgagacaaacacaaactacagagtaagagggcaaagtggtctttgtcttgacagcaaattcaatgagaattgatttgcagaaaactgcatcctgatcaattagctcaaatgcctccttaacgtcactctcactaactgttgtcaagatctcataagcaactctcgcagcgtcctgctctgcttccttcttacgactaaaactaccagttgatgagaactgttgatcacccacttccactgtgcatgtgaacttaggctgatgagactggccttcagactcaaccttgtagattggcgttttcttatatgttcgttcagcaaatgactgcaaccggtttttatgcatatatttatcggggatggctgaaggcggcccgatggcggctgcggtcgcggtggcctccagctcggaggtggctgcggtcgcggtggcctccatctcggaggtggctgcggtcactgtggtcccgacctcggtggtggccgtggttgcggtcgcggtcacggtccccgccatctcgctggtggttggacttgggcaacagtggaacgggaggggattaaccctcttcgactttgagacctcggattgtatgattttaaagcaaaccgttgtgtnctggctccggtttacatcggacggcgtgggtcgacnccgggg

SEQ ID NO: 19958 - DNA, 2290 bp, Zea mays
attcctagtggatgtttctagagccgccgtgcaccctccattcgtctcgctctcgcctgcactgtttctaaaatcaaccccgtcccccacctcctcgccgcctcgcatcctttccccctccgcaagaaagaaagcgaagcaactctccgccgcctccattcctccacagcccacaccaaccaaacctctcgccgacaacagcctcggtccccgcgccaccatccgcaatcatgtaccgcgcggccgctagcctcgcctccaaggcgcggcaagccgggagcagctccgccgctcgccaggttggaagcaggcttgcctggagcaggaactatgctgccaaggacatcaagtttggtgttgaggcccgtgctctgatgttgaggggtgttgaggagttggcagacgctgtcaaagtgacaatgggtcctaaggggcgcaatgtggttattgagcaaagcttcggtgcaccgaaagtcacaaaggatggtgtgactgttgcgaagagcattgaatttaaggatagagtaaagaatgttggtgcgagccttgtgaaacaggttgctaatgcaactaatgacactgctggtgatggtaccacatgtgctactgttttgacaaaagcaatatttactgaggggtgcaaatctgttgcggctggaatgaatgcaatggatttaaggcgtggaatctcaatggctgttgatgctgttgtgaccaatctgaagggcatggccagaatgattagcacttcagaagaaattgcacaggtgggtacaatatcagcaaatggagaaagggaaattggtgagcttattgccaaggctatggagaaggttggcaaagagggtgtgatcactattgcggatggcaacaccctttataatgagcttgaagttgtggagggtatgaaacttgacagaggttacatctctccgtacttcattaccaactcaaaagcccagaaatgtgaactggaagacccattgatcttaattcatgacaagaaagtgacaaatatgcatgctgtggttaaggttttagaaatggctctaaagaaacaaaggcctctactgattgttgcagaagatgtggaaagtgaagcattaggtactctgattattaacaagcttcgtgcaggcatcaaggtctgtgctgtcaaagctcctggttttggggaaaacaggaaggcaaacttacaggacctcgctatccttaccggaggagaggtaataactgaagagctaggaatgaaccttgagaatgttgagcctcacatgctgggttcatgcaaaaaggtgactgtctctaaggatgacactgttattcttgatggcgctggagacaaaaagtctattgaagagagggcagaccagattagatcagcagttgagaacagcacttcagattatgacaaggaaaagctccaggaacggttggcaaagctctctggaggtgttgctgttctgaagattggaggagccagcgaagcagaagttggtgagaagaaggatagagtgacagatgcactgaatgctactaaagctgctgttgaagagggcattgtaccaggtggtggtgttgctcttctctatgcatcgaaggagctcgataagttgcagacagcaaattttgatcagaagattggtgtgcaaatcattcagaatgctttgaagacacctgtacacaccattgcctccaatgctggggtggagggagcagtagttgtgggcaagcttttggagcaaggaaacactgaccttggttatgatgctgctaaagacgaatacgttgacatggtgaaggctggtatcattgatccgctaaaggtcatcagaactgcattggtggatgctgctagtgtgtcgtccctgatgaccaccacggaatccataattgtagagatccccaaggaagaggcaccggctccagcaatgggtggcatgggtggaatggattactaagtgtcaagcacacccacgatacaacaacatcaaagcagagatgacgaggtggttgtcaggaggatacaattttgaggctgcggacgtaggacctctcaatatctccaagcaatagtggggggataataaacatgagcagtagttgtttgagatctgatgctgtagatcaagattggattctgacaccttgtgctgaaccaactgtagtctgattattacacattttttggcagagtaaaatcggattgccgttctgttttgccgcttttgccacacaacttgtgggcttgctttgcttctgataatcacagctttctgcattctgatgt

SEQ ID NO: 19959 - DNA, 2350 bp, Zea mays
gaattcccgggtcgaccagagccgccgcgcaccctccagttcgtctccccagctctgtctctaaaatccactcgtccaccacctcctcggcgcttcgcatcctttccccctccgcaagaaagaagcgaagcaactctccgccgtctccgtttttctccacaccacccaaagctctctccgaccacagcctcgcccccagcgcctccttccgcagtcatgtaccgcgcggccgctagcctcgcctccaaggcgcggcaagccgggaacagcctcgccgcccgccaggttggaagcaggcttgcctggagcaggaactatgctgcgaaggacatcaagtttggtgttgaggcccgtgctctgatgttgaggggtgttgaggagttggcagatgccgtcaaagtgacaatgggacctaagggccgcaatgtggttattgagcaaagctttggtgcaccgaaagtcacaaaggatggtgtgactgtagcaaagagcattgaatttaaggatagagtaaagaatgttggtgcaagccttgtgaaacaggttgctaatgcaactaatgacactgctggcgatggtaccacatgtgccactgttttgacaaaagcaatatttactgaggggtgcaaatctgttgcggctggaatgaatgcgatggatttaaggcgtggaatctcaatggctgttgacgctgttgtgaccaatctgaaaggcatggccagaatgatcagcacttcagaagaaattgcacaggtgggtacaatatcagcaaatggggaaagggaaattggtgagcttattgccaaggctatggagaaggttggcaaagagggtgtcatcactattgcggacggtaacaccctttataatgagcttgaagttgtggagggtatgaaactagacagaggttacatctctccgtacttcattaccaactcaaaaacccagaaatgtgaattggaagacccattgatcttaattcatgacaagaaggttacgaacatgcatgctgtggttaaggttttagaaatggctctgaagaaacaaaagcctctactgattgttgcagaagatgtggaaagtgaagcattgggcactttgattattaacaagcttcgtgcaggcatcaaggtctgtgctgtcaaagctcctggttttggggaaaacaggaaggcaaacttacaggaccttgcaatccttactggaggagaggtaataactgaagaactaggaatgaaccttgagaattttgagcctcacatgctgggtacatgcaaaaaggtgaccgtctctaaggatgacactgttattcttgatggagccggagacaagaagtccattgaagagagggcagagcagattagatcagcaattgagaatagcacttcagattatgataaggaaaagctccaggagcggttggcaaagctctctggaggtgttgctgttctgaagattggaggagccagcgaagcagaagttggtgagaagaaggatagagtgacagatgcactgaatgctactaaagctgccgttgaagagggtattgtaccaggtggtggtgttgctcttctctatgcatcgaaggagcttgataaattgcagacagcgaacttcgatcagaagattggtgtgcaaatcattcagaatgctttgaagacacctgtacacacaattgcctccaatgctggggtggagggagcagtagttgtaggaaagcttttggagcaagaaaatactgacctgggttatgatgctgctaaaggtgaatatgttgacatggtgaagaccggtatcattgacccgctaaaggttatcagaactgctttggtggatgctgctagtgtgtcgtccctgatgacaaccacggaatccataattgtagagattcccaaggaagaggcaccggctccagcaatgggtggcggcatgggtggcatggattactaatgcatcacacccacatacacatcaatgcaggttttttttagcggtgaagttcatcttcactgtttagcggtgcaagttcatctctactgtattttgttcgatgatgaggtggttgtcaggcggatacagttttgagtctgcggacgtaggacctcacaatagttccaaacggaatagtgtgagaataataaatatgaacagtagttctttgagatatgaagttgtagatcaagattggcttccgggcattttgtgtcgaaccaactgtattctgatcgttacatttttttggctggggtaaaatcggattgccgttccgtttaaaaaaaaaaaaaaaaaaaagaatcgagggggggcccggtaccaaaaaaaaaaaaaaacccttgtgacttggccaatt

SEQ ID NO: 19960 - DNA, 956 bp, Zea mays
ctgtgcggccctcgaggccgccgaatttacgatccagaagcacgcacgtgacgtggctgtcagcaagtagcagcttctgtcgcgtctccccctccctgaccgagcgatccagcgagagggagcgagtagcagccgcagccggaggagctcgccgaggccgccgaagacgaccatggggttctgggcgacgacgctcatcttcgtcctcgccggcgtcgccgcatccctcttcacgctcctctgctgcaaccgcgggccctccacaaacctgttccatttgaccttggtgactacagctgtaatttgttgctggatgatgtatgcaatcgtctaccttgctcagatgaagccattgatcgaccccattctgagcggagagtgagcgctgcatctgtattgaacagaacgaaagcgagacctgctgtaccattgttcagtccgtgaactttatattcattttggccccacctgatgaaataaataaataaactgccatgatttttttggtgccactcttcacccgtgattagtgtatgcaattgcatgatatacgcagtaataacatataaatatctatgtatcgatcatgtgcttgaattaaaaaaaaaacgccaccatccagcgcctccaccttcctcgccgcctcactccctctgaggtcgcagatccgtccggttagacgaagccgcccgcacccatggcctccggtgagctcgcctgcacctacgccgccctcatcctcagcgacgacggcatcgccatcaccgccgagaagatcgccaccatcgtgaaggcggccaacatcaaggtcgagtcctactggccggcgctcttcgctaagctcctggagaagcgcagcgttgaggatctaatcctctccgtgggatctggtggtggcgctgctccagttgctgcttccgccccagctgggggtgctgcaattgctgctgtccctg

SEQ ID NO: 19961 - DNA, 2000 bp, Zea mays
gtacctctccggccgtccgggagatcgtcaactgcaattagtactgactctgccaagtcgccacgtgactaacccgcgaggtcgacgcggattttcttctttataccgcgggcaggcggactgggcggctgacggagccgcggagggaaccgagtggccccggcgacgcgaggccgaggcgagctaatctgacggcggcagtgacgactccaacgaccaggcgcggaggctgcactgctccagcgaaggcaccatgtcattcatgtctccattcccggggatggatctaagtaaaatggatcccgggactctgaccctccttggggcagctggttgtgtaatgctgactatgcatttcactgtgcaattggtgtcacaacatctcttctattggaaaaaccccaaggagcagaaagccatacttattattgtgctgatggctccactatacgctatctcttccttcgtgggtcttcttgatatccagggtagcaagacatttttcacattcttagatgctgttaaagaatgctatgaggcactggtgattgctaagtttatggcattgatgtacagctacttgaatatatctatcagcaagaacatagtccctgatgaaatcaaagggagggtgcttcatcattccttccctgtttctcttttcctgccccgcaatgtccgattggagcacaagacattgaagcttctgaagtattggacctggcaatttgttattgttaggccagtatgttccattctgattattgcactccagcttcttgggctgtaccccagctgggtcagctggacgtttagtattatactgaacttttcagtctccatggccttatatgcattggttctcttctaccacttgtttgctaaagagctggcacctcacaagcctcttgcaaagttcttgtgcatcaaagggattgtcttcttctctttctggcagggttttgcgctcgatgttttaacccaagcaggcgtgatcaaatcccaccatttctggctggacgtggagcacatccaggaggcgatccagaacgtcctggtgatccttgagatggtggtgttctccgtcatccagcagtacgcataccacgtcgccccctacagcggggctgacagggccaagttcgagaagaagaacgaatgaaccaggtttccaaaaggaatgaaaggaaaaaaaaactctctgctttctggtctctcggagatggagcaccagttcatcgagtctcgcgagtagcgtatttggtagcgagttatcgcgctgtaaaattacactgtgcttgcgcgctgaataattttgctggctttgtcgttttggttttttgaacgttgtcgccgaggctatgtagccaggactgttcgtcttgtacgcgcgcgctctctctctctctctgcggactttgggaatccttttatatgaataaaagctacagtcctgtccccctccctgaccgagcgatccagcgagagggagcgagtagcagccgcagccggaggagctcgccgaggccgccgaagacgaccatggggttctgggcgacgacgctcatcttcgtcctcgccggcgtcgccgcatccctcttcacgctcctctgctgcaaccgcgggccctccacaaacctgttccatttgaccttggtgactacagctgtaatttgttgctggatgatgtatgcaatcgtctaccttgctcagatgaagccattgatcaaccccattctgagcggagagtgagcgctgcatctgtattgaacagaacgaaagcgagacctgctgtaccattgttcagtccgtgaactttatattcattttggccccacctgatgaaataaataaataaactgccatgatttttttggtgccactcttcacccgtgattagtgtatgcaattgcatgatatacgcagtaataacatataaatatctatgtatcgatcatgtgcttgaaaaaaaaaaaaaaaaaaggcccctacggccaaaa

SEQ ID NO: 19962 - DNA, 1149 bp, Zea mays
gccggccgcgtggccgcccggcgggcggcggggcggaactccatctccttttccggtcttcccgaccgagcgatccagccagcgagaggttgcgagaagtagccgccggaggagcacgccaaggccgccgcctacgaggacggccatggggttctgggtgaccacgctcatctttctcctcgccggcgtcgccgcatccctcttcacgctcctctgctgcaaccgcgggccctccacaaacctattccatttgaccttggtgactacagctgtaatttgttgttggatgatgtatgctatcgtttaccttgctcagatgaagccattgatcaaccccatcctgagcggggagtgatctctcctctgcattaaaaagaatgaaagctaggtctgctgtaccattattcagtctgtgaacttcctattcatttggccccacctgatgaaataaataaactgccatgagtttttttttttttgctactccttcactgcagacattgagaaggctcgctgtgattagtgtatgcaattgtatgatatacgcaataataataatagtatctaaatatatgtgtgccgctcattggaatgtctgggtgcgtgtacccaactttgttcgtcacgactcaggtgtttgtctgcttgtaatggaattatgaacgtaaaacaatgtagcacaattttctgctttcagtgggtgttttgacttttgagcttacattttttggtggtagagtactggtacactgccaaatgtctgctattttcttgtttgaaagtacacctgcaaaatatgtattgtttggttggcgcttataagcatttaacgatgatatgatgcgcattttcacattttcgtttgccaaactttgtttattatttttaaaaatatgtacgttcttactccttgtattcacaactttacttagactatccgtaatcataaaactctatatccatactctaaaaaaaatattctattctactcatcaaaattctcatttatatagcaccatcttctgcacacatatattactctatttcctattctatatcaatcataatatattttttaacagtaagtgtcatgcgatcaataccgatcacatctgcacatgccgtcctgaattttttaatctattttga

SEQ ID NO: 19963 - DNA, 1532 bp, Zea mays
gcacgagaccattacctagaacatcctaatcgaaaaactgcaattagtactgactctgccaagtcgccacgtgactaacccgcgaggtcgacgcggattttcttctttataccgcgggtaggcggactgggcggctgacggagccgcggagggaaccgagtggccccggcgacgcgaggccgaggctagctaatctgacggtggcagtgacgactccaacgaccaggcgcggaggctgcactgctccagcgaaggcaccatgtcattcatgtctccattcccggggatggatctaagtaaaatggatcccgggactctgaccctccttggggcagctggttgtgtaatgctgactatgcatttcactgtgcaattggtgtcacaacatctcttctattggaaaaaccccaaggagcagaaagccatacttattattgtgctgatggctccactatacgctatctcttccttcgtgggtcttcttgatatccagggtagcaagacatttttcacattcttagatgctgttaaagaatgctatgaggcactggtgattgctaagtttatggcattgatgtacagctacttgaatatatctatcagcaagaacatagtccctgatgaaatcaaagggagggtgcttcatcattccttccctgtttctcttttcctgccccgcaatgtccgattggagcacaaaacattgaagcttctgaagtattggacctggcaatttgttattgttaggccagtatgttccattctgattattgcactccagcttcttgggctgtaccccagctgggtcagctggacgtttagtattatactgaacttttcagtctccatggccttatatgcattggttctcttctaccacttgtttgctaaagagctggcacctcacaagcctcttgcaaagttcttgtgcatcaaagggattgtcttcttctctttctggcagggttttgcgctcgatgttttaacccaagcaggcgtgatcaaatcccaccatttctggctggacgtggagcacatccaggaggcgatccagaacgtcctggtgatccttgagatggtggtgttctccgtcatccagcagtacgcataccacgtcgccccctacagcggcgctgacagggccaagtttgagaagaagaacgaatgaaccaggtttccaaaaagaatgaaagaaggaaaaaaactctctgctttctggtcgctcggagatggagcaccagtatttcctcacggatggacgacatacacaagttcatcgagtctcgcgagtagcgtatttggtagcgagttgtcgcgctgtaaaattacactgtccttgcgcgctgaataattttgctggctttgtcgttttggttttttgaacgttgtcgccgaggctatatagccaggactgttcgtcttgtacgagcgcgcgctctctctctctctctctctctgcggacttggcgaatccttttatgaataaaagctactgtcctgttctacaaaaaaaaaaaaaaaacggcccccta

SEQ ID NO: 19964 - DNA, 1759 bp, Zea mays
tcgaggccggccggggtccgacgtggcacgccacagccacacccatcgcttcactccaccacctccttcctccttttcccagcgcgccgccgtccccggcccggccccccgacctccctgcaataataattacggagtataataataataaaaaaactccgaatccgccgcgcgcgccccgtcctcgtcgccggcggaggcgtccgccaccgcccacagcagactatcgccggagaaggaacgccgcggggagcttttccactgccatctcccgtctgacccctccgagatcggaagcggcggccatggccatcccgctcgtgctcgtcgtgctcccgctcggcctcctcttcctcctgtccggcctcatcgtcaacaccatccaggccatcctatttgtgacaataaggcccttttccaagagcttgtatcgccggatcaacaggttcttggccgagctgctgtggctccagcttgtctgggtggtggactggtgggcaggcgttaaggtacaactacatgcggatgaggaaacttaccgatcaatgggtaaagagcatgcactcgtcatatcaaatcatcgaagtgatattgattggcttattggatggatattggcccagcgctcagggtgccttggaagtacgctcgctgtcatgaagaagtcatccaagttccttccagtcattggctggtcaatgtggtttgcagagtacctctttttggagaggagctgggccaaggatgaaaagacactaaagtggggtctccaaaggttgaaagacttccctagaccattttggctagctctttttgttgagggtactcgctttactccagcaaagcttctcgcagctcaggagtatgcggcttcccagggcttaccagctcctagaaatgtacttattccacgtaccaagggatttgtatctgccgtaagtattatgcgagattttgttccagccatttacgatacaactgtaatagttcctaaagattcccctcaaccaacaatgctgcggattttgaaagggcaatcatcagtgatacatgtccgcatgaaacgtcatgcaatgagtgagatgccaaaatcagatgatgacgtttcaaaatggtgtaaagacatttttgtggcaaaggatgccttactggacaaacatttggcaacaggcactttcgatgaggagattagacctatcggccgcccagtgaaatcattgctggtgaccctgttttggtcgtgcctcctgttgtttggtgccatcgagttcttcaagtggacgcagctcctatcgacatggagaggagtggcattcactgccgcagggatggcgctggtgacagggctcatgcacgtcttcatcatgttctcccaggctgagcggtcgagctcagccaaggcggcacggaaccgggtcaagaaggaatgaaaacggagggtggaaatgtgattctgggctctatttatgggcagctttcaaaatgactcgattcatattaatgtatacagcaccaaattccagacagaaacaggatgctctgctcctcttgtatttgtgtgcaggaaagaattttagggagttcatttttgcccccctcttttgggcagaggaactgtaggacatgaacttgatgttggtacatttgccctgtagacattctggaagcctttcagtagttcatttatcagtaaagcttgcatctttcatccctcgaggggggccccgggtctgtcactcatcacaatgttgttgtgttc

SEQ ID NO: 19965 - DNA, 1835 bp, Zea mays
  misc_feature (1808)..(1808): n is a, c, g, or t
  misc_feature (1835)..(1835): n is a, c, g, or t
acaccatcctctcgtgttggctgttgctctgccaatgccacctatggacgcatccgctacactccacctcctccctctcgtcccagtcccagcggccagcgctcatccatccacccccatcctataataaaacctccgaatgcgcctcgcgtgccccgtcctcctcgtcgccggcggagccgcctactatcgcctggagaaggagcgccgcggggagcttttcccactgccgactgccgtctgaccctccgagatcggaagcggcgccggcgccggccggcgatggcgatcccgctcgtgctcgtcgtgctcccgctcggcctgctcttcctcctgtccggcctcatcgtcaacgccatccaggccgtcctatttgtgacgataaggcccttttcgaagagcttctaccgtcggatcaacagattcttggccgagctgctgtggcttcagcttgtctgggtggtggactggtgggcaggtgttaaggtacaactgcatgcagatgaggaaacttacagatcaatgggtaaagagcatgcactcatcatatcaaatcatcggagtgatattgattggctcattggatggatattggcccagcgttcagggtgccttggaagtacacttgctgtcatgaagaagtcatccaagttccttccagttattggctggtcaatgtggtttgcagagtacctctttttggaaaggagctgggccaaggatgaaaagacactaaagtggggtctccaaaggttgaaagacttccctagaccattttggctagctcttttcgtcgagggtactcgctttactccagcaaagcttctcgcagctcaggaatatgcggcctcccagggcttaccggctcctagaaatgtacttattccacgtaccaagggatttgtatctgctgtaagtattatgcgagattttgttccagccatttatgatacaactgtaatagtccctaaagattcccctcaaccaacaatgctgcggattttgaaagggcaatcatcagtgatacatgtccgcatgaaacgtcatgcaatgagtgagatgccaaaatcagatgaggatgtttcaaaatggtgtaaagacatttttgtggcaaaggatgccttactggacaagcatttggcaacaggcactttcgatgaggagattagacctattggccgtccagtgaaatcattgctggtgaccctgttctggtcgtgcctcctgctgtttggcgccatcgagttcttcaagtggacacagcttctgtcgacgtggaggggtgtggcgttcactgccgcagggatggcgcttgtgacgggtgtcatgcatgtcttcatcatgttctcccaggctgagcggtcgagctcagccagggcggcacggaaccgggtcaagaaggaatgaaaaatggagggtggagatgaggttctcgtggggtttgttatgggcaaccttcaaaaggactctccattcatattagtattaattcatatatatgcagcgccaaattccagacattgatatgctctcaaataggatgttctgctcccctcttgtatttgtatgcaggaaagggtttgtagggagtttaccccccccccccccccccccgcctttcttttgggcagaaagacatattctggaagcctttcagtagttcatttatcagcaacaattgcatctttcttccattgctgtgcaccttgtatcacctatcagaatgtggtcatatggggattgtacggcagcactgctgtgtgtgttgaaatgttgttccgttctgtaaaaaaaaaaaaaaaaaaaanaaaaaaaaaaaaaaaaaaaaaaaaaan

SEQ ID NO: 19966 - DNA, 1686 bp, Zea mays
atctgggaggtaacgacctggttgtgaggcgagacgtgagggagaaaaacatatttactctacgcgctgtcacgcttcgcgcgtgacgcacgacacacgaaactcgtgctttaaaggagtagagatatacagtttttgtgtataacataaaccaacatgagctgcagcggttagagactagtgctttgttcctagagaccatagttcgaatcccagtgggggtgcctttttgatatttcgtgatattttgctgagcgtgtgagaaactttggcaacgcgcgtggaggagggcgcgtggaggaggggagcggttgcatcgagcgggcgtaccaagggagaaacttccgttttatattagtagagatgtttatgaagcaagcattgattttttccttcctgatcccagaataacttcagcttatgctctgcaggtacaactacatgcggatgaggaaacttaccgatcaatgggtaaagagcatgcactcgtcatatcaaatcatcgaagtgatattgattggcttattggatggatattggcccagcgctcagggtgccttggaagtacgctcgctgtcatgaagaagtcatccaagttccttccagtcattggctggtcaatgtggtttgcagagtacctctttttggagaggagctgggccaaggatgaaaagacactaaagtggggtctccaaaggttgaaagacttccctagaccattttggctagctctttttgttgagggtactcgctttactccagcaaagcttctcgcagctcaggagtatgcggcttcccagggcttaccagctcctagaaatgtacttattccacgtaccaagggatttgtatctgccgtaagtattatgcgagattttgttccagccatttacgatacaactgtaatagttcctaaagattcccctcaaccaacaatgctgcggattttgaaagggcaatcatcagtgatacatgtccgcatgaaacgtcatgcaatgagtgagatgccaaaatcagatgatgacgtttcaaaatggtgtaaagacatttttgtgacaaaggatgccttactggacaaacatttggcaacaggcactttcgatgaggagattagacctatcggccgcccagtgaaatcattgctggtgaccctgttttggtcgtgcctgctgttgtttggtgccatcgagttcttcaagtggacgcagctcctatcgacatggagaggagtggcattcactgccgcagggatggcgctcgtgacaggggtcatgcacgtcttcgtcatgttctcccaggctgagcgatcgagctcagccaaggcggcacggaaccgggtcaagaaggaatgaaaacggagggtggagatgtgattctgggctctatttatggcagctttcaaaatgactcgattcatattaatgtatacagcaccaaattccagacattgatatgctctgaaacaggatgctctgctcctcttgtatttgtgtgcaggaaagaattttagggagttcatttttgcccccctcttttgggcagaggaactgtaggacatgaacttgatgttggtacatttgccctgtagacattctggaagcctttcagtagttcatttatcagtaaagcttgcatctttcttccaaaaaaaaaaaaaaaaaaaactcgagagggcgcccggtaccc

SEQ ID NO: 19967 - DNA, 481 bp, Zea mays
gagcggccgcccgggcaggtactgacccaaggtctacttctctttgttggtcgtcagggagctgcgcaagcgcagcggccatcgggaggagtcgtcggtccttggtcgtcaaggagctccaagagttaatcccaagcagtgcagactctcaagcatcagggttgccttttcttcttgtgcccacaactggaatttctgcatgcagcaaactttcaatgataggatgcaaagcaaaaggtttttattgttggattgcagaattatggagtgtttgccatagagagttatgctttcaagtctatcaaggagttgaccgaaaaaggcaatgctaccagtagtagcacatccggtgcaaattaagggtcctcaaggtctcgtgccattcttcacatcatcaattataggttgtcgatggctaggacctctttcaaaatggagcatgacctcagtaaatttgggtacctcggccgcgaccacgcta

SEQ ID NO: 19968 - DNA, 1673 bp, Zea mays
  misc_feature (40)..(40): n is a, c, g, or t
attgggtacctcgaggccggtaccctcggggccgcccggngtataacaattacggagtataataataataaaaaaactccgaatccgccgcgcgcgccccgtcctcgtcgccggcggaggcgtccgccaccgcccacagcagactatcgccggagaaggaacgccgcggggagcttttccactgccatctcccgtctgacccctccgagatcggaagcggcggccatggccatcccgctcgtgctcgtcgtgctcccgctcggcctcctcttcctcctgtccggcctcatcgtcaacaccatccaggccatcctatttgtgacaataaggcccttttccaagagcttgtatcgccggatcaacaggttcttggccgagctgctgtggctccagcttgtctgggtggtggactggtgggcaggcgttaaggtacaactacatgcggatgaggaaacttaccgatcaatgggtaaagagcatgcactcgtcatatcaaatcatcgaagtgatattgattggcttattggatggatattggcccagcgctcagggtgccttggaagtacgctcgctgtcatgaagaagtcatccaagttccttccagtcattggctggtcaatgtggtttgcagagtacctctttttggagaggagctgggccaaggatgaaaagacactaaagtggggtctccaaaggttgaaagacttccctagaccattttggctagctctttttgttgagggtactcgctttactccagcaaagcttctcgcagctcaggagtatgcggcttcccagggcttaccagctcctagaaatgtacttattccacgtaccaagggatttgtatctgccgtaagtattatgcgagattttgttccagccatttacgatacaactgtaatagttcctaaagattcccctcaaccaacaatgctgcggattttgaaagggcaatcatcagtgatacatgtccgcatgaaacgtcatgcaatgagtgagatgccaaaatcagatgatgacgtttcaaaatggtgtaaagacatttttgtgacaaaggatgccttactggacaaacatttggcaacaggcactttcgatgaggagattagacctatcggccgcccagtgaaatcattgctggtgaccctgttttggtcgtgcctgctgttgtttggtgccatcgagttcttcaagtggacgcagctcctatcgacatggagaggagtggcattcactgccgcagggatggcgctcgtgacaggggtcatgcacgtcttcgtcatgttctcccaggctgagcgatcgagctcagccaaggcggcacggaaccgggtcaagaaggaatgaaaacggagggtggagatgtgattctgggctctatttatgggcagctttcaaaatgactcgattcatattaatgtatacagcaccaaattccagacattgatatgctctgaaacaggatgctctgctcctcttgtatttgtgtgcaggaaagaattttagggagttcatttttgcccccctcttttgggcagaggaactgtaggacatgaacttgatgttggtacatttgccctgtagacattctggaagcctttcagtagttcatttatttatcagtaaagcttgcatctttcttccgaaaaaaaaaataaaaaaaaaagtag

SEQ ID NO: 19969 - DNA, 1030 bp, Zea mays
aacacagcagtaacattcacagtccgcaggccgcagcagctgaatttcgaaggagactgtttcataaacaggagccaggcaccggactttccaggaggataccacctcccgaacatggtgcgtcgacgacccgccaccggggcagccccgagaccccacctcgccgccgtcggtcgcgggctgctcctcgcgtccgtcctcgcggccgctgcctcctccctcccagtagccgagtcgtcctgcccgcgagacaactcactggtgagagacataagccgaatgcagcagcgcaactacgggagggaaggattctcgcatataactgtcacaggtgctcttgctcacgggacgaaggaggtggaagtgtggctacaaacatttggtccaggtcaaaggaccccaatccacaggcattcttgtgaagaggttttcattgtcctcaaggggaaaggcacgctcttactcgggtcgagctcgctgaagtacccaggacagccgcaggaagttcctgtctttcagaataccacattttcgatccctgtaaatgatccacatcaggtaaaagagaagggttgtcatttatatgcacttttactttgtctgatacagtgatatctcgtgtcctgatttgcacaactctgctgattatatggtactgtacctttgctagttttaagatattgttggagcttgggtagggcctatttgttagtgtctatcatctttctctttcttgcaggtctggaattctaatgagcacgaagatttgcaagttcttgtgatcatatcgcgcccaccggtcaagatatttatatacgatgattggagtatgcctcatacagctgcaaagctgaaattcccctacttctgggatgaggactgcttgccagcaccaaaagatgaactctaggttaagtggttcctgcaatttgtcagcttcgtgttcgtccacaatcctggtggactacgactcacatctacaagttgaaaaccattagtgtactcttcatgtgtagttttgtgttgtaaa

SEQ ID NO: 19970 - DNA, 1667 bp, Zea mays
ttcacagtccgcaggccgcagcagctgatttcgtcgaaaccagttctgccgtgtttcataatctcaataatctctcgaggaggataccacctcccgaacatggtgcgtcgacgacccgccaccggggcagcccagagaccccaactcgccgccgtcggtcgcgggctgctcctcgcgtccgtcctcgcggccgctgcctcctccctcccagtagccgagtcgtcctgcccgcgagacaactcactggtgagagacataagccgaatgcagcagagcaactacgggagggaaggattctcgcatataactgtcacaggtgctcttgctcacgggacgaaggaggtggaagtgtggctacaaacatttggtccaggtcaaaggaccccaatccacaggcattcttgtgaagaggttttcattgtcctcaaggggaaaggcacgctcttactcgggtcgagctcgctgaagtacccaggacagccgcaggaagttcccgtctttcagaataccacattttcgatccctgtaaatgatccacatcaggtctggaattctaatgagcacgaagatttgcaagttcttgtgatcatatcacgcccaccggtcaagatatttatatatgatgattggagtatgcctcatacagctgcaaagctgaaattcccctacttctgggatgaggactgcttgccagcaccaaaagatgaactctaggttaagtggttcctgcaatttatcaacttcgtgttcgtccacaatcctggtggactacgattcacatctacaagttgaaaaccattagtgtactcttcatgtgtagttttgtgttgtgactctgggaaatccatattgacaacgtttataaaattaagcacttctggagctgagctactgtggtctatattctagatttttgaagcagtattggtttgtttcgacaaaagatttctgctctttattgtgatatcccagtgttaatcatatgggttttaggtaatcattcattctaagcattcaaatgtagggcttccgtatagtattattgtattaagaaaaacctttatgaacaggttttatgtctaatagctaagtgaacctgaaattctgaagtaatctctactatataaagtaccaggttttcatgattctatagtcgccgtgcatcatccttctcttctcgctttatgcaaaaataaggtaaaattatacacaagtgaaggttcgaacatgaattgttggctccacattcatatctaattaattatcatctctatctctactcatataaagcatcagttttataggtcggccgttacacaggtgaaactgatctccgcgcagatgagactgatcccttgttcatcgcgcgtacagcaacgaactgtgagcaacaaccgctcgcccgcctcgctgtgggtaacaagtaacaactgccgtcgcatgtaaagcaacaaaccaaaagcagaccagccggccgcctcgctatagataaggatgtgcctcaccggtgtgcgtgcgccgtcgtgcgtacaacagcaaatcagtcgtctgcctcgctgtgacacttaccaccatccaccttcatcaagcgtcgtgtgcagaggaagctaaatgcggagcatgccgcaccaaggctgagcgcacgcggaggaggaagaggacaagtc

SEQ ID NO: 19971 - DNA, 1462 bp, Zea mays
  misc_feature (1427)..(1427): n is a, c, g, or t
aatcaagtagccttcacaaatggttttcaattagaatgcagaacattaaggtacgacaccggtgacggtcctaccactcacttttgaaacctagaaccatgcacgaaacctggtaacgggcagaacttctcttttttttttttttttgtagtgcaacagacaagttgaggcgtacagaagcacaatccaacagatggcaacatgtcatgttcaagcagtagccacatgttcagacagtattcgtcagttcgagtagactagttgaggctgaatctgcacttcagtagttagacatcctacaggagttcatgcagcacatgctacgttttttatatacacatcataacacgtttccgcagcacatccaaaacactgaagggccagtttgcagattccgcgctcctcgatcaacaagacagctgcttccgattctggaggcagcgaagacaaataagaacggtgcacgatcaggatatacgcgtgtattcaaatatctgcagaatggttattactattgtcggtctagttccattggagattcacttagcagcttttatgtttgcgagggcggtaagaacctcggtgactgaaccttcgatagctgacctattagccttgagagatggcactagtgcgtaaacctcttcaacggtctcaggcccaatgtttgctatcatgcatatctctccatcactgaccccacattttttaagaggttcaatggcttgtttcacagagcttgcagtggtgaaatgatttccatcttttgaatactgaaaagctttgtcaaatgactcaggaattttgatcttggggtcctctgatagtatggccatgtgctcgtgaatttcttgcaatagttcagctgcttcacaattcattagcattctagaatttggagggatatcaagctctagctttagttctgcatcagacttggtaggcactgcatgtgatgaagaaccctttccacctttgtcactactgtatgcttttcctttgcttgcctcacctttagaaagggctgaagcctttccaccagtttttaggctcgcagatgaagccttcccgtttgactttgagtgaacaggagttagctcttctacaaaaccttcagagtcagagtcagaatctgaaagcacaactactcttggcttcgcaaaagaaaccttatgccttccattcggtacttggtccattggaaaaacttgtcaagactcctggtgggtgctcgtcgccggcgaagagaccaatgtaaacctccgcaactggcttagggtggcggcggcccaccagtcgccggagagcgagacgcagacagaagtcacagaagtgacagaacccacgcggaggaaattaggaatgcagcggactttttttttttttttttttttttttttttttttttttttttttttttttttttntacgaaatgatctgattttttgacacgtatattta

SEQ ID NO: 19972 - DNA, 1188 bp, Zea mays
tttttaacctagaaccatgcacgaatggtaacgggcagaacttctcacagactcggaagtcggaagtgcaactgttttgttgaggcgtacagaagcacaatccaacagatggcaacatgtcatgttcaagcagtagccacatgttcagacagtattcgtcagttcgagtagactagttgaggctgaatctgcacttcagtagttagacatcctacaggagttcatgcagcacatgctacgttttttatatacacatcataacacgtttccgcagcacatccaaaacaccgaagggccagtttgcagattccgcgctcctcgatcaacaagacagctgcttccgatttattgtcggtctagttccattggagattcacttagcagcttttatgtttgcgagggcggtaagaacctcagtgactgaaccttcgatagctgacctattagccttgagagatggcactagtgcataaacctcttcaacggtctcaggcccaatgtttgctatcatgcatatctctccatcactgaccccacattttttaagaggttcaatggcttgtttcacagagcttgcagtggtgaaatgatttccatcttttgaatactgaaaagctttgtcaaaagactcaggaattttgatcttggggtcctctgatagtatggccatgtgctcgtgaatttcttgcaatagttcagctgcttcacaattcattagcattctagaatttggagggatatcaagctctagctttagttctgcatcagacttggtaggcactgcatgtgatgaagaaccctttccacctttgtcactactgtatgcttttcctttgcttgcctcacctttagaaaaggctgaagcctttccaccagtttttaggctcgcagatgaagccttcccgtttgactttgagtgaacaggagttagctcttctacaaaaccttcagagtcagagtcagaatctgaaagcacaactactcttggcttcgcaaaagaaaccttatgccttccattcggtacttggtccattggaaaaacttgtcaagactcctggtgggtgctcgtcgccggcgaagagaccaatgtaaacctccgcaacttagggtggcggcggcccaccagtcgccggagagcgagacgcagacagaagtcacagaagtgacagaacccacgcggaggaaatt

SEQ ID NO: 19973 - DNA, 1257 bp, Zea mays
gggtaccgggccccccctcgtgtttttttttttttttttttttgactcggaagtcggaagtgcaactgacaagttgaggcgtgcagaagcacaatccaacagatggcaacatgtcatgttcaagcagtagccacatgttcagacagtattcgtcagttcgagtagactagttgaggctgaatctgcacttcagtagttagacatcctacaggagttcatgcagcacatgctacgttttttatatacacatcataacacgtttccgcagcacatccaaaacactgaagggccagtttgcagattccgcgctcctcgatcaacaagacagctgcttccgatttattgtcggtctagttccattggagattcacttagcagcttttatgtttgcgagggcggtaagaacctcggtgactgaaccttcgatagctgacctattagccttgagagatggcactagtgcgtaaacctcttcaacggtctcaggcccaatgtttgctatcatgcatatctctccatcactgaccccacattttttaagaggttcaatggcttgtttcacagagcttgcagtggtgaaatgatttccatcttttgaatactgaaaagctttgtcaaatgactcaggaattttgatcttggggtcctctgatagtatggccatgtgctcgtgaatttcttgcaatagttcagctgcttcacaattcattagcattctagaatttggagggatatcaagctctagctttagttctgcatcagacttggtaggcactgcatgtgatgaagaaccctttccacctttgtcactactgtatgcttttcctttgcttgcctcacctttagaaagggctgaagcctttccaccagtttttaggctcgcagatgaagccttcccgtttgactttgagtgaacaggagttagctcttctacaaaaccttcagagtcagagtcagaatctgaaagcacaactactcttggcttcgcaaaagaaaccttatgccttccattcggtacttggtccattggaaaaacttgtcaagactcctaccacaaagatgtgcgtaagttctgcttatggaagcctggtgggtgctcgtcgccggcgaagagaccaatgtaaacctccgcaactggcttagggtggcggcggcccaccagtcgccggagagcgagacgcagacagaagtcacagaagtgacagaacccacgcggaggaaatcccggccggcctcgaggtacccaatgcagcggac

SEQ ID NO: 19974 - DNA, 1157 bp, Zea mays
  misc_feature (26)..(26): n is a, c, g, or t
cgcatgcacgcgtacgttttcttggnaccttttatacggccgcccttttttttttttttttctcattttaaactctaccatataaacaatatagtcgatagtgtaaaaaggtactttgcacagccattatgcacgccttaccatgggtagagttcccacaatacagcaagtaactgctctgacttaacagttaacacccatttgtccaggccacagcaactgcgatagctcaagaagcacaaggagagagtcgctggcaaagaatgaaacgatgaaaattacatgcgcgagaacgccactatcttgcggtgacaagtgctcaggagccacagcaagctgaattctgcgccgccgccgctgcctcagcttccccttcagccttgatcttgatagttcgatcctcaggcttggaatcggtctccgaaagtctctgtttgatgtcccttgctatggaaaagaaaacctgctcgacattcaggtttgtttttgcactcgtttcaaaaaactttatcccgtattcgtcagcgagagcttgccccttcgaagtgggcacagcccgtttgctttcatccatatcagctttattccccaccagaattttgttcacgttatccgaagcatgttgctcaatgtttctgatccaatttcttatgttattgaaagatgactcgtctgtgacatcgtacacaagcaagatgcccattgctcccctgtagtaagcagtagtaatcgtgcggaaacgttcttggcctgcagtgtcccagatctgcaacttaatccgtttgccatccaactcgacagtccttatcttgaagtcaatgccaatagtggtaatgaagctagtggtgaatgatccatctgaaaaccgtaacaggagacaactttttccaacaccgctgtcaccgatgaggagcagtttgatgaggtagtcgtagtcggctcgggccctcgccggtggcgctgccatcacgctttacctcacaatcccaagcggggtggcctcggcgcggtgtgggggtaacctcttggcgtcgtgtctcctcacggtcacagagccacggaggcaggcagaggcaggcggtggagccggatgctaaagcgtcgcggtaacggcgaggggcggagcaccaggttgcctggccctggctcccccgcgt

SEQ ID NO: 19975 - DNA, 1281 bp, Zea mays
  misc_feature (71)..(71): n is a, c, g, or t
  misc_feature (146)..(146): n is a, c, g, or t
  misc_feature (190)..(190): n is a, c, g, or t
ccacagaaacaaaatctctctgttcgacacatgttatgaggtacagcttattttcttaatccatacagcanatctgtgaagcaaagattatccagtgctgcaagcaaatgttaccgcttgtacgcattgaaaattccccgcaatcncaacgtcatctctatagcagtagcagcctcctcgagatcaaacnagcccacctctcattttaaactctaccatctaaacactgtggtcgcgcgcgatagtgtaaaaaggtactttgcacagccattatgcacgccttaccatgggtagagttcccacaatacagcaagtaactgctctgacttaacagttaacacccatttgtccaggccacagcaactgcgatagctcaagaagcacaaggagagagtcgctggcaaagaatgaaacgatgaaaattacatgcgcgagaacgccactatcttgcggtgacaagtgctcaggagccacagcaagctgaattctgcgccgccgccgctgcctcagcttccccttcagccttgatcttgatagttcgatcctcaggcttggaatcggtctccgaaagtctctgtttgatgtcccttgctatggaaaagaaaacctgctcgacattcaggtttgtctttgcactcgtttcaaaaaactttatcccgtattcgtcagcgagagcttgccccttcgaagtgggcacagcccgtttgctttcatccatatcagctttattccccaccagaattttgttcacgttatccgaagcatgttgctcaatgtttctgatccaatttcttatgttattgaaagatgactcgtctgtgacatcgtacacaagcaagatgcccattgctcccctgtagtaagcagtagtaatcgtgcggaaacgttcttggcctgcagtgtcccagatctgcaacttaatccgtttgccatccaactcgacagtccttatcttgaagtcaatgccaatagtggtaataaagctagtggtgaatgatccatctgagaaccgtaacaggagacaactttttccaactccgctgtcaccgatgaggagcagtttgatgaggtagtcgtagtcggctcgggccctcgccggtggcgctgccatcacgctttacctcacaatcccaagcggggtggcctctcggcgacgtgtctcgtcacggtcacagagccagggaggcaggcggtggagccagaggccgaagcgtcgcggtaacggcgaggggcggagcaccaggttgcctggccccggctcgatcggaggagcccggcagg

SEQ ID NO: 19976 - DNA, 1188 bp, Zea mays
cttgtttttttttttatgttttttttattttttctttccctactgttctctcttttctttttttttttttttttttttttttttttttttttatcaagaacagggtttccacaatatagcaagtaattagttctgacgtaacacccacttgtccaaaccacaacaattgtgatagctcaagcacaaggagagacttgctggcaaagaataaaaattatgaaactatcctgcagccacaaccgttcaagagccgcagcaagctgatttctgcgcctctgctgcatcagcttccccttcagccttgatcttgatagttcgatcctcaggcttagaatcagtctctgaaagtctctgtttgatatcccttgctatagaaaagaaaacctgctcgacgttcaggtttgtctttgcgctcgtttcaaagaactttatcccatattcgtctgcgagagcttgtccctttgaagtgggcacagcccgtttgctttcatccatatcagctttattccccaccagaattttgttcacattatccgaagcatgttgttcaatgtttctgatccaatttcttatgttattgaaagatgactcgtctgtgacatcatacacaagtaagatgcccattgctcccctgtagtaggcagtggtaattgtgcggaaacgttcttggcctgcagtatcccagatctgcaacttaatccttttgccatccaactcaacagttcttatcttgaagtcaatgccaatagtggtaatgaagctagtggtgaatgatccatctgaaaaccgtaacaggaggcaactttttccaacgccgctgtctccgatgaggagcagtttgattaggtagtcgtagtcggctcgagccctcgccggcggcgctgccatcacgctttacctcacaatcccaagcggggcggacacgatgcggggggcgggtgatctctcggcgtcgtgtcgcctcacggtcacagggccgcgcaggcaggcagacgctgtggaaccggaggccgaggcgccgctgtaacggcgaggggcggagcaccaggttgctcggccctgggccctggctcgatcggcggaaggggatggacgcgctcccgtggggtgctttgaattggtctgcttcggcctttggaccttttggggggaaattacaggtgtgcaccgggcgtactattgggtcgt

SEQ ID NO: 19977 - DNA, 1383 bp, Zea mays
ttttttttttttttttttttttaacagaaacaaaatctctaccatataacagaaacaaaatctctctggttcgacacatgttatgaggtacagcttattttcctaatccatacagcaaatctgtgaagcaaagattatccagtgctgcaagcaaatgttaccgcttgtacgcattgaaaattcccgcaatcccaacgtcatctctatagcagtagcagcctcctcgagatcaaacagcccacctctcattttaaactctaccatataaacagtgtagtcgatcgatagtgtaaaaaggtactttgcacagccattatgcacgccttaccatgggtagagttcccacaatacagcaattaactgctctgacttaacagttaacacccatttgtccaggccacagcaactgcgatagctcaagaagcacaaggagagagtcgctggcaaagaatgaaacgatgaaaattacatgcgcgagaacgccactatcttgcggtgacaagtgctcaggagccacagcaagctgaattctgcgccgccgccgctgcctcagcttccccttcagccttgatcttgatagttcgatcctcaggcttggaatcggtctccgaaagtctctgtttgatgtcccttgctatggaaaagaaaacctgctcgacattcaggtttgtctttgcactcgtttcaaaaaactttatcccgtattcgtcagcgagagcttgccccttcgaagtgggcacagcccgtttgctttcatccatatcagctttattccccaccagaattttgttcacgttatccgaagcatgttgctcaatgtttctgatccaatttcttatgttattgaaagatgactcgtctgtgacatcgtacacaagcaagatgcccattgctcccctgtagtaagcagtagtaatcgtgcggaaacgttcttggcctgcagtgtcccagatctgcaacttaatccgtttgccatccaactcgacagtccttatcttgaagtcaatgccaatagtggtaatgaagctagtggtgaatgatccatctgaaaaccgtaacaggagacaactttttccaacaccgctgtcaccgatgaggagcagtttgatgaggtagtcgtagtcggctcgggccctcgccggtggcgctgccatcacgctttacctcacaatcccaagcggggtggcctcggcgcggtgtgggggtgacctctcggcgtcgtgtctcgtcacggagccacggaggcaggcggtggagccagaggccgaagcgtcgcggtaacggcgaggggcggagcaccaggttgcctggccctggctcgatcggaggaggaaggggggtggacgcgctccggtagggtggtggatttgtctgcttggcctt

SEQ ID NO: 19978 - DNA, 1241 bp, Zea mays
acgagccttacgacatcagcaacaaaccaaacaaaaggacacttcgtgagagaacacgtcggtggctcggtgtcagcagcgagccagcgacggagccccaccagacaccgcagtaccgcaccgcactgcccatggacgcacgcctcccggcgcccccgccccgcccgcgtgcgcgtgcccctgtccgcctcccgtttgccgcctccaccgcaacgcggcgcgcggggtggtggtgccctcgcgatcctcgtgtcgatcccagcggcaggggtgcctgtgcctttgcttctcctggccgttgcccgcgcctcgcggtcgcgcacctgaaccggagccccgcgtcaaatctagggttgcatccgcgccgccccctcctcccgagactcccagcggctggaaccagaacgagggtgacaggcgacgaaagctgcgagggacgccccctcgtcgaatgcactggcgaccgttccgtcgaggagcagccggagcacgcaggagttgagggaaaagcttggaaaatgtcatccaccgtgccgaagtcatcaaatatcttctggcatgattgtccagttggcaagactgatcgccagaagctactcaagcagaaaggctgtgttgtctggattacaggccttagtggttcaggtaaaagtaccttggcatgtacattaggccgtgagctccacacaagagggaagcttgcatatgtccttgacggtgataacttaagacatggtctgaacaaggatcttggcttcaaagctgaagaccgtgctgaaaatataaggagagttgtagcaaagttatttgcagatgcgggccttgtatgtattgcaagtttgatatctccacataggagagaccgtgaatcttgccgtgcattgttgtctgatagtagcttcattgaagttttcttgaacatgtccttggaattatgtgaagcaagagatccaaagggcctctataagcttgctcgtgcaggaaaaataaagggttttacaggaatagatgacccttatgaagcaccactgaattgtgagattgagatcaaagaggtagatggtgtatgccctccgcctgctgagatggcagggcaagttgttacttaccttgaggagaaaggcttcctgcacgagtaggctgaatccaagcaacatctggggaagatttcagtaagactagcgcagaataagtcaaaggcgctggcagttacggtatagcagttgcatagattggcctca

SEQ ID NO: 19979 - DNA, 827 bp, Zea mays
  misc_feature (805)..(805): n is a, c, g, or t
  misc_feature (810)..(810): n is a, c, g, or t
  misc_feature (815)..(815): n is a, c, g, or t
atggacgcacgcctcccggggctctcgtgtccctgtccgtctcccgtttgcggcctccacagcaacgcggcgcgcggggtggcggtgctctcgcgatcctcgtgtcgattccagcggcgggggtgccattccctcccctggccgttgcccgcgcctcgcggtcgcgcaccggaaccggagccccgccgcgaatcgagggttgcctccgcctcgccccctcctcccgagactcctagcggcaggaattaggacgagggtaacaggcgacagaggctgcgaaggacgccccttcgtcaaatgcgccggcgaccgatccgtggaggagcagccggagcacgcaggagttgaagggcaagctttgaaaatgtcatccactgtgccgaagtcatcaaatatcttctggcatgattgcctagttggcaagactgatcgccagaagctactcaaccagaaaggctgtgttgtctggatcacaggccttagtggctcaggtaaaagtaccttggcatgtacattaggccgggagctccacacaagagggaagcttgcatatgttcttgacggtgataacttaagacatggtctgaacaaggatcttggctttaaagctgaagaccgtgctgaaaatataaggagagttggtgaagtagcaaagttattttcagacgcgggccttgtatgtattgcaagtttgatatctccatataggagagaccgtgaatcttgccgtgcattgttatcggatggtagctttattgaagtttcttgaatatgtccttggaattatgtgaagcaagggacccanagggnctctnatagcttgctcg

SEQ ID NO: 19980 - DNA, 1336 bp, Zea mays
tcgtgttggtcgaatgagaatactgaggctcagtttgaatatagagactaaattttagtctttatccgatattaattaaaagcattagatatagtatagttataaaactaattatatatattaggactaaaccacaagacaaatctattaaattgaattagtttataattcacttatgtgatgttgagttcgatagattcttttcgtcgttcagtatccgtctctataattaattttataattaaattatatcaacatagatgaagaatcagatcatccatataatattttgaggaagaatactgaagcttttagtttggccctactcaaatatgacgacgggatcctgtacactttcttagcaggtaactgcagacggtcactgacgtgtgggcattatctaggcttggtccctaatgtcagtgacggagcaggttccaaatatgaagcttcagtagtgtatcgtgagaacacgtcgaacactttctcagcaggtaacgaagccgcaccaggccccgcactgcccatggacgcacgcctccctgggctctcgtgtccctgtccgtctcccgtttgccgcctccaccgcaacgcggtgcgtggggtggcggtgctctcgcgatcctcgtgtcgaatccagcggcggtggtgccattccctcccctggccgttgcccgcgcctcgcggtcgcgcaccggaaccggagccccgccgcgaatctagggttgcctccgcctcgccccctcctcccgagactcctagcggcaggaattaggacgagggtaacaggcgacagaggctgcgaaggacgccccttgtcgaatgcgccggcgaccgatccgtggaggagcagccggagcacgcaggaggttagtctaggcacgtatcgcctctcaatccctcttcaccctagacggttcgatccaatgtacttgctaattgctgatcgggttacgcggatgcgtgtagattgagcggaattccagatgtagtcccatttgtacggagtagcagacctcgtaatcatatctccttgtcttccgcgattttctgcactttatcgtctttagggggtgtttggtttgcccctgctggtttctacctttacctcgagcgcggcggcggggggcatttttatgcggtctcgaggaggaccaaggaggtgccctatagcttccacggggccaaatgtgcgagagtgacacggtgatgggtggcggggagcaggttttgtccgggtgcctgactcatcaaggatctagagaaagggaagcaggattggagagattgtttggataattcgagtgcgacgtgagtgaggaactgaggatagccg

SEQ ID NO: 19981 - DNA, 1458 bp, Zea mays
acgagccttacgacatcagcaacaaaccaaacaaaaggacacttcgtgagagaacacgtcggtggctcggtgtcagcagcgagccagcgacggagccccaccagacaccgcagtaccgcaccgcactgcccaccggcatggacgcacgcctcccggcgcgcccaccccgcccgcgtgcgcgtgcccctgtccgcctcccgtttgccgcctccaccgcaacgcggcgcgcggggtggtggtgccctcgcggtcctcgtgtcgatcccagcggcaggggtgcctgtgcctttgcttctcctggccgttgcccgcgcctcgcggtcgcgcacctgaaccggagccccgcgtcaaatctagggttgcatccgcgccgccccctcctcccgagactcccagcggctggaaccagaacgagggtgacaggcgacgaaagctgcgacggacgccccctcgtcgaatgcactggcgaccgttccgtcgaggagcagccggagcacgcaggaggttagtttagttgagggaaaagctttgaaaatgtcatccaccgtgccgaagtcatcaaatatcttctggcatgattgtccagttggcaagactgatcgccagaagctactcaagcagaaaggctgtgttgtctggattacaggccttagtggttcaggtaaaagtaccttggcatgtacattaggccgtgagctccacacaagagggaagcttgcatatgtccttgacggtgataacttaaggcatggtctgaacaaggatcttggcttcaaagctgaagaccgtgctgaaaatataaggagagttggtgaagtagcaaagttatttgcagatgcgggccttgtatgtattgcaagtttgatatctccatataggagagaccgtgaatcttgccgtgcattgttgtctgatagtagcttcattgaagttttcttgaacatgtccttggaattatgtgaagcaagagatccaaagggcctctataagcttgctcgtgcaggaaaaataaagggttttacaggaatagatgacccttatgaagcaccactgaattgtgagattgagatcaaagaggtagatggtgtatgccctccgcctgctgagatggcagggcaagttgttacttaccttgaggagaaaggcttcctgcacgagtaggctgaatccaagcaacatctggggaagatttcagtaagactagcgcagaataagtcaaaggcgctggcagttacggtatagcagttgcatagattggcctcaatgccttagtattttctttccgtacttcctctgccacaggctccatgcaatttcattcagatgagcctggatggttcctaatttctttgacctctagagtagattacttgtaatgcaactctgataaccacttggggcagtatcgatgtggcaatcgcaatcctcacggccaaaaaaaaaaaggcccctagggcc

SEQ ID NO: 19982 - DNA, 1380 bp, Zea mays
agtaaccactccgtggcctcccgggaaaggggcttaactcgagtcgctaatccttttccttgtatctccccgtctccatcctcgctcgccgccatggaaggttcgaaggggagtggaggtggtggggccggtgccgggtccgaaaagccaagcgccgagtcgaaccctagtctgaatctgccgccacctaccgcagcggatgtcgaagccacggatgacggtggcgccacggccgcggccgcggcagctgccgaggcggccaggcggccgttcactgccctcagccaggaggaggctgacctcgccctagcccgcgtcctgcaggagcaggagcgggcgtacatgttgctccggatgaacgggagcggtggcgagggcagcgactacgggagctctgatgcagggagctacgagtacgacgaagagggagatgactacgaagaggaactggagcaccacctccgcgtccaccaccacgaacacccctcgggcgatggtgatggaggcgcggggggcgagggcgccgaggggagcgattacgacgaagagtacgaggaggacgaagaaggggggccggaagtagatcccgcggagtttgagaacgatgaggcttatgcgcgtgcgctgcaggatgctgaggagcttgaggtcgccgcgcggcttatggctctcgctggtctcagcgattggcgaactgtggatgtggagcatgaggaggatcatgtgaatgacccacaggaggcatggcaagaggttgatccagacgagtactcctatgaggagctagttgcattgggtgaagtagttggcacagaaaacagaggtctctctgctgatgcacttgcttctttaccttcagtaacatacaagatgcaaagtgttcaggatggcaacacagagcaatgtgtaatttgccgtgtggaattggaggagggtgaatctttgattgcacttccctgcaagcacttataccatcctgaatgcataaaccagtggctgcaaataaataaggtatgccctatgtgcagtgcagaagtatcaacctccagcaacaaggagccatgattgctctcggatggccatcttgggcatttgatgggattaactagcggcaccactgcagcatctttatgcttcaagcaaaagcataaaggaacgtcttacatacatgcaaggagatcaggaaataatcctcttgtcagtctaaagttttgtcctggttttctgctcactggatttattggccctgcagcttatatggtcttagttcccttcggacgccttatgatccataaaacatgccaattatattatattgttagttattctttttactgatcgcatgatcgtcgtatatatttgctggttgcccggtaccca

SEQ ID NO: 19983 - DNA, 1804 bp, Zea mays
gtatcgatatattattgatatctgttctgaatataaaaataaccgaatccatatgaaaaaacggatgtttgcacttttcccgttttcacctacgtgggtccaaggacatactccccagtccccacaggtcggtgacctgacctttgaggcgggccgagtaggtgaacacccacccgttccgtggtgacgtcgtacggcatcctcattccaggtcgcatagccatcaacaaggtctgactgtaccacgaggaacacacccttatcttactgacgagtggcaccagtagtgctcgggcccaaagtgacagactaacacctaaccgagtcagttccgaggccctgcgtcattagtttaaccagagctccggtttaaaccgaaaccacactgctaatcggccatcagtttacacaaaacgcaagatcgattatccggtcgcctcccgggccgggggcctttaactcgagtcgctaatccgtttccttgtatcgccccgtctccgacctcgctcgccgccatggatggttcgaaggggagcgtaggtggcggggacgggaccgggcccgaaaagccaagcgccgattcgaaccctagccttgacccgccccaacctaccgcggcggctgtcgaagccacagatgacggtgcggccgcggctgcggccgaggcggccaggcggcccttcacggccctcagccaagaggaagctgacctcgccctcgcccgcgtcctgcaggagcaggagcgggcgtacatgttgcttcggatgaacgggggcggtggcgagggcagcgactacgggagctctgatgaagggagctacgaatatgacgaagagggagaggaggactacgaagaggaactggagcaccgcctccgcgtccaccaccacgagcacccctcgggcgatggtgagggagagggcgggggcgagggcgagggcgccgaggggagcgactacgacgaagagttcgaggaggacgaagaaggggagccggaggtagatcccgcggagtttgaggacgatgaggcttatgcgcgtgcgctgcaggatgctgaggagcgtgaggtcgccgcacggcttatggctctcgctggtctcagcgattggcgaacagtggaggtggagcatgaggaggatcatgcgaatgatccacaggaggcatggcaagaggtcgatccagatgaatactcttatgaggagctagtcgcattgggtgaagtagttggcacagaaaacagaggtctctctgctgatacacttggttctttaccttcagtaacatacaagctgcaacatgttcaggatggcaacacagagcaatgcgtaatttgccgtgtggaattggaggagggtgaatctttgattgcactcccctgcaagcacttataccatcctgaatgcataaaccagtggctgcaaataaataaggtatgccctatgtgcagcgcagaagtatcaacctcgggtaacaaggagccatgactgctcctccgatggctatcttgggaacttggtgggaataactagcggcatcactgcagcatctgtattgtcgaaacaaaagcagaaaaaacggtctacatacatgcaaggagatcaggatataatcctcttgtcagtctaaagttctgccctggttccctgctaactggattgattggccttgccgcttattatctcagttccctatgaacgccttatggctgttgtatgatccataaattatgctaattatattatattgttagtcattctttttactgatcgcatgatcatcttctaaaaaaaaaaaaaaaaaaaaa

SEQ ID NO: 19984 - DNA, 3050 bp, Zea mays
agtttagacaaagcgcaagaccaaccagtaaccactccgtggcctcccgggaaaggggcttaactcgagtcgctaatccttttccttgtatctccccgtctccatcctcgctcgccgccatggaaggttcgaaggggagtggaggtggtggggccggtgccgggtccgaaaagccaagcgccgagtcgaaccctagtctgaatctgccgccacctaccgcagcggatgtcgaagccacggatgacggtggcgccacggccgcggccgcggcagctgccgaggcggccaggcggccgttcactgccctcagccaggaggaggctgacctcgccctagcccgcgtcctgcaggagcaggagcgggcgtacatgttgctccggatgaacgggagcggtggcgagggcagcgactacgggagctctgatgcagggagctacgagtacgacgaagagggagatgactacgaagaggaactggagcaccacctccgcgtccaccaccacgaacacccctcgggcgatggtgatggagagggagagggcgagggcgccgaggggagcgattacgacgaagagtacgaggaggacgaagaaggggggccggaagtagatcccgcggagtttgagaacgatgaggcttatgcgcgtgcgctgcaggatgctgaggagcttgaggtcgccgcgcggcttatggctctcgctggtctcagcgattggcgaactgtggatgtggagcatgaggaggatcatgtgaatgacccacaggaggcatggcaagaggttgatccagacgagtactcctatgaggagctagttgcattgggtgaagtagttggcacagaaaacagaggtctctctgctgatgcacttgcttctttaccttcagtaacatacaagatgcaaagtgttcaggatggcaacacagagcaatgtgtaatttgccgtgtggaattggaggagggtgaatctttgattgcactcccctgcaagcacttataccatcctgaatgcataaaccagtggctgcaaataaataaggtatgatggaccttcttaagcttcattgaatggctagaaacttcatttcattaactacttggtccttaaatactattctgattctgtgaagtatcccagactgtcacacatgcatgtacctgatgggagaatgttttcatcacaactagtctgtttatactatgtttagtaacttctagtcaaaataaaaagcttaagatttttctgtgggctgctaggcaggcatggtttgtcaactgatgttcttattctagttatgcagttgtgtttagttcatcatttttctcttaaaaaaactagttgcatataaaacatcgaatgctaatggtattgaggtccgcaataacagggcatcagtctctacattttaagtaagaagattctgttatttgcttgacatagtccctagatttgtaatcgcggtcaagatatcttaggctgttacgttctatcagactgacattgaaccttatagttgtaatggtgcctacgattttctgtcatggtctagtgatgttttggttagcttatgttctgtcatgttgacatgcggaatcatgtaattttcttgtcgcggtaataaaatttgggcacaccatgtggtgggagaaaaggaagattgaaagagcaaatcaataaaccttggaagcaggtatgctgtattcaccaatggacacttggggatatattatctaggttttgcatgatctttatacataaaatacctctaatttttgtacatccacattaatcttgggtagatttggaagttagttaactatatccgtactctctttgaatataagagtcgttcagcaaccttttgttcttaaatcagtccagtatattaaagctttaatgtctattagcgttgtagtattagtagcatcattattgcatgcgactgttttctctttatttaatcagtattgtgatactcttaagttgaccaagaaaacttagtgccttcaaaagtttatcaatggaggctggcaaaaccgctgtaattgctgacacaactgtagtcaggtcaaatgaagtctgatgatggtctgcttgactcctgttatcttaggcagtgtttggttccggagacggctgggatagaatggctccatgccagagagcgtccgtccgggaaattttggggagctggatcattcagcatttgagcataattttccttttttagagccactctgtcctatatggaaccgatccaaacaacaacttactttctgccacagtgactactggctagctataggctatagttgtattcagtattcatattgtcagtccgtttcagcatttctatcatggcagattatgctatatggatccttatcttgcaaagtaataggttttatctgtattattcttagtatatatttcagcatttctgctggcggatcatgccatgtcaacccctaccttgaaaagtaacttctattatgcacactacctggcttgagttaatttcaacatgttttccgatcaacatgacgtggatacatctagacaacagctctcattgctccaaaatttgacaaaatatcccctgattcttgcaggtatgccctatgtgcagcgcagaagtatcaacctcgggtaacaaggagccatgactgctcctccgatggctatcttgggaacttggtgggaataactagcggcatcactgcagcatctgtattgtcgaaacaaaagcagaaaaaacggtctacatacatgcaaggagatcaggatataatcctcttgtcagtctaaagttctgcccttggttccctgctaactggattgattggccttgccgcttattatctcagttccctatgaacgccttatggctgttgtatgatccataaattatgctaattatattatattgttagtcattctttttactgatcgcatgatcatcttaaaaatttgcttgtcaactgattttagtttttttcttcttaattctaatccccttcgtcccgaaatatagtcatttttatccgtctt

SEQ ID NO: 19985 - DNA, 2103 bp, Zea mays
ccacccgcaacagcaaagcccaggctgcccagcacacgcgacgcgaaccagctggcgaggaaccctagcggagcactgtgcaggcgaccgcggcgcgctatcacttacggggggatacggcggcatcgtccccctcggcccctcctccatccctggtgcggcggcgccagcctgcaggtgttgaatgctgatttgttgtggctgattaatcgggttgatcgtcgattaatcgtgattagtcggctgatcgcccttctggcgatcagaaacgataaggcaatctgaaaacattggccgccaaacctccagagcgactcccgcgagccgtgaccaccatagctaaatcaacgcaccagaagctttcacggagctgtctcgtccacgagtgttccagctgactcctattccctgcgtcaatggcgagctctggcaatgaagggcgtgtggtggtggaccttggctccgcggcggagtcggtggctgctgacgaggaggcgcacgccacgcctctccacgagattgagtccctttgcatgcgctgcggcgagaacggcatcacgaggcttttgctgacgttgatcccgcacttccgggaggtggttctgatggccttcgagtgcccacattgtggtgagaggaacaacgagattcagtttgctggacaactccaacccaagggatgctgctacagcttggaggttccgttggggcagagtgagatgctgaatcgtcaggtcgtgaagtctgattcagcgactatcaagattccagagctcgactttgagatccctccagaagctcaacgtggaacactttctactgtggaagggattattatgcgagctgtggatgagctgcaggctcttcaagatgaacggaagaaagtggatcctcagaaggccgaagctatcgatcaatttttactgaagttgagatctcttgggtcaggagaggctgcattcacttttattcttgatgatcctgcaggaaacagctttattgagaatccgcatgctccgttattagatcctttactatctgtgagattctacgaaagaactcgtgaacaacaagcagcacttggctttcttgctgaaccaccaaaagaacaacctggagaggctgtattgcctgcttcagcagtggaatccaattctgatgggttgcaaagcgtgccccatggctcagttggagctgttgcaggtcgtcgtgctatagctcagggaaaccctgatgaagttgctgcagcattgtgtagatattcagcaccagaagaggttgatactttaccatcaacatgtggagcctgtggaacagaatgcgtcacacgtttctttgctacaaaaatcccatatttccgggaggtgattgttatggcaacaacatgtgacatgtgtggttatcgcaattcagagctgaagcctgggggtgaaattccagctaagggaaagaaaattacactgcgtgttcaaaatgcacaagaccttactcgtgatgtcataaagtcagattcagctagcgtaaaagtacctgaacttgagttggaactttcatgtggaacgttgggtggtatggtcacaactgttgaaggtttaattgtgaaaatatgtgaggctctggagagaatacatggatttcaattaggcgatagtacactggaatggaaaaagaagaaatgggatgacttcaaggagagactatccaagcttctgagtttacaagaagcctggactctaataattgatgatggattggcggcttcatttgtggccccggctactgattcgttagaagatgacagccaactaaccattgaagagtatcagaggagttgggagcagaacgaggaacttggtctgaatgacatggatacgtcctctgcagacgcggcttacaacacgaccaacacataatttttttagttttgttgtgccgaatgtatttgttacgctatcagtttactttgatgaactttcagtgtgtatactaatatcaacaacttatatttcctctgacgataaacatcgagcgaacgtgcgaggcgcaaacccgatttgctgtcacccgtgcaggtccatgaattgccaacgttggttcggaggc

SEQ ID NO: 19986 - DNA, 2646 bp, Zea mays
aggcaacagcaccagcgctcgaacgccgcgtccaggcaacccatccttccgaccccgagcggtcggtacctcgcaagcaaaactacaagctcgcttttaaattctgttgctgcaattatctcctctgtttcccactcgtagatcccgccgcctcccgcgtctagccgtcgacgagcaccgcagcctgacacagccgcgggcgaaccatcgcgtgcggcctcgcccgggatggcgaccatggagagcctgatcgggctggtgaaccgtatccagcgcgcgtgcaccgtcctcggcgaccacggcggcggcggcggcggcgagggctccctctgggaggcactcccctccgtcgctgtcgttggtgggcagagttccgggaagtcgtcggtgctcgagagcatagtggggagggacttcctgccccgtggatctggcattgtcacgaggcggcctttagtgctgcagctccacaagacagatggtgggcacgagtatgctgagttcctccacgccccgcggaagcgtttcaccgactttgctgctgtgaggaaagagattgctgatgaaacagatcgcataactgggaaaactaaagctatttcaaacgttcccatccatttgagtatatattcaccacatgttgttaacttgacacttatcgatcttcctggactgacaaaggtcgctgtagaggggcaaccagaatctattgttcaagatattgaaaacatggttcgagcttatgttgacaagccaaattgcatcatcttggctatctccccagctaaccaagatattgcaacgtcagatgctatcaagcttgctagggatgttgatccttcaggtgacaggacttttggagtcttaacaaagcttgatttaatggacaagggtaccaatgctgttgatgtgcttgaagggaggcaatatcgcttacaacacccctgggttggaattgtcaatcgctcacaagctgatatcaacaagaatgtcgatatgctctcagcaagacgcaaagaaaaagagtactttgagagtagtcctgaatatggtcacttggcacataaaatgggtgcagagtatcttgccaagcttctgtcacagcatttagaggctgtgatcagggcaaaaattccaagtattatagctatgattaacaaaacaattgatgaaatagaagcccagttggatcgacttggtaggccaattggaggtgacgctggggctcagttgtacacaatcttggatatgtgtcgggcatttgaccgtgtctttaaagagcacttagatggcgggcggccaggtggagatcggatttatggtgtctttgacaaccagttacctgcagcactgaaaaagcttccatttgaccggcatctttcaatgcaaaatgttcgcaaagttatttcagaggctgatggttaccagccccacttgattgcccctgagcaaggatacagaaggcttatagatagttctctaagctactttaagggtccagctgaagcatctgttgatgcggtccatttggtcttgaaggagcttgttcggagatctattgcagcaacagaggaattgaagcgattcccaacacttcaatcagatatagctgctgctgcaaatgatagcttggaaagattccgtgaggatggacgaaagactgttcttcgtctagttgagatggaagccagctacctaacagtagagtttttccgtaaacttcctactgaaccagagaaagcagctgataagaacactccagtgagtgataggtatcaggacaatcatctcagaagaatcggatcgaatgtgtcatcttatattaacatggtctgtgagactctgaggaacacggttccgaaagccatcgtgcattgccaagtgaaagaagcaaaaagaaatttgcttaaccgtttctatgctcatgtgggaagcaaggagaagaaacagctgagcgcgatgttggatgaggaccccgctttgatggagaagagggatgccttggtcaagaggctagagctgtacaaatctgcaaggaatgagatcgactcggtcgcatggaaatgattggcttgtgacagctacatctggaatgtatgtaaaatgtacaaccgcagcagcacacgtgtgattgcagtagaatgttcaattcttttttacatttgaatttactctggaggccttgtacgcagttttcactcgagtctttgccggacatgcttatttggccgtcttggccttaacacgattgtgttatgcgtggatgatctggtctccggttgatataagagtgtatatgtattcttttgttgattttattactgccttgatgatatcaatagtttttaccacagtgagccatgtttttttgaactttggtagtgtttggttactagggactaatttttagtccctccattttattctattttagtctataaattgcaaaatatggaaactataactttattttagtttccatatttgacaatttagtgactaaagtggaataaattagagggactaaaaattagtctctaaaaccaaacaccccctttattgggtgggatgagtcccgtgttcttaggtgcttgcttgattgcactgtcaagcactcaagcttaagctgaaccaatctgtcagggg

SEQ ID NO: 19987 - DNA, 2489 bp, Zea mays
atcggcgctcggaccccgaccgtcggctggtcggcacgcgcactctcgcaagcaaaactacaagctcgcttttttaaaatctgtccctgcaattctctcctctgttcccactcattaagataccaccgcctcccgccgcccgccgcccgccgccgacgagcaccgcagcctgacacagagccgcgggcgagccatcgcgtgcggcctcgcccgggatggcgaccatggagagcctgatcgggctggtgaaccggatccagcgcgcgtgcaccgtcctcggcgaccacggcggcggcggcggtgagggctccctctgggaggcgctcccctccgtcgctgtcgttggcgggcagagttccgggaagtcgtcggtgcttgagagcatagtagggagggacttcctgccccgtggatctggtatcgtcacgaggcggcctttagtgctgcagctccacaagacagatggtgggcacgagtatgctgagtttctccacgccccgcggaagcggttcaccgactttgctgctgtgaggaaagagattgctgatgaaacagaccgcattactgggaaaactaaagctatttcaaatgttcccatccatttgagtatatattcgccacatgttgttaacttgacacttattgatcttcctggactgacaaaggtcgctgtagaggggcaagcagaatctattgttcaagatattgaaaacatggttcgatcttatgttgacaagccaaattgcatcatcttggctatctccccagctaaccaagatatagcaacgtcagatgctatcaagcttgccagggatgttgatccttcaggtgacaggacatttggagtcttaacaaagcttgatttgatggacaagggtaccaatgctgttgatgtacttgaagggagacaatatcgcttacaacacccctgggttggaattgttaatcgctcacaagctgatatcaacaagaatgttgatatgctttcagcaagacgcaaagaaaaagagtactttgagagtagtcctgaatatggtcacttggcacataaaatgggtgcagagtatcttgccaagcttctgtcacagcatttagaggctgtgatcagggccaaaattccaagtattatagccttgattaacaaaacaattgatgaaatagaagcccagttggatcgacttggtagaccaatcggaggtgatgctggggctcagttgtacacaatcttggatatgtgtcgtgcatttgaccgtgtctttaaagagcacttggacggagggcggccaggtggagatcggatttatggtgtctttgacaaccagttacctgcagcactgaaaaagcttccatttgaccggcatctttcaatgcaaaatgttcgtaaagttatttcagaggctgatggttaccagccccacttgattgcccctgagcaaggatacagaaggcttatagatagttctttaagctactttaagggtccagctgaagcgtctgttgatgcggtccatttggtcttaaaagagcttgttcggagatcgattgcagcaacagaggaattgaagcgatttccaacacttcaatcggatatagcagctgctgcaaacgaaagcctggaaagattccgcgaggatggacggaagactgttcttcgtctagtagagatggaagccagctacctaacagtagaatttttccgcaagcttcctactgaaccagagaaagcggctgataagaacactccagtgagtgatagatatcaggacaatcatctcagaagaataggatcgaatgtgtcatcttatattaacatggtctgtgagactctgaggaacacaattccgaaagccgtcgtacattgtcaagtgaaagaggcaaaaagaaatttgcttaaccgtttctatgctcatgtgggaagcaaggagaagaaacagctgagtgcgatgttggacgaggaccccgctttgatggagaagagggatgccctggtcaagaggctagagctgtacaaatctgcaaggaatgagatcgactctgtcgcatggaaatgattggcttgtgacagccactggtggatcgtagaatgtacaaccgcagcagcacacgtatggattgcagtagaatgatcaattctttttttacatttgaatttaccctggaggccttgcacgtgattttcgcgagtcttttgccgaacacatgcttatttggccgtcttggcccattcacgcgattgtgttatgggaggatgttctggtctccagttgatataagagtatatatgtattcttttgttgattttactgccttgatggcctccatacttctattgggtggggtgccaggctggacaatctgtcagatgctacaaaatgaaattgtgggataggatgaccaactgtccatgatatggatgaatattaatgcgtcagtatcttctgaatctcctccatgcctgctttgcatgagaaataccagggtgagccaga

SEQ ID NO: 19988 - DNA, 935 bp, Zea mays
ttttttttttttttttattttttttttttttttttttttttttttttttttttttttttttttttttagcaaaattatgcacagctcaaaattcaaagcccattagtagcagacacaacagtgatatcacaagggtttagtttctgtacggatcaacatcaggtttctaaagtaaactaaattacacaagcatgcgtgagttcctgaaacgatcagaaaaggcaacttaaagtcaccaaacctcagagctcgctatgctgcgtagaagtccttgaaacaccagcgaagaggtctttggcaatgacaagcaaaccctttaagtccttagctcccacttccaggcaatccttcagcaattccccttcctccacctcccacttaatatccatgaacacctctctcaatggcccctcttcggagaaggcgaggagaagcccgttcaggagctgcgcggcggcgtcgcggatgtcgccgtagtgtaggcgcatccactgcgcagcgtcagtggcggaacgtaggcgcgaggcctccgcggcagcggcgatgagacgagaagcggcggctgcgcaggagaggccgcatccggtggctgaggagaaggcgtagtggcggaggtagtcccagccgagtccccacgcaccacgggacgacagcagggaagcgattcgccgtacgcgtgcggccgccgcggcgtccccacgagcagcacgtgtgatggcgacgcgggagaggagcgaatgggagagggagacgagggttgctgcctggcggagcgggacgcggagcgccgaagtgcgtggggttagagtagagaaaagtaggacgaggacgaagagagggagatggggccgcggtgctcgccggcggcggatggctccggctacggtcattggaggaggccggtggagatcgaatgatttactggccggcctcga

SEQ ID NO: 19989 - DNA, 7149 bp, Zea mays
  misc_feature (1813)..(1813): n is a, c, g, or t
  misc_feature (1924)..(1924): n is a, c, g, or t
  misc_feature (4803)..(4803): n is a, c, g, or t
  misc_feature (4924)..(4924): n is a, c, g, or t
tcaaatatatatattgttagacttagataatcttgacatgagattaaaagctaaagtacctaccctttagaacggaggaagtactatatatattactagcacatgtatgttataagacttttgctcctttacactagctaggtaggaaagtgccttctgtttcattgtgtgcacattgtctagctcacgctagcttttcacctcgcacttggaccagggaagtcaaagtatatgtattaactttagaccaggttatatgaaccatagaagagaatatctctctctttagcctagctaggatcatatttcacgaaggttgcgtcattgctcattatactaggtaatgatgacgtcacacgagtaaattaatatagtctctctctattactttacgaacaaacgaataacaccatatacatcgacactgatacagttgttttgacaacataatacatctgggaactcagtataattaataaggtccatctagctagtatgcaataacctaccacccgacacgcaggtcccatgtgtcagtctgatgtttccttcttctctgttgtggtgctacgtgcgcgtggtgtggagctgcactctgctatgcatatgatctagtgtcatagaacgagaacacgctggggctggggctggggtccgccagctccatgatcatcctgccaacgtcgtcccagctggacccatccttgtagtaaatgtcgtctagcacgccgccgtgatggaacgcgcccaacgtcgtcggcgacggcggcagcggcgccgtagccgccgcaagcagcgcgtggctgttccactggccctgctgcaattgctggccgtacccgtacccgtagccgtcgatcgtattattcaccggatcgtattagtgtactcgtccccggtgtccgattcgacgccgccggtgacggagctcgactcgccgggctgcgcgacggtggccgcgccggcgccggcggacacctcgctgccgcctgcagccatctgctgctgctgctgctgctgctgggggtgtttcttgtaggtgaagttcctcctgaagacccggcagacggtccacacctctgcctctcgctcgctggcgggcgtggcgtgggcggtgtcgtcagcgcgcggcgggaggcggaactcgtgcatcatccactccgtcttggtgcccttgccggcgctgccgcggtagaacacgagcgacttcttgagcccgacgacgacgacggggccgccgccggcgcggccggatgagtggacgggccggtcgatgccggtggccttccagaagccggagccggtgcctgtcaccctgttgggcctgatgctgttcctgtacttcctcccccgcaggcagaagaagtaccactccttctcccccgagatcgagctcgactctgcgtgtatatgatatgcatgtgcatcaattacccatcgtcatcactagctcatcatatatattgctccaaagttagtaatacttatatctccaagcagcaattttcattgtttcattcagttcgtgcatgacatatatatatagatacaaagcatggactaattgtagttgcgagtgttgtaaaaaaaagaatttatcatgcatgaaattatagcagtagatgaatatcatgatcagttcatcacatgcataactaattaagctagctagctagatatgtacttacttggaaggtcccacgggtcgtgcttgtagatgtcgaagtccctgatgatctcgatgctgaggcgcttcccggccaccttccggcggaggtagaaggtgaccagctcctcgtcggtggggtggaancggaacccaggaagcacgtcttcctcctcctcctcctcctcgtctcccacaacaagcaccacttcctctccttcttcatggtcaccgccggccatcatgatctcttgtgcngccacgcagcgttcttgcacgaccagagatgtagtagggctatagctagtcggcggccggcatgctatgcaagaatcagtagtgttttaattggttcggtttagatcctttatattcttgcaaaatgaaagtagctagggctctcactctctctgtgtgtatatatagcatgtgatgcggcctgttgctcttgtgtactgaacttgttcaagaacatggatcattataattagtgaacaacaagggtggccgcatcgagccacgacgacgaccaaggagaaggaagttcgcatcccctggtcaaagctatgtggtctaacttgatttctggcaaccataccaaccatcctatctttattggagatgacaatatgtatctaaaattcgaatacccgatagattttacccaatataaaggtaagtatagaataatttctttacccacgaccacgagtatactaatgggtaagaacatttacttgtcgggtagacgggtatacataccacgggtgacttgttccttaattcgattctctatcctagctccatgccggccgggctgtgcctccacgtccaaaagcacgccgccacaatttacctttgttttcttcagagagtgataattcgtgcttttgaatgcttattaatttgttgacctagtttatcctttgttgtacaagctagcgactaactcgccagttctctctgtgcaaaaaaaaaaagtttaacgacgatcatcgtcattatcccattcatacagattttttttctacgtacagagctgctggggaacatgctagacattttttctttgcaaaagaagtagaaagtggatttgacatccaactacggagccggttcattgtgtgaagagccgtgccatggcaatattcgcagcaccaactaccaatgcaagccggccgtcgtcgtcagagcttcagctaatttaccttcctagctagctcaccagcaacaaagtgtttgcttcggattaaaatcagttgttaatttagactgctgcaagctataatctatatagacaaaaacaatataaaagtattagaagtcgatatcaagcgaacaggagggcaaacgtggtaaatatatacctataattctcatagccgcgccagtttactcgtctgctattgttaaagggcaaagcaggcggctaaaccttgagaggaagcggctgcgactgtcaacttcggcgtgtacagctcggacaaattaaagcagtacatctttatttcgtttcagttgcatctgatgccgaagaaaactatacccctcccctctgaccacctgtcctgaataaattgattgattgtcaaggattagagccgagctgactattatagacctttttttaaaaaatgattcttttaattgataaagaagaggacgatatagaaaacaataccatgcgaggtcttttggttgcgtttttatggtctgtgtccattttttatgatggttttgatataaagttctagatttcaagatttggtgttctaattttaatgggacgatattactgtatgtaaaagctggtattgggaggaagagagagcaaaaatgagctaaagagggagctgatggaagtgcacctatgcacgaaaaggaccaacagaagggacatcaataaagatgtgaacaaagaatcaatctctcttttagttagaattggaactgaaatccttattttgttttgttgaggtgtattaaaggtttagtttgcttagtgttctttgggattgtgcatattatatatatcaaggctttaattgatcgatccttataaacattggcttttaatcaattcttatagtttgtaccttttaattcttatgaattatgcaattcttataatccctctgtcttaaaataaaccaattcttataaatatttaaagttgtattgttttaattttaattagctttatatagagaagtatcaacagctattacatcaaaaagatatgttatgtttcttaatatatttattgatattatattgataacataaatactaattgcatcttctataaatttggttgaagataatttaactttagacaactgtagaagttgatttgttttggactaagtgagttctacgacatttgaagagagaaagagagagaggaaaaaacttgttctttttcactctaaggaaatgctcactagactgataaactactgcaaggggtgagagaaagtggcgtggatcacggagtgcaaagggttaggcagtataaaattactatatatatataatatagtttggaggtagccacatactcctataatactcgtaaattaagggcttgtttggattctagcgctaaaagttagtcctatatcttgatgctaatttgaaagatcagaactagcagcactgtgcaggtaatagtcgatcattgtgttggaacctgacttcctaggcaagttgattcaacggggaagcgaaaagcgtgtttgcaaagtttagcatggaatactaaaagcttcgttaatcaccccgtgtctgggcactatacgggggtatttataggtactcgaggggccgtctgtccctgtcaaagacgtttagacccttgaatactcggtttatccctagaatattcccacgagaggaggttacagatagtcattaaggtaaatcttattacagacacggcccttatcacacttatccttgcgggggccatctctataggccgagtcacacatggacctcccccggtggcgagagcgggaggtccgtagacatcgacggggccttcgtcttgcaacacgagagcgaagggggtcgtacaggcctccagttggtcggcgccctcggcttgttctgttgttctgtggatttagctttcntccccacagtgagatgacgaagtcgtagagcgaaaggtggcgtgttcgccttcgccccaacacattgtaaacaattctcatgtatggcaagtaatagtgatactgcctccgtcccaaattngtagttatactgagaacagagaaattgacagtgaatttgtattcgaattgtctctgttgattctttagcaaacgatactatatagtaggacaaattaacggtcaaaagttacttcgttcgtttgaccctttcttttttttaccaagatacgcttaatttcaggacggagggagtaattgtatattaaaaactctagtgtctgtgtgtgtgtgttttgcagcttattccaatcgtgtccttcaaagtccttgccacggtctaaataatctgcaaaccatacgaaaacccacgtagttcatgatgctagctaagtagctatacgacaatgcaaatcaactcgatgggaaaacttgtttagaaaccctgagtttcacgtttcagtcagcggaacagacgcatatatttgcctgtgacgcggagactccacgtggtttctgctgctggacctggacgctgtcacggtcgacacacgtggctagctctgcccctgtcagctgtccacgtcagcaagctgttccggtcctgcacgtaccttcaagtcaacatgactaatctgttgtcttgagacctacagtaatttctaatgggatgtgttataatggtacacaaggtgctttcagttttgacactcaagaacattatctggaagaccggactttcggtgtgcctttttgcctcttgttcttccaatggagattcgacctgcctgcgcgtgtagttgaacctttcttctccatccttgtaatggtttagcacataacagactatttcttcttgctgaccacactattgcgggcagcgtcgctttacctttgcagtagctgcatataccatctcaaacgaaagacaaaaaaaattgcaaaatttacagtgtttatatagatagatcgtagatagaaagaatcagtgcaaattttactagctcagtttgcaggatacaacaagaatttcctgaataacaaggggaaaatgccaaagatgaccttctaaacatgagagtgagttcaggtgtacacttgcagactcaacacagttgcgcttttttatttcaggagagacagggcacacaagtctaaatggactcaaattcagtaactcatgccgaaacttgaacaagaatgtaacaatgaactaaaacgaggatctactaacacaactcaccacggcgaacaagaatggccggcgtccagcttaagccttctaagcgattcttctcacagaaggggttggacatcaagtatcgacaggaatatccaagctgttttcttcgggttctgtggttacttcccttacatcagacacttcggaagaacggggatcgtcccattcggtgtccccgaccgtagggatgtcgactccctcgtcgtccaactcaacaacgttctccgtaaccggtactgaatccggatcgcttacgcaagctttgtcaacgttatcatcctccatgtgcttcgaggcagtcgagcagagttccgagctctcttcgcagacctgtatcgtgctagtctcttgcctttgtatttgggattgtagagcatccacaagggctaggagatcctccttttctttggtggcagactcaagtcggttcatggcttcttttatgcggatgtcagcatctgctgctgagaccctagctttctcttcggctctgacaacagccgcttctagaattacagcgtttcctctagcttttcctagctccgagcgccacatctgagcttcttgaagagcggaatctctctctgtaagcaagcgatctctctcttcaacaagaagctttgctttctcctccgattcccttaacctaagcaaagatgcttcaacttgtttctcgtggtcttgtttcagccgttcaagttctaacgtaaaaaatcttctctcttcatcaattgaacgtgctgcagaagcagctgtttcagctgcttctgcagtctcctgtaatttatccgcaatttcattgatggtagaatcgcgtgcacgaatatcctgcaataattggtgtagttcgtcgtctttaactcgaagggtctccatcattattgtgagatcatctaattgacctttggtaagtttatgtgtagttgagcccaaagctgcccgtagggaaatcttcattgcggcttctacctcctttgttgcttcaattgcagtggcattggctacagccacaacagttgcaactgttcccaattttgcaggaccattctcacccaataattccg

SEQ ID NO: 19990 - DNA, 4080 bp, Zea mays
  misc_feature (3903)..(3903): n is a, c, g, or t
ccaaaactttccaacaattatgccctcgagtcaactggtagttagatattttgggtgatggccaacaaacataatgggacattcactgtgatagaaggccaagcgtaaccccaaaacacgcaacatagctctctacttcaattaggatgaagcaagattctgactcgaaactttcaaagccaactggtgattacagagttgagaaaccttcgtggacaaggtaggaaacccatgaaagagtcgagacgcggaacatggcaacaaaactcgaaaacacaacaaaatgtcaactctcactacaaaatttggcttagcctagttgggagtcggcttagcctacttttcagattcaacacacaacttctaaagcaaaatgttgaaatccaactaaacgaccttcaatcgatgtggcattttgtggagaggttaacaacaccataaaacccacttccaccaaaaatcaccttaaattgagctagtcgacaaacctggctaagctaactttgcatttcggcttagctggttcttgcagtttttttttctctcgaaaaacgcaggagagctgcgtgttgttatattaagaagagaggaattaaggtccaagaggaccagtacaataaccaccctatggtggccaacaacaagcgtaaataaaaatatccataggaaaagatacaaagaggcgaccaataaaaaactaagtcgagcttgttgcgccaagagcagcagcaagacctaggcttccgaggtgcttggcaccagccagcacccataaggatagctcgtcgacgaagcttctatgcaccttgccaatggttggcaaatctccatcgaaaataactctgtttctatgcaaccaaaggcaccatgctcccaaaataatggcactgttgactccctttctcttgcttctgtgcacctgaatggtcactagtccccaccaatcagcaaaattagtatcctctggccctggagttaagtggcccataccgaagggggagaggatgctatgccaaaactgcctggcgaagacacaaccagtcaacagatgctgaactgtttcttgctcttgttcacagaaagggcatgcttccggatggggaagacctcttttttgcagcctgtcagctgtccaacacttattctgcatggctaaccataaaaaggtcttacacttaggaggagcccaagatttccaaagtcttttccaaggttcgaaggtgatggagcccaaaaacagaaccttgtagcaggacctagaagagaaaaggcccgaagactcgaatctccacacatggtgatcctcctgaagagtgagcacgatctcacccagggtgtcccaaagcgtaagatattgctgtatccctacaagggagagggttggcttgatgtccctgacccacaacatgccctctaaggcttgatgcactgtcctggtagaggctacctttttatccacctttgagatcacttcaggtgccagctcagcgatagagcacccattcaaccatctgtccctccaaaaagggtgtttttgccattgcccacatgggtgtacatcgaactggccactagcttccttgtgactgaacagggagatccaatccactccaaggcctactcgggtcagtcttgatgagccaaagccatttagcttgcagcgctcaactcttatatatcaggtttgggataccaagtccaccaaggtccagcggtctggtgactttatcccatgccacaaggcaatgccctcctttcacatcttttctacccttccacaagaaacctcgccgaattttgtcaatagcaccaataacccacttgggaacattcatggcgatgaaaagatatacggggattgctgagagcacgaaccggaccaaggctgtcctgccggcaaggtttagaagtggagcctttcaaccgggcagccgattagctatcttgtccacccactgcaagaggtccctcctccccaacttcttatcagaaacatgcagccccgaatagttgcatggaaaagaagccagagtgcactgcataatgttgcagtccacgtcagcaagctgttccggtcctgcacgtaccttcaagtcaacatgactaatctgttgtcttgagacctacagtaatttctaatgtgatgtgttataatggtacacaaggtgctttcagttttgacactcaagaacattatctggaagaccggactttcggtgtgcctttttgcctcttgttcttccaatggagattcgacctgcctgcgcgtgtagttgaacctttcttctccatccttgtaatggtttagcacataacagactatttcttcttgctgaccacactattgcgggcagcgtcgctttacctttgcagtagctgcatataccatctcaaacgaaaggctacccggccccccctcttgtctgtgttttttttttttttttttagatagaaagaatcagtgcaaattttactagctcagtttgcaggatacaacaagaatttcctgaataacaaggggaaaatgccaaagatgaccttctaaacatgagagtgagttcaggtgtacacttgcagactcaacacagttgcgcttttttatttcaggagagacagggcacacaagtctaaatggactcaaattcagtaactcatgccgaaacttgaacaagaatgtaacaatgaactaaaacgaggatctactaacacaactcaccacggcgaacaagaatggccggtgtccagcttaagccttctaagcgattcttctcacagaaggggttggacatcaagtatcgataggaatatccaagctgtttccttcgggttctgtggtcacttcccttacatcagacacttcggaagaacggggatcgtcccactcggtgtccccgaccgtagggatgtcgactccctcgtcgtccaactcaacaacgttctccgtaaccggtaccgaatccggatcgcttacgcaagctttgtcaacgttatcatcctccatgtgcttcgaggcagtcgagcagagttccgagctctcttcgcagacctgtatcgggctagtctcttgcctgaaaaaatatgtccctcatcaagctggctctagaaggatccggtttcgagaaacttccgactggatggaaacagaagtgagtcggatagaattgtggacggcagacctttgttcccggccggcctcggcgtccccaagggctaggagatcctccttttctttggtggcagactcaagtcggttcatggcttcttttatgcggatgtcagcatctgctgctgagaccctagctttctcttcggctctgacaacagccgcttctagaattacagcgtttcctctagcttttcctagctccgagcgccacatctgagcttcttgaagagcggaatctctctctgtaagcaagcgatctctctcttcaacaagaagctttgctttctcctccgattcccttaactgaaacaaaaatacacacgagttcaaatattttcactgacatgaagcatgctcacagtggtatgaatctagtctataacactgtgacaactaataagcattagaaggtgtgcactgtaggaaattgttaccctaagcaaagatgcttcaacttgtttctcgtggtcttgtttcagccgttcaagttctaacgtaaaaaatcttctctcttcatcaattgaacgtgctgcagaagcagctgtttcagctgcttctgcagtctcctgtaatttatccgcaatttcattgatggtagaatcgcgtgcacgaatatcctgcaataattggtgtagttcgtcgtctttaactcgaagggtctcctgttaatggaaacgagcaatggctctttgttagggtaccttagaacatcatgctgtacactgtgcagtgtaaangggaagtaatgcctgcttttggagtccgcgattatatagactaccacatgattaagtgtgaaacctttggaggtgaatcatcattggtttataataaaggagtagcaacaacatgattaatggtatgtttattgcataattcacgggtcacgtgaaatcatttgccttcatttcttt

SEQ ID NO: 19991 - DNA, 2933 bp, Zea mays
ccccccctcgagttttttttttgcgtttttttttttttttttttttttttttttttaagggcatgcaatagcttcattcaacataatatgacatagttcatacaaactacatcagacatcataattcatacaagatagtaggaaacagttcatacaaacagcttcaaacaacatcactacgatctgtatcatacaaactatgtcattacattaacatagtacacagtttgtaatcgagtactacgccaaactctggcacaagagtgaatcttggtccaaaccttcagcaatcgcttcaagggcttcgcgcagttccttcacctctattgcactcaatgccttccctgggtgcagcttctccttgcggatatacatgagatgctttgaggtaacctgcatgatgctaatggccttgtcgacaatttcatccatctagatcaccttagttatgcttgtctcttgtcggtaacaactcttcagcatcgattctaatgttggtgtttgatgggcgccgcattgatcggccatctagccttttaacctcaacagtaaatgtccgacaaacacgacgatggtcagagaattgagatcccccccggaagtaggacaactgtgcaataccatctccatgccatagtattctttcacaccaggctggggttctcctctttttctttgatgtggcagtctctccagcataagaatctgaattgcaagagtacttgtatgtgggagcaaaatatatcttctcctcactccaccccttgaacagacttccaaaagcacgctggatattgagctgctggatattgagttgatttgtatggtttgaatttgtgattgactgattgatcatcggaagaacacaacggggtccagtccagcaggctcaaaaaatggccttcacattagtgctagatgttttgagtgaagtggagttttcacaagaggtgcggaattaggcgctcttgttagccagacacggtagtctttgtggtaaaaccaccctttattgtatagttcattagcagcatataactgagtggcatctttaggcatgctgtaaaagatgtagaatagtgtcaaagggtgaaacttttgcagtgctggtggtggctttgtagagaaacaagctgggatctgataatcaggttctcctacagctggctcacttgaccacggagagccaaatgtcttgtaaagattatcttgggagttcaaattcaaccccaatgaggtcaaatcaatccctaaagcaagagttgttggtccaggctctttcattcctattaaactcaacaatccaagtaagctatatggatccagcacagcctgtgttccttgaacggatttttggctctggtccttgtactgttgaggatctgaagatgcctgcaacctaagtgaattttgagtctgtggctaatggtacttctgcatgaattgctcataaacccctgaattagttgacagacttggagaatttgccggtcttagtccaatagtttccagcccagcattttgaactgaattagcactctactgatgttgacggggtggatacccgcccggccggcctcggggtacccgactagccatctacagaatcatgtgtgccgaaatttagaataagcaactattcttgagagtgcactaacctgataggacaagtaagactgctgattcagaccactcttcagaaaataccaaagttttcagacatgtatctaagtgaggaccaagaatattgctattttctggtgcaaaggttaaataaactaatatagttagaataataagcatctgcaagactacaaaggatagaggaatctggactttcttacctgatcattcttgtgataagtagtcagatccaaagtggtatgaagtgacgcttatttagaagaccaacactaacgaaagacatttttccaagaaacacaacataacggttgtcccactgaattcaagaggaaaaaacctcatccatggacatgactacatgagtggactgaagaaggaacagtgatgtgcagcgccaaacctctgggctctaggaactggggggaggaaggactgcaaccaaggatggtagaaagatgaggtggaactgtggaagggcagcatgtctagaggtcagtgcctgcctaccaggtgtgatgtcaaaaactcgatggtggccattggtggccacattctgatcaggatggtgaatatcaagatagtgaataacaagatgggtgaaacaaccggtaaactcttctgtacaccatcgaatattgagatccttcctctggcctatcaagatggtgaatatttcatatcatgttgaactaccattttttaaaccaatatacatgaagagaagctgaggtttactaagagaaactgcttccaattattaaatatataatttggatttaggattcctataaaattttcaaataccatttctcaactaacatgcaccatataaaaccaatttgttcttattgcttcaaatgacttattttcattgccgcacaacccctgccataataatgggaccaacctatcagcaaacaacatgaattattgttcgtttaaaaaacgaaaggaatggtttaataaaggaatcagtaaacttcttgttagtgatttactctcttttggaatgtcattgtcatttcaaccaagatcagagtttctcaagaaaaatagaaggagctggtaacttacaattgttggcccaaccgagtagtcaaattctgcggacagagatatgtgcatggttgaagctgaagccaggagctggtagcttataaatgcctttttgataatattgatatccttcctccggcaattgttgggccaaccgagtagtcaaattctgcggacagagatatgtgcatggttgaagcggaagccaggagctggtagcctcgtgccgaatt

SEQ ID NO: 19992 - DNA, 1452 bp, Zea mays
agtttttgtttcttttttttttcatgctgactcataacggtcaaaacatttattatcatcacggtgactgcgtcacaacaacaacaacaacaaatcaagtcacaacattggtacaacaatggccctactaaataatgccaacaaattatgaagaaaatctaaatctcagctacatttctacaactgccacctgggggtcataagttcttatagaatcattttgtatgaactcagcccatccatgacaacagctactgatcaaaccaaattaacttcaaatgcaggagaaccttatagttctcgcctaatattttggccagcagaaggaaggacaggtctcttctccactgcttcgtaatggagaacaaagttgtccttatgaacagtatcccagatgcttggatcaaaacaaatggagcattgtcacctgagcttccttcatatagcattccagaagatcctaaagaaccacttcctgactgtacttgattctgagatagggaccctccaggggttgggtaagaacttccaagcaagttcataaattgtggggatgcttgttgaagcataccaatacggttggatccttgaatgttgatagccccactaccagagttgccacttaaattcatgcgagatgcaataccaggcatagacagtcctccagagcttatacttctcccaatattgctcccacccaaaatattcccagaacttgctattcttgggcctaaatttcctaagactggagaagctgccaacccaggagcagaattgcggttacccacattagccaagtttgaggataaaccttgtattgaaccaccaatagcattcatgctactaccaaatccaggatttcccccaacattcatacctcctctgttgctaatcccagaatgcccatgaggaatctgagacaaggaagcttgaagattatttggagggaaacggccactggaaatgccaccactgggttgttgaacccctgcagacggaatgcctgccattgaattatttcgtggtgctaatgatccagagatatttgcaagattaagatttccatgaatgttgtgtgaacctgagtgatgaaaacctggaagtgatccagattgaccagaaaacgatgatgtaaatggccttcctgtggaatctctaaggttcgagggggccccactaatgtttgaattcagcggtcctgacattttgatgatgcccggaaatgaacaaaccaggagcacgtcaaatgttatccacctaatggcatgatattgttatccaatcttccgggaggtggcgcggccgaccgggaggcgatggtggcgagctggcggccgaggatgtaggcgagtgtgtcagttgctccgctagggtttcttacagttcgtgcgttgggcgctggggctggttggctaggttcggatatcccggcccggcccgcggtacccaatg

SEQ ID NO: 19993 - DNA, 3425 bp, Zea mays
  misc_feature (2815)..(2815): n is a, c, g, or t
gggccgagccagcccatcgtgcttgtgcttcgggccaaacgaggtcgggccaagaaggcccaaaaaacttttgacccgtgacatgtcagcccaaagagtagaaactgtggtccagattgtccctaaagcacgacgtgcctttgttggaccgtgcagccttgggtcggcccatattttgaaccacgtaaaatccaaatattacaaccacataaattacatagcttactaaattaaatatattaaacaatgataggatcatttgaccacataaagttcaaatattacattaatataaagtatatagcctactatattaaacaatataggcttcactactatattaaacaatataggcttcactactatattaaacaatataggcttcactggctcgtgtcggtctaagcccagcccatgtgtgtgagctgtactggggcccaacgggctggaattaaggcctagcctaggcccgacttcgagtcgtgctagcccgacctatattatcctgtgtcggaccgtgctttagactactgttttttgttgtgctcgtgctggcccaataaaacccacctcatattctcagcactaagcaaaatacatgagagagccaataaaatacatgagagagccaataatttgagagtatcgtaattgatctcatactattttgtgatttttcatcaatagtcgcttgggccgttaagagttggagcagccatcaagtgattaatagagtgtttgattcaagaaataagttggtctatcttcttgttcctctttttttaatagaataagttaattcatcaccacattattccttatagtactaatatgaggaatgaagttatcccaccaactttgaaaaatggactataatacaccatcttattttagatgcagtgatttttcaaaccaaacaaccgccaaatcaccttttccatgtgataggattgaacaagagtaaccacaattttctccttttaatagctttatcttaagagttcagacccacacgttgctaatgtgtagtgaagcgtccaatcatactgatactgaaatccttttatctgatctgctcagagttgttcgattcagctgtttaagtaagctcaattccacagccaaacagatctgtgaagccttcattgtttaacaaggaataatcataaatattctctgtagctatgcacatgttaattcagcaaaattccaatcatcaaacaggcgcatacatctcaaatcaaaagtctcattatattttcatgctgactcataacggtcaaaacatttattatcatcacggtgactgcgtcacaacaacaacaacaacaaatcaagtcacaacattggtacaacaatggccctactaaataatgccaacaaattatgaagaaaatctaaatctcagctacatttctacaactgccacctgggggtcataagttcttatagaatcattttgtatgaactcatcccatccatgacaacagctactgatcaaaccaaactaacttcaaatgcaggagaaccttatagttctcgcctaatattttggccagcagaaggaaggacaggtctcttctccactgcttcgtaatggagaacaaagttgtccttatgaacagtatcccagatgcttggatcaaaacaaatgtaggaccctcgttcatgaagtggagttttcacaagaggtgcggaattaggagctcttgttagccagacacggtagtctttgtggtaaaaccaccctttattgtatagttcattagcagcatataactgagcggcatctttaggcatgctgtaaaagatgtagaatagtgtcaaagggtgaaacttctgaaaatgaaatggttgcagcgctggtggtggctctgcagagaaacaagctgggatctgataatcaggttctcctacagctggctcgcttgaccacggagagccaaatgtcttgtaaagattatcttgggagttcaaattcaaccccaacgaggtcaaatcaatccctaaagcaagagttgttggtccaggctctttcattcttattaaactcaacagtccaagtaagctatatggatccggcacagcctgtgttccctgaacggatttttggctcaggtcctcaacagtacaaggatcagaagctgcctgcaacctaagtgaattttgagtctgtggttgatggtacttctgcatgaattgctcataaacccctgaattagttgacagacttggagaatttgccggtcttagtccaatagtttccagcccagcattttgaactgaattagcactctgctgatgttgacggggtggataactgcttcccaagctaaagccagatggtctagccataggataatgttgtgcttgcataatatttatattctcttgaaggtggtccttgtgatgaatatccataggataatctgaggaactacctttatttcctggtaaagctggaaaatcttcattctgaatgctgaattcctggttttgttgtacaatggcattgacgcttactccatgctttctcagtgatccatattgtccttgaccacctccagcagaattaggtcgtccagttaactgaggaaagtcattaatatcaaatggagcattgtcacccgagcttccttcatatagcattccagaagatcccaaagaaccacttcctgactgtacttgattctgagatagtgaccctccaggtgttgggtaagaacttccaagcaagttcataaattgtggggatgcttgttgaagcataccagtacggttggatccttgaatgttgatagccccactaccagangttgccacttaaattcatgcgagatgcaataccaggcatagacagtcctccagagcttatacttctcccaatattgctcccacccaaaatattcccagaacttgctattcttgggcctaaatttcctaagactggagaagctcctctgttgctaatcccagaatgcccatgaggaatctgagacaaggaagcttgaagattatttggagggaaacggccactggaaatgccaccactgggttgttgaacccctgctgtcgtgaatgcctgagtgatgaaaacctggaagtgatccagattgaccagaaaacgatgatgtaaatggccttcctgtggaatctctaaggttcgagggggccccactaatgtttgaattcagcggtcctgacattttgatgatgcccggaaatgaacaaaccaggagcacgtcaaatgttatccacctaatggcatgatattgttatccaatcttccgggaggtggcgcggccgaccgggaggcgatggtggcgagctggcggccgaggatgtaggcgagtgtgtcagttgctccgctagggtttcttacagttcgtgcgttgggcgctggggctggttggctaggttcggat

SEQ ID NO: 19994 - DNA, 1191 bp, Zea mays
caaatcaaaagtctcattatattttcatgctgactcataacggtcaaaacatttattatcatcacggtgactgcgtcacaacaacaacaacaacaacaacaacaacaaatcaagtcacaacattggtacaacaatggccctactaaataatgccaccaaattatgaagaaaatctaaatctcagctacatttctacaactgccacctgggggtcataagttcttatagaatcattttgtatgaactcatcccatccatgacaacagctactgatcaaaccaaactaacttcaaatgcaggagaacctagggcaagcagcaagggcaaatatgtgtgcatcagggaaggaagtcaattagtcaaacgtacacataactatacattccttttatatatgatagaagcatgctaccttatagttctcgcctaatattttggccagcagaaggaaggacaggtctcttctccactgcttcgtaatggagaacaaagttgtccttatgaacagtatcccagatgcttggatcaaaacaaatgtaggaccctcgttcatgaagtggagttttcacaagaggtgcggaattaggagctcttgttagccagacacggtagtctttgtggtaaaaccaccctttattgtatagttcattagcagcatataactgagcggcatctttaggcatgctgtaaaagatgtagaatagtgtcaaagggtgaaacttctgaaaatgaaatggttgcagcgctggtggtggctctgcagagaaacaagctgggatctgataatcaggttctcctacagctggctcgcttgaccacggagagccaaatgtcttgtaaagattatcttgggagttcaaattcaaccccaacgaggtcaaatcaatccctaaagcaagagttgttggtccaggctctttcattcttattaaactcaacagtccaagtaagctatatggatccggcacagcctgtgttccctgaacggatttttggctctgatccttgtaccgcggccgcccccacgctgcctgcaacctaagtgaattttgagtctgtggttgatggtacttctgcatgaattgctcataaacccctgaattagttgacagacttggagaatttgccggtcttagtccaatagtttccagcccagcattttgaactgaattagcactccggacgcgtggg

SEQ ID NO: 19995 - DNA, 2595 bp, Zea mays
ctgcagatattaatgcaatatcaagaagactgaagacacataagtaccttagttatgcttgtctcttgtcggtaacaactcttcagcatcgattctaatgttggtgtttgatgggcgccgcattgatcggccatctagccttttaacctcaacagtaaatgtccgacaaacacgacgatggtcagagaattgagatcccccccggaagtaggacaactgtgcaataccatctccatgccatagtattctttcacacctgaacatttgcaacaaaccggtcattaatagtattatgtattcatggtttgggaagtgtgattcctgaattctgaatatgtgaattatcttgatttgtttatttattgcacatgagaatgattcctcttttgtgtttccccacgcttacaacttaccttgttgtccaaatctgatttaactcatctcaaaagatggttcttgtggtacagaaaggggaaacacaaggttttcgggttgcaaagaggtttgtggactctaggatacttcatagccactgacgagtgttaacatatgagaatgagatctgaactctctgaaactatctcaaacattgtagtacataccaggctggggttctcctctttttctttgatgtggcagtctctccagcataagaatctgaattgcaagagtacttgtatgtgggagcaaaatatatcttctcctcactccaccccttgaacagacttccaaaagcacgctggatattgagctgctggatattgagctaagaaaaattgtgtaacatgtcattgaaattctagtatcatttcaccgtaatataaaataaaaacatacttgatttgtatggtttgaatttgtgattgactgattgatcatcggaagaacacaacggggtccagtccagcaggctgcaacaaaagtaaaatattttattcttttttaaggatctcagttttttataccagaaataagttgataggcccgcatgtctgatttgcttaatatttctgatgcagctgatttttagctacatgttgagctgttgtggatccatgaagatacaacataatctccatagatcatacagaatacagggaggcacaattggatgtggatctgggattgcttcttaaagtagtaaattaattaaacatccatgtgaaagtgcctgcagaatgttctgaaaagttaatccttgtacttgtatgtctggaaaaataagatcatgaaaagagaggccataaaaatgcttacaaacaaaagaaaaagagcacccatgtatattagcacaaacagataaattgggaaataatttatcaaggaagcatatactaataaaattataaaaaattgtactaaagcctagaataaaaattgcgacgggttcctttgggcgttgttgtcgatacctccataaagccatgcacaaaaatgacaacacaaattaggttctattatattacctcaaaaaatggccttcacattagtgctagatgttttgagtgaagtggagttttcacaagaggtgcggaattaggcgctcttgttagccagacacggtagtctttgtggtaaaaccaccctttattgtatctgaaaacatggagcagcaatttacttaaaaactgtggtagagtgcattagtgcaagactgcaagctatacatcaagaatacaaatagtgatactacaaattgtgcagtttctatgcttacagttcattagcagcatataactgagtggcatctttaggcaggctggaaaagatgtagaatagtgtcaaagggtgaaactttttgcagtgctggtggtggctctgcagagaaacaagctgggatctgataatcaggttctcctacagctggctcgcttgaccacggagagccaaatgtcttgtaaagattatcttgggagttcaaattcaaccccaacgaggtcaaatcaatccctaaagcaagagttgttggtccaggctctttcattcctattaaactcaacagtccaagtaagctatatggatccggcacagcctgtgttccctgaacggatttttggctctggtccttgtactgttgaggatctgaagatgcctgcaacctaagtgaattttgagtctgtggctaatggtacttctgcatgaattgctcataaacccctgaattagttgacagacttggagaatttgccggtcttagtccaatagtttccagcccagcattttgaactgaattagcactctactgatgttgacggggtggataactgcttcccaagctaaagccaaatggtctagccatctacagaatcatgtgtgccgaaatttagaataagcaactattcttgagagtgcactaacctgataggacaagtaagactgctgattcagaccactcttcagaaaataccaaagttttcagacatgtatctaagtgaggaccaagaatattgctattttctgatcattcttgtgataagtagtcagatccaaagtggtatgaagtgacgcttatttagaagaccaacactaacgaaagacattttccaagaaacacaacataacggtttcccactgattcacccggccggcctcgag

SEQ ID NO: 19996 - DNA, 1198 bp, Zea mays
cctcgaggccggcccggccgggaacggctctgctccgtgtccgcttttcagaaagacagagaggaaaggaagaaaaaactcgcccccctctctctctctcttgtgtgtgaggtggcgaacccgaggagcggaggccacaagtccaatccgcccgtatctaatccgctgcgacgaggtgggggcgcggcggggcggtcttgatccgggctctttcctcgcgggagcgcacggttggcatttcaagtgcgagaccttggcttctttgaatcccacaaagcacggttgagccatggctggctcccttgctgcctcagccttcttccctggcccaggggcttctccggcagcatccgccaaaacatcaaagaacttggctggtgaattaccggataatttgagcgtgcgtggtattgtcgcaacgcctaatgccccttcggggaacatgcaagtcaaggctcaagcacaagcccttcccaaggttaatggtaccaaggttaacctcaagaatgcaagcccagacacagaggaggcgataccctacattgctcccaagacattctacaaccaactgccagattggagcatgcttcttgcggctgtcactaccatctttcttgcagcagagaagcagttgacactgcttgactggaagccgaagaaacccgacatgcttgttgatacatttggttttggtaggatcattcaggatgggctggtttttaggcaaaacttctggattcggtcctatgagattggtgccgatcgtacggcttctatagagacattaatgaatcatttacaggaaacagctcttaatcatgtgaaaacagctggccttcttggagatggttttggcgccacaccagagatgagcaaacgaaacttgatctgggttgtcagcaaaattcagcttcttgttgagcaatacccctcatggggagatactgttcaagtggacacatgggtagctgctgctgggaaaaatggcatgcgtcgagattggcatgttcgtgacgaaaactctggacgcacaatcttgagagctacaagtgtttgggtgatgatgaattagaacactagaaggccttccgaaatgcccggccgaggttgggccgagataggcccatatttcaatgggcgctcagccataacagacgagcaaagcgagaagttggctaagccagggagcgctcctgac

SEQ ID NO: 19997 - DNA, 485 bp, Zea mays
tttggcttttttttttttttttttggaggtttccaaaaaaaactgacatgatttatttgaggaatagacagatacagtatagcgaaagctcactgatgggtgttgtgctgtataggatattgttacttgctgaactgaactacccagctacgagtacattacatcacaagcagaagcaaggggatggacctactaagaagaggaagacgaagacgaagatgaggaatcctgagcatcgggtccgtctgcttggtcgataccaaacttgtgcttgaaggtgtcctggcgctgcatccacatcatgtggccctgcagcgctgctgcccatacgacgaggaaggaggccacccagaagcgcttctccttcaccagcttggacagatccaccgccgccatggctaatggcttctcttcacttgaaaaactcaactagtagtaggggatgagcaggacgatgttaccccgggccccccgagcgccgcaca

SEQ ID NO: 19998 - DNA, 1991 bp, Zea mays
gaccctcgggctttccgggctctgcttcgtggcgctgccttttcagagaaaacagagggaggaaagaaaaagctcacccccctctctcttcccaccacctctctcacgtgtgtgaggtggcgagcccaaggaggagcgggaggccacaagtccgatccgcccgtatctaatccgctcgagcgcagcggctcgttcctcgcgggggcgcacggttggcatttcgagtgctgagacatcggcttcattgaatcctaaagcacggttgagccatggctggctcccttgctgcctcagccttcttccctggcccaggggcgtctccagcagcatccgcgaagaacttggctggtgaagtaccggatagtttgagcgtccgtggtattgtcgcaaagcctaatgccaattctgggaacatgcaagtgaaggctcaagcacaaacccttcccaaggttaatggcaccaaggttaacctcaagaatgcaagctcagacacagaggaggcgataccctacactgctcccaagacattctacaaccaactgccagattggagcatgcttcttgcggctgtcactaccatcttcctggcagcagagaagcagtggacactgcttgactggaagccgaagaaacccgacatgcttgttgatacatttggttttggtgggatcatccaggatgggatggtgtttaggcaaaacttcattattcggtcctatgagattggtgccgatcgtactgcttctatagagacattaatgaatcacttacaggaaacagctcttaaccatgtgaagacagctggccttcttggagatggttttggcgccacgccagagatgagcaaacgaaacttgatctgggttgtcagcaaaattcagcttcttgttgagaagtaccccttgtgggaagacacggttcaagtggacacgtgggtagctgccgctgggaaaaatggcatgcgtcgagactggcatgtcctcgactgcaagtctggatgtacgatcttgagagctacaagtgtttgggtgatgatgaataagaacactagaaggctttcaaaaatgccggacgaagtaagggctgagataggcccgtatttcaacgcccgcgcagccataacagatgagcagagcgagaaactggctaagccagggagcactgctggtggcgatgctatgaagcagttcatgagaaaggggctcactcctaggtggtggggtgaccttgatgtcaaccagcacgtgaataacgtcaagtacatcggttggattcttgagagtgctccgatcgcgatcctggagaagcacgagctcgcaagcatgacgctggattacaggaaggagtgcggacgcgacagcgtgctgcagtcgctcaccaccgtcgcgggtgaatgcgtagacggcgacacagactccaccatccagtgcgaccacctgctccagctggaaacaggagccgatattgtgaaggcgcacacggagtggcgcccgaagcgggcgcatggtgaggggacccccatggggggtttcccggcggagagcgcgtgaatccatatttggcagggtgagggggacggctgtgaagcacagatcctatgtttatgggtacactaacgcccaactgagttgagtgtgttttggttggttggttgcttggtcgcgacaagtatggcaggcacatgggggagcgccgcattacccacacccaacctggggattttggccaagagacaaagcccagcaggatgaggatcgaggaagcagaccagagttgttgcggagcgagaggactgggggatcagtgtgtgctgtgggctgctgggcaaggatgcatgcagggggagctgatggttttgcaggggatgatgctggttggttggggtgtgtagaaggcattcattcccctttgtaacagcctaatctgtacattcttaccatcatccttgtcttgttgattgatcgagtcgcagacctcctgcgtttatttgc

SEQ ID NO: 19999 - DNA, 597 bp, Zea mays
ggccgcttttttttttttttcggtggcaaccagccgcgctgcgcttttttttttttgaaacctgctggaaagtgcacttcaatctataaaacacaactcaaatacatgagtttgtggcaatgataagctagcagagttttgcatcccagacccaaaagatatggtatcagaatttattctggactaaagagaagaaaaatgacaatcatcaaaggaacgcctggtagtggttacacacactgcacttgtcttgtcatctgcctcctctcccgcccgctttattaaaggatggatgtctcatttgttccgaacaaaccgcttgagacgatacaaggtaactgactaagaagaggaagacgaagacgaagatgaggaatcctgagcatcgggtccgtctgcttggtcgataccaaacttgtgcttgaaggtgtcctggcgctgcatccacatcatgtggccctgcagcgctgctgcccatacgacgaggaaggaggccacccagaagcgcttctccttcaccagcttggacagatccaccgccgccatggctaatgccgccccgcccggccgcgcccggcctcgaggaacccaatcgcc

SEQ ID NO: 20000 - DNA, 777 bp, Zea mays
gggagctcgccttgtgtcggtacccgggattcggccttatggccgggtggatttcttgagagtgctccgatcgcgatcctggagaagcgcgagctcgcaagcatgacactggattacaggaaggagtgcggacgcgacagcgtgctgcagtcactcaccaccgtcgcgggtgaatgcgtagacggcgacgcagactccaccatccagtgcgaccacctgctccagctggaaacaggagccgatattgtgaaggcgcacacggagtggcgcccgaagtgggcacatggtgaggggacccccatggggggtttcccggcggagagcgcgtgaatccatatttggcagggtgagggggacggctgtgaagcacagatcctatgtttatgggtacactaatgcccaactgagttgagtgtgttttggttggttggttgcgacaagtatggcaggcaacatgggggagcgccgcattacccacacccaacctggggattttggccaagacaaagcccagcaggatgaggatcgaggaagcagaccagagttgttgcggagcgagaggactgggggatcagtgtgtgttgtgggttgctgggcaaggatgcatgcagggggagctgatggttttgaaggggatgatgctggttggatggggtgtgtagaaggcattcattcccctttgtaacagcctaatctgtacattcttaccatcatctttgtcttgttgattgatcgagtcgcagacctcctgcgtttatttccaaaaaaaaaaaaaaa

SEQ ID NO: 20001 - DNA, 3580 bp, Zea mays
gagtgatcccaaaaaaaaagccaggctctaagtgtgacatcagtatcatcacattaatctataatgctgctaaaacacttgcatgacttcgttacttgaatcatataagaaaacccattgtcaatcctggaaatgtgcaggcagttccatcaagtttcgttataaccttgtccagaagctacatatatagaaattttgatcaaaagcataaaaaacaaatactcaaaaacaaaatttgtgcagtttccaggtcatccacacattacataatctctactacaaaaaagatctagacatgcatttcattattaaaatagaacaagagctatacatacagcatgctaagaaccgttgatctacagagtagttgtgaaaacagagggaatgtccaatcttaagtggccgtttctatgtgcgtgtggggtccatcaatactgatatcatattaaacagttggatattgaagtcattatggttgtgtatacagcttattcactccgcatactgagatgcaatgatataaacttgcagctgcagttctatgaaagccaaaaggagccaggtatccgaggaaggctctacacctgcatcaattagcgctagattgtctactcgagagtttcatgtaagcaaaaagccacaaccggaggaaaagagccaaaagaagcacacatagcttgcaattcaaacacgcagtagacagtaccacattcaactgatcgtaatgagcagactgcaataatgctgctgatatagcttttcccccggcaccttcaacgccatgcttcacggatatgtagaaggcttcaggagcatcagcaaatgcaagaagggaagcaaggggctggggcgctgggcatcatcataagtataggtcgtaataccaccagccaagcgtgtttcatttatttggtgcaccacatagtcaaaaacgacaaaaaataaataaatctcgcttctcttccctggagttggctcgcaaatactataaaggtgatagataaaaaaaacattttcaataactacatactaaagatgacaaaatttctcaccttgtagtttctaatcatgtttttgctttgctaacttaaccacatgaatacaatttctcaccatttctttgatgcaaagtgattctttaatgacaatgaaattaaaatgggatctgtaaagtgaacagtacatgagacaattatttgttgtatagtatcgctggtattaggagcaattgccattgcatacaacacaattgtgcacatacctcttacatgcaaatgaaagaaactgtcttgagtatttactgtgaatagtcacagtgaacggtgacttatgatatgctactgtaactatatttctgagttcagttctggctttttttagtttaaaatgtatgttatttgggtgtccggcccgctgcaggtcagggaagacccagttggctcataccctatgtgtctccactcaggttcacccctgtatcaatttttttagaaagcacgtggaccatagacgcaatagaatttgagaaacaaagaagcaacggaactactttcctatttctgattgatgagaatgcaacttccaatccacatgcatgtgggaaatgggaaggttgcctacattgacactaaaggaacattgtatctttgggagtaatttgtcaagctgattctctcaagagtttatattttgtctacaaattaatgaagttttcagtcgacctgaacgtgttgtgccaattgctgagagacttggggattgatgccaatgttgttctcgacaatgtatgcatctgcatgcatttaacatttcttggtcctattagcccattgcagaattgttagatacttgtgtgacacagtgccaacttagaactgagtatttcacctgttttaaatttgttatcacactttgccgtgtctttaactttttttattaatgaaaaatgatggattcccataggtcatgctaccagagactgtgcatttgtggtcgcacccacagatccaaccaggcaagtgtcctttgctaatagctactacacttgtacataaagtgccttgtgcctggcatccatctgtggttcctttgttcttaattgcttttggtcctacctgctggttccaggtaatattcaggcacactacacttgtagaatgaaatatgaaatcgccccacttgtttctcaaatatttcaggagttatggaatagtcaggctgactgatcctgtagggatggatgtgcttaaggattgtgatgaaagtgggttccacactcaccgagagacaaccaacggcagtccactgtccagtctatgaaacctgctggaaagtgcacttcaatctataaaacacaactcaaatacatgagtttgtggcaatgataagctagcagagttttgcatcccacacccaaaagatatggtatcagaatttattcaggactaaagagaagaaaaatgacattcatcaaaggaacgcctggtagtggttacacacactgcacttgtcttgtcatctgccttctctcccgcccgctttattaaaggatggatgtctcatttgttccgaacaaaccgcttcagacgatacaaggtaactgacctgatcagccataggaggcatgagtccaatggcctttgccagaagaaagaaggaagcagctggttgtagtagtatagtgttccatccagttgaaaaggtacattgcaacatatttcgagtgaattctcatcatccaaaaaaaaagatgctactggtgccagccaacctactgttgttgtacaattacacaccactagttaatatacctatatgtaaatatatgaactgaaattacgagttaatattgatgatggaggaaaccaaaaaaaactgacatgatttatttgaggaatagacagatacagtatagcgaaagctcactgatgggtgttgtgctgtataggatattgttacttgctgaactgaactacccagctacgagtacattacatcacaagcagaagcaaggggatggacctactaagaagaggaagacgaagacgaagatgaggaatcctgagcatcgggtccgtctgcttggtcgataccaaacttgtgcttgaaggtgtcctggcgctgcatccacatcatgtggccctgatacaccaacgaaatcattttggattcggaaagggaggcggaggggaatagaagcctccggatccagtcgatgacaagcatgcatgaggaaagcctgcacctacctgcagcgctgctgcccatacgacgaggaaggaggccacccagaagcgcttctccttcaccagcttggacagatccaccgccgccatggctaatggcttctcttcacttgaaaaactcaactagtagtaggggatgagcaggacgatgtggggcccagggcccagggcccagggcacggaagacggattttgggctgctgcttattggttaatttaactacttcttcataacaggccgggccgggccgggacgtcgcgctgacaggacaatacagcggatgaatgggcaaattccttttcatcaaaaaaaaaaaaaaaaaaaaaaaaaaaaa

SEQ ID NO: 20002 - DNA, 744 bp, Zea mays
  misc_feature (2)..(2): n is a, c, g, or t
anactcgcaagcatgacgctggattacaggaaggagtgcggacgcgacagcgtgctgcagtcgctcaccaccgtcgcgggtgaatgcgtagacggcgacgcagactccaccatccagtgcgaccacctgctccagctggaaacaggagccgatattgtgaaggcgcacacagagtggcgcccgaagcgggcgcatggtgaggggacccccatggggggtttcccggcggagagcgcgtgaatccatatttggcagggtgagggggacggctgtgaagcacagatcctatgtttatgggtacactaacgcccaactgagttgagtgtgttttggttggttggttggttggtcgcgacaagtatggcaggcacatgggggagcgccgcattacccacacccaacctggggattttggccaagagacaaagcccagcaggatgaggatcgaggaagcagaccagagttgttgcggagcgagaggactgggggatcagtgtgtgctgtgggctgctgggcaaggatgcatgcagggggagctgatggttttgcaggggatgatgctggttggttggggtgtgtagaaggcattcattcccctttgtaacagcctaatctgtacattcttaccatcatccttgtcttgttgattgatcgagtcgcagacctcctgcgtttatttgccaaaaaaaaaaaaaaaaaaaaaaaaaaaaaaaaaaaaaaaaactcgagaggggcgccggtacc

SEQ ID NO: 20003 - DNA, 1667 bp, Zea mays
tttttttttttttttttcaggcacacaataattggtttttaatttgctgtcatcatagaaatatatattcgaaagtcggagtttaaatagaaatccataaaaaatacaataggttcagcaaccgtgcaagcataggtagctgcacatggaaacacttcatcatcatcattgatacgaacatagctttacgaacagcaactcaactgcctgctgaaactgattccaggctagtgtcctactaattaattctatatatagatcagtagataattgaaacatagcttgacgaacagcaactcttcaagagtcaaatttggtccccttgacggtgcaaattccagccttgtggagaaaatgaggttaggatcacatcctgttgataattcccgtctctgacaattatgtggatcagtctttcttcttcctatcaacatatggatgtttttggtagatgaatatgcttgacgcgacaagtggtaatgctatcaggcagtagagtgacggtagcttcccatcaaatataaattgtagcagtgcagttacaaggagagctgaaactataacaaaaccctttctaacgccacctgcgtaagttgtgacaagaccaacaagaattccacccacggcattcattaataccggtatcacagtccagaaagtccattcatggaaaaatccatatttcctgatggcctctccatctggtgagcgataggtacttgctaacaagcacatacttccaataaatgacatctctatggtcatcatataagaggtatgttttttaacctgagatgcccactgacacaatgaagaggccagcccagacagcacagaagcgactgtaactggaatgatcccatatagcaagatatagtcagagccaccacccttggaacctttgctactgctctccccaacacttaaaagaacggcagcaccaattaagagggccaatgctagaatttgcctggaagattgcttttgccccaaaataagaaatgtgaaaaatgctgtccacaaaagcttagtctggttaaggattgaaaaggtcaaggaatccagatgcttgtatgatacttgcagcagactattctggagggcataaatggcagcaggcagtccagacgcagtcagtgatccagtgagagtccagttactgaactgttttttcagactaccctctgcaatcaataaaatgattgcgcaaataacctttgctgcttccgttgcaagaactagtgaggtcactatagtatcttcgcggacaaagcgcttggagatgaggggctgggcgccgtactgcagggtgaggagggccaggtagagcgccaccttgcgccggctcggcgcggccgcggctgcggccgccggagcggacgaggagcccatccggactccggcgcgttcgctcggttccaatccagcaaccaaaatgcgcccggcgcgccgcccctatttcggaaacttctcctttcctttaccaagcagacgagcgcaaactttctggtctgatcgatctgatctgaatatctgatgctggaacagtggggggacagggaaccaaaccaggacgaagaccggacgagcacgccggccaagtcgtgctcacgtttgcgcggctggggggcaagggcaatgggctcggtttgatcgaatcatcgaat

SEQ ID NO: 20004 - DNA, 1464 bp, Zea mays
ttttttttttttttttgtcaactaacatagtgcagattccgaatgagaaggattgacgcaaaataattagttcttagtttctgtcatcataaataacatattcaaaattcacaaatcagtctataaataacaatccaggaaaggcagacagtaagttcatcatgctgtgcaagtaaacaccattaatatgaaacctccttccagatgttacatgcaagcatgtcaactgcctgctgaaactgattccaggctagtgtactgctaatttaattatatatctagatcagtagataattgaaaatagattcacgaacaggcaactcttcaagagtcacatctggcccacttgacggtgcaaattccagccttgtggacaaaataaggttagcattacatcctgctgatgatacttcccatctctgacaattatgtgcatcagactttcttcttcttatcaacatatggatacttctggtagatgaatatgcttgtcgcaacaagtggtaatgccatcaggcagtagagtgatggtggcttcccatcatacacgaattgtagcagtgcagttacaaggagagctgagactataacaaaaccctgcgtaagttgtgacaagaccaacaagaattccacccacggcattcattaataccggtaccatggtccaggaagtccattcatggaaaaccccatatttccttatggcttctccatctggtgaccgataggtacttgctaacaagcacacacttccaataaatgacatctctatagtcatcatgtaagaggtatgctttttaacctgagatgcccactgacataatgaagaggccaaaccagacagcatagaagcgactgtaaccggaatgatcccatatagcaagatatagtcagagccaccaccatttgaacctttgctactactctccccaacacttaaaagaacggcggcactaattaagagggccaatgctaaaatttgcttggatgattgcttttgccccaaaataagaaatgtgaaaaatgatgtccacaaaagcttagtctggttaaggattgaaaaggtcaaggaatccagattcttgaatgatacttgcagcagactattctgaagggcatagatagcagcaggcagtccagacgcagtcagtgatccagtgagggtccaattactgaactgttttttcagactaccgtctgcaatcaataaaatgattgcacaaataacctttgctgcttccgttgcaagaacgagtgaagtcactatagtatcttggcggacaaagcgcttggagatgaggggctgggcgccgtactgcaaggtgaggagcaccagatagagcgtcaccttgcgccggctcggcgcggccgcggccgcggccgccggagtggacgaggcacccatgcgggctccggcgcgctcgcccggcgggccgcctctgtttcggaaattttcctttcgtt

SEQ ID NO: 20005 - DNA, 1343 bp, Zea mays
ggcacacaataattggtttttaatttgctgccatcatagaaatatatattcgaaagtcggagtctaaatagaaatccataaaaaatacaatagattcagcaaccgtacaagtatagatagctgcacatggaaacacttcatcatcatcattgatacgaagcctccttcgagaagttatatgcaagcatgtcaactgcctgctgaaactgattccaggctagtgtcctactaattaattctatatatatagatcagtagataattgaaacatagcttgacgaacagcaactcttcaagagtcaaatttggtccccttgacggtgcaaattccagccttgtggagaaaatgaggttaggatcacatcctgttgataattcccgtctctgacaattatgtggatcagtctttcttcttcctatcaacatatggatgtttttggtagatgaatatgcttgacgcgacaagtggtaatgctatcaggcagtagagtgacggtggcttcccatcaaatataaattgtagcagtgcagttacaaggagagctgaaactataacaaaaccctttctaacgccacctgcgtaagttgtgacaagaccaacaagaattccacccacggcattcattaataccggtatcacagtccagaaagtccattcatggaaaaatccatatttcctgatggcctctccatctggtgagcgataggtacttgctaacaagcacatacttccaataaatgacatctctatggtcatcatataagaggtatgttttttaacctgagatgcccactgacacaatgaagaggccagcccagacagcacagaagcgactgtaactggaatgatcccatatagcaagatatagtcagagccaccacccttggaacctttgctactgctctccccaacacttaaaagaacggcagcaccaattaagagggccaatgctagaaccccccccggcctcggcgttccccccgaaataagaaatgtgaaaaatgctgtccacaaaagcttagtctggttaaggattgaaaaggtcaaggaatccagatgcttgtatgatacttgcagcagactattctggagggcataaatggcagcaggcagtccagacgcagtcagtgatccagtgagagtccagttactgaactgttttttcagactaccctctgcaatcaataaaatgattgcgcaaataacctttgctgcttccgttgcaagaactagtgaggtcactatagtatcttcgcggacaaagcgcttggagatgaggggctgagcgccgtactgcagggtgaggagggccaggtagagcgccaccttgcgccggctcggc

SEQ ID NO: 20006 - DNA, 894 bp, Zea mays
  misc_feature (33)..(33): n is a, c, g, or t
  misc_feature (36)..(36): n is a, c, g, or t
  misc_feature (859)..(859): n is a, c, g, or t
aaaggaacccccatttatttttttttttgtttncantcaaaaaaggaagttttctctcacgccccccccccttttttttttttttttttttttttttttttttttttttgttttttttttttttttttgacgcaaaataattagttcttagtttctgtcatcataaataacatattcaaaattcacaaatcagtctataaataacaatccaggaaaggcagacagtaagttcatcatgctgtgcaagtaaacaccattaatatgaaacctccttccagatgttacatgcaagcatgtcaactgcctgctgaaactgattccaggctagtgtactgctaatttaattatatatctagatcagtagataattgaaaatagattcacgaacaggcacctcttctagaagtcacatctggcccacttgacggtgcaaagtccagccttgtggacaaaataaggttagcattacatcctgctgatgatacttcccatctctgacaattatgtgcatcagactttcttcttcttatccacatatggatacttctggtagatgaatatgcttgtcgcaacaagtggtaatgccatcaggcagtagagtgatggtggcttcccatcatacacgaattgtagcagtgcagttacaaggagagctgagactataacaaaaccctttctaataccacctgcgtaagttgtgacaagaccaacaagaattccacccacggcattcattaataccggtaccatggtccagaaagtccattcatggaaaaccccatatttccttatggcttctccacccacgcgtccgcccacgcgtccgagcacgcgcacacttccaataaatgacatctcntatagtcatcatgtaagaggtatgctttttacctg

SEQ ID NO: 20007 - DNA, 2047 bp, Zea mays
gggttccgccccgccggcccggccgggccggatttttttccacgaaccaaaatcactatttcttatatattctattccctctcctctctgcaccgcccgccgcgccgagcacgcctctccctccctcgatccagatccaccccatacctccgcggcgccaccccttcccgctccttctagccggcgtcggcgcgggccggagatctgttttctccggtaggaaaaatcctattgcgatctaaatatgggttcgaaatcggtagacgaggtgctcgacgccgccgccgccggagtccattactccgcactccgtctggacggccaggcttccgcaacgacgtctggcctggagaacggccaccaggagccctttgtcattggtgttgctgggggtgcatcgtcaggcaagagtaccgtgtgcaagatgatcattgatcagctccgtgaccagcgtgtcgtggttgttacgcaggagtccttttattatggattgacggatgaagaattagtacatgtccataattataactttgatcatccagacgcatttcatacagagctacttctctcttgtatgcaaaacttgaaatgtggcaaagctgttgacatccctaactacaacttcaagacatacaaaagtgtcccaaatgcaaggaaggttaatccttcggatgttattattttggaaggaattctagtttttcatgattcacgcctcagggatttgatgaacatgaagattttcgttgatacagacgctgacgtacggttaacaaggaggatccatcgtgataccattgacaagggtagagatctcaaagctgtgttagaacagttctcaaaatttgttaagcctgcttttgaagacttcatcctcccaacgaagaagtatgctgatgttatcatcccacgcggaggagacaatgatgtggcaattgacctaatcgttcagcatattcggactaaacttggacaacatgatcttcgtaaaatacaccctaatctgtatgtaattcagactacttatcagatacgaggcatgcacacaataataagggatgctgccacagcaacacatgatttcatattttatgctgatcggttgattcgattggttgtcgaacatggtcttggtcatcttcctttccaggaaaagcaggtcatcactccgactgggtctgtttacactggtgtggagttctccaaaaggttgtgtggtatctcagtgatcaggagtggcgaaagtatggagaatgcactacgtgcatgctgtaaaggtataaagattgggaagattcttattcatcgggaaggtgacaatggacaacagctcatctatcaaaatttaccaaaagatattgcaaataggcatgttctgctgttggaccccatattgggaacaggaaactcagcagttcaagccatctcccttctattaaagaagggtgtacaggaagcaaatatcatatttcttaatcttatttcagcgccccaaggagtgcatgtggtgtgcaagagattccctagaatgaagatcgttacttcggagattgagtccggtctaaatgatgatttccgtgtcgtacctgggatgggcgaatttggagacagatacttcggaacagatgaatatcagtcatcgacgccatttttctgtgacgataaaaatcgtgtcaggctcttgtgagaagacaacatcaagccatggacgcggcatattctccaattttttagaaacttatatctgcatttcgaactctagaatgcacatataatgatgctttctttaccatacagacagcacagaacacctcttggtataattggacccattccatttttgtctgtttggaaagcagtgtcatgttcagtagcctctagaaggaacattttttttctttcatgtaataaattagggtaaaaaggatgttttggatcggaacttaattcacataaaaagtgtgaagcttaaatacgaactcctgtcgacttttgattttttttgttaagtatcaaaaaaaaaaaaaaaaaaaaaaaaaaaaaaaaa

SEQ ID NO: 20008 - DNA, 1843 bp, Zea mays
acatacatgtattcttgtaggctccctctcatctcagcacacctcccgccgcgccgaccacgcgcctttccccttttcctctcccccagatccacccgccgcgccacccctctcggctcctcccaggcggcgtcggccctttcctcgccctcctccgtttctctccggcgtatatatgggttcgaaatcggtagatgaggtgctcgatgccgccgccggagtccattgctctgctctccgtctggacggtcccaacgtccagttttccgcctcctccgaggaagaaccaacgacgtctggcctggagaatggccatcaggagccctttgttattggcgttgctgggggtgcatcgtcaggcaaaagtaccgtgtgcaagatgatcattgatcagctccgtgaccagcgcgttgtggctgttacacaggagtccttttattatggattgacggatgaagaattagtccatgttcatgattataattttgatcatccagatgcatttcatacagagctacttctctcttgtatgcaaaacttgaaacatggcaaagctgtcgacatccctaattacaacttcaagacatacaagagtgtaccaaatgcaaggaaggttaatccttcagatgttattattttggaaggaattctagtttttcatgattcacgcctcagggatttgatgaacatgaagatcttcgttgatacagatgccgacgtacggttaacaaggaggatccgtcgtgataccattgacaagggtagagatatcaaagctgtgttagatcagtactcaaaatttgttaagcctgcttttgaagacttcatcctcccacgaagaagtatgctgatattatcatcccacgaggtggagacaatgatgtggcaattgacctaattgttcaacatattcggactaaacttggacagcatgatctttgcaaaatacaccccaatttgtatgtaattcagactacttatcagatacgaggcatgcacacaataataagggatgctgccacagcaacacatgatttcatattttatgctgatcggttgattcgactggttgtggaacatggtcttggtcatcttccttttcaggaaaagcaggtcatcactccgactggatctgtttacactggtgtggagttctccaaaaggttgtgtggtgtctcagtgatcaggagtggcgaaagcatggagaatgcgttacgagcatgctgtaaaggtataaagattgggaagattcttattcatcgggaaggagacaatggacaacagctcatctatcaaaatttaccaaaagatattgcaaataggcatgttcttctgttggaccccatattgggaacaggaaattcagcagttcaggccatctcccttctattgaagaagggtgtacaagaagcaaatattatattccttaatcttatttcagcgccccaaggagtgcatgtggtgagcaagagattccctagagtgaagatcgttacttcggagattgagtttggtctaaatgatgatttccgtgttgtgcctgggatgggcgaatttggagacagatactttggaacagatgattatcagtcatcgacgccattcttttgtgacgataaaaatcgtgtcaggctcttgtgacatgaagccatggctgcggcgtattctccaatttttgagaaacttatatcagcattccaaactctagaatgccatcataatgttttcattaccagacactgtaccatggaacatccagacagaaatcacctcttaatataattggatttgttccatttttaaaaaaaaaaaaaaaaaagcgcccgggggggcccggtaccca

SEQ ID NO: 20009 - DNA, 840 bp, Zea mays
cgtctcgaggatccccgtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctagggtaccgagctcgaat

SEQ ID NO: 20010 - DNA, 1966 bp, Zea mays
ggccgctttttttttttttttttaaccaaaggggatgctctttccagggagcacgttcctcttcttggtgcaatgacgcccccctctctttttttttgtttaaaataaaacaaaccacgacagcttcctatcagacatgctcttattggtcgatataatacatttctgttatattcaggcattcgtcggtgacaagtggccgcagccatgtgcacacaaagtacatatccatgcgctctgacagcgagctatcagggaatgctgcgatcagaacaccgcaaagcattcgatggaataatcagtaacagcaccgtgtggggccttcagaaacatttgtacagctatactcgggcatgcatcggccctcgttacatcattatattaagacagacctcttcagagttccgtggctgacaaggccggctcaacaaccggtggcacagcatccaccttgtaccgaaggacctttttgaagaatgaagaatatgaattgtcccacacaagtttgtatgatcccgatgaaacagtgcaaaaattaccttggtcagcttcatatcgtcggtatggaagaattaaagttttctcccctgaagggctaatgtactccacatgaaagccaatgtccaataccatgttgagggccccttgttgcaaggaaaagtcccatgcgatgtatgagtttacagcttcaacactcaaaatgacctcatgtgtctttccagctggaataatagtttctttgtactcatcacttttccttgcatccacggcacctgcatcctcagcagatataaagaatggtgcattcacaaagacctcaccaatgaattcagtgaacttcaaaaactccttggtgtagataaccacagcttgctgcaacacagcagcgtcatccttctctattttcctttgtccatatcgtgccaaagagacatgcaaatacaaccgaattgcaagcaccagttttgtaagggtgtaaagggctggaccataacgttctctttgttcttccataggcccattatcgtcatttatttgtcgaataaaatccaataaaacctgtggaacaccgaccaaatacctaacaagagtcttatatacacctgttgcagaaccaagctgtgctaattgcaccctcctttccatttgctgtttccataacaatgcatatcgatcatgaatgcttccaccagcactaaccagagcatctacctctgcttgcttatttctctctgagcgttctcgctgttgcctgattagagtaccccgaaaatcttggggcatgtatgtcataactgtattgaaaacattgtcagcatttttcaactgaaattgttctaagttcttcaacatatccttcaatttagcttctatatcatcaagtgtacaaactatctcagcatcttctggggtggacttctgttgaagagccacaggacgatgggatgtgttaatcaagaaaagaatttcttccatttgttctcggttcttccacaaattctcatcaattttgtgggcaggtatgccagctgcttcttgttccaagagctcctcatctggggcgatgggagcaacggcagcgaggtcggcggagagagcacggagccgggcggcgaggtccgtagtggcgtcgggcagcgggggcagcgggtacttgtcgtagtagcgcgcgaggtaggtccgcgtaataggcacaagcccttcggtcatcgccatcgccggcgcggcgggcggcggcgaacggaggtggcgtgggggcaggggaaagggagggaggaaagggcacgtgaaatggacgtgctgctgcggttgcagacttgcagcagaggggagagcgggagagaattgggcgcctagtgccggccccgggcggtgggttcccggccgccctcgagcaagcatcaaccaaagagcgtgtttattttcgtgtcatcgtgtcacccggccggcctcgaggtacccaatg

SEQ ID NO: 20011 - DNA, 2118 bp, Zea mays
atgtcaggatcaaattacacaaaatgacgataacgacgacgacgatcccgataacaagccataggtaggttgaccggagcgacaacaatctcgagtgtttaacagggagaaagacgaacttgggaaacatggcccacatgttaacggcttgaactcatgcgatcgcacggaggtgcaaacccgaggggaacatggatttccattctatgtgcttaaagtgcgattgcaggatgggctgagcaactggcatggttgtaggacggcagacgaccatacgagtgaggagagggagagggaaagtggcgaggccggctgggccacattagaagagtggcccactaagcaagtgaggcttttttttcttgttttctaagttttcatttttaaaccaaatttctaattcaatcaattcaaaatcatctcaaacaatagaaatagtgcttcaacatgcggtgcacagacaagtcattttatattttcttttattttttgtctcatttatttgaagagaagcaaattagatgcacaaaaatacccaaattcaaatgatccttttggagaatttttatttagattttaaacttatgaaatttttgggtcgggtgcttttttagggtggcggacttatgtctaatggccacaacaacatcctcatctaactgtgttttagccgatgttccagaaatcattggtcctccaccacttatttctttattgactacgacatccgtggtgtatattttgttgatgttgcagaatgtagtactctctaatttttagaacttattgtagtaagtgactcaggtgttacaaatgcaagggttttcacaatatgtctccgtgttggatctgtcggcctttgggactgaatattctgacatgactgctgatcttgtgcctcaagaccggattgtggaattttcaatctggtcgagctagcctatcaagtactgaaatttgtggtgcccccaagctgagtgatgtggtattctatatagaaattgtgggcgtggagtggggctaagcacgcgcagggggggggcgagggggaattgtggcggcgcaatggtaccgagccctcttttggctgctgaatcgtgattgtcgttcataacagcttggagacagaacatagaacgcatgcacaaagataatttgatctccttacatacaaaatgcagggaaaagaaattttttttgtttgtttatacagtaaatggtagtatcatcaattagaagatgtttgtaatctcttttttactaagtaaatatttcggatggcaatattgtgaagcactacgttgagtcccaaatgtgcaattctgtatgcttacaacgtttcaaagggtgcataacagtattatatatatatatatatatgtgtgtgtgtaatttttattggagtactaacttatgacaacgtttcaaaggcgggagcgcagcggtaaagctgctaacttatgacgcagattctgggtcgtgaaaataggctcttgtagatacacaaaaaatctgtttgacaactaacttgatgaatacttggcgacgaattcagcaatattcttgtccgagctccctccgtactgtgcagcttccttggcctttttcatccacacattggcattcatcgactactcatcttttctatccccatccatgacatccttgatgcacctcgccacctcgtctctcgtcaccaagcctttctcatccttgcgcaccttgacacccaagccccacacgctctccatgtatttcgatatggtcggctggtcagcccagtgtggtactgccaccattggcacgccattaacaatcgcttctagtgtcgagttccatccacagtgcgtgaagaaacagcctgcagctttgtgtgccgcaacttcgtttcacattccttgccagtttgtctcatttttcctcatatatatatatatatatatatataagctatatttggatactctagtatttagtacaatgtatataagttaaggtagattaaggtgtaaattagtttaatttacacccagaaaccccctcaaccaatatgtgctgagatgaatactatagcatccaaacaagcccgtaagagtaagagaataaccattatcaaca

SEQ ID NO: 20012 - DNA, 1888 bp, Zea mays
tctaacaaatcaaacaaagaaaaaaagtgataagtcagaagatgatgaaccacctcgttcatcaaaccaacacactgctaattaatgttgatggttggttttttttttttttttagatgaaatggtctcacgatgagtcattcatatagcaagggattcctcaaataataacaccacaaaaaaagtttgaaggatctcttactgctactgcgtgtcatcatgctagttagctatctttatctcttgaaagtaggcggtcttctgactttcgtagcttgctcgaacgcataagcgatctcaatcaacctcggctcgtagccctggagcccaccgaagcagatcgcgaaggggactccctgctcatcgtaccccgccggcacggcgatgcccggatagcccccgacggcgagaacagaggaggcgtcgctgttgggcgccacgatcgcatccaggcggcgttccttcatcagcttctccagcccattggtggagatctccctcagccgccggatggcagctctctccctggtgccgatgccgttggtcttctccgcggcgatcagatccggctgcccaaaatctttgagcctctcctctacaggatgcgcttcgttgaatgctatgacttgtgcgagggagcggactggagagtacagtaggcccgacaagtaagccttgatgcttatcttgaactctgcagccatgagcaggatctcttgctcacccagatcagtgaaatttgttgcgatgtcaagatccatgatcacgacggcgccttgttgcctcattgtatcgagatgcttctcatagaccgccagttgcgtatcatcgtatccttgaaaaaacacgtcggggacaccgatcctcttgcccctcagtccgttggtcctcaggaactgcgtgtaacccccgtgtgggatgtatttggacgctgctccggtggcttcagcgtcaagctcgtcgtagccgacaatgacgtccaacacacggacggcgtccgaaactgtgcgacacattggtccaatagtgtcttgaagaggcgtgatggggatgacaccggatcggctcgtcaacccaacagtgggtttgatcccgaccaccgagttgagcgacgacgggcagaggatggagccgtcggtctccgatccaagtgtcaccgccgccatgttggctgccgccgcaacgccaggcccagcgctcgacccgcatggggttaccgagagaacatatggattcagcgtctggccgccgcgggcgctccagccggaggcgacggggcggaagttagaccactcggaggggttggccttgccgaggatgacggcgccggcgcggcggaggcgcgccaccacgccggcgtcgcgcctgacgacggagccgagcagcgcgagcgagccggccgtggtgttgagccggtcgcgcgtgtcgatgttgtccttgagcaggacggggacgccgtgcagcccgacggcgcagcgcccgcgggaggcggcgcgctccgcgtcggcgcgcgccgcctgcgcgagcgcgtccgggttcacctcgatgacggcgcggagctgcgggttgaggcgggcgatctgctccaggtagaaccgggcgagcgccgtcgacgtgaggctgccgttcctgaagccctggtggatggcgtccacggtggcctcctggaactcgaactgcttgccgctggagctgccggcggcagcggccgccagggccacgcccaggacggtggcgacgacctggacgcgcaggtcaaccatcgctagctagctactgactagtactgtcctcgggccgatctggtgcttgctttatcttcagcgcttgtgcatcgtgtggtgtgcacagcacactgccacactgcgtgtcttcagatgctcatgtc

SEQ ID NO: 20013 - DNA, 1002 bp, Zea mays
aaggcgtcgctgctcggcgacgccatctcctacatcaacgagctccgcggcaagctgacgtcgctggagtcggacagggagacgctgcaggcccaggtcgaggcgctcaagaaggagcgcgacgcgcggccgcacccgcaccccgctgccgggctcggcgggcacgacgccggcgggccgcgctgccacgcggtagacggccgcgccaagatcctggggctggaggccatgatccgcgtgcagtgccacaagcgcaaccacccgtcggcgcggctgatgacggcgctccgcgagctcgacctggacgtgtaccacgccagcgtctccgtcgtcaaggacctcatgatccagcaggtcgccgtcaagatggccagccgcatgtactcgcaggaccagctcagcgccgcgctctacagccgccttgcggagcccgggtctgtcatgggcaggtaatcaggcaggagagctcatcagctcgcctgtgtgtgcctgccggatagggacgataccgatacactgctacccaccacggggactgtcatcgcggtcaccatggttacaaaacacacacacgcacgataggccttagagattcaggaggaggtggaggacggcggcgacgatgatgatgctggtgttgttgaaaactctagaaggatggatggatgatgacacctagcttccggctgctgttcatcatcctcttgtgtttttgctagtagcctggtaattagcaggattaagcagccgtcaagcgtcacccccgttgttgttaattaagtacctcttgtgcggccacgcgacgacgaaggatcgaccgatgttttagcgttggttgaatccaaagctgtatataggatgtatgtattattacagcaggaattcgcttgcaactgaagagtccgttttttttattcaagctcggcacggggtctttgtttggttttggtgaaaacattcgagggatcgatgtcgctgtatcttgaccgatgttctatgcat

SEQ ID NO: 20014 - DNA, 5169 bp, Zea mays
  misc_feature (4083)..(4083): n is a, c, g, or t
tacatatataacatataaattaaatactatgtgtattgtatgcattcattaattatgtaaatgaattttaatttaaaatagagagagagtataatatagagttccagatgtattataagttaaaacaaataggttctatatcttcgactagctcactaggcgggcttgatctcctatcgagtcccacgtgagatttagcaaagtatgcaaccttaataaccacgaaaatgtctcctaattcctatggcctatacaccatgatatctgactgacaaccgggcccatttcgtaggaggcgggctaggaacccggcggttacacaaacctggccctggaatgtaggtttgccctcctaaatcaacctgagggattacccgttttacctggtcccgccctgaccccgggcgacgacatgttcccgtatttgccctcgcccagccggacaagaagcgagacaagcgcccatccttggctcgggcgttttcgggtttgcgccataatcccacggaatccgcattctgaaccatttccttcgctttccccttcgccctctctctctcccagtctccacccaccatttctcctcctctttccgtcgggtctactgcaccttgccctcccccatgaacctgtggacggacgacaacgcctccatgatggaggccttcatggcttctgccgacctccccaccttcccctggggagcgccggccgggggcggcaactcgtcggccgccgcggcgtcgccgccgccgccgcagatgccagcggcgacggctcccgggttcaaccaggacacgctgcagcagaggctacaagccatgatagaggggtcgagggagacctggacctacgccatcttctggcagtcctcccttgactccgccaccggcgcctcgctgctcggctggggggacggctactacaagggctgcgacgaagacaagcgcaagcagaagccgctcacgccctccgcccaggccgagcaggagcaccgcaagcgcgtgctccgcgagctcaactccctcatctccggcgcggcggcggctcccgacgaggccgtcgaggaggaggtcaccgataccgagtggttcttcctcgtctccatgacgcagtcgtttctcaacggttcgggcctccccgggcaggcgctcttcgccgggcagcccacatggatcgcctctggcctctcctccgcgccgtgcgagcgcgcgcgtcaggcctacaacttcggcctccgcaccatggtatgcttccccgtcggcaccggggtgctcgagctcggctccaccgacgtcgtgttcaagaccgccgagagcatggctaagatccgctcgctctttgggggcggagcagggggtggctcgtggccgcccgtgcagcctcaggcgccgtcgtcgcagcagcccgccgccggagccgaccacgcggagacggacccgtccatgctatggctcgccgacgcgccggtcatggacatcaaggattccttgtcgcacccgtcggccgagatctccgtctccaagcctccgccgcatccgccgcagatccattttgagaacgggagcacgagcacgctcacggagaaccccagcccctccgtgcacgcgccgccacccccgccggcgccggctgctccacagcagcggcagcaccagcaccagaatcaggcgcaccagggcccgttccgccgggagctcaatttctcggacttcgcgtccactccttccttggcggcgaccccgccgttcttcaagcccgagtccggcgagatcctcagcttcggcgccgacagcaacgcccggaggaacccgtcgccggtacctcccgccgccaccgccagcctcaccaccgctcccgggagcctcttctcgcagcacacggcgaccatgacggccgccgcggcgaacgacgcgaagaacaacaacaagcgctcaatggaggccacctcccgggcgagcaacaccaaccaccacccggcggcgacggcgaacgagggcatgctgtccttctcgtcggcgccgactacgcggccgtcgacgggcacgggcgcgccggccaagtcggagtccgaccactcggacctggacgcgtctgtgcgcgaggtggagagcagccgcgtggtggcgccgccaccggaggcggagaagcggccgcgaaagcgcgggcggaagcccgcgaacgggcgcgaggagccgctgaaccacgtggaggcggagcggcagcggcgggagaagctgaaccagcgcttctacgcgctgcgcgccgtggtgcccaacgtgtcgaagatggacaaggcgtcgctgctcggcgacgccatctcctacatcaacgagctccggggcaagctgacgtcgctggagaccgacaaggagacgctgcagacccaggtggaggcgctcaagaaggagcgcgacgcgcggccgccctcgcactccgctgggctcggcgggcacgacggcgggccgcgctgccacgcggtggagatcgacgccaagatcctggggctggaggccatgatccgcgtgcagtgccacaagcgcaaccacccgtcggcgcggctgatgacagcgctccgcgagctcgacctggacgtgtaccacgccagcgtgtccgtcgtcaaggacctcatgatccagcaggtcgccgtcaagatggccagccgcgtgtacacgcaggaccagctcagcgccgcgctctacagccgcctcgcggagcccgggtctgccatgggcaggtaatcaaggaggagagctgctcagctcgcctgtggctgccggattaggggacgacactgatactactgctactcaccaccggactgtcctgtcgtcgtggtcaccacggttacaacacgataggcagaaagattcaggagggagggagacgacgacgatgccggtgctgtataaactttagaaggatggatggatggatgatgataccgagcttctgctgctgttcatcatcatcttcttgtgtttttgctagtagcgtgttaattagcaggattaagcaaccaacaagtgtccaaccgttgttgttaattaagtacatgttgtgagcgaccaaccgatgttagcgttgggttggatccaaacctgtgtatagtatatggatcagccgtcgtcctatccggtggacgatgccctgatcctgatgtatgtatttttacagcaggatctcgctttgcaatggagtcaggctttttgatccaagaacagcacatggacccgggggtcgcggtccgtgtatctaaagactggtcgatggctcttcaattggatgtcgttcctgttttgatgagctgaaagttgtgggtgtgtctttcttgtcacctgtgagggcgtgcgagaggagaggttttaaacatgagcgacagtaggatttgcacatgacacgatggagacaccgtagaggcaggggcatgtgagttgggtttagttgggtaagcttcgccatcgagcacgtgcaagcactaggcgtgaagcgagttaggcaagccaaggaggagcaaccttttccctcttaaaaaaaaggggaggggcaacttgcttgcttgagtttgcaggaatttcacatggagagtaccagctcccggatgaattaatacaatatactgtagaatatattaaatccggcacttctgtccttcacttgcataataaacacgattatccagtgactactgactagccacccactgcatgatggctatatgaggtattttttcctttttctttagcgatgcacgaggaaatggcacatgcgtctgtataaatccatctttttagactagtttgagagcttaattttcgaatgtttttaactctctgagtgggctgtgcatgtttcgtggaggggacaagaatgccgtgcggctttgcttatcgcgcatgtgacttcacctgattagcacagctcagctctattattgaagcattttttaatataatagtttcgtgagcatatgtttttttggtaaaggtgagctattctacagaaacaatatttagcaaaaataatttcaccaacaatttttttatatatatgtgagaaataaaaatgaacgagagagatgtnaaaagctatattttcagcttcgtcattatattcctttgtataaaaaagagcttcatccatgaaactgtttaaaaaaaagaatatttggcaaaaaaaaaactcaaaacaactcatgcatcagttaagccgggccgggctaggccatcaagagctgcatgcttgcctccccagtccgtatgttagaggtaccgcatacggatataaaaatacgacgaatttttggatataaatattgtattttttgttggacggatacggatactattcgaatattgaacctcgagtaggatatagaaacattattacaggtaagtatctgtaaatcctaggtaggatacgaatatcttcgggtggagtactcggttgaaagtaaaagtgtacgtgcgcatgacgcgtgcggctaggcttgctgctgggcgatgcgtgctggattctgcgtgtttttggttgagaagtcggacacaaatagagtgattctattctaattttctgaatatttggtttctaaaaaaaaataagagcaaagcggcttttggatccctgtatagaaattttacaataaatagttggaacactcccgctccataaaaacaactggacgcaagctctcccctcttttcacctttatacttatacaactctccaaccaaacaaagaatgtagcggttctgttttattatactcttcaaccaaacaaaaattgagcggcattgttctttttgctaaacatagaatagaacggcttcattctcaaatactggaatgtaactactacattctatttaattctccaaccaaacacactctaagagtccagagctgctctagaacctggccacagcgcgtgcgtaggccgtagctttctgttaacttttgtatgtctcgtattattgatttatctagcgctagtacatcgttaacattttggaccagagcatgcatatggtattaattcatagaactattacggccagggacaacctaaccgaggtacaaaaatgaatgacgtgagcttgctagtactgtgaaaatagagaaagtattccacacttgttcctgcttctggagtgagttgtaggcgaatag

SEQ ID NO: 20015 - DNA, 1480 bp, Zea mays
cccgttgccgcctaaggaatggccgcctattttcagtccagagcccttgccagccccatccctgctgtgatcccgttccctgtcgccctttttccatttcgcaccaccttgatcaaatggagttctgtcgagcttctgatgcttcagcctctctacaccctccgtgaatctcgcgtcactgcttggcaagggtgcagacagcacactccaaagagaaggctcactgaagcagcttttccctgtttcgtcaaatttgtggcatcgaacaagagtgcgtttggcaaaagccaaggctagctgttttgcagctttgttggcagatttactgacaccagccttgtgactagagccaatccgcccacccttgagttttctgtatgctctttcaaccaatttgttcatagcatgttgctccaagctcctctcctcaatattctttgtatcttgaattgatttatctagcttatgtaatctgcatttcttctggttcacctgatcatgcagccttttcctcagctctgaaatcattttattaatgtcctcatcttctccgtcatctagctttggcactgtctctggacaaatgccaatactttgcagctcaattaaaatcttatcttccatagacatctgcccatattgatactcatatggagacaaagggaaatctttccctggattttgacattgccgtggagtcagtggtatcaagtcatgcaaagggccactttctgggtatactgtaaaatttagtccgtctgataaattctcactatgaactgaattttcactgttggacttgtgagctctccttgtaaaaccattgcacatgctctgatgtaccacagaagtactgtttgagtgcacgaaatccacactcagcccaaaattagatgttatggtactagcttgaagttcattttccatgtatccgttgacagtgtaagggttgtggctatttggaaattcaacaagtatatcgctttgcaccccattggtatcccgccaggcatcttccataattaaagccgaaaggagtctgtgtgccattggagccatttcattaagccatttatcagcttccagcttttgtggtccagtatggattttgtcaccatgagaaaaacagccgattaatccttttgctccaactccattagttttacccggccgggatgagggggggaaattagacagagcaagtccctgagatgaatgctcctccatctttgacattattctgtgatcaactgatgctataatatcatgttcactgtcatacatgcaggacatgctcatctcaagctcttcaacaaggttgatctgattttttaagaaagaaaaattttctgagctcataaaagttagcatgggttccactttcttccaaaaagggccagaataggcactaacaatagcgctgcgagcagcattaacagcagctaaaagctcctcttggtcatcttgtggttcacctgtt

SEQ ID NO: 20016 - DNA, 2885 bp, Zea mays
agcctttttttttttttttttttagtctacctacatcacgccttcatattacaccggtgacaatggtacagtattcagtacagccacaatgcagtcagcaattaggggaacacccaaacttctgattcctaaaaaaggttacaaaggagtgctaatgtcaccgatcatatagtgtatatatccagtgtgttcacaaaggaccaagtggagggatggagtaacaacatcgaaaacaatcaaccagaatcatcgcactccaatttcgctgatacaaataatttacgcctgcaatgaatcaatgacgttcctccggtccacaactccaccctaaaagatgctcccataatccttccttgtcgtaaatgagtgccctcttgttcctccccagggcactccatcgcccatgccaaaactactaggccacgcaggctgcccattgtgatggcttcccattggccgcattggactggaagttgcctgattatatcgctgatggagaattggctgtccatgacgaggacgggcattttgctgaggataattttgagggttgtaaccaccgtagttgatgagaacactggaatgggcactcactccttgagaggacacatgaaataattgatctcctctttggtttgtcggtacagggttagatgtagcaaagatgtggtcttggccagttgcatctccaaagtggaggttgctgcttagatcagctgacagtgaattgtcttcttgcaatagtgactcatcactataattagggtcccaattagcaggatcaagtgtcgatgaagctgaaaagtcaaatgattgtgacggagccttcgaaggcacatgactagacgaggcctccaaggaaataccactccttgaacctatttttggtctccaaccagaatgataagaactaggtaccgctgcattatgagagtggcctgtatgtccttgagcacaggcatcagaatgactaaagctgacaccatctctaaaacgcccttgtccatgctgagatacataatcatgtggtggcattggcaagtttctcctcatgttgtatgggcccactgctgcagcttttcctaacggagaaccatgaatgactccacttgcaggagaaccagaaccatgtgtcccagtagaattagctgggatttgcatatggtagttcggtggggtaaactgtgatggactggctccaacagacataggcccaagactaccagggctcaatcgaattcctctatcatgtgagagacgcatccttagtctaacatctggactagggccaatttgcgttaatccagaagaacctaagggtgagtaatacatattgatagcattagcatcaccaatgcttccatagctgttaccaaaaccagcattaccagtatagctgccatggctaccaaagcttccataactactcccataagaaaaaggaacctttggagggtagacattattcaaaggtaggtatctgtttacacttccaacctgcggggaaagacctgaatgtagccagtgcccccctccaggattgtgatcaattgctgctgcacgagcaacaggaattcttgcagtctcgggtattggctcatatggaccagtaaacgattctcctgttatgaatggatggtgtagagcctgcaatggtgaccatcgcttatttggatcaaattcaaggagtcccttcaagaaatcaactaattcccaaacgatctgttttctctgtctctgccagttcagaattgttccaaggataggtacatatgagtctgtcaagcttcaggtgtgggaagtaccactttcccatcttttgcctcttggaatctctctgcgcttcaacctcttcttcacttaaaattctgtatgcactagaaagaccaataggcgccgcattgccagcatatatacttccaacatgtttaaaaaacccggccgcgtgggcggccgcccgtagcagttcatctggtggttggcctccgagaattttcaccattctctgaagcacatcatattctgttgctccaggaaacaatggcaagcctagaaacagttcagcaactatgcagccgaatgaccacatgtcgatcgcagtagtatatggatagccaaggagaacctctggagacctgtaatagcggctctgaatgtacgagtaaactgttttaccctccaggcacgctgatccaaaatcaataactttcactgctgcagctgttgcgacgctgtaaaattcatctttttacgctgtcaagctacggtattctttaaagtagtaacccaaaaactatgatggaaaactcccacggccgcagcggttgcgcccctgggagctaacaggatattttctggcttcagatcacaatgaattattccagcttctctcatcacaaccatggcatccaatatctgttttgagaaggcttgaacatatttcaatttcagacctcttaagtgattccttttgagcagttcatacaggttttgaccaagcatctcaaaagctatgcacaaatgattttgaaatgacaaataatcaagcatacggacaatgttatgctgatcatcaggatcaaatttctgatttaacgttcttaatagtgaaacctccatgatagcttgatggtaaaatgtaggctggttttttatcaccttcacagcaacatagtcattagtttctgtgtcccagcacttgactacttgaccaaaagttccctgcccaagcatttccttgacaataaaccttctgtttgacatcttattaaccaactccaagttgacatacaatgtgagatcccaatttgcattgtcaagcccatcgttgtgggctggggtagagggattcgtgaggaaacgttttggatttagaacctctgagt

SEQ ID NO: 20017 - DNA, 1500 bp, Zea mays
  misc_feature (8)..(8): n is a, c, g, or t
cgcccctnttttttttttttttttttgttttttaaaaaaagggcttcattggtttgctattgtcatcgatcatatattgtatatcaactgtcttgttcacaaaggaccaattggagggatggggtaacaacatcgaaacaataaaccagaatcatcgcactccaattttgctaatacaaataatttacgactgcaatgaatcaacgccattcctcctgtccacaacacactaaaagatgctcccataatcctttcttgcaagagatgaagatagcccacttgtcgtaaatgagtgccctcctgttcctccccagggcactccatcgcccatgccaaaactaggccacgcaggctgcccactgtgatggcttcccattggccgcatcggactggaagttgcctggttatatcgctgatgaagaattggttgtccacgacgaggacggagattttgcggaggataatttggagggttgtaaccaccgtagttgacgggaacactggaatgggcactcaatccttgagaagacacatgaaataattgatctgctctttggtttgttggtacagggttagatgtagcgaagacgtggccttggaaatttgctgacctgatagatccactcccttggccagttgcatctccaaagtggaggttgctacttagttcagctgacagtgaattgtcctgcagtagtgactcatcactataattagggtcccaattagcaggatcaagtgctgatgaaggtgaaaagtcaaacgattgtgatggagcctgtgaaagcacatgactagacgaggcctccaaggaaataccactccttgaacctatttgtggtctccaaccagaatgataagaactaggtcccgctgcactatgagagtgacctgtatgtcctcgagcacaggcatcaaaatgactgaaactgacaccatctccacaacgcccgtgtccatgctgagatacataatcatgtggcggcattggcaagttcctcctcatgttgtatgggcccactcctgcagattttcctaacggagaaccatgaatgcctccacttgcaggagaaccagaaccatgcttcccaaccgaattagctgggatttgcatctggtagtttggtggggtaaactgtgatggactggctccaagagacataggcccaagactaccagggctcaatcgaattcctctatcatgtgggagaagcatccttagtctaacatctggactagagccaatttgcgttaatccagaagaacttaagggtgaataatacatattgatagcattaacatcaccaatgcttccgtagctgttaccaaaaccagcattggcggtatagctaccatggctaccaaagcttccataactactcccataagaaaaaggaacctttggagggtaggcattattcgaaggtaggtatctgttgacacttccaacctatacaagtttcaagtatacggcataatggtttaagaaagattcggtat

SEQ ID NO: 20018 - DNA, 1612 bp, Zea mays
tgcagtcccccactaaccaaagcccttaggggcttgtttagatactttattcacttcaatacacatgaatttaaggggactgtggtatccaaacataacatagcatagatggtttaaacttgagaaatatgacagtcccaaaatgcaatatgttcataaaattcaaaggattacacaaagatatccatcaattcgactcccatttcagatataaccatcaattcgattccatttcatcatcgtttcaatccagcagtagacacccaaccacacaatacattttcaggactccacgatcgccaagaaacagatcaggaactagagcagcacatacggcgaccaccactcagtgcttattcctcggcgaggtcctccttgacccagccgccgacaagggcgccgcggctgttgcagcagccttcctctttggcgacaacctcgccggcgccccagcagcgggtacagaagccttcctctttggcgaagccctcggcacggtagccttcctctttgttgacgtcgtcgccggcgtcgcggcacccggcttctgcttgctctccaacaccagctgctgctgctgctccgcggcgatgcggtcgaactcgtcgctgagcttcctcgcgcgcctcttcttggcggcggtgacgatggccgcgaggggctcgtcctcctccgactcgccggacccgtcggagtcctcgtcgtcgtcgacaagctcacgcttcagggcccgctcccgcgccgccacctcctgctcgtcctcggagtcgccgctggaggcgtcgtcgtcggacccaagcgcggcgagcgaagccggcatgtggccagcggcgcgggccttggccttggccttgaccctggcatcgcggtgcgcgcggcggcggagcttgtcgacggagccctcgatgcggccctgcaggcggaggcgcttcacgctgatgccgcccatggaccagtgcgcttcgcgcgcccactcgagcagcgggtcggtgacggacgccggcgggtccacgcggtcgcccgggaagaagcgcggcctcggcaggccgctgccgtagaaccggccgggcccgagcgccaccaccatactggactgtccctctcggttagttgtggctctgtcgctctagcgtagatctgccctctctctctctctctctctagatctctgtaattgcgaacgtggcgtggtctgtggccgggagaggaatcgtgagggagtttataggagaagaggaagcgcggcgggaaaggataggcgagtttggcgccaagaaaatggcggtaaaatgctcgaggggaaattggatgatcgggcgggcgcgggagggaaagccgcatcgtgtgaatgggcgcgggggaaatggcgggagcccactgctttccgcgcggcgctgacggcagggccccaccggcccgctgcacttctgttcccacgaacacacggcccggttggagactgagttgaatgcttgcttctctttccatgtagatttttacatgcgttatttatgcatgtagaaacatgtagattttgttttttgaaatttgatgttacgatttatttgtatattatcgattacattatttttagtataattatctattgagc

SEQ ID NO: 20019 - DNA, 1920 bp, Zea mays
  misc_feature (1612)..(1612): n is a, c, g, or t
  misc_feature (1752)..(1752): n is a, c, g, or t
gggtgccatggcacagcagagagggattcaggacaacctaatctgataccaaatgttagcaccttctaaaagtctataaagcagggaagggagaaagcaacagagattggagacttggagaagaagataggcaacacgacagttgtattgttattctattcatatccccaacaagagtcagccactgaacatatatatgtgtgactcgctaatggaccacttacacaacccactgcggcccaatcacaacatacgaatacagcttccttatcctcggagcgtgcgactactgcgacattgcctgtcttgttgttgctgaatcctccacttcctttacgtgcaaatgtgctgacacaaccgtcaattcaattccatttcaaatataaccatcgattcaattccattgtatcgtcactccattctcgttttttttttttttttttttttttcagatatggccatcgattcgatttcattccatggtcattccaatccagcaattgtgcacagccactgattacacattttcagaggagtagcaccccacgatcgcaagattcacatcaataaacaaaacagcacatacagcgacctacgctcagtgcttgttcctcggcgaggtcctccttgccccagccgccgacgagggcgcagtggccggtgcggcggccttcctctttggcgacaccctcgccggcgccccagcggcgggtgcagaagcctgctttctcttcggcgacgacccagcggcgggtgcagaagcctgcttcctcggcgacgtcctcgccggcttggccgcacccgccttccgcttcttctccacgaccagctggtactgctgctccgcggcgatgcggtcgaactcgtcgctgagcttcctcgcgcgcctcttcttggcggcggtgacgatagcagcgaggggctcgtcctcctcctccccctccgactcgtcggacccgtccgagtccacgtcgtcgtcgacgagcgcccgctccggcgccgccacctcctccgcctcgtcctcggagccgagcggggacagcgaggcgggcacgtggccagcagagcgggccttggtcttggccctggcgtcgcggcgcgtgcggcggcggagcttgtcgatggagccctcgatgcggccctgcaggcggaggcgcttcacgccgaagccgcccatggaccagtgcgcctcgcgcgcccagtcgaggagcgggtcggtgacggacgccggcgggtccacgcggtcgcccgggaagaagcgtggcctcggcaggccgctgccgtagaaccggccgggtcccagcgccgccaccatggcgatctctctctcctctgtgacgcggatctcggtagatctgccccgctctggattgctggtactgcaagcgtggcgcggtgtgcggggtggggcagaggaatcgtggcgggcgtttataggaggacggggaggaggggaagcgtggcgggaaaggataggcgagtttggcgccaagaaaatggcggtaaaaggctcgctcgagtggacaatacatggcgggagggatagccgccgcgtcgtgtgaatcggagggaaatggcgcggcgggagcgtacacccgttgcagttcgattnccaacgaacggcacggccccgcgggtgttgaagtggctgctaattacgcgcggaagaagtgtaataagtaataaatgcagagtgttatagtatatggttaggcccatgtggctagatttatgtaagactatatagctacnctctagagttagcctaataatcaatctactgtctctaacatggtatcatcgagctacggtttcctccctcccttctcttcagccgccacttccctgcaggcgtcgccgccccctgctcgcgaccgtcgcgcgggcctcctccgcgcgccgcaccgtcgtccgaattga

SEQ ID NO: 20020 - DNA, 1001 bp, Zea mays
ctggtatgttatgaaaatttcagctacaaaattaagccgaacaacatttaatacatcttaccggtgcagaacaacataatgtatgaccatagctctcatcatagcaacaatgtaaaagcaaagtgttatatctatattatccccagcaccagcacaatatgctgatagctattataatactcatttggccattacagcagcgatgccccattttttggtggaaaagcagggcaacaacagtggatggatgtacatgtaaaggctaagcaccactaacaaacttttcagcaaacaacatgagaaaaaagttatagataattcatcagagtggtcatgccaatttcaaggagccggagtggagtggaagagggtggcaaagcaaccatcgattcgattccatttcattcatggtcattccaacccagcaattgtgcacagccactcattacacattttcagaggagtagcaccccacgatcgcaagattcacatcaataaacaaaatagcacatacaacgacctacgctcagtgcttgttcctcggcgaggtcctccttgccccagccacccgacgagggcgcaaacggccggtgcggcggccttcctcttcggcgacgccctcgtcggcgccccagcggcgggtgcagaatcctgcttcctcaccggcatggccgcacccgccttccgcttcttctccacgaccagctggtgctgctgctccgcggcgatgcgatcgaactcatcgctgagcttcctcgtgcgcctcttccaggcgctcgtcgacgacgacgtggacttggacaggtccgacgagtcggagggggaggaggagtgggactattcccaacaagccggtcagaccgtcagagaaggaagggaggtaggaaagggggacgaggctgcttggcatacctcgcgactgcggcctcgaggcggggcgatggttaggcccaacatggacgacagagacatggtggcgaggtcgggaggaggcaaacgcg

SEQ ID NO: 20021 - DNA, 1144 bp, Zea mays
  misc_feature (2)..(3): n is a, c, g, or t
cnncggccgagaaaaaaaaataaaaaagaaaagatcctggcttttgcccacgcttatcacctcgcccacctcccggccggcccccaaaaaaaaccagtgcgagctgaagcatccaggctctggaatcatcgtcgggatgtctgtgccagcatcagcccaggtgcctcacaccatacgatctgctgggagctgctgcttcaggtcgtcgcatcaactatctgcgcagaatctgggccgacatcgcaggtggcgggggaccggaaagaagaagatcctttccacccgtggcgtgcttgagtccagaaacggcgcacatcctggtggccttatgaagagaaggaaggtcgtggagcacatcatcctgctcagagccaagcccaacatctcagacgctgaagagaaagacatgctggactacctatacacatcgcagtaccagatgcgagggatactcgcggtctcgctaggccgcatcgaggaccccaacagcgacaacttcacgcacgctgtgttcatgcgtttccagcagaagcaagacatcgcggagttccagagtaacgcgtactactccaaagttgtcgacgagcacgtaaagcccgtttcctatggctcggtttctgtagatttcgagtccgaggtggaagacgacattatacctctctttcgcaggggagaggattttaactacggcgtcgagtttatgctgctggtgtctttcttgaagactgcgtctagagaggcaacggaggacgcattagcgtctcttgacaagttgatcagccaatgcagcgcttctattgtgcaggcaacatgtggctgctgtttggatcgtccggataacgggtacagtcatgctgcagtaatccgtttcccatcatctgatgagttgaagctgttcagggagagcgaggagtacaaggatatgtgggcgtccaagttccgcccgatcgtggagagatccctgcacctgcacttcaccgttgaccccgtggggaaccagctgatgtagaccaaccgagtggtcatccctatacatgggaccaagagcatctgtactgtacagtgtaaaacagagagatggggtaatatagaggataccgatagggtcaacaagtgccagtgctcggttacattacatcacggc

SEQ ID NO: 20022 - DNA, 1517 bp, Zea mays
cccatcgcgtccgcccacgcgtccgcccacgcgtccgcaaaaccataaaaaaaaccagagcgagctgaagcatccaggctctggaatcatcgtcgggatgtctgagccagcatcagcccaggagcctcacaccatacgatctgctgggagctgctgcttcaagtcgtcgcatcaactatctgcgcagaatctgggccgacatcgcaagaggcgggggtccggaaagttgatgatcctttccacccgaggcgagcttgagtccagaaacggcgcacatcctggtggccttatgaagagaaggaaggtcgtggagcacatcatcctgctcagagccaagcccaacatctcagacgctgaacagaaagacatgctggactacctatacacatcgcagtaccagatgcgagggatactcgcggtctcgctaggccgcatcgaggaccccaacagcgacaacttcacgcacgctgtgttcatgcgtttccagcagaagcaagacatcgcggagttccagagtaacgcgtactactccaaagttgtcgacgagcacgtaaagcccgtttcctatatttcgagtccgaggtggaagacgacattatacctctctttcgcaggggagagactgcgtctagagaggcaacggaggacgcattagcgtctcttgacaagttgatcagccaatgcagcgcttctattgtgcaggcaacatgtggctgctgtttggatcgtccggataacgggtacagtcatgctgcagtaatccgtttcccatcatctgatgagttgaagctgttcagggagagcgaggagtacaagtatatgtgggcgtccaagttccgcccgatcgtggagagatccctgcacctgcacttcaccgttgaccccgtggggaaccagctgatgtaaaccaaccgagtggtcatccctatacatgggaccaagagcatctgttctgtacagtgtaaaacagagagatggggtaatatagaggatcccgatagggtcaacaagtgccagtgctcggttacattacatcacggcaaaaaaaaaacaaaaaaaacaagagaaaatagcctcccttgtcgctcaggagctcagatagatagatagacagatagatgctgagcaccgaccgagttgaggtccctcttgagagttcagttgtgcagcgggtttgacccctgcggcacccttctcttagcctcggacagatcctgcacctgcacgactcgcctccagccaagtttctgttgaccgtgctgcctgaaagacgacgtcccctcggcgtcggattccggaacccgtcggccgtggcagaagaggcctctctgctctgctcccaagaacgagactgtgagcactactactaccatgagcctgaccaagctttgttgcggcaatcccatgctttttcaggcagggtttcacaagcacaagttggagatggcaagggacggtagtttgtaatacatcacgcacaagcaacggaataaagattttatatacgcagacaaaaa

SEQ ID NO: 20023 - DNA, 4107 bp, Zea mays
  misc_feature (2942)..(2942): n is a, c, g, or t
  misc_feature (3086)..(3086): n is a, c, g, or t
  misc_feature (3344)..(3344): n is a, c, g, or t
gccacggggagcacaacggacacagtggagggcgcccagtctgcgtgccaacttccttgccacgtagtggagactggaggcccctgcgtcgtcgcctacacccctgtgcctgcacacccgtcaacgcatcaagtggaaccgcaccagcaccagcgagtgccccctactcgtgctctcagtaagtcagtagtcagatcccttaattcggtcactttgcttcaacacttcaattcatgtacatacatgttagcatttgatggatcgattcaacacttgaaatcctggttgagatggcttgttgttggttgctacattatggttggatcaggggaagactcctgactgtcgttctcatattgcggcgaaatatggggtacttgcaattctgagattttatagtactcatttagtgtagtggttatgctggtaggtagtgtaagaccatgccctgagccatcagcctgcgggtgctcttgatctaaattttgcactgattggttgatgagctttatcttatccatagacgctgatgcactgtctacaatttggatgccatttggggctactgaagctatgcatgtcctatctctagtgccggtatttttttctattagtaaaccagagctttattttcaaagagaaaaccaatttcaacaaaatagaatgcaccactgcttgtgctgctgaaatttgtttctgagaactacatgatagtgcatacttgcagtttaatttgtttctgggtattaattatctctgtcggagattgagctggcaagcacttttgtacactttctgacattttattctgcactgctgtgcacattctattggctttatgttgtttttacttgacaatgcaattgtatggtatcaccagtagtatctaacatgcgtacacatctattgggctcaagttgaatttgtagcttcaccaaacaaaccatacgctatatgtcccttagaaaaactatgctaccatggatgttagttttagctaccttcctgccaatgcttagagttatttacaatataccctagggcaatcaggctaaaatgtcaacttctagcctttccatcatgttatttatttgtatttacatgcttacatatgcatcaaccaaaaccacatgttatggtgaaggacaagatatccatttatttcttgcagtgaatgatagagaactttaccctctttacttcatagtttcttatctctgctcttttcatgccttgatggttttatttcccttctcacttcttgtttttactaggaactatcagatgtaattatttggggatacttctgggttttgcttgttctttttcttgcagtcctcttgtctatgtctggattacaagttcaagctacttgtctataactaatcacaggacactttcccatttttaggcagtgaggcaatgtttgctaaccttggtcactttacaagtacatctgtctgtgcctaggtttgtgtcttcttctttatctggttcttgctttatttgttgattattttggctctgctacaaatccttgctcgagccacggtagtgtttgtcgtgtgtgtgcgtgcgcagcatgacactgtttaagttgtcgatctcacggataaagctgctacggaatcggtgggagctgcagctgcgccatcctcgtggtcggccaggagcccccaccgcacggatcaaggtacactcgttgtgaagggatatgcttggatcagagtaggggtgggtgagggtgaggactgtccatttatcaccttcaatttcttttatattttctttggattttgacactctcctttcttttgcttgcttttctcgtcggatctgacttgaggatgtgatgacaaaaaatacctacctatttttagatccctgacaagagaaaccaatgaatacttctgagcctttctaagatttttcttttttgtttggtttaggttctctatgcttaaaaaaggaaaggaaggtaggatttcagccatgctcttatagagtgactggtgctcaaatctagaaattgatatcaccttaggtttcggttttgagtgctcacttctctgaatctgtagtatggcagtttgattaaagtcttagtataaaatgtcttccaaatttcacgcactaaataaagcagcatcgggagggccatttcttgaattttttgtctgcactttattcaggtgaaccaaaattttctcccaggtcttcgaactgaaatacagtagtactttagaaccgcaacactacaacaaagttgccactgcatgtaaattagacaaacagagtgtgcacacaaccactgaaagacacatttataaccaaaattcataagttggcaccggggaccctaggtcgccgtcgaaggcagcgagcccccacgacccgcacatgaacttcaaccctcgcactacttcgtcaaggaggtggtcaaaggcatcgacgagagcgacctccaaggctccactagacgtggatcaaagtcttcgccacgcacaacgcccacgagcgcatcaccaagctcgagaacatgtgctggcggatctggcacctcacgcgcaagaagcaggtcaggatttcgcacgtctctttcgtggttatgatctctcgctgcttgttctgttttgttaataatcttgctcgcctctcgattcatgttttgtatcagtttgatctctattttaatttgatctctgttttagtttgatctttgtttagtttgatttttaagtgttctctgtttactgaatggagatgcatgattaatgaagcgcacactgcacaacgagtacaatctatactacaccataaggaactaccgagggcgccaatctccatccggggtcatctctgcaacttcgcaatcatcaatttggtactgctgtttttgaaaccatgcatttgtactgttgttttttttgttatggtgttanggtttcatcactgacagtttgtgtaatgctttatcagtgtacactaaatctactactatttcgagaataattgtaaaagttgaagcaagttctctgttccttcctatttgacttaaaccctaacacccttggcctttttatcantgcctttagaaccttccagtggtatttgtttgaggggatttctgcttgtttattcaataaatggtttagggtctcatacattataaaaccctttatatcgtgaaatgtgatttcctgtttcgtgaaacgagcaatgcatttttgtagtaagcgaatacataatgtagttctgctcatgggagacaaccaagtagacatagctgcattggcaacctgcaggctgttgatgaaatgccatggcagtagcccattgatggnctgaggtgactggccaatgtcaagtatgaagactcaatttggtagagaaagaggtcaggattatttgagtcacaaatactgtggaaggaactatcagctacaaaatataattgggatcaatcgctagaaggattctcatttttgaagtattattttcatcatgcaattaaaactttcaatatcaagtaggttatttattatttcagcatgatttctgccaaaggaaacactacttttgtcttctgaatgcatggtgaggaacatgtttactagtattagtatactgcttgctgcttcaatgtttcttgtgtatgtgcagcttgtcgatttttcagagatttaagaagaacaattcgactcttgtgtggcgtctctggttcatgcatgtgtcatatattaagagactacaaatgtcccactacataagttgtctttggttagatgctttggcccatatttttagtacaatttcaaatttagttcctttatttagtaagtaaataacatgcctatgatagaaaatggatatgactatagcaaaatttgaccttattctgctacaagttagattctaggagaacgaattggcatgagtactgagtacatattctgtccatctagtacattattatataactgattgattaagggaaaatgacacttagatataacttaccctctcacactagattagttgtactctttaatgctagagagaaaatatgtgtgttaaaaaaataatagacacattttagcttggcac

SEQ ID NO: 20024 - DNA, 1988 bp, Zea mays
cacgcttatcaccactcccatctccatccaaaaccataaaaaaaaccagtgcgagctgaagcatccaggctctggaatcatcgtcgggatgtctgtgccagcatcagcccaggtgcctcacaccatacgatctgctgggagctgctgcttcaggtcgtcgcatcaactatctgcgcagaatctgggccgacatcgcaggtggcgggggaccggaaagaagaagatcctttccacccgtggcgtgcttgagtccaggaacggtgcgcatcctggtggccttacgaagagaaggaaggtcgtggagcacatcatcctgctcagagccaagcccaacatctcagacgctgaagagaaagacatgctggactacctatacacatcgcagtaccagatgcgagggatactcgcggtctcgctaggccgcatcgaggaccccaacagcgacaacttcacgcacgctgtgttcatgcgtttccagcagaagcaagacatcgcggagttccagagtaacgcgtactactccaaagttgtcgacgagcacgtaaagcccgtttcctatggctcggtttctgtagatttcgagtccgaggtggaagacgacattatacctctctttcgcaggggagaggtatggccatggcctaaatcgatcgataccgttctttctttttttctttttcttttctttttttggcaacagaaagaagaagaaaaatgtggcaggattttaactacggcgtcgagtttatgctgctggtgtctttcttgaagactgcgtctagagaggcaacggaggacgcattagcgtctcttgacaagttgatcagccaatgcagcgcttctattgtgcaggcaacatgtggctgctgtttggatcgtccggataacgggtacagtcatgctgcagtaatccgtttcccatcatctgatgagttgaagctgttcagggagagcgaggagtacaaggatatgtgggcgtccaagttccgcccgatcgtggagagatccctgcacctgcacttcaccgttgaccccgtggggaaccagctgatgtagaccaaccgagtggtcatccctatacatgggaccaagagcatctgtactgtacagtgtaaaacagagagatggggtaatatagaggataccgatagggtcaaaaaaaaaaaaaatgctcggttacgttacattacatcacggcaaaaaaacaaataaagaaaaacaagagaaaatagcctctcttgttgctcaggagctcacagacagatagatagatagatagatagatagatgctgagcaccgaccgagttgaggtccctcttgagagttcagttgtgcagcgggtttgacccctgcggcaccttctcttagcctcggacagatcctgcacgactcgcctccagccaagtttctgccggccgtgctgcctagagatgtcaatggggacccgatacccgctaacccatggggaattcccctattagggtacgggtatgggacaaaaattgtccccatgggtatggatatgggacaaaatctccacccattgggtaaacgggtatgggtttgggaagcaataatccgaacccgattacccatgggtatttcatacgtgtacacctctcctgtttgtatgaatgagttaaggccgagccgaccatcaagcctagcacggcagcgcaccaggcccaggtcctagcccaataaggcaacatggcaagtcatggttcatggatgagtgttttctgatgtggtgatgtctgaaatctagattatttgtgctacctgttagtacctagttatctcttaattggggatggggacccattggggacccgaaacccgaatgaggatgggtatcggatgagttttgcacctatgatgggtatggggatgggtatggggatggatcaaacatgatggggatgggtatgggatgctataacccggtggggaattccccattgacatctctatcactgatcgcggc

SEQ ID NO: 20025 - DNA, 2474 bp, Zea mays
  misc_feature (2295)..(2296): n is a, c, g, or t
cgggccgcctccccgccggtgcctgtcccgaaagagaagtgcgcccgggccccgacgggagggacccctaatctgtcacctcccccaccgcacccccgtagcctcttcaatctcgccggccacctcacgtcctcacctcgcgtggcctcccgttctgacttcggagtccctcggtctcaacgactagttgagagctcgcggctccgttcgggcgaggggaggaggttcatgaggctgctgtaggctccgttgcagccgccgcgggcgggagtccgtgattttggacgccccaccgcggcaagatccggaagcgcgttggctgttgtgccgtgagtttcagtttcggtggtcgattgcttcagcctgctgagaagtaggaggggcggccatggcggggtcgaggttcgggtcgttcaagtcggagaagggcgactccgcctccgcagcggcggcagcgggtggagcggcgcagaggagggacccgtacgaggtgctcggggtgggccgcaccgccaccgaccaggagatcaagagtgcgttccgacgcatggcgctcaagtaccatccggacaagaatggcgatgaccctgttgcatcagacaggttccaggaagtcacattctcctataacatcctgtcagatcccgataagaggcggcagtacgatacatcaggatttgatgcaatcgaatctgatagtcaggaactggagctggacttgtcgagtctcaacactgtaaacacggtgtttgcagctctttttagtaagcttggtgtgccaattaaaacaactgtttcagctacagttttagaggaggcattgaatggttcggttatggtttctcaactccagctaggaaactcagtgcagagaaaggtggaaaagcaatcggcccatttctattctgtggatataactgaaaaacaagctaaaatggggctagtttgtcgtgttcactcaaacgataaaagcaaattcaagttgctatattttgagcttgaagaaaatggcgggcttagtcttgcactacaggaagacagtgtgaaggttgggaaagttactgctgcagggatgtatttccttggttttcctgtgtaccgttttgaacaaaataacctggcagctgctgcaaaagattctgatggtgcattctttaaaagattggatagctttcagccatgtgacatacatgaactgaaacctggaacacacttctttgctgtctacggtgacaacttcttcaagagcgctagttatactatagaggttgtatgtggtgaatcttttcctgccgaaaaggagatgctacgaaatgtggaggccaagatactcacaaaacgagctgaactttccaaatttgagtcagagtatagggaggttttggcgaagttcactgaaatgaccagcaaatacacacaagaaatgcaagcgattgatggccttctgaaggaaaggaatgagatccatgcttcctataccaacaatccacctctaaaacggagttccagcaggaataaagccaagtcgccttcgaaagtggccaaaactggtacagaaaaacatcatcagaaggaaaagaaggtgaaggatcactgcatggagggatgtggaagtgacagcgataactcaagtgaaaagaaatcaaaagagcggttcccaaggaagaaatggctgaaccttccattcaaacttgacaggagaaagacgtgctgagcaatgtattatatgttccgttgctattctatcctgttatgcataatcctgagctgaactcacatttcttctctttctcatgcttttataggaagtccctctcggcccaacactagattgatatacagagaatttccactgtggcctcccgaaccaagccctctcccactgctaccaccttccttcgttgtacccggattatttcgtgtaaagatcacatgtgatcctaagaattaaaacgtgagtcgttttagcatatattgtgaagcacgtgctggcaagttgccgttcttggcattgggtcaaattggggtgccctgcttccgattccgtgctgcaccgtgcctatgtagcatgtaaagttgtatatgctgcgaatcgtagtacagctatatatttgtgtgtcctgaatcttgagtgtctttttactgccttctgtaaatgctccccaactgatgtaaatacaaaattccatgttcctcgcactaggatccgtgtgccaaattaaaaaaatctaaaaaaaaaaaaaaaaaataaaaaaaaaaaaaaaaaaaaaaaaaaaaaaaaaaaaaaaaaaaaanngggccgtgtggaaaaaatgggaaaagtttttcctgaaaaaaaaaaaaaaaaaagggccccttggtccgcaccttttttctctttttagtagggttaaatgccccctttgggcccccgtgggaaaaatttgggcatggttttcccccaaaaaaaaaaaaaaaacggcccccccgacccc

SEQ ID NO: 20026 - DNA, 1016 bp, Zea mays
accgttttgaacaaaataacctggcagctgctgcaaaagattctgatggtgcattctttaaaagattggatagctttcagccatgtgacatacatgaactgaaacctggaacacacttctttgctgtctatggtgacaacttcttcaagagcgctagttatactatagaggttgtatgtggtgaatcttttcctgccgaaaaggagatgctacgaaatgtggaggccaagatactaacaaaacgagctgaactttccaaatttgagtcagagtatagggaggttttggcgaagttcactgaaatgaccagcaaatacacacaagaaatgcaagcgattgatggccttctgaaggaaaggaatgagatccatgcttcctataccaacaatccacctctaaaacggagttccagcaggaataaagccaagtcgccttcgaaagtggccaaaactggtacagaaaaacatcatcagaaggaaaagaaggtgaaggatcactgcatggagggatgtggaagtgacagcgataactcaagtgaaaagaaatcaaaagagcggttcccaaggaagaaatggctgaaccttccattcaaacttgacaggagaaagacgtgctgagcaatgaagtccctctcggcccaacactagattgatatacagagaatttccactgtggcctcccgaaccaagccctctcccactgctaccaccttccttctttgtacccggattatttcgtgtaaagatcacatgtgatcctaagaattaaaacgtgagtcgttttagcgtatattgtgaagcccgtgctggcaagttgccgttcttggcattgggtcaaattggggtgccctgcttccgattccctgctgcaccgtgcctatgtagcatgtaaagttgtatatgctgcgaatcgtagtacagctatatatttgtgtgtcctgaatcttgagtgtctttttactgccttctgtaaatgctccccaactgatgtaaatacaaaattccatgttcctcgcc

SEQ ID NO: 20027 - DNA, 3608 bp, Zea mays
ctgtcactctgcaactggttgcgtcacacaattcttcgataacagtttcaatcatcctatcatttactttagagcataaccaacagtgatattagacctttaggatttgaaatctttggaagcaagagtaccagagaggattgagggagctagaacccctcactattcaataacaggcccttaaattggtatcacttggatttcttaagacagcatcacgcctaccctgatgtatacatgataacaaattaatttagtctaggaactagagtacaaggttacagaggctatctggcaatgccctctcctacagacaacgcatattttgcttcaggtcaaaacccgccgctagcatttgtcggctaacatatggtactattgctgctaaagtgctaattacagatacagtgagttggagaacatgataccccgacgcaaactctcacttgcatttttgaacttcttctcaaggttaacctcccctacggcttcagcagcagctctcaactgattcagaaattcatccagccttctagcaagtcttatgacacttccttcaaatatgtcggtcatttccatcacctccgcaaaggtggctccccttgaccaacagtatatgacatccataaggtagggtctgcaggttgattcaacatattcctccacatttacttccagtttgcattctcgttgtacctcagctatttttcttgcagcctcctgaagctgcatcatcggcctagaaagttcatttcttaggcgtatctgctcacttgatttatcacaaggtacaaagcagctagcaagggaagcaacttgatgatggtcaagatcattaaatgtaccattgaacataagttcagtgataagcagttcatcccctgtgtctattagacaggcagcacgtcctttcaactggagaacaccgtcagcatcaatatgccccagcatcttcagaacacgggaccggttcctaagttcatctctaaatttttgtagctgtgaatcccgcatctttgacttgagttgctgaatttcagtattcagatctgcttttttttggtaccatgatagttcctgttcactttgaccggacttatgaagtcggtgagagcattgtttctgctcaaggtcttcaagtttatgtaccaagtcaactagttcaggttcttgaatacccatgtcattgattggatgtagtttcggaagaccttgggggtagcgctttcctagttcttgcactgcagaaagtatattctgtcttgcttcaggtggtcgtagatcaggaggaatgttgattctaacactgcttagaccagatactaaaggcaatggtacaggcaccacatgcatttcacccttttcccctgggcgaggagggcatggctttgaacgtgatccattctcgctggaattagaggagcagtgaagcaaggtgtcgactgtatagttgttgctgcgcgatgcacttaatgcaggagggagagtcccagatgctggaggtttcttcactacatttacaaccacaccccatccccagtctgttgaaccatccctcactctaaccagccttccaggaaccaaatacaacaaagccctctctggtctaatcatctcagacatgattttcttctccagttcagatatatcaagccccaatttgtgatattcagcaagatcagtctcgccagaagaatcaagcaaggtagcttcattctccaaccgtgtaatcttttgagctatttctggcaatgccttctcatactgaaattcatggaatgaatgcctaatcacatgctcagcggtaaattggccctccacacggctcattaagttcagaatagtgtagtagctcagacggaaagtactgactagaggtgctggtttgcctaacaccatgtccttgataacactcatttccatcttctcatctatcattataacacagataccacgttcatccttgccacgccggccagctcttccactcatctgtatatattctccagaaccaatatagcggttactatcgccatcccattttttgacagacgtgaaaacaaccgttttcgcaggcatattaagacccatggcaaatgtctcggtagcaaagagagctttcacaagaccttcttgaaagagcaattccactagctccttaattattggaagtagtccagaatggtgtactgcaatacctcgtttaaggagtggcaacatcaactctatagcaggtaaacttctgtcttcctccactaaacaaccaatggcattacagaaaacctgctcaatgcattccttttcttcttcagtgctgaagtcaagttttgacatagacatggcatgatgctcacattctcttctactaaagctgaaaattatgactggttgaaacttgcgctccataatcatcttaacaattctgtatatgtcagaattcccagaggcgcttccaccttttgcaattcggccactcgctttaggtccaccacctttccttccatccagttgattatttggcttagcaaaggagtcttgtagcttcgcaaagttatcttctctaaactggccattttcatctactacaaggtaaagaccagaaccacctattggaaacatatagtgctgcaatggtgtgggcctgaagtccgtatacacaacatgacagggctgcttgtgcaggctgcatatccattcagcaaattcggtcgcattcgacatggtagccgaaaggaaaaccatcttgatggcagggggcaagaaaatgatgctctcctcccacacgacccctctctcacgatccttcatgtaatgtatctcatcgaatataacccaggcaacctccttgatcacctcggagcccctgtagagcatcgccctgaggatctctgtcgtcatgaccaggcatgtggcgttcggatggagcgtgacatcgccagtcatcagcccgacatctgtgaactcctgactgagctccctgtacttctggttgctcagggccttgagcggggaggtgtagatgaccctctgcttgtccctgaacgccatggcaatggcgtactccgcaacgacggtcttccccgcggaagtgtgcgcggagacaagcacggactcgttccgctccaggcaagcgatggatacgctctggaaggggtcaagcttgaacgggtactgcttggccatctccccattgaaggccgggctggcaagcgtcccgtgcaccgcctcgtccttaaccgactcgtacccattcgggacggctacctcgtggacgcaagagcgggagatgttcgggcgcttggccgccgggtccgcctgcgactgcgccggcgccggcgcgaggctcggctgctcttccacgctcgagtccggcgccttgcgcttgcagttgctctccgcctcttcccccatcggcccctgctcgacctaaacctggctgtgctcgtcgccggcgaagagcccgaagaagacctgggcagcttgcgttgggcgacagcggctgtcggctgtcgcccagtcgtctccacgagagaggcgagagggagacagcgcgcgcgacgtgggggcggggttggcggcggccggcgtgcaactgtgaatgcaacggg

SEQ ID NO: 20028 - DNA, 1827 bp, Zea mays
aaaatacccctctcttaaaccctccgccgccgccctctctcctccgccgtcgaggagcaggatgaggagcactcgcgggacgtggcgctcgcgctgctcgatgcggcgctggagccgcccgacgaggacgaagatgatctcggggaggtcaaggaagaagaccagatgtcgctttccgttggcattgtcggcgcgcccaacgccggcaagtcctcgctcacaaataccatggttgggacaaaagtggctgcagtttcccgcaagacaaatactacgactcacgaaattttgggggtgctaacaaaagggaacacacagatttgcttttttgacaccccagggctcatgttagggcaccatggatttccttatagggatgtcacagttcgtgtggagagtgcctggagctcaattaacctatatgatttactaatagtcatgttcgatgtcaataggcatcttaatttgcctgattcacgtgttataaagttaatcaaacgttttggtacagaggtgaacccaaaccagcggcgaatattgtgcatgaataaggttgacctggtggaagacaagaaggacctacttaaagttgcaaaagaatttgaagatcttcctggatatgaaaggtacttcatggtatctgggctaaaaggcaagggagtgaaagaccttgtacagtatttgatggagcaggcagtaagaagaccttgggatgaggagccaactgtaatgactgaagaggtaatgaaaaccataacgttggaggttgtgcgcgagaagatgctgcatcacatccaccaagaaatcccctatgtaattgagcatcgtctgatgggctggaaggagctaaaagatggttctcttagggtggagcagcacttcattgcacctaagcaaagccagcgtcagattcttgttggtaaaaatggttctaagatagggagaatcggtattgaagctaatgaagagctaaggtccatattcaagagagatgtccatctaattctccaagttagagttgcgaaaaagagaagtgcctgaacagacagattttagtgcctgtatagaccgcaactgatctgagaactgcagtgcagtgttgtcacaatgtattcaggagacatggttggtaagtggtgcttgggcgcatcagttcgggtgactgctttgacagaactttggatctatgatcaaatggaggtgccgagctataacctagcgtgtggagccttgatttctgaataaaagatataccgggagcaatccacacgccagtggtgacaaggaaacggcttgctgaatagcgagctgctgctgtgctggagaatctggggtctgtgatactgatatgcagatacgtctgcgctggacaccgttttgcctactcttctctgattcgaaaagtagtcccgctccttctcaggtctcagcctgtattttctataggttctttagacagtgttgtaacgacaggatgatcgagcatgtcggcgttgaagtttgctgctgatcttccgcggtgttttgaacagcggaaatttaaggatgaaatccggtggaaaatttacacgatggaaaatttccccgggacgtgcgcgtgctgtactgctgatacagaaatgctccctatatctatatttatcatcgtctatatttatcatcatttgaatgaatattcaaattgtggacataaaaaagtgagactacaaaaaaaaatattttgggttccagggaataccttatttcgcaaacttcggtgaccacgaattgtctaggactacacaaacacttcgtctgttcataaatattcataaatatatgacactg

SEQ ID NO: 20029 - DNA, 786 bp, Zea mays
atccatctggtaaccatcaggattgaattccacatgagcaagtatattatcatcagtgctagtgtcgcacagcacatccatatccacatgtagaacccatgcccttattaacaaagtgcaatacttctgcttttgataagaatcgctgcccagtaggtaggtgaacataaaacttgtacattttgtccattttcttcccaccggctctgacttcaatcacccacccacgtggaagccatgtatgtgactcatgaagctcgttgtcctcggcgcttgcctgcaactccaacatgcgttcttccacccctgagaaaagataatgcaatgtctccatctttgatgtgaacatgtatccggacattggggaagtgtagtacttgtagatggagccattgtcttcttgacaaacctccatagtccaaccgtcaggaagccaacccggcggctcatccaatgacccagaatcctcattcgactcatccaattcatgaaccactaagacctccttaccttgcctcccctgtttttctacctccacggtctgcttcaatgtgttgtcattagagataaccaggccattattctcccgcggggggagggaggttgcaggggagctggatgccggctcggacggcgctccgtcggccgggagcgaaccgctgccgctcctccgcgctgagcggcgagtctctaccataggacgcccggcgccggcaggagtgacatgcacgggagggtgcggcctcggtgaaaggtttggccgcaagcccgcggggaattttcccg

SEQ ID NO: 20030 - DNA, 3621 bp, Zea mays
tgctgcgctggcccaaacggacgacgtgacaccgacgtggtaccgagctcggcgccatagatcttggcgccgagctcggttttgttacaaaggttttctagctcagttggtagagcgtaaggctcttaaccttgtggttgtgggtttgagccccacggtgggtgttttttttgtctttgtcactaatttttttttgttgtcccgattttttgtttatgtcgttgatttgtccgtccaaatttatttctcatcctgttttttgtttttgtgactgatttgtttattcatccagatttttttttgtttatccggtaaagagaagcacaaatattcatgaattgactatcctatacgatggcctatttgaaatgcaagattattatataaattaatacatgaattttgtagtctcaccagttcgattttatacaaaagcacgtgaagaaaaaaaaaacctacacaaacatcaaatttgttatttttatattaattttctacagataagcctgtattctataatccgaatatgagtacatatatattccaacgttgtggatgcgtcaaggtttagatacttgaatatttctggaataacgaaatgtgaggggctgaacagtgacaggtatttcattcttgtgttttcagtaggccgcttaatgctcctaatgagaacacggaactcctctggcaaatacagctgccggatagtatactttggaagtttctccaaaataattgcttcgtagtttatgacacagatagctgcatttttatacgaattcctggcaaaccagtgtttcatggcatagaagttctgagcgtcagttaggatatgaaaagcaaaatagcctggctccttacaactgctcacagttgagttgattgctacagaagccgcaagaacgttccttgatagtataacaaagtgcctgtattctggactactgacctgccaggagaatcttcagaatccaatgttgatgctttaaaaaaatgagtagtgataaagataaaaaatctaggtgagaaataaatttggacagatacaccagcgacataaacaaaaaaacaaatcaaaatgcaaactgtggggcttgagaacctacgcccacaaggttagaagccttatgctctaccaactaagctagatggactttgtgcttatgtctccagcaaaaatgttgataacacaaccgagctcggcgccaagatctgtggcgccaagctcagtgccacgtcgacgacactcgtccgggttgtgccaacgcagcacgtacctcggcgccagcctatgacgccgagctgtgttaactcggcgccataggctatgacgccgagcaaagggtccaaaactgacattaaaattttttaaggtctaaacctgaatttttttccaaaaaatggctaaaatacaaaaaaaaattcgggcagggaagtgcactgggcaccttaagttcgtacagcatgcaatctagaatcacctccttttcaaaggcacgtgttgctgggtcactatcgtcagcacttaatctctgaatgtgatggtttaacaataccttgtttactatttattttctttcacctgaactctggagcagataatgaagaaagaaaatatgctcattgacggcatttatgtccgtattgacggcatttatgtctctgccctctggttaacgcaagcttcttaaatttgattcctttgatgctcctgctgtcaagtgttaaatcctgctctctacaaccagtattaattcctatgatacaagaatcaaacagattacttccactagacaccctccacatcaactagaagcagaagcatgcagaagggaataaacaaaacgaaaaaaatgaaaacctggacacaccagatcaactttggttccatttgttccctgaagaagtatgatacaacttttgggcggcgacccataaaactcaccagataacttgatctaattttatgcttttcttgaacctcatgtcttattgcaacttctcctcttgtaaaatttgtaacctgtggagaatgttgccttctcactaacttcagttaatctgctattctcttgcttgtgcaaacccgtgccggttaccagatccgagttgtctccctctatcttggataggtttttctctgctgtgtcgttgttgtttacttccttggttatcattgtgctattctgagcctcggtacgctccagagttttcaaatgcgtcaagtctttcccaccacagatatcaacttcctctttggcctcgatgtgctcctgatgtgaacccttgtcacgatccgaaatgctatcatttgtttgcttcaagattttctttggcctccctattcgctgtttcatagtctctgaactggtccccttttcgcatgccgcttccatagatccaaacttatctccttccgggtcagattgagttaacccaatagcaccttcacagtgatttgaagtctgcccattagataagtccttgtctaaaacctgtgctctcatgaattttttctttgcttgtccttttgctttcaatcttttcaccatgcttttgggcagatctgcacacttatcaaatgaatacatgtcaatgacatttctccttggtaaataggaatgcctagatatttctccggttccaaggtagctcaatacagacttaagcgtgcgaaatacacggtgactaacaggatcggtatagtactggtcttttctgattccatcattgaactttctagatatcgtttctttcacccatccatctggtaaaccatcaggattgaattccacatgagcaagtatattatcatcagtgctagtgtcgcacagcacatccatatcacatgtagaaaccatgcccttattaacaaagtgcaatacttctgcttttgataagaatcgctgcccagtaggtaggtgaacataaaacttgtacattttgtccattttcttcccaccggctctgacttcaatcacccacccacgtggaagccatgtatgtgactcatgaagctcgttgtcctcggcgcttgcctgcaactccaacatgcgttcttccacccctgagaaaagataatgcaatgtctccatctttgatgtgaacatgtatccggacattggggaagtgtagtacttgtagatggagccattgtcttcttgacaaacctccatagtccaaccgtcaggaagccaacccggcggctcatccaatgacccagaatcctcattcgactcatccattttcgattaggatgttctaggtaatggtctcgtgccctgtttttctacctccacggtctgcttcaatgtgttgtcattagagataaccaggccattattctcccgcggggggagggaggttgcaggggagctggatgccggctcggacggcgctccgtcggccgggagcgaaccgctgccgctcctccgcgctgagcggcgagtctctaccataggacgcccggcgccggcaggagtgacatgcacgggagggtgcggcctcggtgaaaggtttggccgcaagcccgcggggaatttccccgcccgacgggctgatttggtgattagggatccctaggggatccatgggggaggaatccccttgcaattcaatttt

SEQ ID NO: 20031 - DNA, 1573 bp, Zea mays
  misc_feature (1481)..(1481): n is a, c, g, or t
  misc_feature (1483)..(1483): n is a, c, g, or t
  misc_feature (1515)..(1515): n is a, c, g, or t
ggtggatggatcacgtagtccccatcatttactcaaatttatactaccgtatatatattagtgtttactactttcatgtttggaatctccactcaaaaaaatcctagctccaccaccagaattcattctcgttcacaatttgccgacacaaacttcagtgaggctagctgatgtctattccagttgttctgatttcagatccaactctgcgtcacagattcacgcaatcgttctcgtttcgggtccaactctacgtcacggatttacgttgcactcgtccataaatcgatctcctcggacaagaaacctcttccagtacttcttgtactccggtatacctaattcaagccaaggtttcatgttgccattgtagtgcaatgatgcagatctccgcgcaacctcttcatcgattccgtaatcatatccaagtccagccagcgtcaatttttcatctagggggtatattagatgttggaaggatagcaagcttagaggaaatgctgctgctcgcagggacagctcatccttgacttcgaactttttcatgagccgcagatagttctctgtgacattatgctccctccatttatccagattaatcaaattcacccccgacatccacgcacacgactttggatcatatgctgttttacccaagacatttttcatctcacccagtttcagaccacaaagttcgacagcgccatttaccttgtctcccatatcaatattccacaagaaagacagatcacgttgaacaactacatcgtcatccaacacgaccaccttgtttagatacttgaatatttctggaataacgaaatgtgagtggctgaacagtgacaggtatttcattcttgtgttttcagtaggccgcttaatgctcctaatgagaacacggaactcctctggcaaaaacagctgccggatagtatactttggaagtttctccaaaataattgcttcgtagtttatgacacggatagctgcatttttatacgaattcctggcaaaccagtgtttcatggcatagaagttctgagcgtcagttaggatatgaaaagcaaagtagcctggctccttacaactgctcacagttgagttgattgctacagaagccgcaagaacgttccttgatagtataacgaagtgcctgtattctggactactgaacctgccaggagaatcatcagaatccaatgaagatgatttgaaatattctagtgtcaacctcatagaaaggcaatgatgacttttcaggcaatgtctgggcaccgagattgtagaggaatgcactctgctgcatatgaaaatgagcttcatcctcagtcatataaagaatctggcgaagcttcctgtcaacacttctacaatctactgtgcaagatttggctctcactattgtttgctccatctgcttcatccttctgttgatagaggatggtagatcagcatcaactgttgatacactaagaatcttncncatggtcttgtatgtttgcttctttcctgagncagagctcctgtccctgaattttgcaagctggaagatgagcgcccggaatgcggaccg

SEQ ID NO: 20032 - DNA, 1207 bp, Zea mays
ttttttttttttttttggatatcttcttccattccatccacagctgtggcattgcctcactcacctaaccctccatgacatgtatcctctgcatctatctggtaaaaccagaggatgctatgagccaccatccaaggttgaggtgacatcaagcttcatcaccttggctcctgaccaagcatgccagtgtgtgctactgtgcttgcaaccaatacctaccccaattgttctttcggttttggactcgcttttagaagggaacatcttgtcttgccaactacatcttattggaagactgttgtattttttatatccaatatgtatagttgcaataaagtaccacaccatatggatgtaatgaaaggcccacacaggtgagcttatccgtggacctgcaaatatgcttgatttttgtgggttccgcggagaacttcaaaaattaagactgttagtgggttcacggacaagcctcattgcatccctagatgttattgtgcaacaaatctccaacctaccttgtacattttgtccattttcttcccaccggctctgacttcaatcacccacccacgtggaagccatgtatgtgactcatgaagctcgttgtcctcggcgcttgcctgcaactccaacatacgttcttccacccctgagaaaagataatgcaatgtctccatctttgatgtgaacatgtatccggacattggggaagtgtagtacttgtagatggagccattgtcttcttgacaaacctccatagtccaaccgtcaggaagccaacccggcggctcatccagtgacccagaatcctcattcaactcatccaattcatgaaccactaagacctccttaccttgcctctcctgtttttctacctccacggtctgcttcaatgtgttgtcattagagataaccaagccattattctcccgcggggggagggaggttgcaggggagctggatgccggctcggacggcgctccgtcggccgggagcgaaccgctgccgctcctccgcgctgagcggcgagtctctaccataggacgcccggcgccggcaggagtgacatgcacgggagggtgcggcctcgccgaccgatggtgaaaggtttggccgcaagcccgcggggaatttggtcagtctacagtgatgttcttcgtcgcccgcggggggaatgggttcctgcttaggagttgctgcatcttct

SEQ ID NO: 20033 - DNA, 807 bp, Zea mays
  misc_feature (13)..(13): n is a, c, g, or t
  misc_feature (96)..(96): n is a, c, g, or t
gatcaactacctngtcttcaatatcaggaatttcatcatcagtaccagtactctgatcacagcgtggagcttcatctaacacattgatctccctgncctcctcagtgcctctatcatcaacagttccagcatcactgattatatcgtctgtttcctcagacaattctgatggagggcgggaaggaattcttgtaatatctggttttctaacctcaacagccttagcagcactgactgttttcttttgtttctgaggcttgttctgtacattgtttaatcctttatgttgcagcttgttttgagcttgacggctggcgctgcttttggtcgttcgggggctattatcttttgactcctttttaccgagcctctttggaacccgagactcaccttgtgatgaaaaggagtctctagcaggtacataatctgatccagtccccctcttctcatctctcccctccccgttatctcttgcgcccatttcgggatatacttcaaattgttagaaacttgatgccgtctccgcgtgggccggctaggcgcagccgcgcagtcgccagcagcagaccacaccgagtcgccaaccgcagcgcgatccaatgcgggagcgagcagcggggcggcggcgcgggaggcggcgacgacgacgcccgcgaccggccggcgggcgtgctccggttcgcggcttgcctttggctgggtctgccccgtgcggcgtgcggaggggagggagatcgtggtgggcgagcgggggcgagtggttgctctcttctgcgctgcttaaatccaacccgcgggccgcgtgtc

SEQ ID NO: 20034 - DNA, 2667 bp, Zea mays
ggccttttttttttttttttttttggtaggtgaagagaatgtcatatcattatagaattttaactcaatactgtatctgtatctttgccgacaccctcttttgctgctatatactacaaaagagctaagatacataggatcgtgggaatgtacagtacaaggaagtgttgcatttttactgtagagattgctgaagaccccacacaaataggccttcttgtgctctcatttgggtggctgtagaagagattttaggttttacaggctcatcatcatccatcaccgttgctccagcccccatacttctcttaggagcgtgtatcttgtattctccatggaaactcctctccgagcactgaagtgtgcgaaaccgtttgacggagaaggtggggcgctcctgtcgattagggatgcgaggggagaatccaggtcgtcaaggtcgtcgtcactggtgtaccctctcctctgcaccattgaggctttcctgtccagcttcgcgccacctcctatgtctgccgctctctctgccgcgtccaacgttgaaggtgtgcggtacactataggggcagcggtgcacggaaacacactggtcgcgtctttgttggcgtgacgctccagcaagctctcggaattcagctcttctaagaccgtgcttggaaccggatcagggcaaaactcatctggggtgaagttgcacaggatcctagtcactaactgaaggccaattgagggacaaacctctttcctgatagatttttcaaggagcatgtcctttgggagcatcaggagatcacttagctcattgagaagttgaaacgatttcgtttcagctgcggctcttctttcgtcttcaacatctcctatgtcctcagaatcatcgtgatctatgccaagcttatctgtcagccatctggaccagtttccaatagagttcttcagctgcgcgcctgacccaaagcttagatcaccagctggaattggtaggacttttgggtcaacaattgggtcagatatagggtctgttggtatctcacttgctgattcacgaaggatggcattgaacatggcaacatccaaacgggctacacactgctccatcaccagttttgctaatactggtaaacagccacactcatgtccgccagcactgagggggcacattctgctgaatgcgtcctgaaacgcagccttccacaggttaacagaaaaggtgccctgctgctgatcacccaaagcaggacctagcactctaccagcctttggagttgatgatccttctgcccgtttttgcatgtgaggagttagtgcctgccaccatactgtctcaacaatgcgagaaaatatccaagactcaatcttctctaatgcagccaaaagtgtacttgtttcctgccaatcatctggcatcagcctcgcagcaaatttggcttgcgtgccattgtagttgtttctccacagcattgtcatagatttcccaccaagttttttggcaccaccattcatgctcatattcgtcatggatggagtaaattgatgtgagatgccaaaagtttgtacaattatctccctgaggacaactgtgttggacagccagaatgtcagcctcgaagcatcattgctactggactttgcaacaagaacaagaccagaagcaatgctttttgctaccgaagctctcttatcttcagaccaagacttggatgcatggatatataacctagacagacgccgagctggggtgtgcaacttatgtgctgaacttccatgctcgggcactacagagtacagggaaacttcaagagcagcaacttcacgaagttcctgttccaacttgtcgattttcagcactaattcccctcggccttgatctacaactgattttccatgatcaactaccttgtcttcaatatcaggaatttcatcatcagtaccagtactctgatcacagcgtggagcttcatctaacacattgatctccttggcctcctcggtgcctctatcatcaacagttccagcatcactgattatatcgtctgtttcctcagacaattctgatggagggcgggaaggaattcttgtaatatctggttttctaacatcaacagccttagcagcactaactgttttcttttgtttctgaggcttgttctgtacactgtttaatcctttatgttgcagcttgttttgagcttgacggctggcgctgcttttggtcgttcgggggctattatcttttgactcctttttaccgagcctctttggaacccgagactcaccttgtgatgaaaaggagtctctagcaggtacataatctgatccagtccccctcttctcatctctcccctccccgttatctcttgcgcccatttcgcggtacttcaaattgttagaaacttgatgccgtctccgcgtgggccggctaggcgcagccgcgcagtgaccagcagcagaccacaccgagtcgccaaccgcagcgcgatccaatgcgggagcgagcagcagggcggcggcgcgggaggcggcgacgacgacgcccgcgaccggccggcgtgctccggttcgcggcttgcctttggctgggtctgcaacgccccgtgcggcgtgcggaggggagggagatcgtggtgggcgagcggcgggcgagtggttgctctcctctgcgctgcc

SEQ ID NO: 20035 - DNA, 4692 bp, Zea mays
  misc_feature (651)..(651): n is a, c, g, or t
  misc_feature (1129)..(1129): n is a, c, g, or t
aggagagcagtgcatgaactctctagcttgtgaataggtgcaaagactctattcagaccaagaaagattatcaatatcatagccaaacttttaccaactctatgcgtcatggtttcggaaaccggaggacaataagatttgtgatcgatagggggctagcgcagacttgcttcgaatgttgaatctctgggaatcaacaagaaatttgagacacggggttatactagttcgggttcgcaccctactccagtgtagtgttgatcgtgttattgcttggagcgtgttacaactggtgtgcttgtatgtcagagaaggaatgagacctacccttttatagctcaagggctagtccttatagaggagagttgttgtctatgagagagagagagaaagagtcctttagctgtcatggcaggcccctcccttggtcatgcaaagtagtgctcccagtatggcgccgctcctctcttccgctcctgtggagggttcatggttgacatccctacgatgatgcgcgacatcaaaatatatcaatggccactacttactcatatcagacatcaaaattttgtcgttggttccattttaacttgcaagaacttaatatgtatatatggtcatacaatcacttaaaatcaactatagtagccnttaatgcgaacttactaaaactttaataaaaattctgaaaaaatcacaatgttaatcaaggacttaaacgttctagctgagcatctaacattgttctattctatatcaccgttgggtagaaattgaatggaacgaaagatcttatgtcattgcaaatatttgtcagacttaagtgaaacattcatctaactaaatcttcacatctgatccaatttaattagaaaacagcttaacttaatacaacagaagttttaatcaacttatacattcaagaaaactgtgctcaactattcttaaacttcttctctagttaaagagaatatagcttaattatgccatgaaaaaaacaatattattgggcataattctcttatacataaaaaacaacaataccttagcacataaagtatcggatacactttaacccaataattttatttgtcatattatccaaaaacttaaaacttaattatcatgnagagtttcatcattaaagttggtcaaaagatgaaacacaccggtctaaaacataatttcttaataatatctttcaagataaaacatagaatctgataacataaaaaaacttgagttaacaagcatggggtgagctacttattcgttactatatattttctaattaaatatccacgttggattcaatttaatcagaaaataataaacttacacttagcaacagaaacttgactaaaatctaaacttaatggccgagctcgtgaaatggccgagccgagcccgactcatttctagccctagttaggatcatgtgaggcaactacatgcgcgagcgagcaatcagatcttaacaacagcaaacatcttaagagcatatacaataactgtcttgaattgtgtcttcaagtgtatctaagtgagtaaatgtaaaaaaaatcaaaacatgtatcttaacaaagacactgtgttttagctctatgtccgagacagaagactaactgattagtcaatttaatttattaaatgctctgattaatataattgatataataaaatataaattttagatatatttaatatattatattgtattttaaccgtgtttgggtacctcgccctaatccccgttcaccgcaccccactcttcgcggcgcgttgcaggaacttcccgtattccccacgcgtccgagcgcacagcgtcacggcgctcaggccgtggcttccacccacagccttcgcacttccctccttcctcgcaaatggccgtcgccgtccccaacgctcccggccgcctcttccttctccaatccaccccgttcccgaaccctagcagctcggcatccgccgctcgagcccaatccttccgcgtaccacccctccgcctctcgctattccgacgcatggctgggcgctcgctgacggtgatcgcaggcgcctccggcggctccgaacgagatctcagcgcctccgcagtctccgtggaggccctggactccgtcgcctccgattctgacttagagacgaaggagcccagtgtgtcgacgatgctgacgagcttcgagaactcgttcgacaagtatggggctctgagcacaccgctgtaccagaccgccacctttaagcagccttcagctacagattatggaacttatgattacactagaagtggtaaccctactcgtgatgttctccagagcctcatggctaagcttgagaaagcagatcaagcattctgcttcaccagcgggatggcggcgttagctgcagtaacacacctccttcaggctggacaagaaatagttgctggtgaggacatatatggtggttctgatcgtctactctcgcaagttgtgccaagaaatggaatagttgtaaaacgagtagatacaacgaaaattagtgatgtggtgtctgcaattggaccctccactagactggtttggctcgaaagtcccacgaaccctcgtcagcaaattactgacattaagacaatctcagagatagcgcattctcatggtgctcttgttttggttgacaacagcatcatgtctccagtgctctcccgtcctatagaactgggagctgatatcgtgatgcactcggctaccaaatttatagcgggacatagtgatcttatggctggaattcttgcagtgaagggtgagagtttggctaaagaggtagggtttctgcaaaatgctgaagggtcgggtctggcaccttttgactgctggctttgcttgaggggaatcaaaaccatggctctgcgggtggagaaacaacaggctaatgcccagaagattgctgaattcctggcgtctcacccgagggtcaagcaagtaaactacgctgggcttcctgaccatcctgggcgagctttacactattcccaggcaaagggagcgggctctgttctcagttttctcaccggctcactggccctctcaaagcacgtcgtggagaccaccaagtacttcagcgtaacagtcagcttcgggagcgtgaagtccctcatcagcctgccgtgcttcatgtcccacgcatcaatccctgcctcggtccgcgaggagcgtggcctaaccgacgacctcgtccggatatcggtcggcatcgaggatgtcgaggacctcatcgccgatctggaccgcgcgctcagaactggcccggtgtagacatcgccgatccttaggtcatgtcaagctatcttttgatgattcattggttgactgcttgcgtgatgataataatgggaatgttgcttggatacgccgctggctgatgagggacttcacgcgcccgaagctgactgttacgctgaagtacttggtggtctccacgacgtgctttgagagggccagtgagccggtgagaaaactgagaacagagcccgctccctttgcctgggaatagtgtaaagctcgcccaggatggtcaggaagcccagcgtagtttacttgcttgaccctcgggtgagacgccaggaattcagcaatcttctgggcattagcctgttgtttctccacccgcagagccatggttttgattcccctcaagcaaagccagcagtcaaaaggtgccagacccgacccttcagcattttgcagaaaccctacctctttagccaaactctcacccttcactgcaagaattccagccataagatcactatgtcccgctataaatttggtagccgagtgcatcacgatatcagctcccagttctataggacgggagagcactggagacatgatgctgttgtcaaccaaaacaagagcaccatgagaatgcgctatctctgagattgtctctcgtgctaatgtcagtaatttgctgacgagggttcgtgggactttcgagccaaaccagtctagtggagggtccaattgcagacaccacatcactaattttcgttgtatctactcgttttacaactattccatttcttggcacaacttgcgagagtagacgatcagaaccaccatatatgtcctcaccagcaactatttcttgtccagcctgaaggaggtgtgttactgcagctaacgccgccatcccgctggtgaagcagaatgcttgatctgctttctcaagcttagccatgaggctctggagaacatcacgagtagggttaccacttctagtgtaatcataagttccataatctgtagctgaaggctgcttaaaggtggcggtctggtacagcggtgtgctcagagccccatacttgtcgaacgagttctcgaagctcgtcagcatcgtcgacacactgggctccttcgtctctaagtcagaatcggaggcgacggagtccagggcctccacggagactgcggaggcgctgagatctcgttcggagccgccggaggcgcctgcgatcaccgtcagcgagcgcccagccatgcgtcggaatagcgagaggcggaggggtggtacgcggaaggattgggctcgagcggcggatgccgagctgctagggttcgggaacggggtggatggagaaggaagaggcggccgggagcgttgggacggcgacggccatttgcgagttcccggccggcctcgagg

SEQ ID NO: 20036 - DNA, 1814 bp, Zea mays
agtaaaaagtgatagatatgttaaaatgcgtggcgttcgcgttttcctacacacaaattgggatgtacaagtgctaacgatagagaattcagggcatgcacggaagaaaccacaggcatgtttgctcaccgcggcactgctgccgccggtggccacatcccacaagccgacagctcgacagcgggcagcctttcacccaaggtgaacaaatcctagcggactagtacgagaaggcgtagcagcggcgtatccaagcaacattcccattattatcatcacgcaagcagtcaaccaatgaatcatcaaaagatagcttgacatgacctaaggatcggcgatgtctacaccgggccagttctgagcgcgcggtccagatcggcgatgaggtcctcgacatcctcgatgccgaccgatatccggacgaggtcgtcggttaggccacgctcctcgcggaccgaggcagggattgatgcgtgggacatgaagcacggcaggctgatgagggacttcacgctcccgaagctgactgttacgctgaagtacttggtggtctccacgacgtgctttgagagggccagtgagccggtgagaaaactgagaacagagcccgctccctttgcctgggaatagtgtaaagctcgcccaggatggtcaggaagcccagcgtagtttacttgcttgaccctcgggtgagacgccaggaattcagcaatcttctgggcattagcctgttgtttctccacccgcagagccatggttttgattcccctcaagcaaagccagcagtcaaaaggtgccagacccgacccttcagcattttgcagaaaccctacctctttagccaaactctcacccttcactgcaagaattccagccataagatcactatgtcccgctataaatttggtagccgagtgcatcacgatatcagctcccagttctataggacgggagagcactggagacatgatgctgttgtcaaccaaaacaagagcaccatgagaatgtgctatctctgagattgtcttaatgtcagtaatttgctgacgagggttcgtgggactttcgagccaaaccagtctagtggagggtccaattgcagacaccacatcactaattttcgttgtatctactcgttttacaactattccatttcttggcacaacttgcgagagtagacgatcagaaccaccatatatgtcctcaccagcaactatttcttgtccagcctgaaggaggtgtgttactgcagctaacgccgccatcccgctggtgaagcagaatgcttgatctgctttctcaagcttagccatgaggctctggagaacatcacgagtagggttaccacttctagtgtaatcataagttccataatctgtagctgaaggctgcttaaaggtggcggtctggtacagcggtgtgctcagagccccatacttgtcgaacgagttctcgaagctcgtcagcatcgtcgacacactgggctccttcgtctctaagtcagaatcggaggcgacggagtccagggcctccacggagactgcggaggcgctgagatctcgttcggagccgccggaggcgcctgcgatcaccgtcagcgagcgcccagccatgcgtcggaatagcgagaggcggaggggtggtacgcggaaggattgggctcgagcggcggatgccgagctgctagggttcgggaacggggtggattggagaaggaagaggcggccgggagcgttggggacggcgacggccatttgcgaggaaggagggaagtgcgaaggctgtgggtggaagccagtaagccacggcctgag

SEQ ID NO: 20037 - DNA, 2075 bp, Zea mays
gctgatttggttgcggatttcttagatgtggggtcttactgaccgaattatccatccacgggtggtctgtttgattaggttccctctcttctccgcgcatgcgtgcggggtcgaaaggtagggttcataccccaaagtttgtcattggggacaacaccagcggcggcgatggactacaccaacgccatccacatcatcccggacgccgcgggccccgacgcctgggccaacgcggcgtcggccgcgggcgccgacgccagcatctgggccaccgaggacgactaccgccagtggagcgccgaaccaggctacggcgaccggaacccctcgtcgcgggcggggagcgagcagccgccgccgggcaagaaggctcgcggcgggggcggcggcagcgatagcggcggcggtggcagcacgagcaagtcgcgcgccattggcaagatgttcttcaagaccaagctctgctgcaagttccgggccgggacctgtccctacgtcaccaactgcaacttcgcgcatggcatggaggagctccggaagccaccgcccaactggcaggagatcgtggccgcccacgaggaggccacggagcagcgggaggagcaccagatccccatcatgacatctggaagtgttgtagctggagacggcggcggtggcagtggtggcggctcgcaggggggcagggcattcaagggccgtcactgcaagaagttctacactgaagagggctgcccctatggtgacacatgcaccttcctgcatgatgagcagtctaaggcacgggagagcgtggccatcagtctctcgcccaccgttggtggtgggggatacaatgctgcctccgccaacggagtgatggtgcagaagccgtccaactggaagacaaggatctgtaacaagtgggagatgactggatactgcccatttgggagcaaatgccactttgctcatggttctaccgaacttcacaagtacggagggggcctcgtggacatcgacggcagggacatcttgtccactcctgattcgaagcaagccggtggctctgctaaagctcctctagagtctgctgctgcgtccactgcgttgccccctcatgcagacgtgtaccatctcggcatccagtcgcagcgctcggccatcgccagccagaggtctggacagctgcaaaggcccatccagaaatggaagggccctgacaagatcagcaggatctatggagactggatagatgagaacgaatagaagaaggatcttctacggtgggccgaagggaagctgttacttggtatccgtccgactccacatcagctggtggaagctttacctggcttagaagatctcgttagcgctgcaaaaccagagtcaagatcatctttgcaagacctgtattggggagataaactgctggaacatagtgccgctttcttccgttgaactcagtagcattgctatgcttgtgtaatttgtgtgttggatggaggagcataatagcatatagcgagtcatggtgcaccctgtacagggtggctgagctgcatcctgaaggctggttgttcaggtgcgtccgtgactgtctgttggttcttgttttcgggctattattattgggccggatatttctagccttactctttggcccattgagcagtgcgctgtgtaccaagcagttaagcccaataaacagggtattttttcccctgaggtctagtttggaaagtctattttttttaagagatttctatttttcctaagaaaaatgaactaatttctcttggaaaaatagaaatcacttgaaaaaatagagttaccaaactagccataaagtttgatttgatgaccaggaatcacgagaggatctatgtgaatttctctcccatagatcctcttgtaatctatggtcaccatactagcctcagccctaaagggatgttctatatcttctagagagaagatgcactacactattactattaactggaaataattaaattgcgaaaaatgtcatcttttgttacaacgacaacaaaccgatagcaacgaatcttttagcgaaacacttaccgctgcag

SEQ ID NO: 20038 - DNA, 1608 bp, Zea mays
gacttgctcgtccggttcagttcagtggcgccgtcgtgcctcgacgacggcgggagacgccgcaagcaggtgagagtgagacgggcggtgactagcgggcgcttaggccgacatcggccccgcagcggcggggtagggtgcgtcgacacgcgggactgcgacttgggggggattgattcccttcgctgttctctcttctccggcgcgtgcgcgcgggatcgaaggtagggtttgggccccaaagttcgtgtctttggggacagcggcggcgatggactacaccaacgccatccacatcatcccggacgccgcgggccccgacgcctgggccaacgcggcgtcggccgcgggcgccgacgccagcatctgggccaccgaggacgactaccgccagtggagcgccgaaccaggctacggcgaccggaacccctcgtcgcgggcggggagcgagcagccgccgccgggcaagaaggctcgcggcgggggcggcggcagcgatagcggcggcggtggcagcacgagcaagtcgcgcgccattggcaagatgttcttcaagaccaagctctgctgcaagttccgggccgggacctgtccctacgtcaccaactgcaacttcgcgcatggcatggaggagctccggaagccaccgcccaactggcaggagatcgtggccgcccacgaggaggccacggagcagcgggaggagcaccagatccccatcatgacatctggaagtgttgtagctggagacggcggcggtggcagtggtggcggctcgcaggggggcagggcattcaagggccgtcactgcaagaagttctacactgaagagggctgcccctatggtgacacatgcaccttcctgcatgatgagcagtctaaggcacgggagagcgtggccatcagtctctcgcccaccgttggtggtgggggatacaatgctgcctccgccaacggagtgatggtgcagaagccgtccaactggaagacaaggatctgtaacaagtgggagatgactggatactgcccatttgggagcaaatgccactttgctcatggttctaccgaacttcacaagtacggagggggcctcgtggacatcgacggcagggacatcttgtccactcctgattcgaagcaagccggtggctctgctaaagctcctctagagtctgctgctgcgtccactgcgttgccccctcatgcagacgtgtaccatctcggcatccagtcgcagcgctcggccatcgccagccagaggtctggacagctgcaaaggcccatccagaaatggaagggccctgacaagatcagcaggatctatggagactggatagatgagaacgaatagaagaaggatcttctacggtgggccgaagggaagctgttacttggtatccgtccgactccacatcagctggtggaagctttacctggcttagaagatctcgttagcgctgcaaaaccagagtcaagatcatctttgcaagacctgtattggggagataaactgctggaacatagtgccgctttcttccgttgaactcagtagcattgctatgcttgtgtaaaaaaaaaaaaaaaaaaaaaacaaaaaaaaaaaaaaaa

SEQ ID NO: 20039 - DNA, 3723 bp, Zea mays
  misc_feature (788)..(788): n is a, c, g, or t
ggggaagaattcagtccgacaggttggtcccatgtgccagtgagcgcagaggtgacaggagtgcgcaataagagtgctgacgtgtgggacccacaggtcggccggtgaagggaggtgggctggcgcggggtaaatgtggagttgctgggccgcgcggaggaagaagcaagctgggcctgccggccagatttggcccaaccgagttctcccagcttttcttctttttacaatttctgatttcctttccttttccttttcttgatttcatatttaattttgaattctttcatgatcctcacatttgagctaagtatccaaattcaaatcctagtttaagaataatatatttatctatttatttttatttgtataatattttctttctcttccttcccttgttatttctcattcttaaatattcaaaataggttcttaatccccaaattcaaatttatgttttaatctaaatcttcccctcattataatatatatatatatttatccatgttattaagtgcacaaacagaaactccaataagatgcactttattttattttggaattatttgtttcgattaatccttcttaattacatgtgtgctctttttatgatgcaaatatggcacatgaaataaggagatctgctatagtacattccttgaatacaactttgagtattacaaggtcccacttcacctattccttgacatcactatcccagctagtagtgatcaacaaaccagaccagttgcagcgctatgtaaagatacaccaggtccgattacctnatacatgaagcagagtccagtcgcttattttttctaaatcatgctcgtgccactcaagttgtagtgataaatatctctcttaatacatgaaatggagtttaatcgctaactatatacaacttgtatgcgtgattcaagctctagccataattaatctttatttttgcaccaaaaatcctcaacaaccatgccacccaccatcaatcgagattcacaagggcactagtcatgctagcttgtgactcatccaacaaacaatagttatcctctattacacctcagtgccagcactaggtgccaatccacctgtatccacgatgtcattgcttggacccatctgctcctataagaacaccaagcaaacggccggccacgaggtgacaaagcatggatgctcacaccactcacattgttgcaagaaagaacacttcgctttcattcacctcaaatgagctcatggatcattttcccttcgcttggttacccatggaccccttcacagccatggcgctcagcggtaccctctcaccctcattctctaccacatctaccaatgataccatgtacaaccttaacccagcgttgtatgcatccctcgtgccaccaataaggaaacctgcaaccccgaccacactagaggtagggaggcaatgcaaggaggaggaggatgcatccattcgtctggtgcacctgcttatcacttgcaccagtgccattgagactggtgactactcgatcgcacaaggaaacttgtctgaggcacgcaagattcttggggaaatcccaacttcgaccgggatcggccgtgttgggaaacacttcatcgacgcactagttcaacgcctcttcccggcatatccgcacgcagcaccaccttctccatctccttctacatcgatcgatctgcacaacaatttttatgatgcaggtccctacctaaagttcgcctactccactgccaaccaagcaatcctcaaagcaatcaaaggatacaaccatgtacacataattgacttttccctgatgcaaggtctccagtggccggcactcatggatgtcttctccgcccgtgagggtgggccaccaaagctccgaatcacaggcattggcccgaacccaataggtggccgtgacgagctccatgaagtgggaattcgcctcgccaagtatgcacactcggtgggtatcgacttcactttccagggagtctgtgtcgatcaacttgataggttgtgcgactggatgcttctcaaaccaatcaaaggagaggcagttgccataaactccatcctacaactccatcgcctcctcgttgacccagatgcaaacccagtggtgcccgcaccaatagatatcctcctcaaattggtcatcaagataaaccccatgatcttcacggtggttgagcatgaggcagatcacaacagaccaccactactagagaggttcactaatgccctcttccactatgcgaccatgtttgactctttggaggccatgcatcgttgtaccagtggtagagacatcaccgactcactcacagaggtgtaccttcgaggtgagatttttgacattgtctgcggcgagggcagtgcacgcaccgaacgtcatgagttgtttggtcactggagggagaggctcacctatgctgggctaactcaagtgtggttcgaccccgatgaggttgacacgctaaaagaccagttgatccatgtgacatccttatctggctctgggttcaacatcctagtgtgtgatggcagccttgcactagcgtggcataatcgcccgttatatgtggcaacagcttggtgtgtgacaggaggaaatgctgccagttccatggttggcaacatctgtaagggtacaaatgatagtagaagaaaggaaaaccgtaatggacccatggagtagcaggaagaataaccatgtcatgagcaaatcgatcaagtaataaaatgcactgatgacatgcatggtgatctaaagttattttgcgagaatgtgcaatgacgaattgttcaatttgaataacctaatcatgagactcaaaaggaaaatatttgtttgttgttaattcaatgagttttttttttaaatgtttgccctcactactataaaacatacatatgttgtttttaaggaagtattggtgcctaatatcatcctcaacaagtaccgctatttttacatgtgaacatatgtctaactcatattatcaacctatttgcagtgcaaccacatcccgtcaggtagtgtttaactaaaatcatgagcacaaactccatttccatatagtatcaagctaagtaccaaccataccaaaaaagaacttgaaagcaacaaggacatattctacgtaatgtttcttgtgtacaactgaaaagatccaattaattctaaatgctctaatgaatccaagtcctttatcgtgacaatgagatgaaacaatattccttttcttgcacaatggtcccaatgcaataggtggcataggtcgttaataggttggattgttacaggtatgcatgccttgctctagttgtaccaataagtttttatcagcagcatcaccaaaagacatgccaactatgaaaatcaaaatacaaaagaaccaagggaggtgtagtctcactgcattagtcatgccaactagtcactcacctaacgtgcattgatgggtatatgatgctccacctcagcatcatcattgcgccctcctcttgtgcaatgtgattgttgcaatacgaattgatcaatagaccacaacacaatggttgagttatacaaagatatattgaccacaattgactaacacatgaagcgactcaaattgctagctttctacaactgtgcattcatcacttgaactgtagtgataaatatctatctttcttaacacatgagcatgagtccagttactattgtgatacaa

SEQ ID NO: 20040 - DNA, 2318 bp, Zea mays
aggctatatacccaggcggatggcacaacaaacaggcagcaaggtttggaggtcatcggccaatcctactggaacggtttcagctatagcaatgctcagtctttttttcgcctcaggaatacacacgagcgcgcgcgcctttatcacacaaaatcatccttcgcataaatatacggccccaagaaaaccaactggaaaaaaatcgctatggctaacatatcgattcaacaatgtacagatactgtcacgacgacgacgaccgacactggtgcttgtggagtttgcatgcccgaccaaccaaccaaccaaccatatccagcttctttatcaggcacaaactcaagcgcaaccaccgttttcctggtggctagccaagctagtcctcttagtttctccacttgaaaggttctccattcggtgcgtcctttggagtgttgtttccgctgctatcgccaggttcgcttgcaggtggcgtttccaccgatcttgcttgggctggagctttgccaccccggcgctcatctctgtacgggaaatcgtcaacctcaagcatgtgaatgacatgcccaatctttggcctcttgcgagcttcagggtctacgcaccgcagagccactagcaaagccttcttcaatgccctagaagtaggcttctcagtcatctttggatccaaaaccccctcagaatttctgttgctgaccatcgtcttcagccactcaactagattaatctcccctggcggcctgttgtaatcaacaggtacacggccagatattatttccatgataagaattccgaaactatagacatcgctagtttcattcaacatgccagtgcccgcatactctggcgcaacatacccaaacgtccccatgaccctggttgtgacataactcctttctgaacccaaaagtttcgctagcccaaaatcagaaagctttgcattccaatgcttgtcaagaagaatattgctcgacttgacatcacggtgaacaacctttggctcaagtccctcgtgcaaatacattaacccttttgctgttcccagaataatcttcattctgatatcccatgtaagagggctcacagggccaacatccccatggagccattgctccaagtttccattattaacgtactcatacacaagcatcctttggttgccttcagcgcagtatcctaacaaccgaacaaggttcttgtgtcgcactcgcccgatagcttccacctcaaccttgaattcccgttctgcctgccccctgttgttgagcaagtttttgacggcgacctgcactccgccctccagcacgccgtggtacactatgccgtagccgccctcgccgatcaccttctcgtcggcgaacatgcacgtggcgtcctccagctccttgagtgtgtaccagtggccccaccccaggtgcgacacctccgggacccccggttccccaccaccgccacggctctccccgctggcgccccgagacgacggccccccgctccgctggtggtgcgggggcggcggctgctccgggaacgtgatacggtgctccttccccgtctcgatctggatggagtccggcggcggcgcctgcagcacctgggcgagcggcgccttggccggggcggcgggggccgcggtgccgcgggagggcacctcttggatgtccttggggggcttggcggggtgcttgggctgggcattgggcacgacggcggggaggtggaggacgggggcagcacggcggcgtcggcggcggcgggaggcgaggaggcagagcagggagaggaggacgaggaggagcacgaatgcggcaccgacaccgatgccgacgagctcccagaggtggaggccgaacactagcgtgccctgggacagctcggagtccgacatgggcgccgcgctgctcagctccccggctgctcaagccgaaacgaaatggtggatctccctcccaagaacccccctcccagcagaattgggcgccactaaagaatgaagaaatcttccaagaaaaaaatcgccagagactggggctttgcagggaattgggcgcgcggagccggattcatgcagcggacaatcgaagtggcgaagaatctatggatttctgcagggggggggggcgcagtgggaaaggtatgactttgggggggagggacgggatttaggacaggatggagtgacgaaaaaggtagatttggaggttgattgagcccaaaaaggttggatttgcgggcagtggggggcctgagactggattttttccggcggcgcgggggcgcccacgcgtccgcccacgcgtccgcccacgcgtccg

SEQ ID NO: 20041 - DNA, 1918 bp, Zea mays
atatattttttttttttttttttttttttttgtttgttctccatcaaggaggatcgcttcattaaagcatttagggctcaaatacaaagataataccatccttatctttcaagcaaatacacagcccatctcaagaaagaaaatgggggaaaaataagtccatatacaaactcttatggtcgtttccaaggaaatacatggcccgtgccattaaaagtacacttcacacaaaatcaacacaggatagtttcgagaaaatatatgacagcttataaaaatagagattgatacagataacacatgaactgcatcacttgggtccgtctccctcttcaatgtgattttagactaagaaccacgaatgtaattaacaagccatgccaatgcttctaatcatctagctgaacaggacctctctctttggtacttaagcaactcacatttacctgctgctgggttggaaggatctaacaaaccgagtcatcaattcctgggctctgtgttgggatggtcggatgaggaggaggccattccgtcggtgtttgttctgataagttcaatacttggatggttaggatgaacctcggctgcatgtctataagctgcttccactttctgcacctcacacatgctggcacccgaacagtcgatgaaaataatggcttcctgaagatatcgatacgaccgcagctggctgaggaagaaagcatcagatttatccttcatcatgcgcacgcagcaatccttttcaatgtgtcgccgaagcagagtctcccacttttcatcagataagatattttcttcatattctcgatccatttttatggttggacggttggcatgattttccacggcacgcatgaccacggcctccacctcatccacttgtgcggcagtagcacctgagcagttgactttgactattacttgctgaagtaaaaggacgttatccaggtccaagtcaagatcttcgatcacatccttcgttgggaactgctcgaacggcataccattgcatacccaactccagtaccctgcataaactccaaattgcagcacttcaagccttggcatggcgcccttacgaaactcgaacgttgtgcccacttcgcagaacctcagattcctgaagtcgtctgggccaacagtataccttggaggccagctgagaccatatagcgtgaggtactggagctctggcaacctcgctagattatctagctcctgttttttgattaggatgttctaggtaatggtctcgtgcaggcgtggcaggcaggagcggctgatccatcgaggctgccgtgagaagtcgatgcctttaataatcaggcgccggagctgccttggtggctcccagtctccccacatatcgcttacccgctgtggcattttaaacaaaagcgctagttcctggagtccccgcagattggacagagattgcacgaatgcttcttgcaagctctcctctagctgctctgaaaaggcgatgctgaccaccctcaacctcgtcagcttgccaagctctgccactagggcttgggtggcactccggccaactaccctatgtagtcgtagctcctccagggacgttaggttccccatcctgtcagctggtaacctttcgaactccagggctatcaggcacatcaaccgtgtaagtgagcaaacagccggtggcagctcgtctagtccagtatcggctaatatcagtgtctgaagagacctcagatgcccaatttctctagggagctcatcaatagtcgtgccagatatctgtaggaacttgagatgcaacagcttccctagatgctttaggttgatgggtacgtagttgttttctatatgcagcacacggcaaaccctgaagctatcaatgtttaaacacaataaagttggaacgggaggggggaaagga

SEQ ID NO: 20042 - DNA, 3321 bp, Zea mays
  misc_feature (1074)..(1074): n is a, c, g, or t
tggtggagcttatggttggagagaaacaacataattttcaagggtcaacagagaacgtcagatcaaatggtgcagatggtgaaagatcttgtgggtagtggtctggcatactagtaatgtctgagggcctggccagagggttagatttttattcagtggtgctagataggtgtttgattgtctagtgttttttggtgttggcgccttttttgtgccagtttttgtacagtgttttctccttattatctaatatattggaaggcaactcttttgcctctccctttcaaaaaaaaaacatcattgaaacatgacaaaatcaggaacttaagctccctaataatcaatccatcatgcgaatcatcccaatcattcgacgtgagagtatctcgaagacacttacaatctgtttcaatctcattcgacgtgagagtatctcgaagacacttacaatctgtttcaatctccagagacccgtgcattcggcggcaccaccagatctgcgcagtggtcaatatccagatttgttcggtacactattcattactacggcgtgtgtgtgagcctgtgacggtgaggttgtggtgtggcgcaatgcatgaaggaattaggaacacattacactcactcggtccactggtcagtggtcactgccttcctgcaaatacacagcgctggccgccgtgcaccagaccggtagaaaaacaagccagatacccatatgctgcgccaggcaaccctctgctgacctgcatatagtttcatcattcgtgttagatgaacctgcatatattcaacctcattggatgtgctgcgcgtctatgcactgccgtttgcatagactggtgctgttctgaccggccagatacgataattttgagcgtattggtgaatacagattaatagtatcaaaataacctattttgcatccatccatgcaaactatgactcccacatacgagtaaccaaatataatctcaaacaaaatcaacgtatgcggtgatccaagatgagatagtgcgggtaactaattaggcggattgtgaacaacatagatatataacaaagacgagctanaggagcttgcaccaaaatcccatacacgttggcgtcgagaattgggttcacaccatacttatctccatccaggatgatcacttcatttaagcatctagagttcaaatacaaagataatatcatccttatctttcaagcaaatacacagcccatctcaggaaagaaaatgggggaaaaaataactccacatggtcgtttccaaggaaatacgtggcccgtgccattaaaagtacacttcacacaaaatcaacagaagatagtttcgagaaaatatatgacagcttataaaaatagggattgatacagataacacatgaactgcatcacttgggtccgtctccctcttcaatgtgattttagactaagaaccgcgaatctaattaacaagccatgccaatgcttctaatcatcttgctgaacaggacctctctctttggtacttaagcaactcacatttacctactgttgggttggaaggattggacaaaccgagtcatcaattcctgggctctgtgttgggatggtcagatgaggaggaggccattccgtcggtgtttgttctgataagttcgatacttggatggttaggatgaacctcggctgcatgtctataagctgcttccactttctgcacctcacacatgctggcacccgaacagtcgatgaaaataatggctttctgaagatgtcgatatccgcagctggctgatgaagaaagcatcagatttatccttcatcgtgcgcacgcagcaatcctcttcaatgtgtcgccaaagcagagcctcccgctcttcgtcggataggatattttcttcatatactcgatccatttttatggttggacggttggcatgattttccacggcacgcatgaccacggcctccacctcctccacttgtgcggcagtagcacctgcgcagtcgactttgaccatcacttgctgaagtaaaaggacgttatccaggtccaagtcaagaccttcgatcacatccttcgttgggaactgctcgaacggcacaccatactgttcccaactactgtaccctgcataaactccaaagtgcagctcttcaagccttggcatggcgcccttacgaaactcgaacgttgtgcccacttcgcagaacctcagattcctgaagtcgtctgggccaacagtataccttggaggccagctgagaccatctagcgtgaggtactggagctctggcaacctcgctagattatctaggtcctgtgcttcaagagcgtgcaccatcagagataaggagcagaggcgtggcaggcaggagcggttgatccatcgaggctgccgtgagaagtcgatgccttcaataatcaggcgccggagctgccttggtggctcccagtctccccacatatcgcttccccgctctggcattttacacaaaagctctagttcctggagtccccgcagattggacagagattgcacgaatgcttcttgcaagctctcctctagctgctctaaaaaggtgatgctgaccaccctcaacctcctcagcttgccaagctctgctgccactagggcttgggtggcactccggccaactacactatttagtcgtagctcctccagggacgttaggttccccatcatctcagctggcaacctttcgaacccataggctatcagacacatgagccgtgtaagcgagcaaacagccagtggcagctcgtctagtccagtacggactaatatcagtgtctgaagaaacctaagatgcccaatttccttagggagctcatcaataggcgtgttaaatatctctaggaacttgagatgcaacagcttccccagatgcttatgctttaggctgatgggtacgtagttgttttctatagacagcacacggcaaaccctgaagctatcaattggggccataaccgcaatagtacaacctgtaatgctaagtgacctcaacacctctggcatgtccatggtttcttcagggaagcgctgcacacgttgatttcggacgaccagacgacgtagcttgcagtctgagcgaggcacacctgttttcttctctcttcttaaactatcctgagatgaatgttgcccgctaaggctaatgaagtcttcatccttggacaacttacagatgagatcaaacacaatgtcgtgaatacggaactcttctacaaaccaatcatttatgctctctatcggctggatcatgcttctattcacaagctccttgaagtatcttcggacgcgtggg

SEQ ID NO: 20043 - DNA, 2085 bp, Zea mays
acatatctccatcccggatgatcacttcatttaagcatttagagttcaaatacaaagataataccatccttatctttcaagcaaatacacagcccatctcaggaaagaaaatgggggaaaaattaagtccacatggtcgtttccaaggaaaatacatggcccgtgccattaaaagtacacatcacacaaaatcaacacaagatagtttcgagaaaatatatgacagcttataaaaatagagactgatacagataacagatgaactgcatcacttgggtccgtctccctcttcaatgtgattttagactaagaaccgcgaatctaattaacaagccatgccaatgcttctaatcatcttgctgaacaggacctctctcttggtacttaagcaactcacatttacctgctgctgggttggaaggatctgacaaaccgagtcatcaattcctgggctctgtgttgggatggtcagatgaggaggaggccattccgtcggtgtttgttctgataagttcaatacttggatggttaggatgaacctcggctgcatgtctataagctgcttccactttctgcacctcacacatgctggcacccgaacagtcgatgaaaataatggcttcctgaagatgtcgatataaccacagctggctgatgaagaaagcatcagatttatccttcatcgtgcgcacgcagcaatcctcttcaatgtgtcgccaaagcagagcctcccgctcttcgtcggataggatattttgttcatatgctcgatccatttctatggttggacggttggcatgattttccacggcacgcatgaccacggcctccacctcctccacttgtgcggcagtagcacctgcgcagtcgacttcgaccatcacttgctgaagtaaaaggacgttatccaggtccaagtcaagaccttcgatcacatccttcgttgggaactgctcgaacggcacaccattctgttcccaactcctgtaccctgcataaactccaaagtgcagctcttcaagccttggcatggcgcccttacgaaactcgaacgttgtgcccacttcgcagaacctcagattcctgaagtcgtctgggccaacagtataccttggaggccagctgagaccatctagcgtgaggtactggagctctggcaacctcgctagattatctaggtcctgtgcttcaagagcgtgcaccatcagagataaggagcagaggcgtggcaggcaggagcggttgatccatcgaggctgccgtgagaagtcgatgccttcaataatcaggcgccggagctgccttggtggctcccagtctccccacatatcgcctccccgctctggcattttacacaaaagcgctagttcctggagtccccgcagattggacagagattgcaccaatgcttcttgcaagctctcctctagctgctctgaaaaggcgatgctgaccaccctcaacctcgtcagcttgccaagctctgccactagggcttgggtggcactccggccaactaccctatgtagtcgtagctcctccagggacgttaggttccccatcctgtcagctggtaacctttcgaactccagggctatcaggcacatcaaccgtgtaagtgagcaaacagccggtggcagctcgtctagtccagtatcggctaatatcagtgtctgaagagacctcagatgcccaatttctctagggagctcatcaatagtcgtgccagatatctgtaggaacttgagatgcaacagcttccctagatgctttaggttgatgggtacgtagttgttttctatatgcagcacacggcaaaccctgaagctatcaattggggccataaccgcaatattataatctgtaatgctaagtgacctcaacacctctggcatgtccatggtttcttcagggaagcgctgcacatgttgatttcggacggctagccgacgtagcttgcagtctgagcgaggcacacctgtttgcggcgcgcggcttttactgtcctctgtcgcttgttgcccgctaagggtaatgaaatcttcatcctggacaacttcagatagatcaaacacaatgtcgtaa

SEQ ID NO: 20044 - DNA, 1325 bp, Zea mays
atataatttatggatggaatgacaagccaagctcacttctggtgaaattgcagatctcaccttagttgcctcctccgtcttcgctccctccgcagcgtcagatcggccgtcgctcgccgagccctagcgccgccgatctcagcccgtaccagtcttgcagatcggggtcgcgccgcggcggcaagaacgatggccgaggaggccaagtacctggagacggcgcgggccgaccgctccgtgtggctcatgaagtgccccccggtcgtctcccgcgcctggcaggccgcctccgcctccgcctcttcctccgacgccgctaacgccaaccccgttgtcgccaaggtcgtcctttccctcgacctgctccgcccagaagaacgccccgaagagcgcccggaagagcccacgctccagttcaagatggagttggcacaaactaacactgggaatacacctaagagctactctttgaatatgttcaaagatttcgtgcctatgtgtgttttctccgaatctaaccaagggaaactttcatgcgaaggaaaagtcgagcataaatttgacatggaacctcacagtgataatttggcgaactatggaaagttatgtcgtgaaagaacacaaaaatatatggttaaatctagacaagtgcaggtacttgacaatgaccacggtatgagcatgagaccaatgcctggcttggttggtctcataccttctggttcaaaggaaaagaagaaacaagcaccagcgaaaccatccgatgtcaaaagaactcgtagggatcgtacggagatggaaaacattatattcaagctttttgaaaggcaacccaattgggcactaaaggcgctggtgcaagaaactgaccagccagagcaatttctgaaggagatattgaacgatctctgtgtgtataataaacgaggaccaaaccagggaactcatgagcttaagccagagtacaagaaatccacaggggacactgatgctgcttaaagatgatagacgacttggttgtttatgtgcagaatcgctagttctctgtcggtaactcgggcacacaaacacaagcgtgatctagttttatttgtatgctttaagaggtgttatttgtaagctggatacacatttgtttagagaggaaaaggggaaagataattgaaacaaaatgtaagagtctaaattgttggaccaatgttctttatcgggtattaaatttagtcagttggaagtggagtgaataggcgaaaccaaagaacaaaaaacggcacgagacgaattttaccgtgagttaaaaaaaaaaaaaaaaaactcgagggggg

SEQ ID NO: 20045 - DNA, 1380 bp, Zea mays
aaagatatttgtgtagataacagtagattaaagtctaaaataagagaggagatggtggatgaaataggggagttttgacagcctaattgtaattggaagcctttcttggcctgccctcggcgcggaaccgtcccgcactcacgcatcagcgtcgcacactcgcacgtgcctccgtcttcgctccctcggtccctccgcagcgtcagatcgaccgtcgctcgcggagccctagcgacgccgttctcaagtccgagccggagtagcacgagagccttgcggatatgagtcgcgccgcggcagcaagaacgatggatgaggaagccgagtacctggagacggctcgggccgaccgctccgtgtggctcatgaagtgccccccggtcgtttcccgcgcctggcaggccgcctccgcctcttcctccgatgctgccaacgccaaccccgtcgttgccaaggtcgtcctttcccttgacctgttgcgccaagaagaacgcccggaagagcctacgctccagttcaagatggaattggctcaaactaacaccgggaatacacctaagagctactctttgaatatgttcaaagatttcgttcctatgtgtgttttctccgaatctaaccaagggaaactttcatgtgaaggaaaagtcgagcataaatttgacatggaacctcacagcgataatttggcgaactatggaaagttatgccgtgaaagaacacaaaagtacatggttaaatctagacaagtgcaggtacttgacaatgaccatggaatgagcatgaggccaatgcctggcattgttggtctcatatcttctagttcaaaggaaaagaagaagcaagcaccagtgaaaccatctgatgccaaaagaactcgtagggatcgcacggagatggaaaacgttatattcaagctttttgaaaggcagcccaattgggccctaaaggcactcgtgcaagaaactgaccagccagagcaattcctgaaggagatattgaacgatctgtgtgtgtataataaacgaggtccaaaccagggaacgcatgagctcaagcctgagtacaagaaatccacaggggacactgatactgcttgaagatgagagacgacttggtagaatcgatagttctctgttggtaactcaggccacacaaacacaattgtgatccagtttcatgtgtatgctttcagaggcgttcttttctgtaacaatataagctggatacacgttttttagggaaaggaaaaaagttttgaaacaattgcctgataaatgtgcttcatgggtataaaatattactatatgtaacgctaagttttagccactcaatacagagaaagtggaggatctgaaaaaaaaaaaaaaaaaagcggcc

SEQ ID NO: 20046 - DNA, 1488 bp, Zea mays
tttttttttttttttttagaaaaaaatatatgcatttttatataaaagctttttatataaaaattaatgaaaagttgggaatacagggaaagagttggaaaaaaaagatgattcgaacaaacagcagaattcaaaacttaagcactacaaccaaaattctaacttgtagcagtaacaaacaaaaataacatatatgataactgacaggctcatcaccagaaggggcaggtaggccaacccatcccagtcagcaattcggaaacaaatagtagacagtattgctcattccaccattccagtatgagtgttcccttccacagtttctttcccttcatcctcctcatcgtcaccaagggtcaagtcctcaatcagctcctcaattggcaccgtagggatatcatcaccaactgttgatgccatctcagacctatagtcctcatttttgtacagattcatcttggaccacatccctgagtccacctccaaatccctgaggaaagcctcgtactcatctagcctcttctcttcctcgcccttggccttatttgcagcatcttcctccaccggcaacctcttaagcttccatcgccgtgtgcgaggcctcttctcatagctcttcttgacaagaaccacctcaggtaagctgtaccgggtcatagccatgtccatgtcatcatcattcaggttggcaccatacagatcatacccaagggcgtgatcgccaggattcagcagatgcccaagatgcgtcctcacagtaaagatggcgtcattcttcccgaaatctgacatccgggcaacctgcgcataagccaactggtaccgagacccatcgatgcaaatttcaggcgattctggttcaatgtcaagcacaatgtactccacgagctgcttgctggtgagagctgctttaaaattataaaccctgtattttttctcctccaggtggtgcactcgcagcgttaggggatcaagaagagcaatggcatttgtgaccttgacacagagcacgagcgggccaaggccacccatgtcccgggacgcctgggggctgagcgcgatgaggtcctcgcggcagacggggcagatttcgactgaaaaggtgtacttgtaattgtagacgctgctcttggtgtcgtgcgagacgagctgcttcgctgtccaagcctgggtcggcccggcggtggcaaggaagtcgaccaggcgggcggcatgggaacgcgagccgaagaagaagtcgaggccgccgggggccgccgcgactcggatcgctagggaagcctggccgtgaaataagaggagctgctcgaggtagaggaaggtgcggcggtggggcacgtgctggcggagctggacgacggcgacccactgatcggggttggcctgcgcgcgggagcaggagtcgcagagtcggtcgtggacgacgaactcgacggggtacgtctgctcgaggacgatgccgtggagcacctcgcggcggagggaaaa

SEQ ID NO: 20047 - DNA, 1865 bp, Zea mays
ttagggcaacattggtcagcgctgcatttggctgttgttcggtaatgtactatcaacggtgctgaagatctccggggaaagatcaggaggcactactgcttaagattacttttttttttttttttgtcagaattgctgagtggggtgcatggaaatcaaaatttctagtttgaggattgttcaaatttggtactgaaatctccttggggaaaacattctagagacactactgcttaagattacaatagcaccatgtcaagtcagaataaatgagcgaaggaaaacagaaatggaaattccatgccactgagcattgctcaaatttgcttcaaataaacaagttagccaacaacaaccgcacacctcagtaccagactgggaataacaatcaaatgtactaggagatagcaagattttatccatcttgcaagtttgttcgttcaccgagagaatagaggtccatcaaagcgacaaaccaaccgcatccacatcagccaacaccttatgcactctttatttgctttttctcctcaatcttagcctttataaatgagtagagggcaacaccagaaacagcaatggaagtgccaattccagtctgtgtggtgatcttgttgccgaatgcgatgatggaaaagccaatgacgaaaacacgtttcaacacattgccgatggcatgtgttaaaggggctacccgctccaatgtgtttgtagcaacctggttataaaggtgatagaataagcccaccacaaaaaaattagaaatcaactttgttaatccaactttggcaattgcatctttaaaaccatgctgcactaattgaggtccttcaataataattgcaggggggatgcagacaaagagagcaattattgatatgtatgcatacaagttggtactatccatgtcagtcatagccttcttagaatagatgcttcggtaggtgaaagaaatatttgagatcatggcattaatgaagccagtccaattaaatgagagttcagtgagggatgctaccgagacaccaatcaccactggaacaagagacagccagagtgtcaatggaactggttgtccaaggataaactgggaagcagccgcattgaagaatggctcgagagctttaatagtgtgggcaaatgacacagctacagcagcaaatgacacagtgcttgttacatggccaatggcatggcaaaccgcaactggaacaagctgcttcagaagtgttgagttgattggcgcgcgctttgggatgccgaagctccagccaataaggcagtatagtactccaataaaaagatggctcactgacacaaaatatggataggggaagtagtcgaagatcttcttgttgaggatgttaaatattacattcagaaaataccacaagaagaagaagaaacctgtgacaagagctgggtatctctctgcaaatccctggggcttggcttctccagcgggacctgaggaggctccggccgcagcatcgcagaggaaccgccgcctcgctggatgagaaagggagatgaaggaagaagcgaggaccggagccggacggagctgcctccggcagacgaggcgggtgccctcggagacgtaggcagctacgaaagaaggagcgccgacgcgacgttggcgttgggacacagaagcgccaatggctgcggcggcgccgggaattgttccggccgccgccatttaggcctgttgggagttgggacttgggagtgcggcgcggtgaaggggagagtggggagggcagtggagggtttgtttgaacagtgcgcgttcgaggggacaaggacaactgagatttttggatcgggatgccccccggcctcgtcgcgcccgaattcctgca

SEQ ID NO: 20048 - DNA, 829 bp, Zea mays
  misc_feature (787)..(787): n is a, c, g, or t
gtccttgggatatcatgtggatatatgacagtgatattttaaaagattaactccttatgccattttttctcaacatttatgtattattccatatgtactgatgattcaacctttcttattttggcaggcttgttcatgcctgacccattgatacctgcccattgaaatattacttatggaggttttctctggaaaacatacatgaacacacctaaggctaggtgtgattatactatgctcgccaaaatctgatgcgatctgtgtcccccccgttcgcccccgcgtccgttgaattctcatcttgattgaacagtcaggctaactacactgtcaagcactccatcggatcagaattcccattttgcgaagattagcagcggttacagaatgacatgcatgctatagcaggaactgctgagaatgctcgggatctgtatatttgttgttgtctttgcgttagtgcgcttgcacatattcattcttgaacctccacatttttggtgacgaggtgtactcattctctatataggcctgtttgtaaaactgaccagatgataccccacacgtgctgttttcccttaaaacctagggagcggcatttggttttcgctgtatactgtttcggggcaccgaatatgttgtggcttgattgggaactggttataagaaaagcatgatagattgggaactgaatttctgttatgccgccaagtaaggcacctagttcgaataattgccaaaatatctcttcggaagggaaaaaactttggttagcttttatgtttgngatttttctctgctcttgcttttcacaatcgcatgacttcag

SEQ ID NO: 20049 - DNA, 1221 bp, Zea mays
ttttcatcagtttccaaggagacggagtttgacttctggggcttcatttttgtgacgcttgctgctgttatgtcaggattccggtggtccatgactcggccgccctcgcggccggacagttacggcctgaagaatccgattaccttgatgagccatgttacaccagtgatggccatcgccactatgatactatctctattactggatccttggagtgaatttcaaaagaattcatattttgataacccttggcatgtcatgcgcagttgcttacttatgcttatcggaggatccttagcttttttcatggtgttaacagagtatatacttatttcagcaacaagtgccataaccgtgacgatagctggggtagtaaaagaagctgtaaccattttggttgcggtattttatttccatgatgaatttacttggttgaaagggtttggtcttttcaccattatggttggtgttagcttgttcaattggtacaagtatgagagattcaaaaggggtcagataaatgaggatgacgtcagctctccatttactggtgacgtcaagtacattattatagacgacttggaatatcagaatgaatttgaggaagatacataattctgtaatacagtgaattctaactgccactggcttgttcatgcctgaacctattgaaatagtagttacttatcgaggttttctccggaaaacatgcatgaagaacacagctaaggctaggtgtgattatactatgcacaccaaaatctgatgtgagctatgtttgtcacgatgatgttcaattctcgtcttggttgaacagccaggctgactacactgtcaagcaaagagctaactccatcggatcagaattcccattttgagaagactagcagtgggttgcatattgatatacatgcttagcgggaactgctgagaatgctccggcatctgtatatttgttgttctcttcgcgttagtgcgctgggcgcatattcattcttgaacctccacatttttagtgacgaggtgtattcattctctatataggtctgttttgtaaatgtgaccagaggataccatacacgtgctgttttcccttgaaacctagggagcggcatttgattttttctgtagactgtttcggggtaccgaatatgttgtggatatttgattgaagaattaagaacagcagggtagattggctaacttgccttttgaggtgtt

SEQ ID NO: 20050 - DNA, 2375 bp, Zea mays
gatatgagattttctgaatctgagtatgatccttcacatgacgattctatgaagggggatttgtttgaccatgatgatcataataaggtgatggttcctctttcttattagggatgcatttgtttacttgctattcaaatatgtccatctactttattgattgattcatgcctccatttctagaagggctcaaaggacactaacagaagaactattcacatggctcctggtggaatcaagccctcgaactaagagagtttatgcagagcgacatactactagaaatacaaggtcaaagaaaagcattgctcagcctgacacaagtctaacacgaagtgacatctatgtgccaccaccctcgctatctcatttgacccaagttggagaagttgctcgtagcattgaaaaccatagaaagactagtgttgaaggctagttttgtactatgtttcttagactttcattctattagttgtgattgcatgatgaatgcactcttactgatttccttttatttcagctaagggccctacccaggttgacaacacccacatggccaatcgaggtgaggccattgctccacctaataaggggcacaaccagattggcaaccctaatgggcacaactagattgacatcggcgatgatgaattcttactaccattatattactttgattgtattgtgagtgcattcttactgtcttccttttttagaagatggctttgaccaatttgatgacaacatgaccaaccaaggggaaggcattacccagcctggtggaaaaggtgatggtatatttctatatttaccatattgcatattacatcactagttgcttgctaaacctatcatgtgtcattagtttctactttactggatgttcttttgaccttttcaattagattcatgtgccatgtgtcattagcttgtcaatagtccattggatgatcatctttgatccatgtttgatgcacctcacttattgcaatttctatgtgaatctaaaactaggagtaaatcagcatagagaaaggggacttaatatgggacttggtctccaaaggatgaaccgagctcggcgtggcaaactgccaattgtcattactgaaggaaggataaggcctgtggcaccaattgttgctgcaaagtttgcaactgagtgcaacattgcagttcggaatcatgtgcttgtgcttaagtcatggaaggaatacgagaagcatcctgggctctttaaattgtttacagcaaaacttagtgcaaagtttgatatcaatacagaagatgcgctagttaaaaatgcttgtttccaaatgatgaggaatgcactgcgccaacaacgatataagctgaagaaacaatattttgacccttttccgctacatctagtgaggaaaacatctcctatcaaatcgacaagtgatgaacaatggaatgaccttgtggaacattggaaaggtccaaaaaatatggcgacatgtgaacataacaaaggcaaccgaggcaaagttaagttccatcaaacaactggatctcgtagctatatggttcatgtagaaaatttgggggacaagtacatggatcaagaacctgatgcattggatctgttcaaggagtgccactacagtaagaaaaagcaaggctacacttccactgtacaactggctattactcaaatggaagacaagcgatctacaccaggagaaggtgaacaaccaatgtctacgactcaggttgtagctgatgtgcttgctgagaacacaaagaagaatcggtttcttcaaaatgtgggaatccaaaatgcacgacctagatctagtgtacaaaatattgaagcacaacttgaagtagagaggaaggcaaatgcagagcttcaatcacttgtcagcatccaacgtgagcgcatggatgtattattaaagcaagtgcatgaagcagaactggtaaggattagagagcaagaagagatgaagaagaagcaagatgccatggatgctcaacttgagcttatgctaagtcagattcaaccaagttaaagctaactagtatggggtgttaggctttgttggtacttctcttttgctgatgctattgcattctattgatggataaatacgtttcaatccattttttgtctattgtgctgctagagtagctttagcggcatgtgtggtgtgttggagtggcttacgtgtcagtggttggatacttgctgtaatgacatgctattggatacttgcatgtaatgacatgctggagtgtggtcagtattttttgtgatgagatgctggattaaaatctgagttgtgatgtaatagaattcaacattttgtccttatgttctggattatcattaaaatatattttaatta

SEQ ID NO: 20051 - DNA, 2080 bp, Zea mays
ttttttttttttttttttaaacaatacttcactatataaacaatgtagtacaaatcctctattacagacaacgtcacgtagtggcagaaataacgatgcagatagcacacgatattgcccggcaacggcgcgaatagtagcaacacctgtccagccatctcgggatggcaacacatgttttcttctaaaaaaaagctggatcagtaccacacaaacaataacggctgctattttacaaatggattcgacacacatattcctagttgtacactactagtgctgtgacccttaagatacacagcatgcaccaactaccaggcacagctaatgcagcctcagcctgcatctgcaatgtttgagcctgaacctgacaaggactgcctgcaccatcaactctcggttacgatcggcatttctggatgatgccatggtctagacagttagtaagttattcatactgatctggcatctgtacatcagtcacagccatctactgctccaggttgatcggagcgggcgctgaactatgaaaggtttcgccaccatgattcggcgggcttcagattatacaggaggggtcgtcatccacgacatcggctggtttatcctgctgctggggagtgcccacttccaagaaatcctccgcgttgaatttctcaatcccatcccactcatctggtcctgtctcccacatgttcgtcatgctaactcctgtgttgtccgataagagccagtagtctgtatcagcatcaagctccgaagggacaatcttcatcatccctgaaatgtcctgtgaactactaggtgcatcagaaggtaggataagtcctccgtgaatatttgattccatccctgtgactttgttgcaatccgcagccaaaggcgtcctaggattctctagagaatccatgcttattgtctgtgtaggccttggaggagtctccatgccactcatctcctcaaattgactaactaggtacacatctatcggacccatggtacttcttaggacaatcctatatctcctttgaggataatcattaacctcatcaggatctgggacttccaaagttgtgccatgcggtgcttttatagcaattagagtctgattctggaagcatggcaaagatttgatatcttcttccgtgacataaagccacttttgattattttcatcttccgtaagccctcttaatctgtcccgcatttcacttattcgttcatccaaattgcgctcttgcagtgtgagagcatcaatatctgcctgtaaaatggacatatcatcactaacttctccgggtcgagagtcgtcaactcctttccaacggatgttgttcttaagcttcttttctatcagtcctatcccttcaagaacattagtgatgtcatatatacgccttttctgtacctctagagtttctgcagcattattcagatcaacaatgccaccaggtgcaccttttagcaagttcaggaacttctttgtcaagagcccgagggagctatcatagcggcagccaccaacaggagtagaaggattgcccggagaaccaaaacccaaaggggtctgaggaccagatttctggcccttcgtagccttaggcttggtggatgcttttaaacctttccctgaagggggtgtaggaactgggctgctgccagcattagcatatccagggctcatccagtcatttgattcggcagcttcattttctgttctgtcgttatgtttccgtttcaatggcgtcctgaggacaaccgcctccaccatctcgtcggtggcggcggaaggcgcgccgaagtggtggtactcccctggcggcgtcgcaaacggccggtgctgctgcagcagcgcccgtgccctggcctcgccggccccgtcaccggccgccgccgccatggggatcggggcaggcgcgggtgcgcggatcggaggcccggtcgcgggcgcgggcgggcggcagggtcctggagctgggatctgaggaggaggaggcggcgggcgagggtttgcgcggggtagggggaagggagggaagaaaacgagggaaacgaaggggtgcgagaagcgagggaaatt

SEQ ID NO: 20052 - DNA, 2027 bp, Zea mays
actagtaacttatacacgtatccgcttgagcacatagcacagcaaatttatatgactacaagtccgttctcgaatatttatcgcccgctaatttttaaactaaaacacgacaattaaaaaagaacggacagagtatatagtggacaataagtgaaacagttgtttttttttttttatccactgcatgttttatttactaccatccgttcacaagatatatgacaccgttgactttttttttttattttttttggccgtcttattcaaaatatttattcaaaaatgtaaaattttaagtcaatcacaaactatgatgcctagacacgaaagagatggaacttacaaatagtaaaactcttgctcttcctagaatttggtagtttcagattcacgcctattgctgggaaccaacatatgttagttcagctcctaagaactgagcatcctgtctggttagaaaagttagtctttacaaacatgagattggtatcatctcatcgacactgaactgaaacagtagattcattgtggttttgctgcacataatcgagccttgccagggttgagcaaagattctgacattatccaaccctgttcccttgctttcttcttgaatgttccgtacgatgaggaaacaattttgcaagattcagctatgtgcgccaggaaatccacgtttctagagtacagatgctctgattggtcagggtttgcctgcttctgcttcagcttcagcctccgtgcatgtgatgcattaataaaatgcagtagcacatgagcatgaaaagcagctttgataatgtcatctgattttgcttggtccttgagcaaagcatacactttatcctttgtcgggttatatgttaccatgtatctctcgtcctcaaacaggggtcttatggcaagaaatgaagctggctcttgaaatgcttctccaaaccttgaacctatggcgactgtctcgtgccgccaaggtggattaaatatcgtctcctgtgagtttccttccttcaaggagggaatgtgaccagttttaatgaaggaatctactgcgacggtgaacctcgctctgtttagggtattcagcacaacagatctcacctcttgatatgaactcaggagatatccacaggaaaggaaggcaaacgaagtcaccagtgacgggttcctttttgagataaagatactcaaaccagtaccaagcagatctgcaatgttcccgacagattcgcctttagcagtgacatctccaatgttttctcctctagcataggccttatagataggagtgcgagttgaagttgatgtaacagcagcgacgttctttacaacattggctacacaggccataggcaagaaaaactgagggaatgcagcagtagttaattctatcccagctcctatttccaacaagagatcactagaaaaccgcaactgctttaggtcattgtcaaacttctttccttgacgtgcaaaaagcatttttccaacacgcccagcaccatccttgctttgagagactccaacagaactcagcaaggttcttgtcgtaaacacccccatggcaccaccaaagaaatgcttcagagccctccagttcatgtaaggtacatatgaaggagtaacactgtctggaaacccttcaggcacaacatatgatcttatgaatgacattatttcctcggcaggcggaagcggcgactgcagcggtacggccctgacggaggcgccagcggggacagcgaccccgccactgcccctccccttcgcggacccgccgtccaccacatagctccagcgcctcccgtccacctcctccaggcacaggaacccctgcagcgccgcggcgggcgccggcctctccgtggacgccggagcctcggcgggccgcgacgggatcgtggaccgcatgacatcgcgcacagccagccgcgcgtcgggcggcggcagtgtgatagtctgcgtggcggagcgcttgagcctcaccgctggcgccatggctgccgcgtccggtggatggcggcgac

SEQ ID NO: 20053 - DNA, 2536 bp, Zea mays
gggggggggggtgttttttacacaacaataacttcttcttttttttgtaaaaaagagcatacacaataacacagcagtggataccatactacaggtccacaccagcacgccatatcaacagaaagaaggcttgcagttattaccgatcatgggggggggggggtgaaggagaaggagccatcgacgacatcagtgatgactcttcactgagaaactggaacttgctaagagcatctcccgcagctgctggtgatgctctaacgggggctagaagccaaggagatgaacactcaagtgccacaagtcggccaagtggcggggaaaaaacgtagcaactccaaagacttccaaacaagaagccccgcagccgaccaacacccgaagggaaacaggttacatcaggaatggctacaccaaatctgataccgcagcaaacataaatacaagctctagtctgtgcagttagcagtttgaagtcaacctcgttgagccctttactcgcgagtcgcgaaccagcgcaccacttatccactgcatgttttattacatgttcaggcattcttcctgtttatatgccgataatttcaaacacaaaaacgatcagaaactagaagtgcaccctacaacgcctagacacaaaagagatggaacttacaaatcgtaaaactcttcctcttcctggaatttggcaagcttcagatcaaaggttcacgcctagtgctaggcaccaacatatgttagttcagctcctaagaacttagccatcccgtctcgttagaaaagttggtcttacaaacatgagattggtatcatctcatcgatactaaactgaaacagtacattcattgtggttttgctgcacataatcgagccttgccagggttgagcagagattctgacattatccaaccctgttccctagctttcttcttgaatgttccatatgatgaggaaactattttgcaagattcagcgatgtgtgccaggaaatccatgtttctagagtacagatactctgatcggtcagggtttgcctgcttctgcttctgcttcagtcctccgagcatgtgatgcattaataaaatgcaatagcacatgagcatggaaagcagctttgataatgtcgtctgattttgcctggtccttgagcaaagcatatactttatcctttgttgggttatatgttaccatgtatctctcgtcctcaaacagaggtcgtatggcaagaaatgaagctggctcttgaaatgcttctccaaaccttgaacctattgcgactggctcatgccgccaaggtggattaaatatcgtctcctgtgagtttccttccttcaaggagggaatgtgaccagttttaatgaaggaatccactgcgacggtaaaccttgccctgtttagggtattcagcacaacagacctcacctcttgatatgaactcaggagatatccacaggaaaggaaggcaaacgaagtcaccagtgagggattcctttttgagataaagatactcaaaccagtaccgagcagatctgcaatgttcccaacagattcgcctttagcagtgacatctccaatattttctcctctagcataggccttatagattggagtgcgagttgaagttgacgtaacagcagcgacgttctttacaacattggctacgcaagccataggcaagaaaaactgagggaatgcagcagtagttaattctatcccagctcctatttccaacaagagatcactagaaaaccgcaactgctttaggtcatagtcaaacttctttccttgacgtgcaaaaagcattttcccgacacgcccagcaccatccttgaggatccagttgatagcaatggcacctggtgttaccttgctttgagagactccaacagaactcagcaaggttcttgtcgtaaacactcccatcgctccaccaaagaaatgcttcagagccctccaggtcatgtaaggtacatatgaaggagtaacactgtctggaaacccttcaggcaccacatatgatcttatgaatgccattatttcctcggcaggcggaagcggcgactgcagcggcacggccctgacggcggccccagcggggacggccccgcccctgctcctccccttcgcggccccaccgtccaccacgtagctccaccgcctcccgtccacctcctccaggcacaggaacccctgcaacgccgcggcgggcgcctgcctctccgtggacgccggcgccacggcgggctgcgacgggatcgtggagcgcatgacatcgcgcacagccagccgcgtgtcgggcggcggcagagtgatggtctgcgtggcggagcgcttgagccccaccgctggcgccatggctgccgcgtccggcggacggaggcggcgccgaggccgaggtcgaggcgtagtcaggtgggcggaagaaaatttacttggcgagtggtcgcgacggtcgcagaggtggctggcagtgggttagagagagagagaaggcggacgacgcgaacaatcccgcccggcctcgaggtacccaatg

SEQ ID NO: 20054 - DNA, 3176 bp, Zea mays
ctgcagttagaagtttgaagtcaccctcgttgagccctttactcgcgagtcgcgaaccagcgcaccacttatccactgcatgttttattacatgttcaggcattcttcctgtttatatgcccataatttcaaacacaaaaacgatcagaaactagaagtgcaccctacaacgcatagacacgaaagagatggaacttacaaatcgtaaaactcttcctcttcctggaatttggcaagcttcagatcaaaggttcacgcctagtgctaggcaccaacatatgttagttcagctcctaagaacttagccatcccgtctcgttagaaaagttggtcttacaaacatgagattggtatcatctcatcgatactaaactgaaacagtacattcattgtggttttgctgcacataatcgagccttgccagggttgagcagagattctgacattatccaaccctgaaacacaaaacacaatgtggttggttgtcactgtcagaactaacatatataatggacatgtgcatttatcatgaagacggggagtttttacctgttccctagctttcttcttgaatgttccatatgatgaggaaactattttgcaagattcagcgatgtgtgccaggaaatccatgtttctagagtacagatactctgatcggtcagggtttgcctgcttctgcttctgcttcagtctccgagcatgtgatgcattaataaaatgcaatagcacatgagcctgtacagcagaaacacattgagcatatgggtaaaaaaaccaaaacacatataccaattacatcgcactgagaaacacatgcttacatggaaagcagctttaataatgtcgtctgattttgcctggtccttgagcaaagcatatactttatcctttgttgggttatatgttaccatgtatctctcgtcctataattaagataccagatgttcataccaaaagcagaggttgtatgccaaagaaatgaagctggtgtccagagtagtttctggagaaattactgcacatatatgaaagcagagtagtttctggatttgttttttaattgctggtgtccagagaggacatacctcaaacagaggtcgtatggcaagaaatgaagctggctcttgaaatgcttctccaaaccttgaacctgaaatacagttgaaatagaatatgaaaattgtcaccaatatctcaaggaacacaatttgaataacacttgcacttgcacaaacctattgcgactggctcatgccgccaaggtggattaaatatcgtctcctgtgagtttccttccttcaaggagggaatgtgacctgtgtcacataaaactaaagattcaagaactggacaaatacaattcaaaattttgagttaatacttctagaggtctagaaaagtcataaacaagtttcaagcttggaataaaactgaactatgtacgaatgaaaaaggaaaactaagatgtgttttaaaatctttgggctccattttcagtaagcagcttctatagatacatagcagtatagcactgcagcatcctgttttaaaaacaagcagatttttcaacaagtttcagaactgatcaaaagaatttaggtgctagttttcatatatgatacataaagtcctacgatttcaaatcaaatacaacttaaatggtgcaaagagcaattgaatatggaccaccagcaggtattttagcacttcccagaacagttcaaatatatgttttcaagtttgacataccagttttaatgaaggaatccactgcgacggtaaaccttgccctgtttagggtattcagcacaacagacctcacctgttaatcaacaatatcaaattattaatgatagaattccagtcttttacaaacgctgaagctactcgctagaacaatgaaagtgaacctcttgatatgaactcaggagatatccacaggaaaggaaggcaaacgaagtcaccagtgagggattcctttttgagataaagatactcaaaccagtaccgagcttcaggtggaataaaacaaaaaggagtcagtgtagctgctaaatcatgttaatatatgagaacaataacattcaaatataagcagaagcctttctgttgattgtagtgtagtaacaagccaaaccaaattttgtcaaacatgagcatcttattatactaacaaaaaaggacatttcacgaaatgttaatttggcatgccaccatgcaacaagaaatatttagaggtaacagtatgatgaattgatttttaccagatctgcaatgttcccaacagattcgcctttagcagtgacatctccaatattttctcctctagcataggccttatagataggagtgcgagttgaagttgacgtaacagcagcgacgttctttacaacattggctacccaggccataggcaagaaaaactgagggaatgcagcagtagttaattctatcccagctcctatttccaacaagagatcactagaaaaccgcaactgctttaggtcattgtcaaacttctttccttgacgtgcaaaaagcatttttccaacacgcccagcaccatccttgaggatccagttgatagcaatggcacctggtattaccttgctttgagagactccaacagaactcagcaaggttcttgtcgtaaacacccccatggcaccaccaaagaaatgcttcagagccctccagttcatgtaaggtacatatgaaggagtaacactgtctggaaacccttcaggcacaacatatgatcttatgaatgacattatttcctcggcaggcggaagcggcgactgcagcggtacggccctgacggaggcgccagcggggacagcgaccccgccactgcccctccccttcgcggacccgccgtccaccacatagctccagcgcctcccgtccacctcctccaggcacaggaacccctgcagcgccgcggcgggcgccggcctctccgtggacgccggagcctcggcgggccgcgacgggatcgtggaccgcatcacatcgcgcacagccagccgcgcgtcgggcggcggcagtgtgatggtctgcgtggcggagcgcttgagcctcaccgctggcgccatggctgccgcgtccggtggatggcggcgacgcctggtcaggtgggcggaagagagataatatagagtgccggccgg

SEQ ID NO: 20055 - DNA, 883 bp, Zea mays
aacttgctaagagcatctcccgcagctgctggtgatgctctagcgggggctagaagaaaagatgaacactcaagtgccacaggtcggccaagtggcgggtaaaaaacgtagcaactccaaagacttccaaacaagaagccccgcagccgaccaacacggaagggaaacaggttacatcaggaatggctacaccaaatctgataccgcagcaaacataaatacaagctctagtctgtgcagttagcagtttgaagtcaccctcgttgagccctttactcgcgagtcgcgaaccagcgcaccacttatccactgcatgttttattacatgttcaggcattcttcaaatcgtaaaactcttcctcttcctggaatttggcaagcttcagatcgaaggttcacgcctagtgctaggcaccaacatatgttagttcagctcctaagaacttagcatcccgtctcgttagaaaagttggtcttacaaacatgagattggtatcatctcatcgatactaaactgaaacagtacattcattgtggttttgctgcacataatcgagccttgccagggttgagcaaagattctgacattatccaaccctgttcccttgctttcttcttgaatgttccatatgatgaggaaacgattttgcaagattcagcgatgtgtgccaggaaatccatgtttctagagtacagatactctgatcggtcagggtttgcctgcttctgcttctgcttcagcctccgagcatgtgatgcattaataaaatgcaatagcacatgagcatggaaagcagctttgataatgtcgtctgattttgcctggtccttaagcaaagcatatactttatcctttgttgggttatatgttaccatgtatctc

SEQ ID NO: 20056 - DNA, 1540 bp, Zea mays
caatactactttggagatatatttatatactatttatatttttatatccttcctctttttattctctatttctattttttaaatcctaaatttcaatttagtgttccacccaattttaaagttttgttatattcctatttgagttattattattattattaaatgcacaaacaaaactcttgtgtgatgcatgctttgtttgtgttttagtaaggggttattctcttttaaatggacttagtcacatgactcaagaagtaggtggccaatcacatgatgagatcaatttttatataagtcttataatttgggtattataattaactagagacctatataaatagaagaaaattaaattaccaaggaattaagttacaaattttgattttttttttgtgggtctctagatgatggatgtgtgagactatagaggagtaccattttgcatcctaaatgcacagaattttttgccccttcggccccacctcgtgatcacccgttccgtgctgctccgcctgccccacggccccccgtgccggccgcgaacttcgagagccgaagcgaagcggggccatggggagatcacgagcgactgccgccgccgccacctccaggcccaggcgcaaccccaagccaaagccggactcccccttcctctccccgctcgcgtcgctgtctgccacaccgcgcatccgcacccgcaagggcgccatccgccgcggcggcccctcccacgcgtcgtcgtcgccgggttcttcccccaccggtctcaacgtcagattcctttcctcgccgggctccgcctccccgtcgaagcccaagccgaagcttaggtccagtgccaagcccaagtcgcgcccctccttcgtctccccgctctcgtcgccgtcacccgcaccacgtacccgcaaacgcaccgtccgcggcgtcggctcctcacctgcgtcgtcgtcgccggggtcctctccagccgaactcaacatcagcttgccctcctcgccgggttctccgcctccccggcgaagcccagtgccagggccaatctcgccgcgcgcgcccccttcgtcgctagcccccgcaccgccacaccttcccccgccgcgtctccccagcctgcttcggtgtcggcgaaggggttatccagcgtcggagacctcaggaccgccgtcgcctcacagatggagaacctcaagcgccgactcgacgcgctccattcccgcgctcacgacgacctcgatgcgtccttctcccgcatctccaagcgaatcaaggtgagcccgctgcgagcctttcccgcaccccgctgccctcccagttgcattggtgtttggcttcgagcttcgtggtttgtttcgccgggtcctgccaacacgaactgctccagattgttggttgatgttgtagagtgctactgtgctagcgtgtaagggactggagataaccattggcactgtttgggacagtatttttctaaataggttttctctagatttctagatagtctaacttttagatttctagatagtctaacttcaaagag

SEQ ID NO: 20057 - DNA, 2244 bp, Zea mays
ccccgcgtccggccgccctttttttttttttttataccggaacatgctctccatataatttgccatcagccatcaggcgttttcacatatctcgtcctctttctagcaatggagtatgctgtgcacacttcactcagttccatcgatcgcgaacggtaattaacgtagacaaaaccacaagtgcaaaatatgaaacgctagtaatagtagtataataatatagttttgcatggaactcgatggcgcgccatgcgtagcgtagttgcgctttcgctctagcaatcgccattcaccacctcggcgtgggcttgcacacgaggggcttctccatctccagggacatgccgaggcgctccgccaggtcgacgccgcggccgtcggccggcgcccaccggaagcggtgcagcagctgcgcgagccagaggtggacggtggcgagcgccagcgtcttgccggggcacacgcgccggccggcgccgaagggcgcgaggcggaggtcgccgcccagcacgctcacgtcctcctcctcgaaccgctcgggccggaacgcggagggctccggccacaccgcggggtcgtgcgcgatggcccacatgttgaccatggccgtggtgcccgcggggaccacgtggccgccgaccaccgcgtcgcgcacggccaggcgcgcccacgagagcagcggacccggcgggtgcacgcggagcgtctccttcacgacgcgctgcaggtagggcaggcgggccacgtcggcgtcgcaaacggcgcggccgcggcccaccacggcgtccagctccgcctgcgccttggactggatgcccgggtgcagcaccatccgcgccatcacccactccagcaggatcgccaccgtgtcggtccctcgaaagatcatctcctgcgcgtgtattgtgttactgtttgaagaaacaaacgaaacgagtacacgagcatgcgccgagctgagcatcgacacgtacatgcgcgcagtgcgcatttcgtagctgatcgatccatgctacgaaatgacatgtccatgaatgtcagcagctgttcttggtaccgtatgaaagtgttcggtgttccttatttcttacccagaggacagcgatcatgtcggagtccgacagcttctcctcgccatccagtcccagcaagacgtcgacgaagtctccggcggcggccggctctccaatggcgtcgtccttcttgtgcctgtgctcttcgatgatcctggccacgaacacgttgactctgcccaccaggctcctgcaccgcctcctgacgccctgcaggtccagccacctgagcagcggcaggtggtcaccccagttgaacatgccgagcaggtcgtacccttccttcaccatctcctccagctccgcgccctccgggctggcggcgtcgtagcgcgcgccgaacacggtggccatgacgtggtccagggatgccgcgtggagcacgcgccgcatgacgacctctcgtccggccgcgcccgagaggaggtcccgcagcatgcgctcgccgatggcggcgcggcgcgggcccgccgcggccacgctgcgcgggctgaagaggtacgcggagctgatgcgccgcagcgcgcgccagtagtcgcccgacggggcaaagcccatggcgcggtggaagaggagcccccgcgccgcgtccttcacggggcggtcggcgaaggcggcgctggccaggagctcccgcgcagtgtccggctggctcgctacgacgaggcgcgtgaggccgacggagaaggccgacagcgcggcgccgccgggcagggaccgggacagcgacgcgagggcgcggtgcgccgcggggcccgcgagcgcggtgaccaggcccggcgcgcccggcggcgtcgcgcgggacctggaaacgaacgcccacgcgggcccgcccgggaagagccagagcagcgagacggctacgaggagcacggtcaggagcggggagagcaaggtggcggctgaagggaggaggaagagtagggagtcctgggtggtcgtggtgctgagggtggcgtccatgacgacggcgtggtgggggagggaggtgggaaggctggatggtgtgggttttgggtcgggggggcggagagggtttaaatagaggaaggcaaaggaggcagacgagcagaccagtgtgctgagagcatgacactagtaacggctggaggagaaatggaaacgcattgtactgattccctgattaaaggagagaatgtagccgcttttg

SEQ ID NO: 20058 - DNA, 1807 bp, Zea mays
  misc_feature (339)..(339): n is a, c, g, or t
ttttttttttttttttacaaaatattgtcctgtgatcaactggcagttactcccaagggacacaccccttgggagactttgtatcccctgtataaatacatgacactctgcaataaagacgatggttctgtcatttgtctctctcaatctcgttaccactgagtacactttaacacgttatcagcacgactcgcgagagaaccgagagaaatttctgttggagacagacagaggacatcgctcgctgtacaaggaaccgatgatcggtcaaggcaaaagcagacaggaggaacatcgaacgcaaagaggaagaagaggaaaggatcgctcgctgttaanaaaattggagggctctgccgaacaacaggaaggtattgaacctattgttcatctttgcgttcgtcgtttgcgtgaagaactttgtgacgaccatcggcctagcgtggcaacgacgcagcttcagagcgcccggcgaggcccggccatggcttggcatgcgcaggcacgcgcacgcgcgcacaggccaacccggccatggcactccggccccggcagcgggcgcaggcgcggcttcctggcggatggaccccgcgggcgcgtccagccacgacggcgcgggtgtgacccgaccacgggctcgggcgccggccatggcggcgcgggctcgtaccggccgcgagcggtgcaggacacggcgagccccggcgctgcccaggcaggggcaagcgggcccctcggccgcctaccggcgcgggcgcggccgtcctcagcctcggctcggtcggccctggtgcacggccggcctcagcctcgtccccggcgcgggtggcacggcgagccccgacgtgggcgcggcggcacggctagtcggcggcggctggatcgctccccccatggcacggctgcgagcgttgctcggccacctggcgcgggtgcgagcgctgctggcgctccggcgcaagggcgggctctccggcttctcggctcgggcgcaaacggtggcggcccggcagcgggcgcgaccggcctaagcctcggccactgcgcgggcgcagaggcgccctcggccggccccgacgtgggccctgctcgccctgggcggcacgaccagatctggctaggcgcgggcgcgtgcttctaggcagaggcagccgggcggcacttggcgtgctccttggtggtgtctccctgccggtgcgggcagtgcctcgacgcgagcacaagcgctgcccaaccacagcctactgcaacgcacatagtccatatgcgaggcgatcttggtgcgagcgcaacctcaagcaccactgaagcggagcgtaccgccgaagaagccgcgcgaacggatcgtgatgagcagtagtggcgagaaagctgctggtgccgcacctccgcggtaggcggcggcggcgtgagcatccatggaacggcttccgcgtccaacctgtttgcacaaatgtgagcagttcccagagcgctctccctccttgtcgtacgccctgcattccctgttgaagcatttttggttgctttgctttggtggtgtcaaacgagatggcttaagcagaagaatcttggcacaactaagcagacttcgtacgataatctgtagttttttttaggcaaaacaactatgtgtttcattttttccctacagtttctagtacaagatcttttgattgttgagttactgttttaattattgttagtgcgtctaaatttaaatatttagactactaatgatatatgtaactgtacatagttgtctattttcaattttgaaaaatgctgaaaaaaaaaaaaaaaaaaa

SEQ ID NO: 20059 - DNA, 1874 bp, Zea mays
  misc_feature (13)..(13): n is a, c, g, or t
gggtacccctcgngggccggccgggaccgcacgattaagcctgtccgtgtcccctcgcggcctcgcccgcccccaaaccaaagggaaaccctcaccacgcttcccgaaacttctcctttctccatcctcaaccctactcccccttcatccgcacgaacgaagcagcgcgagcgaggagcagacgatccttcccgacctcgaagcctaccccccttccagctgcggccatggcgaccgtcatgcagaagatcaaggacatcgaggacgagatggcaaggacacagaagaataaagccactgctcaccatcttggtcttcttaaggctaaacttgcaaaattgcggcgggagttgctcactccaacatccaaaggtggtggtggtgcaggtgaaggatttgatgtgacgaagagtggagatgcacgtgttggtttagttggctttccttcggttgggaaatcaacattgttgaacaagctaacagggacattttcagaggttgcttcctacgagtttacaactttaacatgtattcctggagttatcatgtataagggtgctaaaatccagcttctagatctcccagggatcatcgaaggtgctaaagatggaaagggcagaggaagacaggttatcagcacagctaggacatgcaatgttattttgattgttcttgatgccataaaaccaataactcacaagcgtcttattgagaaggagcttgaaggatttggcattaggttgaacaaaacaccacccaatttgactttcagaagaaaggacaagggtggaatcaacttcacatcaacagtgacgaacacacatttggaccttgatacagtaaaagcaatctgtagcgagtacaggatacataatgctgatgtctccctgagatatgatgctacagcagatgatctcatagatgttattgaaggaagccggatttacactccttgcgtatatgttgtcaacaagattgatcagataacactcgaggagctggaaatcttggacaaacttccccattactgcccggttagtgctcatcttgaatggaatcttgatggacttctggagaaggtatgggaatacttggatttggttaggatatacacaaaacctaaagggctgaacccagattatgaggatcctgttatcgtatcatctaagaagaaaaccgtggaagatttctgcgacagaatccacaaggacatggtcaaacaatttaaatacgctctggtatggggttccagtgtgaaacataagcctcagagagttggcaaggagcatgagcttgacgatgaggacgtcgttcagatcattaagaaaatataggcgtatcatgtggtggaacaaaacctgttttttctggaaaactgggagcgttgaggattttgttgagtagtagcctcgcgagaagagcttgaactcggcctttgcttgttggtgaggctcatatgtaatgttccctgttctcagaaaatttgctttgatccaaagacaatgtgagtcggcatttacttatatacaacgagtcatgtagctgtgatgtaacttcctctaacttggtgccatgtggactggagtcaccgatgtgtgctgccaagtgtctggcccaaccgttgaacacgtggagagatgctctccatatctttagaggaggatataaggtgatttgatgatttatttattaagtgtttgtaccttaaaagaaagaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccccccaaaaaaaaaaaaagggggggcccccccaaaggtttcccc

SEQ ID NO: 20060 - DNA, 2992 bp, Zea mays
accctaactgtgatgattcctcgtgccgttttttttttttttttttgcttaacaacaaggacattaacagaagttactttgatggctgattgccaagatagtcatcctcagtggttccatcacgtccagtgaaacaggagaaaccgaaagctggctatagaagggcctgatctaaccagttcccttccaacaacaggtttgcaaaagggtacaaagaaaacgtttgtaagaatgtgagcagacgcatcatgatgcaccggaccgcggaagccttcagcttatggcgacgccttcccgtgaacaatccagttcagcttgcgcagagtcagttagatcccactcgatttacacggggcttcaccggagtcttggaagggctcaccctgacaggcagtgttcccaaaatcatcccgctgcaattcagagccatgatggcaccctcagcatggacaaattcaacaaaagcaatccttgtggaatgtacattatcccctagaagcctcaaccgagagacctcaccgcaaagttcttcaaagaatttctttacatctaactgagtaaccatcttatctatgtttgtacaatagacagttcgcatgaccatttccttctcgtcatccgtcctgggaagaaactttggattaacaggtaagatagctgtctttgacggcaaaactctaacagggtagaaaccaaaaattgtgcctcccaggttaagcgcagttctggcgccctcttcatcagagaactcaatgaatgcaaacctaagaactgagtggggatcaccacaaattctgcaatcaacaacttgcccacaggtggtaaagatatcagcaagtctctcctctgtcacagtatggtcaagttcagagacataaacagttcgcctaatgctgtcctctctgtctgcccgcctcactctaccatttgtcctcctccttccttggttgatgtatccattccccctcgtgcgcggctggtgcccaaacccaacgtaaaacgcagcgtcggtggccccattcccgcctccgatggagtggtaatcgaacaccggcgcatccgccgacagcgccttcttgggcggagacgcggccgcggaggggacgaactccttggcggccgggttgaggttggacagcaggtccaccagcttctgcacgcccgcctggtactccacctccttcgccgccgaagaagccgatccctctgccaccgccgccgccatacctaggtaggactgagacgaggcggatcgagcgagcgagacgccgacggccgcctgccgatctcggtcaaacccacccgcggccggatgggtggggtagaaagtgccgggcggatactactggcgcgaggccatcccgcgtctctgcctgcacaccggagatgaggacggtggtgtgttgtgggtggcggatgtggtgcgacgcgcgcctgtgcgccctcgccaacggcgtcgatggattggggggctgctggagagagccgcgggcgggtgggttctagtgcctcaggttctggccatttccggggtggagactgggaaatgtacgcgagagaggatcggggggcaggaagcgaaacggaaaccggagagagccagcccagccagccgcgtgggcatgatcgaacggatgggtgtttctgcagtctgcactgcacggggaggcgtgaagcacgtgcgtccggaaccactgcttgtggtaaacgacactttttgataatcaggcgtctactgcctccatatccgacagcaataacagtgagctcttaaaattcagcctattttgagttttaaggggtgtttagaattgctccaaattacagctctagagctatagtttataatataaaattaaatagttttaaaatatatttttattctaaataataaataaaataatttatctaaatattttctaaaggttcataactttagctccacaattttctaaaagcacataatgatctgctttaacaactccatcaaaatatactagagttgtagcagtagcaaagacgacatgtatctatacattttttacttcgtgaagacactaaccacattttctctaaggctatccccaccaggccacaagctctttcatctcattctctatcacaccttttattttaaactccactcacaaatagcgttgtctacagtgcaaaacaatattttatacgaccagatacatgatctattagacacagtctaagtgaactttcgcttgccaatgctggaaacatgggcggaggacccaatatttcttggtgttggtcaagcaataccttgattcaacccaataaaataccaatagaaaaataaatctctatccctaactttattgttcccagtcgactagaactgcctccggttagccccacgcgccttcattgtctgcccaatcgcatgctactcatggtgcgtgccttagcaacccacccagctccaaagcgtctccacctaggcctagcttcacgctcgtcgtttgtcctcacttcactcatcacctagctccacgtgcgcgtcgcgcctcaacctagcctagctctatggttcacccttgacccctattccgcccaatactcagctccgattcttgttgtattgctgccattatcgccattcgcccacccttgttcttatatcggcgaggaggtcaaagcagattatcacagcagcctccgcctagctccacgcatcaagatgaccaatgattagttaaatgatttgatgatgttctatatcaaaaagagaaatcttaaatggacttgatcttcataaaattttaaaagacatttcaaagtaagaaaaatatataaatgcacttgcctaggtatcctagaactagactaaactagaggtatattcatatttcaattctacttcaatttaccattattaactcattttctctttctcccgattttattcgcttttataacaattggttgtagatggattattgacacgatgacccttaattaa

SEQ ID NO: 20061 - DNA, 1588 bp, Zea mays
ttttttttttttttttgacagaagttacttgatggttgattgccgaatagtcattctcaatggttccatcatgtctgaaatgcaaggcaaaagggcctgacctaaccagttcccttccaacaggtttgcaaaagggtacaaacagagtgtttgtaagaatgtaagcagatgcatcatgatgcacaggaccgcggaagccttcagcttatggccatgccttccggttgagcttaggcagagtcagttagatcccattcgatttacacgtggcttcaccggagtcttagaaggactcaccctgacaggcagagttcccaaaatcatcccgctgcaattcagagccatgatggcaccctcagcatgaacaaactcaacaaaagcaatccttgtggaatgtacattgtctcctagaagtctcaaccgagagacctcaccgcaaagttcttcaaagaatttctttacatctaattgagtaaccatcttatctatatttgtacaatagacagttcgcatgaccatttccttctcatcgtccgtcctgggaagaaactttggattaacaggtaagatagctgtctttgaaggcaaaactctaacagggtagaaaccaaaaattgtgcctccaaggttaagtgcagttcttgcaccctcttcatcagagaactcaataaatgcaaacctaagaactgagtggggatcaccacaaattcggcaatcaacaacatgcccacaggtagcaaagatatcagcaagtctctcctctgtcacagtatgatcaagttcagagacataaacagttcgcctaacgctgtcctctctgtctgcacgcctcaacctatcatttgtcctcctccttccttggttgatgtatccattccctctcttgcgctgctggttcccaaacccaacgtaaaagggatcgtcggtggccccgttgccgcctgcggtggagcggtaatcgaacaccggcgcatccgccgacaacgctttcttgggcggcgacgcagccgcggccggagccgaggaagggacgaactccttggcggccgggttgagattggagagcaggtccacaagcttctgcacgcccgcctggtactccacctccttcgccgcagcagacgccgatccctccgccaccgccgccatacctaggactgagacgaggcggatcaatcgaggcagacgccggcggccgcctgccgatatcggtcaaatccacccgcggccggatgggtggagtggggtggggtagggcagaaagtgccggacggattctactggtgcgaggccatccagcgtctctgcacaccggagctgagggcggtggtggcctggtgggtgtgtggctgacgtggtgcgacgcggacctgggtgccctcgccgacggcgtcgatggggtggggctgctggagcgggccgcggttgggttctactgtgcctactagtgcctcaaggctatggccattttcgggctgggaaatttacgcgactacgcgagagagaatcgggaggaatcaaaacggaaaccggagaggaggagaagggccggcgggttgttgggctccccggcccggccggcctcgag

SEQ ID NO: 20062 - DNA, 3058 bp, Zea mays
  misc_feature (410)..(410): n is a, c, g, or t
  misc_feature (2309)..(2309): n is a, c, g, or t
gcacttatgctcaataacatgaatttaatttttgcattcactggttttccaaagttttccattttggagtgacttgctgttcaaatttgaattatccgaagaaatttaattaaataaactaaattttggagtgacttggagttcaaatttgaattatcccaggctcacctataaccacaaagactaaatatctatcaaaataatacattatacaaacgttaagtatatccatctagataccattaaaaaattctagtatcattcaatcatccattcaacatcatcatagataattcgataaagtagtaatgctaggatagtaacatataacacattacatggtcattaaataatggttaagatttacataacattatcatccaaaagcttgttaaacaattaaaagatgnatggctgaagccaagtttatgtttttaggcgaagtttatagtgggtatttcatacccaccgttaacggatgatggtggaacgttctaatacccgtttaactattgagtgaagatttttttaaaaaaagaacaataaacatacaaaatatttagcttatatatataacctaataaaaatatccatcggaaatcagtcagtggatactcgttgccctctctagtcgtatgccaccaccaccacggcctccggccaccggcatggcacgggctgcctgcacaggcgcagcgtggctagtctccagtctccacggccatggcgcggtcagaaactgccttgccaggcgtggcgcaggtaggggccctcggagcggcgtagacaaggacagggggagcgacgcgaacagggacagggcgagccagtgctgccacggtccgggcgggcacggctagcagcgcggccggcgtcaagccctttggctgtgccggcagcgtagccgagcaggtgcacggcctggacgacaccgcctgccgcggtgctcgacgtgtgcgtactgtggccgtcgttgtccctcggcctcgaggagtttcttgttgcatggagccaaaccttgtgtcgtcgtagctcggccttctggttctgggggaggcgagcaaggcgttcggtgaaatgcagatgcctgtgaataatgcgtctcctggaattatgatgcaagccaaacacttcaaaaactatggagttaatagagcagagctgataaaggtggagtggactatggagcactcacaaacacctcctacgttaagataggttgttttagtttgtaaacctaaacgctcgtaaataacacaacggaatacgcgatgaccgtcttgagagggatggcctagcgcctagtattcggaagcccaactcggcctggcccaactgttagccaattcgtcggcgaacgtgtgacgaaattcgtcaaagcactcgggacttggacaccaagttgcctacctgacgaaaccgtggccggcaaggaaccgtccgtgcaccgcagctctcgccgcgccgctctcgccggagccacggctacagccgcactccaatcccaacacagcaaccagcgcaaatcagcacgatgcgtcgcgagggccgccagcacgggtgggtgtttaccgtcgaccccagcctggtcgacgcggagggcaagtgccggtcccgcgcggtgcaggtggagggcgcggcggcggccaacggcggcttcgtcagggcgtcgaggaagcccaccaaccactccaagcccgccgtcggccgcgcgtacaagtccctgatcggcaagggagaggccgggtcgggcaagcagggcaggcacaagttcaagcacgacgaggtcaagatgtactccctctacctcgagggcgcccacgacgcctacgcggatgcgatgctggagttcgactcgtagtcctgctgatgacattgggtgtgtgaatgatgaggtgctggagttcgacatgcgccattgccaggaggtgtagagattcgatgtacgcttctgtgtctgaatccaaatgtgttttgtgatgtgagcagtgaataaacagactggttgtgacgagaatgtcgtgatccggaatgtatctcgaaccggaattcgatcaatcttcatatccaaagttcaaatctgtagagttggaattttatttagccgtgtgagtttccgtttttcggtcctggttattttcaaatgtaatactagcttagtagctttcgtgcagttaaaagacttactttctggcacaaagcgtattgtcattgtcaaacagtatatggcattggatatttaaattctctttagaaccttcgagtttaagacctcctctcctcagctaagtacaaaggaccatctaatnaacaaaaatacatacacaactctaaggaccatttcaccatcaatcaacaaatacaaaaaacaaacaaaaattacatacaccacaattcctcaagtaagctcaatgaccatatctcatcatcatcaatgcactggattgagaatactcggtcctttttttccaatatataactagcaataaagaagatctaataaaaatcagccgccaacgtatagatcagcaataaacaagaaaggggttgcacaaccctattcgcaccattcattgtgcctgaggatgagtacgaccatcgtccactagggataaaaacagtcgaaaatagtcggtaaacactaaaactgttatggttttcatatttttttatcgaaaataaaattgaaacggtaactctagaaacagaaacaatatcgatatttcaaaaacatcataaacaatagtttggtacagaaaatacaccaataatggtcaaaatctaaacacggtcggtaaacatatcaatacgaaaatatctcagtataacaaattcacaatacaacaaagttgacaaagatcacaaagactacaagttcacaattcataatataacaagtttacaaagatcacaaattcatactataacaagtacacaaagaccaaatgactagctcaaagtcaatgtaaaactcgttggacaacttgttttggaggtccatcacatgagctacatcagcgttgtagtttcgcattcatgcttctacaacatagaagct

SEQ ID NO: 20063 - DNA, 5175 bp, Zea mays
  misc_feature (4252)..(4252): n is a, c, g, or t
ctgcagtccgccaattcatcgacgcctgcaagttgtccaggttcaatgcaccgatattctattgcacgtggttgcaaagtttatgtaatttatttatgttgttttggttgatgggttgcattgttgcaagattattttagcttggtcaccggtcaggaattgtggctggtatcttaaaacggaacaaagcagaccacttgctgttactaggctcttaattaaaagaatgctggcctggggccgacccggcctgcctccgagtggaccggtcgtgccgtaccgcccatctgcccgcccccaacggcccaccagaggaacccgaggtcattttgtggacgggaaaggaaaagaaaagtaatgtatttccatggaaccgaacgcgtgctgcgcctcctgtacggcgcggaggtaggtcaagccgcggttgggacgcggtgtggcgtgggcgagccgaaccaagcggcgatcgatcgaaacgaggcgtcgcgtggctgccggagatgtcgcagaagaggcagccggaggagggcgacgtcccgcggcgcgccgccgatgccggcggcggcggcggaggaggagacgagcccggtgggagctcgtcgcgctcctctctgccccagcgccacggcgagccgaagcgacagaggatcgcccttcgcgatgtgatcacggaggtgatgcggaacaccagcatcgagaagtttctaatcgcgctcgagcccctcatcaggagagtggtaaaagaagaaattgagtcggcttttgcaaaccatgcctctatgatggcaaggagtgtcacagacagtgttccatctgtgtcaaagaatttgcagctgcagttcatgaccagactttctcttccaatatttactggatccaagattgaaggagagggctccttgagtataactattgctctagtcgacgctttgacaagacaaattgtagcaccaggcaaagagttccagataaaggttgagattgtagttctggagggggattttgaaagtggagaagatgatgactggacagctcaggagtttaacaataacattgttaaagaaagagaaggcaaaaggcccttgatttctggggatgcatccattgccctcgtcgatggcattggaacagtaggggaactttcattcacagataactccagctggacacggagccgaaagttcaggctaggagcaagaacagaggatggttctttcaatggtgtaagagtacgggaagcaaaaactgaatcatttgtggttaaggatcatcgaggagaattgtacaagaagcaccacccaccatttcttgaagatgaagtctggcgcctagagaaaattggcaaggaaggtgcttttcacaagcgtttgaatagggagaacatttgcactgtcaaagattttctcaccttgttaaatcttgatgcttctaggcttcgaaagatattaggtagtggcatgtcaacaaagatgtgggaggccactgtggaacatgcaaaaacatgtgttctaactgacaaagtgcatcactactatcctgatggtctaaacaaagctggtgttgtattcaatgtagttggagaagtaagagggttaatatctgataaatatgtttttgttgatgactttactgaaaaggagaaggccgaagcacgtgcagcagtgaagcaagcatatgaacactggaaggatgtccatacttgtgacaatgaaacgcttgtggaaaacccttcacatccattcaatttgggatctccatctttgcatgaaaatcagtataaccagttgcctacacaagtttctactgatggttttagtttgagcaattcggccatactgtcacccaacattttctcaatggagccatcgagtgctttagacccttgtagtatattggagactgaagaaagcagtgctaatcaatttcagtcggtgttgcccccagttgggggccatgaagtgcctcgagaacctcagacgctggataagttctccaactcgttggtatatgatgactgcagcgcccatccctcattcagtgaaagctattacagcagtgtagatcccagcatgtccttcgacacacaagatcttggagctgcactgaaaggcttcattgcaaccatatcgaagcctaaggcggcatatagaggatggagaacattgtcttatgtgctaggatggattttctataccaagagaattgttgcaaggagaaagaaacatgggaaataagtgaacacaagtctttgtgtagttaaatgcgaatataagcttagaaaatgagaaattatgtacattagtttgtttcttgtcacagctggtaagctctgctggtttcttcagctgtaaatggtcatgttctcagctatggttcgctatgcggctgtaaataatcaaatgaagtttgtacagggtgagggatgcgcatagcatttctgatgttttggatggatgccggagcttgctttttgatgcggcccgtgtattatctatgtagtagtatgcagtatgctgctgaaaaaaaaaaaaaaatcgacatttggaatctatatgtcgcatggtaacaagtttaattctgcttattttcgtacacagataatactgcagaattaccatgccgcaaactgatttttatgtagacagtaatgtgtttatggatatggttgacacttaaataaaaagctgggcagcgtgcacatgccatttacaatagagatttgccttgcgcgggaaattgtattccatttacagtagagtcttgccttgaacaacaatgttcgatgtggtgggataactgacttgatcctacaactaccatagtagctaatctccccgttgctcgtatgactagtaacacacttgaggagcacagataaacatattgctgctactctggatatacgggtatgcgtacttcttgttgtgcttttcttctactatgctgtgtgcctagtgataataatttatgatcctctactcacacgttatcttgcttggtatggtaaatatgctagtgcatagtgtaattaaaaatggttgttttacgagaataatatattgatttccgttttaatgcatgcactttcatttaaaattgagttgagtagaacttgaagtaatctataaaaaatgctgtacctctagaacaattggcacaaggtcctggactgttttttgtatggttcttatattgaatagcacaaaaaaatttaaatccaagatattaaaatctggtgaatttgatagtttataaatgaagccatcttgcacaccagcttcaaaatttggagcatcaggttttatatgcgaaggtgcgtgttatctcgctggacgtagataggcttcccctgttccccacatcatcgcgtggccacttctctatattcacatggcacatctttcctacataaaaggacatgaacacgacggtcattagttgtttggtgctggcactgaaacacaattaaataaaaactaaacgaaatgaacacgtacgtcgagcaactataaaggcggttcaagacgcagaaaagaagaaggaagaagcgatatgcttatggcttcttgtaatggtggctccagattgcatgtgcgcgagacaaaagagagagagagagagagcaaaatgacgttgcatgtgatcttataacttgggacacgagacagacacaataggtaatgtggtaaagtatatcttaattaatcatttcttggtacgaattacgaaagatgcgtttctttagaggcatgtaggaaggggtttaattccacaacgatcactcaattttcttttttaattagatagttcagttctggatcggaaaccactcgattcgtgtggacgctcacttggttggcttgattggcgtgcaacaccacatcaaagctacagttggactcaaaatgaaatgttctaagattaaaggtccaatctttaacatttttctcatcgttgtagcctgatttgatatgggcttttcagatagggatggtaacggtgaatttcttgttaggttttggctccccattcccgcgacaaaaaacaaattccgagaattcccatgaactctcacggggacttttttttccatcactgttccacgcgatgataaattcccgtcgggattcccgtctctgcttaattaaaatcatgatatactttatttgttattataatataaaatattgtcagatgtaagaaatcattacgtgtacattaaaataaacatatttgtacaacgagtgatgtnttgacaagataattatttatttttatcattgtatataagtttaaagatctctgtcggccggtttggttcttttctttggcggggagacgaggcgagacgagacgagaacgcgtcatcgtgctcctcatgcatggatccgctttccccccacgaccccacgcccagatcgaggagaagaaacacgaggaggaggttcccgagatcctttccttgcaactttcgcctcctcctcctgctggagtggagcctcgaccgtgcggtgcggtgcagtccccatgtggggatcactccaatcaagtgtgtgtgtgtgtgtgttcaggaggacacctgcatgcactcaccaccggcaccgcgccaacggccatgcatgagacctgtggggaggacaacaggcgtggccgcgtgggaactaactcggcggcacctacgcggagggcggacgacgacgacgggggagacccggtttgacgcgcggcccgcgggatgcggatgcctctgctctgctctgctcggccgtgcgaatattttactgctcggcctcggccgcggcccgcgggggagccgttgccgttgccgttgccgttggatgtgatgtgcgtgggtggcagtggcagccgcagccgctgccgctgcgtgcgtgagtcaccgcggagtcatcagtgccctgcctgccgttggtgcgctgcctcgtgcctgcgcctacacgaccagttgcttcaaagttcaaatagcgcatcgccaccaccaaagtcggtagtactttcgctagctcccttccgttcccttcccacgaaaaccggagagggagtgagaagaagcaacaagaagcggagagccaacgcgcaacgcaacgccctgagatggcggcgccggcgccggcgccgaagcaggaggagctgcagccgcacgccgtcagggaccag

SEQ ID NO: 20064 - DNA, 2576 bp, Zea mays
gaaacgccaaaccaggaacatcccaatatgcaacaaagatttacaggtatgcatcattttatggaagaagcaccttcaatttaatattttacaactcctggctcaatgggagcatacatgatacagcagctacgaagaagcaaaaggcccatccaaacaagaaaaaaaaagaagaatggaggcctagcacaactgaagatgctaccttccacatatacattggacctttttgcctgctttctatacaagacagatcactctacatacttggcctattttcccgctcatatgaatcctctctaactgtacagaagaatgaaataaccatcctctcgctatcctcagcgtcttccaatgagcccagccacgttctgggcaacgacttttttggcctccagtgaaaccggtgaatcaccaatatacatgtcgaagaaagccttgcaaagatctttgctccgaacagcaccaatttgtttcccatcaatttctgttataagcttcccatctgatgtttgacagaagtcaatcttcgtacccgaaggtatagcgatatcttctgtgaagtgagaaccaaaggtcttcaagcagtgaaagtctgtgttaggattcatcttctgcagccgcaggccaagggacttctcaaacacatctcgcactgcaccaacgctaaggccattgtagttaaccaccaacctgacccttatatcaaggttttctctgagaagatcactatagaaatcagggttctccatcagcttgtcagttggaaatgaagcatacttaggacccaacttctcacggatagaagtcggttgcatatataaaccaaaagcgtagaggttcagatttttgaccctcatcactctcatgcctttgaaacctatcccaacaaggacctgaaggtttaattatcaatggaaattgtcacatggagggatcaaatcgaagaatttatacaaaatgatacggaatctggaaagtaatattaccaaaattgtacgctttaatttcaatgtttcaaaaccattaaaaatgcattgtgcagatacggagtgcataataacaaatcagtatcagaatacactatatacgattatgtagacttttagttcaaaattgtcaaagaagcaagtttgaatagccataaagtaaaccacaaaccatgtacccaactggtacaatttatgtattgatcgtaatacaccactagcttgaaaatgatttcaaatgaacacacacacacaaaaaaaaaatgaaatcaattcctccagattaagagaagttatggttttaaagaaaacggaaataccgctgcagatggactggagtcgtcttccagaaatgttggaaattttattccagtttttggttcaattggatcttcttgaaatatagtactaggcacagaagggcaagcacaacttaggcactttccttctacataaggctgatccaccagtcttctgatatcactgtcaatatttcgtgatgtgattgactcggcaagcagcactgatgatcttgtccatacaaaagaggaaatcatcagttaactagagacaactatataaccgaaaaaaagagtaaggagagtgcataacaaatacaaaacaaaaacaatattggagcatggtcctcacatattttcaagtggcggtacaatagcaacagcgccagctagagtaagaagattgcatgctcgttgctgctcatttaacagtcgcccaatcgttgcacttgcaagcctcgctaaaattagttgtactgcttgctcttccctcattggaaagctgaactgcagtttagtcagattttgcatgtgagagcccatttggttgaaacgcaactgacaagatctagaactggtcgctgctacagatgccacccaacgcaaaatcttaggatcagatggtctagagagccagaaatagagagctcgggaaagcttgttgaggcgattgaaagctccatggaccattgcatttccagaagaagagatcttcctatgatgtcttaaagaagtacccagcactgtaccggcttgtgaaaacaaattcaatccaagatcatgagacattgaaaactctggttggatctcgtatcggtataccctatgtatatcaacatgggatagtaatctactgattgggcttcattgtgaaatacccttccaaaacacaggcttctgaatgaaggaggtctttacatcaaggttgggaatgtatgccaacaaaaaattaatgatctgtcgagtccagatcggccggagggggagaccgcggcaagaacaggcggaggagaagaagaggcaggcagggaataccgcctgcgatccacgcctcgcttgctcgatccctcggcgaatggattggtgcgggttcgggcgccggactaatcgacgcaggacaaacccaaatctatccggaggaaatggggaggcggaaaggaactgctctccggaattttccttttgcctccccaaatccgattgcgcccgccggctcgccgcgccctcgcctcccgtccctcccgtggggtgagaggcgaagaacgcgtgctcgtgctcggatgtttgt

SEQ ID NO: 20065 - DNA, 1373 bp, Zea mays
ttttttttttttttttgatcatctgactcgcatttcattcacagtgtaccacgaacttaatctaactcgcatttcaaaaacagcacatataaaaacgtttttttttttttttacaccaagacttcgtttttatatttaaaaatagaaagaatgccctgctctaaacctttacgaaactacaattagtttaagacatctactgtgaaaggagaaagcactgtaaagacgctaccctacagatctagtcaagtatcaaaacctggctgcactccgacacagaatgtcaatcttatgccaagtaatgacgttaactgataacaacagatgatacatcttcatacttggagcaggcatccaacaaacaaccagcctggactggtaacgaacagcttatgcactgtccgcagcagcgtgcatcacgccgtttgcgttgccaccacgtcctctgcctctgaatggacctctcccacgaccacgacctcgacctaaggctggagcatggacaggtgcctcctcgtaataacctccgtcctgttggtattcaggctggttattgtagccgcctctcctgccacggcccctgaaactacgacctcttccacgggcatatccattgcccatatatgcaggggtgtgatcctcttcccaaccggcatcagcatagtcattgaacccatttccacgtccacctctgcccctgccccgcccacggcctcgaccaccacgaccccttccacggccaccaggtgagtgtgcatcttcatcattatcatatttaaccaaaggcttcacttcatcagcaggcaaaggagattgatatccgatagatgatgtgtccagctccttctttgaaagagttatagtgatcatagagacatgtcttgttgtctcaagcggaagtaggccttcctccaatggctcccacatatcagtaatatcagtagatccagtggtggtattctgatggaggccaacaatcctcctcttgatcaattccacaaccatgacagtcttattgatagccctccccatggccttgaatacaacctcatcagaacctttgtcctgaagcaagccggtggcgtaggtgatgtagttgcgcatcctcccctgcgtggtaatgcggatctcgttttccttgatgggtgcctcctccctctgcttctccactctctggtaccggtccatctttccctcgcttctctctcgctgcacggcagttttagggccgggcgccggctgttctgtccttggctcgctggcgtcgatgtcgatatggtggtgaagataaccgccgggtggggcgcgaggagaatgcctttatacggccgcctccgtttaggccgggaacggcagcaaccgggcccggccgg

SEQ ID NO: 20066 - DNA, 1276 bp, Zea mays
  misc_feature (13)..(13): n is a, c, g, or t
ttttttttttttntttgatcatctgactcgcatttcattcacagtgtaccacgaacttaatctaactcgcatttcaaaaacagcacatataaaaacgtgcacatttgaacatacaccaagacttcgtttttatatttaaaaatagaaagaatgccctgctctaaacctttacgaaactacaattagtttaagacatctactgtgaaaggagaaagcactgtaaagacgctaccctacagatctagtcaagtatcaaaacctggctgcactccgacacagaatgtcaatcttatgccaagtaatgacgttaactgataacaacagatgatacatcttcatacttggagcaggcatccaacaaacaaccagcctggactggtaacgaacagcttatgcactgtccgcagcagcgtgcatcacgccgtttgcgttgccaccacgtcctctgcctctgaatggacctctcccacgaccacgacctcgacctaaggctggagcatggacaggtgcctcctcgtaataacctccgtcctgttggtattcaggctggttattgtagccgcctctcctgccacggcccctgaaactacgacctcttccacgggcatatccattgcccatatatgcaggggcgtgatcgtcttcccaaccggcatcagcatagtcattgaacccatttccacgtccacctcttcccctgtccctgccccgcccacggcctcgaccaccacgaccccttccacggccaccaggtgagtgtgcatcttcgtcattatcatatttaaccaaaggcttcacttcatcagcaggcaaaggagattgatatccgatagatgatgtgtccagctccttctttgaaagagttatagttatcatagagacatgtcttgttgtctcaagcggaagtaggccttcctccaatggctcccacatatcagtaatatcagtagatccagtggtggtattctgatggaggccaacaatcctcctcttgatcaattccacaaccatgacagtcttattgatagccctccccatggccttgaatacaacctcatcagaacctttgtcctgaagcaagccggtggcgtaggtgatgtagttgcgcatcctcccctgcgtggtaatgcggatctcgttttccttgatgggtgcctcctccctctgcttctccactctctggtaccggtccatctttccctcgcttctctcccgctgcacacacagcacagcacaatgcaagcgagcccactcagatccggcaagacgcgagagc

SEQ ID NO: 20067 - DNA, 1983 bp, Zea mays
aaatgtatgctgtgcgcgcacagccttttcttaaaaaaaggaaaaaagaggcacaataaatggcgtcaaagccacgggccttcgcgaaggtcttcctccccgcgctcccgccgccgcccctcctcactgcccccgtcttctcgcggtagccggccgacgaatcggggtgccggcgcggcggcgatgtcggctgcggcggctgcgccagcgcaggctccaaggaagtgggagggactagtggacgaggtgctcgagagggaggtgctggcagcgtgcctggaccaggcccccgagcgccgccgcatccgcgaggctttcaaggacgttcagctcagcatcgaccattgcctcttcaagggacaatatagtggcatcagaacaaaggagtcatgtgagcataactctaggggtgtggagattttctcaaaatgctggtttccggagaatcgtcgaatgagagcaattgtttgtctttgccatggttatggagacacatgtaccttttttcttgatggagttgcgaggaagattgcttcagctggatatggagtatttgcactggactaccctggctttggtctttcagaaggacttcatggatatattccaagttttgatacacttgttgatgatgtagctgaacacttctctaaggtcaaaggaaatcctgaatatagaggcctaccgagctttctgtttggccaatctatgggtggagcagttgcattgaaggttcacttcaagcaaccaaatgaatggaatggtgcaatactggtggcaccgatgtgcaagatagcagacgatgtggttccaccttggcccattcagcaagttctaatttttatggccaaacttctgccaaaagaaaagcttgttcctcaaaaggatttagctgagttggcattcaaagagaagaagaaacaagagcagtgttctttcaatgtgattgcctacaaggataaaccacgtttgcgaacagctctggagatgctgagaacgacacaagagatagaaaggcgtctagaagaggtttctttgcccttgatcattttgcacggtgaggctgatatggttactgacccggcggttagtaaggctctgtatgagaaagccaagagccaagacaagaagctgtgcctctacaaaggtgcgtatcacgctatcttggaaggtgaaccggaccagacaatattccaagttctcgatgatatcatatcctggctcgatcagcattccacaaaagaaggtatatcgttgtgaatcaggcagcgctgttcgccaggattgggtgaattcctttggcaatgctgtatcgcttccggttggggatcccagattcaacggtggggattccatttttgatatgaccctgtaaaattcttagttcagattattgatgtctccgtcatgtacctgaacgatgtagacgtacatatatgtaactgattaatgtgtatcaattgaccacgaattatttgggaaaacctcagttgcaaaacgccttttatttaatcacaatttctatccttgtgcggcctctgaaagtgagatgaactagcaataaaggaggtgttctgatgaactagcgataatggagaaggtgttgggtattttttttattaaaacctgaccccctttgcagctctcccggcgtttcacgccttcggcgccgatcactggctcgcacatgtctctcctcacgaagccatcgttgggaaccctgctttgggaatcttctatgttaaaactagtgcacgcgttcacttgaggcttggctcacggacgcgaacttttccacacggacacgacctttccagccttgccctcgacggccacacgacgcccacttcgatctcttcactgtcaccgtcccctccactcgtcttgccatcgactgcgtcctgtctgtgccgcagcgcaaggaaagtcagctcctgctacgacgcctcgaccccgcgcctctccacctcctccatgctcctc

SEQ ID NO: 20068 - DNA, 3700 bp, Zea mays
  misc_feature (3700)..(3700): n is a, c, g, or t
tactcatacacgactgagtcatttgcaaaaataacttgtgctactaaaaacaaagtttccacatcctcacaaatactgtaacttccttagcaaatgatcgaaggaacggggtatgactcgcttggtattgcataacaagtggtttcacacaaagtgaatactcctgcgtgtgatacagttcaaacaacccaattgcttcttcattggctgttctgtattacttctactgcaagtgtgaaaaaggtcgcgcgcacattatttattctgtattacttctactgcaagtgtaagcgtcaggactcaggccctgacgttgaagtaaaccgtgtagaattcgtccctcaaactgtacaatggctcgaggaggaagttcctggccatccccttcgcgacgaagctgatcgggtgatactgcctcaatgggtcagttcgcgaaaagctcgccgcctgctcgagtatcccgccaatgctctcaagggaactcttgcagttgacttcaatcctcgtccctgcggagtagttcgtgcccgtcaccaagaagcatcctggtttggtcccgagctcgagggagaccgagttagggtttccatcgagcccgggcacgatgttgaagagggaatcggagctcttctgcgcagatagagtgaggttgttggtgatcacggttcctggcaagtcgaatggttcgagcagaatggaagttcccgtcaaggttgtgctgtagatgtcatgcagctctgttgagtcctcctgagggtgagccctgaatgtcgcatggatggcggcgtcggtgccgtcgacttcaggtcgctcttgcatcgtcagggtgccatttgcacttgagaggacaaatgcctttccgttggatacttgtgtgaaggttaccagctgtgagttgtgtgctggagggacagcggtgatccaatctgaaatagcactgccgttgccagcttttgcatcccagtcaccagtggataggccagcaagaacaaatggcccaaacaggattgcttgaagggatgcatattccagtctgtcatctttaattgcttccgtccttaacctgattggaaagtgtagcgctaagtgatcatcggagttccactgtttggtgattgataggaaagatcctggagatatagaccccaaatctttgtcatttaaagttgctcctgcaccatcagcaaatgtccatgacggaattctaaaatttatattggcagtctgacctcttgtgtttgcagaaatggagaatgaaatttgaagatactggtcagaagagctgagggttttgatttgctgagtaacagtaagcccagctgctttccagttgtaagtgcttggtatgtactgaatgatattgagtgcaggtggatctcctttctcctcaaagtaaatagaatcaccaagttttgaaaaggattctatacctgtcccataacaacaccagaatgaatcgtactttgttccccaaccatgataactcacagcctttgagtgtccaggggcctggggtagcatgtaaatcataacaccaggatctgtcccccgttgaatgcttaaaacaccatttatcaatgccctttcatagtaatctgcatatgctatttcctttgtccatctgaataggttgcgagaaaccttaagcatattgtaggtggtacaagattcctcattctcagtactcagagtcccagctaaacgctttggatcggtccagaattcaccagcagatgtgccaccagttgcgtagctatgagaagaatttatcgtatccataaagaatgacgcaatttgcttgtaaagaggatctccagtaacttcatacctcatttgcgcaccaatgacaactggaatgtgtgtgtttgaatgaaaaccggaaatactgtcagcctgaactgccagcaacccaagaaagcatggcttatcgaagagatgagctagtgtcaaatgcttcatatcgtgcgttatcgtgtagagctgatagagaacatcattcatcccaccagtctcctcattgagagattcccagtgcctctcaatgctataattctgtatgacattcttcacccggtcactgaaataattagccatctttatcaccatgtcaagagccatggaattcccagcaactgtgtactgatcaagaagaccttgcataatcttgtggattgtgtagtaaggagcccacacagacttgatggccccgacgcgtgcgaagaagtccgatgggaaggccgacaggtaccctgtgcccatcttctttctggcaatcgtagagggcatcgacgacagatgacatttttgcattaagagtgtcattgtgtgtgctagcccacatctttgcagtagcactcaggtaatgcccaacgaagtgtccccggagctggatgccagggccctcccacccgccgtagggagttcccggcgccgtcaggccggcctgcttgcggaagctccagacgaaggcggtcgacgtcgaaggaggagcaggtactccaggttggtctgctgggctcgccagtacatgctgcccggctccagccgcacgtcgtgcagggacgcctccggagaggaacgccccagccgcgaccccgggccgcgcggagccaccgccgccccggagctcgcggtagagcattagccagtcgaacgcctcctcgcgccgcagcgcccggcgcggcatgagcgacatccaggtggactcgtcggtcggggtgaggtgctgctcgcgtccgtggcggtggtggtggatgatgggctggagcaccgttgccggcggccctggccgcagctgcgccgccgcgcgctccgtgtgcgaggtcaatcccgggaacgcgttcgtgcacgatttaccttccgcgccgcggaagccggcggccagcagcatcacgaccacgatccctaccgccgtcgccgccggcatgcttggcgctcgcgccatggccccctttcttgcaggaacaagaaccgctcgatatcccccacccactgctcagtcggtggatacccaccgcattagcggaagccttcaacccctccagacctttaataccccatgacaagcgcgaagaggcgaagcggacgaaacatcaagaaatggcaacaacgcatcgtcgagtcaggcaagtattgcgcggaaagccattggcaatacagccgaggattggagaagacgcccttgttcctctcctcgcaagctgatagtgataggtgaagtggaccgactacggactgccaggtagtgaacgactgacacttgtgccgagatttttcacccttctctcctttcgatcaacgggaacgggaaatggtcgagaaatacgcatagcggagggggagacgattttataggggattcttggaccccaagaccaaggaccgcaagccaagtgccgaggccatcattaggggtcctcctgcatctgcctgcccattccaatccatcatcggccactgctcgacgcttgtttgcttgcacgccaccaccgcaacgccaacggctacggcggcgagtggcgcgtccgcgtcacgtcgcacgccacataggtcttttctcttcctcagctcggcggcgaggaccctataccagaatgtatgattgccacttgccggagcttgcaacagaagccgcggagagcgggtagatgcgtcaggttacaacaaacttggcaggccgtcctctgcacccttttcgatn

SEQ ID NO: 20069 - DNA, 1678 bp, Zea mays
gcacgacgcttaaagcagtagatgacaatagaggaccatcaccatttgttgtgattccgcacgagaccattacctagaacatcctaatcgaaaacggtagaactttgatggatggattgatgttcttaatttacaagtatggagatgaaaggaccaaagcccgtgcaatgctgtgtgacatatatcaccatgcgatctctgatgagttttcagtggctcgcgacttgcttttaatgagtcatttgcaagatggtattcagctcatggacatatcatcgcagattttattcaatagagtcatggcccagttagggctgtgtgctttcagggctggtttgataaatgaagcccatggttgcttgactgagctctattctactgggagggtgaaagaattgcttgcacaaggtgtgcaacaaagccgataccatgaaaaaactcccgaacaggaaagacttgagaggagaaggcaaatgccttaccatatgcatataaacctggagcttttggaagccacacacttgatctgtgcgatgctgattgaagtccccaatatggctgccagcacctatgacaagcggagacctatgagcaaaacattccgaaggcttcttgaagtgagtgaaaggcagacatttgttgggccgcccgagaatgtgagggaccatgtaatggctgccacaagagccctcaacaagggtgatcaccaaaaggctttcagtgtcataaattcgttggagatttggaagcttttgaggaacagagagcatgtccttgagatgttgaagcttaagatcaaggaggaagctcttagaacctatctcttttcatactcgtcttcgtacgagtccttaagccttaaccagctcactaccatgtttgatctcagcgagcagcatgcccacagcattgttagcaagatgatgatgcatgaagagcttcatgctagctgggaccagccaacaaagtgcatcgtattccatagtgtggaccaaactaggcttcaggggctactcttccagatggcagataagctctcggtcctggtggagatcaatgagagggcatacgaggcaagaactggtggtgctctcgagggggtaccgcccaggcgcaggggcgagggtcaggataatatgggaaagtggcaggataactttgtctcgtcacaggggcggcagggtggtggcaacaggtttggatactccggcagaggtgcaatatctggtcaaagtggtggtggacaccagagggacaggggcaatcagggttaccgcgggggctatggtggcgtttcaaggtttcaggatgcaaggggtcgcaaccagtctaatccatcaggcagaggtggtgatggtggtgcacgcatggtgaacctgaacagggttggtagagtttagaagtgataattttcagctcaagtaagcctgaaattctcctaaaagccaagttctgaatcactgcattttacatagtttcctgttctgggctgagtcatctacctgtttcctacatttcgttgtagccttttaaattaaggggctaagaaattgaactaagagtttggtactgttttgtgggagtgtgacgatgtattcgctccaatatttgatatctatccctgacacttgctataaaaaaaaaaaaaaaaggggcccgccagggggggccgggttat

SEQ ID NO: 20070 - DNA, 3675 bp, Zea mays
gtcgacctgcagatgataaagatgtggatgatgacgatgctgatgaaagtgatgcagagattgaagatcctgataaaatagctatgtcagaatcagaagaggaacaagatgaagaggatgatgacaaggatggttgggaacagaaaaggagtaagaaggataagctgatggataagcagttcttgaaagatccaagtgaaatcacatgggatattgtcgataagaaactcaaagagattttagcatctaggggaaagaaaggtactggaaggatcgagcgtgttgagcagttaacatttttgacccgtgtggccaaaacaccagctcagaagcttgaaatcctcttccatgtgatttctgcgcagtttgatgttaaccctagtctacttgggcatatgccagtcaatgtgtggaagaagtgtgtcaataatatgcttcttgtgcttgatatactccagcagtatcctaacattgtagtagacacctcatttgagcctgatgagaatgaaactcaaaagggtgcagactacaatggaacaatacatgttgtcggtgacctggttgcattccttgagagactggactctgaatttttgaagaccttacagtgcacagatccgtacacaaaagattatgttcagaggctcagagaggaacccctgtttctggttgtcgcacagaacgtccaagattatcttgaaagggttggaaacttcaaagctgctgccaaggttgcactgcgccgtgttgaactagtttactacaagccccaagaagtgtacgatgcaatgagaaaactcgcagagcagcctgaggactgtgtggatgatgatgatgcagaggctggtgatgaacataaagcagtagatgacaatagaggaccatcaccatttgttgtgattccagaggctgtgcacaggaagcctacttttccagaaagcggtagaactttgatggatggattgatgttcttaatttacaagtatggggatgaaaggaccaaagcccgtgcaatgctgtgtgacatatatcaccatgcgatctctgatgagttttcagtggctcgcgacttgcttttaatgagtcatttgcaagatggtattcagctcatggacatatcatcgcagattttattcaacagagtcatgggcccagttagggctgtgtgctttcagggctggtttgataaatgaagcccatggttgcttgactgagctctattctactgggagggtgaaagaattgcttgcacaaggtgtgcaacaaagccgataccatgaaaaaactcctgaacaggtaaaactaaacccatatgcaactcgttctgtttttcttgtaaatgctgttcacatagcccccaacccaaatcacgcaagcaaaaccctactttttaaatttcatgtggcaagcaaaaccctacttttaaaatttcatgtgaaattgataatattcacacagtaatatctcacccttgcatcagttaattatttatgttttgttgttttttgaattgatataaaaagctttatcctgttgtatgcagtaattctgactcacatcacaaatatggcatttttctatattgagttatatttatttttaatatgcagaattagttcttttatgctacatgtaagtaatcttgtttttattaatattagagcacaccgcatattaattttatattataaaaagggacagacccattgctggcatgagagggtttctggggattcgactgggacaagccttacccctgcattttgcgtagaggctgcgttgaatacatggcctttgtctcagtgaaaagtcttttcaccactgcgtcaagcctgtcattctaattatcttttccttatgtgaaactaccacaattgtagtatataattagaagagtatctgagtatatatggttttatataaatattcttttaattgtaagctacaattggaatagttttacacaaggaaaagatgatttttgtccttttggttatatcattgctaatgtagtcactgtcactgcaggaaagacttgagaggaggaggcaaatgccttaccatatgcatataaacctggagcttttggaagccacacacttgatctgtgcgatgctgattgaagtccccaatatggctgccagcacctatgacaagcggaggcctatgagcaaaacattccgaaggcttctcgaagtgagtgaaaggcagacatttgttgggccgcctgagaatgtgagggaccatgtaatggctgccacaagagccctcaaaaagggtgatcaccaaaaggctttcagtgctcgtggattcgctggagatttggaagcttttgaggaacagagagcatgttcttgagatgttgaagcttaagatcaaggaggaagctcttagaacctatctttcatcatactcgtcttcctacaagtcgttgagccttaaccagctcaccaccatgtttgatctcagcgagcagcatgcccacagtattgttagcaaaatgatgatgcatgaagagcttcaggctagctggcaccagccaacaaagtgcaccgtgtttcacagcctggatcaaaccaggcttcaggagctactcttccaggttgcagaaaaaatatcggtcctggtggagacaaacgagagggcatacgagttaagaactggtggtactcttgaggggctaccgcccaggcgcaggggcgaggctcaggattcatccaagtggcaggagagctttgtcgcatcacaggggcggcagggtggtggcaaccggtttggatactccggtagaggtgcagcatctggtcaaagtggtggactccagaggggcaggggcaatcatgtttcccgcgggggatacggtggcaatacacgatttcaggatgcaagtgcacacatggtgaacctgaacagggttggtagggttgttagtgtttagaagtgcgtaaatttttgaagcacctgccctttccataattacaaacttcctgttctaagctcagtcatccaactattttctctatttcgttgtaagagtttggtactgtcggggtttgattagtgatagatccggctatcaaaattttggtcttttttcttcgactatgaacaaataatatatagaattttctatgtaaatttatacaaatatacacacccgtgagggggccccccgtcccaaaaataaattttaaatccgttctatatctttttaaataattgatataaaatttggatgtctattcgaatactgatttagatgttttttcgcttttttgttgtatggagaaaataatatacataaaaaattatacaatttttttaaatacttcataatattcttaataacattattaaaaattagctttaaattctatgtatattctatattgaaatattagatttgtgatataagtcggatgttttaggaactgataaagtaactgctgttgtactattgaaatgaacaacagagagtctctttattgcttgagtccatgtatatatacacatgagaacagtccatggatggacgtgtcccacctaaagtggagacacgcaaagtacacgaccattgggccatgacaactcgaggagtagcaactccttagaagtttaatattcataacactcctccttaagcagttgttcgtcatgtatatcttcttcaaaatc

SEQ ID NO: 20071 - DNA, 910 bp, Zea mays
cattgggtacctcgaggccggccgggttatgttcagaggcttagagaggaacccctgtttctggttgtcgcacagaatgtccaagattatcttgaaagggttggaaacctcaaagctgctgccaaggttgcactgcgtcgtgttgaactggtttactataaaccccaagaagtgtatgatgcaatgagaaaacttgcagagcagcctgaagactgtgtggatgatgatgatgcagaggctggtgatgaacatcaagcagtagatgacaatagaggaccatcaccatttgttgtgattccagaggctgtgcacaggaagcctacttttccagagagcggtagaactttgatggatggattgatgttcttaatttacaagtatggagatgaaaggaccaaagcccgtgcaatgctgtgtgacatatatcaccatgcgatctctgatgagttttcagtggctcgcgacttgcttttaatgagtcatttgcaagatggtattcagctcatggacatatcatcgcagattttattcaatagagtcatggcccagttagggctgtgtgctttcagggctggtttgataaatgaagcccatggttgcttgactgagctctattctactgggagggtgaaagaattgcttgcacaaggtgtgcaacaaagccgataccatgaaaaaactcccgaacaggaaagacttgagaggagaagacaaatgccttaccatatgcatataaacctggagcttttggaagccacacacttgatctgtgcgatgctgattgaagtccccaatatggctgccagcacctatgacaagcggcgacctatgagcaaaacattccgaaggcttcttgaagtgagtgaaaggcagacatttgttgggccccccgagaatgtgagggaccatg

SEQ ID NO: 20072 - DNA, 1220 bp, Zea mays
  misc_feature (29)..(29): n is a, c, g, or t
  misc_feature (1156)..(1156): n is a, c, g, or t
tgatgagcagcccaatttttttgtatgtntcgcgcatatggggacaaccatcagctgtgacagaaggctttatgttgcatgcactagttgtacctgccctgcggccgtcgagcggccgcccgagaatgtgagggaccatgtaatggctgccacaagagccctcaacaagggtgatcaccaaaaggctttcagtgtcataaattcgttggagatttggaagcttttgaggaacagagagcatgtccttgagatgttgaagcttaagatcaaggaggaagctcttagaacctatctcttttcatactcgtcttcgtacgagtccttaagccttaaccagctcactaccatgtttgatctcagcgagcagcatgcccacagcattgttagcaagatgatgatgcatgaagagcttcatgctagctgggaccagccaacaaagtgcatcgtattccatagtgtggaccaaactaggcttcaggggctactcttccagatggcagataagctctcggtcctggtggagatcaatgagagggcatacgaggcaagaactggtggtactctcgagggggtacctcccaggcgcaggggcgagggtcaggataatatgggaaagtggcaggataactttgtctcgtcacaggggcggcagggtggtggcaacaggtttggatactccggcagaggtgcaatatctggtcaaagtggtggtggacaccagagggacaggggcaatcagggttaccgcgggggctatggtggcgtttcaaggtttcaggatgcaaggggtcgcaaccagtctattccatcaggcagaggtggtgatggtggtgcacgcatggtgaacctgaacaggattggtagagtttagaagtgataattttcagctcgagtaagcctgaaattctcctaaaagccaagttttgaatcactgctttttacatagtttcctgttctgggctgagccatccacctgtttcctacatttcgttgtagccttttaatttaaggggctaggaaattgaactaagagtttggtactgtgaactaagagtttggtactgtttcgtgggagtgtgacttcactccaatatttgatatctatctgtgacacttgctataacctgtacttttcttgtttgtgttatgtggttcnttatttggttatgaaaaataaaaaggcatgtcgcagatagaagatcgcaaaaaaaaaaaaaaaa

SEQ ID NO: 20073 - DNA, 2898 bp, Zea mays
ctgtcattgattcatccatgcagtccaatactcaccgacgaatgggctgcggtgcaacatgacccaccagccagcgaggttccagtaatgagcggcagtcccgatagggtacgtaatatcctatcgtctggtccggccatctttcccgtagccgtcgacgtcggcgtgcaccccaccaggccaccatcttggcaacccccactattccaaccacgcactgacacacggaccctatgctgccaggacccgcttgtcattgtccgtccgggccggacctccgatcgtgggtccggagagccagcgagtgagagccgtgccggagtggcttgcggccaggtagacgaagcacgggaagtaaacaatcgcaagagggaagggaacacaacacccacgcgtccggacagcacccccgcagggccgcagaacggcgctcccccctgctccgccacactccccagaggttctgaacgcagatctctcgccgcagctcggcctcgcgattccgctggagactgttcagctcctcgccggcggcgccgattcgatctgacgcccacgcagcagaaggctgaaggagggcactgggagccgagggggaggctaggggttaggattccggcgtgatgcagcgcccgggacgacttcagcggtcggggtccaagcgcgggctggaacccaccggtggcggcgacgacgacgaccatgcgcccaagcgcccgcgcgtccccgccctcgctagtgtcattgtggaagctctcaagatggacagtctgcagaaactctgttcatcgcttgagcccattctccgaagagttgtaagtgaagaagtagagcgtgctttagccaaactgggtcctgctagaatccaaggaagatcctcccctaaaagaattgaaggccctgatggaagaaatcttcagctccagttcagaagtcagttggctcttccaatcttcactggtggaaaagttgaaggtgagcagggagcagctatacatgttgtgctgttggatgcaaacactggatgtgttgttacttcaggacccgagtcatttgcaaaattggatatccttgtgcttgagggtgactttagtaaagaggaagatgaggattggacagaagaagagtttgaaagtaatattgtcaaggagcgtgaagggaagaggcctcttttgacaggcgacctgcaagtgactcttaaagaaggtgttggaaccataggggagcttacattcactgacaactccagctggataagaagcaggaaattcagacttgggctgaggattgctcctggcttttgtgaaggtatccgtgtccgagaagccaagacagaagctttccccgttaaggatcacagaggagaattgtacaagaagcactacccacctgcgctgaaggatgatgtttggagattagaaaagattggcaaggatggcgcattccacaagaagttaaatgccagtgggatctatacagttgaagatttcctccggcttcttgttagggatcagcagagattacgtagcattctgggcagtggaatgtcaaataagatgtgggacagccttgttgagcatgcaaagacatgtgtcttaagtggaaagcattatgtatactatgctagagactcaagaaacgtgggtgcaatattcaataacatctacgagttcactggtttgattgccgatgatcagttcatttcagctgaaaatctcacagacaaccagaaggtctatgctgatgcattggtaaagaaagcatatgaggactggatgcaagttgtagaatatgatggcaaggcactcttgagcttcaagcagaaaaagaaaactgtcacgacaagaagtgacgttgcatctgcctcaacaagcaatcctgcttcatatggttcggccaattcacagaaacagttgtctcttccagcaaaagctggacaaacttcctcagcgggtactatgaatgaagcagatggaactagaaatgcatacaacgcaaatggaaaccagtcagcaagatatgcagccaacactcagagcattcctgcaaacgtcggcatgcaatacgacgggagtgcagtgtcgcctgaaatccagtttagtggttcatcccttcagagtcagtcttcaagagggtccaacatgctagcattgggccctccgcagcaacatcaaagtttcgaattcccagcgctcggccagcccgttcagccaacaggcctgaaccctttcgaagagtggccgcagcagcaggagaaccgtggcggcggtgtcgacgactacctgatggaggagatccggatgaggagccacgagatcctggaaaacgaagagatgcagcagatgttgcggctcctgagcatgggcggtgccggaaccagcctagccgaagacggcttcaatttccctccgtacatgcctgcgccttcgccgaacgtgagctacgaggacgaccgcacccgcgcgcccgggaaagccgtcgtcgggtggctcaagatcaaggctgccatgcggtggggcatctttgtgaggaagaaggcggctgagagaagagctcagcttgttgagctagacgactagaaagtattgaaccctcgagctgttcatgtaccagagttttcattgttgatggtgtttgtggatccggacggggctcggctatggccctgccccttaggaggacagcagttctggtcctgagcttaattctggacaaaactattttccgtttcccccctttttgtatgtatagcttttttttaccattttaaatgcgttgcttgtttagtgtgatgccggtagtcctgttgtgaaccttagcctgagctctgtacatccatctgttacagaattcaaatcgaaacaggtaaacattggcacttgaaagccacaatgcaaa

SEQ ID NO: 20074 - DNA, 1837 bp, Zea mays
cacactaaacaagcaacgcatttaaaatggtaaaaaaagctatacatacaaaaaggggggaaaacggaaaaatagttttgtccagaattaagctcaggaccagaactgctagcctatcacatatattattgttccggactcgatctcttgtatggtcacaaagcccgcgctacatatacattttcgcaacacttatatgttgaacatgctgtctttttgtagaccaacattttacaccatacaacatagtttatctaaccaccgttgtataaaacttttcttttgcttctatggtaccctcttgtcgtactagatgtttgacgtcactttatctgctctgctttgcttctatagctaacatatccattggtatctcagtctttctgtagcattgatcctaaataccgaaatgtatcctctctggacactacttgaccatccaaaataacatatctttcctcgtgtagtagtgctaaagtcacaactcatatatttggttttagatttattgagtctagaacctttggactctaaagtctcctaccacaactctagtttcctatttactccttcccagctttcattaactagcactatatctccgtaaaaagcatacaccaagggatatccgcttgtatatcccttgtgagcttatccattaccaaggcaaaggctcaaagctgatccttgatgtagttgctttatgacattttaaatacttattagtcaacagttgttggttaagtatagaaaatgatactgtttatgattatgtgatatggatgtgcagttcacacgagtcatgaatttaattaatttaccacacgtatagaaaatgatagtgcttatgattatgggatatggatgtgagtttgcatgagtcgtgtatttgattagtttattaccatgcgtgtgctgtactgacataactgaattacatctgttcagcagatggaactagaaatgcatacaacgcaaatggaaaccagtcagcaagatatgcagccaacactctgagcattcctgcaaacgtcggcatgcaatacgacgggagtgcagtgtcgcctgaaatccagtttagtggttcatcccttcagagtcagtcttcaagagggtccaacatgctagcattgggccctccgcagcaacatcaaagtttcgaattcccagctctcggccagcccgttcagccaacaggcctgaaccctttcgaagagtggccgcagcagcaggagaaccgtggcggcggtgtcgacgactacctgatggaggagatccggatgaggagccacgagatcctggaaaacgaagagatgcagcagatgttgcggctgctgagcatgggcggtgcggaaccatccgagccgaagactcttcaatttccctccgtacatgcctgcccttcgccgaacgtgagctacgaggacgaccgcacccgcgcgcccgggaaagccgtcgtcgggtggctcaagatcaaggctgccatgcggtggggcatctttgtgaggaagaaggcggctgagagaagagctcagcttgttgagctagacgactagaaagtattgaaccctcgagctgttcatgtaccagagctttcattgttgatggtgtttgtggatccggacggggctcagctatggccctgccccttaggaggacagcagttctggtcctgagcttaattctggacaaaactattttccgtttcccccctttttgtatgtatagttgttttttttgttttttgcttaccattttaaatgcgttgcttgtttagtgtgatgccggtagtcctgttgtgaaccttagcctgagctctgtacatccatctgttaca

SEQ ID NO: 20075 - DNA, 1940 bp, Zea mays
  misc_feature (992)..(992): n is a, c, g, or t
  misc_feature (1890)..(1891): n is a, c, g, or t
cgggttgacccagcgcccgctttagccaaactgggtcctgctagcattcaaggaagatcctcccccaaaagaattgaagggcctgatggaagaaatcttcagctccagttcagaagtcagttggctcttccaatcttcactggtggaaaagttgaaggtgagcagggagcagctatacatgtcgtgctgttggatgcaaacactggatgtgttgttacttcaggacctgagtcgtttgcaaaattggatatccttgtacttgagggtgacttcaataaagacgaagatgaggattggacagaagaagagtttgaaagtaatattgtcaaggagcgtgaagggaagagacctcttttgacaggtgacctgcaagtgactcttaaagaaggtgttggaaccataggggagcttaccttcactgacaactccagctggataagaagcaggaaattaatacttgggctgaggattgctcctggcttttatgaaggcattcgtgtccgagaagccaagacagaagctttccccgttaaggatcacagaggagaattgtacaaaaaacactacccacccacgctgaaggatgatgtttggagattagaaaagattggcaaggatggcgcattccacaagaagttaaatgctagtgggatctatacagttgaagatttcctccagcttcttgttagggatcagcagagattacgtagcattctgggcagtggaatgtcaaataagatgtgggacagccttgttgatcatgcaaagacgtgtgtcttaagtggaaagcattatgtatactatgctagagactcaagaaacgtgggtgcaatattcaataacatctatgagttcactggtttgattgccgatgatcagttcatttcagctgaaaatcttacagacaatcaaaagggctatgctgatgcattggtaaagaaagcatatgaggactggatgcaagccgggccggccgggggcaaggcactctntgagcttcacgcagaaaaagaaatctctcatgacaagaagcgatgctgcagttgcctcgacaaaccaccctgcttcaaatggttcggccatttcacagaaacaattgtcccttccagcaaaagctggacaaacttcctccgcgggtattatgaatgaagatggaactagaaatgcttacaatgcaaatggaaaccagtcagcaagatatgcagccaccactcagaacattcctgcaaacgtcgccatgcaatatgacaggagtgcagtgtcgcctgaaagccagtttagtggttcatcccttcagagtcaagcttcaagagggtccaatacgctagcattgggccctccacagcaacatcaaagttttgcattcccagcactcggccagtccatgcggccaacaggcctgaatccttttgaagaatggccgcagcaacaggaaaactgtggcggtgttgatgactacctgatggaggagatcaggatgaggagccatgagattctcgaaaacgaagaaatgcagcagatgttgcggcttctgagcacgggtggtgcaggaaccaacctaactgaagatggcttcagtttcccttcgtacatgcctgcaccttcaccaaaattgagctacgaggatgaccgcacccgtgcacctgggaaagccgttgttgggtggctcaagatcaaggctgctatgcggtggggcatctttgtcaggaagaaggcagctgagagaagagctcagcttgttgagctagacgactagaaagtattgcagctggaagcatgtgcactccagatgttcatgtaccaaagtttcgttgatgtttgtggatccggatggactcagccttgttcgatgcatataagttgatttgtccaggctgttcttttaattannaaaaaaaaaaaaaaaaaaaaaaaagaaaaaaaaaaaaaaaaaagcggcc

SEQ ID NO: 20076 - DNA, 2454 bp, Zea mays
tcgattattctgtgctatctcttttgctttcagtattcttcaatgaaaaactaaatggcattagtgttgttcttaacgatttgtgtgtcaaaatatgtattcagtatccctttggtgccaggtgccaattgtgcctctaaattctaataaaatatttggtatcaaccaaattttgttgaccctgacgcccatgttcatacataaatgtatagttttgtagattatttctgcacatggaatgattcttcgtgttcttgattatctgtttggctatctgtttggcggtactaaaaagtatcaccttgttgagcttctatctgtttgtggaagatccactgcatctgatatcaggcactactgactcttttccttcctgcatctttaacccacttttatgcaccatctgatagtttcttgctatttctaccttgcagatatccaggaacattacaacaaatgagatggcaaataccattaggtacagttacctcaggggaccaagtggcagattcagaaatccatatgaccatgggctgcgtgagaactgttctgacttcttgctgaaggggtacaatgaggatattgagagcactgtacagacattgcaatctgacgaggaaatgggaccaattcagatgagcagcccagtctcacagaatggcgagagcattccaccacatgtgaatggcactgaccatggttccaccatttcacatgccacctcaaaatcccatcgccaaagtccatccaattgtttgggcctagggctgggcactgggcataacaacccctctagccgttatgcgcgatctcttcttcccttatgatttgtcttgaggatatccagatgtgctcctttatatttgtgcatacttgttggacaaccagtcaaccacagctttgtttgggctatttcttcatgggtgctcggtgatttctctctggttgcacaaacgtgaaggcttcagaaacatcttcagcttactgcacctatgacacacgatagaaatagtgtcaatgtcaaggttttgttcttgttttcttggcaaaaggcaccaaggctctatgcctactatccaatatgtatgtacatggatggggctagtagttcatgcactaacccgttttgacttttgaggcatagttgtacgcttagggctgataacggcctataatttttgcactataagatttaagtatcaaatcgggttaggatcggactctatttctagtcatttttgaattataatttatttagggcattgatattttttgaagaaccatttggatcacgatccattaccacccatatgtacgctacgagagttgtaaaatgtacagtaacagaactacatggcatgtttgttcctgcatacgtatttatagaaaaaaatgatttgtctcctcctgtgagttatccttttaattgtactaattgattgggtaagattgttgactggaaatttctaaaaaatttaggcatataaaatatagtaagtaaatattacctcttctcatatagaactagatatcatttatgttgagtgctctagttgaataaggacctgggaattttcccccttattccagcttgattttttgtacgttttctgtgaaatttttacatttcaaatggtcactaagaaactgtgcaacgtgatcagtttcaacagtttaaaaagtcaaaaaggttttatttttccaacaatgtttttagggcagccgcaatgatatagatagcactctatagcaatatctatgttatctacatatcacattatagcgaatctttacaatgatctatctatatagatatctataattgtttttagtatttacatacactctttaaaccacctcggttttgagtatatgctcactccaggttcatagataacaacacactctctctttatttaatttcttgccatataggatagatgctggcatggactccttatagagagcagacttggtaccattgcggttgcccttaattctatctctactctctaaaaaggaagtaggtcgtgcatcttccctccttgggcccacctatagtgatacgcacaagcatcgctctgcattagttcgctctctcgcctcctctttgttgagtcctcccttcctacttgtagtgacaccagcactgctctacctttcatccgctcgctctcttgccatctctccacatctggctgacggtggcttgccgctccaccccaaatttgaccacacccttaccatcataccgcatttggcctcacctccctgtttccccttctttcctgcccctgtttccacctccttttgccacaccctcacctcctctttgcattcgcccacattcagtttgcggtggctcgtcgctccactcccgatctagctcctcctagtttcctttttcctttggatgcacttttgcctcctcttcacatccgtccaacagtggct

SEQ ID NO: 20077 - DNA, 837 bp, Zea mays
  misc_feature (579)..(579): n is a, c, g, or t
  misc_feature (625)..(625): n is a, c, g, or t
  misc_feature (645)..(645): n is a, c, g, or t
  misc_feature (654)..(654): n is a, c, g, or t
  misc_feature (679)..(679): n is a, c, g, or t
  misc_feature (768)..(768): n is a, c, g, or t
  misc_feature (777)..(777): n is a, c, g, or t
  misc_feature (793)..(793): n is a, c, g, or t
  misc_feature (800)..(800): n is a, c, g, or t
cactgcaacactcttctggtacggtgctcgcttctctgtctcggtcggcggactctgtcgctcctcatcctagcgcgagcgagctagctcacctactctgtggctggacctcgcgcgcgcgcgcgggatggcgccgtcgtcctcgccctcgccctcggcggccggctcccacgcgggcctcgccatcgcggccaccgccatggcgctctccggcacgctcgtcctctactccctgtgccgcgcgaagcagcagcgactggtgctcccctcctcctccgacgacgccccgtcccctcgccctcggctccgcccgtgcctctcttcgtccgagaagcggaagaagaagaagcgggagatggcgcggcgcggcagccagaagcgggtgcgcttcgcggacgacgtcgtgggcacggacaatgccgccgccgcctcggcgccaagggaggaggccgagccgtcgtgcgccgcggcgctcaggacgcccatgccggccaaccgggaggcgctgtaccgcggcatgcttcgcggccgctccatgctcagggtcgcctgctcctactagcgctagctacagtagcncccccgtgccggccccgacgtaacccgctccactccattaatctgngtctctctctctctctctanatcttgtgnacgttgcgtgctgccaactagtggngccgccgaccaggcctagctagctccctcgcccattgccgggaaagttttgtaattagtggccgtcccgcgagggagcttgtggtccgngcgtgcgtnttggtacgtgctgtgntattgtntgatggttagcttccttttcgaaaaaaaaaaaaaaaa

SEQ ID NO: 20078 - DNA, 1415 bp, Zea mays
cccacgcgtagatagacctcgcccttggctcccatggcttccgggctccggcttcttctcctcgccgtcgcgtgagactgcgctaaaacctaggctttgagacaccaatggcctccgcgacggcgacggcgcccacattcgctctcgcatcgtccttctcgcgcggcggcttccttccgctccctcgtcacgccggccggcccatgcttcagtctctgcgactcgtcgcgtcagccgtgaagcggcggcgcggcgcggtcgtggtggcagcggacgcggcggcggcggccgggagcgcggagttcggcgacgaggagaacccgtatgagcttctgggcatcaggccgcttgatagcttcgatcacatgaaaatggcctacaagaagaagcgcaaggacgccgaggagactggagacgacgagttccttgccaagttggacagggcctatgacactgtcatgatgcagcagctgcagtatcggaagaagggagtcacatacgggtctgttcaggtgtccaaggatatcaagtatgctgacaatcaaccagtggtgccttggggaccaagattctcccgatcaacaatgaaggacatgcgcataaatatggcagtatcagcagcatttgttgtttggatagctattatgggcaatgcagactggaagcctttgcagttcctttgttttgctttcttctacagaatactacagaagctaagagctactgaaccaccaattactccaatatacaatgaatatggcgaggtcgaaggacgagggataagaatggcaaaaagagtagtccgtgctttgggtttgatatttggatgtgtgttcgctgcatccctgggttatacagcagctattaacttgatcgagctttcaatgcagtacactccccgccttgtttattactaccaggagctgattgttacggcggctacctccgttcttctgtgcatcacagcctcatactaccgatgaacacgacgacgagcagtgatggcctggctgaggcgattgtgagatagccgagaatccacaaattttgtagcatacttccaccagcacctgtcagctttgaggcagagagttcttagtgcaggatcatacatgaccacttgtggcacaatgcagatgaccaatggatgaaaaacatttggcgtgaatacttcaacagcagtgttgtgtgtgtgcaatttttaattaggtcttggacatgttagacaacagggttagctgcaatgtgcatgtgctttgttttgcctcgatcaacgaatgaatgaaagtactagctgctgcttctttgttaagctgcctctccggagcggagctcccatttgtcggacacacaatgctgctcccatttgtatacgaacctgctgctatgcaatgtgaactttaaactcatatcta

SEQ ID NO: 20079 - DNA, 1419 bp, Zea mays
accttatacgggtatgtgtaatattttatattcccgaccgtaacccgttgtcatccctaacccagatagacctcgcccttggctcccatggcttccggcttcttctcctcgccgttgcgtgagaccgcgctaaaaccctaggctttgacaccccaatggcgtccgcgacggcgacggcgcccgcattcgctctcgcgtcgtccctctcgcgccgcggtttcctcccgctctctcgtcgcgccggccggcccgtgccccagtcgctgcggttcgtagcgtcagccgtgaggcggcgccgcagcgcggtcgtggtggcagcggacgcggcggcagcggccgggagcgcggagttcggcgacgaggagaacccttatgagcttctgggcatcaggccgcttgatagcttcgaccacatgaagatggcctacaagaagaagcgcaaggacgccgaggagactggagacgatgagttccttgccaagttggatagggcccacgacactgtcatgatgcagcagctgcagtatcggaagaagggagtcacatacgggtctgttcaggtgtccaaggatatcaagtatgctgacaatcaaccaatagtgctttggggaccaagattctccagatcaacagtgaaggacatgcgcataaatatggcaatatcagcagcatttgttgtttggatagctattatgggcaatgcagactggaagcctttgcagttcctatgttttgctttcttctgcagaatactacagaagctaagagctactgaaccactaataactccaatatacaatgaatatggcgaggttgaaggacgaggaataagaatggcaaaaagagtagtccgtgctctgggtttgatttttggatgtgtgttcactgcatccctggcttatacagcagctagtaacatggttgagctttcattgcagtatactccccgtatgttttactactatcaggagctgattgttactgcggctgcctccgttcttctgtacatcacggcttcatgctaccgataaacacgagaagcaattattgcctggcttagatgattgcgagatgttaggacatgccttgagtttcagatggagaccaacttgttacttgtggtgccttccgcatctaagggatagccaagaatccgcaaattctgtagcattcttccagctttgaggcaggtagttcttagtggaggatcatgtgaccagctatggattcagtagcacaatgaagatggccaatggatgaaaattgtttcgcgagaatatttgaacagcggtgttgtccatgcaatttttaattagatcttggacatatgcttagacgacatacttaactgtgatgtgcatgtgctttttttgcctgaatgagtgctgagcttcttctgtgtcaaaaaaaaaaaaaaaa

SEQ ID NO: 20080 - DNA, 1694 bp, Zea mays
ctcctcccgacctggaccgagcggtgcatcctgccccatcgtgatgcacaccaacgggcatgcacaggctcccccaacgcatcactccgaatgctaccgggcccaaaagaaagcgaaagagatatataactcggagggggtacctctccaccggtgacggtgagtacagaactgcccacgacggtgcagacggtgtcggcatatgaagaactcggtgacgaaatcctctcgcttttgatgctcctcggcgctcgaaaacggtgcacgcgcattccacgcatccagcagatctccttcagctagtccttgtgggcgaaacccaggtactataaggacacggtgtcggtgatcgctctctcccctattctgctcgacccgacaagtgctctcaccgtggatatttcataccatggcaaggtggcacgggcgtttgctatttatgctccagaacgacccagatgacaacggaaatcgggctaagcacgggatccttggcgacatagcagcaacgacaaaggacggtaaaagatgtaaaacgaactcgagagcgtctcaagaaaaacaaaatgccagcatgcatgtgacgatattgcatgtactaaactccgacagtcgcataacataacatgccattttaaagacaggagtttaaagcaattaaggtgacactccggtacaggcacagtaagttcttcccgctggctgcagccctgaaaaagcccgacacgagttgccgctagcatttatagcatcataatatagttcttgattagtcatatgctcttcggttggcaggtggggatcttgatcggtaagcaggagatctccgatagcggtcacgaacaggacttctgctcctgccatacgaaccatatacaggacttgctgggcgaccatagtctggactaggacgtgatctgtacgctgggctatccccccgcctaccatatccaccacctcttcttgggctgtcgtacctatcactccgttcatcatcatccctaaaggcatactcaacagaaatcaccctatccaaaagcatggtagcatgagtagcttcaagagccttacgggcttcttctagtgtttcaaaccggacaaaagcaaagttcttccttatcctaacacttgatatgttcccaaatggtgcaaagtgtctttcgatatcactgactcttgtgtccattggatcaaagttaatgacaaacaatgttttagttggcttagtatttacttctggtttgttgccatcacgtctagcagctcgatcaccccgtgaccactctactgaaagcctgcgtctgccagggccaaatggataaccatcaagagcacgtatggcatcactgccatcacgttcatcctcaaagtagacaaaagcaaagcctgacttcatgtcgatgcgctcgaccctgccatagcggtagaagaggtggtcgagctccgagtggcgggtatcatagtctaggttccccacgaaaaccggcctcatcttggtcgccggcgagtcagcgacaaacaaatcccccgcagaaaccctccgtcgtcgtctcgtcgcccggacgagtggagaccggacagggagacaggcggctagggtttcagactcagagatgcgatgcttctcttccctcttgcagttcggctacgagaccagttgggtcggtggctttaccgttacgagtaagctcctg

SEQ ID NO: 20081 - DNA, 1930 bp, Zea mays
caaggacggtaaaaatctgaaaatagagttcgccccttttttttttttttttttggtagcagccaaatgacaatattgcatgcagtgaaacctgacagtcgcatagcataaccatgtacagaccattaaacacgggaatttaaggacattaaggtgacgctccggtacaggtacagtaagttcttgctacagggtgttcctaggccatatatggcataacagagggttctcgattagtcatatgctcttcgtttcgcaggtggggaccttgatcgataagcaggagatctccgatagcgatcacgaacaggaccaggaccgtcatatgaaccatatacaggacttgctgggcgaccatagtctggactaggacgtgaccggtacactgggctatcaccccgcctaccatagccaccacctcttcttgggctgccgtacctatcactcacttcactatcatccctgaaggcgtactcgacagaaatcaccctgtccaaaagggtggtagcatgagtagcttcaagagcctttcttgcttcttccatagtttcaaactgaacaaaagcaaagttcttccttatccgaacacttgatatgttcccaaatggtgtgaagtgcctttcgatgtcactgactcttgtgttcattggatcaaagttaatgacaaacagtgtccttgttggcttagtatttgcttctggtttgttgccatcacgtctaccagcttgatcaccccgtgaccactctactgaaagcctgcgtctgccagggccaaatggataaccatcaagagcccgtatggcatcattgccatcacgttcatcctcaaagtagacaaaagcatagcctacagatgtaaacgtgcaagtcagaacgatgaaaattgaataacaaatgtccaaacaatcacgagaatagttgcacctctgtttttacaattaacaactcaacacatgagtatacccaagcctaaaataatcagaaatgtactgcacctgcatagttctgatggtatgaagagcactagagtggtagattccattcatgataagacctaagcatggtgttgaacaacttatatccaaagtaagaaagaatgaccggagacattggacatgcttcgccataaatagaactcttgcttatcaatgtagtacacatagcatgttgtcatgttggtgatacttctagtcgtggcatggtaaggcatgatggtactgatggcacgatcccgctaaacatgctcgagcagcagtaacagtttgcatcagggcacatgaacagatggtttcaagtgaaggaaatgatggccaggttattgaatggaaggagttgaagagccctggggaagctatgttttgccctggtagttcctgcgccagagtaaagatttaaacatctgtgcctgcaactgcagttacatcgcatggagcagcacaacaaccgcaaagtatcagagtatcttactccaccaccttttttttcttcaattcgttgaaatttaaacatgaagatataccaagtggctaggtacacaataagatgagatcgaatctaaaaccggccgaagacgaagataaacaagggggtgggcaaaaggagggaatgcaagggcaggcagacctgacttgatgtcgatgcgctcgaccctgccgtagcggtagaagaggcggtcgagctccgagtggcgggtgtcatagtccaggttccccacgaagaccggcctcatcttggctgccggcgagttggcgacaaacaaatccccgcagaaaaccctccggtgtcgtcgcgtcgcgtcccgcggacgagtggagaggaaaagaggcggcgacctagggttgcggtgcttctcttctctcctgcggctcggctatgaactggactacttttacctttgagcctacatgatttccaaccacctgtggcccag

SEQ ID NO: 20082 - DNA, 690 bp, Zea mays
cctgtccaaaagggtggtagcatgagtagcttcaagagcctttctggcttcttccatagtttcaaactgaacaaaagcaaagttcttccttatccgaacacttgatatgttcccaaatggtgtgaagtgcctttcgatgtcactgactcttgtgttcattggatcaaagttaatgacaaacagtgtccttgttggcttagtatttgcttctggtttgttgccatcacgtctaccagcttgatcaccccgtgaccactctactgaaagcctgcgtctgccagggccaaatggataaccatcaagagcccgtatggcatcattgccatcacgttcatcctcaaagtagacaaaagcatagcctgacttcatgtcgatgcgctcgaccctgccgtagcggtagaagaggcggtcgagctccgagtggcgggtgtcatagtccaggttccccacgaagaccggcctcatcttggctgctggcgagtcggcgacaaacaaatccccgcagaaaaccctccggttgtcgtcgcgtcgcgtcgcgtcgcgcggacgagtggagaggaaaagaggcggcaacctagggttgcggtgcttctcttctctcctgcagctcggctatgagctggagtgctgtactacaacctttgagcctacatgatttccaaccacctgtggcccagctaggcatgcgtc

SEQ ID NO: 20083 - DNA, 1352 bp, Zea mays
ttttttttttttttttcgcagtgaaacctgacagtcgcatagcataaccatgtacagaccattaaacacgggaatttaaggacattaaggtgacgctccggtacaggtacagtaagttcttgctacagggtgttcctaggccatatatggcataacagagagggttctcgattagtcatatgttcttcgtttcacaggtggggaccttgatcgataagcaggagatctccgatagcgatcacgaacaggaccaggaccgtcatatgaaccatatacaggacttgctgggcgaccatagtctggactaggacgtgaccggtacactgggctatcaccccgcctaccatagccaccacctcttcttgggctgccgtacgtagcatgagtagcttcaagagcctttctggcttcttccatagtttcaaactgaacaaaagcaaagttcttccttatccgaacacttgatatgttcccaaatggtgtgaagtgcctttcgatgtcactgactcttgtgttcattggatcaaagttaatgacaaacagtgtccttgttggcttagtatttgcttctggtttgttgccatcacgtctaccagcttgatcaccccgtgaccactctactgaaagcctgcgtctgccagggccaaatggataaccatcaagagcccgtatggcatcattgccatcacgttcatcctcaaagtagacaaaagcatagcctgcatagttctgatggtatgaagagcactagagtggtagattccattcatgataagacctaagcatggtgttgaacaacttatatccaaagtaagaaagaatgaccggagacattggacatgcttcgccataaacagaactcttgcttatcaatgtagtacacatagcatgttgtcatgttggtgatacttctagtcgtggcatggtaaggcatgatggtactgatggcatgatcccgctaaacatgctcgagcagcagtaacagtttgcatcagggcacatgaacagatggtttcaagtgaaggaaatgatggccaggttattgaatggaaggagttgaagagccctggggaagctatgttttgccctggtagttcctgacttcatgtcgatgcgctcgaccctgccgtagcggtagaagaggcggtcgagctccgagtggcgggtgtcatagtccaggttccccacgaagaccggcctcatcttggctgctggcgagtcggcgacaaacaaatccccgcagaaaaccctccggttgtcgtcgcgtcgcgtcgcgtcgcgcggacgagtggagaggaaaagaggcggcaacctagggttgcggtgcttctcttctctcctgccccggccgg

SEQ ID NO: 20084 - DNA, 1633 bp, Zea mays
cattgggtacctcgaggccggccggcggtgggtgcggggcggcccgggccgcccacgagtcgagtagccattgcccattgccattccttccttcctccacagagaaatccgatccgcggagatttgacccaaccagatcatatcacacacgtaatcccatcccattccgcccgcaacagcagcaccaccggtgggaagaagaagatgaagaaggccacttcgctctccgagctgggcttcgacgccggcgacgcgtcgtcgggcttcttccgccctgtgtccggcgactcgtcgacgccgacgtcgcagcaccaccggcggaggctgaccaaggtgtcggtcatcggcgcgggcaacgtggggatggccatcgcgcagaccatcctcacgcgcgacctggccgacgagatcgcgctggtggacgcggtcccggacaagctccgcggggagatgctggacctgcagcacgcggcggcgttcctgccgcgcacgcgcctcgtgtccggcaccgacatgtccgtgaccaggggctcggacctggtcatcgtgacggccggggcgcggcagatccagggcgagacgaggctcgacctgctccagcggaacgtggcgctgttccgcaagatcgtgccgccgctggcggagcagtcccacgacgcgctgctgctcgtcgtgtccaaccccgtggacgtgctcacctacgtcgcctggaagctttcgggcttcccggccagccgcgtcatcggatccggcaccaacctcgactcgtccaggttcaggttccttctcgccgagcacctcgacgtcaacgcccaggacgtacaggcgtacatggtcggcgagcacggcgacagctcggtggcggtgtggtcgagcgtgagcgtggcggggatgccggtgctcaagtcgctgcaggagagccaccgctgcttcgacgaggaggcgctggagggcatccgccgcgccgtcgtcgacagcgcctacgaggtcatcagcctcaagggctacacctcctgggccatcggctactccgtcgccagcctcgccgcgtcgctgctccgggaccagcgccgcatccacccggtctccgtcctcgccagggggttccacggcatccccgacgggaacgacgtcttcctcagcctgcccgccaggctcggccgcgccggcgtccagggcgtcgccgagatggagctcaccgaggaggaggccaaacgactgcgccgctccgccaagaccatctgggagaactgccagctcctcggcctctgatgatcacatcaccgtctctcttcattaattaattattgcatcaatttccacaacctagcagcagcatccggtacccgtgttcaataaaaacaaaccgctacaatgtgtgctttctagctgcattaagctgcttactacgagtatttgggctgtggctttctttttcatgtatctcaccaaatcgttattgttgtgagagctatactacacggtggtatcaagagtatcacaatgcccaacaggcgatggattgagctttcctaattttttcatgataaattaagttctaccccctccgtccacataaatttgtctttctaaattttttcgtaagtcaaaatatttaaactttgatggggca

SEQ ID NO: 20085 - DNA, 3643 bp, Zea mays
tagtatatagagatttttaactagcatccaacattcaatgtcatatgtgctaaaatttagcattggaaatgaacgggcctgtaccagcgacgaagcgacaatcctacccgttccttggttcgtctgcatccatcgcggccctacgttcctttgcagcctttacccacggcccagcctctgtcgccgttttcgtgcgaggcaccggcggccgcatagaaactcagcttccgtctctaaaccctcaaccctagcccgtcatgtggcgccgtctccccacccgccgcctcgcctccgccctcctctcctcctccccactccagcgcgccaccgccacgcacgctcctcctctcgagcgccacttccccactacggcctccggtctccttccgccgtcactcttgcccccgtggcagcaggagccgcgatggttctcatcctccgccgccgcggaggctgtgtcctcggaggatgccgaggagctgcaccacgcgatagaggagatcgtccggccgcagccgagtccgaatctgcctcaacctcaggcggtggcagaggagtatcaggcacccgggcgggaccaccgtagccggcataggagaagtgggcgcgggcggcatgcggaagtgttggcggcggagcacgggatgacataccacaggtacacctcccttcgccggcgacaaatccgcatcgagacggaggcgtgggagcaggccgccaacgagtaccgtgagcttctcgcggacatgtgcgagcagaagctcgcccctaacctaccctacgtcaagtcgctctttcttggctggttcgagccgttgcgggatcagatcgccactgagcaagaacttgtggcagaccccgggtcccgggcctcgcacggtccatttttcagtatgctccctgcggacatgatggctgtcatcaccatgcacaagctcatggggttgctcatgacgggcagtggggacggcagtgttcgagtcatccaggccgcgtgccagattggcgaggcaattgaacacgaggttcgaattaacagatttctggagaagacaaggaagaaaaacaacaaagagatggaaaatgaagaagaagctggtgacacaaacattgctgtagaacaacagcgtctaagaaagaaagtcaccgacctaatgaaaaagcaaaagttacggcaagtcaggaacatagtgaagaatcaagataaatccaggccgtggggtcaagatgctcatgcaaaagtcggtagtcgtttgattgatctttttattggaacagcacatatacaaccaccggcaagccaatcatcagatggtctgcctgacatccgtcctgctttcagacatgaaatgagaacaatggtgaaagaacagcagaagagtagtcgcagatatggtgtgatcaagtgtgatccactggtccggcaaggcttggatagaacagcaaagcacatggtcattccgtacatgcctatgttgattcccccaatctgttggacaggatatgacaaaggagcacacctctttttaccatcatatgtaatgcgcacccatggtgctcggcaacagagggacgctgttaaaagagctccaagggaacagatgcaatttgtttttgaggccttgaatactcttgggagcacgaagtggagggttaacaaaagagttcttagcattgttgacagaatctggtcaaatggtggccggcttgctgacttggttgatcgtactgatgttcctgtaccggagaagcctgacactgaagatgaaaccttgctaaagaactggaaatggcacttgagggcagccaagaagaagaacagtgaaaggcattctcagagatgtgatgttgaactcaaacttgctgttgctagaaaaatgaaggatgaagagggattttactatccacacaaccttgattttagaggtcgggcttatccaatgcacccttatctgaaccatttgggttcagatctttgtcgaggggttctagagtttgctgaaggtcggccacttggcaagtcaggattgcgttggctgaagatacaccttgcaaatttgtatgctgctggtgttgataagttgtcatatgatggccggattgcatttgctgagaatcatttggaggaaatatttgattctgctgataggcctttagaaggcagacgatggcggcttggggctgaagatccattccagtgcctggcagtatgcatgaatctcactgaagctttaagaagctcgtctccagaaacaacaatctcacatattcctgtgcaccaggatggctcttgtaatggtctgcaacactatgcggcacttggaaaggataagttgggagccattgctgttaacttagtcgctggagaaaagcctgcagatgtttacaccggaatagctaacagggtgatggaaattatgaggatggatgcacaaaaagatccttctgtagaacctgatgcagctcgtgctcgtctgatagttgaccaggtggacagaaaattggtgaagcaaactgtgatgacatctgtgtatggtgtcacatatattggagcacgtgaacaaataagaagaagactaaaggagaggggggtcattcctaatgactccgaactgtttggtgcatcatgctatgctgctaaggttactcttacagcacttggtgagatgtttcaagctgcccgtagtatcatgaactggcttggtgactgtgccaaggtaattgcttgtgaaaatgaaccagtgagatggacgactcctcttgggctcccagttgtacaaccatatcgcaaacttgggaggcatcttattaaaacgtcattgcaggttttgacccttcagcgggagacggataaggttatggtgaagcggcagaagacagctttccctccaaactttgtgcattctcttgatggttctcatatgatgatgactgctgttgcttgcaaaaggcaaggtctgaattttgcaggagttcatgattcatattggacccatgccagtgatgttgatacaatgaataaaatactccgggaaaagtttgtggaactctatgatacacctattctggaaaatctgttggagagctttgagaaatctttccctaaattaaaattcccaccgttgccggagaggggagacttcgatatgaaggaagtccttgagtctacgtattttttcaactagcacaatcaatgttaacagttgcattatacacgctgctgcccggacatatctgagttctgagtgtagatctaccaactcgaatgatgaaagctaggtcatacatgagcataacccgaagagtggctttgcagaagttatcagaagctaagttggtactctgagcattcacaaatgcatcggcatcatttatcgcgttgaagttggcaatgaggtttgctaaataaaagtgggaaccatatcaaagttaaacgagaatccctgtaaatgtaattatgtaatttttttttgtctttagtgtttttattttccttgatcttggtactgtcgagagaaattcggctgaccggtagtttgtcggctggtgctgactagagattatttcatactttgtagtttaacaatataatttagtaataaagtgatatactagtatttttctaagaaaaaaaaaaaaaaaa

SEQ ID NO: 20086 - DNA, 3225 bp, Zea mays
cccccttttttttttttttttgaatagaccaatatccatttgtagtgttgaacttaaaaacacatgatttagcccgttatgtgaaccaaacgacccaaaacataccagccggccggcgatctacttgccgtggtgcttgacgccgcgcgaccccgcggacttcttaatggactcgattctctgccgcctgatctgctccctgaacctggcgatgaactcctccgccttcttgtccacctcgttttcgtccacctccggcgtcgactccctcgtcgaatacccgccgccgccgctatcgtcgtcgtcgtcactgctctcggtctcatccgaggagactaccacaccgcctaggatagggtcgctccctgatctctcgtactggaacctgtgaatggactgataagctctgtagccgtacggctcctctgacccgtgcacatccagcacgtcacgatcatcaccggcgccgtcggggagttcttggttttggtcttgaaaaactgctgcctcccttgccctgaacgttctcactgacttgccaaccgaaaccgacgaggagaagccgccgtcaaaagagcttcttggcttcgctggggaggagttgctgctgttgtaagcggagatgctgatgctgctcgtcttcggcgagtagtgatcttctccttggcctctcatgctgtggtgctgcagctcctccttaaagcttttcgctgccgccgcacggcgctcggtcgccgggtggtaaccgtggacaaggaacggaggcggaggtggaggcggaggcggcggtgaggagatggaagatgacctgtacgggctgctccgcttggccttggcgtagtactcctcctcgctggccttggccagcgtctccccggacaaggacgacgccggggacagcctcctgggtgacgccgtggagctcggcgacgcgggtcggcgcgcgtcgagcttcccggaccgcgaccgccacgggatcggcgaagcgagcacggtctcgtcgcgggcgcagccggccgccaagtcctgagagctccgacgccgccgcgcacgcggcgtctcgacagcccccgcgctggcgtcctgttcctgctgcgctttcagcgtccggacgggcagagacagcggcgcctgcgcgtccgcggcctgcccgatccgatccccgccgccaccggtggacacgacgacaacgggctcaacgggccggtgcggcgctctccacgagcgcgccctaccacccccgccgccgccgggagggctgtccggcaccagcacgtcgtcttcgtcatcgtcatcgaacggcgggatcgagtccctgaacatccgccacgcgtacctcgcgtcggccttggcaggttccggccccgcggcagcgtgcttctctgtttcagctgcgactgcgacggccccggcgcgtccatcgtcggcgctgttcctgcggctgaagaggccgtacgagacggcgatgccgacgaacagcaggtgcagcagctcccacactttggcgaggaactcctggccgggtcccccggccccgacgtccggcgcctgcgtggggaggagcggcagcagcgcgacgcagagcgtgagcacggccgccctgaacgggaagctctgcagcacggaggcgacctgctgctgcgctgccatcgatcaagccaagaaggggaaaaaaatgggggagcaaagagaggcgcccaacgtgatgcgccgcctcttttaagcttttcgctttccggctgcgatccctgcttttccgattctctctgtggttggggtagggctgcgtgcaacggtcgatgctctgcctcggctttatttttttttcgattaggatgttctaggtaatggtctcgtgccgctcgcttgttcgttctccccactactgatgctgctgtcaccgtgtggatcgcggactgggtgacgatccgtcgaggtggtcgtggtattttttgtgcttgttccgttccgttggcggcggtttgagacggtgataggcgactagggcggagaattgcttagcggggaagagaggaatttgaagttgggctcggagagaaagagagggcgtagatgtagataagactccggtccaggtaggatggagctgcatgcgtgcgatggccgatgggatgcgatgcgtggatatcaagcgtgatgctgaagctcttgttgtcgccctctttttatgccacgagaatctatccgcacttgaactaaggctctgagtatgtctcagacggtaaaccgatgaatggaatgactcggttctatcgacttcgaccagctccatgcatgaccagaggtggcaacaaatcgtgatttaaaatgttttttcacagtttgttattagagcattaaattaaaattaattttagtttaaaaataaataaaatatagcttaattctaatttgatttgattcttaaaatttatagtgtaaaatttagagtctattgacactcctatgcatataaatatgtgacgacgcacgctttatttataccgactggcgacgcggcttggcgcccgttggtactgaccacaccgattctaatgttagattggttggtttagccaatcagttagtctaaacgatatcatcatgttagagtcagattggttagtgtctacccgaaagctgaaaaaccagttgttatcgttttgaatcggtcgataccgactgcctatagccacatgacatgttcgaattagtccgcatagccaaagttttgaagcctaaaatatttattccaaaaaaaaatcgaaatcagaccttaaatagaagtggggtgtttgggctcattcacgtactcccacactccaattatgtaccatgacaattagattttgtttttataaaccatgtatttttaaagttatgtaattttaaattattttttagaaattatatattttttattcaattaattacatactcgaatgaatatttatcttaataaaatatcatgttttattataactaaaagtctataaaagaaaagatgatacgacattgaggtggctctagtctaacattaaatgttgtacactagagcgttacgatagataagggttgacgatgatcgataatgtgatcggtagtatggtcgatagcttacatcgtaatcgataaggaccaattgcagtggaaccaaagtatgtttgagcgactgatagaccaaaccacaaagttcaggcaattcacaattaaagtgttgcatgt

SEQ ID NO: 20087 - DNA, 2646 bp, Zea mays
gccggccggttcgccacgattgcagagccagagcgagacgcgactgcttttctgcttcatccacattggtagctagctagcttacacgttcacgcatcgctttccgggccgtctccggtggtttagctcagcagagcggggaaggaagaagatgacctccgtgagcgcgaggcccgttggcgtggggtactgcttcggcggggcgaggtgccagccacggtcgcgggtgcgggtttcggccgcggcctcggcagtgaccgcgcccgcgcccgcgatggcggcgacgatgtacgagctgctcgccgtcgaggagacggcggggcccgacgagatcaaggcggcgtaccggcgcgccgcgcggcggtggcacccggacgcgtgccccggcggcgccgaccgcttcatggcggcgcgggaggcctacgaggtgctgtccgaccccgagcgcaggcgcggctacgacatccagctccgctgcggcgcccacttcggcgacgccgggtaccgcgcggcacgccgcgccgggttcgccgactgggaggcgcagctgaccgggctgcagtggcgcgcggcggggcggcgcgggcgcgccggcggggagacttggggcagcaggatgcgccgggcggccgcgcagccgtccttgtagcggcgtcgcccggtggctggcctttcatagttcatacttcgtagtactacccttttttcccctttcctcttcgacaatcgaatggcccgagaagctgtaattgcgctgttctgcagcgttttctcttgccaacacgtcatcctcgtcgcactgttcggagtgcagacgagcttgaagtctagaagcagtagacatttctcgccccgggggcgtgtagtatactgtcaacttttagttccaactcggtttcatacggttcgaatcctaaaaaaaaaaaaaaagggcggccgccctttttttttttttttttttaaaaaaaggaacaaaaatattttatagagagtagaaaaaaaagaaaatgagcagagacacatctcttgccaaattgattctacctacctacgtgtatgtaacaagaacgtactttgtttcccccgttttaactttgccctagtaagtagtaacctattgtctgtctatcaccatatttgctccctctttcaggcttcagccttttcctagaacagagcacactagggagccccttttcacacggagcgccctgcaatttctcaaaaatcataacaaacccaagagagccagccaactgccaagcccagtggagtggaaggttacttttttgcacaaaggcccaacaggtaggaggtaatccggatcgctacgacggcggcagcgggaggggcaggggcaggggcagcggcagcggcgggaggagcggcgtccggcagagcgggcaggtgcggtggccgtgcgcggcccagcggtcgaggcaggcgcggtggaagacgtggcggcagccccgggcgcggcgcacctcggcggcggcgtggaagtcgcccaggcagacgcagcagccctcgggcagcgggcgcggcgccgtcacccctcctccgcttccgcacgacagcgagtcgaagcgcaccgcgggggagtgctcctccaggcgctgggcggcggcgcaggggtggcgagggtggccggcgtcggtgtcggcgtcggcgtcggcggcgcccgcgaggcggagcagccaggaggagaggcggcgcaggtggtcgaggaggaagaggaggtgcagcagcagcttgggcgtctccgagtaccccacggggaaccccatcagcatcgcgagacagtcagtcctccactcaaaatggaggaaccaactgagctgagctgagccgagcttcttggctgcggggcgatgtcagtgcgctccggtgggaggaaggagatgagtgcggcggcctggccgggcattaaaaagcaaacaaacagggcagtgccagtgataggggaggcgcagcaggacacattgtattcattttctttgtgcacagcacagcacagtacagtgccgggcagggcaggtgcgcttgtctgcctgcctctccaatggcgctatctagccatctccatcactgttcatcgtcctcctttgcctgcctgctgctgatgcttgcaggaattggatcgcccatccatccatgtgggatgtctccctggctgtccactgtcagtgtgggtcatcagctgccggtgggcctgccttctcccacgatcgagagagccctctcacaagcctgcttgcttcgtcgtctccatcaaggatcaatacctgttgaataggcgaggaggaattgtgtagaccatgtacagttctaagaaagaaaaaaaacaggaggccggaagggcagggcatgtacagtttcttttcttttctttacttagaaaaaaaggcagcatgtatggtctccaaagaaaggtcacacactctctatgtctagaaatgaataatatacatgtctgccaacaattgtatgagcataaaaacctgtgtcaacagacacttactttgaaagaggcttttgagttcatattaatattttatgttgcactactatatgttgtaggataaatttagagttagtcaaaaattaagtttgttcgtttcggattaaagtcggatgtttgaaatg

SEQ ID NO: 20088 - DNA, 790 bp, Zea mays
  misc_feature (1)..(1): n is a, c, g, or t
ntaggggcttttttttggcccttggccccacaaaacagttccactatcatcaaatttaaaaatcaagcagcaggtctttctgaaacagaatagaccggcatttagactcaaacatgttaccagtttcaaaacaaaacgaacacagcacgacacaaacatgtttccaacattccagacaaactaaaaggatcaccaccacaggcaacttgatcaactaaacgatgcatatatcctacttaacagtattgcagtaacatcgatacagataatagcataagtcttcagcaagttgccatcagtgaggaaactagtggggaataaaacacaaagccatagctagatctacttctccgatgagttggggccgcgcttcttgccgaatccaacaacggcggtgacgaagcggcggttgtattgcatgcgcttgtgagcgcggccgcggggcttcttcttcttgtcctgctttgcaaccttgggcgtctgcccgcgcaccttcccagcgcgggccagcgatccgtgaaccttacccatggcggcggcggcgaaggtgctgtgttgctggaggatctgacgagcgactcgggatgttgcggcggcggggctgtcccccggcccggccgggtgggagaatttataaacgccacaggcttcgggcgcaacttgcgttcaaaaactcgatggttcgcgggattctgcaattcacaccaggtatcgcattttgctacgttcttcatcgatgcgagagccgagatatccgttgccgagagtcgtgtcgcccgaaccggccggc

SEQ ID NO: 20089 - DNA, 1259 bp, Zea mays
gcggccgccctttttttttttttttttttggccgcccctttttttttttcaagttcaagatcaaactcattatttcaactctccgcaaacatctaactgaatatgaaacaacagtcaagctatcatcagcatcctccattcacacatgggaacgtttccagccagtgcatatgttaacacacacacacgatacacttacatcgacaagagtcagcataattctagcatttcccgacatcccgcctccagcagctgatcatgcacacgccgcaacggggaactcacctactcatcacactaatgtctaggcagaatacacagaagaatgataagtcaaataggttttgccctacaattggcttggctcttctctcgcagtgtacacatcaacatctcaaatatgcaccagtaatgaggagctgacaccataaataccgcatctcctttgccaggggtgcttctgccgcagcatttatctcttgcgcctctttgattcaatcttagaatctgagtttggtgaaactgagtatgaatttgagggtctctttgcaccattttctttagcacaatccgagcacatgtaatgatctatcttttttgcttgctcaatggtcattcccatacaagacggatggaaccagtccttgcatccttcacactgcaccatgaggtcatccgggttgtacggcatctcacacttgcaatatacggcgacacggtcgggggtgaatgcaccggtggcggccttgtagtcaaatcggcagtagaagtcctccggaccaacgttgtcgagcttggtgtagctcttgaaggagtgaacgatgcacttgccctcaatggtgtgggcgctctgcgtgtcgaagtggtcggagaggaagagctccttggcaccgtggaacgggcgtcggccgcccttggcctcctcggggcggtagtaccagcgcacccgcaccctcacgctgccgcgcccgtccgactccatccgctccacccgcgccacgtacggcgggttgtccgtgtccgctggccgcatcagcacgcagtcccccactcggaccaccttgttggtgcccttgatggtataggcgtcgacatcccgcttcccttgcttcgtcttggccatgacagaggggctggattgcgagaaaaccctagcagcgagggtgcaggaagcgggggggctggggactgccgcggctgtccgttccaacggagcaggaagctgagggagcgggctaggggtaatttggtagtttctc

SEQ ID NO: 20090 - DNA, 1264 bp, Zea mays
tttttttttttttttttttggcgtaaactgaaacttgttgtgttttgaagtaattgtagcgtaaaatgcaagctaaccatctacatgacaactgtttcagattttacaataagatataaaagataattattcatgtaatcaactatggtaatgtcgtgtttacagtttagctgttggtacatacacgcaagactttgtttgaccataacaccactgttatcataaaactgagtagaaaagactcttccagctttcctaacgtggagaaaaccaccgaggtccatatcttagaatcagagtttggtgaaactgggtatgagtttgagggtctctttgcaccattttctttagcacaatccgagcacatgtaattttttggcttgctcaatggtcattcccatacaagacggatggaacctggacagtttgctcgttggttttttgagtgagtgtcaaacctcttcaaaattagcccatctatccatttctttttgtgcaagttcaacaacattttcttctcgagctcatttttgcggtaattgattgcaaattagtagtgtctgttcagcccatggataagagcctgaatcgatgagttatttaggtgcccgacctttgatgtcgtctgccgtggctcctggccaagcatcatggtctgaggattaattaggcggaatacatcaataactactttccccttcacactctatatggggtctacgacaacagtaaccgccctggggttcaaagcttcaaaataccagatttggttgccgagactcgcggacaggggatggagggcactagcggcggtggaggcgagatctacaggtcggcgttggcgcttcacttcaatctggtcggccttcactgtaggtactggtggggaagtcgaggacggtgtcgatgcttaaggccgcagctcggttccgcccgagcgctacgcctaggcaaggaggatgacgcgcggtagatccaggatgacagcgtaccagcagagcaggacctagctgttagctactggctaccctaacagaggaataggaaggagattggaagaacgaagaagactttttttttgaaacacagactcatagagactgttaaacaacatctccaggcagatcgccggagactaaattggaaacaaaggcggggacttggctcatgaaaacattcgaaccagagcaaaccacgctcgccccatacttcgcaaggcaatctgccactttgttgcacgtccttggacaatgttgaacctccc

SEQ ID NO: 20091 - DNA, 1472 bp, Zea mays
tttttttttttttttttttcaagtttcaattttttttttttttttgtctcaagtctttgcttggcaacatctaactgaattatgaaacagcagtcaagctatcatcagcatcgcccattcacacatgggaatgtttccagccagtgcatatgttaaaacacacacacacaacccgataaagttacatcgacagaatcatcagcgctctagcatttcccgacttatcccgccaccagcagctgatcatgcgcgcgctgcagcggggggggggactgactgacctactcatcacactaaatgtctaagctgcaggaaacgtccccagaatacacagaagaatgataagttaagcaagttttgtcctacaattggcttggctcttctctcgcagtgtacatctcaatatgcatcagtaatgaggagcagacgccatatcgatctcctttgccagaatttatctcttgcgcctctttgattcgatcttagaatcagagtttggtgaaactgggtatgaatttgagggtctctttgcaccatttttttcagcacaatccgagcacatgtaatgatctatctttttggcttgctcaatggtcattcccatacaagacggatggaaccagtccttgcagccttcacactgcaccatgaggtcgtctgggttgtacggcatctcacacttgcaatacacggcgacacggtcgggggtgaatgcaccggtggcggccttgtagtcaaatcggcagtagaagtcctccgggccgacgttgtcgagcttggtgtagctcttgaaggagtgaacgatgcacttgccctcaatggtgtgcgcgctctgcgtgtccaagtggtcggagaggaagagctccttggagccgtggaacgggcggcggccgcccttggcctcctccgggcggtagtaccagcgcaccctcacccgcacgccgccgcgcccgtccgactccatccgctccacccgcgccacgtacggcggcttgtccgtgtccgccggccgcatcagcacgcagtcccccactcggaccaccttgttggtgcccttgatggtgtaggcgtcgacgtcccgcttcccttgctttgtcttcgccatggcgtagaggctggattgcgagcgaaccctagcagtgcgagtgtgcagcaagagggggggctgggggatggccgcggttgtccgttccgacggagcagctgcagggagactgagggagggggctaggggtaatttggtagtttctacgcgattagagtgacggggcgtttgaatccaagtggcgagcggctgctctctgccgtccgatggaggctgctgctggtttggacggcgaacttgatgcgttcgctttgccttgccgttgacaccacagagggctagaatgttcggtgcctcctgcgtgggctgtgagagcgaacccatgaagatacttttttaatctcttggtcgttatcttcgagaattt

SEQ ID NO: 20092 - DNA, 1084 bp, Zea mays
agcagacatgagttccaattcatagatcacaatacgtcttgcaagaagcaacaatgttcaacaaaacttggaggtaccagtaacaaaaatcaataaacttggacctactaagtcatacttgtaaacaactagcaacaaattattgataaaacaattagacatagttcaaccaacaaccaaatttcaaaacagaaacgtcctgcaatagttcactgttgggggcttaggaactttatggccctggattgtgctgatcctgattgaagcttagcagctagtgaaggagggcatgtatttcttatggtgtcttctttaaatcctctatttcctcagaatgttttaccaaagtttctgattccatcttcatgttatccaactcttgtcgaagttctgccgtttattgcttctcattctcaaggtaatctaaagatcttggacctgtgacgatattgtgcctctagaggtactcttggaggccgaacaaacacctgcaacacgaagaaaagtagttgattttgacaacctgagaaacagcttcatttgctaactttggttcatgtccatcttgtactggttcactcatgatgccttccatatcatcaattgctttctgtacaaactcggtaaatccattgtttttgctataatggaagttcttgaatagatcaactgaggtgggctctgtgtctcgcacggtggcgcggacggtgtagccacggtcgaggaggagcctgacgatccaggacgcgatgtacgctgatgcgtcggtgacgcacaccaccttccacatccccattgtcgtggtcgcagcagcagagtggcacgggcgacggcggcgacacgggctaggcggcgaggtcgggaggaggaggaagggtcacggcgggagggacggcgtgggagggcgaggctgggagggagtggtacacgggctgggcggcgtggtcgggaggaggagggcgggtcgcggcgggagggacggcgagggtcgggaggaacaacgtgggacggtgggagggcgaggctgggagggagagccggagaggtgaacggacacggggacctcgctcaaagctgggtaccc

SEQ ID NO: 20093 - DNA, 4297 bp, Zea mays
  misc_feature (2636)..(2636): n is a, c, g, or t
ttttttttttttttttgaccaaatttagcagacatgagttccaattcatagatcacaatacgtcttgcaagaagcaacaatgttcaacaaaacttggaggtaccagtaacaaaaatcaataaacttggacctactaagtcatacttgtaaacaactagcaaccaattattgataaaacaattagacatagttcaaccaacaaccaaatttcaaaacagaaacgtcctgcaatagttcactgttgggggcttaggaactttatggccctggattgtgctgatcctgattgaagcttagcagctagtgaaggagggcatgtatttcttatggtgtcttctttaaatcctctatttcctcagaatgttttaccaaagtttctgattccatcttcatgttatccaactcttgtcgaagttctgccgtttattgcttctcattctcaaggtaatctaaagatcttggacctgtgacgatattgtgcctctagaggtactcttggaggccgaacaaacacctgcaacacgaagaaaagtagttgattttgacaacctgagaaacagcttcatttgctaactttggttcatgtccatcttgtactggttcactcatgatgccttccatatcatcaattgctttctgtacaaactcggtaaatccattgtttttgctataatggaagttcttgaatagatcaactgaggtgggctgtatcagctcatcaaccagttggatccaaggtagtagatcccaaattagacggccactccattatttggtgccatgaagttgggtaccagaaggtggatgatcaacaactcatttaggtgagaacagatgagatgaaatcatcagtcagacagatacataatgaagggccaaatatttggagagtgagatcacgcaatccagaaaaagagtgacatcagctcaggaaaagggaaaaaaacatgggaaaagtggtgcatatatttggttaattgtaataatgtcacagaagaactatgaatgtgtgaccaaagaaattatacaggacagttctccttttttgacagctaaatttagttctcctttttaacacctaaatagcagagcgaatacaaagtttgtttagaggggcagaattgtgctggatgagtgagatggaaaacagaacaaggcaccaacccacactacaggacacaatctgtatgagaatcttgaccttggccaaataatagcaactgtaagagccctaggcaagagggaaattccttagatttgaagcctgccttgttttggtttgccccacacagcaagtcagcaacactaaaacctgatgctgctattagcatgtgtattgggctcaagaaaggggaacacatggatcagcagtccgcgtgcaggcatatgtaagctcactattttttttaaaaccagagcataactgcattgatgaggttacaacttacaccgcctgcggtgcaaaagacaatgtatatcccatattttcacttgtctagttatataaaattctaagaaggcatcattaaagtagaataataacttgtttccactaaaccaaggaggacaaaactttcaaaagcatcagtaggagcgcccagtgctttctctctcgtggatcccctataccagtcatgtatgttacattaacaaagtgtttagcaatgttatttggtcattcacatcaccaaccggttgattctcatcaacattagacgaatattacaaaaaggaagtccacaagcaacactttatgatgatagcaacactgaaaggagtacattttttattattctcaagaaaaagtgccttgttaagtgaatgtaggttgtggagaactgaaagaaaaagcatcagagagatgagaactaacgaaactttcagtatactaccagcaacaaatagaactactcaaagatcactccttccgacttttgatgcatttactctagggaacattgatgtcatggtcaatggatattggttcgtcaatcataaataaatatggcaaggaatagatcgagttcaacatctgagcatgtaaacaaactgtagagatatgcagtatcaagtgtgtttgaaacatgaatgataaataatagcagtatgccttaatatgctttggttctgtactatcaactttcaaggatataccaagataaacacagattgcagccaacaagctgagtatttgacgaccagcatcagggatcaggtttaaaggcaagtaaaaatgcaaccaaatgaactgtgagaatccacacatgtctaaaaacacaacacaaaagatcaaatatattttgcttgccattctcgctgaataaaagatttggtcagacgatttgagccatcgaccaacaacgtacacaaatactcacagtacagatctttctccattctattaagaaaagacagctacaatcctttatcttccggggagaggaaagaagcctatagagagtacaattggcttggtgactcctctctgtagatgagagtttgcaagattcagaagctagttaagtgaccaaacaagcgtggatatgtgaccaaatatgtgcggagattgaaatgttgatggtgatcatcagtgaatgaagtgagacatgaaaatcttatacaagcgtgcaggtcanctgggttggttcagttgcaacagcatctgaaatagacacgcgaactccagcagaattccttccatgggggcaggaaattaaactattgtcaaacgtagcccttgacaacgtagatatatagtatagggtccgtatcgaagaagtataaatacagacatatacaagttaatggccaaagataacatatatattgtggtgacatatgtagaactgctggaaatatatacttatactcaagcttgatacatatacatgtggcgatgcgctagtgcagaaataagctatagtcccggatggaaacctcatttatgtgcagtgtgttaattaatctagatctagagaccagaagtgcctgtctgacagaatgaattttctgccagctatcgttggctaccaaaaaatggatcggagctattttcccatatctatgtatgcagagagtaatccaagcatgctagaatgaccacacgaagaacaaataaaagttgcaaatgcagaatacgtgttgcaaatcctaacaaggagatacaacagaataatactactgtcttctatttcttaccataattctttagtaatattacctttggcattcggtcattgttgttaccttcacttttcggctgacccaaagaaaacattgcaagtgactgcgttggatggagctaaggataggctgcacttcaaggtttctccttgttaggattataatagggacccattataatatgtgttgcttctaaaaaatagtttctgtttctatccgtttggttgattttctatttctctcccttctggaacttggtgtactgatatgtatggggatacaaattgctccttaataaactgacaagccaagttcatctgtagcagcatttttcagtctacagatgcaatcaagattttgggttgccggaggcaagtggatccagaagcaaaatagtaccgaacctaacatcccaaatttaccaaggtaggttatgcagtcccctgccaactaatcaattcccagtctaacctaaccaatctcacaaaacatcacagtaattccgctagctaccacagggaatcagtgggaaagaaaggcacggggattggggaggacgggccgggatgcgcacctgtgtctcgcacggtggcgcggacggtgtagccacggtcgaggaggagcctgacgatccaggacgcgatgtacgctgatgcgtcggtgacgcacaccaccttccacatccccattatcgtggtcgcagcagcagagtggcacgggcgacggcgacgacacgggctaggcggcgaggtcgggaggaggaggaagggtcacggcgggagggacggcgtgggagggcgaggctgggagggagtggtacacgggctgggcggcgtggtcgggaggaggagggcgggtcgcggcgggagggacggcgagggtcgggaggaacaacgtgggacggtgggagggcgaggctgggagggagagccggagaggtgaacggacacggggacctcgctcaaagctaaatttttagtttcaaaactgtttctatttttttacagtttcattataatttttagctattggtatataacagattgctcatgaatacattagatctaaatttatagtaatatatttatgaaaaaatacatgtggaaaattcaaa

SEQ ID NO: 20094 - DNA, 1999 bp, Zea mays
ttttttttttttttttcaaatgtacagatgttcgcatgtattatttcacaaaatttacatatcaaaagaccaaaattatagcaaacacaatttctaattcataggtcacaatacgtcttataagaagcaacaatgttcaacacaacttggagctaccagtaacaaaaatcaacaaacttggacctacttagttgtacatgtaaacaactagcaaccaactattgataaaactagacatagttcaactaaaaaccaaatttcagaacagaaacatcctacaatagttcactattgggggcttagtaactttatgaccgtggattgtgttgaccctggttgaagctcaatagttggcgaaggagaccatgcatttcttgtgatgtcttctttaaaccctctatttcctcagaatgttttacccttgaagtttctgattccatcttcaaattatccaactcttgtcgaagttctcctttttcttgcttctcattctcaagctcaacctgaagatcgtggacctgtgatgatattgcacctctagaggtactcttggaggctgaacaaacacctgcaacacgaagaaaagtagttgatttgacaacctgagaaacagcttcttttgctgactttggttcctgtccatcttgtactggttcactcataatgccttccatatcatcaattgctttctgtacagactcggtaaatccattttttttgccacaatggaagttcttgaatagatcaattgaggtgggctctacatctttgaatatatctttcttcacaacatgggcctgtgcaatgtagcatcgagatccagtgcgctgatgtaaccggacattctctcgatttagttggtttttgttacacttttccttgtgctttgcgtctgaccacatctccaccaatgctttccattgatcatctgtcatatgtttaactggcgatgtggtccttacttgatttgctggtatcccattgaaatatttttttttcagctggtacctcatctgtcgttgtccacccttgagcaaatcggcacatgcggctttgattgcattattgttggtgtccatggtgaattgggcagcaactttgccgatatagtttgtaacaattgacttatccttcttgtactctttccaatgccggaggatcggcatttgctgcctaagtataatcccgccctctgatgcaagtttggcagcttgcataggtgcttctggccgcatctttccttcagcaatgtgtatggggatgttagtgcataaacctctacttatcctatccagttctctgcccatactcctgttcctttttccatttggatctatggttgcctcaagtgcaccttgatcactagagttgttctggtcctgttgaggggtggatgtgatagtagagagtcctaaggtttcgacttgttgcagttctggactgaaagttaaagccaaatcccttgtattctgcctagtaaatcttgtaggttcatcttgttgcgcaggtgccaagaccctctttaatctgtttctccggtttgttgcacactgattgacttcctcatcttcagaaccttcaccttcctggacctcatacaaagatccagatttttcatgagtgtcaaccttgctctttgcagaagtatggttaagtattgacgctagtgtagtgacaccaagtctttgcaacttttggttattcctcatcaaattctcagctctcaatttctcatattctgttagtggcacttctgttggtttggttggttttgctgtagttttacgcccaggtgccatggtggtctccagatcgagcagatgagccgataggggagtggatcgagcagactggccgatgtgcgagcaggagagggatcgatgggggagtggatcgagcggattggccgatgtgcgagcaggagagtggccggcgtggggagggagctgtagcctgtagctccgatttacctggggacgttgtggggaatggggaatgt

SEQ ID NO: 20095 - DNA, 1164 bp, Zea mays
ttaatgtaacagggatgtttgaactgtaaacaaaatctgtcgacatcaaaatacaatcgtttctcttgtggtctaatgctttttattaactttccttattgatactttgggccaaaaaagggtgtcaaaatgttttaagctgagtagaatgggcacacaactgcacatatatgatgcatcatcagatttggatctgttgcagattctgtgccactaccatcatgacaggaatgcataagcaccctagttctttgggcaccaaatatagttaaacaccctagttcttctttgggtattctcttgcaccaaatatggttgacccaactcttacatttgtgcttcccatttcaatcgcttgttcaaaatcagccgacatgcccatagacaattcgcactgctcttcgggtattccaagctccttgcacacctcttcccggcagttagccagcgccttgaaattctcaggggttgaggagtaatcaagcatcccaattgtcatcagaccagagaacacaaggttcgggcagttcagtttgacatgctttgctagttccatgcatcctgagggatctactccaaatttcgattcttctccactagtgttgacttggaccaaaaccttaagaggttttctccccaagtcagctaccactcgatcaagacggttagcaatcttctcatcatcgacactctcaaccatatcaaggtttggcacgccagcaagtagggctctggctttgttgctttgcagattcccaatgaagtgccactcaatatcctcaggaagctgaggcgccttgtcgatgagctcctggacgtagttctcgccgaagcagcggtggcccgcgtcgtagacgccccggatgacaggcaccggcttggtcttgctcaccgccaccacgcgcacggaccccggcgcgcgccccgcccgcgccgccgcctgctgcgcgcgcgacagcaccgaccggagcgccgccgccgcgacctccgccgcggccacggacgccatctctgccttcgccgacgacgccaccgccgacgtgaggggttggtggtggcctgatgtgagcagcctcagagctctgattctctgacgggcctagttcgacccttcgaagattggagtgggatggttttcgcccccggccggcctcgaggtaccca

SEQ ID NO: 20096 - DNA, 869 bp, Zea mays
ggctcacggaccccctcggggcccgctcgtcgacacaaggtatcttatcttattatatgaagcagacggtgcattactacatctaaaatttcattacaaagtagaatatgtatgaacataagtcataagagcatctcgatgtcgctccacacttttaatacacacagatactatacaagtataaatccattgccttctctggaagcaattcaccacacgtgtgttcccttagttacccccaggaatatggcaacggcagcaacaacggcagcaattgtgcaagcaacatatcctggtttctctcggtggtcatgtacccgcacgcatatcagaacgaaagccccaatgtaccatggaatggcagcaaggaaaaacccagcaatgaacaggcaccagcctaagccgaggccacaacatgggagacgcctcattctcacaggtcttccttcagcaacaggaccatagcctggcacggcctggtacccctgggcgtagtacgtctccgcgtgcgcgtacggctgttgctggttgtggtagccgccgccgccgccgaacccgggaggcggggcaggctgcgggaacccgacgggaggatgccgagggccctggaacgtgccgtacccgtactcctgcggcggctggccctgcaggtgcggcggctccgacggcgggagaccggaggagtagcccccggcctttgcgccgccaccctcctgctcctcgtgccctcctcccatgggcgatgggttcgacgtccgttgacgtacgcgaatgcgctgtggcgtgtgcgcgtgtcgcggaaggagaccgcggtgggatcaggaaggacagtgcttagtgagtcccccggccggcctcgagggtcccaa

SEQ ID NO: 20097 - DNA, 911 bp, Zea mays
cccatattatttattatatttttttttttttttttcgcgtgggccgcttttttttttttttttttaaataaaaggtatcttattatatatgatgcagtgctgcttacaagaagcagatggtacattactacatttcaaatttcattgcaaagtagaatatatatggacataagatcacattcacatggatgttgctccacactttttagcacacacagatatacaacgcaaatacacattgattgccttctctggaggcaattcaccacacgtgcgttcctttagttacccccaggaggatggcaacggcagcaacaacggcagcaattgtgcaagcaacgtatcctggtttctctcgttggtcatgtacccgcacacatataagaacgaaagctccaatgaaccatggaatggcagccaagaaaaacccggttatgaacagacaccagcctaagccgaggccacaacatgggagacgcctcattctcacaggtcttccttcagcaacaggaccatagcctggtacggcctggtacccctgggcgtagtacgtctccgcaggcgcgtacggctgctgctggttgtgatagccgccgccgccgagcccgggaggcggggcaggctgcgggaacccgacgggaggatgtcgagggccctggaacgtgccgtacccgtactcctgcggcggctggccctgcaggtgcggcggctccgacggcgggaggcccccggcctttccgccgtccgcctccggttcgcgccttccttccataggcgatgggtcgaccgttgacgaacgcgacgagctgtggcgtgagactgagagcgtgtcgcggaaggagacgcgcggcgggatctggaaggactctggtgcatccccgccggccccggccggccccgtggtacccaat

SEQ ID NO: 20098 - DNA, 790 bp, Zea mays
ctcattatatgaagcagacggtgcattactacatctaaaatttcattacaaagtagaatatgtatgaacataagtcataagagcatctcgatgtcgctccacacttttaatacacacagatactatacaagtataaatccattgccttctctggaagcaattcaccacacgtgtgttcccttagttacccccaggaatatggcaacggcagcaacaacggcagcaattgtgcaagcaacatatcctggtttctctcggtggtcatgtacccgcacgcatatcagaacgaaagccccaatgtaccatggaatggcagcaaggaaaaacccagcaatgaacaggcaccagcctaagccgaggccacaacatgggagacgcctcattctcacaggtcttccttcagcaacaggaccatagcctggcacggcctggtacccctgggcgtagtacgtctccgcgtgcgcgtacggctgttgctggttgtggtagccgccgccgccgccgaacccgggaggcggggcaggctgcgggaacccgacgggaggatgccgagggccctggaacgtgccgtacccgtactcctgcggcggctccgacggcgggagaccggaggagtagcccccggcctttgcgccgccaccctcctgctcctcgtgccctcctcccatgggcgatgggttcgacgtccgttgacgtacgcgaatgcgctgtggcgtgtgcgcgtgtcgcggaaggagaccgcggtgggatcaggaaggacagtgcttagtgagtcatgatgactgacctc

SEQ ID NO: 20099 - DNA, 3374 bp, Zea mays
gggctgtgaaaaagctattgtgagctgtaaaaaaagctgttgtagactgtgagtcgttaaaaagctaaaactcgtttggtggaaaccactaaaagccgctaaaagtttttttatatatattttcacagtttcatccgaaagccgctaaaaacaggtctaaaggtgctttaaagttttcgagaaagtcgacttttaaaaaaatgcttctaaatccagccctttgatttaacttttgtcttttaggaggcaaaagctaaagtcaaaagccaaaccatgcacacctctagccaccctcatgtctttatatttagaaatatagaagagcaaatatctcaaatggttatagtatttagggaatattaccttaactatttaaattaaattttatttttttaataattattatttgaaattatgatcagatattttaggtttagttcaagtaatttgggtttggagataggctattggttattttgtccacccccaccattcaacaccacacgtctgagctgcagtggcggagcgtgaccgaaaagcccaatccacagccgaagccaaacaggcacaagaaaaggctcctgctagctatattttttttggatccagaatgcagtcagaaagctttgtaatcagctgaatcaaagtttacatgccaagggaccactacccagttacattctactgttttattttggtggcaagtaacaaatcagagacaacagttgttaaagtaaaagctcaggcttaacgtatgagctgcaaaatagaacaccagagctgcttaggacctgtttggctgtttctcactgacgacatcatacagcatgtctctcacatgaaactattagctaactaaatgttagataggcatcagcctaccttcagcacataaacaacctatagcggtcttgtgccaataaaaattgaccaagatgtggactttctttcatcttgtttaccagtagtctttgcaagaacacacaccattttcgaagtggtggaacctctttgcatcccttgcaatgatctgacgtccaacaagttttgagattatcttgaaagccgtgtgacaatccccacaggatcgaagattctttataacccgaataggtgagcggggagcacttgttataagaccgtaactgatagccagcctctcactgtgagccagtaaagcatcctctttggtttcttgatcaacatcgtgaagaacaaatcgagtgtcagcaatatacccagcttccttcatgtgagccaacaaatacctcagctcttcatagatcttaggagtgtcagggtgagatcggtcgccagctctgtattcatggaccttgctccgagcttcggcgacacttgcctttttcctttccttttcctttgcaagatctgacacatcgacagggaacagacccattttagactgttcattcagcctagaagaatccaagcactctatgatctgagcacaacgatctccaagctctaaaaagccattaagtcgacacatgttcatcaaattttcccatacctcaatgcttggttccacaggcatccgttccacgaattcataagcctcgacaatgtagccagactgtccaagcatagtaacaatgcttgcataatgctctgtagtgggatgtatgccaaaatctttctgcatggattcaaaatgcaacattccttcattaacagatcccaaaattccacatgccaagaaaacatgtctgaacatgccatgatctggcttgtcccctgtctgcttaaaccgttcaaaaaaatctattgcttcttcaccaagaacattgtgcacaaaacctgagatcatagtgttccaagaagtcaaattatgatgatccatagaactgaaaatcttctttgcatcttccatagaaccacacctagcatacatctccagaattttgttttgaaaatctgtgtcaacagtaagtgatgattcagatatttgactatgtattaatcttgcttctgaaagggcagttgcatcaccacatgcttgcatcaatctgaagtactgaggagcatgtagcacaattctgttttcctttagcatagccaaaacttccagagcttcttttacattgccatcatcacaaaacttctccagttcttcaacagtacatttgtgtttgctgccagcttcactaggtacttcgtaaggcgatccaacatttgaagggttgccttgtagtgactgatgatatttgccatattcatgaggtgcactatttacatggttcccaaatgatccagcagattgtgcatgtgaatgtttttcttgatgaactccatgagagaggcgttgcacatctgtatttaggtacatggaatatccttgagaagtactatgtgtatcagcctgcctagtgaaataagggctttgatatgcctgcgaagcattatatccaaaattactattgttgccttgctgaaaccctgcaacatgctccttacgggaatgagttggatttacatattgagagggatgatgcccagatctatctggataacttcccccagatctatgatcaacatattgctgtttctgaactcgctggctatttccaactgggttcggacatggttgtcctgaaggaccatatccatactgcccattattagctccctctccttcataaatcttctgcttcctttgggtgtagtatccagagctatatgtactattagcttctgtgccattgtactgttgacgatcatttgaaaaatgtccatcaaggccttgctggctgtatggaccactacctctataaggttgtgatgcattgtatctctcattattcgctcttgtaccagtatatggctgatgattgcctcgtgccccatatgatccaccacttctgtaatgttgctcagaactgccaccaacaccatccacacccttatttttgtgagtacctgttgtggaaccagctgaagtgacatctctctgaagttggagattagagccgttccaacgggagtcagtgtagctacctgctttgttttgtccccactcacgctgataatcttcatcagtcctttcagatgcaaaggtaccagcccctcgatgtggaacccaagactgtagacaaactctttcagctggaagcctgcaagataaaagaaccatgcttttaggatgaccctgaattgaaaattttcaggtgcaatgtcactcctaacaggtaagtgttttttccattttgaaaagtaacaagcaacatcctagtgaacagaaacacgaattagaattactgtgagtctatgccaaggtccaaggaataattcatgttctaatcaggcaaaaatgactagaaatttccttcccagaataattggctaccttttgtttt

SEQ ID NO: 20100 - DNA, 812 bp, Zea mays
tttttttttttttttttttttggcaacggagaatctgatctctagtctgaaaatgcgacaactcgatggggatgctacctgcttcaactctagcatggatgaaaaagtcagacggtcgggctacgtttcacggtatcggtacagcatctcacgtaaacagtttacaactgaaaaaaaaaatttaacggccctctgctaatccactttacgagtgcaaaagtttgggcgctaggagcacaatgactgtcgctttgtatgatctagtaacacagaaggaacgaacggtatgcttttctatctcgctgcagttttttcagaccaccccggacggaagccgcagcaccagttgcccgccgaaaacactcttcacatagtagtagcagaaatctgcaaggatgaatgtctggacgatttcggagaggagaaccatcgaaggccacagaccgtagcccagcgcagtcaacaatccgcctcgggtgtccaaaacctgaaggacccagtgtgcacagctaagaaaccttgcaacacccagcgcaaacacataatgagctgtgaacggctccacaatcttggtattttgcatcaagcgcaactggggcaacactgaaactgcttccaaataaacacagaaggcccagcagattctgttcacaatgttgtgcgatgttgaaggatgaacaagtagcgctagcacagcacagggcaataccacatagtacaaggcaaagttgtctttatccagcatatatgtcgacctcagtttgaaccgaatgcggcacgaggcctccgctttcattcttctcttcccctcg

SEQ ID NO: 20101 - DNA, 3095 bp, Zea mays
  misc_feature (2442)..(2442): n is a, c, g, or t
tcatgccaccaactcaagatgtgaaagtcttcatgaaactggaagacaatgtcactgtcaagatatgaagacaactctcggagagaggcttagatgggtctctttattgtcactccatgttaggtatttctgtctacacttcattcaaatgatagggttgcccctcttgcatgtactctcatacgcatacaagattattttacttctttaaattgccaaaaaaatcacaattttgccattgtgattgaggctgcttttttttacccttagccttattgaaatttaaccgaatctgttcatttttgtatttgagtgtttttaatggattagaaaatctttctttgatgtcttgctaatttaatgtggtgtaatttcattgatttttagattttgatcgtatctaagagatcctattttatccgggttgctaactcaatggtagagtactcggcttttaagtggagctatgatcttttacacatttggatgaagcaacaaattcgttcagactcttggtagaatctagaagaccaaaatttgtgatatgtacttgtattatttgtttgtgaagtgcattttatgtcacgtttatcgggcggcccgacactatcaggcccaacggtcctaaggcacatcacgacccagaaacagacataacctgttcgtgccgtgatgtgcttgtgctaggtcgagccgagtggtatgtttggacatgtatagtacagggtaggaggggcggaccgaaagaagggagtttgggttgtttttttaatcagttttggccaattttggattggaaatggatcaagccgtccacccggcattccggctgcgtccacacgtgagacggagcagcggagccggagcgatagtctactagctcttgcgttgccgcgttgtcttttgctggaggacatctgtaaaggcttcgctgatgctttccacgccaaaacttctggacgccgcatctggcgttgcgctgcgacagcagcatgttccagccagccagcgccagtagaggcaattggcaaagattttacgacggcagtattcggctccaaccttttcatgtttcggacacgacggccaacagcaccaccgcccagcagcacgggcacggttcctgtagtcctactgttgcacaccatttctgcgtggtcaacaaaccgacggaactgcaggcggaactgatgtgatgtgagctgccaggaagaatgcatgaggcgactgcgatccaccctcaatccgactataccattctgaatcttcagtttgtctacagatgactcggctttggctgtccagggcactcaatcttttcttcatgttttcttcctcccgacagacacgtcgccgccagccaccggccaccggcccactgcccactacggtcgcacagcttgacagctacaacgataccctaccatgccacgacgaaccacccctcaaaaaaacctactcgagtaaaatgtagtctttctgttcttaattgactaataaaagaaaactagtactaaagattagtagtggacccgaaaggaacccctactgataatcccaatgttaagtaaatacaaacctgatgaccttggtccaaccattttcacgtggctagttctgctgatacatcaagatcaatctgtttcatatgaaagcattatagaattatataatccaatgagatcactaaccacctgattctaagaccaccacgacagtcacaggaagctagtactcggagattgggcatcaagaaacggcgcagctatgaagtctcaatgacaaactatgttttaagagaacccttgcagcaattttgtcatacatagtcattacttgcaacatcatcagctaaaagaaggctcccaggttgggcactagagcataactgttattcagagtatctcttctgcacttcttacaccacccctgagggaagccgtagcaccagttgcccaccaacaagactacaacggcaaatcacttattagacgatgtacagaggaacacccaactaaacttaacggtggtactgaatttacctcttcacatagtagtagcagaaatctgcaaggatgaatgtctgcacgatttctgataaaagcaccatagacggccacaaaccatagccaagagctgtcaacagacgaccacgcgtgtccaaaacctacattgcagaatttgttgcttccggtgatcagggtttgagtaccatttgcctaagtgtacttcagtgatgtggtaacactagactagagaatcaaaagcgtttttttttcatgaccatgaatgactacaagtctacagtggccataagacactacccaccacccaaaaacaaaaacaaaaatctgactgttcaacaaaaatgacctaaaaacacaaggattggtaaacataaaaaaaatctcacacatctacgatgaaaatatatatattgcngagaattctgttaggtatgaaaaacaataacaacaaaaatgaaggctgctacaattatacagctgtgtacatcatctcaggagtttatacaaaacacggacctgtagaacccagtgggcgcagctaagaaaccttgcaactcccaatgcaaatacatagtgagctgtaaagggttcaacaatctgcaaaagacggtaagcacgaagtcaaacttatcatcctgcaatcaacggaaccaaatggcagtatggtgatattaccttagtattttgcatcaagtgtaactgcggaagcactgaaacagcttccaagtaaacacagaacccccaggagatccggttcacaatgttatgagatgttgacggatgaataagtagtgccagtccagcacacggtaacaccttgaaaagtaacaagaaaagcccaagcacaataagacaacaatatacaaatacaagtaagatgtgcaatgttgtggcagaacaagtacaactagccagcataagcccaatgccttctgttagcaggagcatcagaaacactacctctgatcccagaagtacagaaagagaaagaaactagttaattacaaaacagagacatggatttcaaaatgtttcaataataaaacatctaaaaggtgatggcattct

SEQ ID NO: 20102 - DNA, 2243 bp, Zea mays
tgttcgatctcgaagagaaggaagagatcttcgaaaagtaggtttttatgatccgataaagaatcaaacttgtttaaatgttccagctattctctatttccttgaaaagggtgctcaacctacaagaacagtttatgatattttaaggaaggcagaattctttaaagataaagaaagaactttgagttaattgaagaactaaatgaataaaaaagtaggagagggtccttagtaccccttaattatttagacacaatttgcctctttcttagtcctattttttttttgctgcatttatgtcgtgccaatccaacaaaagtccctattttatttcctttttatatctaattacattgtatttgcattgacaaagagcagtggtaccaacgcagtgtgtagatagatgggtctctttattgtcactccatattaggtatttctgtctacacttcattcaaatgatagggttgcccctcttgcatgtactctcatacacatacaagattattttacttctttaaattgccaaaaaaatcacaattttgccattgtgattggggctgctttttttttttacccttagccttagtgaaatttaaccggatctgttcatttttgtatttgagtgtttttaatggattagaaaatctttcttttgatgtcttgctaattcaatgtggtataatttcatcgatttttagattttgatcgtatctaagagatcctattttatccgggttgctaactcaatggtagagtactcggcttttaagtgcggctatgatcttttacacatttggatgaagcaacaaattcgtccagactcttggtagagtctagaagaccacgactgatcctcaaaggtaatgaatggaaaaaatagcatgtcgtaataaaatcaatttcttttttttttttaataaaaaaaattctgattttctgggtctagtgaataaatggatagagcctggctctaattctggtaaaataaaaaaaaagcaacgagcttaacttcttaattggttaattggaaggattccccgatctaattagacgttaaaaatagattagtgcctaatgtggggaaaggttaggttttcctatgaatggaccctttactttttttttttagaaatcctaattattcttgattatggattgaaaagagatgttatgaattgaatgtgtaaaagaaacagtatattgataaagagactgtattccaaagtcaaaagagcgattggcctgcaaaaataaaagatttgttcttgtttgttttataattagaacaaacataaactaattagatagaaaaggagtggaaaaagttctatggattagactccctttctttcctgggtttgtattatgcaacaccttgttctgaccatattgcactatgtatcatcatttgataaaccgagaaatgctttttttctctatttcaagtagaaatacaaatggaaaaattcgaagggtattcagaaaaacagaaatctcgtcaacactacttcgtctacccacttctctttcaggaatatatttatgcatttgctcatgattatggattaaatggttccgaacccgtggaaatttttggttgtaataacaagaaatttagttcactacttgtgaaacgtttaattattcgaatgtatcagcagaattttttaattaattcggttaattatcctaaccaagatcgattgttggatccccgtaattatttttattctgagttttattctcagattctatctgaggggtttgcgatcgttgtagaaatcccactctcgctagggcaactatcttgtccggaagaaaaagaaataccaaattttcaaaatttacaatctattcattcaatatttccctttttagaagacaaatttttgcatttacattatctatcacatataaaaataccctatcctatccatttagaaatcctggttcaactccttgaataccggattcaagatgttccctctttgcatttattgcgattctttctccactattattcgaattggaatagttttattacttcaatgaaatccatttttcttttgaaaaaagaaaataaaaaactatttcgattcctatataactcttatgtatcagaatatgaatttttcttgttgtttcttcataaacaatcttcttgcttacgattaacatcttctggaacctttctggaacgaatcatcttttctgggaagatggaacattttggtgtaatg

SEQ ID NO: 20103 - DNA, 1339 bp, Zea mays
ttttttttttttttttggaccagaaaggaacccctattgataatcccaatgttaagtaaatacaaacctgatgaccttggtccaaccattttcacgtggctagttctgctgatacatcaagatcaatctgtttcatatgaaagcattatataattatactactataatccaatgagatcactaaccacctgattctaagaccaccacgacagtcacacgaagctagtactcggagattgggcatcaagaaacggcgcagctatgaagtctcaatgacaaactatgttttaagagaacccttgcagcaattttgtcatacatagtcattacttgcaacatcatcagctaaaagaaggctcccaggttgggcactagagcataactgttattcagagtatctcttctgcacttcttacaccacccctgagggaagccgtagcaccagttgcccaccaacaagactcttcacatagtagtagcagaaatctgcaaggatgaatgtctgcacgatttctgataaaagcaccatagacggccacaaaccatagccaagagctgtcaacagacgaccacgcgtgtccaaaacctgtagaacccagtgggcgcagctaagaaaccttgcaactcccaatgcaaatacatagtgagctgtaaagggttcaacaatcttagtattttgcatcaagtgtaactgcggaagcactgaaacagcttccaagtaaacacagaacccccaggagatccggttcacaatgttatgagatgttgacggatgaataagtagtgccagtccagcacacggtaacaccacataatacaacgcaaagttatccttatccaccatataagttgacctcagtttgaaccgtatcatataaataacaaacagtgtggctacaagtgtagcagtgtccagaattgtatggatgtcatactccatgacaaagctgcagtacagtctaacagctagaaataatgcagttaaatcctgagacttgagggatagtccggcgcaggtcttctccttggttagcttgtagatgaggacgcctatgccgagcgcgtgcgcagcctcggcagcgacgaagaggttgtcgtggtcgtggacgatgaagcggatgaagacgagcgcggccatgccggtgacaacggcaaggaaggccttcaccttgggcggctgccgccgcacccacgacgtcaccacgccgagcggccgcttcgtccccctcatctcgtctcccttaccgcctcgcttcgcaccaccgccgccggtcgaagaacacgggagtatttttcttattattttccccccctgccggctcgaggttcctttttatct

SEQ ID NO: 20104 - DNA, 1417 bp, Zea mays
gggtaccgggccccccctctagttttttttttctttttttttttaactcttcaagaaaattaaaatgatttataaataatttgaaatggagtaacaatctatcatagcgttccgtctgtttctacaatagactaccagtcaatgaaggccgttttttttttttttttgctggaaatgcgacaagcttcaactctagcctggatgaaaaagtcagatggacggcctacgttccacggtgttggtacagtattcacgtaaacagtttacaagtaaaaaagattaacggggctctgctaatccactttgagagagtgaaaaagtttgggcactaggagcatgactgttgctttgtatgatttaacacagaagaaatggacggtatgcttcttctatcgcgctgcagtgttcacaccaccccggacggaagccgcagcaccagttggccaccaaaaacactcttcacatagtagtagcagaaatctgcaaggatgaatgtctgaacaatttcggagagaagcaccattgaaggccacaaaccatagcccagagcagtcaacaaacggcctcgggtgtccaaaacctgaaggacccaatgtgcacagctaagaaaccttgcaacacccagtgcaaacacataatgagctgtgaacggctcaacaattttggtattttgcatcaggcgcaactggggcagcactgaaactgcttccaaataaacacagaaggcccagcagattctgttcactatgttgtgcgatgttgaaggatgaacaagtagcgctagcagagcacaaggcaatatcacatagtacaaggcaaagttgtctttgtccagcatatatgttgacctcagtttgaaccgaatcatgtaaataacaaaaagagtagctgcaagtgcagctgtatccagaattgtatggatgtcatactccataacaaaactacaatacaacctaacggccagaaataatgcagtcaaatcctgagacttgagtgacaatccggcgcaggtcttctccttggtgagcttgtagatgagcacggcgatcccgagcgcgtgcgcggcctcggcggcgacgaagaggttgtcgtggtcgtggacgatgaagcggatgaagacgagcgcagccatccccgcgacgacggcgaggaaggccttgaccttgggcggctggcgacgcacccaggccatcaccacggcgaccggcctccgcgacgaacccctcatctcccctcccgcttgccgatcggtggaggcgcaggcgcaggcgagctctgtccgggtccggatgggcgcgctctcgtcgtctctggcccgtgcgcggcgtgaggacctgactcctgagctggggaagcctgggacggccggacgggcgaggcggtggagttatcccggcccccctcgaggcccaccatg

SEQ ID NO: 20105 - DNA, 1375 bp, Zea mays
taaagtgaatacgacctgatgaccttagtcccacgattttcacgtggccggttctgcatagatcaatatcaatttatgaaagcattctagaattgcctaatccaaagagaccattaaccacctgatcctaagaccacgacagtcatacggcagaagccaagtacccaaagattgggtatccagaaaagcgcagctataaacagtctcaatgtcaacctagtatcttttaagaggacccttgcagcaattttgccatacatatagtcataactcgtaacatcaactaaaaaaggctcccaggttgggcactactcaaagtacatatgaaccggtgaagcactaaagttttgtgttctgctgcagcttgcacttctcttacaccacccctgagggaagccgtagcaccagctgcccaccaaccaggctcttcacatagtagtagcagaaatctgcaaggatgaatgtctgcacgatttctgaaaacagcaccatagacggccacagaccatagccgagagctgtcagcagacggccacgcgtatccaaaacctgtagaacccagtgggcgcagctaagaaaccttgcaacccccaacgcaaatacatagtgagctgtaaacggttcaactatcttagtattttgcatcaagcgtaattgtggcagcactgaaacagcttccaaataaacacagaacgcccaggagatccggttcacaatgttatgagatgttgaaggatgaacaagtagtgccagtccagcacatggtagcaccacatagtacaatgcaaagttatccttgtccaccatataagttgacctcagtttgaaccgtatcatataaataacaaacagtgtggctacaagtgtagcactgtccagaattgtatggatgtcatactccatgacaaagctgcagtacagtctaacagctagaaataacgcagttaaatcctgagacttgagggatagtccggcacatgtcttctccttggtgagcttgtagatgaggacgcctatgccgagcgcgtgcgcagcctcggcagcgacgaagaggttgtcatggtcgtggacgatgaagcggatgacgacgagcgcggccatgccggtgacaacggccaagaaagccttcaccttgggcggctgccgccgcacccacgacgtcaccacgctgagcggccgcttcgtccccctcatctcgcctccccttggtcgccttgcgttcgcaccaccaccgccggtcgaagaacacgagaatatttttcttattatttcccccttattattattatttttattctctcacttcctgcgctctcgtgctttttgaggggcgacggatagatcggggcggagttatggctgcattggtgagtat

SEQ ID NO: 20106 - DNA, 1219 bp, Zea mays
  misc_feature (1204)..(1204): n is a, c, g, or t
  misc_feature (1207)..(1207): n is a, c, g, or t
  misc_feature (1210)..(1210): n is a, c, g, or t
gaaaatgcgacaactcgatgtggatgctacctgcttcaactctagcatggatgaaaaagtcagacggtatcacggtatcggtacagcattcacgtaaacagtttacaactgaaaaaaaaaattaacggccctctgctaatccactttacgagtgcaaaagtttgggcgctaggagcacaatgactgtcgctttgtatgatctaacacagaagggacgaacagtatgcttttctttctcgctgcagtttttcagaccaccccggacggaagccgcagcaccagttgcccgccgaaaacactcttcacatagtagtagcagaaatctgcaaggatgaatgtctggacgatttcggagaggagaaccattgaaggccacagaccgtagcccagcgcagtcaacaatccgcctcgggtgtccaaaacctgaaggacccagtgtgcacagctaagaaaccttgcaacacccagcgcaaacacataatgagctgtgaacggctccacaatcttggtattttgcatcaagcgcagctggggcaacactgaaactgcttccaaataaacacagaaggcccagctgattctgttcacaatgttgtgcgatgttgaaggatgaacaagtagcgctagcacagcacagggcaataccacatagtacaaggcaaagttgtctttatccagcatatatgtcgaccttagtttgaaccgaatcatgtaaataacaaaaagagtagctgcaagtgtagctgtatctagaattgtatggatgtcatactccataacaaaactacaatacagcctaactgccagaaataaggcagtcaaatcttgagacttgagtgacaatccggcgcaggtcttctccttggtgagcttgtagatgagcacggcgatcccgagcgcgtgcgcggcctcggcggcgacgaagaggttgtcgtggtcgtggacgatgaagcggatgaagacgagcgcggccatccccgcgacgacggcgaggaaggccttgaccttgggcggctggcgacgcacccaggccatcaccacggcaaccggcctccgcgacgaacccctcatctccctcccgcttgccgaacggtggaggcgcaggcgccggcgagctctgtctgggtccggatgggcgcaccctcggctccggctcgtgcgtggcgtgaggacctgagctggggagcctgggcccgggccgagnccncgnagggtaccc

SEQ ID NO: 20107 - DNA, 1060 bp, Zea mays
ctttttctctctagaaccatagcgttagcacgggtaattaggctagtactttagaaaactaatctacaaaactgatctaaaggctcaaggctgtacatgccttaataaacagctatccaccccttctaaattataggtaattttaattttgttagagtcaaaaaatcttaaatttaatcaaaactgagagaattataaaattttataatataaaaatagagttaataaaaaatctaatgatacttgctttgtatcataaaaaataatgtgttgttatataagtttaatctaaattaagatgcttttacctcttcaagaaaattagaatgatttataattaatttgaaatggagtaacaatctatcatagcgttccgtctgtttctacaatagactaccagtcaatgaaatgggagaatctggtctcttttctggaaatgcgacaagcttcaactctagcctggatgaaaaagtcagatggacggcctacgttccacggtgttggtacagtattcacgtaaacagtttacaagtaaaaaagattaacggggctctgctaatccactttgagagagtgaaaaagtttgggcactaggagcatgactgttgctttgtatgatttaacacagaagaaatggacggtatgcttcttctatcgcgctgcagtgttcacaccaccccggacggaagccgcagcaccagttggccaccaaaaacactcttcacatagtagtagcagaaatctgcaaggatgaatgtctgaacaatttcggagagaagcaccattgaaggccacaaaccatagcccagagcagtcaacaaacggcctcagggtgtccaaaacttaaaggccccaatgtccacagttaagaacccttccaccacccggcgcaaccccataataagctgtgaccggctcaacaatcttggtattttgcatcaagcgcaactggggcagcactgaactgcctcccaattaaccccatagggccaaccaattctggtccctattgttgtccaatgttgaaggatgaccaagtagcgctagcagagcacaagac

SEQ ID NO: 20108 - DNA, 577 bp, Zea mays
  misc_feature (5)..(6): n is a, c, g, or t
  misc_feature (10)..(10): n is a, c, g, or t
  misc_feature (565)..(565): n is a, c, g, or t
  misc_feature (577)..(577): n is a, c, g, or t
gctcnnaacnagtggtcccccgggctgcgaggagctcactagtcccccccccccctaattcctgaacagggtcgttttgagatactctctgtctgggtcgtttcttcaataagataacggtggccatcatagtcgaattggtgggcctgctagcgtccccaatggtcgtgtcctggcctgtgtggtagtgttgccggacttctgatagttgcttcgccagtacagatcatagtggaaccatcatggatgtttaatattgcagtccaaggtaagaaagtattgcagaaccaagcacaaaagcatccaggaagaaaaatagaagggacaagctgaatgagagaggtatgtgccctggtgagacaaatcattttagttcttagatataatacttgcatcattgtctaagctggtagcatcgtagatatattttttatccaaataatgattgtgctcatgtaaaccatgccaaatattattctacaatgaatagcccatcgctgaaaaatgcagaaatcaagaagagcttttaccattgcattgcaaagtccacatgttcgacgattcnaaaaaaaaaaan

SEQ ID NO: 20109 - DNA, 763 bp, Zea mays
acgagagacgacatatgcctgtttatctcggagcacaacccgggacagataaagacgtgggacacggatggtgacaagatcaagctcattgcagaggatcacagcaggcggggcaccttgacctgcccccctgagaagacaatccaggaagttgtctttgccagcttcggcaacccggacggcatgtgcggcaacttcactgtaggcacttgccacactcccaatgcaaagcagatcgttgagaaggaatgcctcggcaagccatcctgcatgctgccggtggatcacacagtgtacggcgcggacatcaactgccaatcaacgactgccacgctaggggtgcaggtgagatgcggaggcggcaagaagggtgcctgagaacaacaagacggatgctgctaattgacgtttcagctcgtttgtttgttcgtcccttcggtttggcactgatgctaatgacccattggtctgccattgcaattgaaatgtgattggaacgtgcttgatcgggaactaacatgaaatgagtgaagggtagatgctgatctgaaaaatatgtgtgttcccccctctttccttccatgtcgtgttgtttcaggtaaccgtcacaatatatataggtggccccctttggaatccggggattattccgtttgctgtatttttttctgtgaaaatgaactgattcctgtcaattttctatatgatttatgattcatctgaaattcctgagaacgatgctcaatttttattattttaattt

SEQ ID NO: 20110 - DNA, 2583 bp, Zea mays
caacaccgcatcgacagcacgcgcgcagccactgccaagcgcagttgtctctgatgtctggtcacgcctgacgccgccgctatcacgcgccaccctcctgccgacgaacgcggcctcctcctcattgccgagcgcagcccctcacttctctcctggctgcgccaccatgatgccgccacggaatgcgcagagccgccgaagagagcagagtcccagcgagaaacgcaggagctcttccttccacctctggcgaacctccaaggaaactcgacgcccagacctgctcgcgcacagggagcatctttgctccggcggctgctcgccggcctccctgtctcctccccagttcttcctctcacagccgtgcagcgccctcttctctacagtggccgctgctcctctctgaagctatgcgcaggagctctccaggacgccgcgcctcctccctgctacacgccccggtcgacgacgaacttcccgtggtctgggaggccgcgcccgcccagatccgccggaaggagcgaaaggagccccgccgccgctgtcatcacaggccgcacgggcttccggtggcctgctcaggcggcggctagggttttgaggggcgctcgggtcgcccagcgcggggacgaccgagcgccgtctgcttcaaacatttggagctcatcccctcgaaatacagaaggtgcatccacaaaggattaatctcttcgtctaattttcttgggcatacacagattcagagcatatggcgatcaagtagctatgcgctcagcggaggacattgcatatgctgtgttacggttttttgcaaagggtgggtcattggttaactactacatgtatcacggaggaacaaattttggaaggactggggcttcttatgtgctgactgggtactatgatgaagctcccatggatgaatatggtatgtacaaggagcccaaatttgggcatctcagggacttgcacaatgtaataaggtcatatcagaaagcattcctcttggggaagcattcgtctgagatattgggtcatgggtatgaggcacacatctttgagttgcctgaagaaaatctttgcctctctttcctttccaacaataacacgggcgaagatggaacagtaatcttccgaggggagaagcactacgtgcctagccgttcagtctccattcttgcagggtgcaagaacgtggtttacaattccgtgccgcggggccggccgcgcaatgaaaggtcataccatacctcagaggtaacaagcaagaataaccaatgggagatgtactcagaaaaaatcccgaagtaccgtgatactaaagtcaggatgaaggaacccctggagcaatttaaccaaaccaaggacgatactgactacttatggtacaccacaagctttcgcttggagtcagacgatttgccttttagaaatgacatccggcctgtgcttcaggtcaaaagtagtgcacactcaatgatgggatttgccaatgatgctttcgtaggatgcgcacgcggaagcaagcaggtgaagggtttcatgtttgaaaaacccgttgatctgaaagtaggtgtgaaccatgttgtattgctgtcgtcaactatgggaatgaaggacagtggtggtgaacttgctgaagtaaagagtggcattcaggagtgcctaatccagggtctgaacactgggacgttggatttacaagtcaatggctggggccataaggctgcactggaaggtgaggacaaggagatctactcagaaaaaggtgtgggcaaagttcagtggaaacctgccgagaacggccgggcagccacttggtataagagatacttcgatgagccagatggagatgatcccgttgtacttgacatgagctcaatgagcaagggaatgatttttgtgaatggcgaaggagtgggtagatactgggtctcataccgaactcttgctggaactccttctcaagcagtgtaccatattccgcgtcctttcttgaaatccaaggacaaccttttggttatcttcgaggaggagatgggcaagccggacggcatcctcgtgcagaccgtgacgagagacgacatatgcctgtttatctcggagcacaacccgggacagataaagacgtgggacacggatggtgacaagatcaagctcattgcagaggatcacagcaggcggggcaccttgacgtgcccccctgagaagacaatccaggaagttgtctttgccagcttcggcaacccggacggcatgtgcggcaacttcactgtaggcacttgccacactcccaatgcaaagcagatcgttgagaaggaatgcctcggcaagccatcctgcatgctgccggtggatcacacggtgtacggcgcggacatcaactgccaatcaacgactgctacactgggggtgcaggtgagatgcggagggggcaagaagggtgcctgagaataacaagatggatgctgctaattaatggacgtttcagcttgtttgtttgttcatcccttcggtttggcactgatgcttacattgttctgacattgcaattgaaatgtgattggaacattcttgatcggg

SEQ ID NO: 20111 - DNA, 2891 bp, Zea mays
  misc_feature (2725)..(2729): n is a, c, g, or t
  misc_feature (2736)..(2737): n is a, c, g, or t
  misc_feature (2848)..(2886): n is a, c, g, or t
ctccagccgtgcagcgccctcttctctacagtggccgctgctcctctctgaagctatgcgcaggagctctccaggacgccgcgcctcctccctgctacacgccccggtcgacgacgaacttcccgtggtctgggaggccgcgcccgcccagatccgccggaaggagcgaaaggagccccgccgccgctgtcatcacaggccgcacgggcttccggtggcctgctcaggcggcggctagggtttgaggggcgctcgggtcgcccagcgcggggacgaccgagcgccgtctgcttcaaacatttggagctcatcccctcgaaatacagaaggtgcatccacaaaggattaatctcttcgtctaattttcttgggcatacacagattcagagcatatggcgatcaagtagctatgcgttcagctgaggacattgcatatgctgtgttacggttttttgcaaagggtgggtcattggttaactactacatggtatggatttactttttgttcctgtaatgaatatgttaataaacatttgcaagggaaatgtggagatttatggtatttctcggttacctgccacctgtatcacggaggaacaaattttggaaggactggggcttcttatgtgctgactgggtactatgatgaagctcccatggatgaatatggtcagaccgattcagttgaccattatatttctgtattatttttatcttcatcatgtagttcctcttgacataaggagcacctcatgtagtccatgatttttcataggtatgtacaaggagcccaaatttgggcatctcagggacttgcacaatgtaataaggtcatatcagaaagcattcctcttggggaagcattcgtctgagatattgggtcatgggcacacatctttgagttgcctgaagaaaatctttgcctctctttcctttccaacaataacacgggcgagcacggggcagtaatcttccgaggggagaagcactacgtgcctagccgttcagtctccattcttgcagggtgcaagaacgtggtttacaataccaagagggtgtttgtacaacacaatgaaaggtcataccatacctcagaggtaacaagcaagaataaccaatgggagatgtactcagaaaaagtcccgaagtaccgtgatactaaagtcaggatgaaggaacccctggagcaatttaaccaaaccaaggacgctagtgattacttatggtacaccacaagctttcgcttggagtcagacgatttgccttttagaaatgacatccggcctgtgcttcaggtcaaaagtagtgcacactcaatgatgggatttgccaatgatgctttcgtaggatgcgcacgcggaagcaagcaggtgaagggtttcatgtttgaaaaacccgttgatctgaaagtaggtgtgaaccatgttgtattgttgtcgtcaactatgggaatgaaggtaaaaattcgtcggaactgtggaatgggtttggaatgtaagatgactgattatactggcctagccgatatccaggcgaaaaaaatatggctggattgacgcaagctacaaacactttattttggaaaggtggacatatataaatatcataaatagaagggtggcccatgcgctctgctaatgcaataatccttcccatcagctcgtattgcgctcgtctcccttgcgtctgcaggacagtggtggtgaacttgctgaagtaaagggcggcattcaggagtgcctaatccagggtctgaacactgggacgttggatttacaagtcaatggctggggccataaggctgcactggaaggtgaggacaaggagatctactcagaaaaaggtgtgggcaaagttcagtggaaacctgccgagaacggccgggcagccacttggtataagagatacttcgatgagccagatggagatgatcccgttgtacttgacatgagctcaatggacaaaggaatgatttttgtgaatggtgaaggcgtgggtagatactgggtctcataccgaactcttgctggaactccttctcaagcactataccatattccgcgtcctttcttgaaatccaaggacaaccttttggttgtcttcgaggaggagatgggcaagccggatggcatcctcgtgcagacggtgacgagagacgacatatgtctgttcatctcggagcacaacccgggacagataaagacgtgggatacggatggtgacaaaatcaaactcattgcagaggatcacagcaggcggggcaccttgatgtgcccccctgagaagacaatccaagaagtcgtctttgccagcttcggcaacccagagggcatgtgcggcaacttcactgtaggcacttgccacactcccaatgcaaagcagatcgttgagaaggaatgcctcggcaagccatcctgcatgctgccggtggatcacacggtgtacggcgcggacatcaactgccaatcaacgactgctacactgggggtgcaggtgagatgcggagggggcaagaagggtgcctgagaataacaagatggatgctgctaattaatggacgtttcagcttgtttgtttgttcatcccttcggtttggcactgatgcttacattgttctgacattgcaattgaaatgtgattggaacattcttgatcgggaactaacatgaaatgagtggagggtagatgctgatcagaccaaagatgtgtaaaaaaaggcccctannnnntgtcgtnngttgtttcatgtaaccatcacaatatatatagatgttgaataatcatgaccagtagtatagatcttagagcatccctaacttttgaataaaagactcttggagattggagnnnnnnnnnnnnnnnnnnnnnnnnnnnnnnnnnnnnnnncttct

SEQ ID NO: 20112 - DNA, 1953 bp, Zea mays
taggggccttttttttttttaccgccctttaaaccgaacaaaccacaataaattcatcaatatgtatattagacatgataatacatgacaatccaacaaaatacaagatcaacatagcttagaggtgatgttacacgagaaaaccaaaaggggaagaaatgaaaggtggtatgaattgtgagaaacagtatagtacggagatatccatgtcctagtagtggtattcatttgccttcttgaagatccctgcctgggcagaagcagcatcgtcagaggtcacggacacagcaatgcagtccttcacctgctgcgtggtaaaggggaacttcttgttgacaatggaattcaggaaagcagctgacccctcacgtagcagggcaccaacgccatcagttctggtgttcgagagtgcttcatgcagattctcaagcttcttgccgacgagcagactgcaggcagcaccaaaggtcttgccaatgttgccaagggacccaacaactgcaatgatcatgtctgggtggctcttccagtagctgcggtttcgatgccaagacatcagttttgagaacattcgcttcgtgatgttaggtagctaatatgcatatatatcaattgatacacgggttcttactcgccccggcccgcccggccatgcttgggaatttcagggaccccatgagcaggtgtacttggtgttgtgccgtaagatggtgtcggtgttgtgccatgatgagatggtgttggcgttggctcgtggccttctcctgatccgtacgtaggagttggggagccaccatctggtagtaagatatagttcagcaactgttatttcaagggatgcataaaattgctaaatcagataaatataggttggacaaattaaaggaatagagccggggcaagtttttacagctgggagcagaggagtaggtcttctgctcagacaactctcccaggctcctgcatgagctcagggtgacgagcgccaccagaacagcactgacaagaagaacactgctgctgctcatcttgctcttaacgtctacagactagactgaatacgtcgctgaaactggccgagaagcttgagttgctgaactcagctcctttggggatcatatatatacacacacgagtgtgaagggtgttgtacagctacagttgtgctaatgcatgcaaggctctgtacatgttcatcgcaccgctaggtggttggccaccatttaaagatttggaaagaaactaaaagttgtggttgattagagcttgtctggatcttggaaaaggcttctttggacagcgtgaattcttcttccctgcagccctcgagatttaattggaatcggcgcctgccacctactctgtgcacttactgacctacctatgccctggagctgatgatcttattatgtctggattgaaatactgagtctgccaaacttattgatgcaaacttattaatgcagaggatttggtcagattttgtcactggtccattatattatcctcagaggtgcacctgcaggtaatttgtttcgaacccatcttcgctgcagttttgttgctgcatggtcaaatatactctgtctgtcagaacggtggtgcctagtcctctgcgtttctgttcagaattctgattgcatctgcctggcttttagtgcgtacatgctttagcaattaacagtgcactgctgccgccattcatccaccgtaccgtaccgtaccgtacctgtgtcttaccatggctgtgatgtgcaacaccgtcgtcgcacatttttttgttcatgagcacacgagcagtgcatgtgccagtgccactttcttgaactacgactgtgtcatgatctcgtatgcagagttcacgagcagtacgtgtgtcagtagacaacgggagcaatttgcaagttcctgctcgatttcacgtgaaaacttgagaaatatttgcagttgcag

SEQ ID NO: 20113 - DNA, 919 bp, Zea mays
  misc_feature (911)..(912): n is a, c, g, or t
ccccttctcgagttttttttttttttttttttttttttttttttaaattcatcaatatatatattagacatgataatacatgccaatccaacaaaatacaagatcaacatagcttagaggtgatgttacacgagaaaaccaaaaggggaagaaatgaaaggtggtatgaattgtgagaaacagtatagtacggagatatccatgtcctagtagtggtattcatttgccttcttgaagatccctgcctgggcagaagcagcatcgtcagaggtcacggacacagcaatgcagtccttcacctgctgcgtggtaaaggggaacttcttgttgacaatggaattcaggaaagcagctgagccctcacgtagcagggcaccaacgccatcagttctggtgttcgagagtgcttcatgcagattctcaagcttcttgccgacgagcagactgcaggcagcaccaaaggtcttgccaatgttgccaagggacccaacaactgcaatgatcatgtctgggtggctcttccagtagtcgcaggatccaacaaatccatgcttgggaatttcagggaccccatgagcaggtgtacttggtgttgtgccgtaagatggtgtcggtgttgtgccatgatgagatggtgttggcgttggctcgtggccttctcctgatccgtacgtaggagttggggagccaccatagctgggagcagaggagtaggtcttctgctcagacaactctcccaggctcctgcatgagctcagggtgacgagcgccaccagaacagcactgacaagaagaaccctgctgctgctcatcttgctcttaacgtctacagactagactgaatacgtcgctgaaactggccgagaagcttgagttgctcccggccccggccggccctatgttccggccgnngcctcga

SEQ ID NO: 20114 - DNA, 1354 bp, Zea mays
gccgtgccggactcgaggccggcccggccgggatcagccgagtggttgtgccgtggaagctttcgtttaccgttcccattccccgtcgtctctcctctccttcccactctcccacccgtcctccattgctcccttcctctctctcgcggagtcgctgcgatctagccaccgagcacgagcgtcctactcgccgcggaccttgctcatggccgcggggtcgatccgggtcaccatggaggtgggcgccgacggcgtcgcgctcatcaccatcgccaacccgcccgtcaacgcgctccaccccatcatcatcgcggggctcaaggacaagtacgcggaggccttgcgccgtgacgacgttaaggcaatcgtgctcactggtgctggaggcaagttctgtggaggatttgatatcaacgttttcacaaaggttcatcagactggggatgtatcacttatgccggacgtatccgtcgagcttgtgtcaaacatgatggaagagggaaaaaaaccttctgttgcagccattcaaggtcttgcattgggtggtggcctagagttgactatgggttgtcatgctcggatatctactcctgaagctcaacttggattgccagagctaacccttggcatcatccctggatttggaggtacccagcgtttgccgaggcttgtaggtctacccaaagcaattgaaatgatgctgcaaagtaagttcattacggcaaaggaagggaaggaacgtggtttgattgatgccctttgctctcctgatgaattgataaagacatcacgtctttgggctctggaaattgctaattgccgtaaaccttggatgaggtctcttggcagaacagataggcttggaccactctctgaagctcgtgctgtgttaaatgcagcaagacagcaagcaatgaagatcgcaccaacatgccacaaaaccttgttggggggggggggatttttgaaggcatattatgtggaggccaagctggggttttgaaggaggccgtggttttcaaggagctggtgatagcaccaacatcaaaggctcttgtccatgttttctttgcacaacgttccacgacaaaggtgccaggtgtaactgatgttcaactgaaaccaaggccaattagaaaaggtgctgttattggtggtggtctgatgggatctggaattgccacatcacttcttgttagcaacatttctgttgtgctcaaggaagtaaaccctcagtttctgcaaaggggagagaaaacaatagcaggtaatcttgagggcctggtcaaaagagggtcactaacaaaggataggatgcacaaggccatggcccttctcaaggggctttggatta

SEQ ID NO: 20115 - DNA, 866 bp, Zea mays
  misc_feature (784)..(784): n is a, c, g, or t
cattgggtacctcgaggccggcggggccgtagaagctttcgtgtacccttcccatccccgccgttctctctctcttttcccactctcccacacttcctccattgttccctttttctctcgcggagtagcggtgatccagacaccgagtgtcctacgcgtcacggaccgtgcacatggcggcggggtcgatccgggtcaccatggaggtgggcgccgacggcgtcgcgctcataaccatcgccaacccgcccgtcaacgcgctccaccccatcatcatcgccgggctcaaggacaagtacgcggaggccatgcgccgtgacgacgtcaaggccatcgtgctcaccggtgctggaggcaagttctgtggaggatttgatatcaacgttttcacaaaggttcaccagactggggatgtatcacttatgccggacgtatctgttgagcttgtgtcaaatatgatggaagagggaaaaaaaccttctgttgcagccattcaaggtcttgcattgggtggtggcctagagttgactatgggttgtcatgctcggatatctactcctgaagctcaacttggattgccagagctaacccttggcatcatccctggatttggaggtactcagcgtttgccgaggcttgtaggtctacccaaagcgattgaaatgatgctgcaaagtaagttcattgcggcaaaggaagggaaggaacgtggtttgattgatgccctttgctctcctgatgaattgataaagacatcacgtctttgggctctggaaattgctanattgccgtaacccttggatgagatctcttggcagaacagataggcttggatcactatctgaagctcgtgctgtattaaatgc

SEQ ID NO: 20116 - DNA, 1387 bp, Zea mays
agttatcacctatgttccatgtttacctcaagctttaattcgtctccctatagggaaagttggtacctcctgcagatatctgatccgcactcgcgggtttcgaccctacgcctccacccacgcgtccgcccacgcgtccgcccacgcgtccgcccacgcgtccgggatttttttaaccaagtctgaaaattcgctcccgataggaatggaacccaggatttggaggtgctactcggaagtccttaaccgctaggctagaggccctttcgctggacaaagaataatgcgacatctttagtatgctgtgctgtgccttagctaactcgttaaaatgagcaatgcagacctgaggcaccgttgattcttaaatggctattgttgattgactgttctaaattttacttccatgattcttgtgagttcttaaatttggcattttttccttgcttccctgtagactccaagatgtggctgggtatggagttgccttggcagtaaaggatatctacgctgatgcctttggagaaagaaatttggactctgaccttgtggatttgatggtaaaggatggacgacaaggaaaggtgaacggcaaaggttactacatttatgagaagggtgggaagccaaagccagatcctagtgttaagcatgttatcgaggagtaccgaaagcacgcaaacacaatgcctggtggaaagcctgttactttaacggatcaagatattttggagatgattttcttcccagttgtgaatgaggcatgcagggttatggatgaaaatgttgtaattcgagcttctgatcttgatattgcttctgttcttggaatgggctttcctaaatacaggggtggtcttgtcttctgggctgacactgttggagcaccttacatacattctaagctaagcaagtgggctgaaatttatggccccttcttcaaaccatcatcatatttggaacagcgagctaagagtggtgtaccattgagcgcaccaggagcttcgcagcaaggttcggcgaggtcacgcatgtgaggtgctgtccagcattgagcagaaataatgcagaatacttgcgggatgagccattgacggctgcttcgctgattaaaacacctccgtgaacacaaacatgaggcgcagaagaaatgatgaaaaataaagggattgtaacagttttggtgccttcgactgtaactggcagagtttctggggacagagtggcatggattaattgcacctgatcactctgtatgtcgctgtcatgtgtgcaatgttcaatacgtacgtaataaagaatggaaatatatgccgccaaaccccccacacccccaaaaaaaaaaaaaaaaaaaaaaaaaaaaaaaaaaaaactcgagagggggccc

SEQ ID NO: 20117 - DNA, 885 bp, Zea mays
  misc_feature (4)..(4): n is a, c, g, or t
cgtncgtggagaattgtcaaccaccgggatatcattccaacagggccacgtcttgaggggctattgccatgtggaagcatcctgttatcttaaaatttggggacgcaaaagatgcaccggtaaataacagcattctagatgatgaagaccaaggtgacgtgataggggagtacacacctgatgttcttgttactgaatttatgaaaggcgagaagcaacttgtggaaaaactactgcaaacagaaataaatttactccgctcaatcagggatggttcggctcttatgcagcacatggaagacttctactatgtcacccttcttgagaatgtgagatcaagttatcaagtggcagatactgccaatgatgaataccaattgacagcgtgatcctagtaaaactgcacagctgaacatcatggactgtgtttccctgcaaaaacttcatttctgaaggacactgaatggggctatgaaagtgtgcaatccttactcttagtggaaacatgaacaggcagaacagccttggacctcagtcaggatagaggaaatgaaactggtttcactggcggatatacttgtagcaccgtgtcaattggtagatatgttgtttgagctattttccgttgatgtagctagcacactttggaatatattgtatgatgtttgaaattctagaaaagttcatagacacctgggagaataactcaagaaatatccaagtccgttttggccaatattttttttcatggagaaacttgcacaccgtggtaggctaccggctacccaagggctgatagggtgtgttaatcgagtgtacgacctagataaaaatgttcaatgtgatggaactatatatcttgcatggaataaagtagcatcatgt

SEQ ID NO: 20118 - DNA, 5535 bp, Zea mays
  misc_feature (3084)..(3084): n is a, c, g, or t
  misc_feature (3906)..(3906): n is a, c, g, or t
ggagtgcctcgattcattcaactaatattattatcttccacaaattagctcgaataggatcacacagtcgaagtaaaatgttatcttgtcacctatataacaactatgttaccagttactttaatctatttaataaaaactaataggttatcaaatatattggtatctacctagttgcggacgtaacctatgattagggatgataatgaattatgatccaaatatttctatacaattagttaagatcctaaaataattttaatttaaaaataaatagaaataaagtttaattctaactagatcatatccttaatttttatagtttaaatttagagcctattgtcagctatacctatgatgcagagatggggagagggagtctagtggagaatgggcttaacactccagagcccttgcctctactcatgtctatctataccttcatactatactacagacaaaatcatattagctattgtatttaaataataattaaccaactaatagtaaagtacgaacatgcttgatcagctaaagctgtagatttgctatttcgttaacagctatctatacatttggttaataaatgagctatttaaatcaggactaattttaacttttttagctggctaataattaacttttgaacggctattagtgactctacaaatctaaaacaaaactaaggatttcacagttttatttcacgtgaaaaatgtagagtagaaataagaaaaaaaaatctcgtacgtactttcaaacaggacctttgacgtttgtataatcaaagccctatcagtattcagtagggatgcaaatgaatgagacatcaagagatattattaatactagtactatttttttatatttctgtttgacttcggattcgaatatgaacaatatcaatatcaaatagaatgtaataaatattatatatatatgatttgagttcgaatatgattcaatatcaaatcttaaaaacccgaatttagatacacctagactctgcacatattccgatattcggaggatggaaaacacccctcgggcagtctgggctggcggtcccgtggcggtgggcccacgccacacgcagacgagtcgacccacctcaccggctccggctcatatatcggccgctccccttgagagccacctccgcagccgagtggttgtgccgtggaagctttcgtttaccgttcccatcccccgtcgtctctcctctccttcccactctcccacccgtcctccattgctcccttcctctctctcgcggagtcgctgcgatctagccaccgagcacgagcgtcctactcgccgcggaccttgctcatggccgcggggtcgatccgggtcaccatggaggtgggcgccgacggcgtcgcgctcatcaccatcgccaacccgcccgtcaacgcgctccaccccatcagtaagcaacgggccgacgcctcccttcttcctcggtgttcaattctgtcgtgattttcctttcggtggagtgttcgtcctgcggtctcatacccggcgtcgtgctccccagcatcgcctgcagtcatcgcggggctcaaggacaagtacgcggaggccttgcgccgtgacgacgttaaggcaatcgtgctcactggtcagatctctcctccctcctcttcattatttaatttgtccttctatcatttgataatatatatctcgctgaattttgggagtggggatcgtgtctctgctttctgtaggatttattttttatatatttcgccgtcgtaatgagatatatcggtaatattattacttgtaccagccatttaaatgtttggtgctattcacgtttgatatcgatagttgtggaaactggaaacatcgctttcctagttttgtactactgctccacccccagtccaccttgccagttgcgctggcctctggagaaagtattttgcttaggcagagatagaactcaagtggtcgaagcaagaaaacagggccgttgacccaagaaactggtttatgaaaattaagttgcctccaaacataccagtttatgcctcaatttatagaaattggattaccaatttcttaaaaaccaagaggttggtctctcctagctaaaagataaaaccagtttcttaaaaactgggttgcttccagacaggacctaaaccgaaagtatcctgatgccttttcaagttattcaacataacacacaattttaactcttttttcttgtttaattggtaactgatgtggatgtgctgccaaatgcccaaatccgtagttccgtacactgcaccagtatacaaaagagtccttttttttgaaacgagattttactctgcttttaagaaagcatataacaatgttcaaacacatactggggataccagtttacaatcatcagacaaccaaccaccagaactaaaggaacctatagactagcatagccaagatgcaatcagtgaaccgatcagctagaagtaatatagacagcacacaggagccatgaactccaccaaaaagaaaaagaaaaacctccagaattttcctcccagcaaaggtgaaccaccagctaagagtaaaacactctgaaacactccagaaagtgtagagaaatctctaacaaagattttctaatacttcaaatcactactatgtcgcttccccctccatcaacacttttgaagctgaagatccaagactgcacctcctctaccttcttctctaacatgctttggtcatcttcagatagcaacaccttccatttctgcaaaaacgaaacagcatcacggaggatcacaaaagggctgcaggggaactctctctcgaacaccattttatttctattacgccataaggcccaaaccatgcctgcaagcagaaataaacgaaaaagagaagtccacttaggtttcacttcactcctgcaacagaacatctcttccactgagctgggaatattgttccttccaaatacctgcctcaaacaactccacacaaaatatgccaaggagcactgaaagaatatatgatccactgtttcttgcttttgacataatgcacaacgatcactacccttccaaccttttnttttaagcaccacgcctccctgaattttccggttacataattgccacaaaaaaactttaatccgcaagggcaccttggacttccaaatatttttatatatatcttttctaatccctccatcagtcataaacctatacatagactgagttgtgaaagttttagatttgtccagtacccataccacctcatctctcccatgagtgagctcctgatcgtcaagcttagttacaagttcatcccaaacctgaaaatcagcaatcgtcaggggccgcttgaggtcgatatgccactccccgtcctcataataatctacaactctggcatttttgtccatgcatatgtcaaagaatctgggatatactaattttaggggcacatccccccaccaggtatctttccaaaagagggtaccttccccgtccctaactttattaatagcaccccatttgaataggtgtttaaccttgtgcaaccctttccaaaattgagacgcatctctatccgatgacaggaaaaaatttcctttggtcatgtattttcctttgataagtttgaaccaagtatcattagacccctgaacaattttccatatccattttaccagcaaacattcattcatcaatctgctatcaaggatgccaagaccaccttggtcttttggcctagttaccatctcccatttggccatgtgatagcatttttacttttcagctccttgccaaaagaagttagatctaattgaattcattttataatgaaactctttagggagaagataaaaacccatgcaatacataggtagactactgagacaggagttanttagaattaatctcccaccagaagagaggtgcttgcccttccatgggtctagccttttcctcattttctccaaaataggctccgagattactgagttaatgttatgatcagagataaatatacctagatatttcatcgaaaaggatcccagggaacagttaagcatattggccatctctttttcctcctggtcatcagctccaaacacaaagacctcgcttttatgaaaatttattttcagctctgataaccattcaaagcaatacaaaattaatttcagatttaaaattgatttttttgacccatcaatcataatcactgtgtcatctgcgtattgtatatgtgaaatacctcctggtagaacatcattcaaaactccagagatgtgccctttggcaatccctacatccaacagcacactaagggcatcagccaccaaattgaaaagtaaaggggagagagggtcgccctgcctaagacccctaaaagtcttaaaatatttactcctctcaccattaatgttcacacacactttcccattctccactgttctcatgaccatattggtccatctgtccgggaacttcttcaattttaagacctcagctaaaaaattcaatctaaccttatcataggctttctcaaaatcaatcttcagaatcagacctctctgtttttttaatttcaaatcatgaattacctcatgaagtatcactactccttccagaatgtttctgttttttatgaagcctgtttgattgcccccaacagccaccttggctacctgggcaagcctactagaaaggactttggtgaaaattttgaaatcaacgttaagaagacaaattggatgatattgcttaatcgaggtggcatctttaatttttggaaccaaggagatgaccccataattcagcctctgaatatctaaatttcctccatggaaatctctaaacattttcataagatctcctttgattatatgccaaaagtttttgaaggaaggccaccccaaacccatttggacccggggcagagtcaacatgcataaggccaatcgcctgttttatctcctcttcatcaaagggcctaatcaggtgaatggcctcctcagttgatagttcacttctaccttccccagaagtcctcgcgtaacttcatcgcacaaggaatagatggcccaaaaagatttttataaaaatcaaccacgtggtttctaatatctttctggttcaccaaagtacaagaatctgccaccaagtgcaaaatattatttttcctcctccgcccgttagcaaacaggtgaaaaaaactagaattagagtcacctttgagaaaccagttttttccagcccgttgttgccaatacacttcttccatatgataaacctgctctaattttctctcaactctatatctttcgttccaatttaggggaagtttgtcattcatgtccaaaacagcatccaagtttttcagctttaataaaagatcatgtttaatcttattttgttcacctcttttttgtctgttccaccctcttaaaaatcttctaatagaaaccaggctcccatgccacccatccatcgagtaggaaccttcaggcctacgatccttaagtttagtcca

SEQ ID NO: 20119 - DNA, 2437 bp, Zea mays
cgccgcgtcgtaagctcggaattcggctcgaggcgccgtgacgacgttagttaatcgtgctcactggtgctggaggcaagttctggggtgcctcggggcccgccgggttccctaacgttcatcagactggggatgtatcacttatgccggacgtatccgtcgagcttgtgtcaaacatgatggaagagggaaaaaaaccttctgttgcagccattcaaggtcttgcattgggtggtggcctagagttgactatgggttgtcatgctcggatatctactcctgaagctcaacttggattgccagagctaacccttggcatcatccctggatttggaggtacccagcgtttgccgaggcttgtaggtctacccaaagcaattgaaatgatgctgcaaagtaagttcattacggcaaaggaagggaaggaacgtggtttgattgatgccctttgctctcctgatgaattgataaagacatcacgtctttgggctctggaaattgctaattgccgtaaaccttggatgaggtctcttggcagaacagataggcttggaccactctctgaagctcgtgctgtgttaaatgcagcaagacagcaagcaatgaagatcgcaccaaacatgccacaaaaccaggcctgcctggatgtgatggaggaaggcatattatgtggaggccaagctggtgttttgaaggaggccatggttttcaaggagctggtgatagcaccaacatcaaaggctcttgtccatgttttctttgcacaacgttccacgacaaaggtgccaggtgtaactgatgttcaactgaaaccaaggccaattagaaaagttgctgttattggtggtggtctgatgggatctggaattgccacatcacttcttgttagcaacatttctgttgtgctcaaggaagtaaaccctcagtttctgcaaaggggagagaaaacaatagcaggtaatcttgagggcctggtcaaaagaggttcactaacaaaggataggatgcacaaggccatggcccttctcaagggtgctttggattattcagatttcaaggatgttgatatggttattgaggctgttattgagaagattcctttgaagcaatcaatatttgctgacattgagaaaatctgtccaaaacattgcatacttgcaacaaacacatccaccattgatttgaatgttgttggcaagaagacaaattctcaagatagaattataggggctcactttttcagccctgctcatattatgcccttgcttgaaattgttcggacggagaagacatcaccacaagctatccttgatctcatcaccattgggaagataataaagaaagtccctattgtggtcggcaactgcacaggatttgcagtcaaccgtacattttttccttacacacagggttctcatcttctagttagtcttggtattgatgttttcagaattgatcgagtaataagcacctttggcatgccaatgggaccttttcaactccaagatgtggctgggtatggagttgccttggcagtaaaggatatctacgctgatgcctttggagaaagaaatttggactctgaccttgtggatttgatggtaaaggatggacgacaaggaaaggtgaacggcaaaggttactacatttatgagaagggtgggaagccaaagccagatcctagtgttaagcatgttatcgaggagtaccgaaagcacgcaaacacaatgcctggtggaaagcctgttactttaacggatcaagatattttggagatgattttcttcccagttgtgaatgaggcatgcagggttatggatgaaaatgttgtaattcgagcttctgatcttgatattgcttctgttcttggaatgggctttcctaaatacaggggtggtcttgtcttctgggctgacactgttggagcaccttacatacattctaagctaagcaagtgggctgaaatttatggccccttcttcaaaccatcatcatatttggaacagcgagctaagagtggtgtaccattgagcgcaccaggagcttcgcagcaaggttcggcgaggtcacgcatgtgaggtgctgtccagcattgagcagaataatgcagaatacttgcgggatgagccattgacggctgcttcgctgatcaaaacacctccgtgaacacaaacatgaggcacagaagaaatgatgaaaaataaagggattgtaacagttttggtgcctttgactgtaactggcagagtttctggggacagagtggcatggattaattgcacctgatcactctgtatgtcgctgtcatgtgtgcaatgttcaatacgtacgtaataaagaatggaaatatatgccgcaaaaaaaaaaaaaaaaaaaacaaaaaccaaaaaaaaataaaataaaaaaaaaaaaagtactctgcgttgttaccactgct

SEQ ID NO: 20120 - DNA, 2240 bp, Zea mays
ggaagaggaaaaaaccttctgttgcagccattcaaggtcttgcattgggtggtggcctagagttgactatgggttgtccccccccgtccgctactcctgaagctcaacttggattgccagagctaacccttggcatcatccctggatttggaggtactcagcgtttgccgaggcttgtaggtctacccaaagcgattgaaatgatgctgcaaagtaagttcattgcggcaaaggaagggaaggaacgtggtttgattgatgccctttgctctcctgatgaattgataaagacatcacgtctttgggctctggaaattgctaattgccgtaaaccttggatgagatctcttggcagaacagataggcttggatcactatctgaagctcgtgctgtattaaatgcagcaagacagcaagcaatgaaggttgcaccaaacatgccacagcaccaggcctgccttgatgtaatggaagaaggcatattatatggaggtcaagctggtgttttgaaggaagccagggttttcaaggaactggtggtagcaccaacatcaaaggctcttgtccatgttttctttgcacaacgttccacgacaaaggtgccaggtgtaactgatgttcaactgaaaccaaggccaattagaaaagttgctgttattggtggtggtctgatgggctctggaattgctacatcacttcttgttagcaatatttctgttgtgctcaaggaagtgaaccctcagtttctgcaaaggggagagaaaatgatagcaggtaatcttgagggcctgataaaaaaaggttcactaacaaaggataggatgcacaaggccatgtcgcttttcaagggcgctttggattattcagatttcaaggatgttgatatggttattgaggctgttattgagaagattcctttgaagcaatcgatattttctgacattgaaaaaatctgtccgaaacattgcatacttgcgacaaacacatccaccattgatttgaatgttgttggcgagaagacaaattctcaagatagaattataggggctcactttttcagccctgctcatattatgcccttgcttgaaattgtccggacggagaagacatcaccacaagctatccttgatctcatcactgttgggaagataataaagaaggtccctgttgtggtcggcaactgcacaggatttgcagtcaaccgtacattttttccttacacacaggcttctcatcttctagttagtcttggtattgatgttttcagaattgatcgagtaataagcagctttggcatgccaatgggaccttttcaactccaagatgtggctgggtatggagtggctttggcagtaaaagatatctacgctgatgcctttggagaaagaaatttgggctctaaccttgtgggcctgatggtaaaggatggacgacaaggaaaggtgaatgccaaaggttactacatttatgagaagggtgcgaagccaaagccagaccctagtgttaagcatgtgatcgaggagtaccgaaagcaggcaaacacaatgcctggtggaaagcctgttactttaatggatcaagatattttggagatgattttcttcccagttgtgaatgaggcatgcagggttatggatgaaaatgttgtaattcgagcttccgatcttgatattgcttctgttcttggaatgggctttcccaaatacaggggtggtcttgtcttctgggctgacactgttggagcgccttacatacattcgaagctaagcaagtgggccgaaatgtatggtcccttcttcaaaccttcatcgtatttggaacaacgagctaaaagtggtgtaccattgagcgcaccaggaacatcacagcaaggttcggcgaggtcgcgcatgtgaggtgctgtccagcattgggaagaagaattcagaatacttgcggccgggatgagccatagacggctgcttcgcagatcaaaaacacctccttgaatacaaataggaggcacagaaatgatgaaaaataaatggttttgcatagctgtaacagttttggtgccttgaactgtaactatggcagagtttctgtgaacagagtggcatgcattaattatacttgaccactctatatgtcgctgtttgtataattttcaatacgtacaagaactaaaatatattattggatagtattttttataataaactcatctgttgctatactttatttaaaaaaaaaaaaaaaaa

SEQ ID NO: 20121 - DNA, 1970 bp, Zea mays
  misc_feature (41)..(86): n is a, c, g, or t
  misc_feature (158)..(162): n is a, c, g, or t
gcacgagggcctgtttgcagcagcaagcgttcaagaaatcnnnnnnnnnnnnnnnnnnnnnnnnnnnnnnnnnnnnnnnnnnnnnngcagcgtgaccgtggaagggacgaagaagagcaccctcaagcggccgcactaatcccaaaccggcctccgannnnnaagcagcctcacgctgctcgatggcggcgccgtatcaccagcctacgagcctggaggaggtccgcactctgtggatcggcgacctccagtactggaccgacgagaactacctctacagctgcttcgctcacaccggggaggtacaatctgttaaaataatacgcaacaaagtaacaagccttcctgagggttatgggtttatagagtttgtttcacatgaagctgctgagaaaattctccagacttacaatggcacacagatgcctggaactgaacacacattcagattgaattgggcctctttcagctctggtgagaggcgccctgatccaggatctgatcattcgattttcgtaggggacttggcacttgatgtcacagattacttactacaggaaacattccgagtgaactattcatctgttagaggtgctaaggttgtcacggatccaaataccgggagatctaaaggatatggatttgtaaagttcgcagatgaaaatgaaaagaaccgtgcaatgacagaaatgaatggtgtgtactgttcaacgagacctatgcggataagtgctgcaatacctaagaaatccactggctctcagcttcagtattcagctgctaaagcggtgtatccagcaacagcgtatgcaatgcctcagctccaggcagttctccctgacagtgatcctacaaacactacgatatttattgggaatttggacccaaatgtgatagaagatgagctgaggcagatatgtgtacagtttggagaacttatatatgtgaaaattcctgttggtaaaggatgtggttttgtacagtatgcatctagggcatcagctgaagaggcagtacaacgtcttcatggcacaatgattggccaacaagctgttcggctttcatggggccgaagtcctgcgagtaaacaggattcatcagctgtgtggagtcagcaagcagatccaaatcagtgggcaaacacttactatggctatgggtatgatgcatatggatatgctcaggatccgtcatacgcttatggtgcttatgcaggatatagccaatatccccaacaggttgagggaactgttgacgccacttctgttgctggtagccatccaggcatggagcaaaaggaggagccatatgatccaatgaacatacctgatgttgacaagttgaatgcttcatacatggctgttcatggtagagccatgctagggcggtccttgtggttgaagaccaacccgctgccccaaccgacataagcatgtttcctcccccgaagactacagccagtgctggtgggcgcagctgggtttcatcgcgcagatgattttgcccttcccagtagtcacgttaaactctgaaattgttgtaggctggccagcagcttcgtctatattgagaacattcgatgtatgataggcgtgactcttttgtactgtatttcttaggctgttggttaatattattaggacaatattgagggagcggtgaaagtcaactgtctgtatttccaactgattattctgctgttcgatactcaactcccgactcccgttcacttggcaggacaatggcatatctgatatttctatcgttgaattacctttaaaaaaaaaaaaaataaattaaaaaaaaataattaaaaaaataaaaataaaaaaattaaaaaaaattaaataatattaaaataatatatataaatataaaaattaattataaataaataaaataaatatggggggggccttttaagaggttcaaatttttttcccccgtttttgcaagtttatatttttttt

SEQ ID NO: 20122 - DNA, 2447 bp, Zea mays
tgcatgcctgcaggtttaccccaatatgaggtctgcgtttattgatataattaaaactcgtggtgttcaagggctttattctggtctatctccaactcttgttgaaatcataccatatgccggtttgcagtttggttcatacgacactttcaaacgttcgatgatggtaatgacattaaactcacagtttttgcacattgcatacttatataagtagagagttgattctatgttgaatacatgattgccaaggatatgaaatacttatgaatgctggtgaagtttactcttcctgactatattttctgccacagacatggaacagatataaatattcacatcttagctttggaagcgaggatgattcagtatcaagtttccagctatttctttgtgggtttgcagctgggacattttcaaaggctgcatgccacccacttgatgttgtaaagaaaaggttccaggtgattttcttgtctcgaaagcaactgatttctgcttcgtggtatttagaaataggcaaataacttgatgctgcatctgcatagctatagctttgaggcagtcattgtggtttatcattccgtggctgtctgtctgttgtaactacttagtagtaagtcctttatatatacattactagagtccttttttatatgcactcatgtactgtacaatacattgcacccatggggctatataaaggactctactaatatgtacataaagggtttcctaacacaccatgctccaccaggccagttaacatttcgtaagtaactacataaaggcagttgctggatataacttttcattactaaattaatcagggatataccatttctttactaaattttaactagttctttctgtcttaaaacagaacaagaactttttcatgcaccctctacattagacaaactcatcaccagtatttggatctcttttggtcacgcccaacagtgcaacttcaaccttgacgcaggatgaagttgggccgcttcttttttaattgctcgtgcgatggcgcgaatgtgtatatgttaggtcattctgaagagtttcatagttttcaagtatgtagaacaaaacgagacgtggatgaagccatcactctcaatgcataattttattcttttgtttcataggcatttaattctatgactcatctgcgaaagggcctctagtgtaatggttaaggcttccgagtagcacctccaggtcccgggttcaatccccctcgaagacgaatttcgggcttgattaaaaaaatcctctcgctatgccccatccgctctcggggatcgatatcctgcgcgccacttttcggttgggtcgttgcagagtgggcggtgatgggtggccagggttcggggattttctcggttgggaccatgttttggtctcttaatataataccgggagggaggtctttccctacacggccgagtcattttttttgttaaaccagacatagaaaactgcatccttgtgaattatataatccaccatattgaaaagctgaaggatagattttgggcctgtagatttacaattattttgtcttgttctattttctgctaagatatcttggaagtttgtatggaccttgtacatgctcccattgtttttttttcgacataagtacaccaatgaagtgatttgtggtgcatacctctcatgacctttcatgtttcatagtgcactgacgatatgttatccgtgtctggccaaaatctgttctccatatttgacaaatcccacaatcttgcaggttgagggaactgttgacgccacttctgttgctggtagccatccaggcatggagcaaaaggaggagccatatgatccaatgaacatacctgatgttgacaagtaagatctgtcacattgcccttcacactgttgtttctgtagagatgtttctttaatccatggtcctctttctcctgcaatcttaggttgaatgcttcatacatggctgttcatggtagagccatgctagggcggtccttgtggttgaagaccaacccgctgccccaaccgacataagcatgtttcctcccccgaagactacagccagtgctggtgggcgcagctgggtttcatcgcagatgattttgcccttcccagtagtcacgttacaacgatggcgatggatcattaaactctgaaattgttgtaggctggccagcagcttcgtctatattgagaacattcgatgtatgataggcgtgactcttttgtactgtatttcttaggctgttggttaatattattaggacaatattgagggagcggtgaaagtcaactgtctgtatttccaactgattattttgctgttcgatactcaactcccgttcacttggcagcacaatggcatatctgatatttctaatgttgaattacctttacggctttacttaaatatctgatggccttgatcg

SEQ ID NO: 20123 - DNA, 1992 bp, Zea mays
cctcgaggccggccgggccgggaacatgatgaaacgctctgtgacaacattgggtcgtcgcaacctgtcatcttcccagatgatacgagcacctctgagcttcgatcttttaaaaaaaaaaaaaaaaaaaaaaaaaaaaaaaaaaagattgcatcagcgagcacaaatcgaaccgtggtcgtacaagggcctgtttgcagcagcaagcattcaagaaatcaagcggccgcctcgtcccctccgcgcccggcgcctccgacgcccaagcagcgtgaccgtggaagggacgaagaagagcaccctcaagcggccgcactaatcccaaaccggcctccgacccccaagcagcctcacgctgctcgatggcggcgccgtatcaccagcctacgagcctggaggaggtccgcactctgtggatcggcgacctccagtactggaccgacgagaactacctctacagctgcttcgctcacaccggggaggtacaatctgttaaaataatacgcaacaaagtaacaagccttcctgagggttatgggtttatagagtttgtttcacatgaagctgctgagaaaattctccagacttacaatggcacacagatgcctggaactgaacacacattcagattgaattgggcctctttcagctctggtgagaggcgccctgatccaggatctgatcattcgattttcgtaggggacctggcacctgatgtcacagattacttactacaggaaacattccgagtgaactattcatctgttagaggtgctaaggttgtcacggatccaaataccgggagatctaaaggatatggatttgtaaagttcgcagatgaaaatgaaaagaaccgtgcaatgacagaaatgaatggtgtgtactgttcaacgagacctatgcggataagtgctgcaatacctaagaaatccactggctctcagcttcagtattcagctgctaaagcggtgtatccagcaacagcgtatgcaatgcctcagctccaggcagttctccctgacagtgatcctacaaacactacgatatttattgggaatttggacccaaatgtgatagaagatgagctgaggcagatatgtgtacagtttggagaacttatatatgtgaaaattcctgttggtaaaggatgtggttttgtacagtatgcatctagggcatcagctgaagaggcagtacaacgtcttcatggcacaatgattggccaacaagctgttcggctttcatggggccgaagtcctgcgagtaaacaggattcatcagctgtgtggagtcagcaagcagatccaaatcagtgggcaaacgcttactatggctatgggtatgatgcatatggatatgctcaggatccgtcatacgcttatggtgcttatgcaggatatagccaatatccccaacaggttgagggaactgttgacgccacttctgttgctggtagccatccaggcatggagcaaaaggaggagccatatgatccaatgaacatacctgatgttgacaagttgaatgcttcatacatggctgttcatggtagagccatgctagggcggtccttgtggttgaagaccaacccgctgccccaaccgacataagcatgtttcctcccccgaagactacagccagtgctggtgggcgcagctgggtttcatcgcagatgattttgcccttcccagtagtcacgttacaacgatggcgatggatcattaaactctgaaattgttgtaggctggccagcagcttcgtctatattgagaacattcgatgtatgataggcgtgactcttttgtactgtatttcttaggctgttggttaatattattaggacaatattgagggagcggtgaaagtcaactgtctgtatttccaactgattattttgctgttcgatactcaactcccgttcacttggctgcacaatggcatatctgatatttctaatgttgaattaaaagggcggcgctcgcgttctagaac

SEQ ID NO: 20124 - DNA, 1296 bp, Zea mays
ccgcccctttttttttttttttttccataatagtcacatcttgtgttgtcattaatccatgaaaaactcaaacggtagcctagatgctattagtaatattgatgccgttggccaaccttggcgtacaacgctgacatcaggaagaacagccgaacccgacgtgctggtcagctcacccaccagctgaacactggttagctcacctaccagccaaacagcacagcacagtcctgtctcaagtctacacaactcggcttattttccttataattcgcaccagattacagttcaaaagcctccaccaattccaaacaagagcaaataaaagataaggttcggcctcaacatcaaaacttcctatcgcgcacctggcgctgtatggtttggggatcaggaaagaacagccatcacgtcagacgccctgagcacgatgtactcaccgtcctcgcccttgaactcactccccgcatacttggaatacatcacgttgcttccaggagtgatcgacaggggattcctgctgccgtcctcgcccaacggccctgggccaacggctaccactgatccaacagaaggtttctccttagttgcctgcgtcaatagcaaaccaccagcagttcgttcttcagcttcagcaaccttaatcagaatgcgatcattcagtggtttcatatccttcacatcatcactgtcaagaataccaattatgtcatcttctttcaaaatgagatggtcggcgtcattgaatttcaattctgtgcctgcatatttcgagtagacaacttgtgcaccaaccggaacactgatctcaatgcggttacttccaaaacttctcccttctccaaccgcaacaatctcccctccttgtggtcttgtctgaactgatactggaagtaaaatacctccatcagatttagcctcagaggttttgatcttcacaagtactctgtctcccaatggttttatggacgtatacttaggtgacacgaccgtggcggccctcaccacgaggcccctggccctccgcccctttggcaccgcaagggacggcgtcaggaggagcccgcccaacgcagccggtttcgcagccgccaccacccgcggcccagacagctgcaccgacgccatggctgctaccgggaactgcaaatgacactgagcgcgaggacgatgacgagaactgaggagctggggttggaactgaggataagaagcggtgttaacctatcttcaagcgcgcactgtggtagcgttgctagttgctacggcgttcggacgcgtgggcggacgcgtggg

SEQ ID NO: 20125 - DNA, 1055 bp, Zea mays
caacacaaccgggcttattttccttataattcgccccagattacagttaaaaagcctccaacatttccaaacaggagcaaataaaagatagggctgggcctaaacataaaaacttcctatcgcacacctggcgctgtatggttgggggatcaggaaaaaacagccatcacgtcagaccccctgagcacgatgtactcaccgtcctcgcccttgaactcacttcccgcatacttggaatacatcacgttgcttccaggagtgatcgacagaggattcctgctgccgtcctcgcccaacggccctgggccaacggctaccactgatccaacagaaggtttctccttagttgcctgcgtcaatagcaaaccaccagcagttcgttcttcagcttcagcaaccttaatcagaatgcgatcattcagtggtttcatatccttcacatcatcactgtcaagaataccaattatgtcatcttctttcaaaatgagatggtcggcgtcattgaatttcaattctgtgcctgcatatttcgagtagacaacttgtgcaccaaccggaacactgatctcaatgcggttacttccaaaacttctcccttctccaaccgcaacaatttcccctccttgtggtcttgtctgaactgatactggaagtaaaatccctccatcagatttagcctcagaggtcttgatcttcacaagtactctgtctcccaatggttttatggatgtatacttaggtgacacgaccgtggcggccctcaccacgagccccctggttctccgcccctttggcaccgcaagggacggcgtcaggaggagcccgcccaacgcagccggtttcgcagccgccaccacccgcggcccagacagctgcaccgacgccatggctgctgccgggaactgcaaatgacactgagcgcgaggacgatgacgagaactgaggagctcggaaaaggggttggaactgaggataagaagaagcggcggttaacctatcttcaagcgcccactcccgcggcgtcgagtgctagctgctacggcgttttaactgtt

SEQ ID NO: 20126 - DNA, 6005 bp, Zea mays
tagaagatttaattatcttgaagttcttattaaaattttctgttgtctttaattttagttaaaattgtctacttggttcattgatcctatactcgtcaagcgcctttgggacacgatgctaacaacgggtcccacgccacgtcaaacgtggggattgcattgttccgccccctagtagttgggcccacatttgtgttcacaagaggctttagaatagggctgaacctttgttgtcttagcaagccgccttctacatgccaacaagttgtgtagccttgggtcagtgacctactgaccttcccttcctggctaagtcactcgaggcacaattgctggaggtgtctttggcgatgctcttaattccaaactagcgtttatgttgtctacagcgaaccatgtaaaaaataaaagatttacattgttgtagatgacaatatttgtaaagtgaagtttgaaatggagtggcataggggcatggtaaatttagaggggtttgtcagtgtcagctgaccccgataaaaattataattctttagaaaaatataattaaagttcaaaaaactttatattatatagtaaagcttagattctgttgacccgacgatattctcagctagattcgctagatgggatagcatgatgttccgcggctctagcccgttggatatggcagcgtacgcaacgccttctgaaatctgaagtaacacgaagagcagcgccgaaatttgaatgctcgaggctcgagcggcggccgtgatcgccagcaacaccgtacggttacggtccgggaccgtgccagatttttctattgatttgtaggatgcgtccacttcgcaagcataatccagacattcagatgggaactcaaaccttgtagtgaaatggaaattaaagctacagaattcgtctctaaacctttgtagtgcaaaggtaacagcaaaagcttctcactagtttggggccttggaagtgcagtgaggcagcgagcgacgctctgggccgtcgaaccacaaccacctgacctgaacgcggagcaatcagggcagttctcatggcgcgtgtcactgttcggcgccgtgccgcgcagggcctcacccagagatgccaactggccgcggcatggggaaccggtgcccgtccagtcttgcgcggtcgaacgggacgccgacctgggagcaaccagaccaccccttgctcacgggcttcccactcccgcgcgggctgggcgccggcaaaggctggtcgccgccgccgccgccgctcctgccgcccttcctcacgaagctcagcagcttcttgagccccttggacagctccctgtgcgaatcggccgtcgctgagaccgagagcgtcgccgtcggcctctcagggctgccccaccgcttcctcggccgcgcctgtggcgacggcgaggccagcgccgccgcgtcgaacggcagctccgacaccgaccgcacgtggcgcggcgcgtgggcgtgggcgtgggagtcgccgagctcctggggcagcggcggcctcggggtcgtcatggccacgtcgatggccggcagcaggtcgtgcacccgcgccgtccgcagcctggccggcgccgccgcgcccgcgccgcccgtgcccgtgccgcgcttcaggaacggcctcggcgtggcgcactcgccgaactcggcgggcacgacgccgaggctgttccgcctctggtggtgcgagtgcgacggcctcgccgggctcccctccgcgccgccgcccaccgtcctgctcctcggcagcgtcgcgccgtcgcttctcggggtgctcggggtcgacacggccgcgtcttgttgcgtgtgcgtgtcccgacccgcgcacctgagcgcgcgcgggctcatcggcgtggcgcgcacgcctcgaggttggtgaaccttaccattcgccggttggtgctgccgctgctcggccgacacggccacgcgcctggcgtcgcgccggcgcatgtaggcgtcgtaccgcctgccgcggtgcaggctcagttactccaggtttgccgcgcaggcagcacgcgggctttggagtgtgggcgttggtggggtggaattggaaatataggagtggctcggggtcgggccgttttgatttgatttggtttggtcgcggcaggcagacggggatgctggagttacctggtagcttgactccaacgacggcggcgtacatggcagggcagcgacgagccgacggacgacctggccaagttctggcatagctacggatttggtcagggctgtcatgctgaatagtaagatcctatcacacaggccgtgtcgccgttgatcggtcgtcggactcgttaaaacaaaatgactttcctgctggacaaggtcgggatgcatgacaatgacaagacgaccgtctcaaaccgtgcttttatgtagttacagatccaacttttgttcctgcgcgtcgaccagcatcgtgccaaggctcctgcgccatcgggaagtccagcgctattgacgtgcacttcggtagttgcaccaccggtggtgcggtcgtccggtctagtatgtatgcatgtcgcatgtgaaacggtcttggtctagcttgcagtgtggatggctcatacaaaagcccggtcgtcaggacaagatgatatatggtgcacatgtatggacatgctcaacacctctgcattagaggagggcaactcgctaaatatctgcaatagtttttcaagttaagtttaaactcaaacttttcatggtctctcatgggattacctagcactagtttttacaagtatgcatcaccactctatataaaacttacttaggtcaagatacccatctatgcccccattttatagtacgatcaaaaaaatgatcctatcactaatctatgtccaacaactccttgatacttagacctacctatttttaaccactaattgtttactatcaataggggcatctaagtgaaggcatcaaaacgatccactatggtccgacgatcctgaaagacaaggtccgacaatcccgaaatacaagatctgatgcctaaaaactcttctaacttgtccaattttaaaaccttatctaagtcaagctagttcatacccccttcataatacgattaaaaagaagaagaaaaataaagtgctaaacaactcgaactatctatcaactctaattgacatttagaactagtttaccctacaccttaaactactctaagttttgtttaactccaatcaacacttagaactaatccaccttatatcttaacatctatccttttaaagaccgcaacaaaatacatggcatagaaaccatacatcacctaaaatattctctatcattatgacctaaccgaaatttcgctttgcaaagcacacattagtcacaacaaacttatgttacattaattaatcagaaatttttaacatcaaagcccaactataagcctagttatctttgcaaaatactatcttctattcttgaatatttgtcgtccgctagttcatttttgaactaaaacaggtttatttttgaattttttttttttttttaaaaaaacagaggaagtatataatagtcacatcttgtgttgtcattaatccatgaaaaactcaaacggtagcctagatgctattagtaatattgatgccgttggccaaccttggcgtacaacgctgacatcaggaagaacagccgaacccgacgtgctggtcagctcacccaccagctgaacactggttagctcacctaccagccaaacagcacagcacagtcctgtctcaagtctacacaactcggcttattttccttataattcgcaccagattacagttcaaaagcctccaccaattccaaacaagagcaaataaaagataaggttcggcctcaacatcaaaacttcctatcgcgcacctggcgctgtatggtttggggatcaggaaagaacagccatcacgtcagacgccctgagcacgatgtactcaccgtcctcgcccttgaactcactccccgcatacttggaatacatcacgttgcttccaggagtgatcgacaggggattcctgctgccgtcctcgcccaacggccctgggccaacggctaccacctgtgttcacggtgtattagactcaagaaatgagctcaatgtgaggactgaactaataacatggagatatagtatgtagggagagtacagacggatgaagtataattctgtacgattgtatgttatttatttagtgaggtggccactctattgtaacttaggcagctgcactttccgcaccagtgattgcaagtcgtccgactaatcgcgattagtcgggctggtcgtctgtttatactcgattagccggacgactcaattagcttgtctagtcgtcctgatcgtccgactaggggccgattacggcgattagtcgtccgacttgtagttcctggtcgccaacgtctagggtttttgttgatattacttgggccaatgtggatgaagtgttggtgcagcagagggtctaagggggcgtaacttgcctcgtgtagtttctagccatattatttcttattctcggtctagaaagcgacaaagggacaaaacccaacactagccatataattcttattctcggtctagaaagcgacaaagggacaaaacccaacagtctgaaggtgatgcaacagatgaaatggatgaggacaatgatgatgaatctggatctgctgaagttgctgatgcatgcttccatttggatgatgatttggtttagattattgtaggcttcaagcaggctgtttgctgcatttttgttcttgctcagtgctcatgtcttctgtgctatttatacactagtctaaaggtctaggacggccagggaccgactagttgctctggtcgtcgcctaatcgtgattagtcgcctggtcggtcccagggaccgactaggcgacttgcaaccattgttccgcactaaaggctgcaagctaaactgtcttgtgttttcccctatatccatagtaacatccccaaacttctagcgcgcgaaccacacaagtaggagacaactaaagggcatcaattactggccaaaatctgcagcttattcaaaacaagtcccatccttgcaacttgtaagtataataaaactgttgaaacttaaaagtcgagcacagcttatactcagctgttattagtccactagaagtctagaacatgttaaatgtaccattgatgcatttaacatgtagattcaaaaaaggcccaaaacaaaataagtaatttttttcaaggattcagctgttgaacatgtgttcataatttgaaaacataaacaatcataatcaacagataatgattaaggcctctatcgtaatggtcaaggcttccgagtagcacctccagatcctaggctcgattcacctcgggggcgaatttctggcttggttaaaaaaatcctctcgctatgccccgcctgcttttgggttacatcctacacgaccttccggttgggccgttgcagagtgggcggtaacggtccgctagtgatggggggcaggttcggagattttcttggccggaaccatgtttcagtttcttcttaatataataccgagagggcggtctttccctcccggccgagtttttcataatcagcagatagtcgaataaattactgcaaatccagcatatactaaacctaaaatactcactgatccaacagaaggtttctccttagttgcctgcgtcaatagcaaaccaccagcagttcgttcttcagcttcagcaacctggtacagaagaacaataaaaaattaagtaaaatgtattgtaaatgtagatgtcacagttcacactccaacagcacagagcatagctgctccttagcctgcactaaaacacagatttccacttgggcagatggaatgtaccaaattattatccagtttgactatttgaagaataaactagtatatagaacataatatacacttgaatctttaaaggagaaaatgtcgctgcaggtcg

SEQ ID NO: 20127 - DNA, 1165 bp, Zea mays
aaataacaatatttctttctcacacagattagtgtggtgtgcgagatcagtaacggttcatcctggaaccaaactgccagcgcgacagcagcaaaattacagaaaccttagcgttcgtttacattacgccaaaggcatgcagaagcagaacaaactagagactccggtagagttgtagaaccgtgtcatctcatgtagtgtctgtcgacatatcttgcatgctttacttaactcacaagatctgatccatctcagcaaggactaataataaggtaattaatgtgccatgcatgacatgaatgatttactagtacttaatcagactgccgcgatgccccattatcaataatccgagctgagctgtgtggtgagctgccagcctctggaaatggaacaggggagcttagctagctagctagctagggaagaaggccctctgcatgcatgctgcgctggccgatggagaagttcgttggtcggatagatcacaccttgatctcttcctcggcgggcggcttcgggcgctcggacttcttgctcgacatgatgctgttgaagttctctgatttgcacagcaggatctcgatcttggctttacggacaagccggcccttcgcctcatccttggtgccgatggttgatgtgaggatcttcttttcagtggcgaggccattgttcttgaggatctcagcgacggtcaccacggtaccaatggccatccccagagcggagagctcaacctcgtcgtagttctgcatgtacctcttggcgagattgacgtagaaatagagcggcttcttgttggtggacacctggatacggttcttcttcgcagacgatgcaccggcctccgcctccacctcgacctcggcctcgacctcgacctctgcctccgcctcgccttcagtctccgtctccgcctccgcctccgcctcttcccctacaaccgccaccgccacgtctttctcctcaggcaccgcctcctcctcgtcgtgcgccttcgccacctccctcttcacctcgtccgcctccgccctcaccgcctgctcctgtgcctccccctccgcggccggacgcatcgcctgcatggtggtgtctgagactcacttgctgcctcggtcgtgcggttcgatcatgcgccagagatggccgatggagagaggac

SEQ ID NO: 20128 - DNA, 956 bp, Zea mays
ttttttttttttttttctttttttaagcaagaaacggagctttcaatcaaatccaaaaaaggtcaaataaacaaccgtgccacgcagaacatacaattccaaacgggtaaagaagtgtaaaagatgagagaaatagcggtacataagcatatatatattgttcgaaaatccaggagcatgatactagtggtaatgaagtattccttgacgcctcaaggtacgatgaggccaggccagcagcaaagagtcgtcagctctgagacgttggggtccgcatggtttactcaggttcatcttgacggtattccattcggcgatctggagctggtgttgaagtcggagggcgccatggggatggagatggagagctgggtggccgaggagccgaggctgttgtcctcgttcagctcgggccacgagtccctcgacttgggccactcgtcgaagaaggggcgcagcgtctggttctcctgcttcggggtcacgaagtcgctcccgaagaaggagaggggctccctctgcgtcttgggcagcgaggcgatggtgctctcgtccagaccgctcagcgcgccgaacagagggtagcttgtggcctggaacgtggcggcggtttgggacggcaacaggcgccacgagttgtccattgacgcgtccatgccgccgccgccgccgggcaagagctggctgtgctcgtccgacagagacttcaccccgtaggcagagtacctgagatctttgctccctccaccacgcacgcagtcgcgtaagcagcggcactgtccatgtgcagctgagaggtgggccccaggccgaacgtgccaccgccaccagcaccaccacctaccccgccgccgccgccgccgttgccggcgaggatggatgggtacatggggtggctctggaagccagcggtgggcgcgggggcctgctgctgcggctgggcgtgcggcgggggc

SEQ ID NO: 20129 - DNA, 1944 bp, Zea mays
ttttttttttttttttacaagtggttggtttgcatctgatattttctcttttttttaccaaacagcaaaccgctatagattatacaatatttcagagcacgagtacatgacaacgagtacatgacagattgagttcttacatactcaccccgtcctaaaatataattcgttttacactaaacaagcattgactacttaacttaatttatgaatgtagtttgtatgtatgtctattcattatcatttgttcgaatgtggacggaaaaaaggaccagaaaaaactatattttaggacggagggagtatatcaattacacaaactgctgtgctatcaccatccttgcaagcagttgttttctgcaactaatctagacaagctggaccactgcagcaattcgcagggcaccaccctggagaagatcagcaagctcatcaaatagtatagcagtgcgccagccccagcccttcggcgcttttggtagcagcgtcccagcctgcttcaggcttccaaatatcatgacctctctctttgatggacagatgagctgataccgagcagtgaccttttcccgggggtcaacgtacaagtgagccttcctcaagggatctaacaactcagccttgcgtcggtggagaaatagtccaagggtgcgtcgcccatgaggatcctcatcattgaatggctggacactcaccttccatagagagcctgcataaaacacttcagtcgaatgtttcacctgaccatcagcaagcctgtgcacatcctcgaactcaaccccaaagcggaaaggtggaaaatggctaagaggtgttttcatgtctaatgatatagttgcatcctttgtggtttcccaatctgatccaagttcatgctcctttgactcctgcatctggacagaagaaccacctggagtggaaacagatggaacactgcgatatcttgtctgcatccctgtctcaaatagactttgatcctgcagatgagcagcattgttttcttggctaaggttaaccaatgcagtcagaccatctgctgaaatatctccattgcggtcaattctaggttctgattcatcaatggcaaattgctggccatttcttgaaccaagcccataagggacacgggagaagacatatcgtgtaggagcccaagctgcaccaggcacatttgagttccctctcccaataccagcaagtccatcgactgctcctcttacattaacacggacaggcccaagtacaccattcccatcaccctggccatccgcaaggtagacattacctatgttgtcggaggcactgctcctgtcatgctcctgcctgtaatgtgtatgcgagctcacatatgcttgcttgcaagcacaagaactattcataaggcaacaattcctgcaagtatcagcaacaatcgcttgcaccctgtgacacagaagcatctgtagccatagactatcattgacagctttacaagggaatccaaattcttcgagttgctttcgaacacttagcagtgcatcaaaggacatattgcagtagagaagagaacctctctcaaatatccccgcaggaccaggagggtcctcagtagatagacaagagcttcctctaatgtatctaatttgccgccgtccaacgaccctgccaccccaaagtggtgcattgggccttccccactcagtaggaacaacaacactactggaagttcttgagaaataattatttgcagtttgctcactagaaatccagttattttcattaaattgatatgaagtgctttctcctgatggccctccggtagaacaatcaaactccattctcttgggagcttcaccattcatatctgaaatagcaataatgttatggggaatttcattccccaagttatcatgcaacttcaagttcttcaattcagagtccattagcagttcctccccagattca

SEQ ID NO: 20130 - DNA, 917 bp, Zea mays
ttttttttttttttttcctcaaaccaaacacccccttaagaaactccaattatttggtcattagtgcttagcatacaactagatggacttataagcaacaccggttacacgcatatacaacagaaacatccaacaacttccaggggcaatagcagggatatgatcatgtcatctagaacaacaataatttatgccggggattatttcaatgggagcaatcccggctgcctaaagagcaaaaacacccaggttctctacagctacaggggaggcgacgaacagcaggcttgaacttgttgacttgcgcttcatatatcatcggcgtcgcttccacccaagtgaggatcttgtggaatccagtattggcttccgtcagggcccgacaccttgtacctctccagaataaactttccttccttgtatctctggctcttctcatgagcagcctcatatttccatccaacgatggatccacagccaacacagaagatatcagaaacagtatgcattcctgtcatcatcatgcgatcttcttttactccagaagtcacattggcaaccttatggaagaggtacgccttcccgtgcctgcagtggaaggccttggagatgatgtcgctggcaacgccgagctgggtcctgcagtgcttgcagctgtagacgttgccgtccaggtgcatcaggaacagccgccccatcgccgccttctctcacacctcccgaactccactccaacccagtccctctcggcaattccagcgccgggtgagggccactctaatgtcccgattccgcggctcgaaatcccctcctccggcttcctcgaatcggagattgggagacgagaaatttactggagtggagctttagtgtttatgcctgggttgttgtggtctcggccggcccgagggtcccaa

SEQ ID NO: 20131 - DNA, 865 bp, Zea mays
ttttagacacttaacaaactttaattatttggtcattagcgcttggcatacaactcgatgaacttataagcaacaccggttacacttacacacatatacaccagaaacatccaacaacttccagaagcaataggagggatatgatcatgtcatctagaacaacaataatttatgccggggattatttcaatgggagcaatcccggctgcctaaagagcaaaaacacccagattttttcaatggcagcaggcttgaacttgttgacttgcgcttcatatatcatcggcgtcgcttccacccaagtgaggatcttgtggaatccagtattggcttccgtcagggcccgacaccttgtacctctccagaataaactttccttccttgtatctctggctcttctcatgtgcagcctcatatttccatccaacgatggatccacagccaacacagaagatatcagaaacagtatgcattcctgtcatcatcatgcgatcttcttttactccagaagtcacgttggcaacccttatggaagaggtacgcccttcccgtgcctgcacgggaaggccttggagatgatgtcgctgccaacgccgagctgggtcctgcagggcttgcagctgtagacgttgccgtccaggtgcatcaggaacaggcgccccatcgccgccttctctcccacctcccgcaactccgctccaacccctctctctcggcttctcggcaattccacccgcggacgcgtcgagggccactctagccccgatcgccgcggctcgaaatcccctcttccgccccgcgtccgcccacgcgtccgcccacgcgtccgcccacgcgtccgcccacgcgtccgcccacgcgtccg

SEQ ID NO: 20132 - DNA, 1236 bp, Zea mays
tttttttttttttttttttttttttttttttttttttaaaaacaagcgtgcagctattcggttatttaagagtgacgttggaaccgaacacacaatacaatgcagatttgtacatactgccctcgcttgacacccaggtcgaccagacacttgagaaatttactttacttatttggtcactagtgcttggcatacaactcagatggacttataagcaacacaggttacgcacatatacagcggtaacatctaatgacttccagggacaacgggagggagggagggatacgatcatgtcacctggaacagcaacaatttacgccggcgaattatttcaatggagcaatccccggctgtcggctgcctaaagagcaacgccacccaggttatttacaggggatcaacgacaggcttgagcttgttggatcgtgttttatatgtcatcggcgtcgcttccgcccaagtgagcatcttgtggaacccagtattggcttccgtcagggcccgacaccttgtacctctccagaataaacttgccttccttgtatctctggcccttctcatgtgcagcatcatatttccacccaactatggatccacagccaacacagaagatatcagaaacagtatgcattcctgtgatcatcatgcggtcttcttttactccagaagtcacgttgacaaccttatggaagaggtacgccttgccgtgcttgcactggaaggccttggagatgatgtcgctggcaacgccgaggtgggtcttgcagtgtttgcagctgtagacgttgccgtccaggtgcatcaggaacaggcgccccatcgccgccttctctcccacctcccgcaactccgctccaagccctctctctcggcttctcggcaattccacccgcggacgcgtcgagggccactctagccccgatcgccgcggctcgaaatcccctcttccggcttcctcggatcggagactgggagcgggagttgtttattgccggtggtttctgggtttgtgtgcagcggcggtggtatctggtatggtgcgaatgtgcgatgtgtcagcgagcgagtggggaaacgggtgagaagagtgggggatttcggttttcggatgggaggagtgcgtgggaggccgcgcgctcgcacagccacctgcaagctgcacgggcagcacggcatggcagcgctcgctttgcccgcatccggcggtcccggccggcctcgaggtacccaatg

SEQ ID NO: 20133 - DNA, 991 bp, Zea mays
ttttttttttttttttttcgatcagacaattaacaaactttaattatttggtcattagcgcttggcatacaactcgatgaacttataagcaacaccggttacgcatatacaatagaaacatccaacaacttccaagggcaataggaaggatatgatcatgtcatcaagaacaacaataatttatgccggggattatttcaatgggagcaatcccggctgactaaagagcaaaaacacccaggttatctacaggggaggcgacgaacagcaggcttgaacttgttgacttgcgcttcatatatcatcggcgtcgcttccacccaagtgaggatcttgtggaatccagtattggcttccgtcagggcccgacaccttgtacctctccagaataaactttccttccttgtatctctggctcttctcatgagcagcctcatatttccatccaacgatggatccacagccaacacagaagatatcagaaacagtatgcattcctgtcatcatcatgcgatcttcttttactccagaagtcacattggcaaccttatggaagaggtacgccttcccgtgcctgcagtggaaggccttggagatgatgtcgctggcaacgccgagctgggtcctgcagtgcttgcagctgtagacgttgccgtccaggtgcatcaggaacagccgccccatcgccgccttctctcacacctcccgaactccactccaacccagtccctctcggcaattccagcgccgggtgagggccactctaatgtcccgatgccgcggctcgaaatcccctcctccggcttcctcgaatcggagattgggagacgagaaatttactgggagtgggagctgtctagtgtttattgcctgtggttggtttgtgtgtgcagcggtggtggtgtggtatggggactggggtgacggtttctataattctattcccagcatgcgagtgggaaaacggatgaggccatgaggggatggcggt

SEQ ID NO: 20134 - DNA, 1939 bp, Zea mays
gctctttgtcccccgccgccatcgtcgccacctcccggcccgccccgacgcacactgactgaaccagagcgcgaggacagcagctcgctcgaccatggagaaccgacaccaagtggctgcacctgcacgaggcgaggtgtgggccgagatgaagaagcaggtgcgcctcgccgcgccgctcgccgcggggttcctcctgcagaaggtgatccagacgatctccatcatgttcgtggggcggctcggcgagctgcctctcgccagcgcgtccctggccacctcgttcgccagcgtcaccggcttcagcctgctgacaggcatggcgagcagcctggacacgctgtgcgggcaggcgttcggcgcggcgcggcaccagctgctgggcgtgcacaagcagcgggcgatgctggtggtcggcgcggcgagcgtccccgtggcgctcgtgtgggcctacaccggcgacatcctggtgtggttcaggcaggaccgggagatcgcggcgggcgccggcagctacatccggtgcctgatcccggcgctgttcctgttcgggcagctgcagtgccacgtccggttcctgcagccgcagaacgtggtggtgcccggtgatgctcagctccggcgccaccgtcgcgctgcacgtggccgtctgctggctgctggtgcgcaggctgggcctgggcgccgacggcgccgcgctggccaacgccgtctccaacctcggcaaactatccgccctggcgctctacatcaggctctcgccgtcctgcaaggacacctgggcggggttctcgcgcgaggcgttccgcggcatcctcgtcttcttgaagctcgccgtgccttcggctgccatggtctggtgagcgtccattgattatcgcattatttccatagtgttattgtatttgtagtatatatgacttgaggaagacgatgctggggcgcagcatggagtggtggtccttcgagctcctggttctgctttccggccttctccctaaccccaagcttgagaccgccgtcatgtcgatctggtgggtgtgccgtgaaagcctagctctatatatctctgaaaattcctatgcttaataatgttctctgattcttgcagcttcaacacttacgtcttcgcattcatgttcccaatggggctcggtgctgcagcaagcatacgcgtgtccaacgagcttggtgcaggacggccacgcgaggcccgcctggcgactcgggtggtcatgctcctggccttctccctgggcgtctcggaaggccttgtcatggtgctggcgcgccgcctgctcggctacgcctacgccaacgacaagcaagtcgccttgtacaccgctaggttgatgccgatcctcgccgcctccaccctgtttgactgcctccagtgcgtcctctcaggtgttgtcaggggctgtggccgacaaaagatgggccgcctttatcaacgttgcggcattctacatcgtcggcatccctgtagcgtccgttttcgccttcgttcgtcacctcggtggaatgggtctttggtttgggatcttgtgcggagtagcagtgcagatgatcctgcttctttgcatcaccttgtacactaactggaacaaagaagtatcgaaggcaaatgacaggcttttcagctgttctcttcctgtcaacgacaccataacatcgggtgttagcgagcagggaaatggatgtagttttgttgggaacaaggatgctgctaatggagacattgagctgacaagtggtctcaacaaaggttgatggctacaatgctacttttctactcatctatttagcttaattgtaggctggtaaatagcatctagtggaatgtacgtactcactgcttagccttcagttgaaagcagcaaaccatggtggtcatatggacctctttttttttaaaaaaaaaaaaaaaaaagcggcc

SEQ ID NO: 20135 - DNA, 2088 bp, Zea mays
ccgacgctgttcccagcggtgtacacctccaaaccagtgcatcatcgacaacacgaagaactttcacgcatatgacgaacctaaagagaaatggtaggctccatacctttcttgtcgttctagcggcagaggccgaggcctccaatcttctccaacagcaagcgatcccttgtcttctccctctgttctagcgagcacgtgctgataacgtgttgtagtgtaatggaaacgagattgagggaatgaaagttacagccactattgtttattccaagcgtgattacatatatatacaaagggacgggtgcaagccaagtgacatgtcatttggcgagataactgtcaccatcacatgtttattttctaacgcaaattatcatgtgccttttcttggcactttgctttacacgagaggccccttcgcgccttttttttttttttgcatgcactgagggtatgggaaatctcattgattcgaaatgtattgatacaaatgtgtgagacatgctgtcatacgccagaatttacatcatggtatttgagactgctgcataagctttcacaatttgactcccagatttgaaggacgaaatggcttagacacggttatccactcttgtgatatcgatatttttagtcgcagtatagaagtcgatctaaatcattaagacctcaactaaaagaaccatggtgatcctcttactattggaggaacaggaagctttccaggtccaggaaataagtataatgcagctgggagagtggctctgtacttgccaaattttcttgggcatcagagagcattgatgtcgctaaatggcggtaccttgctcatggtgccatgagcagcttctttacaaagccaataacctttggcacatcaaccgtccatgcaactgaaatcggtttataccctgaccaagggttctctgaattccactttttcaatccctgatccatcaaagtgtggccagtgcaaatgccctgggtctccactctcaccacacccttcttgaatgtgaagtactcgggatgaagcacggcagtgaagctcacaggatcatgaaggaaaattccatggaagccatcagacttgacatgccaatctctgtagaacttgcacgtctcagataagaacggtgcatgcttcccttttgagtttcttagctccaagagaccctcatctgtcaaacagacttgtgttgttatgttaatgccaaccacaatgacatctgctcctgaagtaaaaactatgtcagctgcttctgggtctccaagaatatttgcttcagcagcagggttgacatttccagccacgaagaaagctccacccagtacaactattttattcaccttgcttgcaaaggaagggtctcgtttgatggccaatgctacatttgtcaggggtcccaaagcaagcacagagacctctcctggaaactcagagaccttattaaccatgaaatcagcagcactttcctcaaccttcttagcagagggtgcaggaagaaacagattcccaatgccatctgacccatgaacaaaatcagcaatacggggctttcctccctttaggggctcgtggctgccctctgctactggaacctcaggatgtcctgctctctcacacagcaatagtgcattacatgttgcgccttctgtgtcgacgttgccgaatatggtcgtgagcccaatgatttccagagtatgtgctctgaacgccattaggatagccatgctatcatcgatgccgggatccgtatcgatgatgagcttgtcgcggcgggtctgctggccgtcccgctccatcgcgagtccggccggcgcctccactgaagaacacgcactggagattggcaggaaggcccctccagtctgaacctgaatggtggaaagccgccgaggaaggggaagaagagaggagatagcaggtggggctgggacgcaacccctctatcttcctcccttcctactactttcttgtctcgcgacggaggacgagatgagtcgagccccggccccgaggggccaagtgggtgatatccgccgggacgtaattatcgtgggattagttatgttcccggccgg

SEQ ID NO: 20136 - DNA, 3295 bp, Zea mays
  misc_feature (100)..(100): n is a, c, g, or t
  misc_feature (290)..(290): n is a, c, g, or t
  misc_feature (436)..(436): n is a, c, g, or t
  misc_feature (644)..(644): n is a, c, g, or t
ttggtgggtgggtgggtgggtgtgttgaaacaggcgtgggcccacgaaggtagctcagctaggtcctgatcttagcagtttgttcgctgcagctttaatncatcgacttttgttttttctacagtattttgtctatatggattacagttgcagtagttcgaacgatttttatctagtcacagtgaacaaccccccacatcctattcgcttcagattaaaaccagttgtcctgactgttgtaactacaatccatagaaacaaaataatgtagaagtagtagaagccggtanagattaaagccaagcgatatctcgctcgttcggatcacataaaatagaaaaagttacactgtaaatgatacaatttacacagtgaagttgaaatagatgatttaattgataatgagatatgagagctactggagacgaccttatgntattaggaaactaatttggagtagtcttatgtcgtttcatgtagttccttagcttgagccaaaactaggatacattgattctaaactagtttaggtctaatttaagtgtctaacacactgatgacctaatccgtttgaatgatgacacgtggtattcatgtaaacagatccaaggttcagaacaaataaggagatttgaatttgatgntcagatgctgccgaacccaataccaactcgaccagaccgccacacatcacgacaagtaatatgcaattatatcttatgtgcaagtatataaatgatgtttctggtctgttaaattatgatataattatagacataatcacgttttgttaggaggttttatataaatttatactaggtgagtgcccgtgcgttgcaacggaaatatataatatcacggcaagttatatatgtgtgttatactgttattagaaaatgtttcgtaatccatttgtgatcctagccatgtatacattttgttatcttaatctagctatttcacctctacatagtacagtgcccgtgtgttgcgatggcacagtcatatttgatgaggcagggacatagaattgctcatatgttactttctattcatgcttgaagttgaatttacttttatgtgaattttatgcataatagccatgccaccacacattctcttcgcgaaaaataaaagatgaagcaggacttctggtacaattcaggcgccttttgccaagtttgtgcttcgagtggctcaccttggccaaaccatccttggctaagttcttttattctcccttaaatactgtgtactttgtttttgagaaacacccttctatagtagtacaggcaatgcagagtcctgccggcggtttcaaaaaaaatgtttactaatggtaattgcaaaaggatgttaatgtgttatctgtcgactggattgtcagatgtattactgaaaaatgtgtgattgcgttatctggtagcctatctgaatatctgagttatgcaactcttgtgatctgtcgccggttacaattaaagcgctctgtaatatctatctgcattggcaatgaaaatgagaaaaataactgatcagaaagtagtgtcagacagaagaatgttgtatcaaaattatcatatgccttgttggcactaattggctttacatgagccccccctcgcgtttttttttttttttttgggaaaagtgcacagtaaagagtgagggaaactttattgattctaaatgtattgatacaaatgtgtgagacatgatgtcgtatgccagaatttgcttcatggtattcgagactgctgcatgacctttcacaatgaaaggttcctcttactattggaggaataggaaccatcctaggtccaggaactaattacagtgcagctaagaaagagcatctgtactcgtcaaattttcttggacatcagagagcgctgatgttgacatgtcgttaaatggttgtactttgctcatggtgccatgagcagcttctttataaagctgatgacctttggcacatcaaccgtccatgcaactgaaatcggtttataccctgaccatgggttctctgaattccactttttcaatccctgatccatcaaagtgtggccagtgcaaatgccctgggtctctactctcaccacacccttcttgaatgtgaagtactctggatgaagtacggcagtgaagctcacaggatcatgaaggaaaattccatgaaaaccatcagacttggcatgccaatctctgtagaacttgcacatctcatataagaacgctgcatgcttccccttcgagtttcttagctccaagagatcctcatctgtcaggcagacttgtgttgttatgttaatgccaaccacaacgatatctgctcctgaagtaaaaactatgtcagctgcttctgggtctccatggatatttgcttcagcagcagggttgacatttccagccgcaaagaaagctccacccagtacaactattttcttaaccttgcttgcaaaggaagggtctcttttgatggccaatgctacatttgtcaggggtcccaacgcaagcacagagacctctcctggaaactcagagaccttattaatcaggaaatcagcagcactttcctcaaccttcttagcagagggtgcaggaagaaacagattcccaatgccatctgacccatgaacgaaatcagcaacacggggctttcctccctttaggggctcatggctgccctctgctactggaacttcagggcatcctgctctctcacacagcaatagcgcgttacgtgttgcgccctttgtgtcgacgttgccgaatatggtcgtgagcccaatgatttccacactaggtgctctgaacgccattaggatcgtcatgctatcatcgatgccgggatccgtgtcgatgatgagcttgtcgcggcggatctgctggccgtcctgccccatcgcgagtccggccggcgcctcccgctcaggaacagcgaagtggggactggagcgacgagaattgccgcgcagcagcaaaaggcccccaatctgaatctgaatcctggaaagccgccgagggagcggaagaagaggcgatggcaggtggggctgggacgcaacctctctccctgtttctcccttcctagtgctttcttgtctcgcagattctgcgcttttccaactcgccgggcatgcttgtgggctgtcgccccgccgccggggccccaagagaagctttatagatggagagttcagacggagacggagacggagacggaatgggtgagacacggatgaggcgatgagttgagttcgagtagatgacgggagatgcagatgtggttgtt

SEQ ID NO: 20137 - DNA, 2826 bp, Zea mays
ttgggtacctcgaggccggccgggattccccggcgaggattccccgttgccatccctacgctccaggctgcggccgcctggtaggcgctggtacaagcggaagcagcagtagcgtgaggcatccccatgccgggggcaatctcttcctcgtcgtcggcttttctcctccccgtcgcgtcctcctcgccgcggcgcaggcggggcagtgtgggtgctgctctgcgctcgtacggctacagcggcgcggagctgcggttgcattgggcgcggcggggcccgcctcaggatggagcggcgtcggtacgcgccgcagcggcaccggccgggggcgaaagcgaggaggcagcgaagagctcctcctcgtcccaggcgggcgctgttcagggcagcacggccaaggctgtggattctgcttcacctcccaatcctttgacatctgctccgaagcaaagtcagagcgctgcaatgcaaaacggaacgagtgggggcagcagcgcgagcaccgccgcgccggtgtccggacccaaagctgatcatccatcagctcctgtcaccaagagagaaatcgatgccagtgcggtgaagccagagcccgcaggtgatgatgctagaccggtggaaagcataggcatcgctgaaccggtggatgctaaggctgatgcagctccggctacagatgcggcggcgagtgctccttatgacagggaggataatgaacctggccctttggctgggcctaatgtgatgaacgtcgtcgtggtggcttctgaatgtgctcctttctgcaagacaggtggccttggagatgtcgtgggtgctttgcctaaggctctggcgaggagaggacaccgtgttatggtcgtgataccaagatatggagagtatgccgaagcccgggatttaggtgtaaggagacgttacaaggtagctggacaggattcagaagttacttattttcactcttacattgatggagttgattttgtattcgtagaagcccctcccttccggcaccggcacaataatatttatgggggagaaagattggatattttgaagcgcatgattttgttctgcaaggccgctgttgaggttccatggtatgctccatgtggcggtactgtctatggtgatggcaacttagttttcattgctaatgattggcataccgcacttctgcctgtctatctaaaggcctattaccgggacaatggtttgatgcagtatgctcgctctgtgcttgtgatacacaacattgctcatcagggtcgtggccctgtagacgacttcgtcaattttgacttgcctgaacactacatcgaccacttcaaactgtatgacaacattggtggggatcacagcaacgtttttgctgcggggctgaagacggcagaccgggtggtgaccgttagcaatggctacatgtgggagctgaagacttcggaaggcgggtggggcctccacgacatcataaaccagaacgactggaagctgcagggcatcgtgaacggcatcgacatgagcgagtggaaccccgctgtggacgtgcacctccactccgacgactacaccaactacacgttcgagacgctggacaccggcaagcggcagtgcaaggccgccctgcagcggcagctgggcctgcaggtccgcgacgacgtgccactgatcgggttcatcgggcggctggaccaccagaagggcgtggacatcatcgccgacgcgatccactggatcgcggggcaggacgtgcagctcgtgatgctgggcaccgggcgggccgacctggaggacatgctgcggcggttcgagtcggagcacagcgacaaggtgcgcgcgtgggtggggttctcggtgcccctggcgcaccgcatcacggcgggcgcggacatcctgctgatgccgtcgcggttcgagccgtgcgggctgaaccagctctacgccatggcgtacgggaccgtgcccgtggtgcacgccgtgggggggctccgggacacggtggcgccgttcgacccgttcaacgacaccgggctcgggtggacgttcgaccgcgcggaggcgaaccggatgatcgacgcgctctcgcactgcctcaccacgtaccggaactacaaggagagctggcgcggcctgcaggcgcgcggcatggcgcaggacctcagctgggaccacgccgccgtgctgtatgaggacgtgctcgtcaaggcgaagtaccagtggtgagcgaattaattggcgacgccgacgccgctcctgtcgcaggacctggacgttatttagaaggctcttctccctggcggctttgatgcgtgcgtcgcatttgcgccgggcggacgggcgacggtggttggcctaccgcctacgtcggctgcgtgccctgggaatttgggcgggcacgatgatgccactgggcaccgggcgcggggtagtatgatatgaaaccgacggcgatggagatgaggcgcatggcattttcccactgataaatggggagttgtatgctactttaatatcgccactcctgttagtatttatattgatgctgtcaagttttccactccaagaacaaatgacggtagccggtaagtataggcctatttgtagagctagttagaagtacatgtgcccaaaccgacaacattgtacgtacattataaagcacggcactatttgttactgtcagtaaccgtgtcgtgctagtactatacctaaccatcgtcacaggtacagcattatagcacctatgacgccattgtatagcacttagtagtgctcttgtcagtctagatattatttcactttaagagtgctcaaaagagctagaac

SEQ ID NO: 20138 - DNA, 2529 bp, Zea mays
catgatccaaatggtacctaaattgcgttagaatacaatatggggtaaattttattgagaatgcatcagtgttctagtacctaaatggttgcacaagtcattgaaaatgttatttcctaattcatggcaaatgtattgatgtttgtgaacattttttatttaagtgtggtttataaggttgtgtgggatgatgcaaacataaagtacttcattgacattagcaatgaggagatagaagctgagaataggccaaatgtttgttggactagacaaggtttttgattttgacgctacttgcaggtgtgtttgttccatggaaaagattcctatagttcaattcagaatcaccttctaccctagatttttaaattcttgtcatccatgttacaagatgtcatgctcctatagaacttatagttgatagttgtttaaaccaaacaaatttcagttttttcataattattggctcactgcaagtttatcatagcttatttacatctaaaatcagattttcaaaaaaactctacaactaaattaaacaaaccctcgagtcacttatagttgatagttgtttcaaccaaacaaattttagtttttttcataattattagctcacagtaaatttatcataacttatttacatctaaaatcagattttcaaaaaatctacgcctgaactaaacaaaccctcgagtcaaatgcagctggaacaccagtataggccaaccaccaatctttacatttcatttcccttcacaacagatatgacacccatcttggagccacacaggacacagcccaccaggcccagagccttcctggtccaaaagacacgcggccttctgcacgtccactcaagtcaacaacgcaacacagacacccactcgcgccacgtccacgggtgacgtcacagaagatagaagcaacacaaaaccgtcgcgcaagcgcaagtgcgcaaccacaagccaagccacagccagccggcgaacccatcagttggggttggggaacctgcagtcgcggcgtatctcgccgtcggccgccgtgcggaccccgaccctgccgagcctcgtcattgccgcggcaaagtccccgaagaaggcggcctggtccgcggcgtagcgctcgacggcgccgcgggacctcgggtcggcgtacagcacctggtcggaggccaggatccccatcccgccgagcaggttccggtagtactcgttgtcgaaccgcagcggcgtcgtggcgtccaggaacgcgaacccggctggcccgccccccgggcagcgcgccaggacctgctgcgcgagcgccgggtccatggccggatccgcgcccacccggtacgcgaaggagccgcacgacgccgcgccgatcgtgtgaccccctgcttgcacagttgcacgcagtggtgcatgccacgcgcaagaacggccgttagcgacgggcatggcttcacggctgcacctgcacttcaggtgttcgttcgcagtagcagtagcagcggtatgcatgctcttggcgtgttctactagctgacgcatttatatatggacacgcgcgcgttgacacgtacctgacagtgcgatcatgtcggtctgggagagaccgaggctggagaagaaggcgttgagctggtcgaggtcgaacgtgccatgaggaaccacgacgctgccaccactcgacaccctgccgtcgaacctgcccagctccacttcgtagtctggccctccgctctgcgggccgtacgacgcacgatggcacgagagagacggtcacacgatcaactcgacaacgaaagcgaccgagcaaattcgcgtagttaccaggaacacggagtccctggcggcgagggccaagatgtcggcgcaggacaccatgttccggcactgcgggtcgctgtccaccgccgccttggcgctcatcaccgtgctgaacccttccggcttcagcatcacgccgtcggggctccgccactcgtcgccgccggccgggtcgatgagcatcaccgacgcgtcgcagcccttaaattcacaagagagtggtggcaccggcacggcatcagttctctcatcggcatcatccgtattataatcgcacgcacgtaccctgaccgcgcagtcgtggaagaagagccggagcgtggccggggcggcgagcggcgagagcgccacggactgccgcacggcgccgcggacaatgctctcgaggttcgggcagacgccggcgtagtagtccggcctcagcttcggctgggccgtcgccatcagcggaagcgcgaggaggaagatggcggcggcggcggcggccaggaactggaggcgcctcatggtactgccgctagctaggctcgctcttaagtctgctgtttgtttactaatctctcttaaattagctaaggccgttaggctgcaagagctcgcggtggttcgcaaacgatgacagcgtgggtttatatagaagacaagaagtggcgtgtggcgtccccgcgctctcacaaaaaaaaaaaaaaaataccataccaggggtaccgag

SEQ ID NO: 20139 - DNA, 1299 bp, Zea mays
acataaaatcattcaccctcggccttggtatattctccacgcgagtctccccatcttcttttcctcgcttgccctaattccgcatccccggctgaggcagcagcggcggcgccggcagcggcaccggctcaccagcgataccaggaagaatggggaggtacagtcccgcgtacagccccccgaggagaggacatggcggcaggggaaggagcccacctcccaggagaggatatggcggtggccgtggtgaccatggctctgtcagcctcctggtccgcaacattccattgagatgcaggcctgaggaactacgtgtccctttcgaacggttcggccctgttcgggatgtttacctgccaagagattatcacactggggagccaagaggatttgggttcgtggagttcgttgatgcttatgacgcttctgaggcacagtaccacatgaatcgccagatgtttgctgggcgtgaaataactgttgtacttgctgcggatacacggaaaaggcctgaggacatgcgtagacgaactggaccaagaggttattctggtcatgaagggcgtcgtccgaatcgtcatggtgcaggacggtcccgttctcgttcatactcgcgttcccgctcaccacgccctcgtggtcgtggtagatcacagtcatactcccctgccccgaaaaggcgtgatgactactctgcttccccaccccgggcaaaggaagagcacccgaggtcatcaaaacagcctaaagaaaataacagggataggaggagatcctatactcctgatgatataaatgatcgccgtggtgcagacaatggtcgtgatgagaggaagaggtccccagcaggcgaggaggatgaggagcctcggcgcggtcatcataggtcaccccggccagcgtccatgtcacctcctgggtcacggtcaaggtcggcgtcgcctgctatcagcgactgatgaatgtggcggcgatggaactgttggccccatgattggggcggtttgtcagactcttgttatatctgctgctaggctctgttttgattttcctccgtggattgtttgtgtatgtggggctaagtccggtggttggtttgctcggaatgaaatgagtgggtggtgcgtttgtcggtggagactctgcttgtaacctggtatggtattagtggcatttgttgctgctgttttaggatgatgatgatgaccgtaatcattgtgcacatttattactgttcccgttttaaatcataaagctttgtctggtttttaaatgaaaaaaaaaaagcggccagcggcc

SEQ ID NO: 20140 - DNA, 1236 bp, Zea mays
  misc_feature (13)..(13): n is a, c, g, or t
acgcgagtctccngttgggaccctcctcgccggccgcgaattccgcatccccggctgaggcagcagcggcggcgccggcagcggcaccggctcaccagcgataccaggaagaatggggaggtacagtcccgcgtacagccccccgaggagaggacatggcggcaggggaaggagcccacctcccaggagaggatatggcggtggccgtggtgaccatggctctgtcagcctcctggtccgcaacattccattgagatgcaggcctgaggaactacgtgtccctttcgaacggttcggccctgttcgggatgtttacctgccaagagattatcacactggggagccaagaggatttgggttcgtggagttcgttgatgcttatgacgcttctgaggcacagtaccacatgaatcgccagatgtttgctgggcgtgaaataactgttgtacttgctgcggatacacggaaaaggcctgaggacatgcgtagacgaactggaccaagaggttattctggtcatgaagggcgtcgtccgaatcgtcatggtgcaggacggtcccgttctcgttcatactcgcgttcccgctcaccacgccctcgtggtcgtggtagatcacagtcatactcccctgccccgaaaaggcgtgatgactactctgcttccccaccccgggcaaaggaagagcacccgaggtcatcaaaacagcctaaagaaaataacagggataggaggagatcctatactcctgatgatataaatgatcgccgtggtgcagacaatggtcgtgatgagaggaagaggtccccagcaggcgaggaggatgaggagcctcggcgcggtcatcataggtcaccccggccagcgtccatgtcacctcctgggtcacggtcaaggtcggcgtcgcctgctatcagcgactgatgaatgtggcggcgatggaactgttggccccatgattggggcggtttgtcagactcttgttatatctgctgctaggctctgctttgattttcctccgtggattgattgtgtatgtggggctaagtccggcggttggtttgctcggaatgaaatgagttggaggctcgtctgtcggtggagactctgcttgtaacctggtatggtatcagtgccatttgttgctgctgttttaggatgatgatgatgaccgtaatcattgtgcacatttattactattcccgtttccaatcataaaactttgtctggagccccta

SEQ ID NO: 20141 - DNA, 971 bp, Zea mays
  misc_feature (839)..(839): n is a, c, g, or t
  misc_feature (862)..(862): n is a, c, g, or t
  misc_feature (878)..(880): n is a, c, g, or t
  misc_feature (925)..(925): n is a, c, g, or t
  misc_feature (927)..(927): n is a, c, g, or t
  misc_feature (935)..(935): n is a, c, g, or t
  misc_feature (942)..(942): n is a, c, g, or t
  misc_feature (947)..(947): n is a, c, g, or t
  misc_feature (949)..(949): n is a, c, g, or t
  misc_feature (957)..(957): n is a, c, g, or t
  misc_feature (963)..(963): n is a, c, g, or t
aaaatcattcaccctcggccttggtatattcgcgacgcgagtctccccatcttcttctcctcgcttgccctaattccgcatccccggctgaggcagcagcggcggcgccggcaccggcaccggcaccggctcaccagcgataccgggaagaatggggaggtacagtcccgcgtacagccccccgaggagaggacatggcggcaggggaaggagcccacctcccaggagaggatatggcggtggccgtggtgaccatggctctgtcagcctcctggtccgcaacattccattgagatgcaggcctgaggaactacgtgtccctttcgaacggttcggccctgttcgggatgtttacctgccaagagattatcacactggggagccaagaggatttgggttcgtggagttcgttgatgcttatgacgcttctgaggcacagtaccacatgaatcgccagatgtttgctgggcgtgaaataactgttgtacttgctgcggatacacggaaaaggcctgaggacatgcgtagacgaactggaccaagaggttattctggtcatgaagggcgtcgtccgaatcgtcatggtgcaggacggtcccgttctcgttcatactcgcgttcccgctcaccgcgccctcgtggtcgtggtagatcacagtcatactcccctgccccgaaaaggcgtgatgactactctgcttccccaccccgggcaaaggaagagcacccgaggtcatcaaaacagcctaaagaaaataacagggataggaggagatcctatactcctgatgatataaatgatcgccgaggtgcagacaatggtcgtgatgagaggaagnaggtccccagcaggcgaggaggnttgaaggagctcgggnnnggtcatcataggtcacccccggcagggtccatgtaactctgggtnanggcaggtngggttcngcctntntcaggatnatgatntggggggc

SEQ ID NO: 20142 - DNA, 2305 bp, Zea mays
ggagcgaaacaactgcactgtaaaattgcataagatctgaaagaggtgtatagttcattttgcatcagaaacctcatgtaactaggatgtacaggcgtgaccatgtgaagttgaatgcttctattactgtttcttctttttggtggtttcgtcgcttctgctaagcagcaacacaagccacccggatcttacattatggaacttttcaaagttatagaatctacaaaatctggacatgatgcctatagacagcttagcaagagctaagcaagcgaaaacaaaactgagaaatataacagcaagactcctgttctccatgtcagtctgtttttgccgaaatatttcaaattccaatctgagtagagcattatccaggaccagctggtttagttgcgaggaagcaactaacttccatgagaggaatccatcaacttcattcataatgttatctttgctgctctcaagattcttcagctctgattggatcttctctaacaagacatctttgctatcaatatcggcatcgaaatccttaaagatttgcccatatctgctgttcaactccactaggtacctctccaaaacagagaagctcacatcaagagattgaactttctgcattagcaccttaagaactgtatctccaggaatcctgccagcctgaagtgtccttgcctctgaaactggatcattagcaccattcttcaatgaatcaccgtttggtttatcatcttctagttcaaattcatcttcatcaagggtttcctgtgagaattcttttcctccagcaggatctttcaaataaattttctcaatgggttccttagtcttgtcatcaggttccgttttcttattctcaactggaatcaagttttcaagcatcttttctacagcatccattccatacacttcaagcacactgagagtacagtagaactcagaaccataatggcttaccaagttcagtttcaaatatctagcccactttggttcaagaaaagtgaaattttgagcaagttttgcattcgcggcagtgaatcttccaagagtttcccagttttctgtgggatatgtcagactgctcagcagttcaaattcttttggattagaagaataatgctcaaaatttgcaattgcgattgtatctactaaggtttcttcagaaagctctatgatgacaaacttcccctctgctgagcaaggattgcggaggtacttgtctttgtctttatctaagatgttggaagcacccttagcctccttattgaaatccagaaccttggcccctttagaagctgcagcataattatacaacttcccactaggctcccttcggtggatgatattaccaggttgactagaaataccaggtcccctttcagcaattgctcttgtcttgaattcatcgagatcaggaggagcaacccgtgatagtctcggtggtctaggcaaatctttactctctaccttctcccctggttgaactccagaatcaacacccgactgaggaagatacccaccctgatctcctgaaagctcaacctgactgtctatggttacagcttctgtgttctcattctgcacctcatcactggaacacaactgatctgcttgcaccagtgtatcctctgaaagcacagcgttttcgtcagaattaacacagctatcacctggcatctccaaatcctctccatgctcttcttgtacaaccggattaatcggaccaacatttacagcaggctctacaacagtaagatctacagtagagcctcctccatctcgttggccgtcgccgtgtccgacgagggagtggaggaggagcacggcgacccacgaggcgacgacgagggaggcggagaagccgtacaaacgcctcctccttccgttagcggcagcctccgccaccgcgctctgctcctgggctgccgccgtcctccgcagaagggctcgccgcgacctctgcattcgttccctgcccctaccacggccttcacttacatccgcgccaggaaaccgcaccctcccgtacgacaaggactagggaatccggccgacaccgagtaggaacggtcggaaatcagaagcagcgcggcgtccggcgcgaggcgacgcgggccggggactgaggctgcggggacgcggccgcgtggcaccgggcagggggtagggggttttgaaacggccagagctccatcaggaggggacgaagagggaggcgtttatggcttttgcgctcttccccgcccggcctttctgcttgtcttcttcacgttggcagtgtgaaactcccggcccggccggcctg

SEQ ID NO: 20143 - DNA, 1254 bp, Zea mays
ccttgaacatgtgaggttgaatgcttgtgttactgtattatcaaaatggtggatatgatgcaactgctaagcagcagcacaagccacccggatcttacattatggaacttctcaaagtcatagaatctacaaaatctggacatgatgcctatagacagcttagcaagagctaggcaagcgaaaacaaaactgaggaaaataacggcaagactcctgttctccatgtcagcctgtttttgccgaaatgtttcaaattccgatctgagtagagcattatctaggacaagctggtttagttgcgaggaagcaactactttccaggagatgataccttcaatttcagtcgtaatgctgtccttgctgctctcaagattcttcagctctgttttgatcttctctaacaaggcatctttgctatcaatatcggaatcaaaatctttaaatatttgcgcatatctgttgttcagctccactaggtacctctccaagacagagaagctcacgtcaagagattgaactttctgcattagcaccttaagaacagtatctccaggaatcctgccagcctgaagtgtccttgtctctgaaactggatcattagcaccattcttcgatgaatcaccatgcccatttggtttaccatcttctagttcaaattcatcttcgtcaagtggttcctgtgaggattcctttcctccagcagactcttttaaaggaacccattgagcaaattcctttatcttgccaccaggttccgttttcttatgctcaactggaatcaagttttcaagcatcttttctacagcatccattccatacacttcgagcatactgagagtacagtagaactcagaaccataatggcttaccaagttcagtttcaaatatctagcccactttggctcaagaaaagtaaaattctgagcaagccttgcatttgcggcagtgaatcttccaagagtttcccagttttctgtgggatatgtcagactgctcagcagttcaaattcttttggattagacgaataatgctcaaaatttgcgattgcaattgtatctactaaagtttcttcagaaagctctatgatgacaaacttcccctctgctgagcaagcattgcggaggtacttgtctttgtctttatctaagatgttggaagcacccttagcctccttattgaaatccagaaccttagcccctttagatgccgcggcataattatacaacttcccgctaggctcccttcggtggatg

SEQ ID NO: 20144 - DNA, 1810 bp, Zea mays
ttttttttttttttttgtttgaagttaaatgtcgcttacacttttagttcctgtcttttacacgtacaaacaacaaaaagaatcaatgaaaaattaccgggcctcacaatatacagaaaagaatcactcaataaaccaacatctcagtatcagtacaacatctcgtctgcctccgatctggtccctccaggccctgccgcctcctcaccggatgtggcttcttgagaatgacgagagcccaatatcacgcacaggagtctgtgttctaactgatggaaatatgttccagaaccgtagagtttcgtcacctgcccctgttactatggtctgtccatcaggcgacgacgcgaggtaaagcacacgcatcgtatgtccagttagagttgcaacctttgacatggatgggtacttccacaccatgatctgattttgggaatatccatgtgtgctcacaagctcattcacatttttgcaccaggcaaggttgcaaacctggctgcctgtgtcaattgagttcagaacatttccgttagccgtgttccaaaacctgatgcatctatcagctgttccacctcctgatgctaggagtccttgctgatgtggtgaccacgctattgctttaacagcagctgtatgttctgtcaaccgcaacactggctgttgcgatcgttggttccagactaataactggttgtcatttccgcctgaggcaagctcgcggtcgtcatgcgaccattcgagtccacaaacctctgatctatgaccagaaaacttgctgatatagtcattggggacacggatgtcatgctgcagtatgttcttgtccctgctacccgacgacaaaatgcatgagctccatgctaataccccagtccttgtttggtgacctcccatatttctaatccgcttacagcgagaactatcccaaatctggacatctccaaggccggtgccaatggaaagataagagccttcccgtgaccaatgcactgcgcatacgctgtccctaggccccaaatcgcagagcttggtgaccttgctattggacgcggaccagaggtagacgcaggtgccgaggccgacagcgagcacgttctgcgaggaccagtcgacgaggttgagatagaagtcgtcctgcagggagggcgcgtccaggaccttatgcggcgttttggggaccttcctgggtggcttctgcggcgacggcgcgtctccagatcccccggtgcagtcatggtgcgcggcggcagctttagcgaagggtgaggtgggagcggagtggtctttcttgaagcggaagaggttggtgttgggcgaggcggaggctgcggaggtggcggtggtgggtttgggcgaatcggggccaaagagctcggcgcggaggaggcgggagtagggcgtgtcgtccttggctggggagagaggggagtcgattagcgcgaagttctggaggcgggaggaggagcggcaggggatgaaacggtcgctgtaggtggtcttggatggggagggcgtcttgggaggttcggcgagtcggcgggagggggacggcatagagggtcccgcccccagccccacgggatcgaggcggagcgcggctgccatggacggtggcacgttgaggcgcggcttggcgtccgaggccggcgccgccaccgccatggtggatgagatggattactggagatggctacctcaagaatccttcctccgcgtcgcctccttggatctcccgatctcaatttcgatctctcctcgacgaacaaggaagggcctcgatcgagggaaggcagggcaagtgggaaaggag

SEQ ID NO: 20145 - DNA, 3201 bp, Zea mays
  misc_feature (2170)..(2170): n is a, c, g, or t
  misc_feature (2215)..(2215): n is a, c, g, or t
  misc_feature (2502)..(2502): n is a, c, g, or t
  misc_feature (2598)..(2599): n is a, c, g, or t
ctctctagtcgacctgcagtatgttcttgtccctgctacccgacgacaagatgcatgagctccatgctaataccccagtccttgtttggtgacctcccatatttctaatccgcttacagcgagaactatcccaaatctgtttcaagtattagggttacctgtatgtcagtacatcttattcatggatttcagaaagaatttgaaattgccatgaaacctggcatcgtagttgcatgaatacaaatgaagcaattccttatgcgatgccatattaagctaccatatagttgaataaagctcagttccaagtgtgacctgtgattaattttttggttgaattgcatttgtgaaacaagtgaaaatgtgagaaatacatcagttcagattttcagataacaaaactgcattagtgaatagatcatttcccatttggcactagttaggtttgagaactgactcatattgcagtagcaacatgaaaatggagggagcgaagcaaggcatacctggacatctccaaggccggtgccaatggaaagataagagccttcccgtgaccaatgcacggcgcatacgctgtccctaggccccaaatcgcagagcttggtgacctggattttggttggtgggttaggaggcgtcatcgaatccatcattgtcactgtcctaccagaggtagacgcaggtatgcagcagtaatcttgttcgtatagctgagacagtaccttgctattggacgcggaccagaggtagacgcaggtgccgaggccgacggcgagcacgttctgcgaggaccagtcgacgaggttgagatagaagtcgtcctgcagggagggcgcgtccaggacctggcgtgcataatacggacgcggcagggttgatcaacagaactgcccacgaagtgtttgtgggattgtcaagtaggaaggaaggaagggaagaaatgaaggcgcgttgcctaccttatgcggcgttttggggaccttcctgggtggcttctgcggcgacggcgcgtctccggatcccgcggtgcagtcatggtgcgcggcggcagctttagcgaagggtgaggtgggagcggagtggtctttcttgaagcggaagaggttggtgttgggcgaggcggaggctgcggaggtggcggtggtgggtttgggtgaatcggggccaaagagctcggcgcggaggaggcgggagtagggcgtgtcgtccttggctggggagagaggggagtcgattagcgcgaagttctggaggcgggaggaggagcggcaggggatgaaacggtcgctgtaggtggtcttggatggggagggcgtcttgggaggctcggcgagtcggcgggagggggacggcatagagggtcccgcccccagccccacgggatcgaggcggagcgcggctgccatggacggtggcacgttgaggcgcggcttggcgtccgaggccggcgccgccaccgccatggtggatgagatggattactggagatggctacctcaagaatccttcctccgcgtcgcctccttggatctcccgatctcaatttcgatctctcctcgacgaacaaggaagggcctcgatcgagggaaggcagggcaagtgggaaaggaggaggactccactgcaggaggggagcggaagagaggcagcggcagcaacggtcactagtcgctttgtcggtcggtggactagccgttggatggagtatgggccaattccactgcgcgcctgggcccatttttttgctgacttctcttgcttttgcatatatatatatatatatatatatatatatatatatatatatatatatatatatatatatatatatatataaaacacgggaaaatccattttatccctctaaaaatttaatgttagtttttttattcctcaactataaaatccaaaacagcttcttcatcgtctcttaaatttaaactggacatgtcaccctatggcagtttttctcaaaagtttctatttttctttatatttattttatctaaatctttaaaacctatagtaaatctaatagaaatcataaaataaaaaatatataattacactagaagactctatatggaagaatacaattgagttttctaatgagaggcaacacatcagacagggatacaaaattacaatacttagcgtcttaaactangacagattgttgtctctgtgtttaccatcgagtttggcttacgcngaaacgctttaaaccctccttcgggtaacccatagtaggattaatggtcatcaaacactgagaggtggcattgctagataggggctttcaacaaaaagacgcgaaggtcgatagattgtgtcaagttcattgtaaattttaatagattttaatctctattccaaatcagacgctgaaatgattcaacttgcatgagtcctactcatacatgaccaagtttttgagtcacctcccaaggcattgatagatgcggtccaagtctagttggactcccttttggactcaanaataccacttcaatctaccacaaagtggtcacaagacaaattattcactcactcttgcacaagaggagggatacgagcaacaaatcccactgatanncatccaatgaggcctagttcttaccaccaagatagatagaaatattatacactatccaagacttcgactatttagtaacacttctacttctcgtgtagtctcttttaaggattagctatcataccaagctagagtcaccaccttatccatcttgattatcgagccctgcactaccaatagcatagcaagctatgatcttacaaatgttgttggttcatgctacccgatatacaacatgatattgtccctaccaccctgggagtaaacaatggctacactattgatttgtcataccacaccttagagcatataatgtctatgtcgtttgctcctgctatccgacacacaacagtatgttgtccctgccacccccgtggagcatacaatggctatgtcgttggtttcggctacccgacatatataggatgttgtctctgtcatcctgggagcatacaatgactacatcgttggtttctgctacccaacacacaatagaatgtcttcatgtaacctctagatcgaagcatacaatgtctatgttgttggttcttgctaccttgcacacaaaaggatgttgtccatgacaatcctaggagcataca

SEQ ID NO: 20146 - DNA, 826 bp, Zea mays
ctctctgcgcacgaggttgtcataaaatgcatcaagaaatatcgtaaattggagtaaatacaacaagaagtgatcttccaaccagctcttccaacaggtcatcttttaccattctctcaatgtcccttcctgccctgtcgatgcagtctgctaaacctagccacttcggatcaaatcctttcttctctggcttagtcccttttctcatcatcttcaaattcttcaaggatgtcttcaaccagcaatatgggtttctcatcgcttgactgcacttcggaggataaacaaacactagttccgcgaaaactacttgcctctgcagcagtctcccttggtgcagatgtgccaagctcaagcctcaatgatgcagctgctagaagcctcgagaggctgatttctgtagaaataaaaaaggcgaagccttccagcctccttccgtccgtcctccgagcccagcaaacgccgtggcccgccaaccattccctgtgtagcgtgccgcgtcgtctttgagttccatctccttcctcccaaaatcatccccggtggccgtctgtggccgtcgacgccaccagcgacgccatgcctcaccgctatgggagggaggaaaaggaagcacctgttggaagcgcgcaacaaaaaaaagcttgcgcagaccggcgatatccagcttctagcatcgctgccatcacggaggacgtggctagccatgggcggaggcatggtgcccatcggcgaacggaggaagatgatgccgccgcgctgccgtggaggaaaatgggagacgaagaaacgggcgcgggatttaggggaaagaaacacgctggtc

SEQ ID NO: 20147 - DNA, 3469 bp, Zea mays
  misc_feature (36)..(36): n is a, c, g, or t
  misc_feature (78)..(78): n is a, c, g, or t
aaaaaaccgaaggaagtatattccagcctccttcancacatccaattattttagaacaagtgtcttttctccttcctntctttcttttcttttttccttcgtggcctcatggggcttcgaatgaggccgagggttggtggtttggctctgggtgcctttaagctgttctctaacaactatctacactgcacaaatactgaatcccgaacatgatcaacttagatcaaaaccagcttctgagtttatcgcatacaatagtttggtttgcatctgctccttgcttttatagggtggaagcttcagaaggttcatgcaggtagctgatgtaggcaagcggtctgcatgctcctccagccctggaacaccagctctctgaatgcagaattttggttcgagatactgaaatccaaggagggggccacgagaacatccagtaacaaacttgagaaactttttctggttgtccgaacttaagctcttcaagacctcccaaaacatctcaataagctcatggtccggatgatatcctgcagaatagttggtgttcgaccgcaggtcatcaatatccaagctttctaaagatccagatataagaacctgaatttcatgttcattgaacatatcaatccaatcttttggtataagctgctgaaaacctctcaagaagtgtgtactttgtgcacggatctggtagtttaaccgatgattggcgacaagatggataaaagtaataacattatcatttgttacacgcatgtgcctcccaccagggagaagttcttcttcacattgttcaccatattcattatttacaataacaaaatatagttccaactctgagatatcaccattataatgctttaaaaatagaagatgccgatacaattctggatccaatgaaggaagatcatttaaaaaattgtacttttgtttcaccttgctcaagaagaacgttgcaaacggcaagtcaacaagtatgccttcatacattgccttcccaagtagacttccaagaaaatggaaatattgcagatgtagttcatgaaccaatcctgatcctgggtttgggtacaaaagatgatcagcagtctccttgaagagaccgtactgcacatcaaaagccgctcgagtaatattttccatgaaatccttgaaaattccaccaccatcaattccaacctcttcctcaccatgttcattaataaatgaaactcgaatcggtcctttgagatcttcttcagaaagcaaacttagctgatcaaaagcatcttccaaaagtcgacttcttcttattttgaaccgctgtcttgtcaatgcagaatgtgatgttgattgtctagaacacgttaattgggaagtgaatattttgactcgactggtaaatggagccaaaaaaggagcaagctttatgatctctgatgctcgagtattaccaagtattgcttgagaacccgtggcatagtcatagaagatgaaagacatttctattaatccaaaaaagcataggcatccatacttgagacacaaaattttcgctcgtagcttcttgagaatagaaatcacttgcagcagtgaatggtagtcggctgttccagtcttgcaactgtgtgagaagttcagattacccaaccctagctctagtcctgacattctccactgacaactttttaaggcctgaagggttgggtgacactttctgagtacacgaggatgcaataacccacagaagttgccataatgcctgttttaaaatgagaaccaaggacttcgaatctttaagggaaaggggtttctcctgttcatagaactccccggtatcaatgatcttcaacatgtgcttgtatatgggacaggatacagacatgggaaggagccaaccaggagaatcagcaggtaatgaagatgcaaacttcaaaaaaaatggccatcttcggcttgcatggcaacgttttatgaacttccatagtgcaggaacaatttcagtccggtatgccaggacagtcataattcgctctagaggaaatgtattgaacgtaacatgaagaaaagcacaaatagatcctacagcatcaacttcagcatctgatggtccagacagatcagaatcatttgtgcttaatgtacctctgaagagggcattcaccaaatgttgaagtagctttgaatcaattgctgcagttatctgtctttccaaatcaacatcaagattaattttaatattgacatccatgggcatctcatcatcgtcatctgccctttcagtaggtgttgtgactgctggcaacgtaccctacaacgaggtacaaacagcaatgatgtcagccgctgaatcagaagctaactttgcatcagacaaaatccaggttgcagcttcaagaacatttgcaaggacgcacgcatatcctggatgattagctgatatagcgtttggaaggacatcaacaagactgggcaaaaggcaagctatttgatggatataatatttgttgagcccgtttaacggagaaaaccttcttgagttgtggtaaacgatgccatagaaaagggatggacagaagctgagacgagaaactccatcttggatccactttcagacaacaacagggatgatggccaacatgcgaagcaacaagcataagcacttgctccagcacagatgcactatcaaaatgaccagaatttctgacattttgcggtacagatacgataatgccacgaaataagcaatagatctttctctgctgaagataaccaactactttgcagttccaaagaaattttggatttatcaagcaacctacagtttccagtaatgacacagaaggcactgatgtggttccaggtgttgttaaaagttggctgccccaatcatgcctcttttgatagactgcttgcacacagatgagggcaaatttttttactcggtgagcaacaagaggttgcagcgaggagccattcacaccagtgaagagagttacaacatctccgccttgtttaacatattgcagcagcaaattgcagacatgacaaagtatagctatgtcattgtcttcatttgcattgaagaagaacagtaattgccgaagaaagtcagaattagtgccaaagatgttccactctatcctctcgcaatgctccccaaaagttgagcaaaaattcttccgaacctctgagcgggccaattccaaagccttcttccctctgaagaatttctggatcttcgtggcggaggtgttctggaggcggaggccctggcgccggcgccgctcctcgcgcgtctgctcgagcagcaccttgcggtcccgctccttgctgctccgcccgccgaggtcgacccgccgccgcgccgatgggtcaccggagaagaacatcgccgcctccctcacgaggtccgggaggcgctagggtttgggagccggggagactccgggatgggccgagcgagtagggcgatgacgagacgtgcacg

SEQ ID NO: 20148 - DNA, 892 bp, Zea mays
ttttttccgggccccccctcgtgtttttttttttttttttgaccgcaaaccagcattgattagatacatataaaatttctgtataaaatgatgcacatatgtacatgcccatgattgattagacagcgtctgcctatttctcttggagaacgaagcccttagttagcagacagctatattgcagcctccctccagacattcaactactctgagaaacaactgcgtttctttctttttttccttcatttccttcattcatggggcttcaaatggggccgatggttggttgggttcggcccttggtgcctttaatagcgactatctgaactgcaaatactgaatcccgatcatgatcaacttagatcaaaaccagcttctgaatttatcgcgtacaatagtttggtttgcatctgctccttgcttttatagggggggagcttcagaaggttcatgcaggtagctgatgtcggcaagcggtctgcatgctcctccagacctggaacaccagctctctgaatgcaaaatttcggttcgagatactgaaatccaaggagggggccacgagaacatccagtcacaaacttgagaaattttttctggttgtctgaacttaagctcttcaagacctcccaaaacatctcaacaagctcatgatcctggaaaaagaagccatcacttcgctagataagatcaacaaaaatgatctgaccttcgagcgcgggggcgtgtatttgatatttgtcaccttttgtcataaacccaatggtccatcacctgctcgtaatggtacagttgaaccaactagacatgtgtgggcttgttcggttagctctcaatccatgtggattgagtgggattgggtgggtttaaatcccaaacaagtcaaacttat

SEQ ID NO: 20149 - DNA, 1714 bp, Zea mays
ttttttttttttttttcgatgcaaattgaagaattatttgctaaggaaaaaacagcaagttcaagaaatacaatcaagttctgtaaggcatgcatgatatgtacattgtatttacattgtatggtaacctgtgcacaagcacattacaaaccctacacttcacatatttggtctaaaagcatctacatcctaattccacttcgattctttaccttgcatctcatcacgcctggattcctcccatgactggcagtgaagatctggaattgctatcacagatccatcggaggtgtgtccttgtgcaaaagatcgtgggcaatgtagtcccaaggaagagacacagacatcaagcaacacttcagagggacaagctcatcatccatttgtctgttagcagatgaagactcataagcatgcttcactagctttgatgcagcagaagctgctctgtgaacaaggactcgaaagctatctcctggatctttcttcgacttcccactgctctgatctgcaatgccagagacagctacttccacctctccacgtccttctgggcccttcataaaaagtctgtcgagcttattgtggtcatgcccaagtgagaggaaactcccaaattttgatctgcaagcatcataagccccacgaacattttggtagcccacataagctgagaagagagttctctttggtggtttttcttgggcactaccacagctcattccaggctgtgtatttgaaacaggattcttgcactcactttcttcgggaaatgctgccccatcatgtgcgttaagaatcacacaatagcagtgttcaggatctgacaaaacctggacagaatgttgtacaactacaactttgatataattgcacagaaccttaccacagcatcaaaagtatcatcgaagtcgtctacagagaaaaagatgttgggatatgccggtagtgtttctacagcctttcttctgtcaagatgaaaatttacacggctaggagacgcgtatacattttttgtaaccttataaactggaggcaactgtttgtttttcactgcacggttgcgaagatcttcaattccaaatattgcaacagtgacagtgtacgacgtgtgagcgattaaattcaaatagaatgaacgctcccaatcaacctccactgtattaatactgatcttttcaagcgtgggagcccatctccgtacaaaaaagggaggtggatcttccatgttatcattgaaaccataaccatgcaatttcatgttattaacaaagaagacaaggtcatcctcttcacttctttttgattgcctgccacgcacaaagaataggtcaagcatttcatgccagaatttatcatccattcccacatctgatgcatcatcctcggcaccaataatcgtccacccaatcaaatgtgagtgcttcttcaccatgctcaacaactcggtccttgagggcgatgatgatacatccaaggtgccgctgaatctgtggacggcaacctcgctggacggggagcgggacgaaggagaaggcggcgcggccatggtgacgggattggggaatccgaccgattcctgggcacgcgtgtcgaaactcggaagcaaagcaagcaatcgcacgcctcctcgctctcctctgcactgctgcactgctctcctgcacagcacggttggccaggccgaaaaagttgtaggaaccaagtccgatct

SEQ ID NO: 20150 - DNA, 742 bp, Zea mays
  misc_feature (59)..(59): n is a, c, g, or t
  misc_feature (219)..(219): n is a, c, g, or t
tgataggagtgggcacattctgaagtgggaatagtggctgttgtggtggggggccgcancaactatggggaggggcgtgagacagctgattgttgtgggtgatgctgcttgtggcgaataccaagcttgcgctggggcagcaggccaaattggggggggggccatcaaaggagtgagtgcgggattatagattgggggggccacaccataaggtgggcncggaggaaatgccatgcctagcgaattaggcgtaataacaggccttacctgagggcgcttctactttgggtacctttgttgaagggtcttcctcttctccataatgagcagccaatacatgcgcaggaattccctgcattccaaatatctctatctccgttgactccctatcaggctttgcattaggaaccttgggcacggactccttgtggacctggaggacgtgtatggccatgccagaggcggtggagagcttcttgtggcatacgtggcacttgaagtgcttggccttctggggctggacgaggatcttctcgtcgtcgaactcgcggtcgcagtagtagcagaagaccttatcgacgcgcttcttcttcttccccatcggacgccctttgatgtgcaagtctctctctcccttggccggcggcggcggcggcggcggggtctaaggtaggttagggtttcgccgagaggtcgcggcagcggtcagggaggggaggaagaagccgagggcgagacgtct

SEQ ID NO: 20151 - DNA, 1696 bp, Zea mays
  misc_feature (1693)..(1694): n is a, c, g, or t
  misc_feature (1696)..(1696): n is a, c, g, or t
gggcccccccctccgccgcccccccttcttttttttttattataatccgtaacatttttaagttgctttccagccaatgcacagcattaggttcaattggcaatagcacatgaccaggttacaatcgggcagaaattgaggtgttcatcaatatattcccaatgaggcgacagttggaccaaaataactcctaagtgctgctaattcattttcttgtcgatgctggaaacatagaagaacaaaggctcgacactcaaacaagtcagaaacaacacattcctcttaactgcagcaactccattcgctaactaaatgaagagggccgactgctgcacagcgagatacaagcgcaggcagagtccttcggtgaaatgcaagggggataatctaccgagcaaagcccagattcttcatagggccatgcgtcctgccagccgactttctgatattcttcgatcaattgctgcgtcaacagagttcatctggctagtttcatcatgcacctgatactttggcaacgacaaccttctttcctccattgacattgcttcatcatcccacaccagatatacctcattcgtagctggttgggcaccagacgccttattattggatactgcaggtgaagatccaactgctggatctctagtgccttggttattggttccatatccaattcctgcaacaccgactgctgctggagagcttgctggaatggttccaggtgcaacagatgctaaaaatggggaatttacagctccattgacagctgaagtgttaacaggaaacaaaggctgggaaacatgaggggcaacaggtgaaggtactcctggaggggccataggaaacgatgtttgaagtacattagcagctgctgatgtcataggagtaggcacattctgaattgggaatagtggctgttgtggtgggagcccagcaactatgggaggaactgaaacagctgattgttgtggatatgctgcttgttgcggataccaagcttgcgctggtgcagcaggccaaattggaggccgggccatcaaaggattgagtgcaggattatagattggaggtgccacaccataagctggtcgcggaggaaatgccatgcctagcgaattaggcataataacaggccttacctgaggcacttctactttgggtacctttgttgaagggtcttcctcttctccataatgagcagccaatacatgcgcaggaattccctgcattccaaatatctctatctccgttgactccctatcaggctttgcattaggaaccttggtcacggactccttgtggacctggaggacgtgtatggccatgccagaggcggtggagagcttcttgtggcatacgtggcacttgaagtgcttggccttctggtgctggacgaggatcttctcgtcgtcgaactcgcggtcgcagtagtagcagaagaccttatcgacgcgcttcttcttcttccccatcggacgccctttgatgtgcaagtctctctctcccttgggcggcggcggcggcggggtctaaggtaggttagggtttcgccgagaggtcgcggcagcggtcagggaggggaggaagaagccgagggcgagacgtctgggtctcgtctctcgtctcgtgcgggctttttttggttggtgggggacggggggcttcggtcggtcttttttttttttttttnntn

SEQ ID NO: 20152 - DNA, 1752 bp, Zea mays
ctgcaacaaatagtacacctttaatctaaaagcccaccgatgggtgtttgctgtggtcatctcccggtaaccaggctaaacccgtgtcgtggtaggcagagtgcacctaagaccccctgcagaatctttgggcattatccctgtaccccggactgtcaacgaacgacaattgagggacaaaatattaaaatccgtaacatttttaagttgctttccagccaatgcacagcattaggttcaattggcaatagcacatgaccaggttacaatcgggcagaaattgaggtgttcatcaatatattcccaatgaggcgacagttggaccaaaataactcctaagtgctgctaattcattttcttgtcgatgctggaaacatagaagaacaaaggctcgacactcaaacaagtcagaaacaacacattcctcttaactgcagcaactccattcgctaactaaatgaagagggccgactgctgcacagcgagatacaagcgcaggcagagtccttcggtgaaatgcaagggggataatctaccgagcaaagcccagattcttcatagggccatgcgtcctgccagccgactttctgatattcttcgatcaattgctgcgtcaacagagttcatctgctcatacaaattgtgaaataaaaaacttggtgttagatatggttgctgcctccaaaacaatgagtcgagcagcatctcaggctcactggccaaatgaaagctgacctggagcaagactcttgtcacattctcgaccaaacttaagctacaataaatgctaccgtattggcagaacctcagccacctagttttgctacaaacccatatttgcatgcagtaaattggcaatgaataaaattaatgcttcaattgaaattaaatacatacatatttgccagctgtccagggcttggtcgataaccctcaagccattagcataggcaccacgaaatttgtcagattatagaaaacttactagtaggaagaatggtgtaaatacctacttggaactcctgatgtgtgcaaaatcagcaggatataggtgaccaatcaacacaacagagacatttgaaaatgtaaaaagtggcataaaatatgaatcatctcagactcacatattgtatgaccagatgagactttcatattccactaaaacgttcaagaattgcatgcccttgaatccttgacaagttcacaattcagtatattgtgaatatgccaatattttatatgaaaatgaaaaggtcaattgtaaaaatgcaaaagaattggttgtaaatggatactgtgttaatttacatctaatgaacaggctcaaaagaaatcattatattatcaaatgcatcagttaagttcatagtagataccaagaaaaaatgggcaagtttatgtatcacaaataagtagaatagcaaaaccttccaagaattctatactatacttaaagcaccaatttcaacggtcatcatgcgtcatctttttaaaataacccctcagctatttcaaattaatctgctgcacgtctatatagatggccaaacggcgaccggcacaggctagacgcacgcgtggggttcgaacccatgtcctgatggaagaaggacgaaagacactgggtgaagctgtctaaccagtagaacatcatgctaagatgtttttaatattgaatataaattgtatataggtatatagttttttttgtaaaataaaaaaataatcgtgtcgggccgaacccgggggtcc

SEQ ID NO: 20153 - DNA, 4849 bp, Zea mays
  misc_feature (527)..(535): n is a, c, g, or t
  misc_feature (574)..(578): n is a, c, g, or t
  misc_feature (705)..(721): n is a, c, g, or t
  misc_feature (943)..(965): n is a, c, g, or t
  misc_feature (1203)..(1204): n is a, c, g, or t
  misc_feature (1314)..(1318): n is a, c, g, or t
  misc_feature (1386)..(1420): n is a, c, g, or t
  misc_feature (1537)..(1560): n is a, c, g, or t
  misc_feature (1611)..(1625): n is a, c, g, or t
  misc_feature (1830)..(1865): n is a, c, g, or t
cctcccccagccgccctccgcctccgcgccatcgacacgctcgagagcgtcgctgcctgctgctcgcgcggctacacgcaagtaataaacatcatatggcgctagtacagttcaacggtgccttggttcctcaactcggtgaaaagcctcggctgctatcctcgtcacctgcaatcgcaaaggctgcctattctgatgcaagattcctgacaccaaaaactggttcaagaggtagaggtaaacacctgctatcacctagttatagtttgcattcacagacctcttctgaacaactaaaccatgtaccatcgtcaagatttcgccagaaaaggggttcacgttttatcgtcagagctgaagctgatttctatagtgtacttggtgtctcaagaaatgctagtaaatctgaaatcaagagcggttggtatcttctgtttggttgatcatgctgttaatgtttggttgtggttgtcatgtaatatgccatgcaaatactcaaatacctgcaattgtcacttttgtcagannnnnnnnngaagttcatcttccatacttccacttcaatgctgctccnnnnntgtagtgcacttctgaaaacaaaaccgctgatttaagatatggtgatatattgatatcacttgtaaactactatctccggtcataattatacaatgttttggacacgacccagtcaaactttcgaannnnnnnnnnnnnnnnncctaaaatattagtttgaaaacataaagctggcatgcgtagatttatcttcaaaggttctttcatataaagtaaataaatgcattctttggtctaatctaggcttaattgaactttaggtttattttctttgcacacagaagtgtaatgcagttctgcaaaagcctgtattgttaagatacaattgcatggttggccccactctgagaccttactatgagtnnnnnnnnnnnnnnnnnnnnnnncaccattgtaccttgtttgtaaacaaaaaaataggggcaccgatgcaaacatttcggaaacagtagtggtttgggtgcaaaatgggaaaggaaggcagactcataattaggctccatagtgagggtaactatgcaaatgcactgaattgttactatttcatctaatttaagatgtcatgtccttggtgtctctttatcgcatctgcttagctggtattatttattttttagatcaaannggcccagccaagatttattacgaaattttaagtttgaattagctggtactgttagctgtttattacttattttggtgaaaatatcaactacaatgctgaaactaagaagnnnnnaacttgaaagcatcatggtcagtagtagtacctgatactgaatagagtatgaatttgatatacataannnnnnnnnnnnnnnnnnnnnnnnnnnnnnnnnnntgaatccttttattttccagcctatcggaagcttgctaggagctatcatccagatgtaaacaagtgagttggctattgcaatagagaatcacttttcagctactatcaccatcatcnnnnnnnnnnnnnnnnnnnnnnnntagccagctgtactgcctgtatattcttctttgtacattagacatctctcnnnnnnnnnnnnnnnaataatgaaagtatctatttatgatctattttagagatcctggtgctgaacaaaagttcaaggatatcagtaatgcttatgaggttctgtctgatgatgagaagcgatcgatctatgataaatatggagaagcaggtctgaagggtgctggcatgggcacaggagattactcaaacccgtttgatctctttgagtccctgtttgnnnnnnnnnnnnnnnnnnnnnnnnnnnnnnnnnnnngtgctgctcggaacagaccaatgcaaggtgatgatgagagctactgtctgctgcgcaatttcaaggaagctgtgtttggtgtggagaaggagattgagataaccagattggaaggctgtaacacctgcgacggaagtggtgccaagccaggtacaaaggcaacgacatgtaaaacttgtggaggtcagggccaggtagtctcctccacaagaacaccgcttggaatattccagcaagtctccacctgcaatacttgtggtggcaccggtgaattctccactccttgcaacacctgtgggggtgatggccgggtgcgaaggacaaagaggatcagcctaaaggttcctgctggagtggattctggaagcaggctgagggtccgatctgagggtaatgctggccggcgaggaggccctcctggggacctttatgtcttcattgatgttctctctgatcctgttcttaagcgagatgggacaaacattctctacacatgcaaggtttcttacattgatgcaatccttgggacaaccgtcaaagtccccactgttgacggaacggttgaccttaagataccctcagggactcagccaggcacaactctggtgatgtccaagaaaggtgtcccgcttctcgggaagtcaaatgcccgtggagaccagctggtgcgtgtccaggttgagattccgaagcgtctgagcagcgacgagaagaagctaattgaggagcttgcaaacctgaacaaggctcaaacagccaatagcaggagatgattgtcgcacaaggcttcgtaggacagcgcgcttgtgtggtaggcaattttgatgcaaactgcagtgatgattggatgaaaagagttggtagtgataaactcttctacgaactacatacagcaaggggtacactggagcaaaaaatgtgtcgttccacatctgtaacctcgtttttaagctattgaaagttgagtcagtgaactggacgtttttgcaatagcttagcatatgcactaggcgactttattagccatttttttgttgttatacggcttttgtattcttgaaagccttaggcaaaatatctgatggtggaatcaggtttagacttgacatttcttgcacaaatgctgcaccatgcattcatggaatctgtaagctgtaccatggaaatgttaactgtagttttatggtttgtgatgcattgggggtttattggtttgctcttcaaatacgttatgcagacactacgtttttcttccccttcggcagctgttgatatgaagctgcctctcgtagagcaggtgcgttttgctctaggctgctgttgatatgaagctgtgtgtccaccggacatgacactggataggataagtatgtttactatattcaaattcgtagtataataacaacatctagttttagttttagaactagtcattacctgttcagtgcactggaaaagatacatgaaaatttcagttgaggttctaaaggctagtttgaaaccagaggcggcgccagatcaggatcgagatggccggccggatcagggcttgatgagcgtgtaggtggcagcccctgcgatggcccccagaggcggcgccagcaggtagacccagatgtccttgtacttccccgtcgccagcgccgccccgatcgtccgcgccgggttcatggacggcccagtcgacggcctgcatctcatgcacacgcagcgttcatctgtcggatcggagcaccagttcatgggtatcgatttctgtagcagcactagtcagtatactacttaccctccgatgagagcgttcatcattatagccgccgcgatcgcgatggccaccagctctttgctctggattgaaagatcaacaaaacattcgtcagatttttacgttttccaaggctgaagaactgcaggcatagataccatcgtcaaatttacggcgcacttgccgaggtcgggtcggtggcgacggcggcgatgacgaacatgagcacaaacgtgagcacgagctcgaggaagaacgcctgggcggcgccgacgcggggcacggtggccatgacggccgggtcggcggggcggtacatggccttggcgaggaacgcggcggcggcggaccccgccgtctgcgcggcggcgtaggggagcacgtgggcgcgcgggaggtgcccgaacacgcccatggccaggctgacggccgggttcaggtgcgagccggatacgctcaccacggcgagcaccacggccaccacggccagccccgccgcggccgccacccccaccaggccctccgcgccgccgtgctgcgcgtccgccacgacggtcgacaccaccgcgaacatgaggatgaacgtgcccacgaactccgccgccaccttcttggccagcggcacctcgcgtccttgctgctcgtcgccgtgcgcgtcagcctgcggcggcgacttgagcatcagtttctgcagggacgacgactccaccgccaccagcttgctgggtgttggcgccgagcacatgctgatggccacctgcctctgctcttcgacgcccgttgtggcgtgctcggccatttctcggttcaactcagctccaaatacacatctctaactcgtcttctttgaccacaccaatctacctatatatgcatatagtttctcctaattgcctagctaagcacaatttccaagcaaagtttcatatgatctatgcacacgtgttcgaggtgatcttgcagagttattcagctactcctagtcctatataagtgcgcgcgcagcatgtcgagtcaaatttggagaatatttgttaatttgaacgcattggaggcttggagctactgtgcccttaggagaatatgacgaggaatatgtgatgagagctggagcaaaatgtttgtgtcagcactcaggagccaatcagcaagaaaccgcagatgagtcactgactactctgtttgtcatttggcccggtcgggcaacaaagtcatccgt

SEQ ID NO: 20154 - DNA, 1912 bp, Zea mays
ggccccccggggccggccgggaagtggctcacccaccccctcttatctccttcccccagccgccctccgcctccgcgccatcgacacgctcgagagcgtcgctgcctgctgctcgcgcggctacacgcaagtaataaacatcatatggcgctagtacagttcaacggtgccttggttcctcaactcggtgaaaagcctcggctgctatcctcatcacctgcaatcgcaaaggctacctattctgatgcaagattcctgacaccaaaaactggttcaagaggtagaggtaaacaacttctatcacctagttatagtttgcattcacagacctcttctgaacaactaaaccatgtaccatcgtcaagatttcgccagaaaaggggttcacgttttatcgtcagagctgaagctgatttctatagtgtacttggtgtctcaagaaatgctagtaaatctgaaatcaagagcgcctatcggaagcttgctaggagctatcatccagatgtaaacaaagatcctggtgctgaacaaaagttcaaggatatcagtaatgcttatgaggttctgtctgatgatgagaagcgatcgatctatgataaatatggagaagcaggtctgaagggtgctggcatgggcacaggagattactcaaacccgtttgatctctttgagtccctgtttgaagggtttggtggaatgggtggaatggggggtggccgtgctgctcggaacagaccaatgcaaggtgatgatgagagctacaatctggtactcaatttcaaggaagctgtgtttggtgtggagaaggagattgagataaccagattggaaggctgtaacacctgcgacggaagtggtgccaagccaggtacaaaggcaacgacatgtaaaacttgtggaggtcagggccaggtagtctcctccacaagaacaccgcttggaatattccagcaagtctccacctgcaatacttgtggtggcaccggtgaattctccactccttgcaacacctgtgggggtgatggccgggtgcgaaggacaaagaggatcagcctaaaggttcctgctggagtggattctggaagcaggctgagggtccggtctgagggtaatgctggccggcgaggaggccctcctggggacctttatgtcttcattgatgttctctctgatcctgttcttaagcgagatgggacaaacattctctacacatgcaaggtttcttacattgatgcaatccttgggacaaccgtcaaagtccccactgttgacggaacggttgaccttaagataccctcagggactcagccaggcacaactctggtgatgtccaagaaaggtgtcccgcttctcgggaagtcaaatgcccgtggagaccagctggtgcgtgtccaggttgagattccgaagcgtctgagcagcgacgagaagaagctaattgaggagcttgcaaacctgaacaaggctcaaacagccaatagcaggagatgattatcgcatatggcttcgtaggacagcgtgcttgtgtgataggcaattttgatgcaaactgcagtggtgattggatgaaaagagttggtagtgataaactcttctacgaactacatacaacaaggggtacacaggagcaaaaaatatgtcgttcccacatctgtaacctcgtttttaagctattgaaagttgagtcagtgaactggacgtttttgcaatagcttagcatatgcactaggcgactttattagcctttttttttgttgttatacggcttttgtattcttggaagccttaggcaagatatctgatggtggaatcaggtttagacttgacatttcttgcacaaatgctgcaccatgcattcatggaagctgtaagctgtaccatggaaaaaaaaaaaaaaaaaagcggccttgtg

SEQ ID NO: 20155 - DNA, 2117 bp, Zea mays
ccttccgggctcccctctcatcatctcctcccccccgcacctgcacagcctctcccgccgcccgccgcgcgccgcctccgcgcgccatccagacgccagtgcgcgtcgcggtccgctgcccgcggtgcgttcaccctctccccatctcccttttcctctcccgcgcgcccttccctacgcgcctccgccggcgacgagtgcccaccagctggtgttacacacgtgtgacaatacattacatggcgctagtacagttcaatggtgccttgcttccccaactcggtgaaaaacctcggacgctattctcgccgcctgcagttgcaagggctacctatgccgatgcaaggttcctggcaccggaaaccagttcaagaggtagaggtaaacacctgctatcatctagttatagtttgcattcgcagacctcttctgaacaaataaaccatgtaccgtcgtcaagatctcgccagaaaaggggctcaagttttgtcgtcagagctgaagctgatttctataacgtacttggtgtctcaagacatgcgggccctcctggccgcccgggcgagatcctggtgctgaacaaaagttcaaggaaatcagcaatgcttatgaggttttgtctgatgatgagaagcgatcaatctatgataaatatggagaagcaggtctgaaaggtgctggcatgggcacaggagattactcaaacccgtttgatcttttcgagtccctgtttgaagggattcggtgggatgggtggaatcggtcgtgctgcccgtaatagaccaatgcaaggtgatgatgagagctacaatctggtactcagtttcaaggatgcggtgtttggtgtggagaaagagattgagataaccagattggaaggctgtaacacctgcgatggaagtggtgctaagccaggtacaaaggcaacgacatgtaaaacttgtggaggccagggccaggtggtctcctccacaagaacaccactcggaatattccagcaagtctccacctgcaatacctgtggtggcaccggtgaattctccacgccttgcaacacctgttcgggcgatggccgagtgcgaaggacaaagaggatcagtctaaaggttcctgccggagtggattctggaagcaggctgagggttcgatctgagggtaatgctggccggagaggaggccctcctggggacctttatgtcttcattgacgttctctctgatcctgttcttaagcgagatgggacaaacattctctacacgtgcaaggtttcttacatcgacgcaatccttgggacaaccgtcaaagtccccactgtcgatggaatggttgacctcaagataccttcagggactcagccaggcacaactctggtgatggccaagaaaggtgttccgcttcttgggaagtcgaatgctcgcggagaccagcttgtgcgcgtacaggttgagatcccgaaacggctgagcagcgacgagaagaagctagttgaggagcttgcaaacctgaacaaggctcagacagccaatagcaggagttgatttattgagcaaatctttttaggacaccatgcttgtggtcacaggcaattttgatgcaaattgcagtgatgaaaagagttggtagtggttcaacacttctacgaactaaagaggtacactggagcgaagcgtgtcatgctcatgccatatctgtggcctcgtttctaagctattggaaaccaagtcggtgaccactggacgtcttgcaatagcttaacatatacgactttattagccattttttgttacacggctttttgtattcttgagagccttaggcaaaatctctggtagtggaatcaggcttagacttttacatttcttgcagaaatgctgcaccattgatggaatatgtaagctgcaccatggaaatgtgactgcagttttatggtttgtgatgcgtcgggggtttattgttttgccccccccctcccttatctaaccaatacatttatttgcccctggcaggggcagctgttgatttgaagctgcctctgcgcagagcaggtgcatttttgtggtctaggcagctgttgacatgaagctggttgttctgtgtttgcaactacttgggactct

SEQ ID NO: 20156 - DNA, 1451 bp, Zea mays
ggaccctcgggctcgccgggatcagagcgcctatcggaagcttgctcccacccgtccgcccacgcgtccgagagatcctggtgctgaacaaaagttcaaggaaatcagcaatgcttatgaggttttgtctgatgatgagaagcgatcaatctatgataaatatggagaagcaggtctgaaaggtgctggcatgggcacaggagattactcaaacccgtttgatctattcgagtccctgtttgaaggattcggtgggatgggtggaatgggtggcggtcgtgctgcccgtaacagaccaatgcaaggtgatgatgagagctacaatctggtactcaatttcaaggatgcggtgtttggtgtggagaaagagattgagataaccagattggaaggctgtaacacctgcgatggaagtggtgctaagccaggtacaaaggcaacgacatgtaaaacttgtggaggccagggccaggtggtctcctccacaagaacaccactcggaatattccagcaagtctccacctgcaatacctgtggtggcaccggcgaattctccacgccttgcaacacctgttcgggcgatggccgagtgcgaaggacaaagaggatcagtctaaaggttcctgccggagtggattctggaagcaggctgagggttcggtctgagggtaatgctggccggagaggaggccctcctggggacctttatgtcttcattgacgttctctctggtcctgttcttaagcgagacgggacaaactttctctacacgtgcaaggtttcttacatcgacgcaatccttgggacaaccgtcaaagtccccactgtcgatggaatggttgacctcaagataccttcagggactcagccaggcacaactctggtgatggccaagaaaggtgttccgcttcttgggaagtcgaatgctcgcggagaccagctcgtgcgtgtccaggttgagatcccgaaacggctgagcagcgacgagaagaagctagttgaggagcttgcaaacctgaacaaggctcagacagccaatagcaggagatgatttattgagcaccatgcttgtggtcacaggcaattttgatgcaaattgcagtgatgaaaagggttggtagtggttcaacacttctacgaactaaagaggtacactggagcgaagcgtgtcatgctcatgccatatctgtggcctcgtttctaagctattggaaaagtcggtgaccaccggacgtcttgcaatagcttaacatatacgattttattagccattttttgttacacggctttttgtattcttgagagccttaggcaaaatctctggtagtggaatcaggcttagacttttacatttcttgcagaaatgctgcaccattgatggaatatgtaagctgcaccatggaaatgtgactgcagttttatggtttgcgaaaaaaaaaagaaaaaaaaaa

SEQ ID NO: 20157 - DNA, 2454 bp, Zea mays
gcacgagaccattacctagaacatccttatcgaaaagaacacacacaccgtttgtgagcaagacaagacaaatcgctagtggaggagcaacgcgctcaccgcctagcagcaagacacctccgctaggtttttccgccgctgaccggggcattgcggaggcagcaagccacgctacagcgcggcggaacgggagctcggcggcggcggagcgccagtccgggtggcggcggctgatttggatggtgggttgcccagctggggttcagatctgaagatggccgacggcgggggcgaagaggggaatgcttcggcgcacaagggctccgcgcgccgccggggcccggtgcaggcgggcctggacgcggacgacctcctcactctcatgcacggctcggatcccgtcaaggtcgagcttaaccggctcgagaacgaagtcagggataaggatagggagctgggcgaggcgcacgcggagataaaggcgctgcggctgtcggagagggcacgggagaaggcagtcgaggagctcactgctgaattagagaaggtggatgagaagctcaagttgacagagtctctccttgaaagcaaaaacctagaactgaagaaaacaaatgatgagaaaaaggctgctatggctgctcagtttgcggcggaagcaacactacgaagagtacatggagctcagaaagatgatgatatgccacctattgaagccatccttgcgccgcttgaagcagagttaaagctttgtagaaaggagattgcaaagcttcaagacgacaatagagctttggaccgtttaacaaagcaaaaggaggcagcactgctagaagcggaaaggactgtacaaatcgcaatggctaaagctgctatggttgatgacatgcaaaataagaaccaagagttgatgaagcaaattgaaatttgccaggaggaaaataagatcttggataggctgcaccgccaaaaagttgcggaagtggaaaagctgagtcaaactgtgagagagttggaagaggatgttctgcaaggtggtgcagctgccaatgtcgttagggattaccaacgaaaagttcaagaaatgaatgaagaaaagaaaattcgtgaccgtgaacttgctcgagctaaagttactgcaaatagggttgctgttgtggtcgcaaacgagtggaaagatgctaatgacaaagtaatgcctgttaaacagtggctggaagagcgaaggttcctgcagggtgagatgcagcagcttcgtgacaaacttgctattgcagagagaactgctcgatcggaagctcaattaaaggaaaagtatcagttgcgcttaaaagttttagaagatggcttgaggggcactccaagtggatcttgtcgtcctcccatggaaggaaaatgtataagtaatggacctccccgtcgactttcactaggtggtgctgatagtatatccaaaatctctccaaacggtgtgttaatgaggaggtctccatctttcaattcaagatcctccctctctaccagcagttgtttggtcctgaagcatgcaggaagaacttcaaagtcatttgatggcggtaccaggtcattagaccagggaaaagttctggggagtggacctcattcactcaatagatctacggatgcagttagagattgtgagacagctgatagttggaaggctaatgcagaagaaaaaagtaatgaaaccgcaaacaatgattcagctgacatggtctctggtgtactctatgacgtgttgcaaaaggaggtggtttccttgagaaaggcatgccatgagaaagaccaaactctaaaggacaaagaagatgcaatggagatgctagcaaagaaagtagatacattacataaagcaaaggaagtggaggctaaaaagaagaggcaagagatagctgctttggagaaaaaatttgccgcggtgtgccttgaacaagaacggcttggtaatttgagaggacctggaacttctcagacggtttcgggaagaactgcatcacgaggtggattgacgcgcaacctccaatagcatacatctaacttcaggcaggcatggaattcgtccataggcttcatttccattgtatttgttcccgtgttcttattcgttttgtgatcaaatagcacagatgaccctgcgatacctagatgaggggaaagagtaggttttcatctgacatgacttgcttgtagtgaaggtaaatccttcggtcggtgaggtttaaccttgcgccccgccctcattttgtggaggcagtgctgtagtggctgtataggttggacgagcctgtgcctttctatatgtagggtgaggtactgtgtttgtgttgcatcttgcatgttcgggttgtgaatatatcattgtattctgctgtggtttctcctttctaaacaaaaaaaaaaaatttggttgttgggctggtaactcgagagggg

SEQ ID NO: 20158 - DNA, 1404 bp, Zea mays
gcagctcattcgccgaggtaacatcccctgcccttcctcacatttcctccctgttcgtccgtaatagtcgtttccgaaccttgcgtttcgtgggatttatcgaggcgagggcttcgatttgaccgaggaatcgcccaaatccgtttgtcttcgacttcagttcatccccacgaatttctagggttttagtgtcgattttgtcccccttcattacatttgattggcggtgaattgggccccgttttgatgattccttgggttcgttggacggcaggaaacgagatcctctagaggtttgtgctgtttagcgtgagttttttggggccgatttgctttgctcgcatgggggatcatgtcgcggtggatgttggggagctcgtagcgtcccgagtcggtgaggcagcggggttagtgtccggcgccaaggaggaaacagaggcgctgattgggatggtggagtgccgcatttgccaggaggaggacctcaggaagaacctcgagagcccctgcgcttgcaacggcagcctcaagtatgctcacagagaatgtgtgcaacgatggtgcaatgagaaaggggatacaatctgtgaaatctgccatgagttgtacaagcctggttacactgccccaacccaggtgcatcatgatgaaactaccatagagataagtggtggagattggaccatctctggcaaccgtttggatttacatgatcctagaatattggcaatggctgctgctcaacaccgtctacttgaagacgactatgatgaatatactgcaacaaacaacaacgctgctgcattttgccgctctatatttctgattttgatggcccttttgctcctgaggcatacactgaccattactaacagtgatgatgaagatgatgcatctgctattttctcgctatttcttttgagagcagctggatttttgctgccatgctatattatggcttgggctattagtatcatgcagcgtcaaagacaaaggcaggaagaagcaatgctattaccaacggaagtggcgatcattctgcatcggaacggaagaacaatgcaatttgcggtggcaccaccggaatctcctatctcacctcaccccgagctaaactaatagaatacatcatcgacagggtcacagtcccgcctctggagtgcataacaggtggaaactcgaggacattgtgcaaagcatgtgttgcatcggccacctcgaacggccatgttgcagcaaaaatgttgtgccttcgaattgagttaactttctagcttcagattcaatgcttgttttgtggcctctcagcatcttctgtacataaagagatttctctaataaatgaatataagttaaatcaacacaaagttcgattttgaacaaaaaaaaaaaaaaaaaacatcg

SEQ ID NO: 20159 - DNA, 1247 bp, Zea mays
gcacgagaccattacctagaacatcctaatcgaaaagcgggaaatagtttctctctctcttcttcttgtaagatatttcggagtaggaagtgcgtgccttcctcgcagctcattcgccgaggaaacgagatcctctagaggtttgtgctgtttagcgtgagtttttttggggccgatttgctttgctcgcatgggggatcatgtcgcggtggatgttggggagctcgtagcgtcccgagtcggtgaggcagcggggctagtgtccggcgccaaggaggaaacagaggcgctgattgggatggtggagtgccgcatttgccaggaggaggacctcaggaagaacctcgagagcccctgcgcttgcaacggcagcctcaagtatgctcacagagaatgtgtgcaacgatggtgcaatgagaaaggggatacaatctgtgaaatctgccatgagttgtacaagcctggttacactgccccaacccaggtgcatcatgatgaaactaccatagagataagtggtggagattggaccatctctggcaaccgtttggatttacatgatcctagaatattggcaatggctgctgctcaacaccgtctacttgaagacgactatgatgaatatactgcaacaaacaacaacgctgctgcattttgccgctctatatttctgattttgatggcccttttgctcctgaggcatacactgaccattactaacagtgatgatgaagatgatgcatctgctattttctcgctatttcttttgagagcggctggatttttgctgccatgctatattatggcttgggctattagtatcatgcagcgtcaaagacaaagacaggaagaagcaatgctattaccaacggaagtggcgatcattctgcatcggaacggaagaacaatgcaatttgcggtggcaccaccggaatctcctatctcacctcaccccgagctaaactaatagaatacatcatcgacagggtcacagtcccgcctctggagtgcataacaggtggaaactcgaggacattgtgcaaagcatgtgttgcatcggccacctcgaacggccatgttgcagcaaaaatgttgtgccttcgaattgagttaactttctagcttcagattcaatgcttgttttgtggcctctcagcatcttctgtacataaagagatttctctaataaatgaatataagttaaatcaacacaaagttcgattttgaacaaaaaaaaaaaaaaaaaa

SEQ ID NO: 20160 - DNA, 1317 bp, Zea mays
gtgtgcgagctcacagtcacaaaagaaacgatgtccactggcgaactgacggctccgtcatgcggcgatcgataaaaatgccgcgaggccaccacgcgagacgaacgcaaacgaagtgcggaaaataggcctattttttcttcttcctcgtagagatatttcggaagagggagtgcgtgccttcctctcagctgattcgccgaggacacgagatcctctagagggttgtgctgtttggcgtgaggctttgggggcgatttgctttgctcgcatgggggatcatgtcgctgtggatgttggggagctcgttgcgtcccgagtcggtgaggcagcggggctattgtccggcggcaaggaggaaatgaaggcgctggctgggatggtggagtgccgcatttgccaggaggaggacctcgcaaagaacctcgagagcccctgtgcttgcagcggcagcctcaagtatgctcacagggaatgtgtgcaacgttggtgcaatgagaaaggagatataatctgtgaaatctgccatgagtcgtacaagcctggttacactgccccaacccaggtgcatcatgatgaaactaccatagagataagtggtggagattggaccatctctggcaaccgtttggatttacatgatcccagaatattggcaatggctgctgctcaacaccgtttacttgaagacgagtacgatgaatatactgcaacaaacaataacgctgctgtgttttgccgctctatatttctgattttgatggcccttctgctcctgaggcatacattgaccattactaacagtgatgatgaagatgatgcatctgctattttctcgctatttcttttgagagccgctggatttttgctgccatgctatattatggcttgggctattagtatcatgcagcgtcaaagacaaagacaggaagaagcaatgctgttaccaacggaagtggcgatcattctgcacccggacggaagaacaatgcaatttgcggtggcaccagcggaatctcctgcatcacatcagtgacaggctcacaggcctgcctcggaatctcagcatctggtcttaaaggtggaaagacgaggacgttgtgcaattcatgttgtgccttcgaatttagttaactttcaagcggagattcaatgtttgttcgatgggctctcagcaccttctgtacataaagagatttatctaataactaataagtgaatataagttaaatcaacacaaagtttgattttgtcttgtggtatatacgaccgctgaacagatttctcacgtttggggaaagccatatttttggatgc

SEQ ID NO: 20161 - DNA, 590 bp, Zea mays
gcccagcaacccgtttacttgagcccgggtacgatgaatatactgcaacaaacaataacgctgctgtgttttgccgctctatatttctgattttgatggcccttctgctcctgaggcatacattgaccattactaacagtgatgatgaagatgatgcatctgctattttctcgctatttcttttgagagccgctggatttttgctgccatgctatattatggcttgggctattagtatcatgcagcgtcaaagacaaagacaggaagaagcaatgctgttaccaacggaagtggcgatcattctgcacccggacggaagaacaatgcaatttgcggtggcaccagcggaatctcctgcatcacatcagtgacaggctcacaggcctgcctcgggagtgcatagcataacagatgcatctcagcatctggtcttaaaggtggaaacacgaggacgttgtgcaattcatgttgtgccttcgaatttagttaactttcaagcggagattcaatgtttgttcgatgggctctcagcaccttctgtacataaagagatttatctaataactaataagtgaatataagttaaatca

SEQ ID NO: 20162 - DNA, 2206 bp, Zea mays
tttttttttttttttttttttttttttttgcagcaacaacaacagcacaaaacccacagcatttccattgatcacaacataaggtttttctcaactcgatgcaaccaaaccttgcagctcactggctgaaaaatgtacattttttctatcaacaatttgtgtcaaaaacaatgaaattgtcatcacaagttttttgtatccaaatcaccgttcatgtttctactagtaaaaaaacagcaaacctttgaaataaaaagaacgagaagaatacggagtgattttgagaggagtgtcatagcaagatttttttatcgctaactaaagaattaatatgtattgattcagtgaattataaatcagcaggctatattcgatttggcctcgtacccactgggatgcgacttttgccacctccatgcgactgacagactctctttaagatcagtatatcgagctgtccagttgagctccttgttgatttttgttgggtcgctatatacttctgcataatctcctggccttctgctgaggtactcaattttgatgttaaccccagttgccttcttgcaggcatcgacgaactcattaaccgagcgacctcttcctgttccaacattgtaaatgctgacttttctaggctctgccttgttgagtgctttcacatgagcatcaactaaatctgtgacatcaatataatctcttatgcaggttccatcagttgtgggataatctgttcctttaacctttaatcctggaatgactcctaatgctgcatcgaagcatgccccagatatccgaccatgctctcggagttctggcctaggagcctcacctaatctcccctcagggtcagagccaataacattgaaatatcttaaaatcatgacagccatgtcagctcccttcgactttgagaaatctattatgatatcctctgccattttcttagcttttccatatggattgatagggaactgaggtgtggcttctgtaataggcatcttctctggttctccgtaggtagcacatgtactggagtagataagggtttggactccatgagatgccatagcctccaaaatcagtagtgtgttcgatgttatattgtgatagtacctaaggggttccaatgtgctctctccaacataagcaacagctgcaaagtgcatcacagcatcaaatgcattttcagcaaatatcttgttgacagatttctggttccccagatcagcaaagatgaattgcagtctcccaggctgcggaaacaagccctgcagaacctttactgctcccatgtttcctctagatagattatccacgatagtaactcgatagttatcctttaagagccttaaagcagcatgtgaaccaatatccccgccgcccccgggtactaagacgtgggtaaccccatgttcatggcgagaaaacacactaattgccaccaaaaccaggagattgcttcagaacaaatatacagagtgttgtgaggaccagggctgcaatgattttaccaacattatgaggcttccgccttgcatcaaagtagtccatcccagccctgggcaggcttgtcctccggtttaaagggatcatggaagaattttgctccttcagatgaggctaccgatggtagaagccctactcgccaccgtcaacgtgaatttccagccagaagatcaaattagagtccggggtgctcggcttcgcacagcaggaaggggggcagaaggaggcgggcgtacttggtggatgctcgtcgcaggtgaagacctggagaagggcggctgcactcgcctattcgtcgccgaaggaaacaaatgagagagagatgggggagaaacggatgaacgggagtaagaacaaggaacgagcgtatgtgctcttccgcgccgtttgaattctgggaaatgatgtggcgtccctgccaccaagatccgtggctgcagcgaggaaaagagagaggagggcggggaggagcaccgcggggaggccgccgaggagaccgatccttccgcgggctgagcactgactggccgcgcgcctcttcaacgagagagctgcagcgaggggaagatagggggcgtcagtggaggaggctcgctgcgggttggtgacgagtcttgggcggcgggggcgcagaagacgtcgcgcgtgaaaagcctcttttaggaagggaaggcccggccggcctcgaggtacccaa

SEQ ID NO: 20163 - DNA, 2164 bp, Zea mays
aagactgatccatagacccgtatatatggtcatacaaaacaatattgtacactacatactgcactatttatataataaagtttgaaataggagattatatagggaaaactgctggagattaaggatcgttttttttttttttttcttaactcaattcaatcaatcttgcagctcattggctgaagcaatttacattttttttaccaacaatgtgtcagaaacaatgaaattgtcatcacaggtcctttttttcatccaaatcaccattcatgtttctgctagccaaaaatgcaaacttttgaaataaaaaggacgagagaaagaagaatacgaaggactgattttgaggagtatcgcagcaagatcttgtatctctaactaaagaactaatatgtattgacgattaagtgaattatagatcagcaggctatatttagtttggcccgtagccacgcggatgcgacttttgccacctccatgcgactgataggctctctttgagatcggtataatgagctgtccagttgagctccttgtttatctttgttgggtcgctgtatacttctgcataatctcctggccttctgttgaggtactcaattttgatgttgaccccagttgccttcttgcaggcatcaacaaactcattaactgagcgacctcttcctgttccaacattgtaaatgccgacttttctaggctctgccttgttgagtgctttcacatgagcatcaactaaatctgggacatcaatataatctcttatgcaggttccatcagctgtggggtaatctgttcctttaacctttaatcctggaatgactcctaatgctgcatcaaagcaagccccagatatccgaccatgctctcgaagttctggcctaggagcctcacctaatcttccctcagggtcagatccaataacattgaaatatcttaaaatcatgacagccatgtcagctccctttgagtttgagaaatctattatgatatcctctgccattttcttagcttttccatatggattgatagggaactgaggtgtggcttctgtaataggcatcttatctggttctccgtaggtagcacatgtactggagtaaataagggtttggactccatgagatgccatagcctccaaaatcagttccgtgttcgatctaatattgtgatagtacctaaggggttccaatgtgctctctcccacataagcaacagctgcaaagtgcatcacagcatcaaatgcattttcagcaaatatcttgttgacctggcagccagttaagtgaaaagaagactttggatgtaactctccataagcagaaaaggcacaagcaaagcagctttagaagcataaatgaggatacagatttctggttccccagatcagcaaagatgaattgtagtctcccaggctgcggaaataagccctgcagaacctttactgctcccatgtttcctctagatagattatccacgatagtaactcgatagttatcctttaagagccttaaagcagcatgtgaaccaatataaccagctcctcctgttactaagacgtgggtaaccccatgttcatggcgagaaaacacactattgccaccaaaaccaggagattgcttcagaacaaatatacagagtgttgtgaggaccagggctgcaatgattttaccaacattatgaggcttccgccttgcatcaaagtagtccatcccagccctgggcaggcttgtcctccggtttaaagggatcatggaagaattttgctccttgagatgaggctaccgatggtagaagccctactcgccaccgtcaacgtgaatttccagccagaagatcaaattagagtccggggtgctcggcttcgcacagcaggaaggggggcagaaggaggcgggcgtacttggtggatgctcgtcgcaggtgaaaacctggagaagggcggctgcactcgccgcggggaggccgtcaaggagaccgatccttcggcgggctgagcactgactggggatgcagctcttcaacgagagagctgcagcgaggggaagatagggggcgtcagtggaggaggctcgctgcgggttggtgacgagtcttgggcggcgggggcgcagaaggcgtcgcgcgtgaaaagggtcggaggaggggaggaaggtccgaaggt

SEQ ID NO: 20164 - DNA, 847 bp, Zea mays
  misc_feature (839)..(839): n is a, c, g, or t
aagcagcaaccattttatcaactttatcacgagcatagatggtttctccaacctgtcgcctcacctccttccaccattaccctcagatccaccttgaggttgatgaatcattactctagcatttggcattgcatagcgcattcccttctcgccacctgcaaggataattgctgcttgactagcaacaacaccaaagcacactgtcccaactttgggctttatccaggacatgcaatcataaatcgctaagatcgaatagagacttccaccagggcagttaagatatatcagaatatcagcctcttcatcgatggcagcaagtgttacaagctgtgatatcacacgttgggccacctgggagttaatatattggccaatgaagattatacgatttcccagtagtacagttgcgagatcaagcgcaccaccaggagtcatgattgccggcattaaaggtggattttcattctcagatgccactattgtattttgcttgtggactgctggggttagaagcgcagccttgcccttgggaagcaaggagttgcggtagaatccagctcgcaccttcattgtatcccctttcttccccacctcttctatgtcatctgtcaatatgacctgagggtgtttcttcaccttcccctgggcgacgatgaccagcgacggagcccggcgagaggccgtgaggcggcggtccgccgagggccgcggggaggaggcgggggtccagggcagcgtggaggcgcacgacagcgacgccattgctctcgcgcttcgctactcaagcaagtggcgcttcggtcgcctcctccgctcgcaccgctttcctttcttcnccggccgg

SEQ ID NO: 20165 - DNA, 1543 bp, Zea mays
ggccgctttttttttgggttcccgatcaccacttttttttttttttttttgatctgtgtccaaattatgattattagaataaaattcaattcaaagtatccaaaccaaacggggcccttatcaaaatccttgaagacgtatttgcaacatccgaatgtatgagttttcctgaacgctaacacgagtagttgcccacatacaaataaaaatcatgtgacggtctcaccataaatccaatatgttgaatccaaacgatttcttaaaccacttctcctttcctgggctataagtttgcaaactggcacttttctcccatctgcaaagatcatctaggtctacattaaacagtcttcatcgttttagcatgagtgcatgacaatgccatcctacgtgccaccataagctggtgaatggtacaaccataaatgcaatggaatcaaatcttgttcttcggtaaacatctgtcattccagggctttaatcgagatggacggcaagcatctaactttggctccagttctgcagtatttctagtctgctaatagaatgtgggttgtgtcccttctctagtatcttgtttccagtaaagcatcaagcaatccgaaatccatggcctctgaagaagacatgaaccgatccctctctgtccactgctgcaccatgtcaagtggttgcccggtgaaagcagcaaacattttatcaactttatcacgagcatagatggtttctccaacctgtcgcctcacctcctccacattaccctcagatccaccttgaggttgatgaatcattactctagcatttggcattgcatagcgcattcccttctcgccacctgcaaggataattgctgcttgactagcaacaacaccaaagcacactgtcccaactttgggctttatccaggacatgcaatcataaatcgctaagatcgaatagagacttccaccagggcagttaagatatatcagaatatcagcctcttcatcgatggcagcaagtgttacaagctgtgatatcacacgttgggccacctgggagttaatatattggccaatgaagattatacgatttcccagtagtacagttgcgagatcaagcgcaccaccaggagtcatgattgccggcattaaaggtggattttcattctcagatgccactattgtattttgcttgtggactgctggggttagaagcgcagccttgcccttgggaagcaaggagttgcggtagaatccagctcgcaccttcattgtatcccctttcttccccacctcttctatgtcatctgtcaatatgacctggcggtacttcttgaccttcccctgggcgacgatgaccagcgacggagcccggcgagaggccgtgaggcagcgccccgccgagggccgcgggtaggaggcgggggtccagggcagcgtggaggcgcacgacagcgacgccattgctctcgcgcttcgctactcaagcaagtggcgcttctgtcgcctcctccgctcgcaccgctttcctttcttcccggccggcctcgaggtacccaatg

SEQ ID NO: 20166 - DNA, 940 bp, Zea mays
ggaccctcgaggccggccgggccgggatctcccttcctcgcacatgagctcgtctcggtctcctctcctgtaccgaaagtccacgcgcttcctcccctctcctctctgcctcttttctccctcctcggtgctcctccaccagaaccctagctgccgtctcccactctcgtcgggcagctctctcagcagcacctgcggccgttgtctctccttgcgcggtctgccccagccctgacccccggagatccggggctgttctcggttctttacgcggaggcggaggttggtttctgatctggggatcggttcgtgcggggatgaatacgaggccggtggtgctcgtcttcctcctgctcgtgctcgtcatcacgtcgcagttcgagtggaagcagcagatcggggaggccgcggacgccgacccggccgctgcccgccgccggcagcagctgcacgccagggaggatgccgtcaaggaaaagattatattatcccaggagaaaaatatccaacagctcaaccagcttatcgagagccttcagcgccagctactgcactgccgtggtagcaataacactgttcatgctgctgccgccgttgccacagaagcgagtgaagtcgagggacatgaggtcattgaagatgagaatagacgatgatccttggcgtacatgcttctacgatgccggtacagctgctaaagagcagaacagtcgtctgaatgcttgaattcactgtattgtatatttgatactccgccgactagtggattcccccgaccctgtaagcctgtagagaattgtaattttttataatgtgatttatttaggtcgcggctactaattcacctggaaagttaccttgccattctttcttctgatgatggcgctccatcgatgcttgattgctccctcgaaaaaaaaaaaaaaaaagcggcctcgag

SEQ ID NO: 20167 - DNA, 951 bp, Zea mays
cccacgcgtccgcccacgcgtccgcccacgcgtccgcccacgcgtccgcttgcgacctcgtgccaggttcagctggccagatcggtggcatgcagcagccactgcaaccacaagttaaccacatgggagttccacaaagccagccaatgtatagtaaccaaccaatgcgacccggtcaggttgccgccacaacacagatgcagcctggcttcggaaaccagcagttcggttcgctaccaccaacatccatgctgggcatgcaattcggtggcatgcagcctccgcagatgtatggcggatcgcagccagtcatgatgtacccgcaacaaatggcagtggcccagtatggagcaatgccgcggcagcagccgacgtatggtggtcgattggcgggttacatgcagcatcctgctgtggctgccgcacactactacaacaaccaggggatgtatggctaccccggtgcgaacgggctgtcacagagcatgtatggcctctcggtgcaggacaactcgtccatggggatgaggtcgtcttaccagactacgacggcgccaccctccacggggcaacctatgaagccaacgaagcccgaagacaagcttttcggtgacctcctgagcattgccaagacgaagaaagcttcatgagacgagctcgagcaggagcggccttctgatatatcgtctcccctatttttcgtggtttttcgtgctgtttgatcttacacttgtaacattatctgaatgtgtaagctttttgggggtccttttcttttattcccacgtcgtgtgtgatctattgatcccattggattcgttataccgtgtgcgtgtactgatcactagcgatgggaaactttggccgtaaatgatgattcaataaagggtgtgcagtacgtgattatgaaaaaaaaaaaaaaaaaaccccacgcgcaagcccgccctcccc

SEQ ID NO: 20168 - DNA, 747 bp, Zea mays
ctgtgctgggatgatacccctgctacaacacaaaatccacttgctcttgttcctgtcacagatcctcttgctgactctacttcatcaaatcaaaatgcgctagcaattgttgacacattttcagaaaacagcaccacgaaccacaacgctcaaccagctgacccctttggtctcaatccgagttctgctattccaggatctcagctatacaacacaccaactcagcagcctttccagtcacaacagcctctgcagcaggcggcgctctatgcgaatgggggtgctgtggaccctggaacgtcttacgatcaggcatcccagtttaaaaatgttagttctgggtggaatggtcaagctgccaaccctgctgtgcccctgccagagcaagcactgaattacgatgatcaaagtggaaaccttccaccgcctccttgggaggctcagccagcgtcaaacaatgaattgccaaatggccaattgggaagcttgcaacctctcccaggttcagctggccagatcggtggcatgcagcagccactgcaaccacaagttaaccacatgggagttccacaaagccagccaatgtatagtaaccaaccaatgcaacccggtcaggttgccgccacaacacagatgcagcctggcttcggaatccagcagttcggttcgctaccaccaacatccatgctgggcatgcaattcggtggcatgcagcctccgcagatgtatggcggatcgcagccagtc

SEQ ID NO: 20169 - DNA, 1303 bp, Zea mays
ccctcgcctccagcgacttttttttcaagaagacaggagaagggagttgtagtgagttttaagaatggcgagtgcacaggcagtggggcaaggagaacgaggccacttcgttctgaagagcggacacaccattccggccgttggtctaggcacttggagggccggctcagataccgctcactctgttcggaccgccatcgccgaggctggatataggcacgtggacacagctgcccaatacggagtagagaaagaggtcggtagaggacttaaagctgcgatggagggcgggatcaacaggaaagatttgtttgtgacgtcgaagctatggtgcaccgagctggctcctgatagggttcggccagcactcgagaaaacactcaaggacttgcagctggattacctggatctctaccttatccactggcccttcaggctgaaagacggggcgcacatgcccccggaagccggggaggtgctggagttcgatatggaaggggtgtggagggagatggaaggcctcgtgaaagacgggctcgtcaaggatataggtgtctgcaattacacggtcgccaagctcaaccgcctgatgcggtcagcgaatgttccaccggcagtgtgccagatggaaatgcaccctgggtggaagaacgacaggatctttgaggcatgcaagaagcatgggatccatgttactgcttactctccgctgggtccgtcagagaagaacctagcgcacgacccgctcgtcgaaaaggtagccaacaaactggacaagaccccggggcaggtgctcctcaggtgggcgctccagagggggacaagcgtcattcctaaatcgaccaaggacggaaggatcaaagagaacatccaggtgttcgggtgggagatccctgaggaggacttcagggccctgtgcggcatcaaagatgagaagcgcgtgctgaccggagaggagctgttcgtgaacaagacccacgggccgtacaagagcgcgaccgaggtgtgggaccacgaggactgagcggagctgccgtgccgccggatccctccactccacctgatgaaaccagaataaaggataccgacgcacctgtcagtcacctccctcccgtgccttgcgagagcggcagcctctcgcacagggaagatgctctgtgtctgagagcatgcagcctcgcacgagaaagatgcagaaggagtgtgtgtggcgcgcaatacactcctgtactgtacgatagactgaataataataaagaagaaaacgcagcagtttgccgttgcgttttcctttgtgcttgcg

SEQ ID NO: 20170 - DNA, 1327 bp, Zea mays
  misc_feature (1309)..(1309): n is a, c, g, or t
gctgtacgcctgcggtatccggtgcgcggagtctccggtgcgacaagcgactttatttcaagaagacagaagaagggagagtcgtactgaggtgtaagaatggcgagtgcacaggcagtggggcaaggagaacgaggccacttcgttctgaagagcggacacaccattccggccgttggtctaggcacttggagggccggctcagataccgctcactctgttcggaccgccatcgccgaggctggatataggcacgtggacacagccgctcaatacggagtagagaaagaggtcggtagaggacttaaagctgcgatggagggcgggatcaacaggaaagatttgtttgtgacgtcgaagctatggtgcaccgagctggctcctgatagggttcgaccatcactccagaaaacactcaaggacttgcagctggattacctggatctctaccttatccactggcccttcaggctgaaagacggggcgcacatgcccccggaagccggggaggtgctggagttcgacatggaaggggtgtggagggagatggaaggcctcgtgaaagacgggctcgtcaaggatataggtgtctgcaattacacggtcgccaagctcaaccgcctgatgcggtcagcgaatgttccaccggcagtgtgccagatggaaatgcaccctgggtggaagaacgacaggatctttgaggcctgcaagaagcatgggatccatgttactgcttactctccgctgggttcttcagagaagaacctagcgcacgacccgctcgtcgaaaaggtagccaacaaactggacaagaccccggggcaggtgctcgtcaggtgggcgctccagagggggacaagcgtcatccctaaatcgaccagggacgaaaggatcaaagagaacatccaggtgttcgggtgggagatccctgaggaggacttcagggccctgtgcggcatcaaagatgagaagcgcgtgctgaccggagaggagctcttcgtcaacaagacccacgggccgtacaagagcgcaaccgaggtgtgggaccacgaggactgagctgagctgccgtgccgccggatgcctcccactcccacctgatgaaccagaataaaggataccgacgcacctgtcagtcacctccttccccgtgccttgtgagagcggcagcctctcgcacagggaagatgctctgtgagagcagcagcctcgcacgagaaagatgtagaagagagtgtgcgcgcaacacactcatgtactgtacgatagactgaataataaagaagaaaacgatccacatctcgcccgntgcgttttccttcgtgcg

SEQ ID NO: 20171 - DNA, 1158 bp, Zea mays
  misc_feature (1113)..(1113): n is a, c, g, or t
aagaggtgaaatagtaggtttattggagcctaagtttgcattactgacagtatatacaagtaggtgggcaaaaaatggtcttacaaatgtaaacaatgatatatatagtcacctacattcttgaatattacattttgaatgacaacttcaccaccacatgaatagaagatctagcttttattttctcttagccactcaacaaaattgtctagaatcaaaggccaagcaaggtctgaatcataattgtcaagtgatgggaagtttatctcattacagaaccgcataaatcccatccactgatccatgtttatcaccttgtagtcattttggtacttgaggtaattactaagcttgtcaacctgagggcggaactgcaagcctaatactagattcagcaactcacaagcaactggtatttctatacacttcttcttatcctctgtgaggcaataacgaaatgcatatatgtagaaatcctggaaatttgacggccttgtaacctcttgaaccagttcaggaaatgctttcttcagtttactgatgctgtctgctcgaagagctttcaaaccagctctccattcatccaaggtaaaataaccttgcttctcacagcccattttccatgctaacattagaatcctaacgtcggtgtggggaacttcaaggtgagaacagagtgtttcaatgccttctgggtcaatcatgacagatgagttatcggcataagtatagaaaaattgatcaatccgttctacttccttggaaactgctttagtagggccacgttgtgctttcctgctggtcaggtttgtactgactccttttctttttctgttttgtttttcatttacttgttccgcaccagcgctagcggtcgcggcagacgacaaggatttcttcgaggcgcgcctcatggtggcggcaggctggcttgctcctgaacccaccctcttccgcgtctgattcgggaccacctcaggttcttctctcctcgtcgcgacgagttctctcccttctgggtgcgagccccgagttcgttgtgggagaacaaaaggggaggaagacggaggggcattcgattttattttttttttttttttttttttttttttnttgaagtaacaccatggtaaacaagtccatcccggcccggccggc

SEQ ID NO: 20172 - DNA, 1070 bp, Zea mays
ggggcagagccttgcttccccaaactgctactaaacacaaaattcggtaagggagttatcagtgagtttgcactactgccgaagtatatacatgtgggtggtccaaaattgatgtcttacaaacgcaaacaatgatatagtcacctacattcttgaaaattacattttggatgacaacttcaccacaggaatagaatatctagcttttattttctcgtagccactcaacaaaattgtctagaatcaaaggccaggcaaggtctgaatcataattgtcaagcgatgggaagtttatctcattacagaaacgaataaatcccatccactggtccattgttatcaccttgtagtcattttggtacatgaggtaattattaagcttgtcaacctgagggcggaactgcaagcctaatactagattcagcaactcacaagcaactggtatttctatacatttcttcttatcctctgtgaggcaataacgaaatgcatatatgtagaaatcctggaaattggatggccttgtaacctcttggaccagttctggaaatgctttcttcagtttactaatactgtcagctcgaagagctttcaagccagttctccattcatccaaggtaaaataaccttgcttatcacagcccattttccatgctaacattagaatcctaacatcagtgtggggaacttcaaggtgagaacagagtgtttcaatgccttctgggtcaatcatgccagatgagttatcagcgtaagtatagaaaaattgatcaatccgttctacttccttggaaactgctttagtagggccagcgctggcggtcgccgtagacgacgacgatttcttcgaggtgcgcctcatggcggcggcaggctggcttgctcctgaacccaccttcttccgtctctgattcgggaccacctcaggttctcctcttcacctcgcgactagttcttccttctcggttggcgagtcccgagttcgctgtcgggggcctcgggggagccggagagaaggggaggaagagtggaagactaggaggccccggccggcctcgaggtacccaatg

SEQ ID NO: 20173 - DNA, 1108 bp, Zea mays
ggtggggggggggggcatatgattgtacaaaatattgttttgcactgtacactatttactttttttttttttttttaagaggtgaaatagtaggtttattggagcctaagtttgcattactgacagtatatacaagtaggtgggcaaaaaatggtcttacaaatgtaaacaatgatatatatagtcacctacattcttgaatattacattttgaatgacaacttcaccaccacatgaatagaagatctagcttttattttctcttagccactcaacaaaattgtctagaatcaaaggccaagcaaggtctgaatcataattgtcaagtgatgggaagtttatctcattacagaaccgcataaatcccatccactgatccatgtttatcaccttgtagtcattttggtacttgaggtaattactaagcttgtcaacctgagggcggaactgcaagcctaatactagattcagcaactcacaagcaactggtatttctatacacttcttcttatcctctgtgaggcaataacgaaatgcatatatgtagaaatcctggaaatttgacggccttgtaacctcttgaaccagttcaggaaatgctttcttcagtttactgatgctgtctgctcgaagagctttcaaaccagctctccattcatccaaggtaaaataaccttgcttctcacagcccattttccatgctaacattagaatcctaacgtcggtgtggggaacttcaaggtgagaacagagtgtttcaatgccttctgggtcaatcatgacagatgagttatcggcataagtatagaaaaattgatcaatccgttctacttccttggaaactgctttagtagggccagcgctagcggtcgcggcagacgacaaggatttcttcgaggcgcgcctcatggtggcggcaggctggcttgctcctgaacccaccctcttccgcgtctgattcgggaccacctcaggttcttctctcctcgtcgcgacgagttctctcccttctgggtgcgagccccgagttcgttgtgggagaacaaaagggaggaagacggaggggcattcgatttttccccccggccggcctcgagcggacccaatg

SEQ ID NO: 20174 - DNA, 1080 bp, Zea mays
tcctgtccgggcgcgcctcgaggccggccactgttgttttgttcttgcggagacgagacgagacgaggcgacgcgagtcgcgaggagtcgaggaggatcggggctcaggcaagatgaacaggaagccaggagactgggactgcagggcgtgccagcacctcaacttcagccgccgagacatatgccagcgctgcagcgagccacgtggagttgctgatcgtggcggcggaggaggaggaggcgactacgccagcttcggtggccgcggtggctcctccttcggcggcggctttggcgctgctggctctgacgtccggcctggtgactggtactgctcctgcggcgcgcacaacttcgccagccgctccagctgcttcaagtgctccgcctacaaggaggaggccgctgtgaacagtggcgctggcggctttgacggcgacatgtcacgctcacggggctacggcttcggcagcggtgctgctggtgctggtgctggcgctgcccgtactaccaaccgccccggttggaagtccggagactggatctgcaccagatccggatgcaacgagcacaacttcgccagcaggatggagtgcttcaggtgcaacgcaccgcgggactctggtagcgctgccatgacctacgaaaactacttgcactgaggtgtaggatcgagcaagttaaaaagtctgcagcgccgaagaaagcgacgacaagaggagtcctcatcacgtcgtaacgtaagagagagagagtagtggatttgcaacaaaaaaaaaaaagaaaagcggccgcgatgctctgttactagctagctagttttgttcaaccacccatgccgtctcttctcttttattagatttggtttggttctcatagccctttaattaccatttgggacctatgtttgctgttctgtttcccgttcgtctcctccgcatgtttgcgcgtggatcgagtcttgtgatgtaaccccccaaaaaacgcttgcttaactagtactgttgcttcttaatatctccgggggcgttggtgtaaaggctagctccaacaaggagctttaaaaggttctgtacccgc

SEQ ID NO: 20175 - DNA, 1153 bp, Zea mays
  misc_feature (7)..(8): n is a, c, g, or t
  misc_feature (25)..(25): n is a, c, g, or t
gtgattnncttgttcctcgcgggcnaaagcgcgctaagaatcaaaggcacaaagatagctcaccctcggtttcagcatcccctccaaacttcactataaatacccctgcacacacgcacccggcccggccatcaccaccatctcacttcatataccactccctaggaggacccagcaacacacacagccgagctttgtttaggcaagatgaacaggaagccaggagactgggactgcagggcgtgccagcacctcaacttcagccgccgagacatatgccagcgctgcagcgagccacgtggagttgctgatcgtggcggcggaggaggaggaggcgactacgccagcttcggtggccgcggtggctcctccttcggcggcggctttggcgctgctggctccgacgtccgccctggtgactggtactgctcctgcggcgcgcacaacttcgccagccgctccagctgcttcaagtgctccgcctacaaggaggaggccgctgtgaacagtggcgctggcggctttgacagcgacatgtcacgctcacggggctacggcttcggcagcggtgctgctggtgctggtgctggcgctgcccgtactaccaaccgccccggttggaagtccggagactggatctgcaccagatccggatgcaacgagcacaacttcgccagcaggatggagtgcttcaggtgcaacgcaccgcgggactctggtagcgctgccatgacctacgaaaactacttgcactgaggtgtaggatcgagcaagttaaaaagtctgcagcgccgaagaaagcgacgacaagaggagtcctcatcacgtcgtaacgtaagagagagagaggagtgagagagagtagtggatttgccaaaaaaaaaaaagacggccgcgatgctctgttactagctagctagttttgttcaaccacccctgcctgccgtctcttctcttttattagatttggtttggttctcatagccctttaattaccatttgggacctatgtttgctgttctgtttcccgttcgtctcctccgcatgtttgcgcttggatcgagtcttgtgatgtaaccccccaaaaaaacgcttgcttaactagtactgttgcttcttaataaaagaaaaaaaaaaaaaaaaaaggccccta

SEQ ID NO: 20176 - DNA, 495 bp, Zea mays
  misc_feature (479)..(479): n is a, c, g, or t
tgttttgttcttgcggaaacgagacgagacgaggcgacgcgagtcgcgaggagtcgaggaggatcggggctcaggcaagatgaacaggaagccaggagactgggactgcagggcgtgccagcacctcaacttcagccgccgagacatatgccagcgctgtagcgagccacgtggagttgctgatcgtggcagtggcggcggcggaggaggaggaggaggcgactacgccagcttcggtggccgcggtggctcctccttcggcggcggctttggcgctgctggctctgacgtccgccctggtgactggtactgctcctgcggcgcgcacaacttcgccagccgctccagctgcttcaagtgctccgcctacaaggaggaggccgctgtgaacagtggcgctggcggctttgacggcgacatgtcacgctcacggggctacggcttcggcagcggtgctgctgggtgctggtgctggcgcnggccgtactacgagat

SEQ ID NO: 20177 - DNA, 999 bp, Zea mays
  misc_feature (900)..(900): n is a, c, g, or t
  misc_feature (904)..(905): n is a, c, g, or t
  misc_feature (926)..(926): n is a, c, g, or t
  misc_feature (928)..(928): n is a, c, g, or t
  misc_feature (963)..(965): n is a, c, g, or t
  misc_feature (981)..(981): n is a, c, g, or t
gtgattcccttgttcctcgcgggccaaagcgcgctaagaatcaaaggcacaaagatagctcaccctcggtttcagcatcccctccaaacttcactataaatacccctgcacacacgcaccttgctgcatcaccaccatctcacttcatataccactccctaggaggacccagcaacacaacagccgagctttgcttaggcaagatgaacaggaagccaggagactgggactgcagggcgtgccagcacctcaacttcagccgccgagacatatgccagcgctgtagcgagccacgtggagttgctgatcgtggcagtggcggcggcggaggaggaggaggaggcgactacgccagcttcggtggccgcggtggctcctccttcggcggcggctttggcgctgctggctctgacgtccgccctggtgactggtactgctcctgcggcgcgcacaacttcgccagccgctccagctgcttcaagtgctccgcctacaaggaggaggccgctgtgaacagtggcgctggcggctttgacggcgacatgtcacgctcacggggctacggcttcggcagcggtgctgctggtgctggtgctggcgctgcccgtactaccaaccgccccggttggaagtccggagactggatctgcaccagatccggatgcaacgagcacaacttcgccagcaggatggagtgcttcaggtgcaacgcaccgcgggactctggtagcgctgccatgacctacgaaaactacttgcactgaggtgtaggatcgagcaagttaaaaagtctgcagcgccgaagaaagcgacgacaagaggagtcctcatcacgtcgtaacgtaagagagaggagtgagagagagtagtggattggccttttctgggaaaagtcttaanctgnncccccttttttgattctatgncnatccgtgttaactggcgtattcccggccccccccnnnaagtccatcccataancagacaccggcggagggg

SEQ ID NO: 20178 - DNA, 846 bp, Zea mays
ccggccgggatcaccaccatctcacttcatataccactccctaggaggacccagcaacacacacagccgagctttgcttaggcaagatgaacaggaagccaggagactgggactgcagggcgtgccagcacctcaacttcagccgccgagacatatgccagcgctgcagcgagccacgtggagttgctgatcgtggcggcggaggaggaggaggcgactacgccagcttcggtggccgcggtggctcctccttcggcggcggctttggcgctgctggctctgacgtccggcctggtgactggtactgctcctgcggcgcgcacaacttcgccagccgctccagctgcttcaagtgctccgcctacaaggaggaggccgctgtgaacagtggcgctggcggctttgacggcgacatgtcacgctcacggggctacggcttcggcagcggtgctgctggtgctggtgctggcgctgcccgtactaccaaccgccccggttggaagtccggagactggatctgcaccagatccggatgcaacgagcacaacttcgccagcaggatggagtgcttcaggtgcaacgcaccgcgggactctggcactgaggtgtaggatcgagcaagttaaaaagtctgcagcgccgaagaaagcgacgacaagaggagtcctcatcacgtcgtaacgtaagagagagagagtgagagagagtagtgggatttgccaaaaaaaaaaaaaagacggccgcgatgctctgttactagctagctagttttgttcaccacccatgccgtctcttctctttttttagaatttggttttggtctcatagccctttaattacatttga

SEQ ID NO: 20179 - DNA, 1085 bp, Zea mays
cgggaccctccggcccggccggggcatcaccaccatctcacttcatataccactccctaggaggacccagcaacacacacagccgagctttgcttaggcaagatgaacaggaagccaggagactgggactgcagggcgtgccagcacctcaacttcagccgccgagacatatgccagcgctgcagcgagccacgtggagttgctgatcgtggcggcggaggaggaggaggcgactacgccagcttcggtggccgcggtggctcctccttcggcggcggctttggcgctgctggctctgacgtccggcctggtgactggtactgctcctgcggcgcgcacaacttcgccagccgctccagctgcttcaagtgctccgcctacaaggaggaggccgctgtgaacagtggcgctggcggctttgacggcgacatgtcacgctcacggggctacggcttcggcagcggtgctgctggtgctggtgctggcgctgcccgtactaccaaccgccccggttggaagtccggagactggatctgcaccagatccggatgcaacgagcacaacttcgccagcaggatggagtgcttcaggtgcaacgcaccgcgggactctggtagcgctgccatgacctacgaaaactacttgcactgaggtgtaggatcgagcaagttaaaaagtctgcagcgccgaagaaagcgacgacaagaggagtcctcatcacgtcgtaacgtaagagagagagagagtagtggatttgcaacaaaaaaaaaaaaagacggccgcgatgctctgttactagctagctagttttgttcaaccacccatgccgtctcttctcttttattagatttggtttggttctcatagccctttaattaccatttgggacctatgtttgctgttctgtttcccgttcgtctcctccgcatgtttgcgcttggatcgagtcttgtgatgtaaccccccaaaaaacgcttgcttaactagtactgttgcttcttaatatctccgggggcgttcatcttgttcttgctttatggtgtaaggctagctccaacaaggagctttaaaaggttctgtaccct

SEQ ID NO: 20180 - DNA, 1069 bp, Zea mays
ccctccaaacttcactataaatacccctgctcccccgcgccttgcgatgcggccaccatctcacttcatataccactccctaggacccagcaacacaacagccgagctttgcttaggcaagatgaacaggaagccaggagactgggactgcagggcgtgccagcacctcaacttcagccgccgagacatatgccagcgctgcagcgagccacgtggagttgctgatcgtggcagtggcggcggcggaggaggcgactacgccagcttcggtggccgcggtggctcctccttcggcggcggctttggcgctgctggctccgacgtccgccctggtgactggtactgctcctgcggcgcgcacaacttcgccagccgctccagctgcttcaagtgctccgcctacaaggaggaggccgctgtgaacagtggcgctggcggctttgatggcgacatgtcacgctcacggggctacggcttcggcagcggtgctgctgctgctgctggtgctggcgctgcccgtactaccaaccgccccggttggaagtccggagactggatctgcaccagatccggatgcaacgagcacaacttcgccagcaggatggagtgcttcaggtgcaacgcaccgcgggactctggtagcgctgccatgacctacgaaaactacttgcactgaggtgtaggatcgagcaagttaaaaagtctgcagcgccgaagaaagcgacgacaagaggagtcctcatcacgtcgtaacgtaagagagagagtagtggatttgcaacaaaaaaaaaaaaaagacggccgcgatgctctgttactagctagctagttttgttcaaccacccatgccgtctcttctcttttattagatttggtttggttctcatagccctttaattaccatttgggacctatgtttgctgttctgtttcccgttcgtctcctccgcatgtttgcgcttggatcgagtcttgtgatgtaaccccccaaaaaacgcttgcttaactagtactgttgcttcttaataaaaaaaaaaaaaaaaaaactcgagagtattttagacggccgc

SEQ ID NO: 20181 - DNA, 1897 bp, Zea mays
ttctactatttgtgcttgctgcctctccgttctttctatctaacgaatgatttcacacaccatacagtcacgcctaaatggcagcaagtgcatatagtacgaaactctcaaacaagacacaacagatactaaatccaaaaggcgaccagccaagtgtcaattgtatgcctataacaaatgaggtcagatatcatcactcttcatctcagggccgtaacagacaaaggccggttctagacatgaggaagatcagttctcagttgttactccgccagtggatgcctgatgatcccacgcccttcatccagaaggaagccgttgtccctgaagcacgcgctggagaagaacggcttcagatcgtagatctcgtattcttgggccttgttcctcaggtcctccaatttgacctcgacgtgagtaagacgtgaggctgatcctgccatgatttcttcgaagtgcacggcgtccttgaccagtgtgcgcaggagcagcaggagcagctcgttgtagtccttcttgaatgtcatgtacttccggaaattcttttgaagtgctttctgcacaccgaacttctgagtcgaaataaaagagtcaagcaagacacggatggccatgtcaacatcttcctgagacacgtagctcctcagatgcatccttgcatgtgcctccgacatccggatgattgactctatatgccttactgcaataggaaccccttggccatgagaggattcacggcggagttcagcataaacatggctaatcttgtctagatcggcatcatgtattttgggaaacacattcagcttagcataggttatgtatttcttcagcatgtcttgggaaaggacatctgggtcagcttgccttgcagcagccagtggatcatcatccacatcagttgaaaccctgtcttcaaggttagcccccttcggctgggatctggcgtgactatctacaacaaaccttgcgagcatttcatctgtaaatggatcgacaatatccttaaccacacagaggacgtcgaaacgtgaaataatgggatccgtcaattcgacgttctgagtgaatgtctttgatgaatcataccttccccctactgggtttgccgcagcaataacactgcatctagcttgaagagatgtgacgattcctgcttttgatatactgatactctgttgctccatagcttcatgaatacttaccctatcttccccacccggccggccaaactcatcaatgaggcaaatgcccctatcagcaagaactagtgcacctccctcaagtgtccattctcgtgttactggatctttgtgaactgcagcagtaagaccaacagcagaggctccttttccagttgtatatactgctctgtgtcctgttttctccacatacttgagaaactgtgattttgcagtgcctggatcacccaggaggaggacattgatgtcgcctctcaggcgatgttttcccttcacattcttctcttgtccaccaaacatagcaagtgcaatggcagtcttgatatcttcatgcccataaatggatggtgcaattgatttgataatcctttctccaatccttggatcctttgacaacttctcaatctctgctttgtcctcgtccgttaatttgtatgcagaaaacagatcctgtttttttgccacatagtttgcctcaaccactgtggcaaaaacagggaaaccattctttgtattcaaagacaggtcaaaattatttgtgtatatcccagtgacctcaatctcctctcctggacgagcacagtcaatcagatcattcagaagtatgacttccttgtatctgggaagccttccagcaggaacaattcctgggctttcctgaagagtgagtttctggtagttcctatatatagtct

SEQ ID NO: 20182 - DNA, 926 bp, Zea mays
  misc_feature (6)..(6): n is a, c, g, or t
  misc_feature (11)..(11): n is a, c, g, or t
  misc_feature (50)..(50): n is a, c, g, or t
  misc_feature (65)..(65): n is a, c, g, or t
  misc_feature (67)..(67): n is a, c, g, or t
  misc_feature (71)..(71): n is a, c, g, or t
  misc_feature (104)..(104): n is a, c, g, or t
  misc_feature (109)..(109): n is a, c, g, or t
  misc_feature (131)..(131): n is a, c, g, or t
  misc_feature (139)..(139): n is a, c, g, or t
  misc_feature (143)..(143): n is a, c, g, or t
  misc_feature (147)..(147): n is a, c, g, or t
  misc_feature (156)..(156): n is a, c, g, or t
  misc_feature (164)..(164): n is a, c, g, or t
  misc_feature (187)..(187): n is a, c, g, or t
  misc_feature (911)..(911): n is a, c, g, or t
tatttntttanggcatatgcttggggaaagggacatcctaggtcaggctnggcctggcaggcaangncagngggatcatcaatccacatcagttgaaagacccngtctncaagggttaggccccttcgggntgggatcngggngtgnacttatctncaaacaanccttgggaggcatttcatctgtnaatggatcggacaatatccttagccacacagaggtcgtcgaaacgtgaaataatgggatccgtcaattcgacattctgagtgaatgtctttgatgaatcataccttccccctactgggtttgccgcagcaataacactgcatctagcttgaagagatgtgacgattcctgcttttgatatactgatactctgttgctccatagcttcatgaatacttaccctatcttgatcattcatcttgtcaaactcgtcaatgaggcaaatgcccctatcagcaagaactagtgcacctccctcaagtgtccattctcgtgttactggatctttgtgaactgcagcagtaagaccaacagcagaggctccttttccagttgtatatactgctctgtgtcctgttttctccacatacttgagaaactgtgattttgcagtgcctggatcacccaggaggaggacattgatgtcgcctctcaggcgatgttttcccttcacattcttctcttgtccaccaaacatagcaagtgcaatggcagtcttgatatcttcatgcccataaatggatggtgcaattgatttgataatcctttctccaatccttggatccttttgacaacttctcaacccccgcggccgcctcgtccgttaatttgtatgcagaaaacagatcctgtttttttgccacatagtttgcctcaaccactgtggcaaaaacagggaaaccttntttgtattcaaagac

SEQ ID NO: 20183 - DNA, 3038 bp, Zea mays
gctttgtatgcctgcagcacaaagtctgaaatcagattccagagatggagatagtccactaagatccaaacagatggagatctagcaatatcaaaaatccatcttatatctgagaaggcttcatgaatcgttcttttgttagaaattctcttcggaattgccttaaatattctaggtgcaagattagcaattttctacccataaatccatttatcaatctagaacaaagtgtgtgcccaattcccaacttccgagagcagcaccaccgggaagaaagctcgtgctttttgcctgacacttggataggtaaactacacaatgtccaactaagctctttgagaccggagatgcaagtctgtccatctagagaggtctacaaacacttcctcatgcaacgaagcagtgccctttcgacttcatttcaccatataaggttatgtttggatactcttatatttacttcgatacatatggttggggtggattgagggctcgttcgtttcaccgttaatacatgtggattgaatggtatttggagtcggtttaaatacatagcaagttaaaatacatctcaatacattctaatccacatgaattagaataaccgaaatacattctaatccacatggaattagaataaccgaacaaggcatgagatataaatcggtttaatttacatcttaatccccctcaacccatgagtattgggatgaataccaagccctaaagaaaacttattctgatttttatcaatagtcttgatagcccaagagggaatattaataactatagaaagatacataagcatcccattaagcacataatgttcttgcactctcgtgaatatgatttccatccggagagttgatctacaattctatctacaaaaggttgtaactgaacagaacagccaaagagggcagctaaggcagccacatattcgtcagacaagggttgatggaaaagcttagcatactcttcttctaaggcatggcaactgatgcattcatcatcttcaataaccctcagggtcttttggctgcagttcgtttttgtttctttttctaactatttgttgcttgcagccacaccgatcattctatctaacgaatgatttcacacaccatacagtcacgcctaaatggcagcaagtgcatatagtacgaaactctcaaacaagacacaacagatactaaatccaaaaggcgaccagccaagtgtcaattgtatgcctataacaaatgaggtcagatatcatcactcttcatctcagggccgtaacagacaaaggccggttctagacatgaggaagatcagttctcagttgttactccgccagtggatgcctgatgatcccacgcccttcatccagaaggaagccgttgtccctgaagcacgcgctggagaagaacggcttcagatcgtagatctcgtattcttgggcctgggtcaacacaggtgcagtccagatgttagagaggtcactcagctcggttgtcttttgtgtggaagcactcatgaaggcttaccttgttcctcaggtcctccaatttgacctcgacgtgagtaagacgtgaggctgatcctgccatgatttcttcgaagtgcacggcgtccttgaccagtgtgcgcaggagcagcaggagcagctcgttgtagtccttcttgaatgtcatgtacttccggaaattctgtggacacaagaaatttatgttgatgtttgcaaggcatttcactggtttaaggactacccacacccagactgactagtaaaaaagggtaaaaaaagattaatctgcatccggtcttggaaagcaatgcataataattaatttagtgacatttactgacaactatactgtctcgtacattatttcagttaaatggatgagcacttttacattaaattgtttatcaagtgcatgtacttgtgtagcactggatgatgtaataacagctcacttccggaaattcttttggagtgctttctgcacaccgaatttctgagtcgaaataaaagagtcaagcaagacacggatggccatgtcaacatcttcctgagacacgtagctcctcagatgcatccttgcatgtgcctccgacatccggatgattgattctatatgccttactgcaataggaaccccttggccatgagaggattcacggcggagttcagcataaacatggctaatcttatctagatcggcatcatgtattttgggaaacacattcagcttagcataggttatgtatttcttcagcatgtcttgggaaaggacatctgggtcagcttgccttgcagcagccagtggatcatcatccacatcagttgaaaccctgtcttcaaggttagcccccttgggctgggatctggcgtgactatctacaacaaaccttgcgagcatttcatctgtaaatggatcgacaacatccttaaccacacagaggacgtcgaaacgtgaaataatgggatccgtcaattcgacgttctgagtgaatgtctttgatgaatcataccttccccctactgggtttgccgcagcaataacactgcatctagcttgaagagatgtgacgattcctgcttttgatatactgatactctgttgctccatagcttcatgaatacttaccctatcttgatcattcatcttgtcaaactcatcaatgaggcaaatgcccctatcagcaagaactagtgcacctccctcaagtgtccattctcgtgttactggatctttgtgaactgcagcagtaagaccaacagcagaggctcctcttccagttgtatatactgctctgtgtcctgttttctccacatacttgagaacctgtgattttgcagtgcctggatcaccccgcgcgtccgcattgatgtcgcctatcaggggatgttttcccttcacattgttgtcgtgtccgccaagcatagcaagtgcaatggcagtattgatatcttcatgcccataaatggatggtgcaattgatgtgataatcctttgttcaatccttggatcctgtgacaaacggcgtgc

SEQ ID NO: 20184 - DNA, 2595 bp, Zea mays
  misc_feature (33)..(33): n is a, c, g, or t
  misc_feature (569)..(569): n is a, c, g, or t
tttgtttctttagagactaaaagtgacaaggtnttagtgcataaattttatcatcaatttgtttggaaaaaacatccgttctataattaagagaaattacataattcaaagaaaaattacatattttgtaaaaaacaatacaacactactcatcgtcatcatttttttcctcgtctaatttcaattgtatggacaaattttatatggctaacttaagggtgatagattgtactattgattgcgttattttttggttggtcttatagaacatgtagaggttgctcactcttcacactctctaaaatagtgtagtctacaatttaaaatagtattttgtatgctcactagcgagttgttcgttttgttacagtttgtatatattatataaatagttattgagacatttatttaaaattaattattatttaaatataaatactatggtacgtggggttcagcggttagcccaaaaatttggaggagggggtgtgggttctattgctcgctctcgcgggcagagtcgagtgctggactggcgagatagctagttgcgcgggcgtggggcccanagggcagtagctgagagagcactgcgcggacgctgggtgtgagggccatagagcacgacgggacaggagaaccagtcggaccgcgtggagcgagccaaattgtgaggatgaaactgtggtaacaccagatatccatattagatttttaatagagtaatatagatatatacgctagagatgtccagatggaccgggcggcccaaaatccggcacgtcacgtagtgaatcggatctgtgccggtccggccaggtcaccgggccatgcctgggctaaaggcgtggcacgacgggttagacctggcatgacctagttttatttttttattttatctataaatacttatattatatttaatatagagtataaaacataaaccctaaaatatgcatactttttaagatatttttatcgtttaaacataaaatattgtcatggtcccgttaaacctatcaggccatgaatcagcccgacacgattattaacctagcgggtcgtgcttgaacctcacttggagctatgagccaacacgacacgacccgctagctaattcgggcagggcaggcacgcccgctcatttgactcatttgaacgtctataatatacgatgaagatgaccaagaggctcaaagacacggaaggagacgacaagcctttcgcccagtaagaatcaagaaaaaaaagtttcttttggttgctggacgcctgacagttccctggcgttcacggaaactgattgtcaatccgggctgggccgacgtggcttagtttcgtggcgcttacgaaattacgcagccgcagctcaatgtataatgctcgaggccggccgggcgggcaagcattcgatccgttcccttgccctaagacccacccctgatttcatttccccaatcatggcggcggctctgtcggggacggcggtgtccacggcagcgcttctagccccaatccgagctccaaccagcgcgtttatccggcgctcccagctcacctgtcatcgcctccactcactaaaatgccgccgcgctgggcccatcgtccccgcggccgctgctgccgcggcgggcagcagctcgccgtcgtcagccgttttccacggcgagtgcttcgtggtgggcgacaatatcgacaccgaccagatcatccccgccgagcacctcactctggtgccctccaagccggacgagtaccgcaagctcggttccttcgccttcgcggggctcccatccgcggcctacccgacgccgttcgtcgctccgggtgaggagtcctcccgctacgccatcattgtcggcggagccaacttcgggtgcggttcctctcgcgagcacgcgcccgtcgcgcttggggccgctggcgcacgcgccattgttgcggagggctacgcgcgcatcttttttcgcaactccgtggccactggggaagtgtaccctctggagctcacggacgttggggcctggaaggagtgcaagacaggggatgtggtcaccgtggaccttgctaactccgtttttattaaccacacctctggcaaggagtacaagctgaaaccaattggtgatgctggccctgtaattgaggccggagggatctttgcctacgcccggaagacaggaatgattgcgtcgaaagctgctgcatgagggaaagatcagcttaggcagccgagcctctgcggagatgaagaagtaagctggagttaggactaagagttactgcacctacttgatgtcgacggtgtctcaaaataagttgcggcctaccgaaattatgatgaatcaatcaatttggtctttgtcacagatcgtttttttttgtttgttactagtacttgtacaattgtactcctgcctgctactgtccttatctgtttgaataactgctgtgttgccatcttatgtgtacaactctcgaaactcgctgccgttcgatgtatttgagcttttggtatgcaattaaatggttgcattcaaaaaaaaaaaaaaaaaaaaaaaaaaaaaaaaagtactctgcgttgttaccactgct

SEQ ID NO: 20185 - DNA, 1080 bp, Zea mays
attcgatccgttcccttgccctaagacccacccctgatttcatttccccaatcatggcggcggctctgtcggggacggcggtgtccacggctgcgcttctagccccaatccgagctccaaccagcgcgtttatccggcgctcccagctcacctgtcatcgcctccactcactaaaatgccgccgcgctgggcccatcgtccccgcggccgctgctgccgcggcgggcagcagctcgccgtcgtcagccgttttccacggcgagtgcttcgtggtgggcgacaatatcgacactgaccagatcatccccgccgagcacctcactctggtgccctccaagccggacgagtaccgcaagctcggttccttcgccttcgcggggctcccatccgcagcctacccgacgccgttcgtcgctccgggtgaggagtcctcccgctacgccatcattgtcggcggagccaacttcgggtgcggttcctctcgcgagcacgcgcccgtcgcgcttggggccgctggcgcacgcgccattgttgcggagggctacgcgcgcatcttttttcgcaactccgtggccactggagaggtgtaccctctggagctcacggacgttggggcctggaaggagtgcaagacaggggatgtggtcaccgtggaccttgctaactccgtttttattaaccacacctctggcaaggagtacaagctgaaaccaattggtgatgctggccctgtaattgaggcgggagggatctttgcctacgcccggaagacaggaatgattgcgtcgaaagctgctgcatgagggaaagcttaggcagccgagcctctgcggagatgaagtaagctggagttaggaccaagagttgctgcacctacttgatgtcgacggtgtctcgaaataagttgcggcctaccggaattatgatgaatcaatcaatttggcctgtcacagatcgttttttttgttactagtacttgtacaattgtactcctgcctgctactgtccttatctgtttgaataactgctctgttgccaaaaaaaaaaaaaaaaaaaaaaaaaagagggaaagcatggcac

SEQ ID NO: 20186 - DNA, 3845 bp, Zea mays
  misc_feature (6)..(6): n is a, c, g, or t
aatgangatatgcgatatagccggtggcggtggtgttgccatcccgctcgcggcgtgcagtcagtcagtcacagactccagcgagcgagggaccaaaaccctagctgaaccctcccggcccgcgcagcagctgcgtccatggaggtggacccctcgccgtcgtcgcgctcgcccaggccgccgcctccgccgctggcggcgatgccgagctacttcgacccggagtcgtccggccgtcgggaggagtaccgccgctacaggaagaggttgtcttcttcaaatgtctctcctctgctgggaagatcactctccaagacctctggaccaaggctgttatatgatggagaaagcatcccaagacagcctaatgccggtttactccttgaagacataaagcaggaagctgccgattattccaacgtagaaagcttggatggattgagactgttcggttcgccgaaaaggacatctctcgatggcggttctgcatcaggcgcagcttacagttcgggcaggcaagcagtgaggcagacgctgaagccagtcaaactggaggacgatatgtatgtgccgcatgaaggagaaacgccttctacaatgtttgcaactctccttgattctgggatccaaggtttgatgcacttccctgatgtaattcaacaatttgagaggacatgtcgaaatgcttcggagtcaatcagatctgctgcaactggaaagcttcgtgtggtggaagagaaacttatgcagcaaaatgctcaacttttactggacgaagctgcttcctggtcacttctttggcacatatatggcaaagaacatgaggagctttctggagagctgttggtgccgccaattacatctcatcaggaggcttgccgctttgttgcagcagacattacagcacaactgtgtctgcggatcatactttggcttgaaggtcttgcttctgaagctcttgatttggagaagaaggtgagaggcccgccggttggttcgtacctaccaagttctggtgtttggcaccgtacacagaggtacctaaaaaggaacaatgctgattctactatagtgaagcatgtggattttgatgctccaactcgtgaaggggcccaacttcttcctgatgacaagaagcaagatgaattgcttctagaagatatatggactcttttaagagcaggaagattagaagaggcatctgacttgtgccgttctgctggccaggcatggagagttgccactctttgtccttttggcggcataaatatgttcccttccctgaatgcattgcacaaaaatggaaagtacagaacactacaagccatggaattagaaagtggtgttgggcggcagtggcgtctttggaaatgggcatcatattgtgcttcagagaaaatcgctgagcaagatggaggccgttatgagatggctgtatatgctttacaatgcagtaacttaaagcgtgtcttgccaatctgtactgactgggagtcagcttgttgggcaatggcaagatcctggctagatgttcaagtggatctagaattatctcagtaccaaacaagtagaccagaaaagcaacttgatgacgacatgaatggagcccaaagttcagttggtccagaaagttggccataccatgttcttgatcagcaacctcatgatttaactgctcttctgcagaaactccactcaagtgaccttgttcatgaaactgtctctcgagcatgccgagagcagcatcgacaagttcagatgaatctgatgagtggaaatatatctcatcttcttgaccttctatggtcatggttatcacctgctgaagagaaccataataatactgcaaggccccttgatgaccctgagatgatacggttcggggcacatattgttcttgtgctgaggcaccttttcagtgatgggatggatgatgagttagatgaaaaactggttactgtcggtgatctcatcatcaacatgtacgtgaggtatttgttctcagaggatcaagaggagttggttggaatatatgcctcacagcttcaacatgacctttgcattactttgtttgtagaaatgatggaactaaggttaaatagcagtttgcatactatgtacaagctcttcctttctgctgtggagtatctgccattctcatctgataatgtatccaaggcttgttttgaagagatcatcgagagggtgctttcaagatctcggcaaacaaaacccactaagtatgatggggatttctctgatgttgcgcatcaacatcacctgcaatcacttcaaaaggctatggttattcagtggctttgcttcacaccaccatcctcgattccagactttcaaatgatcagtgggaagcttctgatacgggcattgacacatagcaatacactgttcagggagttttctctgatatcaatgaggagagtccctgagctaccagcagggccacacaagttgcttgccattttagctgaaccgttaaagcaaaaagaaaatttaatttcacgggaagatccggaggtatctgataacttgccggagtttgaagattggcatgaatattactcccttgacgcgacttaccgcagttggcttaaaattgagatgatgaatgccgctgtttctcctgagatgctttcggcagaggaaaagggtcaagctgttgctgcagctaaagaaacactgaacttggcatgttcgttactacgcagggatggaagaccatggctgtatgctgtcgagagcagtccatttgaatcccccgatgttattttccttgagctgcatgcttctgcaatgctctgcctaccttctggagaatgtatgttaccagatgcaacatcatgcacagctttgacaagtgcactatattcaactgtcagtgaagatgatgtgctgcatcgcctgttgaaggtggatgtccaggtctcttctagagacccctgctgtattgaagtcgctcttcgctgcttagcagcagaaggtgatggatatgggcttcatgaagccaacgatggaggtcttcttgctgcagtcatggctgctggctttaaaggtgaactcagtcggttccaacctggagtttcgatggcaatttcacggcttgatgcttggtattctgaccggagtggttccgtggagagcaccgctgcttacataattcgagggctgtgtcggaggtgctgccttcctgaaacaattctaagatctatgcaggcatgtatcgcactctccgcggctggtgatgatctagattactctctagataaatgtgacgaacttgttgagttagttggttcagccgagtctggaatgatgcatttgttcagccagcagcagttgcaggagttcctgattttcgagagggaatatctcatatgtacaatggagcttgaggaggaccggttgccttgtgatggctaagctttttccccacttgctgactaatccatgagacatgaccggcatgtgcattttgcggcgccgtgacccaagaacctgctgtgatgtatcgctacaccatttcaaagcggaaagatggaatttagtgcgtaacgtggttctgcccgtttgtgcacgagaattggcccgttttggaaagtcaatataagattattcaagtcgaaatccaagatttttgttcatgataaaaacaatgttcggcgcgaaaaaaaaaaaaaaaaaaaaaaaaaaaaaaaaaaaaaaaaaaaaaaagggcggtcggcggcctccggaaatttttgaccgggcactcgctaactaattacctcctggacccttaaaaaattccccctatagggtcttggaagtaaaccttgttgcttttttgg

SEQ ID NO: 20187 - DNA, 1234 bp, Zea mays
ggccgcctttttttttttttttttccagtatggatattgttttaatcgggcggcgttcgagtaaaatttcagcgtgccgtgcatcatatgatttcaacacacacaattgggtaccaccaaatacaacctcattatctgttcatcaaaagtccaccaaaccactccaccgcacaattgagacatggcatcacacgccgattgacctccactccgcacccttgcctccttcgttctaacacgactacatgccgtctaaactagagacccagctgctgtctacacaccattgccatcgccatcgtctatcacaggcaggcagcttctcagtcgtgctaatacatttgctactcaggtcaggcatccctggacgcctccttctgcagtgtcttcctcatgaaatccgagatcctcgaggacgccatgacacccctctctatgcagttgaaatagtcatcttcagacattgctccatgcgtgatgcaagttatcaatcctcgctcggactcctcatctcgctgtgtcgggtccttcgattcgactgacttgcgcgagttcggaaacaccaggtgagcaaacgacctagcttgctgctcttctgctctgctagtgtctaagataaccacaccattgtccatcactccacagctaatcgcgacagcgagatgtttcatagggattccagcaaatgcaagagcagcacaagaagcattaattgcacatgacataagagaaccatcatcacccacaacctgaagcacgacagaggtggtggtgttaggatgaactgtgagcaagcagatgctctgcaacgtcctcttgagtgtcatctcatattccctctcttgccttccgatctggccggtcttgggcttccacacgacctcgatggaggccttctcggggttctcgcccttccgggttcccgacttgggcccgtacacagcggccagcacgacggtgtcgccctgcgcccaccgcgcggagccgtgggcgcggtggagcgggttcccggtgcaggtgaacggccggagctggttcggattccgcccatccgcgcggctacctccctccatcatcccctcccactacgctccggttgtccacggcggcggcggcggcgcagggagaaaccagataggcgctagaaccctactcctcgaccgactggagtggaacagtaagggtaacctagcctcgctggacgatgtacagagcacagaataatcctagccgt

SEQ ID NO: 20188 - DNA, 1221 bp, Zea mays
  misc_feature (8)..(40): n is a, c, g, or t
  misc_feature (99)..(99): n is a, c, g, or t
tggccctnnnnnnnnnnnnnnnnnnnnnnnnnnnnnnnnnttttttttttttttttttgcagctcaccgacacacgtacagtatggatattgttttaantcgggcggcgttcaagtaaaatttcagcgtgccgtgcatacaatctcattatctgttcctcaaaagtccaccaaaccatccgcagctaagctagtgcgtggcatcacacgccgattgacctccactccaccgcacccttgcctccttcattctaacacgactacatgccgtctaaactagagacccagctgctgtctacacaccattgccatcgccatcgcctcagcttctcggtcatgctaatacatttgctactcaggtcaggcatccctggacacctccttctgcagtgtcttcctcatgaaatccgagatcctcgaggacgccatgacacccctctctatgcagttgaaatagtcatcctcagacattgctccatgcgtgatgcaagttatcaatcctcgctcggactcctcatctcgctgtgtcgggtccttcgattcgactgacttgcgcgagttcggaaacaccaggtgagcaaacgacctagcttgctgctcttctgctctgctagtgtctaagataaccacaccattgtccatcactccacagctaatcgcgacagcaagatgtttcatagggattccagcaaatgcaagagcagcacaagaagcattaattgcacatgacataagagaaccatcatcacccacaacctgaagcacgacagaggtggtggtgttaggatgaactgtgagcaagcagatgctctgcaacgtcctcttgagtgtcatctcatattccctttcttgccttccgatctggccggtcttgggcttccacacgacctcgatggaggccttctcggggttctcgcccttccgggttcccggcttgggcccgtacacagcggccagcacgacggtgtcgccctgcgcccaccgcgcggagccgtgggcgcggtggagcgggttcccggtgcaggtgaacggccggagctggttcggattccgcccatccgcgcggctacctccctccatcatcccctcccactacgctccggttgtccacggcggcggcgcagggagataggcgctagaaccctactcctcgaccgactggagtggaacagttttggtaacctagcctcgctggacgatgtacagagcacagaataatcct

SEQ ID NO: 20189 - DNA, 1774 bp, Zea mays
catatcacacatcacattgcagcccaccgacacacgtacagtatggatattgttttaatcgggcggcgttcaagtaaaatttcagcgtgccgtgcatacaatctcattatctgttcctcaaaagtccaccaaaccatccgcagctaagctagtgacgtggcatcacacgccgattgacctccactccatcgcacccttgcctccttcattctaacacgactacatgccgtcaaaactagagacccagctgctgtctacacaccattgccatcgccatcgcctatcacaggcaggcagcttctcagtcgtgctaatacatttgctactcaggtcaggcatccctggaagcctccttctgcagtgtcttcctcatgaaatccgagatcctcgaggacgccatgacacccctctctatgcagttgaaatagtcatcctcggacattgctccatgcgtgatgcaagttatcaatcctcgctcggactcctcatctcgctgtgtcgtgtccttcgattcgactgacttgcgcgagttcggaaacaccaggtgagcaaacgacctagcttgctgctcttctgctctgctagtgtctaagataaccacaccattgtccatcactccacagctaatcgcgacagcgagatgtttcatagggattccagcaaatgcaagagcagcacaagaagcattaattgcacatgacataagctaagcactgtcaaggaaacaaggactagcttcgattgaaaaaaagaagctactcatattttgagttaaaaggtcttggagtgcgcatgatgttttggcaacgaactacatttcaaggaagagccaaagatatccgacaaagattcaactctctctaattccaaacctagttgatgtgaccgattcgctcatgccttcatacattattccctataagttactacctaattgatcctagcaaatttatcaaaaaaatcattagctaacagtcagtagactaaagtttgaagctttaatattgaatgcaggacaacaaacacaataaacataaaagcagccaaactatattactgctacatcaagtggaaagatacagaaccatcatcacccacaacctgaagcacgacagaggtggtgttaggatgaactgtgagcaagcagatgctctgcaacgtcctcttgagtgtcatctcatattccctctcttgccttcctgcaaaaacaactcgccatttcagtgacccggtaacacgcgcagccgtggggcgaagcgaactcgaggggaagagcagggtaccgatctggccggtcttgggcttccacacgacctcgatggaggccttctcggggttctcgcccttccgggttcccgacttgggcccgtacacagcggccagcacgacggtgtcgccctgcgcccaccgcgcggagccgtgggcgcggtggagcgggttcccggtgcaggtgaacggccggagctggttcggattccgcccatccgcgcggctacctccctccatcatcccctcccactacgctccggttgtccacggcggcggcggcggcgcagggagaaaccagataggcgctagaaccctactcctcgaccgactggagtggaacagtaagggtaacctagcctcgctggacgatgtacagagcacagaataatcctagccgttggtagtccatcggacggctgggaattcatgaggctttcccgaccccacatctattccgagccacccaacgaggaggacaaggtgttttgcaaaaaaaaaaaaaaaa

SEQ ID NO: 20190 - DNA, 855 bp, Zea mays
tcgaggtcgttcctatcgataagcttttttttttttttttttggagcagatgtccatgcatctaaaattttatagaagcggatgtggaggcagtcaaacagaggagaaggggacaaccgtctctatggtggtcatcagctgcccaccagggacaccacacacctggtacccttcaaacacgacaggattcaggttcgccctagcaggcgtgtatgacaagattcaagcgctcctcgatcatgacaccgctatcaactgcacgacccccaatgtggccctcatcggggagcgaggcagcgacgccgagtggcacctccaagaggaaagacgcattcctggacccaaacgtgaggcatgggaccccgctgtcggacacggtgatgacggagatctccgtgacgcgcgctctggagccgcctgtcttcgtcggagtcgttggagatgaagtcggtgactgctcaccgacgggggtgaagttcctgccgatctgcacgaccgggtctactgaccgggaccggaggcgaggccactcgaatttgttgcggatggagctccgcgctggttggatgacgccaaggcgcccggtcattttcgatccacgccatcgaccctgaatcatcctggaggttacacccgtctcttcgccacgcgcgtgcttgggtatctggatcagggcgattgagggagagagaagggggggagatggaggtgtgagtgtgggcgcgcttccatggatggaagggcgctggcgactgccatggatggaggggcgcggttgggaaggaaaggaccaaaccgtgtgccatggatggaagcgcgcgattggggaggcgcggattgcggttctggcacggt

SEQ ID NO: 20191 - DNA, 2030 bp, Zea mays
ttttgttttttttgaaacaaaaaaaagttgaaattattgatgtcataataggtctcggtaggtttcctttcttttgcctggatacaagacgacgacatttacagtaaagggcacaattgtttcaacctgcagttcagaaccatcacccagtaatggcagtgtttttgtgaactcgatcagatgaaacaaatccaagtttggtacccacaaaaataaatcaataataatacaagagagatgaaaattaaaattatcctctctttttttcaaaaactatacttgatgggtaacgtacaataaccaaggtaaggtgagcctaacaagatgaacaagcccccagggggaaaaccttgtgtggtcggcagaagacgtccaggctaacattcaaatgtcatacggttgctgtctcgagcaaatatgtatcttgcagcttcataaatgtcttccatcagccagaaaagagaaaactcatataagtctcagctcatattcgccagccatcgtgatatatctaacccaggggagtgcctggtaaccactcttttcaattatcttcagataacggacctgaatacctgatacggtgaaatatggtatctcaaatttcactcgtattggtgccttcttttctggggccccttcttccgctgttatgctaggaagactaaattctgctctgcacatgtattccttgccaccagggaatgattttactttccagaccattgcatctctctcaggagcatatgcagcagaacccattgaagttcttatatttgggtttgtggcatctgaaggaacaggcacttcaatttcaacatttgttgctgtgcttctttccttgaactgactccttgccttcaccatgagttctatacggcttctagaatgtttctcaatctgtgcttcgacccagataagaggttttacctgagtgctaagcctgtatgtcattagatcaaaagatccatcaggaggtatgaacgatatagttctatcattctcgaatctagctaaacgtacacactgatgaaatttgatatcatcaaggtctatcgcttttcctttagttgctctgccttgagcctccaaaagaaccctatcattcaagccgagtttgcactcaggcattccactcaaatatgttcgcatcttcagtgccccaaccacatctgatctcacaatctgcccattgctgttaactagaatgttaacactctctactacatccaagaagacttcattcttcttgtaacggatcccctcgctcctccatgacacagcatttgtcacggccatgggtggacgctgtgtgacctccatcctgtacgcatctgtcttgatgaactcacttaggatcttcgcctccgtgtattgtgggtacccgaaatccatcatctcatccagcaactcatacacaacgacgaagttatctctgagcgactcctcttccagttcctcgaagtagtgcttaaacacatctacgacacggtggaggaagaggaggatgctggccgcgttgcagttctggcgagcagcggtgaggaggaagacattgttgtgctggatgaacatgtacgtgacgccggcgtcgtcgtagaccacaggcgagtggacttccgagtcgccctccttgtcgaggagcttggtgaagaagcgctcggcctggagcgcggagacatcaccacgatagtcgcgccagacgaggacgcggcccttaatgtccagcaggaagagcgccgacacggcgcccgccatggtggtagggggcgatctcgtcctcgccgcccaccggatctggatctgcacgcccccgcctgcgcctccctatctgcggccagcggcggccatgcgggtgcgggggcgcgagggaggagtgttctcggatctcgcctgccgcaacgtcgcccgacgtgctcgcgcggcgcggcgctggtttgtatcggacttggaaacgcaagaatccgggaaacggaagtggagaagggagagagggctggatccgggtgcctggacagtggggcctggat

SEQ ID NO: 20192 - DNA, 2008 bp, Zea mays
ggccgcttttttttttttttgtttcaacccgcaccccagaatcatcgccagatgtggcaatgttttgttgaactcaaatcagcccatgttttccgtgtaatacagaacgaaacaaatctagtttggtacccacaaaataaatcaataacaatacaagtgaactgaaaactgaatatcctttcctccaaaactgtacttgattggtaacttacaataaccagggtaaggtgagcctaacaagatgaacagcaagccccaccacggggaggggtatggtcggcagaagacttccaggccaacatccaaatgaaaactgttcgctgtgtcgatagcaaatatgtatctttagtgtcctgcagcttcaaaagtcgtccggcagccagagaagagagaactcatataagtctcagctcatattcaccagccattgtgatatatctaacccaggggagtgcctgataaccactcttttcaattatcttcagataacggacctgaatacctgatacggtgaaatatggtatctcaaatttcacccgtatcggcgccttcttttctggggccccttcttccgctgttatgctaggaagactaaattctgctctgcacatgtattccttgccaccagggaatgattttattttccaaaccattgcatctctctcaggagcatatgcagcagaccccattgaagttcttatatttgggtttgtggcatctgaaggaacaggcacttcaatttcaacattcgttgctgtgcttctttctttaaactgactccttgccttcaccatgagttctatacggcttctagaatgtttctcaatctgtgcttcgacccagataagaggttttacctgagtgctaagcctgtatgtcattagatcaaaagatccatcaggaggtatgaacgatatagttctatcattctcaaatctagccaaacgtacacactgatgaaatttgatatcatcgaggtctatcgctttgcctttagttgctctgccttgagcctccaaaagaaccctatcattcaagccaagtttgcactccggcattccactcaaatatgttcgcatcttcagtgccccaaccacatctgatctcacaatctggccattgctgttaactagaatgttaacactctccactacatccaagaagacttcattcttcttgtaccggatcccctcgctcctccatgacacagcatttgtcacggccatgggtggacgctgtgtgacctccatcctgtatgcatctgtcttgatgaactcactcaatatcttcgcctccgtgtattgtgggtacccaaaatccatcatctcatcgagcaactcatacacaacgacgaagttatctctgagcgactcctcctccagctcctcgaagtagtgcttaaacacatctattacacggtggaggaagaggaggatgctggccgcgttacagttctggcgagcggcggtgaggaggaagacattgttgtgctggatgaacatgtaagtgacgccagcgtcgtcgtagaccacaggcgagtgcacttccgaatcgccctccttgtcgaggagcttggtgaagaagcgctcggcctggagcgcggagacatcgccgcggtagtcgcgccagacgagaacgcggcccttcatgtccagcaggaagagcgccgacaccgcgccggccatggtggtgggggcgatcaagtccttcccgcccaccggatctggatctgcacgccctcgcctgcgcctctctctatctgcggctagctgcggccatgggcggtgcggcgtagcgggggaggagtgctctcggatttcgcctgccgcaccggcgccggacgtgctcgcgcggcgcggtacagatgctgggttggatcggagctggaaacgggatccggaaacggaagtggagagggtaaggagagcgcaggatccgggtgtctttcttacgtccactgaacggtgggccccccggccggccccggccggccccgtggtacccaatg

SEQ ID NO: 20193 - DNA, 2653 bp, Zea mays
attctattatgtcttaagctaggatatcaacatccctaaggctttaaagtattttttttgagaccttaaacgttttaaatacggtactatttcaatatttagggttttacttcagaggtctttattggagatacattgaagaaggctcgtggactttgacgattttaggtccgtttcgcacgctcgtgtgagttcaggagcaccactaattctccaatctgggttccttttcgtttttttgtagtcagcattctagaacatatatttctgcagaattttgtgataatagcaggaaaaaaacactcttacggcatttcaaacacataaacacaatgtgacaaagacactgacagctagcgacatgatctgagcacatatcacagttagcaacaagtgcctaaacaacggcttccctatcaaagatccagctgaacttgaccatcctgggctcgtccttcttggccctgtcctcggcgcgctccgcggcccggcgcatcctcggcgcgagcccgcagacgaagtccctggccctgcggccctcgccggagagcccgctctccagtgtctccagcttccaccgcttgacaaggaactcgacgatgtccgcgtagtcccgggcggtgtacacgccgaggcgctgggcgacggcggcgaagtgctcgaacaggtccatgtcgcggccgtcgtgcatgaggtgcgcgggcatggtgatccgcttgcgcatcatgtccgcgacggcgagcacggcgccctccgggtccagctgcagcagctgctcgacgatgcgcccgtacgccgtctcgtgccgcttctcgtcggcggcgatggtgccgcaggcgcgcgccaggacgtcgtccccgtgcgccctggcgagccgcgcggtgttgccgtgcgagacggccgtcgcgcgctcctggaagctcgtgtacacgaagcccaggtacgggttgttctccgttccgggatcctgcgattaaaccagcctcgggagtcaacacaacagaatgcgcaacggagtggagtggagtggagaactgctggatccaatccaagatgaatatatagatgatggtgacgcgtacgtaccatgccggagccgatgaggtactggacggtcttctcgaccatgcgcatgtcgacgcggccggataggtacatgtacttgccgaggatgtcgccgtggcggttctcctcggcggtccaggcgcgcgtccagaccgcccaggggcagttgctggcgccggtctcgtcgcggacgccgtcgagcgtgttgatcatggtctggtacgtgggcagcgcctcttccgtgaccatgtcgcccacgagcacgacgaagtactcgtcggggagccccgcggcgcgggcgcgcagctcgcggacctcgtgcccgaacatctcggacgaggagtccgggaggaagtccgccggctgccagcactcctccacgggcttgagcagcggcagcagcgaccgcgccgcccagccctccagcgagcggaacacctccgccttctccggcggcatcgagtgcgtcacgcgggctcgcgcggcgggcgcgccgaccgccgccgcagacacgcggcattgccgtcggcgcgcgggggcctgcgtcgccgccaccggcccgcgggcgcggatggcgatgccgtgggcctgcatcgtgcccgctgggttggctgcgcggcgtacgggccggacgctggaggaggcggcggtgggtgactgtggagtggccggccgcgttcgccggcgcgtcgcgtgtatataaatccgggagacgggggtgcgacaagctggatcgtggcgtgggcggtgggtttggctggtgggcggaaaaccggtgggtgcagtggttttccggggggtttccgcggcaagtctgggcatacgaaatctgtgggtgtctgctctgtccggggcacctgctggttcgtggagttgcctgcatctgcatgcttggccggtgagcgccgggcagggcacagttgcaccttgggcgctcggcgggcgatcaatgaactcgaccatccagtcatccgggcccaacggagtcgttcggcgcgcagtctgactggtaaaactggagcatactgggagcagattcgtgactgtgattgtctgagccacagtggacgaaagtgtactgtagtacagtatactccagttgtgagttgcttgatctgctggtgtggtgtggaagaatactgcatctgaaacttttttgaccaggtctggctgattagcgaagggggatttaaggtaaaacaccgtgctccgcccctgggttttacaactggagtctttgcacattgagcgacaccggcacgtgcggcgggggcgtgcgaagtgctgtacctgtaggggtgtaggcgacacgcgctgcacaaaaactgtctactggctggctgcaacccacccccacctttggatggtgtgttcatccactccagtactagtccagtgacgtgacctgttccgttctgctgccgtgggggtttgcacttgcagcacgtccagcgtccgtgatcgcctatcgcacgaacagtcgtgtagtgaactgctgaccgtggctaaacattgctcgggtaatcagttggttaggaaatagtacatcgttcggctggttgtttcctggtccgctgtgcagctgcag

SEQ ID NO: 20194 - DNA, 1398 bp, Zea mays
  misc_feature (55)..(55): n is a, c, g, or t
gggtaccgggccccccctcgtgttttttttttttttttttttctagaacgtatantttctgcagaattttgtgataatagcaggaaaaaaacactcttactgcatttcaaacacataaacacattgtgacaaagacactgacagctagcgacatgatctgagcacatatcacagtcagcaacaagtgcctaaacaacggcttccctatcaaagatccagctgaacttgaccgtcctgggctcgtccttcttggccctgtcctcggcgcgctccgcggcccggcgcatcctcggcgcgagcccgcagacgaagtccctggccctgcggccctcgccggagagcccgctctccagtgtctccagcttccaccgcttgacaaggaactcgacgatgtccgcgtagtcccgggcggtgtacacgccgaggcgctgggcgacggcggcgaagtgctcgaacaggtccatgtcgcggccgtcgtgcatgaggtgcgcgggcatggtgatccgcttgcgcatcatgtccgcgacggcgagcacggcgccgtccgggtccagctgcagcagctgctccacgatgcgcccgtacgccgtctcgtgccgcttctcgtcggcggcgatggtgccgcaggcgcgcgccaggacgtcgtccccgtgcgccctggcgagccgcgcggtgttgccgtgcgagacggccgtcgcgcgctcctggaagctcgtgtacacgaagcccaggtacgggttgttctccgttccgggatccatgccggagccgatgaggtactggacggtcttctcgaccatgcgcatgtcgacgcggccggataggtacatgtacttgccgaggatgtcgccgtggcggttctcctcggcggtccaggcgcgcgtccagaccgcccaggggcagttgctggcgccggtctcgtcgcggacgccgtcgagcgtgttgatcatggtctggtacgtgggcagcgcctcttccgtgaccatgtcgcccacgagcacgacgaagtactcgtcggggagccccgcggcgcgggcgcgcagctcgcggacctcgtgcccgaacatctcggacgaggagtccgggaggaagtccgccggctgccagcactcctccacgggcttgagcagcggcagcagcgaccgcgccgcccagccctccagcgagcggaacacctccgccttctccggcggcatcgagtgcgtcacccgggctcgcgcggcgggcgcgccgaccgccgccgcagacacgcggcattgccgtcggcgcgcgggggcctgcgtcgccgccaccggcccgcgggcgcggatggcgatgccgtgggcctgcatcgtgtccgctgggttggctgcgcggcgtacgggctgcacgctgggggaggcggcggtgactgtggac

SEQ ID NO: 20195 - DNA, 2208 bp, Zea mays
ttaaaattttcaaatatcatcgtggtagaagcgaccacaaatctcaaaaagttatgtaactttgtagttgataacctttttatttttgtttttatttgaaatgatctaccaaagtaaaattatgtttggattttgtttttcacaattgaaaattcgcttcgaatgacctcatgcaaacaaatgactaaaataaatatcgtagatctcgagaaattataaaaccttgtagttgtcaatgtgagcgtgggttctcttctcctcatcagagagacaccaaagatgagcatggaataaagagctgcgtagctttcctctccgtccttccttgccctgcaaccaaaaccccgccgggaaattaaagagctcaagaagtttcattgcagcttcctctatctctttccttcgacagatcgaatcgtgcttaccgagctttataccatcgtcatctcccgccagctgccgtgccgtctgctcgtccgattgttcgtgttcctcgcgtgcgcggatcggatcggttcctctggattggcgcgcacgctcagcaagtagtagcaggtctttcgccgtcgcatgttactgcagcaggccaccggaagagcgcgccgtcatcagctagctgcctcctcctcctcgtcgtctcgaccaccggcggtggatgggcggcgtgctcggcgcgctgctgcaccggcggtccgggggcaggccgccaccggcgcgggccacgaggcgccgggcgctcacccgccagccgtcggcctatgacgccggcggcgggcaccggagggcgatgctgtccaagaagtactcgtacataccggacacctacacgtcgcttgacgaggtggcggcggcgctgcgcgagcaggggctggagtcgtcgaacctcatcctgggcatagacttcaccaagagcaacgagtggacagggaggcagtcgttcggcgggcagagcctgcacagggtcggcgacacgcccaacccctacgagcaggccatcagcatcatcggcaagacgctggctcccttcgacgaggacaacctcatcccctgcttcggcttcggagacggtgactgacgactgacgacggccttcctccgatcctgctgttgatgcatccatccatcttctcgcgtgtcgatcgcttgtccttctccttaatctatctaacctctcttcttgcattatattggttgcgtcgggactcgcgcctgcactgcgcagccaccacccatgactacaacgtgtttcagcttccacccggacaactcgccgtgccacggcttcgaggaggtcctcgcctgctaccgcaagatcgtgccgcacctcaagctttccgggccgacgtcgttcgcgcccatcgtggaggcggccgtcgacatcgtggaccggagcggggggcagtaccacgtgctcgtcgtggtcgcggacgggcaggtgaccaggagcgtcgacaccggtgacggcgacctcagcccgcaggagaagagaacggtagagtccattgtcacggcaagctcctacccgctgtccatcgttctggttggggtcggggacggcccctgggacgacatgcgcagattcgacgacaagctccccgcgcgcgacttcgacaacttccagttcgtcaacttcaccgccatcatggcccgcgccgcgacggcacagcagaaggagtcggcgttcgcgctcgccgcgctcatggaggtccccatccagtacaaggccaccatggagctcggcatcctgggacggtccacggggaacgccaagcgagtcgcccccgcgccgccgccactgccgcacgcgcagcggcaggcgtcgtcgctgaggaggggcgccagcaacgtcggcggcgccgccgcggcgccgagagatgaccaggtgtgcccgatctgcctgaccaatgccaaggatctggcgttcggctgtgggcatatgtgctgcagggagtgcggggaaagcctcaccagatgcccgatatgccggcagccgatacggtcgaagctgaggctatattcaggatgaagtggctatgctacaacagaggccacgaagaggaaaaaggatatatagcttactcgccgttaaaatgtacatgtgaatctgtcaaaacgtgtaagaaggaaccaccggtcgaggtcagtcctgttcgtctccaaatttggatgaaccgatgttccattttgtcactaaaaaaaaaaaaaaaa

SEQ ID NO: 20196 - DNA, 983 bp, Zea mays
  misc_feature (33)..(34): n is a, c, g, or t
  misc_feature (36)..(41): n is a, c, g, or t
  misc_feature (43)..(52): n is a, c, g, or t
gggttgggggggtgtggaggttttttgtttggnngnnnnnngnnnnnnnnnnattttgtagtccaactcggggggtacatggaaacgaaatcatcgtcaccaaatagagggcaaccgaaggtacatgaccatccacaacccaggcagcaaatctagctacactgccagtgtgcccagcaactaataaagtcatacgcggtaaacatcactgaacatgactgggaaacacaggacgcccccgtccatgcggttagtggtgtacaaaagctatggcttcaccaaagtctcctaggagacaatatatctgagacctcgtccaaggcagagtgctcaaatcaagctgtgccggtaacagcggctgcgtccggcttggagctgtctttgccgttttcccgagctgctgatccaccagacgcttctgcaaaccgggcagctcgggcctttcttttttcttcttccgccttgtcgacatttgcgctctgaccaaatcgttccaaacgggcctttttcttagcttcctcatctgaagaagagggcgaggcaaggccaaacctctcagccctggacttcttcttctcttcctcctttacacttgaagagccagtcccaaatctctcggcgcgactgctgcgcttttcctcctctgacatcagtactggcatcccaaaccgctccgcgcggcgcatcttcttctctagatccgtggccccggccactgcggttgcagcagcgttagggttttgtgccggtgttgaagaagccgcacccggagccgcctctccggtggctgcaacctccggcggaggcgcggcggtgtccgcggtctttgagctctgagatgccatcaccaacggagagggagggagctcggcagggagggagctcggcagggaggtcgtggtctggtgatgtcgagaggaatttcctttttctttttgtgccccggcgcggccaacgctgctgctttttcctttgcctagagt

SEQ ID NO: 20197 - DNA, 1112 bp, Zea mays
ttttttttttttttttttgtgtcttctaacagttataaagtagtccaactgggggtacatggaaacgaaatcatcgtcaccaaatagcgggcaaccgaaggtacatgaccatccacaaaccaggcagcaaatctagctacactgccagtgtgcccagcaactaataaagtcatacgcggtaaacatcactgaacatgactgggaaacacaggacgcccccgtccatgcggttagtggtgtacaaaagctatggcttcaccaaagtctcctaggagataatatatctgagacctgcaggagaccaagtcgattcttttcatgttagggaaactgcagcagcgggtcatggtaaggaaaacgtcgttctgggagggtaacagcattgcctaacgaacctcgtccaaggcagagtgctcaaatcaagctgtgccggtaacagcggctgcgtccggcttcgagctgtctttgccgttttcccgagctgctgatccaccagacgcttctgcaaatcgggcagctcgggcctttcttttttcttcttccgccttgtcgacatttgcgctctgaccaaatcgttccaaacgggcctttttcttagcttcctcatctgaagaagagggcgaggcaaggccaaacctctcagccctggacttcttcttctcttcctcctttacacttgaagagccagtcccaaatctctcggcgcgactgctgcgcttttcctcctctgacatcagtactggcatcccaaaccgctccgcgcggcgcatcttcttctctagatccgtggccccggccactgcggttgcagcagcgttagggttttgtgccggtgttgaagaagccgcgcccggagccgcctctccggtggctgcaacctccggcggaggcgcggcggtgtccgcggtcttggagctctgagatgccatcaccaacggagagggagggagctcggcacgggcggtcgtggtctggtgatgttgagaggaatttcctttttctttttgtgctcgtcgctgcaacgctgctgctctttcctttgccctttaccttcgtggacctgccctttttttttttatattttttttcccggccggctcgaggtcccaatg

SEQ ID NO: 20198 - DNA, 957 bp, Zea mays
tttttttttgaagggcgaccttgtgtcttctaacagttataaagtagtccaactcggggtacatggaaacgaaatcatcgtcaccaaatagagggcaaccgaaggtacatgaccatccacaaaccaggcagcaaatctagctacactgccagtgtgcccagcaactaataaagtcatacccggtaaacatcactgaacatgactgggaaacacaggacgcccccgagccgccggcctggcgggtacaaaagctatggcttcaccaaagtctcctaggagataatatatctgagacctgcaggagaccaagtcgattcttttcatgttagggaaactgcagcaacgtcgttctgggagggtaacagcattgcctaacgaacctcgtccaaggcagagtgctcaaatcaagctgtgccagtaacagcggctgcgtccagcttggagctgtctttgccgttttcccgagctgctgatccaccagaagcttctgcaaatcgggcagctcgggcctttcttttttcttcttccgccttgtcgacatttgcgctctgaccaaatcgttccaaacgggcctttttcttagcttcctcatctgaagaagagggcgaggcaaggccaaacctctcagccctggacttcttcttctcttcctcctttacacttgaagagccagtcccaaatctctcggccgcgaccagcgcttttcctcctctgacatcagtactggcatcccaaaccgctccgcgcggcgcatcttcttctctagatccgtggccccggccacacaaaaaaaaaagcgttagggttttgtgccggtgttgaagaagccgcgcccggagccgcctctccggtggctgcaacctccggcggaggcgcggcggtgtccgcgggtcttggagctcgtgagatgccatcaccaacggagagggagggagctcggcagggaggtcgtggtct

SEQ ID NO: 20199 - DNA, 2035 bp, Zea mays
tgcagctgtcgcgccgcctctctcccactcgctgtaggtgcagagtaaggcgaacaggacgccttacgtcgccagggcgccttactgcctagtcgacgcttaagtggcgccttgacaactatgaatatatcatctggaaacttgattagccaaacaggaatgatcaaagtttggagtatgctcaaataaacatgaaagagcagaggctctacgaagcttggcccttgagtggattgaaaagcaaagttatgcttggttttgtgcaactattcaaccttatctagaacttacatgaaaccctacacagtgcattgactatatatatgtatgtgactacctctagtttcagtgtaagcacgccaaaagtatatgacatatatttaacattgcataatgaagttacccacgtcatatgcaattaagagttcaataacagcacatcatcattttattacctagattcttaccaaacaagtaagaaaactaagggccctgttggcatggttttcatcagctctggcttgccattctcagttcaaaccgtttttctctctctcactgaaatgaactaggagccaatggaactgtagcacgagcctgagccaacggaaaccatgccagacaggcactaatctagcacactcagatctgagatctgactatcaccgaggttagaaacatcaaaccaaaagttaaacttctttaaaaactagtagtagtccatagtcttgatggctcaaatctaaacatatggcttaattagatagacaatataccagtaagctccatttggggacttgtgtttttcttgcaaaaccaaaccatgtaattgtttttcctttgatgtttaacagagtagattaaaactagaagaaaaacagactggtacactttgaatttttatttactaggttttgcatctaactgtccacaattttgtgtggggatctaaagactgggcaccaatgaattgaattaagtacctaaatcttttgaacttctaattgaatatcctacacaacaaacacagaaacgatggatggaaatcaagggtgaaaattcaatatacaggcagtatcaagggggcacatggcctacaaaattagaaaggctcaaaggtatcaacaatcaagtgacttagttataaactgcatgaaacacttaaacaataaaacatcattcatgcaaggacctaactgcttaggtcctgaaatgcactggcatctctatgaagagaagcaacaattggacacctcatcaaataatgcagagcacagaattgctgcaacatcacccacgggactagatcttttctatgtactttacctaaaagcctacagtgttgcaattcaacacacccaatgaccaagacatgcatgctgcagtattgcactacatctatattgttaggagattacctacatattgtgcttgaaaagaacacttctcaacatgaacttaggatttgttaggacaaatcctctaagccctaggaaaggggatccacaaaacacttacctctcggcgcgactgctgcgcttttcctcctctgacatcagtactggcatcccaaaccgctccgcgcggcgcatcttcttctctagatccgtggccccggccactgcggttgcagcagcgttagggttttgtgccggtgttgaagaagccgcgcccggagccgcctctccggtggctgcaactccggcggaggcgcggcggtgtccgcggtcttggagctctgagatgccatcaccaacggagagggagggagctcggcagggaggtcgtggtctggtgatgttgagaggaatttcctttttctttttgtgctcgtcgctgcaacgctgctgctctttcctttgccctttaccttcgtggacctgccctttgcggtcggtcgcggcacgccgcttcacgggaacatgccttttgggttgggatagtacacataaatgggccttagttgggcctggtttctggactctttaatgttcatcatttcttagtttgaaaacataaatctccttgaatctcc

SEQ ID NO: 20200 - DNA, 1333 bp, Zea mays
gagcgagcgtgccacactaggaaaaccgtgtagttcacatcggtgtccaaaattcggttgtctgcctcgtgttttgcagtgatttatacatagctgtttaggggaggggagtatctgtacaaaatggaataaggtcgctcatgtggatgtggactcactattttattaaaaaaagagtgaatctctaggtgctttgcttgcttctgtttaccgactagtttttttttttttatgttatgcaatgctccgtgattatgggtttaaacaccctgtcgcgtagcattctagcaacaaaaacacggggtacaaacacgagggcgaccttgtgtcttctaacagttataaagtagtccaactgggggtacatggaaacgaaatcatcgtcaccaaatagagggcaaccgaaggtacatgaccatccacaaaccaggcagcaaatctagctacactgccagtgtgcccagcaactaataaagtcatacgcggtaaacatcactgaacatgactgggaaacacaggacgcccccgtccatgcggttagtggtgtacaaaagctatggcttcaccaaagtctcctaggagataatatttctgagacctcgtccaaggcagagtgctcaaatcaagctgtgccggtaacagcggctgcgtccggcttcgagctgtctttgccgttttcccgagctgctgatccaccagacgcttctgcaaatcgggcagctcgggcctttcttttttcttcttccgccttgtcgacatttgcgctctgaccaaatcgttccaaacgggcctttttcttagcttcctcatctgaagaagagggcgaggcaaggccaaacctctcagccctggacttcttcttctcttcctcctttacacttgaagagccagtcccaaatctctcggcgcgactgctgcgcttttcctcctctgacatcagtactggcatcccaaaccgctccgcgcggcgcatcttcttctctagatccgtggccccggccactgcggttgcagcagcgttagggttttgtgccggtgttgaagaagccgcgcccggagccgcctctccggtggctgcaacctccggcggaggcgcggcggtgtccgcggtcttggagctctgagatgccatcaccaacggagagggagggagctcggcagggaggtcgtggtctggtgatgttgagaggaatttcctttttctttttgtgctcgtcgctgcaacgctgctgctctttcctttgccctttaccttcgtggacctgccctttgcggtcggtcgcggcacgccgcttcacgggaacatcccggttgggttggatagacacataat

SEQ ID NO: 20201 - DNA, 1252 bp, Zea mays
acgctagattgtaatcgctctcgtgtcaacaccttcgaacaagccgaaggtgcgtccttcatgaccttcgtctgaagatcattatatctgaaaggagatgatgccttggaggacgaaggtctataatctttaacaattgtgttgccttgttctggattcacagtatttgagaacaaaagaccaacactaacctaatagcctggtgtatttggctccaccagaatcaaattctagaacctaataattgctaattggctggatccatagacaattaaatcataataatgtgttgctaattttgatcaatacaatattctcgataatcaaaattgatatggtgctttggtagctaataagtgcatatgagtgccagattaatatgtaatgaatctatatcattaaaacatgatagataaagatcaaaataggtatggcattttcaggtaaattttgtatacatgccaataaaaacctttaattgtatagatttgatctaaatagcattgtcattaacataaaaattgagtgggtaatatatattagatgatattgctactacaagtaaaactagagatatgatatctctaagtaaaatagtagaaattgattgctcatggttaatttgtgttgctcaagtctatataatcagagccccacaacaatagggagactcaattatatacgtgcaaaaaaccagaaagcatacaagcgtcatcaaggcactaagtatcctctacttgaaaaaaccatccctagagcttcatggcgtgctctaagaagactcttgttgttctcgttgttccaatattattagctcttcttgcttcgaccatgccagcaagccaaggcggtcgtgccctcttaggaggggaacaatgctccacatctaacaattgcaatgagcagttgtgtggagcaacatgtgccgtcttgggggagaatgctattgggatatgcaaggttgttggagggatctcctcctgttgttgtgtcccaaaaccatccacatccttcaacatccaactctagctggttcatagattcatcattgttctcactcaatattgagaatgtcacgttttgttagaaaaaaataatatgtattgtatgggacaagatgtgtggcacaatgtattacatccatgctaggatggcaaataagtaatggtttgtattttaaaacaaaatttaatttataacatggtattgcaaactttccattgtgacgaaaaaaaaaaaaaaaaaagcggcc

SEQ ID NO: 20202 - DNA, 603 bp, Zea mays
ggcaggttactgattcgtacttcagtgatcaactcaacagatggtacaagtaaagtccgcaggccagcaaagcaaggaaccaactaaccatttttttttttaatcaaaacttgcacaacgtatttttttttattccattgaaattaacactagagactattggcttccagggaagatacagacgatggctacactgtaacacttgcttaaattacttcttctcagctcctcagttaagtagttaacaactaattaaacacatggaattacatggggcaaatgatcataagcagatcttgtttgacaatggttatgtactgccttgcccaaggtagttcccctcttggaaaagagtcttcacattactttggaagaacccaaggagatagcggagaatgtaccagaagaggcaaaccatcaaaatattgaagaggtagcgctcccaccaatcgagcatgtagaggccgatggtgacattgtagaggtggatcttgcgcccgatccagttcatcctcttccccgcgacgtccggcgccgcagctcacctcgcccagatccgaaaggagcggcgcctctgatgctctatgactacgagggttgagt

SEQ ID NO: 20203 - DNA, 740 bp, Zea mays
  misc_feature (38)..(38): n is a, c, g, or t
  misc_feature (43)..(43): n is a, c, g, or t
ttttttttttttttttcttttttttttttttttttttnggggnaaacgaacaaagccaaagagttaatgttgcacaacatcagtttttctcccctcctacattagaagaaacactagaggctattagcttcctggggaagatacagacaacggctacacggtaacacttgttcaaattagttcttctcagctgctcagtcaacaactagtgaaaacagatggaattacatgggcaaatgatcataagctgatcttgtttttacaatggttatgtactgccttgcccaagatagttcccctcttgaaaaagagtcttcagattactctgtaaaaacccaaggagatagcggagaatgtacgaaaagaggcaaaccatcaaaatattgaagaggtagcgctcccaccaatcgagcatgtagaggccgatggtgacattgtagaggtggatcttgcgcccgatccagttcatcctcgtccctcccgcgaccccccggcgccgcagctcgcctcgcctagatccgagagaggaccggcgcgctgtttgattcttctatgacttcgactcttcgaggattgagacgacgacagcggactttgagcgctgcagatcaaaacccatgggtcccgttgatgcaggatttgtcggatctgttgttaccggttgagatcgaggtcctggaggcaggtttgattgtcttgacgggcttttgggacatgcgtgcagctccaatggtgtgttt

SEQ ID NO: 20204 - DNA, 1018 bp, Zea mays
tgctcaaggagggcctgcatactgggctggcaactatagccttttgttgtgtttttttcgcggttcaaaggggcgttaagggaatgtgcactgacagtgacaatatatagattcgatacatcccaatcctcacagcttgctcacatctagcaaagcaaaaccagtaaaaaaaagacaacgggactgagcccggcgctgaattaaccaactgatttcaggaggatagggggcacgaccgccagagaagcaatcgggagaaggatactgaagaggtagcgctcccaccaatcgagcatgtagaggccgatggtgacattgtagaggtggatcttgcgcccgatccagttcatcctcgtccctcccgcgaccccccggcgccgcagctcgcctcgcctagatccgagagaggagcggcgcgctgtttgattcttctatgacttcgactctacgaggattgagacgacgacggcggactttgagcgctgcagatcaaaacccatgggtcccgttgatgcaggatttgtcgggtctgttgttaccggttgagatcgaggtcctggaggcaggtttgattgtcttgacgggcttttgggacatgcgtgcagctccaattgtttgtttgcttggactgaactgcataggaggctgttgctatccaaaattcagagcaccctgaagccaacgagataattgtcattatagacgaagagagaaggggattcgatgaaatggatgtgttggcgttggcttctctgttttggagacgtaggcgacagacaaactccaaaacggatacgagacagcacttggcgctgcgtaaacaggtattagtttcctgtccccgtttaccgttcgcgtgcgcagacgccgtctggcgtactcttcttgtctctgtcgcatctcctctgtcgccgaattggactgctctcggggtggacatcgcttgcgtctccgtctcctcttgcggctctttgcggcgtcgcggcggtgagttctcctcctccgccataccagaccc

SEQ ID NO: 20205 - DNA, 736 bp, Zea mays
  misc_feature (158)..(158): n is a, c, g, or t
aaaccaaggaaagaaagaaagccaaccaagaaaggatgcctctttcctagcttcgttccaaaaaaaatagtaaatcttgatctccgatccacctgcccaacgcgtctccggacacatcacatccatccagggcagcacccgcgagagtcactgcgaanagcagcaagaaagcagagagcacagcgagcagcggcagcagcagccacgccaccgccgccgcgccgccgacggggcacgcccccgccgccaagaaccccgggtcctgaggtaacatcgccaccgacgacggcggcggcggcggcggcggcgacggcgaccaggggaacggccccgacgacaccccaggcggccgcgccgggcagaacgggaacggcgacgcgggccccggtggcggcggcggcaagaatgccgtgctgccgtcgtcggccgtgacgcaggcggccggccacagcagcagcgccgccgccgacgccgcggccagcaggattattcggcgcggagctggcggcggcatctcccttcactcgtccaagctttctttcgtcggtggcgtggcgatgaggctgtaccgtgtccgtaccgcagcgtagcgtgggcgccccgcgccgtcccggccccgccgccttaacccgggcgtatcagtatcaaatagcctggaaaacgctgtcagccgacgggcactcgaccgtagccgtccgacgccgatccgagggccctggtgccgccccaacacaat

SEQ ID NO: 20206 - DNA, 1680 bp, Zea mays
tgtgcggcgccccgggaggccggccgggcgttaaaccaacaagatgttgttcgaggcgttcccctcctccacgcaaccttctcccctccagatccaggattgccgggctccttgactcgttacctcgcgcgccctcggtgagctactttgtttcgatttagcgacaaatcagtttgcttcatgttgcgcaggcttagatctgaatgccggattcttcgtcttacggcttgaatcgagctgggaggctgtggatctgagcacgggaggtacaacaaatccgcgtgtatgacgagttggatcggcaccggttagtctctgaccgcaagattttgttgttgtgttgggctgatctgccgcgttgttttgcttcaggttctagagctagcgaaatcgcaaggctattagggttcctttcggagcgcgtctgaagcgatgatggctgaagtcggcggtgggatcgggatcttctctgccctgctccactcgggatgatgaatctgctgcgctgataattattggatgaatttcgataattattagatctaagagatgcgccgacttgaagaggcgaggtaaggtgcaacatgtataagacgtgacatgctatagaggcctttgccatggtgggtgcgctcgcatggcaggccacggtaataaaagaagatatttttgtgtcctgggggtggagatcgcacgggggattgttttttggccccgggttctcctccctcgtggtgttccgtgtccctatgtgcattggtctttgcgtggtttgcgatctcagctcacctacacgcttcggatttctgcatctaacacggagatctacaacaaaaacaaacatggagctacaacgagattcttaaggtacaatcgttaatttactgtaacaattaagtttcttttctcatctctgacgccacacttgtatccttatgttctctctctgcacattcaaagaaaccgttaaacccccatgaataatgacattcgacgtccactttgcccagctgtgttgaatttaatagttcaacaatttcagactcccatgaactcagtgaaacaagcgttactgatgtcctaagtgaaattttatgtcgcacttaagatggcgctgcgtctttatttcgttgtatattttattttcaacaactccaatctgattatgtcgtggcatttcatttgtatttatcatgtcaattgggatatttggtccttgtaagcttttggcatgtttgttagttaagccattgcaattgttggacttgtggagggttgcaaaatcgcagtgattctactattcatcatgtcatcatgtgaaatcttctaccacggagcacgtcaatcgtggctgggctgatggacgactgtgctgatggaactgattcgttacgtgggttgaagattttgtgccaaatatgcgatctggttggttactccgccctgctgacgttgttttagcccaggtgtttctgctgctcattccttgcattttttatggcactgtacatacaattggacaacctaatttttggcagttcaactcatttagaagttagaagggtttgagaaacattctcccctagaaatacatggaggtgtatctgatgattgttttttttgttacaaagtttcctagtttaatttgtatgatattctggaagaaaaaaaaaaaaaaaa

SEQ ID NO: 20207 - DNA, 1608 bp, Zea mays
tacgcggttaaaccaacaaaatgttgttcgacgcgttcccctcctccacgcaaccttctcccctccagatccaggattgccgggctccttgactcgttacctcgcgcgccctcggtgagctactttgtttcgatttagcgacaaatcagtttgcttcatgttgcgcaggcttagatctgttcttcgtcttacggcttgaatcgagctgggaggccgtggatctgagcaagcacgggaggtacaacaaatccgcgtgtatgacgagttggatcggcaccggttagtctctgaccgcaagattttgttgttgtgttgggctgatctgccgcgttgttttgcttcaggttctagagctagcgaaatcgcaaggctattagggttccgttcggagcgcgtctgaagcgatgatggctgaagacggcggcgggatcgggatgatgaatctgctgcgctgataattattggattaatttcgataattattagatctaagagatgcgccgacttgaagaggcgaggtaaggtgcaacatgtaagacgtgacatgctatagagaggcctttgccatggtgggtgcgctcgcatggcaggccacggtaataaaagaagatatttttgtgtcctgggggtggagatcgcacgggggattgtttttttggccccgggttctcctccctcgtggtgttccgtgtccctgtgtgcattggtttttgcgtggtttgcgatctcagctcacctacacgcttcggatttttgcatctaacacggagatctgcaacaaaaacaaacatggagctacagcgagattcttaaggtacaatcgttaatttactgtaacaattaagtttctttctcatctctgacgccacacttgtatccttatgttctctctctgcacattcaaagaaaccgttaaacccccatgaataatgacattcgacgtccactttgcccagctgtgttgaatttaatagttcaacaatttcagactcccatgaactcagtgaaacaagcgttactgatgtcctaagtgacttatttatgtcgcacttaagatggcgctgcgtctttatttcgttgtatattttattttcaacaactccaatctcattatgtcgtggcatttcatttgtatttatcatgtcaattgggatatttggtccttgtaagcttttggcatgtttgttagttaagccattgcaattgttggacttgtggagggttgcaaaatcgcagtgattctactattcatcatgtcatcatgtgaaatcttctaccacggagcacgtcaatcgtggctgggctgatggacgactgtgctgatggaactgattcgttacgtgggttgaagattttgtgccaaatatgcgatctggttggttactccgccctgctgacgttgttttagcccaggtgtttctgctgctcattccttgcattttttatggcactgtacatacaattggacaacctaatttttggcagttcaactcatttagaagttagaagggtttgagaaacattctcccctagaaatacatggaggtgtatctgatgattgttttttttgttacaaagtttcctagtttaatttgtatgatattctgg

SEQ ID NO: 20208 - DNA, 1503 bp, Zea mays
  misc_feature (4)..(5): n is a, c, g, or t
gggnnattcgaaaaaccaacaaaatgttgttcgaggcgttcccctcctccaaccttctcccctccagatccaggattgccgggctccttgactcgttacctcgcgcgccctcggtgacctactttgtttcgatttagcgacaaatcagtttgcttcatgttgcgcaggcttagatctgttcttcgtcttacggcttgaatcgagctgggaggccgtggatctgagcacgggagatacaacaaatccgcgtgttctagagctagcgaaatcgcaaggctattagggttccgttcggagcgcgtctgaagcgatgatggctgaagacggcggcgggatcgggatgatgaatctgctgcgctgataattattggatgaatttcgataattattagatctaagagatgcgccgacttgaagaggcgaggtaaggtgcaacatgtataagacgtgacatgctatagaggcctttgccatggtgggtgcgctcgcatggcaggccacggtaataaaagaagatatttttgtgtcctgggggtggagatcgcacgggggattgtttttttggccccgggttctcctccctcgtggtgttccgtgtccctgtgtgcattggtctttgcgtggtttgcgatctcagctcacctacacgcttcggatttttgcatctaacacggagatctacaacaaaaacaaacatggagctacagcgacattcttaaggtacaatcgttaatttagtgtaacaattaagtttcttttctcatctctgacgccacgattgtatccttatgttctctctctgcacattcaaagaaaccgttaaaaccccatgaataatgacattcgtcgtccactttgcccagctgtgtttaagttaatagttcaacaatttcagactcccataaactcagtgaaacaagggttactgatgtcctaagtgaaattttatgtcgcacttaagatggcgctgcgtctttatttcgttgtatattttattttcaacaactccaatctgattatgtcgtggcatttcatttgtatttatcatgtccattgggatatttggtccttgtaagcttttggcatgtttgttagttaagccattgcaattgttggacttgtggagggttgcaaaattgcagtgattctactattcatcatgtcatcatgtgaaatcttctaccacggagcacgtcaatcgtggctgggctgatggaactgattcgttacatgggttgaagattttgtgccaaatatgcgatctggttgttactccgccctgctgacgttgttttagcccaggtgtttctgctgctcattccttgtattttttatggcactgtacatacaattggacaacctaatttttggcagttcaactcatttagaagttagaagggtatgagaaacattctcccctagaaatacatggaggtgtatctgatgcttgttttttttgttacaaagtttcctagtttaatttgaagaaaaaaaaaaaaaaaa

SEQ ID NO: 20209 - DNA, 1893 bp, Zea mays
ctctcagtgatatattttgtgctacaaatttagtgaaaattaaaatagtttgaggtacgacttttgaaactgatttatttttatattgaactgaggagcagtacattattttttttgcgtgattcccccacatggcctgtgcgtcctgcttccttcttttctgtgaacaaagggtagggtacgatcgcgccatggcaactaaatttatttaaattatcctgtcagagtaggacgatcagaggacgggggattcgttccacgcaaaatggttaggcgcgcaggtcctacacgaaaggaaatacaaaatgcttggagcctgtctgacaaggacacgcacgtacccagcaggcgagcgcaaggcagccacgacgggacagaggccgaagcctcgcgcgcactcgctccgccttctctcgtgtcgcgtcgcgtataaaagcggccgccccgcaccccggcggaaaacaccaagattccaagaaccatggcctccgcaccctgctccaactcttcccccgccgccagagccccgagaaccgccgctggcggcaacaagaagctgacgacgtgcctctgctcgccgacgagccacccggggtcgttccgctgcagccggcaccggaacggggccgccgcgccgggcggcgaggcggtgcacggcgccaccaggggcggcactgctggcactggcagggcggccaaggggcggtccgtgcgcgcgctgctgctccagaggatcggcggcggccccagcgagctcggcggccgccgccgccgctgccgtcgcggggtcggcgacttccagccgcggccctccaggctgcgcctcatgaaccagtgacgccggcgggcctgcttcggtctcgtcgctgctcctctcctgatctagcaccggtggtgcgccactatttcgcgcgcacgcatcggttcgacgacgcgacgctggatcgtactatgttcttagcagaataaagagcaaaaactgttcgtactgtagtcgtagcctgcagatctggaactgtgtgtacatagtgtcgaggaagacgaagcaacgtggttcgttcctccatttctgatggctccatgtatgcctatggtctgtaactctgtactccttgtgtttttttagagaggaaagaaagaaatccatggaagagtgcatatggtgttcgtgttcttggctcttgcatagtttcagttttttttctctaaaaaagattttcatttaccttttttttcaagaaacaaagtactcgcctagttattttgggagggtgtgtcgtgccgtgtgtgtgcggtgcgcggtgtggacgttcatgttcacaggacgtgcatggttcgttcctccatgcctgatggctccatgtatatatgtctatggtctgtactccttgtgttttttagagatgaaaaaggaaatacatggaagagtcaagagtgcacatggacatggcgttcgtgttcttggctctcgggcaatttccatatttttcttaaaaatgacttttcattcatcttttttaagaagcaaaatactcgcactagtacacgctagaagcgtctttttcccctagttattttgggagggtgcgtgcgaggattgttgtgtgcggtgtggacgtgcatgttcacaggacgcccatgagagctatccgaaagcaacgttcttttctttaggtgtgtgcgtgtggaactacgcgcatgtgagcttacttactgctcttctttagagcatctccatagttacgaaaactaactccctaatttaagaagtttttttagaaaaactttccactaacaagttagttatataaaacaggttcctaaatttctaaacttcttacgaaatataatttcatcactatatttaccaacctcgttggcactctctaagtc

SEQ ID NO: 20210 - DNA, 3420 bp, Zea mays
tatacatatatttattgaatattcaatatataaaaattattatacattgttttgaagtttataagatgacaaatataaaacatagcaaaaaacacttacttgttacctgatatcattaaaaatatcttttaacattttgtgatacaaaaatcattgcttataccattgagatcaacctcttccaacaacttattttcgatacttagaatcaccaaaccgtttaacctctcttgaatcattgttgatcttaaatagttcacaaaattatttcaattctaaagagcttctttccgtcgatgtaactatcatgtgtataataaataatactcactctgtatcaaataaggagtaaagatatgatttttttatactgatagacacgagatcataaaaagtataaaagtggttacattggtttagaaagatatatatgaggccagcaggtggttacagtgatttagaaagattttacagttttaggtggaagtttgcattccatcttttttggagttaagtttttaaaacgtttgaagaaatcccttctacaaacctttttttgtagccactcgaagaatcaatttcgtttacgaattgccttcttaactatcggagacgctctaaacctcctagctcaagaaccatgcatgggcgtaactgaatcacacgagaagacacacaaataaccttttagtataacacgcgaacatccttttttaaacgcgcaaaacacttgacacgcaaactagccttggacggcagtcggtcgatcgtcgcctgccctgaccgacgtgcctccaagcaaagcctccaaccggcagccggtggaaaaagcgcaaaacgacgatggaattgcaactgcagccgcagcgacagacggccggccgggcgcggcgcgcgcagaccggacccccacccacacgtgacacgtcgcgcgcgctacggcgtcatgccgggcgccctcgagcgttgagggcatgcggaggccagccggcggttcgcgctcatgtcatgtcccatgctccccacctcccccgaccccaagcaaaaaaaccaccgaaaacgcccaaaacccaccgcaaacggccgcgcgcgcgcgcgcccgaaaccgtccgcccgcccgtccgtccacctaacctaacccctccttcgcatctcatcacaccagacgaagtgacgaacgacgcaactccaggagcctccaaccacaatacccacgtccttatatcccccggcgacggagagagatacgtactaggtcgacaagaaaatggtggtatcgtcgagtggtggcgcgggaggcgtggagggtggcagcggctgcggtgtctcggcgtcggtgccgccggtggtgtcgtcgagcggtggcgcgggagaggtggagggtggcgacggcggctcggctgcggtgtcggggtcccgccggagggtgaaggggtcgtggacgccggaggaggacgagctgctgcggcgcgcgatcacgcggcacgggccgcggaactggaccgtgatcagctccgagatccccggccggtccggcaagtcgtgccgcctgcggtggtgcaaccagctcagccccagcgtggagcgccgcgccttcacgcccgaggaggacgccatcatcgtcgccgcgcacgcgcagcacggcaacaggtgggccaccatcgcgcggatgctccacggccgcaccgacaactccgtcaagaaccactggaactccacgctgctccgccagcgcagggcggcggccgcccacgccagcgccgccgggtgcgccctccagctgcggccggcaaccacggcctccgtcccgctccgccatctgctggatcgtcctaaggaggcggcggcatccgtttcgttccgtcgtctggacccaaaggcggaggaggaggaggacgaggacatggacgaaggcggcagcagcagcgaggattcggcgcatcggcatcgttcgctgtcacccgcgccggtcgagccgctcacactcaatctatttagcgacggagcccacgggctccctacccccgcccccgcacccgcaccgcagggtacggcagccagaacggagggtgccgccatgaggaggaaggcgaagctggagcaggacccgtggttgagcggcggagtccacggggcccccgcacccgcgccgcagagtgcggcagcgagaacggaaggtgccgtcgtcacgaggatgaagacgaagctggagcatgacccgtggttggtgaccttggtgcggcagatgatatctgtggaggtggagcggcagatgcatggagtgggcccgcaggccagaagcagcgccggtggtggtggtggtgcagacggcgacggcgtgaacggccaggacacgtcgatggacgtggacccgtgacggaatggcggcggtggcgttgggcttaccgagttccttctaccctgtttgtcccgttcgctaatcgcgcgcttgaaccattaacgtccgtcacaccatccgttgatacgtaggtatctagcttgtggttcagtttactttcactctagctgtgatcatcctatagattgaagcttctatttttttcttggaatgaaactaccactgctagtgctagctcgtgttcgttggtctggcttaggggcagggcgatatggtctagcagggacgatggttgtcgttgagtgttcgttcaggggggcgtttcaggtgtggttgggtcgtcgattaaccaatatgttgtgcgtggctgcgtgcgttactaaaagcgaacgaaaccgctcgtacgtgcgcacgcacgctaccccgtcgcaatcgccacttagtagtactactagtctactagtgctagccgttttcggttcctctcatatcttttctcctatttcaatcttctttatgtaaacagtattaaacagataaacagtgtcatctacacttccgggtctcctattttacactttcgcgtctcctgttttacacactctactagagacagtcttagaatggagttacagctccactatactgctacttctgttaaaacttctgctcagaaacccatactcatatcagggattgcaaaggttgcaaaagttgggctttgggcacaacaggatacaatgggtatagatgtccaaacagtgcgggccaagcacggcccaacacggttggtaacgggttctgttaagcgtgccgggtatggacgactacggtggcccgcgtgttttggcccgacccggcacgagttataggccggcacggcgatggcccgtatgtcacaacccccccaccggcccacgacctacccacaaggccacaaagccagcgccgcagcgcgtcaccggtacccacacggccacacatctatccccacgacaaccctatccctaactcgcgtcctcggcttctcaggcgattcggcggcggcgccgttctcggct

SEQ ID NO: 20211 - DNA, 3333 bp, Zea mays
ctcctcccagtcccaggctcactgtcgctcctcccaagaacccgcccaaagaatcctagaaatccaagaaagggagcaaccaaaacaggaggaggtctgcaggaggaggagcaggtcagcaggaggaggtggtgctgaaggggaagatctcacaagtgtgtgaagaccacacagtctcgcgcactcgcaaacccagtgcgcgctgcggtcttcctcttcgcccaccttcttggagcggggaggttggccatgaggaggtggtggccggctgccctgctgggctgcgcagtggcggtgtccgttctggtggccgccgtggaatgcgctgtgacttacgacaagaaggcggtgctgattgatgggcagaggcggattctcttctccggatccattctcttcccctggtcctcccctcagatgtgggaagggctgattcagaaagctaaagacggaggcttggatgtcattcagacctatgtcttttggaacggacatgagcctacgcctggaaattactatttcgaggagaggtacgatttagtcaggttcataaagacggtccagaaggctggcctgtttgtacatctccgcatcggtccctacatttgtggcgagtggaacttcggcggcttcccagtttggttgaagtatgtaccgggcatcagcttcaggacagacaacgaacctttcaagacggccatgcagggtttcactgagaaaattgtgggaatgatgaagagcgaaaacctctttgcatcccaaggtggcccaattatcctctctcagattgagaatgagtatgggccagaaggcagggagtttggtgccgcaggtcaggcatatatcaactgggcagcaaagatggcagtcggattgggtactggtgtgccgtgggtgatgtgcaaggaggaggatgcacctgatccagtgatcaatgcatgcaatggtttctactgtgatgcattttctcctaacaaaccttacaagcccacaatgtggactgaagcttggagtggctggttcacggaatttggtgggaccatccgccaacgaccggttgaagatcttgcatttgctgttgctagatttgtacaaaagggtggttcttttatcaattactacatgtatcatggaggaacaaattttgggcgcactgctgggggtcccttcatcacaacaagctatgattatgatgctccaattgatgaatatggacttgttagagaaccaaagcacagtcatcttaaagaactccacagagctgttaagttatgcgagcaggctttggtttctgttgacccagcaattactacccttggtaccatgcaagaggcccgcgtcttccaatctccatctggttgtgcagctttccttgcaaactacaattctaactcctatgcgaaagttgtgttcaacaatgagcaatacagcctaccaccttggtcgattagcatccttcctgattgcaaaaatgttgtttttaacagtgccacagttggtgttcagacatctcagatgcaaatgtggggagatggtgcctcatcaatgacgtgggagaggtatgatgaggaggttgattctctggcagctgctccattgctcaccacaactggtttgcttgagcagcttaatgtcacgagagacagcagtgattatttgtggtacatcaccagtgttgacataagctcatctgaaaactttctacaaggtggcggcaagcctctgtctctcagtgtgcagtctgctggtcatgccttgcatgtctttgtcaatggacagcttcaaggttctgcatatggtactagggaagatcgaagaatcaaatacaatggcaatgctaaccttcgagctggtactaacaaaattgcactgctgagtgttgcctgtggattgccgaatgttggagtgcattatgagacgtggaacactggtgttggtggtcctgttgtgcttcatgggctggatgaaggttcacgagaccttacttggcagacttggtcctatcaggttggcctgaaaggcgaacagatgaatctgaactccatagaaggctcaagctcagttgaatggatgcaagggtcattgatagctcaaaaccagcagccattggcctggtatagggcttacttcgagactcccagcggggacgagccattggctttggatatgggtagcatgggcaagggccaaatctggataaatgggcaaagcattggacgctactggacagcatatgcagatggggactgcaaagaatgcagttacacgggaaccttccgggcacccaagtgtcaatcaggctgtggtcagcccacgcaacgttggtatcatgtgccaaagtcctggctgcagcccaccagaaacctgctggtagtcttcgaggaacttggtggggattcatcgaagatcgccctagtgaagaggtcagtctcaagtgtatgtgctgatgtatctgaggatcacccaaacatcaagaactggcagatcgaaagctacggcgagcgcgagtaccacagggccaaagtgcacttaagatgtgcgcgtgggcagtccatttccgcaatcaaattcgcaagctttgggacacctacgggaacctgtggagatttccagcaaggagattgccactcagctaactctcacacagtcctagagaagaaatgcattggactccaaagatgcgtcgtcgccatctcccccgagagctttggaggagacccctgcccgagcgtgacgaaaagggtggcggtccaggcagtatgttctcccgtcgcgtagccttacttctccaagcaatggatttggaaggcggtcgacaaaaaaaaaataaaaaatggtcgaaaccagtgcagggtgagtggaactgtaagtatcgtcgactttgattattagatgtggctggcttgagaggttagcagcattcgttgtcggattccagattaggatttgtagtctgctgcatctccatgaattgttcaaagcggccggctggataatgttgtagctggtccaggaatgcagctgtagagagagagagagagagagagagagagaggagtggaggcagaagagtgactgattatgcattcttttgctgtggtgttagtagctgtgtacccgtgacacatgtcgtctttcttggaacggagaaagatgcaggtgaagtgtgcattgtgcccttttgttctactgctactgctagtggtaaggcaggagccttgcaattgtcgggggagaattgtctgtaagactgtaactgatgagaacagtgccttctttttctgaaggaaaatcccgtgtggaattgcttggagcaaaaaaaaaaaaaaaaaa

SEQ ID NO: 20212 - DNA, 5376 bp, Zea mays
  misc_feature (999)..(999): n is a, c, g, or t
  misc_feature (3430)..(3460): n is a, c, g, or t
  misc_feature (3643)..(3759): n is a, c, g, or t
  misc_feature (3923)..(3928): n is a, c, g, or t
  misc_feature (3943)..(3947): n is a, c, g, or t
  misc_feature (4120)..(4154): n is a, c, g, or t
cctacctttgcatccctactattttggcattagcatgatcacatttttctgttttaaatattaatatatttttgtttttaaatatcttatttatattgtttaagtatttgcacttgttgatcacccagtaggtaaaaatctatccgttaagtattataggtgtgagtgtgacttatgttggatatcaacatgagtgggtgtttgctccatcctcattacaaccccccattgtatccctactatttttgcagtagcatggttaccgttatttttttgtgtttaaatattaagatattttggttttaatatattgtttgtattatatgtgtatacatagtgtatttttaaatatataaaaagtaacatacttaaaatagccaaaatatcttggaacccagggagtaactaacaagacttttatctcgctatggttgatctcttccttctcaacgagttgtgatgcaataattgcccactttattgccataccgcttatggaccattcatggtggcggtggtggtgggcggggatgattttttggaacattgagatgatcatatgagttataatataatcttatagattgtgttaacgttaggatcctaagaagagagaaggggtcgacgacggcgtcgacggcgcgaggggaggggttggtggcggggacgtggagaatgatgatgaatgattcaaataatattgtctattagaattgagtgagtaagaaagagtgtgttatgtggcgatttgattttgacgatgtgttaggtctggtgcaatttggttggcagattttaacgaaggaatgagcgtgggataatttggttgagtaggttttgcaaagtttaaactggtgataatacagtgaaaatagacaagtgcaaaaatgactgagttaacggataattatttgatttttgaatttgtagggcgttctacttttttcaggaacaggaacgtgacaaaaaatatttaaaaagtatgtgtaatctatattnacggttcgagttttttccccgttagttgtgacttaaatcctgttgtgttggtgagggtaatctaattgctacaatattacaatgttatataccgatttttgattttctttgttctaaaatataaaagggtttgattattttttctagctatattattttactgtgtattaaaatataatatgtatctaaattatatacattgtaaaaaaataaattattaaaaaaagcataagttaaaatgaatggagtagtttatggtcgcggaatgcaatcggggccgcataccgtacctaacctttttgaggtcaaatcgggtcttttgtttatgttcggcacgagaaagagatcaaccgctccgtgatggcagtggcagtggcacacagagaggtaggtgccacgggcggcctgcgttcctccccgtcgctcctggcttttggctggccctctctccatcactgcccctcttgtgttctatacatagcaaagtactactattatgcagagtccaaccacgcctcgaaatataaccccccgccacaccgtacgagacgagggcagatatggaagctgatgctgctgctgccagtggcggcctggccctgctgcccgccgtgctgctcctcgtggcgctctccaccctcgtcttctccacatggagcaaccgcaacagcaggctgcccccgagcccgatggccctcccgctgatcggacacctgcacctcatccgcccgccgccgcacagggccttcgaccgcatcctggcacgctacgggccgctcgtctacctccgcctcgggccctccacgcactgcgtcgtcgcgggcaccgcggacgcgcgcgggacctcctcaagcacgaggccagcatcccggagcggccgctcacggccgtcacgcgccacctcgcctacgacgacgccggcttcgccttcgcgccctacggcccgcactggcgcttcatgaagcgcctctgcatgtcggagctgctgggcccgcggaccgtggaccagctgcgccccgtgcgggaggccgagctggcggccgtgctggaggcggcgcgccaggcggccgccgctcgggagcccatcgacgtcagccgccacctcatcagcatgtccaacaacgccatcatgcgcatggtggccagcgcgctgccgggccacatgacggaggcggccagggactgcgccaagcacgtcgccgagctcgtgggggccttcaacgtcgaggactacgtcggcctctgccgcggctgggacctgcaggggctcacgcggaggacgcgcgaggtgcgtgacaagttcgacgcgctgctggagatcatgatcacgggcaaggaggagagtcgccgtcgtcgccacgccaccaccgacaccggcggcggcaccaaggacctgctggacatcctcatggacgcggcggaggacgccaacgccgaggtcaggctcaccagggagaacatcaaggcgttcgtcctcgacatcttcacggccggctccgacaccaccgccaccagcgtggagtggatgctggcgctgctcatcaaccacccggcctgcatggacaagctgcgcgcggagctggacgccgtggtgggcgcgtcgcgcctggtcggggagcaggacgtcccgcgccttccctacctgcaggccgtcttcaaggagacgctgcggctgcagccccccgcggtgttcgctcagcgggagaccatcgagccggtccacgtccgcggctacgtcatcccgcccaagacctccgtcttcttcaacatcttctccatcggccgcgacccgggctgctgggaggacccgctccagttccggcccgagcgcttcatgcccggcggcgccggcgccggccgtggaccccaaggggcagcacatgcagctcatgccgtttggaagcggccgccgcgcctgccccggcatgggcctagccatgcaggccgtgccggccttcctcgccgcgctggtgcagtgcttccactgggaggtgcccatcccgccgggccaatccactgcgccgcccttgtacatggaggaggcagcggggctcgtcaccgcccggaagaaccatctcctcctcatccccacaccgcgcctcaatccgctaccggcaagagcggctacgtagttagtacctgcgaatccagtctcagttcatcggtccatccaaattcagacgtgtcctccattattgcaagccgcgcactaagatcatatttctgtttgtttatatttctcggtcacacatacgtttgcaatcaccttcaggaaaagtgacctttgtacccgttcgatgttggtacatccagatccgtgtgctcaggaattacgtattactactatatatatactggtccgtttgagtacaaaaaaaaaaaaaaaataaggacatgtttgaaaccttctctcgtgccgctcgtgccgaannnnnnnnnnnnnnnnnnnnnnnnnnnnnnnaaaccagtgcagggtgagtggaactgtaagtatcgtcgactttgattattagatgtggctggcttgagaggttagcagcattcgttgtcggattccagattaggatttgtagtctgctgcatctccatgaattgttcaaagcggccggctggataatgttgtagctggtccaggaatgcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagagtgactgattatgcattcttttgctgtggtgttagtagctgtgtacccgtgacacatgtcgtctttcttggaacggagaaagatgcaggtgaagtgtgcattgtgcccttttgttctactgctactgctagtggtaaggcaggagccttgcaattgtnnnnnnagaacagtgccttcnnnnnctgaaggaaaatcccgtgtggaattgcttggaattagtcttggctcgtgataacaacatactagtagtatgggtgcggtggccgtggggaattggtgaagggaaacaaaagcctgagccctgaggaattgatttccacgctgatttgtatgtatatataaagaaacgtgtggnnnnnnnnnnnnnnnnnnnnnnnnnnnnnnnnnnngatatgcagccggctgctcaaccaagaaatcatgcgggtgtcaagcatggttcatgaccatggatttagtgatcttgacagacgccggtttagaagtcctagccctatgtcttcaccgattgtccggcctaatctacatggaaatggttttggtccttggaatgggatgcaccaagagagattgggctttcctcctcctggaacaagtatggactggcaaggagcaccaccgagccctggctcttatattgtcaagaagatcatgcgcttggaagttcccgtcgactcttaccctaatttcaactttgtgggacgcattctagggccaaggggtaattctctaaagcgagttgaatcatcaactggctgccgtgtttttattagagggaagggttccgtcaaagatacagaaaaggaggacaaacttaaaggaaaacctgggtatgaacatctgaacgagccactgcatatattaatcgaggctgagttaccagcgaacattgttgatacaagactgagacaggcacaagaagtcatggaggaattactaaagccagtggacgagtcacaagatttgtacaagaggcaacagctgagggagttggctatgctaaactctactctgagagaagacagtcctcaccctggaagtgtctcccctttcagcaacggcggcatgaagcgcgcaaaaccaagccagtagagaaaggtttcaggctctcctccaccctcctccactccagtcgttcttggtgcagcaccagcaaggtgtgcctgcccttgaacctgcgctgcttcgtgtcgtgggtgcttgtgtaagaaaaaaaaggtatatgcattttgctgctgctggacggacaggtggtcgagacgaggaggaaatcgctggtcgttgaactgtctccatcttcggtggatccggccattttgctgctgtaaggtgatgggcattcgttctattcgttactgactgttgaccagattatgatgccgtggtttcaggggagactagctatgcctatggccctgataattagtgtgagctggttcgtttaggtgtttaattagtttgtattattattattcgcgttacgttgtggagtagtagcaaacgtcacagctggtgatgcactccgctctgacagtttgatgaggacagctttgaataaaccatgtgaattcagaatgttactgaaaaggtgggacgtaagggcccctaggg

SEQ ID NO: 20213 - DNA, 2692 bp, Zea mays
  misc_feature (15)..(15): n is a, c, g, or t
gggaaagtaaatggnagttaaaaaactgggaaggccaagaagaaagacaagcatgcatcgcgtaaagataataacaacttggagagacatgttgatgttagaactgcaaacactgttgaaataccattaggtaatgtagactggagaaaagggatggaataatgaatagtgaaaacctaatctgaatacaaaggtggcccaattatcctattaggggggaagaatgagtatgggccagaaggcaaggagtttggtgccgcaggtcaggcatatatcaactggacagcaaagatggcagtgggactggacactggtgtgccgtgggtgatgtgcaaggaggaggccgccccggccccggtgatcaatgcgtgtaatggtttctactgtgatgcattttctcctaacaaaccttacaagcccacaatgtggactgaagcttggagtggctggttcacagaatttggtgggaccatccgccaacgaccggttgaagatctcgcatttgctgttgctcgatttgtacaaaagggtggctcttttatcaattactacatgtatcatggaggaacaaattttgggcgcactgctgggggtcccttcatcacaacaagctatgattatgatgctccaattgatgaatatggacttattagagaaccaaagcacagtcatcttaaagaactccacagagctgttaagttatgtgaacaggctttggtttctgttgaccccacaatttctacccttggaactatgcaagaggcccatgtcttccgatctccatctggttgtgcagctttccttgcaaactacaattctaactcccatgcaaaagttgtgttcaacaatgagcaatacagcctcccaccttggtcaattagcatccttcctgattgcaagaatgtagtttttaacagtgccacagttggtgttcagacatctcagatgcaaatgtggggagatggtgccacatcgatgatgtgggagaggtacgatgaggaggttgattctctggcagctgctccattgctcaccacaactggtttgcttgagcagcttaacgtcaccagagacagcagtgattatctgtggtacattaccagtgttgacataagcccatctgaaaactttctacaaggcggtggcaagcctccgtctcttagtgtgcagtctgctggtcacgccttgcatgtctttgtcaacggacaacttcaaggttcttcgtatggtaccagggaggatcgaagaattaaatataatggcaatgttaaccttcgagctggtactaacaaaatcgcactactgagtgttgcttgcggattgccgaatgttggagtgcattatgagacgtggaacaccggcgtcggtggtcctgtcgtgcttcatggattgaatgaaggttcgcgagaccttacttggcagacctggtcctatcaggttggcctgaaaggcgagcagatgaatctgaactccgtagaaggctcaggctcagttgaatggatgcaagggtcactgatagctcagaaccaacagccgttggcctggtatagggcttacttcgagactcccagcggggacgagccattggctttggatatgggcagcatgggcaagggacaggtctggataaacggacaaagcattggacgctactggacagcgtatgcagacggggactgcaaagggtgcagctacaccgggaccttccgggcacccaagtgccaagcaggctgcggccagccgacccagcgttggtaccatgtgccaaggtcctggctgcagcccagcagaaacctactggtagtcttggaggaactgggtggtggggactcgtcgaagatcgccctagccaagaggtcggtctcgagcgtctgtgccgacgtgtccgaggaccatccgaacatcaagaagtggcagatcgagagctacggcgagcgcgagcaacgcagggccaaggtgcacctgaggtgcgcgcacgggcagtccatctccgcgatcagattcgcgagcttcgggacgcctgtgggcacctgcggcaacttccagcagggaggctgccactcggctagctctcacgctgtgctagagaagagatgcattgggctccagagatgcgtcgtcgccatctcccccgacaacttcggaggagacccctgcccgagcgtgaccaagagggtggcggtcgaggcggtgtgctctcccgccgcttaggcttagcctgcccgcccgcccctacttctccgactcaccgagcaacggatttgaaggccgaaagcgatgtgtgtggagagtggaactgtaagtatcgacttgcattggtcggagggaggttaggtgtcttgagcttttagcattcgtccgtctgattccggattaggattggtgctctcctacgtctccatgaactgttcaaagcgcccagctgggtccagggatggagctgtagagagagtaggagtagaagactgatcatgcgttctttttgctgtggtgtgttagtagtagctgtgtacctacccgtgacacatctcgtctttcttgaaacggaggaagacgcaggtgaagcgttcatcgtgcctttgttgttgttgttcctgctctactagtggtagaggcaggagccttgcaattgtgttgtgtgtggacgtgtggtgggggagaaaaaaaaaagaacaggctttgatgttctcag

SEQ ID NO: 20214 - DNA, 1403 bp, Zea mays
ccggcagaaaaaaacacacacactctctttccgagctctctcgctgtctctcacccagccgccaccatgtcaggcctctacaaccagggcttctcccctgcaagaaccctctccccccagattaggagcaaccccgacgctgatagccagtacttggccgagcttctcgccgagcaccagaagttggggccattcatgcaggtgctgccgatatgcagccggctgctcaaccaagaaatcatgcgggtgtcaagcatggttcatgaccatggatttagtgatcttgacagacgccggtttagaagtcctagccctatgtcttcaccgattgtccggcctaatctacatggaaatggttttggtccttggaatgggatgcaccaagagagattgggctttcctcctcctggaacaagtatggactggcaaggagcaccaccgagccctggctcttatattgtcaagaagatcatgcgcttggaagttcccgtcgactcttaccctaatttcaactttgtgggacgcattctagggccaaggggtaattctctaaagcgagttgaatcatcaactggctgccgtgtttttattagagggaagggttccgtcaaagatacagaaaaggaggacaaacttaaaggaaaacctgggtatgaacatctgaacgagccactgcatatattaatcgaggctgagttaccagcgaacattgttgatacaagactgagacaggcacaagaagtcatggaggaattgctaaagccagtggacgagtcacaagatttgtacaagaggcaacagctgagggagttggctatgctaaactctactctgagagaagacagtcctcaccctggaagtgtctcccctttcagcaacggcggcatgaagcgcgcaaaaccaagccagtagagaaaggtttcaggctctcctccaccctcctccactccagtcgttcttggtgcagcaccagcaaggtgtgcctgcccttgaacctgcgctgcttcgtgtcgtgggtgcttgtgtaagaaaaaaaaggtatatgcattttgctgctgctggacggacaggtggtcgagacgaggaggaaatcgctggtcgttgaactgtctccatcttcggtggatccggccattttgctgctgtaaggtgatgggcattcgttctattcgttactgactgttgaccagattatgatgccgtggtttcaggggagactagctatgcctatggccctgataattagtgtgagctggttcgtttaggtgtttaattagtttgtattattattattcgcgttacgttgtggagtagtagcaaacgtcacagctggtgatgcactccgctctgacagtttgatgaggacagctttgaataaaccatgtgaattcagaatgttactg

SEQ ID NO: 20215 - DNA, 912 bp, Zea mays
ctgaaatcgccctagccaatagtcggtctcgagcgtctgtgccgacgtgtccgaggaccatccgaacatcaagaagtggcagatcgagagctacggcgagcgcgagcaccgcagggccaaggtgcacctgaggtgcgcgcacgggcagtccatctccgcgatcagattcgcgagcttcgggacgcctgtgggcacctgcggcaacttccagcagggaggctgccactcggctagctctcacgctgtgctagagaagagatgcattgggctccagagatgcgtcgtcgccatctcccccgacaacttcggaggagacccctgcccgagcgtgacgaagagggtggcggtcgaggcggtgtgctctcccgccgcttaggcttagcctgcccgcccgcccctacttctccgactcaccgagcaacggatttgaaggccgaaaccgatgtgtgtggagagtggaactgtaagtatcgacttgcattggtcggagggaggtttagcattcgtccgtctgattccggattaggattggtgctctgctacgtctccatgaactgttcaaagcggccagctgggtccagggatggagctgtagagagagtaggagtagaagactgatcatgcgttcttttgctgttgtgtgttagtagtagctgtgtacctacccgtgacacatctcgtttttcttgaaacggaggaagacgcaggtgaagcgtgcatcgtgcctttgttgttgttgctgttgctctactagtggtagaggcaggagccttgcaattgtgttgtgtgtggtgggggagaaaaaaaagaacagactttgatgttctcagaaactcaagttcgaatctgatagtgcatggaaaataatgaaccctaggaaaaaaaaaaaaaaaaaactcgcgcgaagagggg

SEQ ID NO: 20216 - DNA, 1535 bp, Zea mays
tgggaccctcgaggccggccgggccgggagtaatcccctccctcgccgccccccgctctctgtgtcatcaccctcattccgacagttccgctagaaggaaaagaagaaaaaaaaactctctttctctctctttcccagccctctctctccctctccacccggccgccaccatgtcaggcctctacagccagggcttctcccctgcaagaaccctctccccccagattaggagcaaccccgacgctgacagccagtacttggccgagcttctcgcggagcatcagaagctggggcccttcatgcaggtgctgccgatatgcagccggctgctcaatcaagaaatcatgcgggtatcaagcatggttcatgaccatggatttagtgatcttgacaggcgccggtttagaagtcctagccctatgtcctcaccaattgtccggcctaatctacatggcaatggatttggtccttggaatgggatgcaccaagagagattgggctttcctcctcctggaacaagtatggactggcaaggagcaccaccaagccctggctcttatattgtcaagaagatcgttcgcttggaagttcccgtcgactcttaccctaatttcaactttgtggggcgcattctagggccaaggggtaattctctaaagcgagttgaagcatcaactggctgccgtgtttttattagagggaagggttccatcaaagacacagaaaaggaggagaagcttaaaggaaaacctggctatgaacatctgaatgagccactgcatatattgatcgaggctgaattaccagcgaatatcgttgacacaagactgagacaggcacaagaagtcatggaagaattgctaaagccagtggacgagtcacaagatttctacaagaggcaacagctgagggaactggctatgctgaactcaaccctgagagaagacagtcctcatcctggaagcgtatcccccttcagtaacggcagcatgaagcgcgcgaagccaagccagtagagggaagcttctggctctcctccaacccttgagtcgtccacggcgcggcaccgacaaggtggtgcccttggaactcgcgctgtccgtgtctgtctcgtgggtgcttgtgtaatagaaggtatgcatctgctgctagacaggatagtctgggtaccaggtgcgtcgtcgtctcaaggagacgaggagggatcggtggccgatgaactgcctttgatcttggtgggtggatccggccgtgctgttgttgtaactgcttgtaagggtgatggacattattcgttttattcgttgttggctgttaaccctgagtagattatggtgctgaggagatagtggtttcagtgggagactagttaaaccctgatagtagtgtgagctgttcgtttaggtgtttaattagcttgtactattctcgaatatttgtcgtccgctagttcattttttgaactaagccgcgacaaataaaaaagaactcagggatagtattattattcgcgttaaaaaaaaaaaaaagcggcc

SEQ ID NO: 20217 - DNA, 1715 bp, Zea mays
tacctcggggcccgccgggccgccgggcgaactatcaaaagccctagaccacatcagatcccttctcctcaccgtgtcgctgtctcaccatcaccacccacctcccgtcccacatttcgccaacgacgggagagagtggccatggcgtcatccgccgccgccgcctcctcggcttccgcgctcttccgcctcccggggtcgggtcacctgcgtgcaccgccacgaagcgggtggcgagaccacaggcggtcccgtcgcgcgaccgtgcggtgctcgttcgcgccggtggagacggcccggataaaggtggtgggcgttggcggaggcggcaacaacgccgtcaaccgtatgatcggcagcggcctccagggcatcgaattttatgctataaacaccgattcccaagcccttattaattcacaagcgcaatatcctctgcaaattggagagcagttgacccgcggcttaggtaccggtggaaatccgaatttgggagagcaggctgctgaggaatcaagagaaaccatagccactgccctgagggattcagatcttgtcttcataacagctgggatgggagggggtactggatctggtgctgctccagttgttgcccagatatcaaaggaagctggttatcttactgttggtgttgtcacctatccattcagtttcgagggccgtaagcgctctgtacaggcattggaagcactagagaagctggaaaagagtgtagacacacttattgtgattccaaatgataagttattagatgttgcggatgaaaacatgcccttgcaagatgcatttctccttgcagatgatgtccttcgtcagggtgttcaaggaatatcagacatcatcacaataccgggacttgtcaatgttgattttgctgatgtaaaagctgtcatgaaaaactctggaactgccatgctcggtgttggtgtttcttccagcaaaaatcgggcccaagaagctgctgaacaggcaacacttgctcctttgattggatcatccatcgaggcagctactggcgttgtgtataatattactggtgggaaggacatcactttgcaagaagtgaacaaggtgtcccagattgtgacaagcctagctgacccatctgcgaacataattttcggtgctgtcgttgatgaccgttacactggtgagatacatgtgacaatcattgcgacaggatttccacagtccttccagaaatcccttttggcggatccaaagggagcacgtatagtggaatccaaagagaaagcagcaaccctcgcccataaagcagcagctgctgcagttcaaccggtccctgcttctgcttggtctcgaagactcttctcctgagaagctcatttggtgaaccgtgactcgtagtgcattagatttgcatttagcgtgttgagggcagtccctaaggtgatcttcggatatctggagatttatagcttgggctagtgttcggtagtggtagaataagtttcagtgtatgtatcgttgctttgctttatgtttttgaggatcaggcggtgaggctgagagaagtgctcagcaactcaacattgaactgttgtagaagatctttgattgcttttattgctgcaacatgccaacaaccctctgttggattcaacagaatgtgggtgcctatttctccaaaaaaaaaaaaaaaaaaagcggccaaaaaaaaaaaaaaagcggcc

SEQ ID NO: 20218 - DNA, 2627 bp, Zea mays
ccactattgagcttatgtgtaccagtggaaactaacctcataaacttgttatgtgttatacaagtttaggccctttttggaacccctagagctaatagttggccagctcataaattattagctgggttgacccaactaataaactaattattggtattagctgatggtgtttggaacccaacgaataatttttagtagctaaatattagttttagaggttctaaataagatcttactctaatagacaactaatcgtcaaaatgacacctaaaaaaaccatgaacgaaaaagatataaaaagtatagtttctcgaatatactaccacctatgttgaaaacattggcaatgcgtttcgtaatgttgaatatttcgtcacttataaataaacttccagtaccaggttctaagtacaggcaccaagagcgcgtaaataagaaaaaaaaatagagagaaggcaatgcatgttgtcgaaacaaacgctgattatttaagctctctcccttgagtagtagtagccaagcccaagaccaagtgaaacatcaacacttccacgttccacccatggctaattctcatcaccggtgcaccagcgtcgcctccgagctggaaggcacgctgctcatctccggcagcctcttcccatacttcttcctcgtcgccctcgaggccggcggccctctcagggccctgctcttgctcgccgtgtaccctcttcgcgctgctcggcgccgccttctcgtgggacgacctacccctgctcgccatgaccttcctgtccaccgccggcctcgacgtcggcgacgtgaccgcggcggcgcgggccacgctgcccaggttcttcctggccgacctgcggggcagcgcgttccgggccttgtcgcgccacgccggcggcggcgagaggtacgtcgtcacgcacctgcccaggctcgtcgcggagccgttcgtgagggagtacctcggcgccgacgtccgcgtcgtcggcacggagctgcgggtggtcgcgggtaagaggttctcaggcacggtggtggtggcctctcccggcgtcgcggcggcagcggctggcgccgaccgcagcctgggtgctctggtggccgtccttgggagcgaccgggtcgtcggcgtggggctctactgccccggcgccggcggggaccagcagccggcgtttctgcaggcttgccaggagcgccgcatggtgtccgcgccggagaaggcggcggcggtgcccctgccgaggagcgagtacccgcggccgctggtgttccacgacggccgcctcgtgcgccggcccgacccgctcgcgtgcctggccatcttgctgtggctcccgctcggcgtgctcctgtccgtgacgcgcctcctcttcggcttcctcccgcacggcgccgggctcctgctgtccgcggccacgggcttccggatgcgcggcagcctcgggggagcggcggcggcgggcccgcggcgaggcacattgttcgcgtgcaaccaccagacgctgatggacccggtgatcctcgcgacggtgctgcgccggaaggtgaccgccgtgacgtacagcctgtccagcttctcggagctgatcgcgccgatcccgaccgtccggctgacgcgcgaccgcggcagggacagccggatcatgcagcgcgagctcgcgcgcggcgacctggtggtctgcccggagggcaccacctgccgcgagccctacctgctgcgcttcagcccgctgttcgcggagatcgccgacgaggtcacgccgacggccgtgcgggccggcggcgccatgttccacggctccaccgtgcggggccacaagtggctcgactccgtcttcttcctcatgaacccggcgccgtggtacgagatccggatcctggccacctgcagtggcagtggcggcgcgtccagcctcgacgtggccaacggcgtccagcgcatgatcggcgatgagcttgggttcgagtgcaccgggctcacgcgcagggacaagtaccggatgatcgccggccacgacggcgtcgacgcgaggtcgtcgccgtcgtcatagctggagaggttgcatgtgccagcgtacgcttgtggggactcatgcacagaaatgcaaaacgttcaactggttctccttctccatgaccgccctgctcttaaacacagacattcagtgttgcagcgactaggctccattcttcccttgactttaatttaaagcccgaacaaaaaaaacacagtttcaggaaaatgaccggtttccacggttttggtacaagcccaaccaaaatttagtgattttttatgttccttaaaaggaagaatggaatacatcattgtgtatttgtgtttctctcgacaaagatatatagatcgtcttgtttagagtctggatggattaattttagttttcggaagattatctgcgctggacccacataaaccggctaagctagttttggcaggcctaaattggatctaaaacgtgttgtaatgtgttttgcaagggttttcgatctcttgtgtgataaggccattcagtgttgcttgttgcttgatccgatgaccaaggatggcgttctgacttgctggcggacctagggcctaggcaaaccgaaaacgtttgatgattcat

SEQ ID NO: 20219 - DNA, 3275 bp, Zea mays
cagtgctatagaaagaagggcacagctgagaaaaaacacgacttagggtgagcacaccacaaaactaagggcacgaatttaaaaaacccaatacaatatgtctctgtcattgacgcatccacgggctgagacacaaagctgtggatagcttcctttattaccgtgttcacgcttccgcatctcacattttttttctcatcaaaagatgcatcgatgttcactgttacttttccctcgggaggtttctatcatccgtgctgtatttttgtttcttcgttccttgtttgctgctagcttggagtaatttctttgtagagctggagctccccagcaatgtccttaatattaacggcctctttaatctgaaaacggaaaaataaagaagagagaaacgggagaagaagaaaaaaaggatgaagagcaagtgggttctgtggcacggaggaacatggagcacagaaaagagtagtaatataatgtgatggaacggccggaattgagatgggtggaacggtttccctccacaaccacttgctcctcatctacttttctcctccgccttccactcatccttgcccctgcctgccgtcgtgcatcatcatctccggccagggccagggcatcccggtccggcctcctccactctgcgccccccagacgcgtcgctgcgtagctgctggccgccatggccaccgtcatggccgcggccgtctcgtccttcccgtcctcctcggccgtcgtcgccaaggcgtcgccggcgtccccctgtgccgccccgcacttccgcccgagggccgtgcgggccgctatccgggcgcaggcgtccgccgtcgaggcgcccgccacggccaaggcgaagaaggagtccaagaagcaggaggagggcgtcgtcaccaacctatacaagcccaaggagccgtacgtcggcaggtgcctcctcaacaccaagatcaccggcgacgacgcgccgggggagacgtggcacatggtcttcagcaccgaaggtaggtactgaggttcaaaaaaaaatctgatttttgctgcctcgttcgttcgttcaactgctgtattcgtatcgtatgtataaacgctgatggacgcacgtatgcaccgcacgcaggcaagatcccgtacagagaaggccagtccatcggcgtcatcgccgatggcgtcgacaagaacggcaagccgcacaaggtcaggctctactccatcgccagcagcgcgatcggcgacttcggcgactccaagacagtcagtagctagccaatctctcctgctttctctctctctctcaagtctgaatcgactattctccgtcattttcttgagcatttctgcctgcaggtctcgctgtgtgtcaagaggctcatctacaccaacgatgccggagagatcgtcaaaggagtctgctccaacttcttatgtacgtctacgtctcttcacatcccgcgctgcaccagagcaccacactgcattcttcttctacaaatcctgatctgacttgattggcacccgaatgtctgatccagcttgttccccctgtgcgtgctcataccataatgcaggtgatctgcagccaggtgataacgtccagataacaggaccggtcggcaaagaaatgctgatgcccaaagaccccaacgctaccattataatggtaagcttcagagccgactccagtccagtaccttacgtacacactgacgacaaccagagattttaattacagtcatgcttgccaattgcttccagcttgccaccggtacaggtatcgctccgttccgatcgttcctgtggaagatgttctttgagaagcatgacgagtacaaggtacaggcagcggtgttgtaaagttcacacactggacagagaatggcaaataatgtgtgagccgctcttgtgcagttcaaaggtctgggctggctcttcctgggtgttccaacgagcagctcgttgctctacaaggaggtcagtacatcgatctgtacaaggagatcagtacatcgatctctacaaggtgctcttgtgcattattcaggagttcaggaagatgaaggagagagcgccggagaacttccgggtcgactacgccgtcagccgggagcagacgaacgcggcgggggagaggatgtacatccagacccggatggcggagtacaaagaggaattgtgggagctcttgaagaaggacaacacctacgtctacatgtgtgggttgaaaggcatggagaacggtatcgatgacattatggtgtcactggctgaaaaagacggtatgcaaataatctttaattctgaacccttagttccaactgctcttgctgtgaaattgatggtggcgctgagacttgtgttgcatatattgcttacttaaatgtcaagaatcgactggttcgactacaagaagcagctgaagaggggagatcaatggaatgtggaggtctactaaccgctgaattttgcagctgacattttgtgttgtgcgtatctgtaagtgaggccagggtgtactgcgtatataatgtagatagtgagtgtgttctgcgtttttttactatggtcgtctctgtttatagatttgtataagtactcttaatattttgcctattcgattttttgtatgagtaatgtgatcaagtgcccaagaatttctgtccccacatttttttgatttgcaaagatcttgtagatatattatttttttagttttggtttatgacaatcctagagaaaattttattttattttgcatcgaaactgataccctacacaatgaacatttgcccctgacaaccaacagaagttacacaacaagcttactgcaatatcatagaccatactgtccctctctttttttcctgcacatttatcgtgtttcttcttttttcctgtgcagtaaatatatagttattatactaatgcagaagcatgcataagaaaaaggcgaacagcaactgcgtactatatttgcaggaatattctgctctccagtattgcacacacactctactctgtatttctccagtattgatcgtcttgcttgataacgcagatgatacaatagtacaagttattatttgaccctgattgttgcctctgcaggtaaagccaacaaagttcaatatttacaataactcgatgtgtccagggtttgcaagacaagattaagcagctctaagattaagatagttgtcatcgatcttgccacaatttttacttgagctgagcagataacaagcaacttggggtattgatatttatttttctgtctt

SEQ ID NO: 20220 - DNA, 2017 bp, Zea mays
ttgatcccaacaaacactagatattactattactattactatatattaaagcagcaagcaaagttgagctctcaagttatccatgtcacctcctaatttctaaccacacgactatattcggaaaaaaccaaagtttaagcagcttctcgtttggtgcttgacatcaattatgtggaggcaaattcactaaacgatggaatacacatacaatcacaaactgcaaacaatgagtgcaaatttcaagagctcacgcttaaaaaactgaaacgaaacttgcaaaaagcaatccaatcacttttctagtggaaacctacactaccacataaacaaacgatcaaaattcacaaaaaacacccatacatgaatgcaatcatgaacgtagtagcacgacagaaatgggtgtgggagacacctaagggtggatatcgagccagctcagctcagcttgaccgagcttgagctggctcgttaagggaacgagctgcctcggctcagctcgttaagcaaccgagccagagaactagctcggctcggctcgtttgcgagctcgagctggctcgtttagctcgcgagccacaacaaaaaatagtatacatatatatatacaacaatttaatcaattgctagttaatttcatactaagttaacactacaaaagattaacaatactcataattttatatatcacatcatttataccctaaactaacatagttcatcacttattaattcatctaatccaagtataggctttgtttacagataaatgctagctcattcgagctaacgagctggctcgttaacgaaccgagttgagatgttagatcagctcgtgataaattgaaacgagccgagtcgagccgagccgagctggccacgagtcgagcgagctcacgaaccacgagtattttatccagccctagagacagaagcataggactgggaggtggaacatgcactaggggcaacccgggttcctcttgcttcttggcgacaagaggtgtcggaggttgtcatcacacacgtctgtgtctagaggtggaaccactgttgcatgaaagcccaagtctcgatgttgtccctctccttgaagctacattgtagctgaagggatggtacccttcccccttatgtcgagaggtgtaaccattgatgcacgaaagcttagatcttgatgatgtacttctcctaaaacttcattgctaaatgaaggggtggtacccttcctccttgtgtcgagaggtgtaaccattgctgcacgaaagcctagatctcgatgatgtgcctctccttgaagcttcattgataaatgaaggggtgggacccttgcgccttaattatcgtgccatggttcctcccccaacatgatatctggaagtcattgccaccgacatcgatgtccacaatcggcttgattctcttctagactctcacggtagtggatgggtctggcacaaacgtcacagtgatcctccacacggaagctatagcttcatctgcatttgacgtctccaactcatcgaccaatgacattccctcgtgttgttgcagccgccatttgattatttgagagattgagcagaccccacctcaacacccgattcaccctcatccatattggatctgcttcatctacattgcatgtgaagagaaagagtgggggcaacgacatgggacacgaagcagaggatggcgatatgcacgttgggaagccgatggacgcaatttgaagggttgcaagcctattattggtcgtccaaacgcggccgtgtggctagaaataaggaggtaacatgtatattttaaaagatcagctttgctccatgctctgcattaatatatagtaatcaacgtatttctagctttggtggcctccagtatctcacacataactaagaaaatatggttagactcatttctaaatttacaaaggtactcgcgacaaacaataatgacaatacatgtacccatgccgaacctcctagttatcaaacctcatagttatcaactactagat

SEQ ID NO: 20221 - DNA, 1542 bp, Zea mays
tccgccccgcgtccgcctcgccctccccgccgccggcctgatatttcctcctttccccatcccttcccctggcttcacggctcggctggctgcacgccggagccccggcgccagatctcgccaagtgccagggccgccgcaggcccctctttgcctgcgcgaggtctcagaatcccgagagggaaaaagaaaagaaaagatgatgacttcctctgcctgttactacctgtgccgctccctcgtccgggctcctccgctcaagtcgaggagtgcagtgcgctgtccaagcgccgccccgccaggagccagcggtgccacctccacctccaagacacaggatccagttgaaaaccagaagctatgtgcctatttggttgagaaggcagtcaacagacttccgccaggagcagagaatatacttgggatctttgatctgcgaggctttcgggttgaaaatggtgatctccagttcctaaagtttttgatggacgttttttactattactacccgaagcggcttggccaagttctttttgtcgatgctccatttgtttttcaaccaatgtggcaggttgttaaacctctgttgaaatcatatgcctccctggtaagattttgtgataccgagactgtgaggaaggaatacttcaaagaagaaactgtgcctcctgatttccgcgattagaaatgtgcaggtggtctcggaaacatgacctttaattgattgagaatcgattggcacccaggggggctggcgccttcctataccttttgattaacttctcaaaagttgctcagacgacaacaaacgattggagagtccagtaaaaaatgaccctgtagtcctgtacttgtataacttctgcgaagtagaatgctgagtttaggctgctgtctggagtgctcctgtaccatatttttctggttttggatgaagctatatggaccaaattcatctctgttgaacaattgccaattacataacttgtgtttgcccaattccatggtgtagtaccataacttctcagtgcagtgcagacaacacatggattccatttttgattaaagtatcatctgctacaaatatgaatcatggcttagtttgtagacttcataaagaaacacacagattaatcaaaccagtcttcgaagagtctctgtggataggaacgttccaaagcaaagtaagatgcaagttgtattgcataaaaaccaggtacacatcaatcagctgcattttggaagactaaactgcaacacaactacatctgcaatcacagagaaatcaggtatacgaccaattgttatctgttgtaaatattttattttttaggtcaacaacggagagggtcaagcgatccccacgtacagatgccagcatggtcttttacatggttccaagaggaggtaaatcgagtgtggccctaaaaagatctgccttgtgccacttcaacactttaacccagatgttgcattgtggtgtggcaaagcctcgagaatatgacaataacagctgctcaaaaactgttggtaggaatattt

SEQ ID NO: 20222 - DNA, 2739 bp, Zea mays
  misc_feature (1976)..(1976): n is a, c, g, or t
gcgttcgcggccacggcccgggcattcgtctccgcctccggtccggcctcctccactccgcgcccccccccccccccaacgcgtcgctgcgtagctgctggccgccatggccaccgtcatggccgcggccgtctagtccttcccgtcctcctcggccgtcgtcgccaaggcgtcgccggcgtccccctgtgccgccccgcacttccgcccgagggccgtgcgggccgctatccgggcgcaggcgtccgccgtcgaggcgcccgccacggccaaggccaagaaggagtccaagaagcaggaggagggcgtcgtcaccaacctatacaagcccaaggagccgtacgtcggcaggtgcctcctcaacaccaagatcaccggcgacgacgcgccgggggagacgtggcacatggtcttcagcaccgaaggcccttctttgcctgcgcgaggtctcagaatccggggggaaaagaaaagaaaagaaaagatgatgactgtctctacctcttgctacatgtgccgctccctcgtccgggctcctccgctcaagtccaggagtgcagtgcgctgtccaagcgccgccccgccaggtgctagcggtgccacctccacctccaagcttgtcctagaggtgaaagaacggctagcaagggagcacccaggcctccccacgggcaggaacgggagggacgatgacgacatggtcctctggttcctaaaggaccgcaagttctccgtcgatgaagccgtctccaagctcaccaaggcgattaaatggcgtcaggactttggtgttgcagagttatcagaggaatcagtgaaaagcctgtaccaaactggcaaggcatatgtacatgattccttggacatttatggccgacctgtgctgattgtagtggcagccaaacattttccttcgacacaggatccagttggaaaccagaagttgtgtgcctatttggttgagaaggcagtcagcagacttccgccaggagtagagaatatacttgggatctttgatctgcgaggctttcgggttgaaaatggtgatctccagttcctaaagtttttgatggacgttttttactattactacccgaagcggcttggccaagttctttttgtcgatgctccatttgtttttcaaccaatgtggcaggttgttaaacctctattgaaatcatatgcctccctggtaagattttgtgatgccgagactgtgaggaaggaatacttcaaagaagaaaccgtgcctcctgatttccgcgattaggtgacatgattatttcttcagtaattgcaagtcagttctacctctgcctttgtgtaacgattgaaattctaaattgtgcagattatttttagttcttccaatccctcctaaaagctattttgcagaaatgtgcaggtggtctcggaaacatggcctttaattgattgagaatcgattggcacccaggggggctggcgccttcctataccttttgattaacttctcaaaagttgctcagacggcagcaaacgattggagagtccagtaaaaaatgaccctgtacttgtataacttctgcgaagtagaatgctgagtttaggctggtgtctggagtgctcctgtaccatatttttctggttttggatgaagctatatggaccaaattcatctctgttgaacaattgccaattacataacttgtgtttgcccaattccatggtgtagtaccataacttctcagtgcagtgcagacaacacatggattccattttttgattaaagtaccatctgctacaaatatgaatcatggctttgtttgtagacttcataaagaaacacacagattaatcaaaccagtcttcgaagagtctgctgtggataggaacgttccagagcaaagtaagatgcaagttgtattgcataaaaaccaggtacacatcaatcagctgcattctgggagactaagctgcaacacaactacatctgncaatcacagagaaatcaggggctacgactcaactgttactctgctgtaaatattttgtttttaggtcaacaacggagagggtcaagcgatccccacgttctgatgccagcatggtcttttacatggttccaagagttcgttaattgagtgtagccttaaaaagatctgccttgtgccacttcaacactttaacccagatgttttaaaaagactctttaacccagatgctgcattgtggcaaaggctcgagaatatgacaataacagttgttcaaaaactgttggtaggaacatttatagcagcaaaagaacaaaagggaatgcgtggtttcttatctgccttagatgagataagatttcggacatgtgtattcatgtttttgagtgatttggcactatgaatgcactagattgttggttgcttttttttgttaattgctcaggttgtatttctagtcactagtgttgtattgtttgtgcttgtgctaagatgatctcttttgcacttgtaatgggtgctctttcaagtactctgctgatcgataatggatggcgtcggtgatggttgattcttttgcccgaaaaaaaaacatggtacattagcggctgatggagatggatggtggtgtcgctgttttgtgttttgtttagccctctaggtgacacattgttatgggattgttacacagctgatatgttatgaacctgatatggagatctttttgcgtcctttgtttgggtgttctgttgtgccattcgtctca

SEQ ID NO: 20223 - DNA, 2294 bp, Zea mays
  misc_feature (1694)..(1694): n is a, c, g, or t
gggaccctcgaggccggccgggagggtggaacggtttccctccacaaccacttgctcctcatctacttttctcctccgccttccactcatccttgctcctgcctgccgtcgtgcatcatcatctccggccagggccagggcattcgtctccgcctccggtccggcctcctccactccgcgcccccccagacgcgtcgctgcgtagctgctggccgccatggccaccgtcatggccgcggccgtctagtccttcccgtcctcctcggccgtcgtcgccaaggcgtcgccggcgtccccctgtgccgccccgcacttccgcccgagggccgtgcgggccgctatccgggcgcaggcgtccgccgtcgaggcgcccgccacggccaaggccaagaaggagtccaagaagcaggaggagggcgtcgtcaccaacctatacaagcccaaggagccgtacgtcggcaggtgcctcctcaacaccaagatcaccggcgacgacgcgccagggggagacgtggcacatggtcttcagcaccgaaggcccttctttgcctgcgcgaggtctaagaatccggggggaaaagaaaagagaagaaaagatgatgactgtctctacctcttgctacatgtgccgctccctcgtcccggctcctccgctcaaatccaggagtgcagtgcgctgtccaagcgccgcaccgccaggtgctagcggtgccacctccaccttcaagcttgtcctagaggtgaaagaacggctagcaagggagcacccaggcctccccacgggcaggaacgggagggacgatgacgacgtggtcctctggttcctaaaggaccgcaagttctccgtcgatgaagccgtctccaagctcaccaaggcgattaaatggcgtcaggactttggtgttgcagagttatcagaggaatcagtgaaaagcctgtaccaaactggcaaggcatatgtacatgattccttggacatttatggccgacctgtgctgattgtagtggcagccaaacattttccttcgacacaggatccagttgaaaaccagaagctatgtgcctatttggttgagaaggcagtcaacagacttccgccaggagcagagaatatacttgggatctttgatctgcgaggctttcgggttgaaaatggtgatctccagttcctaaagtttttgatggacgttttttactattactacccgaagcggcttggccaagttctttttgtcgatgctccatttgtttttcaaccaatgtggcaggttgttaaacctctattgaaatcatatgcctccctggtaagattttgtgatgccgagactgtgaggaaggaatacttcaaagaagaaaccgtgcctcctgatttccgcgattagaaatgtgcaggtggtctcggaaacatgacctttaattgattcagaatcgattggcacccaggggggctggcgccttcctataccttttgattaacttctcaaaagttgctcagacggcagcaaacgattggagagtccagtaaaaaatgaccctgtacttgtataacttctgcgaagtagaatgctgagtttaggctgctgtctggagtgctcctgtaccatatttttctggttttggatgaagctatatggaccaaattcatctctgttgaacaattgccaattacataacttgtgtttgcccaattccantggtgtagtaccataacttctcagtgcagtgcagacaacacatggattccatttttttattaaagtaccatctgctacaaatatgaatcatggctttgtttgtagacttcataaagaaacacacagattaatcaaaccagtcttcgaagagtctgctatggataggaacgttccaaagcaaaataagatgcaagttgtattgcataaaaaccaggtacacatcaatcagctgcattctggaagactaaactgcaacacaactacatctgcaatcacagagaaatcaggtgctcattcaagtactctactgatcgaaaatggatggcgtctgtgatggttgattcttttgcacgtcttctacactggtacattgacggctgatggagatggatggtggtgtcgctgttttgtgttttgtttagcactctaggtgacacattgttatgggattgttacacagctgatatgttatgaacctgatatggagatctttttgcgtcctttgtttgggtgttactgttgtgccattcgtctcataagttatgccattttattacttgcttttggattgatatatattcgtctttgaagccttcctcc

SEQ ID NO: 20224 - DNA, 808 bp, Zea mays
  misc_feature (6)..(9): n is a, c, g, or t
ccgggnnnncccttgaggttgtcggtatggatattttttttgggttttgtgagaagacctctatatattccttgtatacaattttgagtattacagatacccttgcgccttaactatcgtgccatggttgctctcccaacatgacatctataagtccttgacaccgacatcgatgtccacaatcggcttcatgctttcctagactctcactgtagtggatgagtctgccacaacgtcgcagtcatcctccacatggaagttgtagctttatctgcatttgacgcctccaactcatcgaccaatgacattccctcgtgttgttgcagccgccatttgattatttgggagatttagcagaccccacctcaacatccgattcaccctcatccacgttggatctgctttatttgcattgcatgtaaagaggaagagtgggggtggtgacatgggacacgaagcagaggatggcgatatgcacgttgggaagctgatggacacaatttgaagggttgcaagcctattattggtcgtccaaacgtgaccgtgtggctagaaataaggaggtaacatgtatattttaaaagatcagctttgctccatgctctgcattaatatatagtaatcaacgtatttctagctttggtggcctccagtatctcacacataactaagaaaatatggttagactcatttctaaatttacaaaggtactcgcgacaaacaataatgacaatacatgtacccatgccgaacctcctagttatcaaacctcctagttatcaactactagatttatcaactactagat

SEQ ID NO: 20225 - DNA, 1295 bp, Zea mays
atatttcctcctttccccatcccttcccctggcttcacggctcggctggctgcacgccggagccccggcgccagatctcgcccagtgccagggccgccgcagggccctctttgcctgcgcgaggtcttagaatcccgagggggaaaaagaaaagaaaagatgatgactgcctctgcctcttactacctgtgccgctccctcgtccgggctcctccgctcaagtccaggagtgcagtgcgctgtccaagcgccgccccgccaggagccagcggtgccacctccacctccaagcttgtcctagaggtgaaagaacggctagcaagggagcacccaagcctccccacgggcaggaacgggagggacgatgacgacatggtcctctggttcctaaaggaccgcaagttctccgtcgatgaagccgtctccaagctcaccaaggcgatcaaatggcgtcaggactttggtgttgcagagttatcagaggaatcagtgaaactcctgtaccaaactggcaaggcatatgtacatgattccttggacatttatggccgaccagtgctaattgtagtggcagccaaacattttccttcgacacaggatccagttgaaaaccagaagctatgtgcctatttggttgagaaggcagtcaacagacttccgccaggagcagagaatatacttgggatctttgatctgcgaggctttcgggttgaaaatggtgatctccagttcctaaagtttttgatggacgttttttactattactacccgaagcggcttggccaagttctttttgtcgatgctccatttgtttttcaaccaatgtggcaggttgttaaacctctattgaaatcatatgcctccctggtaagattttgtgatgccgagactgtgaggaaggaatacttcaaagaagaaaccgtgcctcctgatttccgcgattaggtgacatgattatttcttcagtaattgcaaaaatgtgcaggtggtctcggaaacatgacctttaattgattgaaaatcgattggcacccaggggggctggcgccttcctataccttttgattaacttctcaaaagttgctcagacggcagcaagcgattggagagtccagtaaaaaatgaccctgtacttgtataacttccgtgaagtagaatgctgagtttaggatgctgtctggagtgctcatgtaccatatttttctggttttggatgaagctatatggaccaaattcatctctgttgaacaattgccaattacataacttgtgtttgctcaaaaaaaaaaaaaaaa

SEQ ID NO: 20226 - DNA, 4023 bp, Zea mays
  misc_feature (249)..(249): n is a, c, g, or t
  misc_feature (942)..(942): n is a, c, g, or t
  misc_feature (1388)..(1388): n is a, c, g, or t
  misc_feature (1423)..(1423): n is a, c, g, or t
gttgctctactctagagttccaccaatatttttatttttgatgtgtttagctttgtaaccctgcttcagctccaacctgtcagtggcgcaataaactagggaatgtatcgatgggtcgatcccgacctttgtggatgagtccgtctttgacgatgggataacttagcttcttgtacagctcgtacaatggcttccacctcgttcatagtgactgccatgcaacacaacaaccgctgaccccgggtgctnttgcgccggagggttccatacgagaagagaaagaaggagatgcgttggggaaggaaagaaaagaaggaaaaacaagctctatttctatgcccagcggcaccagcgtggtcctatgcctaccggcgccggcgttagggcctgcggatccatgaagatgcagataacagagaaagggaaatgtgagcgctagatggggtatgggagaaaaaaagaagcaatttattgtgtaatcggtggcagcggtggataattattccctaacttcacgagttaatttattgcaaaatagcgtttgtgaaacaccctattcgttgctttataaaaaagggtgaagttaaccccaacttcactatttttttgtgaagctgagccggtgaagttggaagtgtttggctagagttttgttgatctaagctagaattcgtgaagtgaagcagtcccaaacaccccctaaatttgtagtagcactgtaaattctctgcttgtacaataatgactacataacataacaatttgatgccaaagtagggccatagtttccacatatttgtggcatctatctttatttgggctatacagacgtggaggtatgggtggtaatgggctctaaattttatactgtacaatgtaaggatcagatctgattgtaatcgagctctatttctattcatttttgaactaaaattatttaanagtccaaacaatctgggaaggaacatttgggtcatgacccattaccacccctaggtgtaggttcaaataaaatgaaacaattataactctaaatgagatattcaagttcttacttatttaaatttatgcgccaaatgatacaaagaacaccagggaattcgctgttgggtggctttgcattgccacttgcagcagacctctttatgaaaagtaccttccgttagtggtcaagcaaaagcaaccccccctggccgggctacaaggcagaagagtagtgtacgtaattaccacctacagtactaactttatttgcttcacgcgttcttctaaatgtaagacggagtaagaaaaaaccctgaacaagtttagcagcaatctgatgaggccatatctacaaagagagcagagatgaaaaagaaaaggaaccaattcgacaagctaagttnttaaggccgtgcttgatgttaaaatcgtgctcagnagcctataaccgtgcaaaacatttgcaccgcacactacactgcacaatacattgtttgcacacaatacattgtttgcagatagaacgcatatatatatatatatatatatatatatatatatatatatatatatatatatatatagtcttgctcgagataggctgagataatctttggagatagcctaaggttgttgtcttcaatatctattctatcttatcccttattataaacttcagtttgtaaatagtatcatctatagtgtaaatcctcctactttacacgatcgacaacctaagataatctcctgggtcgggctggcgatgggtgtccatgctttcagaattttcttttcatttatttcagttccctttcggcgctggtggtttcaatcatatatacacctttctcagattacaaaaaaaaaccaacctcttttgcctagagaagaagagcgcaaagtggttccatgcttttttggtgggcgttaacagctccgcaacatgtctcattattccattatttttttcgtcttttggagcctgcgcggtcaaatatgaggtttggttgtgtctaggggtggatatcgagccagctcggctcaactcgaccgagctcgagctggctcgttaagaaaacgagctggctcggctcgttaaggaaccgagccagagaaccagctcggctcggctcgtttgcgagctcgagctggctcgtttagctcgcgagccacaacaaaaaatagtatacatgtatatatacaacaatacaatcaattgctagttaatttcatactaattttaacactagaaaagactaacaatactcataattttatatatcacatcatttaaaccctaaactaacatagttcgtcacttattaattcatccaatacaagtatatgctttgttttatagataaatgttagctcattcgagctaacgagctggctcgagctcgtgtcgagctggctcgttaagaaaccgagctgagatgttagctcagctcgtgataaaattgaaacgagccgagtcgagccgagccgagctgaccacgagtcgagcgagctcacgagccacgagtattttgtccagccctatcctcccaccgctcaagtctcttgctcctatccatgtcgtgagtttttttttttccgttgaagctgctgcagcacctgctttttcccagctcatatctccctcttgatatttcttgccgtcggaaaaatcaaaccgccccagcctgtctttatctcctgcgcgagccgtgctcgtgatccttcccagccgcttcatcttcttgcgtgcgcagctttcctctactcaagctcgccgcgcgccaggccgactcctctcctgctccagctcgcggagttcccatggccgccgtaagctcgcccctggagcttccccgtcgcgcggttctctgttctctgcgcacagtcgcgagctcgccggcgtgctccggatttagccatggagcgtccccatcggccatcgccgtggagctctcctgaccgtctccagacccacgcccatggcagctcgcctccacagtccacaccgcgctcctctgctcggcctcctctccaatttccccaaccgagctcccatctccctgttgctatgcccagccgactgcaactatggccgcgcccagcttatctccctcagcgctcgcggctctctctctctctcccctggtccctgccatggctggtcgagtttttccccagccgcaaactctccctgctcggctgctcgctcctcccatggcgtccatctccgtagtcgccgccctctgctctggagatttctacgcgcagcccagcttttctgtttattcccagcgcgcgcgtctactccctctgcctgggttatgctcctccctaacaacgctggcacacgctctcctctggtcgttggtcgtgcttctccctcagcagccaacctcgtcggccgagcccagccccagctcgcccagtctccatctcctttaatctgccgttctccagctcggtctctgtatctctgcacacgtcgagttccttgccgcgcgctgagctgtgagctctgtgtcgtgtccctggttccagcgtggagctcgtgagcgtcttcctgtgctccttttgtgcgatcagctttggtctctattacccgctaaactactgtcgcgccgggttatgccctgatgcgcgcatcattagtcttcgccgtgcgtgtcgtgacagctgttgtggccgtgaagcagtccgcgccatagagttcgtccgaccgcgacctcgctttactcctcgcgtcatcgtttgccgtcgagtcgtcaaacacgtcatcctctgctcaaaccccacctcaccagttcgctcccgacttcagctaaaagccgttgtcgttccgcgcgtcagcaagaaatcccaagaatcaagtgaagatgaagctagcagcacgatactccccaagtgttcgacaaattgtctggatcggaaaatcgctaccgatctcgcagattcgtgtcagctgctgaaacggtaagctgatgaattattcagaatagttcaatcgatgaataaataaattgctgaaaaaaaaaaaaaaaa

SEQ ID NO: 20227 - DNA, 1617 bp, Zea mays
ctctgcttcctccaatctcctccccgcgtacgcgttgctccttatctcttgctgtcatggctggagattcttctccttcaagctcatcctccacgccgcttacctgggagatttttatttcttcctcaactcaatcctctgctcaaatgcggcccccccggtccggcccgcatcttcccagccgagattttcccagcgcccatctccctaccgtgcagctcgagctcccgcgcccgagctcctcccagccatggagctcgtcaacctgcagctcgcccagccccagccctcaagccggcgcacggagtgcgcccctgtccaagctcgcacgcgagctcctcccctctgctgcgcgctagatttttctccccgcgcgcgcgtctttcgccatggccgccgtcaagcccctggaaattcctcgcctgtgcgctcctctgggtcacgctctgctcggagctcccatggcggcgccccatctcttcctggctcctgcgctcgggttgccattggtctgcgcgcgggtcgctcatcttccccagccaaggcctctcctgcgcgcggcactctgctcggttccttgtcaccgcgccgcgccgagttcttcacagtcgcgcctgcttcccatggccacgggctgcagctcgctcgtctccctgcgcagtcgtgctcatctgctcggtctccctggcgctcgaaacccagtcgcccagcccagccgatctctctccgcgcgcgttcctgtttctcgttagccacagttatctcgaccgcgtcacctcgccagacctgcaactctatatatgccacccttccatatcgttgtcgagccccgtcgagcctcgttcttctctgctcgctctcgtcgaacaccgaattccggatattagacaaaaataagcgagacccttgtgtatcgcttatcaagtactcgggtgaagacatcaatcgaagatcgtccgcgccgtgtgtcatcaagaaatcccaagaatcgagtgaagactgaggctagcagcacgatactccccaagtgttcgacaaattgtctggatcggaaaatcgctaccgatctcgcagattcgtgtcagctgctgaagcggtacgctgatgaatcgcgcggtgcggttcacgcgccgagtcgaccccaagcgtgggcttcttcgcaaggcgctgctgatggacaaacctgaagatggtctttttttgctcatcgactaacaacactaacctagtgttacccagggtggatggagacgagtaagctgctgtgctcaagatacattgtctagcagtgtagcttacgttgttgttgtcttgcgttagatggatgttgttgctcatcgccgtacgcattaccacatgggtattaggttgtgtccaatagtatgcatatcgactctcgcataacgatgcactattcacgctttcagtaggtcacggatgtcgtcactcaaaatgtgcggtcgaccatgcggatgcacatctcctctgcgagaggatgcacatctgaatgcgcatgctgctggaaaccattgcttcgtagtctttgtatccgccatgcaagggcctgtgcgtccttcctcctgtgacggatacaaagactacgaaagatgggaagcg

SEQ ID NO: 20228 - DNA, 5283 bp, Zea mays
  misc_feature (16)..(16): n is a, c, g, or t
  misc_feature (18)..(19): n is a, c, g, or t
  misc_feature (21)..(21): n is a, c, g, or t
  misc_feature (103)..(103): n is a, c, g, or t
  misc_feature (107)..(107): n is a, c, g, or t
  misc_feature (115)..(115): n is a, c, g, or t
tttttttttttttttngnngncgacttcttccaccatttcttatacattcaacaacacacactaacatataaaacacacacactaacatataaaacaaacganaatnttctcggnaagaggtccatgtggcctcccatacgtcttcgtcttcaaatgtgccctttgttgatagacgtgcgccgtgccgcttcagcgagatgtgcagaggttgtctttgaggactacagcaatcggatacgtacggtacacccccagcggtcaagctacagcagcatacgttagatagcactaggggtggatatcgagccagctcggctcggctcgaccgagctcaagctggctcgttaaggaaacgagctggctcggctcggctcgttaagcaaccgagccagagaaccagctcggctcggctcgtttgcgagctcgagctggctcgtttagctcgcaagccagaacaaaaaatattatacatgtatatatataacaatataatcgattgctagttaatttcatactaatttaacactagaaaagactaacaatactcataattttatatatcacatcatttaaaccctaaactaacatagttcatcacttattaattaatccaatgcaagtataggctttgttttatagataaatgctagctcattcgagctaacgagctggctcgcgctcctgtctcgtgtcgagctggctcgttaacgaaccgagctgagatgttagctcagctcgtgataaaattgaaacgagccgagtcgagccgagccgagctggccacgagtcgagcgagctcacgagccacgagtattttgcccagccctagctaagagatatataatacgaagttaaaacatactatgctttattcttttttctaacacatccgatggatacatattgtgccaagaagagtctttatttaataatagttaatagagatggggctattgatttttctgttttagtggagcgcaacacattgatttgacttcagttcaaaagaccaaaatcatgcaatcttagcactgtgtgtgatctggcaccgctggaagaggaggatcaaccttattcgaccatagtccgactcgaggcagccaagtctagataaagcaagactgcaacaccgtatgtgtgatggtgcatagtcaaaattgttggagccgatgccagaagccactgatccatcgagtggatgtattgatgaagtcgtgttagcacaacacaacaatgtgcaccacttccctacttgtcgcgataaatgtctttgtgttgcgacgcgccgagataagaagagtaccatagaaattcagagagaggcataggcctcacacccctagattagagcgcatacatggaaaattgcacacactcaatttagaaaggttaggatcgcttaagtgtaatactcagtgtcccccatatgatgggtgtataaatgtaaatgtacacaacataaaagcttcaatgacgttgaggttgggatcgtgaaaagttgagaatcccgcaaaagccttttctttgttgttctaccatctccttttacaatccaagggaaaaatatatttacatccctacatgaatagttggtcccacaccctatagagtctcaactattattttgtcgtacttgttgatccgtatgtgatgcacgtcttagtcgtggtgacaatgtgtcatgttgtagtggctgatacaagagttcgtacaatataatgtttgtggttatgcatgtagcctcagatatggctatgattgttgtgctaacacacttacacacataacatagtatttatgaataaacctgcgttctgagacataacaataccgttgcttttgaatataacgtcattcttcacaataaatacgatgaacaataactttatctcatttggcgggtgacaagcgcccatttggtcggaggagtaagtgacgtcgatgccatacttccatgaagcgtcttgaggattttgagagatctttttagcctatatctattgagaaattagatatattccaaattaaatttcaaatataaatcttgaccaacaataaatagtctaggtaataaatagtctagatgtgagttccataacaagtaacctaacaggttacctaacaacataattataaaaatgtgtcacacctctaccatgacagatgaactgtagcatgaggtcaaatcaacttatgcgtactgaacagatataatggtagacaatgtgggtcgaagtagcatggttgacaacgtcgaagcaacaggtcgacgacgtcgaagcagcagggtcgacaacatcagcggcatggtcaacaagaaaaacacgagcagtcacgtgaagacgcttcccaaaaactttattcacctcttacggtgtaggatctcgaaggcgacaggttccggagacctgttgtcccgatcgtagatacgcgtcgacgctcgggatgaagaggactatgatggcggcgcaactatgagcaaaggagaaaacccaactcatgttgggataccctctggcaagggctgacagacgccttgtataggaccacgtctacgaaccgataaactcatgatccgatatgatcgtgatctgatatgctcgtgattcgatctgtttgtgatccaatatataaggattcagatcctcatctggttccaccgttttcttgccataaatgagcttttgtgattttcttaggatttaatttaaaaaaatcatacccttagtcgtgttttttgctcagctgtgcccttctgttctatagcactgggagggcatagctgagcaaaaacacgactaaaggtataaatgagcacaccaccaaaactgagggcaccagcttaatttaatttctcaattggctaagcctatttcaaacttgactctttgtttatcactacagtataaaacaatatttctcgattggtcccatattgcaaattctttcattttctactccagatctgtatgaagtatatagagagagatcttgtatgatattagctacatttagtcggagcctcccaccaaattttacattagcaatgcgctggccatcactgtgaacaagcatcctcgcgcatcaggatgttcgaaaaaaattctcacaaacacaaggggattaaactatgtcgtctcacctttctacagaaattttgacctcatgtgttgattcatcttcatttccgccaaaggccggtagtcatactacccaccctctgatgttgaggtccaacagcggcaacccttcatccatagcgcacttgacatcgtcctcatcctgcactccatggtacaactggaaacctagatcgttcgctctgagactgtcctcggacatgaacttcgccgactcaccactgttctgctcgcacactggccccgcgttgtccatgaagccttagaacgccaggctgaagtctgtcagctgcgacctggtttcttctaggtccgcggttccagttgcttcgtacgaatggttgctctatgctttctcgagtatagtctgcagatatttaccttgcgtctcgatccacatttgtagcttcttctgaacctgcatgtggaaaatagatcaagaggtcaatttttttgtgttcgtgaatcgtgactacaatagttgtagcagcggaggtttttgcgtagtccaaccatgagctgttcatgcagtttcttttggacttcaatctggtacttcagcacacccgcacgtgggcatgttcagaaatgataaaccaaacaaaaatattgcgttccttgcaagtcattttaatttcttcggagattcaaagtattttaagtttaatcaaatctatataataaaataattactattataataccaaataaattttttattttattaattatttttatagtatacttattcgatgttacgagtttttgtgattatttctatacctttgttcaaattcgagatgatttaactgttaaaaaagttagaatagtctataatttaaaacggagggagtatgtatacccaagctaaagattgatgtaaagccacacaaaatggaaaccattcggaaacaattccttctcgaattgtatagtttgacaggtttcttcaacatgttgtatattcaaccatatattctacatccatacattcaggcatacactctacagaacatgctgtcaaaacatgcacaagcacttaggctctagtaactgaaacataggtttagtcatatatgcaaactccaatatattcagtcatatatacaagcatacactctgaagaagtaactgaaacatccctcaagcagtagaaacatcccagtaactgaaacaaccatggctaatgaagaagcaactgaaacgtgccaatagaataagtaactgacctatatgtttgctgctcgagcagtagtaaaccaacaaacacaacaaacatacatgagtctgaatagaaggaccgagctcattcctggttatagagaattttaagaacctgtcgatgaactcctttgggtcgtcatccttgtcagaatatagtttagagtattcgcttaaaagagaaatgaatattgaaatgctgcttcttacacaatgcatacacattttctgaagcagagacatcatatttgtagagtctgtcaacgttgctcacctcaagcattttatcaacttctcacagccagatgcttctagcactccatcaagcatagcttgcagctccatgtctttctgcttcattgcttcctgccatgggaaatcaatagaattaacttcttgggggtaacaaaagagaagaacaataggccatgtaaagtgtgctagctagtagaaacttcgacagcacaaattcaagcattcattgaaggactcaaagaaaaaggagcggatgaagtagtagcatacctttccatgacacaccgagcttgaggagagtgagctccatatcacgttgttgtcgcaccatttgacgccacgcgatgaagcactctgcgacatccgtgtggcggcaccgaagctgtcttcgggaatctgggcgccttgatagacatgtggttgttcttcctggagagcaccttgaacgtcttctccgtgttgagtttgtgatccaaattccgaagaaggcagccaagttgacgagcgaactgaaggtccgtcaccgggaggcttggaccgaagcgatgacaactgacctttggcccacagcccagggagcccccacggtacggatcgttccctactcaccttagggtttcacctctataaatacacttgtaatccgccataagatcatcatctcat

SEQ ID NO: 20229 - DNA, 1024 bp, Zea mays
ggggggggggggcgtgctttttagaagtggagaaaagttccaactccagctgaaaaggttaaactaaaaaataataaacggaacggaggcgcccatcttagacaaagaaaaagaaccgaacggaacagaaacaaagcacccagctgagtcggatcaaacagcactccatttgactgaaaaagttgagaccaaccgctggctgctactgctagggaagggaacacatacatccgggacagagtagcgaaaccacagcctacgcttccaaaatgcagatggagatattccacccgaaatgatcaaaattaaaaggagaggggggaaaattctctcggcgcaggcggcctaaacaaagcctctccagtcgataaccaagtattatgggctcgatcaactcgttgaggggagccagctctgccctgtcgatcagccggaattccaatgtgaagagcgtgaagtgcttgaagcaggtgttgagatgcgcctcttccttgagcctgacgatcacctggaagtgcgagtggtatatgtgcgcgtacaccctgaagaggcgcttgaagatcgtcttgacgacctcgcggaagttgggagggaacggagccccgagcttttgggggaatatggtctcttcgtcgagctgggcctccacccagtccatcaggtactccacgtacttgggcgcagacacctcgattggcctcttgatcttggccccgtcagcccatctgtactcgtagcttggtccggctgacatggtcgggcatgtcgctggcgtgcagaactccatccagggtgccgtagagaatgttcacttggttgaagaagtcgacggtgttgacagcgagccactcgttgaggtcctccccgatgggcagacgcaccgcctctcgcaggttaccgctgccgagggtggcgtcgatgtgccttttcagctgcatccccttgttcccggacggcgcgctcttcttcggcctgaaggttctcgaattctgctgccgcggccaaagaagctcatcttctcctg

SEQ ID NO: 20230 - DNA, 2017 bp, Zea mays
ctgatatgttatgaacatgattcttgttttgggtgttactgttgagccattcgtctcacaagttatgctattttattatttgcttttggattgatatatatatttgtctctgaagccttctttcactacaatatgtctctgtcatcgacgcatccactggctgagacacgaagccgtggatagcttcctttatggccgtgtccacgcttccgcatctcatatttgttctcatcaaaagatgcatcgacgttcaccgtcacttttccctcaagaggtttctatcatccgtgctgtatttttgtttcttcgttccttgtttgttgctagcttggagtaatttctttgtagagctggagctccccagcaatgtccttaatattaacggcctctttaatctgaaaacggaaaaataaagaagagagaaacgggagaagaagaaaaaaaggatggagagcaagtgggtcctgtggcatggaggaacatggagcacagaaaagagtagtaatataatgtgatggaacggccggaattgagatgggtggaacggtttccctccacaaccacttgctcctcatctttttttctcctccgccttccactcatccttgcccctgcctgccgtcgtgcatcatcatctccggccagggccagggcattcgtctccgcctccggtccggcctcctccactccgcgccccccagacgcgtcgctgcgtagctgctggccgccatggccaccgtcatggccgcggccgtctcgtccttcccgtcctcctcggccgtcgtcgccaaggcgtcgccggcgtccccctgtgccgccccgcacttccgcccgagggccgtgcgggccgctatccgggcgcaggcgtccgccgtcgaggcgcccgccacggccaaggccaagaaggagtccaagaagcaggaggagggcgtcgtcaccaacctatacaagcccaaggagccgtacgtcggcaggtgcctcctcaacaccaagatcaccggcgacgacgcgccgggggagacgtggcacatggtcttcagcaccgaaggcaagatcccgtacagagagggccagtccatcggcgtcatcgccgatggcgtcgacaagaacggcaagccgcacaaggtcaggctctactccatcgccagcagcgcgatcggcgacttcggcgactccaagacagtctcgctgtgtgtcaagaggctcatctacaccaacgatgccggagagatcgtcaaaggagtctgctccaacttcttatgtgatcttcagccaggtgataacgtccagataacaggaccagtcggcaaagaaatgctgatgcccaaagaccccaacgctaccattataatgcttgccaccggtacaggtatcgctccgttccgatcgttcctgtggaagatgttctttgagaagcatgacgactacaagttcaacggtctgggctggctcttcctgggtgttccaacgagcagctcgttgctctacaaggaggagttcgggaagatgaaggagagagcgccggagaacttccgggtcgactacgccgtcagccgggagcagacgaacgcggcgggggagaggatgtacatccagacccgtatggcggagtacaaagaggagctgtgggagctcctgaagaaggacaacacctacgtctacatgtgtgggttgaaaggcatggagaagggtatcgatgacattatggtgtcactggctgaaaaagacggaatcgactggttcgactacaagaagcagctgaagaggggagatcaatggaatgtggaggtctactaaccgctgaattttgcagctgacattttgtgttgtgcgtatctgtaagtgaggccagggtgtactacgtatataatgtagatagtgagtgtgttctgcgttttttttactattgccgtctctgtttatagatttgtataagtactcttaatattatgcctattcgattttttatatgagtaatgtgatcaagtgcccaagaacgacgcggccgcaagcggcc

SEQ ID NO: 20231 - DNA, 1901 bp, Zea mays
ccggccagggttggagggagtagaggacgtcttgtcctccgttctcggctcgagctctctctcttctctctctctctctacggattgcctcacgcatctcgcgtgcaattcaagcgaaactttctgaatatcaaagtggcatagagctccacttttatggccatccctatgaaggcctctccgggttcctgatatagatgtttccttgttctgaacatgaaaagttctcaggtactccgccgttgatgaactgcctccacacctgcagcgacaagaagacgctgaagaagtggtttttcatcgacaagacagtaggctaaatccagtcccagagaacaaattgaagcaccactccccaccgcacagcagcacagctcttctcttcaccgatcccgatggatatgggcagcggctcgtcacctgtcatcaccgatccgatatcgataagcccaccgctgctgggaggcttgacgtcgaacctgatgccgttctcggtcatgtccggaggctgctcctccagtcctagcatgagcaacagcagcaggcgtaaaatcgaggaggtccttgtcaatggcctgctagacgcgatgaaatcgtcgtcgcctcgcaagaagcacaacctcgccttcggacaggataattcgcccgacgaagatcctgcttacactgcatggctgtcaaaatgcccttctgcgctggcctccttcaagcacatagtagccaacgcaaaaggcaggaggatcgctgtgttcttggattacgacggcaccctgtcgccgatcgtcgacgatcccgacaaagcgttcatgtcccctgtgatgagagctgctgttagaaatgtcgcgaagtacttccctaccgcgattgtcagcggaaggtcccgtaagaaggtgtttgaatttgtaaaactgacggaactgtactacgctggtagtcacgggatggacatagtgacatctgcagcagcacatgctactgaaaagtgcaaagaagccaatctcttccaacctgcttgcgagtttctccctatgattaatgaggtttccaagtgcctcgtggaggtcacgagttcaattgaaggtgcaagagttgagaacaacaagttctgtgtatctgtacattaccgcaacgtagcagagaaggactggaaagtggtcgcagggctcgtgaaacaagtcttggaggccttccctcgtctcaaagtaaccaacgggcgaatggttttagaggttcgcccggtgatcgactgggacaagggaaaggctgtcgagttcctgcttcggtcgctcggcctaagcgactccgaagatgtggttcctatctacatcggagacgatcgaacagacgaagacgccttcaaggtactgcgagagcgaagctgtggatacggaatcctagtctcgcaggtgcccaaggacactgaagccttctactcgctgagagacccgtctgaagtgatggggttcctcaattccttggtgagatggaagaagcacccgctgtgacgcaactgaaaacacgacgactgattcagaagccgtaaagcgactgtacttcgtgcggcggcaattttgtagagtttttggctcaccgggtggctcattctttcatgcgtttttattttttatttttttaactgtcccagtccttcgtcactgagaaataacaagtggttgtcccacaccctcttgcaactgtaatctgtaagcaagaggccctccctgttaggtctatatatattgaataaaaccgggacgcttttgccttgccctgaaaaaaaaaaaaaaaaaaaaaaaaaaaaaaaaaaaaaaaaaaaaaaaaaaaaaaaaaaaaaaaaaataaaaaaaaattatgggaaaaaattctatagcaaaaagggtaaaaaaaaaaaaaaaaaaaaa

SEQ ID NO: 20232 - DNA, 1616 bp, Zea mays
agctttactcgtggtcgcctcgcctgcttgctgccggcctgtaggctgtagctgtaggccataacatacgtagggttgggaggaacaggtgaatgtgcttgcattggaatgagagtctgccacatacacttgccggccaaagttgagtgcaccgcctgcaggcggcagcagctcgatcgatcacacagctcaccaacacgtactagctactgacctggtcaagtcccagttcacctggacctgccagattctgcgctccgcacgagaccattacctagaacatcctaatcaaaaaatctctagccagcgtcgtcggctgacctcctaccgtcgtcatggcttctcttcacccgttgatcgctgctgcgctcgtagtcgcggcggcctccacggcagcggcggcggcgagctgggcggcaccgtcgtcgccagcacgccctctgttccgcgagtacatcggcgcggagggcaagaacgtgacgttcgcggacgtgccggtgcacccgggcgtggacttccacttcatcctctccttcgccatcgactacgccgcgaacgccaccaacgcctccgcgccgccggtgcccacggacggccgcttcgccgtgttctgggacgaggcgaacctcaccccggccgccgtggccgccctcaagtgcccctcctcccacgcccgcgtcgcgctcagcctcggcggcgacaccgtgttcggcgccaacgccacgttccgcgcgtcctccgtcgacgcctgggtcggcaacgccgtggcgtcgctcgcggccatcctcacccgctacggcctcgacggggtggacgtggactacgagcacttcggggagcgcgagacgcccgaggtgttcgccgagtgcgtcggccgcctcgtgcgcgcgctccgggcccgcggcgtcatctccttcgcctccatcgcgcccttcgccaacccggacgtgcaggcgcactacgccgagctctggcgacgctacggccgcgacttcgactacgtcaacttccagttctacgcgtacccgtccaacaccacggtgccggagttcctggcccactatgacgagcagagcgcccggtacgccggcgccagcggaggggggaaggtgcttgtcagcttcgggacggaccccgccagcggcggcctgcgccccgggaagggcttcttcagggcgtgccgggagctgcgccgccaagggaggttgcatggaattttttgtctgggccgcggataactccgccgccgacgggtttcgcgacgagcgcctcgcgcagacgttcctcgccggcaacgccccgggtttcccctgacgcatgcatgcgttaagctccccgtgtctccgttccatatttccgttccttgtgtacgtcttgttatgttttgtcgcgtccatatgatttgtaattggtccagttcattgattatttgcgtgcatccaaaaaaaaaaagaaaaaaaaaaaaaaaacccgagttatgatgcatttagagagtgattctgcattatattttcgttttaaacattgacacaaacataactataatacttatattcggccataaaacacaaggtccgatagccccgatacgaagcatgggctgtcaatccgatgct

SEQ ID NO: 20233 - DNA, 997 bp, Zea mays
ccgcgaaccggaaccccacccggccaccccgcccgccccagtctggcagcctgcctccatagtccatctcctctccccctaccgacaccgatcccattccccaggcccaagcgcccatggatcccaagcccgacgccagcgcgcccgccgcggtgccagcggagcacgcggcgtacccgaggctgtcaccggaggacatcgccccgccgccgccgcctgtcgtgccgccgtccggcgccaacccctacgtgctctccgccccgtcgcctaacccgcccgccaagagcgctagggagaatctgagggagatgttcggcatggtggggaagaagttcaacgaggccgcgcgcaagaccgagggcatcgccggcgacgtctggcagcatctgaaaactggacccagcatcactgatactgccatggggaggattgctcagatatccaaggttatatctgagggtggctacgacaagatatttcagcagacttttgagtgctcgcctgatgagaagctcaacaaggcatatgtgtgctacctatcaacgtcgcatggaccaatcatgggcgtcctgtatctctcgactgtcaagattgcattcggtagcgacagccctgtgaaatatgtgactgaggacaacaaaactgagtcatccttttataaggttgttttaccccttcatcacctgagatcagttactcccacagcaagtcagcaaaaccctgcagagaggtacattcaggtcgtttcagtcgacaaccacgagttctggttcatgggtttcgtgaactatgatagcgctgtaaagaatcttcaggagtctgttcgagttgttcacggggcctagaggttgcccatcacttttcctctatgtggatgtagtatgcccgtgtaaatgtatttgtgcatggcacctgtaaaaaaaaaaaaaaaaagtggtaattggtacacatcattaaggctatgtttgtttctaaaaaaaaaaaaaaaaaagcggcc

SEQ ID NO: 20234 - DNA, 1278 bp, Zea mays
gggtacctcgaggccggccgggagcttcccaatcccacccggccaccccgcccgccccagtctggcagcctgcctccatagtccatctcctctccccctaccgacaccgatcccattccccaggcccaagcgcccatggatcccaagcccgacgccagcgcgcccgccgcggtgccagcggagcacgcggcgtacccgaggctgtcaccggaggacgccgcctgtcgtgccgccgtccggcgccaacccctacgtgctctccgccccgtcgcctaacccgcccgccaagagcgctagggagaatctgagggagatgttcggcatggtggggaagaagttcaacgaggccgcgcgcaagaccgagggcatcgccggcgacgtctggcagcatctgaaaactggacccagcatcactgatactgccatggggaggattgctcagatatccaaggttatatctgagggtggctacgacaagatatttcagcagacttttgagtgctcgcctgatgagaagctcaacaaggcatatgtgtgctacccatcaacgtcgcatggaccaatcatgggcgtcctgtatctctcgactgtcaagattgcattcggtagcgacagccctgtgaaatatgtgactgaggacaacaaaactgagtcatccttttataaggttgttttaccccttcatcacctgagatcagttactcccacagcaagtcagcaaaaccctgcagagaggtacattcaggtcgtttcagtcgacaaccacgagttctggttcatgggtttcgtgaactatgatagcgctgtaaagaatcttcaggagtctgttcgagttgttcacggggcctagaggttgcccatcacttttcctctatgtggatgtagtatgcccgtgtaaatgtatttgtgcatggcacctgtaaagttgtgtgttgaaattggtacacatcattaaggctatgtttgtttctctcctaaattatataagttggattataatgaaaagatagtagagtaaattatcactttgatatcataaataagttaaaataaactacttaatgctagcttattttaacttatttgtagttctaaagtgatgttttactcttctacctttccaccataacccaacttatacaatctaaagagaaacaaacacaccctaagcagtgcattcagatctgtggcatgtgaatgtttttggataaatgtgtaaatctctactacttattaaggctgtaagggtagcctgccgttctgccttcgttcaatctg

SEQ ID NO: 20235 - DNA, 910 bp, Zea mays
cgaaggaggacacggctgctggtggccgcattcggtctggggaggagcacgaggagccatggcctgcctgcacgaccacagctgcgaggatcacaactgcgccgccgactgggtcgctctacaaccacatcgacgtccccacgggtgggggctctcaacgaatcggtgcccgggagcgtcaagtccgtcttcaagccctgggagcagcgccttgacacctcggggggttttctggagagtaatgagggtgaccctgagctacttattttcatcccgttcacatcagatgttaagatcaagagcatttctgttgttggtggtgctgatggaacaagcccgtcaagaatgagagcgtttatcaatagagaaggtattgacttttccgatgctcaaaacatgcagccagtgcaggaatgggaattagcagagaacctgcaaggagctcttgagtaccaaacaagatattcaaggttccaaggtgtggctaacctaactctgcatttctctgacaactttggtggtgatacaactaaaatttattacattggactacgtggtgaagccactcagaacaaaagggatgtagttgcaacaattgtatatgaagtcatgcccaatccttctgatcacaaaacaaaatctgagactggaggaggtttctcgcatgtggagtagacatcatacaagcagagctagagaagcggaagctgggtactgcgttgcctgaaagcaaatttgaacctcgcttcgtcgatcaataagataaatagataattcccagctgctagacttttagcttgacttttgagcacataactctgtacccgtggacgctgtgactggtttgctaatgctctatcatcagagttggtctcttgtgtcaaaaaaaaaaaaaaaaaaaaaaaaaaaa

SEQ ID NO: 20236 - DNA, 1183 bp, Zea mays
acaggctgatctattctttgttggctctggtacgaatcagagacaattaccacggcaggcgtccccacgccacggctgagtacggaggaagaatccctctagacttctctgcaacctgcgcgaggccgaaagagcagcaacggtgcggaggcagggaagcaaagcaatcccccacctatatacgcgccccgcccagtaggagagtaggagctgcaaggagtccggtctccgaaaaccgacaagacgatagcaaatcgaaggaggacacggctgctggtggccgcattcggtcgggggaggagcacgaggagccatggcctgcctgcacgaccacagctgcgaggatcacaactgcgccgccgactggtcgctctacaaccacatcgacgtccccaaggtggtggctctcaacgaatcggtgcccgggagcgtcaagtccgtcttcaagccctgggagcagcgccttgacacctcggggggttttctggagagtaatgagggtgaccctgagctacttattttcatcccgttcacatcagatgttaagatcaagagcatttctgttgttggtggtgctgatggaacaagcccgtcaagaatgagagcgtttatcaatagagaaggtattgacttttccgatgctcaaaacatgcagccagtgcaggaatgggaattagcagagaacctgcaaggagctcttgagtaccaaacaagatattcaaggttccaaggtgtggctaacctaactctgcatttctctgacaactttggtggtgatacaactaaaatttattacattggactacgtggtgaagccactcagaacaaaagggatgtagttgcaacaattgtatatgaagtcatgcccaatccttctgatcacaaaacaaaatctgagactggaggaggtttctcgcatgtggagtagacatcatacaagttgggtatggatcagagctagagaagcggaagctgggtactgcgttgcctgaaagcaaatttgaacctcgcttcgtcgatcaataagataaatagataattcccagctgctagacttttagcttgacttttgagcacataactctgtacccgtggacgctgtgactggtttgctaatgctctatcatcagagttggtctcttgtgttataaaaaaaaaaaaaaaaaaaaaaaaaaaaaaaaaa

SEQ ID NO: 20237 - DNA, 925 bp, Zea mays
ccgaaaaccgacaagacgatagcaaatcgaaggaggacacggctgctggtggccgcattcggtcgggggaggagcacgaggagccatggcctgcctgcacgaccacagctgcgaggatcacaactgcgccgccgactggtcgctctacaaccacatcgacgtccccaaggtggtggctctcaacgaatcggtgcccgggagcgtcaagtccgtcttcaagccctgggagcagcgccttgacacctcggggggttttctggagagtaatgagggtgaccctgagctacttattttcatcccgttcacatcagatgttaagatcaagagcatttctgttgttggtggtgctgatggaacaagcccgtcaagaatgagagcgtttatcaatagagaaggtattgacttttccgatgctcaaaacatgcagccagtgcaggaatgggaattagcagagaacctgcaaggagctcttgagtaccaaacaagatattcaaggttccaaggtgtggctaacctaactctgcatttctctgacaactttggtggtgatacaactaaaatttattacattggactacgtggtgaagcccctcagaacaaaagggatgtagttgcaacaattgtatatgaagtcatgcccaatccttctgatcacaaaacaaaatctgagactggaggaggtttctcgcatgtggagtagacatcatacaagttgggtatggatccacagcagagctagagaagcggaagctgggtactgcgttgcctgaaagcaaatttgaacctcgcttcgtcgatcaataagataaatagataattcccagctgctagacttttagcttgacttttgagcacataactctgtacccgtggacgctgtgactggtttgctaatgctctatcatcagagttggtctcttgtgtt

SEQ ID NO: 20238 - DNA, 1541 bp, Zea mays
ttattattattattatatacactttcgctctcacagtttcaatatggatctcaaaaatgacggggggaggctgtgcaccggaaccagcctaatgctagcagcaaagcaatacagtgagcaaggtgaaagtctcagctatgacaatacccggcggcgtgcaacggatcctccctgtcccggccgtgctcttcatccgccgcccgggcgcgcctttcggcaacgcgatgcacgagcgcttccgcgtgctggagctgccctcgccggcctcgggcgagcaggcagcggctttcctcgccgccgccgcggcagagccggacccgcctcgcgccgcggtcgtcatgggaggcggcgccgtccgcgcggacgcggcgttcctggacgccgtcccctcggtccgctgcctcgtcagcacggccgcgggcgttgaccacatcgacctcgccgagtgcgcgcgccgcggcgtcgccgtcgccaactctgggacaatctactccgccgacgtcgcagaccacgccgtcggcatgctcatcgacgtgcttcgccgcgtgtcggcggcggggcggttcgtcgggcgcgggctatggccgctgcaggagggcgagtaccctctcggctccaaggtccacagctgttggcttcgtgctgtgttctcttcatgaaagccttcagctaaactgaaacagatttgtatatcagatctgtatctgactcagatgtatttgatcattttccgtatgctttcagctagggggcaagcgtgtgggcatcatcggattggggaacattggttcgctggttgcaaagaggctggaagctttcggctgtgtcatctgctacaattccagaagacgcatggactcagtctcctacagatacttctccaacgttcagcgtcttgcttccgaatcagacgtgctcgttgtcgcatgcgcactgaacaaagagacacgccacattgtgaatgaggatgtcctggaggccctggggaaggatggggtcgtcataaacattggccgaggcgcaagcatcgacgaggcggccttagtcagcgcgctgaaagagggaaggatcgctggagctgggctcgaagtctttgagaacgaacccaaggtgcctccggagctcatgtccatggacagtgtggtgctgacgcctcattcagcggttttcacgacggagtcgagggcggacctgtgtcagcacctgatttgcaacctggaagcgttctttgccggtaagccactcatcacgcccgtgctgcgtttgacagagtaggtcgtgttgcaggctagttaagctattgggaggtaactaaattgttatttgtatatatagctgcaaactatagggctgtgttccttataaaatggatccattgattcgaaaaaaaaaaaaaaaaagattgtctcaacatacttattaagtcaccagtcaccactgtgcctatgcgaacacactacaacaatccaaagcatccccgtccgctacattaattctcgtcggcctgcgcgcgggccgacggggattaaataattcccgtc

SEQ ID NO: 20239 - DNA, 1158 bp, Zea mays
gcacgagaccattacttagaacatcctaagccagagatgacaatacccggcggcgagcaacggatcctccctgtcccggccgtgctcttcatccgccgcccgggcgcgcctttcggcaacgcgatgcacgagcgcttccgcgtgctggagctgccctcgccggcctcgggcgagcaggcagcggctttcctcgccgccgccgcggcagagccggacccgcctcgcgccgcggtcgtcatgggaggcggcgccgtccgcgcggacgcggcgttcctcgacgccgtcccctcggtccgctgcctcgtcagcacggccgcgggcgttgaccacatcgacctcgccgagtgcgcgcgccgcggcgtcgccgtcgccaactctgggacagtctacgccgccgacgtcgcagaccacgccgtccgcatgctcatcgacgtgcttcgccgcgtgtcggcggcggggcggttcgtacggcgcgggctatggccgctgcaggagggcgagtaccctctcggctccaagctagggggcaagcgtgtgggcatcatcggattggggaacattggttcgctggttgcaaagaggctggaagctttcggctgtgtcatctgctacaattccagaagacgcatggactcagtctcctacagatacttctccaacgttcagcgtcttgcttccgaatcagacgtgctcgttgtcgcatgcgcactgaacaaagagacacgccacattgtgaatgaggatgtcctggaggccctggggaaggatggggtcgtcataaacattggccgaggcgcaagcatcgacgaggcggccttagtcagcgcgctgaaagagggaaggatcgctggagctgggctcgaagtctttgagaacgaacccaaggtgcctccggagctcatgtccatggacagtgtggtgctgacgcctcattcagcggttttcacgacggagtcgagggcggacctgtgtcagcacctgatttgcaacctggaagcgttctttgccggtaagccactcatcacgcccgtgctgcgtttgacagagtaggtcgtgttgcaggctagttaagctattgggaggtaactaaattgttatttgtatatatagctgcaaactatagggctgtgttccttataaaatggatccattgattcg

SEQ ID NO: 20240 - DNA, 2832 bp, Zea mays
gcacgaggcatcatcgcgcacattgaccatggcaagtccacactggcggataagctgctggagcttactggcacggtgcagaagagggagatgaaggagcagtttctggataacatggacctggagagggagagagggatcaccataaaattgcaggcagctcggatgcgctacgtcatgaataatgagccttactgcctgaatttaattgatacaccagggcatgttgatttctcgtacgaggtttcccgctctctagctgcctgtgagggcgcacttcttgttgttgatgcttctcagggtgttgaagctcagacgttagcgaatgtgtaccttgcattggaaaacaaccttgaaatcataccggttctaaataaaatagatcttcctggtgctgaacctgatcgtgtcgcacaggaaattgaagagataattggattggactgtcgtgatgcaattcggtgttcagcaaaggaaggtataggcatcactgaaatattagatgcccttgtgaccaaaatccccccaccaaaagatacatcaaaagatcctctcagggctcttatatttgacagctattatgatccatacagaggtgtaattgtgtacttccgtgttattgatggcagtatgaagaaaggggacaagatatgttttatggccaatggaaaggaatatgttgctgaagaaattggtgtactatccccaaatcagatgcaagtttctgaactatatgctggcgaggttggttatctctctgcttctataagatcagtagcagatgccagggttggtgatactattacacattattcaaaaaaagcacatcatgctttaccaggatattctgaagccactccaatggttttttgtggcttgttccctatagatgctgatcagtttgaggagttgcgggaagcgctggaaaaacttcagctaaatgatgctgccctaaagtttgaaccagaatcttctagtgccatggggtttggcttcagatgtgggttccttggtcttctccatatggaaatagttcaggaaaggcttgagagggaatacaacttgaacttaataattactgcaccaagcgtggtataccgtgtgaactgtgctgatggtgaaactgttgaatgttcaaatccatccttgcttccggagcctgggaagcggaggtctatagaagaaccatatgtgaagattgaaatgcttacaccaaaagattatattggttcaataatggagctgactcaagacagaagaggtgaattcaaggaaatgaacttcatcacagaaagcagggccaaacttatttatgagctaccactagcagagatggttggcgatttctttgatcaactgaaatcacgaagtaaaggatatgctagcatggaatattcagttgttgggtacagagaaagccaactagtaaagctggatatacaaatcaacggggatcctgttgaggcgttgtcaacaattgtgcacagggataaggcatatgctgttggaagggcacttactcaaaagctcaaggaacttatacctcggcaaatgtttagagttcctattcaagcatgtattggcacaaaggtgattgcaagcgaagccctgtctgccatcaggaaggatgtcttatcaaaatgctatgggggtgatatatcaaggaaaaagaagttgctgaagaagcaggctgaaggaaagaaaaggatgaaggcaataggaagggttgatgtccctcaagaagcattcatggccgtgttgagactggaaaaggaggtgctatgaaagtgctcatgaacctttgtgtctccgtaaattaaagacctcttcctgtgcgccactcgcaagtatagtcagacgagagctttgagacaacaggcattcactatggttcaacctgtcctttctgcaccataggaaccagtcaagcacagatcactcccagaacaaaagcaggaaaacctggcattcgttcgctatttttgctttttttttatgtgtcaggttatgatggtaaaacaatcatgtcgccacagagttttgccaggcacatataggaaattcatatgtcaaagtgcatcatgtagtccaattccttgtaacgcatgctacagagacttgtttctacagttgaatataccttgtaaggctgggaccaacagatcgtgcatatgcaaaacaagaggtttgtaatattttatacggtagacagaattgtttataaagtacaatttaaagtatgaggtgggacggtagacagcactgtttacaaagtaaaatttaaagtatgaggtgtgatagagagctgctggagataaacggtttcctggaggtaggcaaatgtgtcgttcaactgcagcatccctggcataccttcaggacgtgatgtctactgctgttgagctcgctgctgaaaggagcggtaaccaccttgcaggttcctcacgttcttgaaccccgcgttcagaaggtctgccgtcgcgaacctggatctgttccccgtgttgcaacccacaatgaagacatcatccttcccacagaaggcagccacttcctctacaaagtgtgggttcttctccttcccttgcggcgtgacggacaggtagtagggaacgttccgagcaccgggcgcatgcgccttgtggaagtccccccgcatcctgacatccacgtagccatggccggagctcagcagcgcgtgcgcttcgtcagcgtcgatggtagggacggcctgctccttgtcgctgctggtcactgcagacgccattgctgcagggatggatggatggatgacctgggtccgcggacgaagggcgtggccgggcgcgtggg

SEQ ID NO: 20241 - DNA, 662 bp, Zea mays
tttttttttttttttttgtttttttttttttttttttttttatgcaaaacaagaggtttgtaattttttattcggtagaccgaattgtttataaagtacaatttaaagtatgaggtgggacggtagacagcactgtttacaaagtaaaatttaaagtatgaggtgtgatagagagctgctggagataaacggtttcctggaggtaggcaaatgtgtcgttcaactgcagcatccctggcataccttcaggacgtgatgtctactgctgttgagctcgctgctgaaaggagcggtaaccaccttgcaggttcctcacgttcttgaaccccgcgttcaaaaggtctgccgtcgcgaacctggatctgttccccgtgttgcaacccacaatgaagacatcatccttcccacagaaggcagccacttcctctacaaagtgtgggttcttctccttcccttgcggcgtgacggacaggtagtagggaacgttccgagcaccgggcgcatgcgccttgtggaagtccccccgcatcctgacatccacgtagccatggccggagctcagcagcgcgtgcgcttcgtcagcgtcgatggtagggacggcctgctccttgtcgctgctggtcactgcagacgccattgctgcagggatggatggatggatg

SEQ ID NO: 20242 - DNA, 1559 bp, Zea mays
gcacgagaccattacctagaacatcctaatcgaaaaattggagtcactcttagtcaacggcttcctttcgttctccgttccctatcggcactctttggtgcgcccggcgcttctccgttcgttcgccggcgttcgtggcttcgcgacctccgtctgaccgtctgcacccatggccgctgaaggcgaggcgtcaatgtactacacgacggacgacgcgctctcgctcgtcggcttcggccgtttccagaccctcgtgctagcttactccggcctgggctggatcgcggaggcgttcgagatcatgctgctctccttcgttgggcctgccgtggaggcggattgggggatatcaggagcggagcagggcctcatcagcagcgccgtcttcgccgggatgctcatcgggttcatcgccggaggcctcatcgcggacagatacggcaggaggaccggtttccttttcactgcagtggtcactgccgtatttggtttgcttagcgccttctcgcccaactacgcatccttactcacccttcgctttgttgttggtctgggattgggtgctggccatgtgctatctacttggttcatagagtttgtccctgctgccaaaagaggtacctggatggttgttttccatgcttgttggactgtgggaacaatattggaggctcttcttgcgtgggctatcatgccagtacttggatggaggtggctgcttgcattgtcctcagcgccatgctttgttcttctcattttcttccctctaacacctgaatcaccaaggtatctttgctcgagaggtaggactatggatgctacagttatcttggaaagaatagcaaggatgaacaaagggactctccctcctggcgtactaattttcagaccagaaaagcatgttgacaacaaccttgggacttctgagacagcactgctaattgcagaagataatactggcattgaagaggacacaagttccaagtccagtggcattgtcgcatttcaggcactctggtcatatgatttgataagatcaacctttcttctatggttcatctatcttgcaaattattttacttattatggggtaatattgctaacttctgaactaagcaatgggaagaggaggtgtgcatctgtaagaacacatttgatgcaaccaaacagtggtaatctttatagagatgtgctggtgaccagtttggcagctctaccctgcaccgtctcggaacaccggtgttgggatcacttcttctcttggtcggattggcagcatagtttcacctcttgttattgttggcttgttagagagctgccgtcgaaaagaagctgtgttcgtggttgacctggtgctcttccttgctggagtcacatgcgccctcttccctcgagagaccaagggatgccaaatccagtgagagtttggactccataattctgtatgtgtgtatgcttgcaaattacagtacatctaccattgcattttatcacgagcccttttgtggcctaatttaagattgatgtacaggtacttttaagtaaaaaaaaaaaaaaaa

SEQ ID NO: 20243 - DNA, 3472 bp, Zea mays
aattcggcacgaggcgatgcggtacattacatacatcgctgtctccatctagctgcacacatatatacatacatgcatacagattacagagtgttcggcacgaggatcgatctcacttagctgctgctgctgctgctgggtggtggcctgggcctggctgctgtgtctgtatcgatgtgtccgtattttctccatctcgtctgcatacgctgcaattggtaaggagctagctggcctttcatgtcttccatgctgccatagccatacggccggccggaaggcaggataccccatcgctcgctgcacatgcatgtatgccgcatggggatacatgttcatcatcagcagcacagtggctctgtatcccccatcccaatccgatcctatataggaggaggaggaggaggagcagcagcagcagccaggcgcggccggcggccggagtagtatccgaatccgctcaacacccacaccggtgcgggtggtctctagctttcccatcgatcaatggctttcaaaggactcccgcgtgattcccgagggtccctcgaagtcttcaatccagacgcccctgtttcagatcgtgcaaccacctccccgttcctcctccctcctgcggtcgcgtcccatcccagcctcctcgccgccggagatggcggcgatgctgacgtgggtcgggcgacacagagggccgccgagtggggcctcgtcctccagaccgacgagcacaccggccgcccccagggtgtcgtcgcccgcccctccggttccaaccgcaccagcgagagtggcaactccatcgacgagagggccgccgccgccggtgctggtagagctctcccccgggtgtcggaggagcttcgcgccgcgctctcagcgttccagcagaccttcgtcgtgtccgatgccacccgccctgaccaccccatcctctacgccagcgctggattcttcaacatgacgggctactcctccaatgaggtcgtcggaaggaactgccgcttccttcaaggttctgggaccgaccccgtagagatttccaagatcagacaggctctcgcagctgggtcaaattactgtggccgtatcctcaactacaagaaggatggtacaccattctggaacctcctaaccgttgcccccataaaggatgaggatggcagggtcctcaagttcattgggatgcaagtggaagtaagtaagtacacggaaggtaacaaagatactgctcttcgtccaaatggattgccagagtcactcatcaaatatgatgcaaggcagaaggatcatgctcgtagctcagtctcggagctcctacttgccctgaaggatccacggtcattgtcagaatcaagaaacaataccttaaaaaggaaatcacaggaatcagcaggttcagctctagttcccggcaagagaagctccgaaactggatcccgtcgtaactcacatagtggaatgagaaactctctacaaaaaatcagtgaggtgcctgaaggagggaataagaccaggaaatctggtttgcgttcttttatgggccttattggtatgggacatgggaatgtagagaagaacattctaaaaccaagggaagatcccctacttgatagcgatgatgagagaccagatagcttcgatgacgatttcaggaagaaagaaatgagaaagggcatagatttggctaccacacttgaacgtattgaaaagaattttgtcatcaccgacccgaggttaccagataatccaattatatttgcatcggatagctttttgcgtttgacagagtattgccgcgaagaaatattgggaagaaactgcaggtttcttcaaggacctgaaactgaccgtgggacagtaaagaagataagagatgccatagataaccaaacagaagttactgttcagctgataaattatacaaagagcggtaagaaattctggaacctctttcacttgcagcctatgcgtgatcagaagggtgatgttcaatacttcattggggttcaattggatggaactgagcgtgttcgagaggctgctgcaaaagatggtgccatactggttaagaaaactgcagacaatattgatgaggctgcaaaggagcttccggatgctaatttgagacctgaggatctatgggctaatcactcaaaaccagtcttgccaaagccacatatgaaggatactgcatcgtggagagccatccaaaaggttcttgagaacggtgaaagcattgatttgaaacatttcagaccagtaaggcctttaggatctggtgatactggcagtgtccacttggtggagttgcttggcacaggtgaatactttgccatgaaagctatggataaaagtgtcatgcttaaccgaaacaaggtccatagagctaccgctgaacgacaaatccttgatatgttggaccacccattccttccgacattgtatgcatcatttcagacaaagacacatatatgtcttattgttgactattgtgctggtggggaactctttatgctccttgataggcaacctatgaaggttctgaaggaggatgcggtcaggttctatgctgcagaagtggtcacagcacttgaatacctacattgccaaggtataatctacagagacttaaagccagagaacattttacttcatagagatgggcacatttcattgacagactttgatttgtcttgcttgacatcctgccgaccacaagtgtttcttccacacgatattgataagaagaaaaagaggaggaagagcaggagtaatcccatattttttgctgaaccaatgcgagcatcaaattcttttgttggtacagaggagtacattgcaccggagattattaccggagctggccatacgagtgctgtagattggtgggcgctaggaattcttctatatgagatgttatatggttatacacccttcagagggaaaacaagacaaaggacatttgctaatattctgcacaaggatatcagatttcctgcgagcatacaggtgagcctggcggcaaggcagctgatataccggttgctacaccgagaccctgcaaataggctaggttcctatgagggcgctatggagatcaaacaacaccccttctttcgtggcataaactgggctctagttcgtgccgccacgcccccagagctggaggctcccctccaggatacattggaggccacactgcctcctcctgcagctgatgcggctcacaccgatatgttctgatcatacattgatccatgatgctacatgttaatttgcttaaaggaagaaaaaatattagatgatgaagatgcatgactttggcatagatgagaacaataatgtatgttaaggactaattatcttgatccatctatgcatgctcacaattagaataaaaaaaaatataaaaaaaaaaaaaatggtgccgccatacgcacgagtctatgaaaaaaaaaaaaaaaaagcggcc

SEQ ID NO: 20244 - DNA, 1575 bp, Zea mays
  misc_feature (30)..(30): n is a, c, g, or t
tccgcattcccggggttaagaaactgcagnacatattgatgaggctgcaaaggacttccggatgctaatttggtttgtctaaataaacatgaattttgtataatctaaaactaagtattactaggcatttgtaatagaaatttgtggtcatattcagagacctgaggatctatgggctaatcactcaaaaccagtcttgccaaagccacatatgaaggatactgcatcgtggagagccatccaaaaggttcttgagaacggtgaaagcattgatttgaaacattgcagaccagtaaggcctttaggatctggtgatactggcagtgtccacttggtggagttgcttggcacaggtgaatactttgccatgaaagctatggataaaagtgtcatgcttaaccgaaacaaggtccatagagctaccgctgaacgacaaatccttgatatgttggaccacccattccttccgacattgtatgcatcatttcagacaaagacacatatatgtcttattgttgactattgtgctggtggggaactctttatgctccttgataggcaacctatgaaggttctgaaggaggatgcggtcaggttctatgctgcagaagtggtcacagcacttgaatacctacattgccaaggtataatctacagagacttaaagccagagaacattttacttcatagagatgggcacatttcattgacagactttgatttgtcttgcttgacatcctgccgaccacaagtgtttcttccacacgatattgataagaagaaaaagaggaggaagagcaggagtaatcccatattttttgctgaaccaatgcgagcatcaaattcttttgttggagattattaccggagctggccatacgagtgctgtagattggtgggcgctaggaattcttctatatgagatgttatatggttatacacccttcagagggaaaacaagacaaaggacatttgctaatattctgcacaaggatatcagatttcctgcgagcatacaggtgagcctggcggcaaggcagctgatataccggttgctacaccgagaccctgcaaataggctaggttcctatgagggcgctatggagatcaaacaacaccccttctttcgtggcataaactgggctctagttcgtgccgccacgcccccagagctggaggctcccctccaggatacattggaggccacactgcctcctcctgcagctgatgcggctcacaccgatatgttctgatcatacattggtccatgatgctacatgttaatttgcttaaaggaagaaaaaatattagatgatgaagatgcatgactttggcatagatgagaacaataatgtatgttaaggactaattatcttgatccatctatgcatgctcacaattagaataagattggatgtgtatattgtttctgtggttgcaatatacgcacgagtctatgaaaggacctatggatagcttgaggggatgacagacactaggcatgttgattagtactccgtttcgttttacaagtcgtttccaacagcttcgtgctgattaaggaatctatgaatc

SEQ ID NO: 20245 - DNA, 998 bp, Zea mays
  misc_feature (648)..(648): n is a, c, g, or t
atgcgtacatacatcgctgtctccatctagctgcacacatatatacatacatgatacagagtgagagagagaaacagtagcaagcgcatcatctcgatcgatctcacttagctgctagctgctgctgctgcttgctggtggcctgggcctggctgctgtgtctgtatcgatgtgtccgtattttctccatctcgtctgcatacgctgcaattggtaaggagctagctggcctttcatgtcttccatgctgccatagccatacggccggccggcaggcaggcaggataccccatcgctcgctgcacatgcatgtatgcatggggatacatgttcatcatcatcagcagcacagtggctctgtatcccccatcccaatccgatcctatataggaggaggagaaggaggagcagcagcagcagccaggcgcggccggcggccggagtagtatccgaatccgctcaacacccaccggctggtctctagctttcctatcgatcaatggctttcaaaggactcccgcgtgattcccgagggtccctcgaagtcttcaatccagacgcccctgtttcagatcgagcaaccacctccccgtttctcctccctcctgcggccgcgtcccatcccagcctcctcgccgccggagatgngcggcgatgctggacgtgggtcgggcgacacagagggccgccgagtggggcctcgtcctccagaccgacgagcacaccggccgcccccagggttgtcgtcgcccgtccctccggttccaaccgcaccagcgagagtggcaactccatcgacgagagggccgccgccgccggtgctggtagagctctcccccgggtgtcggaggagcttcgcgccgcgctctcagcgttccagcagacctttcgtcgtgtccgatggcccccgccctgaccaccccatcctctacgccagcgctggggttctttcacatgacgggctactcctccatggaggtcgtcggaaggactgccgc

SEQ ID NO: 20246 - DNA, 1533 bp, Zea mays
ttttttttttttttagatcgatacttatggtgtcaagtagattgataaccatgggcttatgcctaaagctggatcatagccagttaaacacattacacgataaaataaaatgaagaaattgtaagtctgaaagaagaaaattggtcagagcgttgtgtgctctcttttttttttttttttgacagttataaacgaatttaatcaataatgcacctcaagcatagacgttagcattttggaccagtgttaggggtgtttggtttctgaggattaatttttaatccatctattttattttatttcagtctctaaattgacaaatacggaaactaaaactctattttagttttcgtatttgataatttataaaataaaatgaagagactaaaaattagtacctagaaaccaaacaccccgcacaatgagtagcacaacttgtgtgggaataatatccctgggcatcaacacgatgcttcccctgcactacagaatgccacaatagctcagcacaaagctgctcctctatccaaatcacatggctaagcacacaggtcatgctatcttgatgcatgtggcttgttttacatcacgtcattctatttagacgaatgttctggcttttccgtggcatgggctccagtgatgcaatcacctgaggcatggtcatccctcctgaaacaattatttcgattccttctcgaatagataaattaggtcttatgacctcctcagagttcaccagaaatatatcaccgatgtacaaatgatttgttggcacatacacactacacagttcttcgtcgcctttgtcagtctgaaggaccaccgttgatgttatgaatccaaatgcatattcaccaattcgtggatgacgaattattgcaacttctttgaaagctgtcgtattttgatctggtgaaattgcagtgctgacttgctttgacgctgaatatatatgccttacaaatggcattttctttataaaccactctcccacccagaagatggttgaaccaacccatgaagaaacaaatattccaaccagaaatatgaataccagagaagtcaaaaaaccaagaccaaatatgttgattccaagttttgcatataggggactgaaaaacccatcaacaaattgaataaaccaccatgtgatgaagaacgtgactgcaacagggaaaaggactacacatccagtcataaattttcttgagacccaactttgaagaacagcacagcatgccttgcgtgtggaggtggtgggcgagctgggtcgcggcggcgacttggctgggtcctcggggtcgacggcctccgccgcctggctgagcgggatcgacgtcgactcctcctccggcatggctccggcgggtctcccccttctagaagcttctcgcggggcgggtggaacgaaacagatgcgaagtcaggcgtcgcttcgggcgggcgagctagggaggacggctgcttttggcaggcggcgagtagcggcaagcaaaagcggttggtggcggagtacgcaagagacgggac

SEQ ID NO: 20247 - DNA, 1487 bp, Zea mays
cggaagaagaaatccggccagagcgttgtgtgatctctttgtaacgtaagatgttatacagcacgtagttacaaacgaatttaatcaattatacacctcacgcgtagacgctaacattttggaccagtactagtaagggcacaaagagtagcacaagattgagggctggtttgatgaccagggaattgattgaagcccatgatccccttcaatttcctggttagtttggcaactccattttccaaagaatttctattttctcaagaaaaaataaactaatttttcttggaaaaataggaatcccctataaaaatggggttgccatactagcctaagacaataaattatcccagggcatcaacacgatgcttccctgcagtatggaaatgccacaatggctcagcacaaagttgctcctctatccaaatcacatggctacgcatatagccaaggcaccctaatcgtgccccacaggtcatgctatctgcttgatgcacgaccttgttgcatatgtgacatgttttacatcacgtcattctatttagacgaatgttctggcttttccgtggcatgggctccagtgatgcaatcacctgaggcatggtcattcctcctgacacaattatttcaattccttctcgaatggataaattaggtcttatgatctcctcagagttcaccagaaatatgtcaccgatgtatagatgatttgttggcacatacacactacacagttcttcatcgcctttgtcagtctgaaggaccaccgttgatgttatgaatccaaatgcatattcaccaattcgtggatgacgaattattgcaacttctttgaaagcagtcgtattttgatctggtgaaattgcagtgctgacttgctttgatgctgaatatatatgtcttacaaatggcattttctttataaaccactcgcccacccagaagatggttgaaccaacccatgaagaaacaaatattccaaccagaaatatgaataccagagaagtcaaaaaaccaagaccaaatatgtcgattccaatttttgcatataggggactgaaaaaaccatcaacaaattgaataaaccaccatgtgatgaagaacgtgactgcaacaggaaaaaggactacacatccagtcataaactttcttgagacccaactttgaagaacagcacagcatgccttgcgtgtggaggtggtgggcgagctgggtcgcggcggcgacttggccgggtcctcggggtcgacagcctccgccgcctggctgagcgggatcgacgtcgactccttttcctccgccatggctccgccggggtctcccccttctagaagctcctcgcggggcgggtggaatgaagcagatgcgggtgtggcgtcgcttcgggctggggggcggctgcttttggctggcggcgagtagcagcaagcaaaagcggttggtggccgagtacgcaaggccgcaagggacagccgcggtttttgaac

SEQ ID NO: 20248 - DNA, 897 bp, Zea mays
taccgggcccggaatcaagaaacaagtctgtaaatctgaaagaagaaatctggtcagagcgttgtgtgatctctttgtaacgtaagatgttatacagcacgtagttacaaacgaatttaatcaattatacacctcacgcgtagacgctaacattttgaaccagtactagtaagtgcacaaagagtagcacaagtttgagggctggtttggtgaccagtgaattgaagcccatgatccccttcaatttactgattagtttggcaactccattttttaaagagatttctattttttaagggaaaataaactatattttcttgaaaaaataggaatcccctgtaaaaatggggttgccaaactagcctaagacaataaattatcccagggcatcaacacgatgcttccctgcagtatggaaatgccacaatggctcagcacaaagttgctcctctatccaaatcacatggctacgcatatagccaaggcaccctaatcgtgccccacaggtcatgctatctgcttgatgcacgaccttgttgcatatgtgacatgttttacatcacgtcattctatttagacgaatgttctggcttttccgtggcatgggctccagtgatgcaatcacctgaggcatggtcattcctcctgacacaattatttcaattccttctcgaatggataaattaggtcttatgatctcctcagagttcaccagaaatatgtcaccgatgtatagatgatttgttggcacatacacactacacagttcttcatcgcctttgtcagtctgaaggaccaccgttgatgttatgaatccaaatgcatattccaccaattcgtggatgacgaattattcaacttcttgaaagcagtcgaggccggctcgaggtcccaatg

SEQ ID NO: 20249 - DNA, 3836 bp, Zea mays
tttgagccaataaaatcaacctaacattcagaacctataataaactgcatgtactagaaggctcctttttgttgcactaaaaatatcgaataaatactttgaaacagtttaaatcaaattaatacatgcattaaaaacaatataggagaaggataccgggaaaaaacattgtaaatgtacatatgtttgaaaaagctggagaaaaaaaagaaagaagaaacagtagcagttaacaacaatagaaagaagaggaaaaacgaaattgaaaatgagaatataatacgaaaaggtatgaaaaaaatataatgcggtagcaaaccaaaccttacggatcagaaaatagaaattaggaaaaaaagaactgatagaaaaacagaagaaactaatattatatctgtttaaggctatggctggcaaattgtgtataaggacatgcaaaatattattttatattatagaatttactgtttataaaataaagttaggaataaatggtacgcacgagtaatactaaacagtgagatgctgcgagaggaagtgaaaaccaaaaggaaaaacaagaggacaaactacagctatgcacacgtgatggtgccatggcccttttgccgggagattgatgtcgaaatatgtatgtggggtgccgccgtgccgctgctcggtggtctgcaactgtttgctccttcggacgtcttcacgtggctgagcagaaagcttgcgggacgcaacggcacagcgaagcagcaggacataatgtagagggagaaatgtttacacatactataatttttatattcaacggctttaattgtaaaaaaaactatttaacggtagaaatgcattggatcatatagtgctagccctccacccacccaaaaaacatgtcatgcccatgtcagccatatggtacaaggttttggtagggtaacaatgatctctaaattttacactataaaattaaaaaatcagattagattatgatcgtgctctatttatatttattttcaaattaatatttatttaggtctctaaaaaattataaaaaatatttagatcacaatctatttcctagcctaatgagctcccgaaccataccccacacccgtgtgctgaccacccatgagatcttataaccttacacacacttggtaggcgacgaaggctccattgacctcgcccagcgactccagtccactaataaagaatgttcacccgatttgaattggatgatcacacacctcgcaacctttttatttttagcgaaaataatatttcccaactttcactttttttttaaaaaaaagtcagagttatatacataactttaacatgatagagttatgcacatgacttatacatatatgataaatttatatgcataaattttagaaataatatttttcggaacaaacttatcgacataatttcttccacataattttatgtataacattttacagaacaaatatattattgtaactttttaatacatttttatacaccttttatgtaatcttatagacagcttaatcatggtaacttttacataaagcagtgcagactgccggcccgggttgccagtagaatcagcatttccagtcttcactcgtattaaagccttagcctttagcatacgtcctaatgatcgatccgatccacatagccattggcagttcagttctccgatcctctaccgcagcagcgtaggcaaagtaggaggcaaggatcaatggcgccgccgcggatctccttcctggagctctgcctctccttcctctgcttcgtggtcttctactacttccacatgagatccaagcggaagaaccctttcgtgccgctggactggccgctggtgggcatgctcccggccctcctcggcaacctccaccacctccacgactggatcacctccctcctggtcgccagccagctcagcttcctcttcacaggcccgccgcgctccggcatgcagttcttcgtcaccgccgaccccgccaacgtccgccacgtcttcacctccaacttcgccaactaccccaagggccccgagttcgaggagatcttcgacgtcctcggcggcggcatcttcaacgccgacggcgagtcgtggcgccggcagcgcgccaaggcgcagctgctcatgtccagcgccccgttccgagccctggtgtcgcggtacagccgcgccaaggtggacaccgccctgctcccgctgctctcgcacatggccgccaccggggaggcgttcgacctccaggacgtgttcctccggctgacgttcgacaccacgacgacgctggtgttcggcgtcgaccccgggtgcctatccgtcggcctccccgaggtgccgttcgcgcgcgccatggacgacgccatgggcgtgctcctcctccgccacgtcgtcccgatgacgtggtggaagctggcgcggaggctccggatcgggcacgagcgcaagatggcggaggcgtggcgcaccatcgaccagttcgtcgccgacacgatcgccaagcggcgggccgagaaggcgaggcacggcaacgggcaggtctcggcggacctgctctcgtcctacatcaacgacgacgaggacgaggaaggcggcgtggacgcgttcctgcgcgacacgaccatcaacctcatgctggccggccgcgacacgacgggctcggcgctgtcctggttcttctacctcctgacgcggaacccgcgcgtggtgggcaagatacggcaggagctggagtgcgtcaagagcaagagcagcggcagcggcggcggcatggcgagcttcgacccggacgagctgagccggctgacgtacctgcacgcggcgctgtgcgagtcgctgaggctgtacccgcccgtgccgcaggagctcaaggaggcggcggcggcggacgtgctgccgtgcgggcacgaggtgcgggccggggacaagatcctggtgtctctgtacgcgatgggaaggatggaggaggtgtggggcagcgactgccgggagttcaggccggagcggtggatcccggagttggaggacgggcgcagggtggtgcaggtgcggtacgtgccgtcgtacaagttcatgtcgttcaactcggggccccggacctgcctcggcaaggacatggcgttcgtgcagctgaaggcggcggcggccgccgtggtcagcaacttcgacgtggaggcggtgccggggcacgtcgtggagcccaagctgtccatcatacttcacatgaagaatggctttatggccacggtcaagaggaggcgccagacgtttgcttagcttcgacgtacgtacgtacggtccattattatctgtggtaaacatgagatcacacagtcggtacgtacgttagctcgctcacatgtatgtaccagcaggtgcaagtacacgtggtcgtcgtggcatgtacgtgtacgacactccgtccgccgttgaaaggtacgtagtgttattacgtgtacttgtacgtgtgtgctgtgcgatgtcgatcagtgcatatagcatatgggtgttttctgtggtgtggtggggcgaaatgagagtatgagaccaaacctcctaacaaaaaaaaaaaaaaaacgatccttttttatttgtcatggtttaattcaaaactaaactatcgagaagatttggactctcgaaccaccttttccatgccggtgacgagaactgaggacgctggcgcaacttgtgagtggtaacaaactacactatagggcgtcatgcatgggtccgtcagttcggtggaaggaccggcacgttgtacctcgatcggtccgcgccgcgagagcaacacgtacgggaattaccaggagcggttgggcgc

SEQ ID NO: 20250 - DNA, 385 bp, Zea mays
tggaagcagtggtaacaacgcagagtacgcgggagcaagtgcaagtacacgtagtcgtcgtggcatgtacagtacgtgtacgacactccgtccgccgttgaaaggtacgtagtgttattacgtgtacttgtacgtgtgtgctgtgcgtcgtcgaccagcatagcgcatgggtgttttctgtggtttggtggggtgaaatgagagtatgagaccaaacctcctagcaaatttatatactatttttgttcttttttaattgtcgcggtttaattgaaaactaaactatcgagaagatttggactctaaaaaaaaaaaaaaaaaaaaaaaaaaaaaaagtactctgcgttgttaccactgcttaagggcgcatgccagcacactggcg

SEQ ID NO: 20251 - DNA, 1307 bp, Zea mays
tattcttttctgccactatttttgatagcttaggaaatttaatagtaaatgacactagagatataatatcatacaaaatatagtgatgaaacgttcatgatatatttttctaacacaaactatgatgacctctataatcacacaatttatacacagagaaacaaaacgaaaaatctttttaaggtgtaaattagaccacctgaaatagttagaggtagtaaattgaactaaatgttagtttaagggataggcaaacttggatggagtaatttggactttttactacagacatcaagaggtcaaagacatgataaatatgcgaaaatcagaaacgatttactcaccgccattggatctgcaaggtggaatcgagcttctcctgtgcaaaaattgtagaaatctagaattaccaccctttttacacaaattcttgcaggaacagaccgcagtcctccaaagaaaagcacagaaatgtcagcttttccttagaacagtactgactgtgctgttctttcctcgatgagttagcatagtactcctttcatctcaaccacctcaccaagaaccaacagaatcaagatcaaatcctcacaagaaatggatatcataggaactcccaagtttatagtctttttgcagcgaggataaagtgaagatatccccaaccacccaaatgcataaaaacaaggagggaggattgaaggaagctctgtcctgcaacgaaattcaccaaatcttcccaagaaaacgagaagtaagaactgcaaatggttactttgaccctcaattattcagcagataagcaccaaaatcaccaggattaatggtgtcttctgctaccctttcaactgcaacttgaacaagcatccaacccaattaaataaagattaaattgtctcctcgacaacacagagtagtagaagaagccaccacggagaagtcaaagttggatgctttgacgctgtataagagcaattcgactacccaagaaaatggaccgaagacgacgtccttcgcacgaatctctcaagagaaaacacaaaaaataaactctcgaagaaacacaaatttatcaaggaaaacgctcaaaccccccgaggtagaaggacttcagccaccgaaaatcgaactgagaggtggatcctctcttctgaccttgcggcttcaaaagtagtacaggcgcgcgagagagaggaagtgggaaggaacaaccgaacgaggaaggaattgagagtggggaggagaggaagaaaaggagaaggaagcgagaagccgagaaagaagaccccggcccggccggcctcgag

SEQ ID NO: 20252 - DNA, 1950 bp, Zea mays
ttttttttttttttttttttttttggctgcggaattccagagcccattcgataaaccttttattgttgcaaagaaattgctcactccatactttacaattctaggtatcatatatatgttccttgtaataattgaagagctcaaatgaaacaatccatctacagatacataatcacaccaacaataacaaacatgacaactagcacaggaagagttacaagatagggatctcatcacaggagcagcataggaagttgtctagaactcttcgagatcctgtccttattttctcaaagtatgcagcaagaacatttctgttgcaccttattctcttcactacgagtagtagacggttgcctagcagaagaggtaggtgacaacctatcatccctcaccctgttgaagataccagtgtacttttcacctgatgctgcatttgcatcatcccattcgccaaagggtggtacagccacttcttcaggctcatagccacccggcttcatcctgctccttccaggtgtatgctggccaagcccctctgaagatgccctcctctctggagtctgcattccagttgacctgtgctttggctttgattggttgtttggctgcattggtgaagcagacccagcagctgttctgtaggggcttcttggtgtcccagcattactcccttgttctctctgaagatttgaatgtcttcgtggtgcagactcacggtgagtaggccggtcagagtgtcgttggttgtcaaccccggcccgccggcgatgtggtgggttccttggaccttggtcttgaggattagttttgtagaccgttgggtgcaaaggcgacttgcgaggaggttccagatccctccttggatcatttggttgtgcaagaattcctgttttcttgttcttccgtgcatcctcgaacttttgtgtgtaaggtgtgtttccagtggtttcccaatccccaaatgcaggaatttcaggttgcgccattggatctgcaaggtggaatcgagcttctcctgtgcaaaaattgtagaaatctagaattaccaccctttttacacaaattcttgcaggaacagaccgcagtcctccaaagaaaagcacagaaatgtcagcttttccttagaacagtactgactgtgctgttctttcctcgatgagttagcatagtactcctttcatctcaaccacctcaccaagaaccaacagaatcaagatcaaatcctcacaagaaatggatatcataggaactcccaagtttatagtctttttgcagcgaggataaagtgaagatatccccaaccaccccaaatgcataaaaacaaggagggaggattgaaggaagctctgtcctgcaacgaaattcaccaaatcttcccaagaaaacgagaagtaagaactgcaaatggttactttgaccctcaattattcagcagataagcaccaaaatcaccaggattaatggtgtcttctgctaccctttcaactgcaacttgaacaagcatccaacccaattaaataaagattaaattgtctcctcgacaacacagagtagtagaagaagccaccacggagaagtcaaagttggatgctttgacgctgtataagagcaattcgactacccaagaaaatggaccgaagacgacgtccttcgcacgaatctctcaagagaaaacacaaaaaatagactctcgaagaaacacaaatttatcaaggaaaacgctcaaaccccccgaggtagaaggacttcagccaccgaaaatcgctctgaggggtggatcctctcttctgaccttgcggcttcaaaagtagtacaggcgcgcgagagagaggaagtgggaaggaacaaccgaacttccagtgaggcaatgcctcagcctactccccacttttcttgctccggaaattctctctcattgccgctacttttttcttgcactggactacg

SEQ ID NO: 20253 - DNA, 1967 bp, Zea mays
tttcatctttcaccatcatcattgtgtttaagccgaagcttcttcagccacagcttcgaagctagtttgtccttccttcggaccgcaccttcataccatgcacaccttcatctcaaagccgaagcctcctataacagtttatgttatactgaaaaacatgttagttaagtttttgaggaccttcggaagaggaaggccccaatagaggctttatgcaaaagttatttatactacaaattctcttcaagacgaactagaaaaatcgtagtagaaggacgaatgattaattttatagatttttctgtttgtaatattatcataactattgagaattacaagggagcacaatttcgtttcctttttaaataaaaaaattgaaagccacattggtggggtctagctgaaatccacattaactatggaaatctagaccccattcaataaaccttttattatcacaaggaaattgctcactccatactttacaaatctatatggtatcatatatatgttccttgtaagtgaagagcttaaatggaacaatccaattacagatacataatcacaccatacatgacaactagccaagaagagttacacgatagggtgctcattacagaagcacaataggatgctgtccaaactctttgagatcatgtcctcattttctcaaagtatgcagcaagaacatttctgttgcaccttattctcctccctacgggcggtagatggttgcctagcagaagaggtaggtgacaacctatcgtcccttaccctgttgaagataccagtgtacttttcacctgatgctgcatttgcatcatcccattcaccaaagggtggtacagccacttcttcaggctcataactaccgggcttcatcctactccttccaggtgtatgctggctatgcccctctgaagaatgccttctctctggagcctgcatcgcagtcgatctatgattcggctttgattggttgtttgactgcattggcgaagcagacccagcagctgtcctgtaggggcttcttggtgccacagcattactcccttgttctctctgaggatttgcatgtcttcgtggtgcaggctcacggtgagtaggccggtcggagtgtctttgttgatcagtttcaggtctcggtcgatgtggtgggttccttggaccttggtcttgaggatcggttttgtaggccgttgcatgcaaaggcgacttgcgaggatgttccgggttcctccttggatcatttgtctgtgcaggaattcctgttttcttgcccttccgtacatcctcgaacttttgtgtgtaaggggtgtttcctgtggtttcccaatcctcaaatgctggaatttcaggttgcgccatcggccaatttggatctgcaaggcggaactgagcttctcctgtgcaaagaaagttctgaactaccacccgttttgcacaaattcttccttcttgcagagtgcgcgcattacacacagatacacgagatatccagatacacagatgataagatgaaccacaacaacttgaactggatagatatacttagatgaggagcacttttgcatagattcttggaggaacagactccaaaggaaagcatagaaatgtcagctcttcctcagagtagtactggctgtactgttctttcctcgatgagttagcatagtactcctttcatctcaaccaactcaccaggaaccaacagaagcaagatcaaatcctcccaagaaaggaatatctcacaggaactcccaagtttatagccttttttcaacaaggataaagttaagatacccccaagtccccaaccatccaaatccataaaaatgaggaccgatgatcgaagaaagctctgcccgccactaaaattcaccaaatcctcccaataaaaatgagaagtgaaaaacccggccccgccggcctcgcggttcccacccgcaattattcagagaaaaacc

SEQ ID NO: 20254 - DNA, 1172 bp, Zea mays
gtgtttcctgtggtttcccaatcctcaaaatgctggaattcagggttgcgccatcggccaatttggatctgcaaggcggaactgagcttctcctgtgcaaagaaagttctgaactaccacccgttttgcacaaattcttccttcttgcagagtgcgcgcattacacacagatacacgagatatccagatacacagatgataagatgaaccacaacaacttgaactggatagatatacttagatgaggagcacttttgcatagatcctgggaggaacagactccaaaggaaagcatagaaatgtcagctcttcctcagagtagtactggctgtactgttctttcctcgatgagttagcatagtactcctttcatctcaaccaactcaccaggaaccaacagaagcaagatcaaatcctcccaagaaaggaatatctcacaggaactcccaagtttatagccttttttcaacaaggataaagttaagatacccccaagtccccaaccatccaaatccataaaaatgaggaccgatgatcgaagaaagctctgcccgccactaaaattcaccaaatcctcccaataaaaatgagaagtgaaaaactgataactgaaggtgactaatttgacccgcaattattcagagaaaaaccaaaatcaccaaaattgatggtgtcttatgctaccctttccaactacctaacctgaacaagcatccaacccaattaaataaagatcaaattgtctggatgacacacgatagaagaagccaccacggagaagtcaaagttggatgctttgacgctatataggaacaatttgactacccaataaatggatcgaaggcgacatccttgcacgaatctctcaagagaaaacacacaaattactctcgaagaaactcaaatttctcaaggaaaacgctcaaattccccgcggcggaaggactcaaatcatcgaaaatcgaactgaaaggtggacactctcttctgacctttcggcctcagaagtagtacacacgcacgagagagagaggggaagtgggaagaggaacaaccgaacaacggactcagagggggaggagaggcagaaaaggagaaggaagccaggaagaagacaaagacgtgacgaggggcggcggggatcccggccggcactcggagggtacccaatg

SEQ ID NO: 20255 - DNA, 2025 bp, Zea mays
tttttttttttttttggaccccattcaataaaccttttattatcacaaggaaattgctcactccatactttacaaatctatatggtatcatatatatgttccttgtaattgaagagcttaaatggaacaatccaattacagatacataatcacaccgacaataacatacatgacaactagccaagaagagttacacgatagggtgctcactacagaagcacaataggatgctgtccaaactctttgagatcatgtcctcattttctcaaagtatgcagcaagaacatttctgttgcaccttattctcctccctacgggcggtagatggttgcctagcagaagaggtaggtgacaacctatcgtcccttaccctgttgaagataccagtgtacttttcacctgatgctgcatttgcatcatcccattcaccaaagggtggtacagccacttcttcaggctcataactaccgggcttcatcctgctccttccaggtgtatgctggctatgcccctctgaagaatgccttctctctggagcctgcatcgcagtcgatctatgattcggctttgattggttgtttgactgcattggcgaagcagacccagcagctgtcctgtaggggcttcttggtgccacagcattactcccttgttctctctgaggatttgcatgtcttcgtggtgcaggctcacggtgagtaggccggtcggagtgtctttgttgatcagtttcaggtctcggtcgatgtggtgggttccttggaccttggtcttgaggatcggttttgtaggccgttggatgcaaaggggacttacgaggatgttccgggttcctccttggatcatttgtctgtgcaggaattcctgttttcttgttcttccgtacatcctcgaacttttgtgtgtaaggggtgtttcctgtggtttcccaatcctcaaatgcaggaatttcaggttgcgccatcggccaatttggatctgcaaggcgcaactgagcttctcctgtgcaaagaaaattctgaactaccacccgttttacacaaattcttccttcttgcagagtgcgcgcattacacacagatacatacacagatgataagatgaaccacaacaacttgaactggatagatatacttagatgaggagcacttttgcatagattcttggaggaacagaccacagtcctccaaaggaaagcatagaaatgtcagctcttcctcagagtagtactggctgtactgttctttcctcgatgagttagcatagtactcctttcatctcaaccaactcaccaggaaccaacagaagcaagatcaaatcctcccaagaaaggaatatctcacaggaactcccaagtttatagccttttttcaacaaggataaagttaagatacccccaagtccccaaccatccaaatccataaaaatgaggaccgaggatcgaagaaagctctgcccgccactaaaattcaccaaatcctcccaataaaaacgagaagtgataactgaagatgactaatttgacccgcaattattcagagaaaaaccaaaatcaccaaaattgatggtgtcttatgctaccctttccaactacctaacctgaacaagcatccaacccaattaaataaagatcaaattgtctggatgacacacgatagaagaagccaccacggagaagtcaaagttggatgctttgacgctatataggaacaatttgactacccaataaatggattcgaaggcgacatccttgcacgaatctctcaagagaaaacacacaaattactctcgaagaaactcaaatttctcaaggaaaacgctcaaattccccgcggcggaaggactcaaatcatcgaaaatcgaactgaaaggtggacactctcttctgacctttcggcctcagaagtagtacacacgcacgagagagagagaggggaagtgggaagaggaacaaccgaacgacctcggcgggggccgaggagaggcagaaaaggagaaggaagcgaggaagaagacaaatttttc

SEQ ID NO: 20256 - DNA, 908 bp, Zea mays
gtctcggccctcctcccctccgcggctccgcctcaagtgctattttaaaccccccgggccggccggggcgggctctccttcttcagatcaaccctcccctccccggcccgacgcacctcgcccccctcctgaccggccatggcgaccgctgctgctgcgtcccgggtggctgtctcggcaccggtcttcggctcggacggcggcgccaggagctccgggatcaagggcaacaacaatgttagcttcggcagcaaatcatgggtcggcggcacattggcctgggagagcagctgctcggtgcgggtgcggcccaggcacgccagcaaggtgctctgcatgtccgtccagcaggcgagcaggagtaaggtctccgtcgcgccgctccatctcgagagcgccaaggagccacctctcaacacgtacaagcccaaggagcccttcacggccaccattgtctcggtcgagagtctggtcggccccaaagctccgggggagacttgccacatcgttatcgaccatggtggcaatgtgccgtactgggagggccagagctacggcgtcattcctcctggagaaaatcctaaaaagcctggagccccacaaaatgtccggctttattcaattgcatcgactaggtatggagataacttcgatgggcgaaccggaagcttgtgtgtccgccgtgcagtttattatgatcctgagactggcaaggaggacccctcaaagaatggtgtctgcagtaatttcctatgcaactcaaaacctggggacaagattcaattaacaggtccctccggcaaaataatgcttctgcctgaggaggatccaaacgcaacccatatcatgattgccacgggcaccggtgttgcccccttccgtgggtacctgcgtcgcatggtcatgga

SEQ ID NO: 20257 - DNA, 9204 bp, Zea mays
cttgcatgcctgcagctgcaggtcgtgcatgcatctgggttaggcttgcgctctgtgctattttgaccggcgtgatcggagacaaaaggtgacccttgacacctccacaaggccgttccagcagccaagccaccggaccggaagctcccgagcggccgctctcggccgaccccagcggccaatcacctctcggtgcctgcttacggctgggctggctcaccaacacacaacacagcacgcccagatcaaatccaaattagattgctaataacgacccccatcaaagcacacaagttggacaacgactttttttttatataaaaaaatgtgttagcggctgctaatcaaccaaccagccagccagccctgcctgactgcctctccaaccagcgggagcgagcgggtcgtcccttccgccacctcaagagctcactgctggccctgagcctgaggccctcggccctcctcccctccgcggctccgcctcaagtgctattttaaacccttgtcccttcggcgagactcctctccttcttcagatcaaccctcccctccccggcccgacgcacctcgcccccctcctgaccggccatggcgaccgctgctgctgcgtcccgggtacgcgcgctcctcccgtccgtgcacccgcttccgcttcgtgccccgctgactcggtctccctctctctctctgttgacctgccctgcaggtggctgtctcggcaccggtcttcggctcggacggcggcgccaggagctccgggatcaaggtgcgtgccgcggcgccggaatctcgccccgtctgctgcttttttttttcttccctacgagggaatcttctgcgattcggtcggtggcggcggcggcggcgctgggttggtagacgactgaatagtttgactaatgggtagttcccgtagtactagattggtaacaacagggagtcagagctcgaatgttagatgccgttgctagatcgaggctaggcgctgttctgcgcggatcggtttgatgaatggcttgtataggccatccgtaacactgcatgcacatcttcagtaattcagagcgcttgctgctgaaactcggcggtgtacctgtcagccattctattctatatttctacgccgatgattttgaactcgcggcgatgaaggctatagacggcgctctaacttctaagcttggcctttcgttgtgctccagggcaacaacaatgttagcttcggcagcaaatcatgggtcggcggcacattggcctgggagagcagctgctcggtgcgggtgcggcccaggcgcgccagcaaggtgctctgcatgtccgtccagcaggcgagcaggagtaaggtctccgtcgcgccgctccatctcgagagcgccaaggagccacctctcaacacgtacaagcccaaggagcccttcacggccaccattgtctcggtggagagtctggtcggccccaaagctccgggggagacttgccacatcgttatcgaccatggtggcaatgtgccgtactgggagggccagagctacggcgtcattcctcctgtaagtattcccttctctctgtcatttcctttgtctgagaacataacattagttttcttcacacttggtgtcattatcgtataaagaacaatcaactttacctttgcatggtgctaaactgctaaatgtattattctctacagataaatataggcatactgatgtccttttcgaatatgtagatattgttttcaatataccatgtggcataatgttagacgaccaggctaaagggaaaaaatgttatggtctatgattcacaacatggcatctttacatcaaaaattgtttcgattaatcttaaattactattttttttattcatttccttttattactcatcatattttctcttcacgctcattgatctctgaaccttgtgtgcactttcatctgttagggagaaaatcctaaaaagcctggagccccacaaaatgtccggctttattcaattgcatcgactaggtatggagataactttgatgggcgaaccggaagcttgtgtgtccgccgtgcagtttattatgatcctgagactggcaaggaggacccctcaaagaatggtgtctgcaggcatgccctgtgcatctcgaaacctggggacaagattcaattaacgggtaacttcctgatggatgaacaggcactcctgtttgtttataatgttttatgacagcctcttagtcctaaccgcaatgctacttctttagttctttttcttaatgtagtccctgaaattcacctggtagatgatccatttgtcatttcttagaatctatacaatggaacactagagatgaaattaagacatagcaggaaaaaaaaccatgcttccaacacattaagaaacaagaggtagttatcggtgtcacagatttgcagcattctgatttaaccatgtgcagaacatgttgaaacactaactactgcaacaaatggcgacatgtaatatatatttttttgctaccaagaagcaaattttatcagtaaatatgactatgaccctgcactttatatgtttgtcttgttttgttccacgtttattttacttgtatgatatatgatatgttgtgaagacttctggaatgcccatacgacatgcaacaactgcagattttcttttatttttttaaaaagttttcttccccaagtatttctcagatatgccactgcttgtctgggcatttatatttgcctgctctgctagtatggttgttctttcatattagtttatggaagatgatggatcttttaagccggaagcttctcatacgatttcatgacctcaggtccctccggcaaaataatgcttctgcctgaggaggatccaaacgcaacccatatcatgattgccacgggcaccggtgttgcccccttccgtgggtacctgcgccgcatgttcatggaagatgtcccgaacttacagatttggtggctttggcctggctcttcctcggcgttgccaattcagaccgccttctgtatgacgaagaattcaccagctatcttaagcagtatccagacaatttcaggttagaatagcctcatcctgtcatccgtagcaacacctcttttcacgtgctgaagctatccctgccaacagctgtgcttcgtttgttggcttaggtgcttgtcagtctgcatcagtgaagtacttggtccagctaattcgtataattgcaatgtagtataacccagtctttctgaaacatgcaggtacgacaaagccctcagcagggagcagaagaacaggagcggcggcaagatgtacgtccaggacaagatcgaggagtacagcgacgagatcttcaagctcctggacggcggcgcgcacatctacttctgcggtttgaaggggatgatgcctggaatccaggacacccttaagaaggtggcggagcggagaggcgagagctgggaccagaagctggcccagctcaagaagaacaagcaatggcacgtcgaggtctactagggctcggattgctgtggttgcgacccttgatgctgccggggcagcgtcaggagacaaacacatgattgaaattgaatcgatggatggttctcggggcggtgtaaagtcacaaaagttctctttgtgagaaaaatcgccttttgtaattcataaaagcttccgcgccacggttatccgtggaacggaccgtgtaactttcagccgtttacatttgcagtgcagttgcttttggcagtctgtctagtgtctaacaataggtctctgtccagttcctacgcatatgaaccctgatgactttgcataattgccgttctatgcttgccccttgtgccccacattcgttggccactctgtcaacgggcgagcggcgatcttcattcttctgagcttcaaatcatgggcatctgctacctctgtcacacttccccttcttttctccacccatgcttggacatgttctcccctggaatcgtcatttatttatatacatcctcagccaactccgtcacattctgcatactccctcaacaatctttaaaagaatagaagtcttgtttttttaacagttaactaattttaagtttgattaaacctatcgtaccgaataaacattattaattttttttatttttttttcgaaagggcggcaagagaattgtcccaatttatttaaagaagaaaaaaaataccacatgcaacagttacaaacagccatgaaggctattgagttgcgtaatgaaacatatttttataacaaccctatttagagacgtcaatggtggtgatatttttaaaattttaatcaaactcgagaaaaaaataatatggtagaaatatagaattgtattcctttgacactactactaaattaatatagagtttatcgataaacaatgtatcggtgcatgtgaagttccagcacaaaaaaacaaagagagccatggcactggcacgcatgagggtgaggtcaccgcaccctcccccgcacctacctccaggccccaacctgaaaccgtgaaacggtttgcggtccagcacgcacaggctcacggcccgcccgccgccacggcaggcggcactggcggcgtacgatcgatgatgacgccctctccctgaaccgccgcgtccctgctggccggccgacgtccgcacgggcgggcgctgtctcacggcctgcctcggcggctcggccctctcctctgccgccacgcccgcctcccccaacttctcccaccggcccctggcccctgcctcttggcccacccggccgccacgccactctgctgatcacacgcgcgcgcgtccctgtcgcgcgcattactccgcccgggctccgcttcactcctttccgttccgttcccgtccccgtcgcacgtcgctgtccgccgcccgggtctccctctcccactaccacttgccgcccgccctgcccgttgcctcctcctccgcctcttatcctctacggccctgtctctcgcacgggccggttcgctggcagttaccttacctgccgctgactcgctccagtggccaggacctgctgcagtggacgtggtgccggcggcgggccaccgcggaagcagccatggaggcagtgcagacggtacgcgatctgatccgctttttccgcgtctcttctcccttcgccttcgccccacgcgcgcgtgtacgtacgtgtctagccagccatcgcgtgccgtgtttctgcctgcctgtcaactgtcatcaggttttgtttggctcggtctgaatcgggctgttcatccgctcgctcttactcgcgccctggtttgattgtttcatccgctgtttgtacgcgttgttctgtttgcttattggcggttcgattcctccaaggcttactttatcaagaactgtctgcggttttctgaattctctcacacaatcaccaatccagttgcgaccgcagcagcgttcacttgctgattcatctgagctaatgttactggaactgctgtatatttgttcataagaaaatttattcgtcagagagttctcgcccctcatatgtgggcagtttgtgcttgaaaccagatgactctgtttcggggattcagttccagtgggttctaaacctaccaccctgttctcactttcatgcccattgtttcatttcgatcagactccctttgtatcagcgagtctgatcccatggtttgcgccaacttgtgacggtttcattgcacggaattcccagcactgaagccaaacacttgtgcttactaccattctgatcaagttcccattttgctcgctcctccaatgtttccatcacccttcttatcatcagatgttgaattacactgaaaattctgatttctgaatatcatcagatgttgaaccgcactgaaaaagaaaagaaaatttgaattctgaatccaaaaacttgctgcaggcactgagtgagagaacgaacccgctgctcaacaggtcatccggtccatccgtcgtcactcggcttcaacctgacgccggcaacggcgcgggcttctatgacggggcctactctttcctcgacaccaccaaggcctgcgctacccggttcagcagcgggtcagtgacatccgacgactcgccggcggtgacgcccaggctgctgtccttgatgtccagctccagccccgacaactgctcctcctcctcagaatggcccgaccgagcggcggcgtcgcgctccaatcggtacctcttcgacgcgaacgcacaggcccggtgcgcggggtacctggacctgatgaggctggaggtggatgcgcagctgggcaggctcaggggcggtgtcactggcctggagagctacgctttgccgggcaacggccgtgcgatcggaggtgcgcacctgggcatgtcgcttgatgtcatgctgattgagattgatgagaggttcaacaccctgaagctgctcatgggctccgtgttccggcaggccaaggagatgcttggttcggtcaactcgtcggtgtctgatctgcagtcggagaatgagctgcagctggaagtgttcggtgccatcatcggagagtgcgtcagtggcctgcaggaggagctagagaggaagctgtacgagcagattagcatcacaaacaccatgggcaggaactggaaggaagccataactcagtttgccgccatgcgcgaagaccttggcgctctttgtaagctactactgcctttagcaccagaagctcatatttctaatggcaagaatgaaagtccaggcagcaagagtaacagatggaagtacaatttctttggaaagaaatccagagaggatcgttctccgcgcgctgaggacagcaagagtttcaggaagcaaaaatcatttggtgcaaaggatgtcatctcagaaaagtctgactttcaccatctcaatggtatgactagagagcaagtgataacctattttaagtctgagatcagcaaaatgaaaaggatgcacgaatcagctttgcaagagaagaccgaagaactgttcaggctcaaacgggagaaggggtcacattctctcaagaatgacatcgaatttgaacctttgagaaagaaaattccagagcttgtattgagaatggaccaaatcatttccaagaatataaaggtacctgcaatctgcatgacccatgatgaactcgatgaaagatgcagattgatgagcagaatcgatgctttgttctatgaaaatcagcattttcgagggttgcttgcagacaggatgaaggacgttaaggcattatcatcccagctatctgaagccagtacagaactgtcaatgcagatgctgtcggaagaagagctcctgagacaaattgataaagttagagaagactgtgaggacctccgaattgaatgtgatgttagagaaggaatgtaccaaactgttacaaaacatttgcttgatgactataaggacagtatggatggtgctgctctaaatcttagtgcaaaattgtcttcacttgaatctgcagtctctgaaaaggataaggcattatgcatatataacgaagaaaatcacaggttaaaggagaagttagctgagttagaaaaggaacgcttgatccacggtgaccaggaagttccagaagccataaaacaagatagcacagaaattgttctgcgtgacattgaggttgagccttgcacgtcaccgagaagatcaaatgtgaacaattcaaggtatgacgaacttgtgaaacttgactcaagcttagagcaaacgtcatgtgtcctcaaggaaatgaacaacaaaaatatggatcgcagtagtagcctcagtaggaatgagcaagagaagcagctggagtgcatcttagtatctatcatgaaactatcaaaagattttgtagagatcgagaaaaagatgtcagcggaaagaaccgagaacaggtctgttggtctgcgccttcactgcatcctcctgcccaggcatttttatttccttttttttcaaaaacacgattccgatgtcgatgtcgtgcattggccgtttcaggtcagaggaactgagcgatcactgcaaccacatggtcagacaagccatggtactaacaaagatagggctttggtataaacaaatgattgaagcgaggcgttctgagctccaaaaggctgaagccaaggtagttctagaattgaatttctgttttgactgcaagagcacgtgatatatgattatataaattgatcatgcaggaactctgaatttttttctttgtgaccaggttatggtattaggcgacaagatcaccgcacagttgagccttctccgaaagatatatttagctctcgatcattactctcctaccttgcatcagcatcctggtgtaagtattgcagctggagataccctgcatgctttgcgtccatccatgcattttgcaatggtccagtatagttaatgtttagaacatcacaaaagttagcatggtttcctttgtatgcagctgctagacgctttcatgaagacgtgcaagcttgttgcagatctgagaagtaaacagaacgaaggcgatgcaacatgaacgaggaggcggtatggtgggatctcccttggtatagctaatgtttctcatgtgcttatccgtgttccacgcctgccgctgcagaccaagtgaaggatcctattgaactgaggttttagaattttcagatcctgatctgcagtatatcttagtgccaagtgaaccaatagctgccttgctgatcttatgcgatgcaagtggtagctgtttctatctgcagtgatggccagaagtctgaaactatgtacagatggcattgtgctcacgtcgtcacgtgcttgttggttagagaatagggttgttacttgcttagttagcagcctaggccatggaatagagaagatgttaactacattgtaagcataaaatttatttatccccactccgtgttgatgagtatatttcctccatctagattgatcatattgctactcattggacgcgatcatggtccacccactgtgaaatgaacatgtcgaatgctggagacaaaaaaatagagctgggctccgccgaaacgcaagtatttcctttggctggccgctttgaactgtacctggacgcctgactgcctttctcgtcgtggccttgagcatccagagagctgcctactttgtgaccatgtcgatgaaacaatcca

SEQ ID NO: 20258 - DNA, 1721 bp, Zea mays
aaccaaccaaccagccagccctgcctgactgcctctccaaccagcgggagcgggccggtcggcccggccgccacctcaagagatcactgctggccctgactgaggccctcggccctcctccagtcccctccgcggctccgcctctattaaacccttgtcccttcggcgagactcctctcctccttcagatcaaccctcccctccccggcccgacgcccctcgccccccctcctgaccggccatggcgaccgctgctgctgcgtcccgggtggctgtctcggcgccggtcttcggttcggacggcggcgccaggagctccgggatcaagggcaacaacaatgttagcttcggcagcaaatcatgggtcggcggcacattggcctgggagagcagctgctcggtgcggcccaggcacgccagcaaggtgctctgcatgtccgtccagcaggcgagcaggagtaaggtctccgtcgcgccgctccatctcgagagcgccaaggagccacctctcaacacgtacaagcccaaggagcccttcacggccaccattgtctcggtggagagtctggtcggccccaaagctccgggggagacttgccacatcgttatcgaccatggtggcaatgtgccgtactgggagggccagagctacggcgtcattcctcctggagaaaatcctaaaaagcctggagccccacaaaatgtccggctttattcaattgcatcgactaggtatggagataacttcgatgggcgaaccggaagcttgtgtgtccgccgtgcagtttattatgatcctgagactggcaaggaggacccctcaaagaatggtgtctgcagtaatttcctgtgcaactcaaaacctggggacaagattcaattaacaggtccctccggcaaaataatgcttctgcctgaggaggatccaaacgcaacccatatcatgattgccacgggcaccggtgttgcccccttccgtgggtacctgcgccgcatgttcatggaagatgtcccgaactacagatttggtggcttggcctggctcttcctcggcgttgccaattcagacagccttctgtatgacgaagaattcaccagctatcttaagcagtatccagacaatttcaggtacgacaaagccctcagcagggagcagaagaacaggagcggcggcaagatgtacgtccaggacaagatcgaggagtacagcgacgagatcttcaagctcctggacggcggcgcgcacatctacttctgcggtttgaaggggatgatgcctggaatccaggacacccttaagaaggtggcggagcggagaggcgagagctgggaccagaagctggcccagctcaagaagaacaagcaatggcacgtcgaggtctactagggctcggattgctgtggttgcgacccttgatgctgccggggcagcgtcaggagacaaacacatgattgaaattgaatcgatggatggttctcggggcggtgtaaagtcacaaaagttctctttgtgataatcggaaaaaaaaatcgccttttgtaattcataaaagcttccgcgccacggttatccgtggaacggaccgtgtaactttcagccgtttacatttgcagtgcagttgcttttggcagtatgtctaaaaaaaggtctctgtccagttcgtacgcatatgaaccctgatgactttgcataattgccgctcttaacatcagaggattac

SEQ ID NO: 20259 - DNA, 1512 bp, Zea mays
  misc_feature (1490)..(1494): n is a, c, g, or t
cctctcctccttcagatcaaccctcccctccccggcccgacgcccctcgccccccccctcctgaccagccatggcgaccgctgctgctgcgtcccgggtggctgtctcggcgccggtcttcggttcggacggcggcgccaggagctccgggatcaagggcaacaacaatgttagcttcggcagcaaatcatgggtcggcggcacattggcctgggagagcagctgctcggtcgttgctgtcggcgccagcaaggtgctctgcatgtccgtccagcaggcgagcaggagtaaggtctccgtcgcgccgctccatctcgagagcgccaaggagccacctctcaacacgtacaagcccaaggagcccttcacggccaccattgtctcggtggagagtctggtcggccccaaagctccgggggagacttgccacatcgttatcgaccatggtggcaatgtgccgtactgggagggccagagctacggcgtcattcctcctggagaaaatcctaaaaagcctggagccccacaaaatgtccggctttattcaattgcatcgactaggtatggagataactttgatgggcgaaccggaagcttgtgtgtccgccgtgcagtttattatgatcctgagactggcaaggaggacccctcaaagaatggtgtctgcagtaatttcctgtgcaactcaaaacctggggacaagattcaattaacaggtccctccggcaaaataatgcttctgcctgaggaggatccaaacgcaacccatatcatgattgccacgggcaccggtgttgcccccttccgtgggtacctgcgccgcatgttcatggaagatgtcccgaactacagatttggtggcttggcctggctcttcctcggcgttgccaattcagacagccttctgtatgacgaagaattcaccagctatcttaagcagtatccagacaatttcaggtacgacaaagccctcagcagggagcagaagaacaggagcggcggcaagatgtacgtccaggacaagatcgaggagtacagcgacgagatcttcaagctcctggacggcggcgcgcacatctacttctgcggtttgaaggggatgatgcctggaatccaggacacccttaagaaggtggcggagcggagaggcgagagctgggaccagaagctggcccagctcaagaagaacaagcaatggcacgtcgaggtctactagggctcggattgctgtggttgcgacccttgatgctgccggggcagcgtcaggagacaaacacatgattgaaattgaatcgatggatggttctcggggcggtgtaaagtcacaaaagttccctttgtgagaaaaatcgccttttgtaattcataaaagcttccgcgccacggttatccgtggaacggaccgtgtaactttcagccgtttacatttgcagtgcagttgcttttggcagtcaaaaaaaaaaaaaagggcccccgccaccgcggtggannnnntcgacgcggccgcgaatt

SEQ ID NO: 20260 - DNA, 2115 bp, Zea mays
ggcccccgtccctttccctctcctacctccacctccacgacaacaagcaaatccccatccagttccaaaccctaactcaaatgctcgctttgactgcctcagcctcatccgcttcgtcccatccttatcgccacgcctccgcgcacactcgtcgcccccgcctacgtgcggtcctcgcgatggcgggctccgacgacccccgtgcagcgcccgccagatcggtcgccgtcgtcggcgccggggtcagcgggctcgcggcggcgtacaggctcagacagagcggcgtgaacgtaacggtgttcgaagcggccgacagggcgggaggaaagatacggaccaattccgagggcgggtttgtctgggatgaaggagctaacaccatgacagaaggtgaatgggaggccagtagactgattgatgatcttggtctacaagacaaacagcagtatcctaactcccaacacaagcgttacattgtcaaagatggagcaccagcactgattccttcggatcccatttcgctaatgaaaagcagtgttctttcgacaaaatcaaagattgcgttattttttgaaccatttctctacaagaaagctaacacaagaaactctggaaaagtgtctgaggagcacttgagtgagagtgttgggagcttctgtgaacgccactttggaagagaagttgttgactattttgttgatccatttgtagctggaacaagtgcaggagatccagagtcactatctattcgtcatgcattcccagcattgtggaatttggaaagaaagtatggttcagttattgttggtgccatcttgtctaagctagcagctaaaggtgatccagtaaagacaagacatgattcatcagggaaaagaaggaatagacgagtgtcgttttcatttcatggtggaatgcagtcactaataaatgcacttcacaatgaagttggagatgataatgtgaagcttacagaagtgttgtcattggcatgtacatttgatggagttcctgcactaggcaggtggtcaatttctgttgattcgaaggatagcggtgacaaggaccttgctagtaaccaaacctttgatgctgttataatgacagctccattgtcaaatgtccggaggatgaagttcacaaaaggtggagctccggttgttcttgactttcttcctaagatggattatctaccactatctctcatggtgactgcttttaagaaggatgatgtcaagaaacctctggaaggatttggggtcttaataccttacaaggaacagcaaaaacatggtctgaaaacccttgggactctcttttcctcaatgatgttcccagatcgagctcctgatgaccaatatttatatacaacatttgttgggggtagccacaatagagatcttgctggagctccaacgtctattctgaaacaacttgtgacctctgaccttaaaaaactcttgggcgtagaggggcaaccaacttttgtcaagcatgtatactggggaaatgcttttcctttgtatggccatgattatagttctgtattggaagctatagaaaagatggagaaaaaccttccagggttcttctacgcaggaaatagcaaggatgggcttgctgttggaagtgttatagcttcaggaagcaaggctgctgaccttgcaatctcatatcttgaatctcacaccaagcataataattcacattgaaagtgtctgacctatcctctagcagttgtcgacaaatttctccagttcatgtacagtagaaaccgatgcgttgcagtttcagaacatcttcacttcttcagatattaacccttcgttgaacatccaccagaaaggtagtcacatgtgtaagtgggaaaatgaggttaaaaactattatggcggccgaaatgttcctttttgttttcctcacaagtggcctacgacacttgatgttggaaatacatttaaatttgttgaattgtttgagaacacatgcgtgacgtgtaatatttgcctattgtgattttagcagtagtcttggccagattatgctttacgcctttacagtgaccaaggagtcaagggccccacatattatatttatttacccctgctttccttg

SEQ ID NO: 20261 - DNA, 2851 bp, Zea mays
tatttttattttatatccgcgaacatatatgcgtaatcatacaggtataatttttttaataggtacgattatggaatgatccgctgccctccctaaacgaaaccgggccgtacctcgcggccgcccggggccgcctattatcgtccagatcggcggaccgacccggcaccgcctctccaaaaaaaagcctaaaccctcctcgacgtcaccagcgtccgcccctatcgccgccccccttcggccttccccactgtactctccaatctcgccgccaagcctcaccgcaccatggcgaccttcaccgcggcctcctccctctccctcctcttctcccacccgcactcccactcccgccaaccatccgcccaggggcccaccgccagctcccacctccacctgcatccgcgcgccagccgcgcgcgctgcgcctcttccgacacgacggccacgaagcaccgccgcccagcggaggagaacatccgcgaggaggcggcgcggctccgaggcccggcccagggtttctctgcgtggtacgagcccttcccgccggcgcccggcggcgacccgaacgagcgctactcgctggacgaggtcgtctaccgctccagctcggggggcctcctcgacgtgcgccacgacatggaggcgctggcccgctacccggggtcctactggcgtgacctcttcgactcccgcgtcggccgcaccgcctggccctacggctcgggcgtctggtccaagaaggagttcgtgctccccgagatcgactccgaccacatcgtctccctcttcgagggcaactccaacctcttctgggcggagcgcctcggccgcgagcacctcggcgggatgaacgacctctgggtcaagcactgtggcatctcccacacgggctccttcaaggacctcggcatgacggtgctcgtcagccaggtgaaccgcctccgccgcgcgccgctctcgcgccccatcgccggtgtcggctgcgcgtccacgggagacacctccgccgcgctctcggcctactgcgcagccgcgggaatccccgccatcgtgttcctgccagcggaccgcatctcgctgcagcagctcatccagccgatcgccaacggcgccaccgtgctctctctagacactgattttgatggctgcatgcggctcattcgcgaggtcactgcagagctgccaatctaccttgccaattcgctcaacccgctccgccttgaggggcagaagacagcggccatcgagatattgcagcagttcaattggcaggtgccagattgggtcattgttccaggaggcaatcttgggaatatctatgcattctacaaggggtttgagatgtgccgcgttcttggacttgttgatcgcgtgccacggcttgtctgcgcacaggctgcaaatgcaaatccattgtaccggtactacaagtcaggttggactgagtttgagccacaaactgccgagactacatttgcatctgcgatacagattggtgatcctgtatctgttgaccgtgcggtggtcgcgctgaaggccactgacggtattgtggaggaggctacagaggaggagctaatggatgcaacggcgcttgctgaccgcactgggatgtttgcttgcccacatactggggttgcacttgctgctttgtttaagcttcagggtcagcgtataattggccctaatgaccgcactgtggttgttagcacagctcatgggctgaagttcacgcagtcaaagattgactaccatgacaaaaacatcaaagacatggtttgccagtatgctaatccaccgatcagtgtgaaggctgactttggttctgtgatggatgttctccagaaaaatctcaatggtaagatataaagttatatgattaattaaccctccaaactgtttttttttgttttttcgttccaggaattttattcctgagtctttcaactttgtttggtgaacatggtatggtgctaaaatctagacctaataccttgtagtactagttctggaggctcttttggttgtaggtcgaagtggatagagctgttccttgtactttatctgtttcatgtaatatgaataataaattatggtctaaatatttgaataaaaaatcgtttggaatgacccaaacaggattgtgccgttccgccccttggtgttctcttctgtatagttttcattgaccttaggcgattcatactgccaatacttgaagtaaaagatggaatttaacatgcagtatcattatctgttttgctgctttctggagtcacaagttaattatggtctaaatccatcatagctcaaaatgtacctgatgtttttgtaacggaaaagttctagccaaataccaaaaatgttattgtgcctcatgatcttttctagctttgctggatcgtcttagaagccaattatgtagtgatctgcttgagttgtttgctctagcctttccattaagtccatagcattggactgcacattagatttactccctgtgcaatttgttttagttaatgaaattggcctttgagtgattacgatagtatagtggaacctttccatttagtccatagcattcgactgggtgttagattactcgtgtgcattttgctttagttattggaattggcctttgagtgattatgataatatagtcaagccttttcatttagtccatcgcactggaccgggcattagatttaggccccgtttggtttgagggactaaattagtccctccattttaatcatatttaatccctaaattaccaaacggttggactaaaaccgggactaaactgttttagtctctaatccttcaagggggactaaaagggactaaa

SEQ ID NO: 20262 - DNA, 756 bp, Zea mays
  misc_feature (8)..(9): n is a, c, g, or t
ctcgaggnncggccccgaggcgttggctcgtgtatttttgcaaatatctcctatcccttttctccctcccgcgatctcctccgctcgacgcctgtaccccgccgtcccgcgtccccggtccagctcgaaaccctagacctgtgcggctgtccctattctccccaacggaaagatgtactcggaccagatctccaccgggcgcaagcgctccatccacgaccgccttgacggcgacctccccgccggcacgggcgccggcggccgtgttcgtcacacggtgtccaagaggcaacggcagatagatgaaaaatggaagcatgatctgtatcgggaagacgatgaaccagcttcaaatccaaaggatttgcgattgaagcttcagaggcgaagttctcaacaaagctttaccagcacaaggagatctggtgtgcgtgatttacgtgagaagctatctggtataatgcacccacagccatcaaatgctgatccaaagcccaagccaaagccagtatcagaggttgttaacatctcaaggcgtcaaactgctgatgaaatgcctgcacgtcaaagcaagagagcaccaaaacagacttcattgaagaagacttcacagccaaaggctgaaagtccactcggcagtttcctgagttcccttgggcttgagaagtattcgattaccttccacgcagaggaggttgacatggcagccctaaggcatatgacggagagtgatctgaaagctttgggcattccaat

SEQ ID NO: 20263 - DNA, 1364 bp, Zea mays
ggtacccccgggttcggccgggaattccagttaggtgacattttaaaaaatctcttgtagatgatcttattgaagttgctctaatagaaaccctaatagagattaaggctttaaaagcgctttaaaattttatagattagaacgacacatacctattaaatttaaggatcggaattgcctctctaaaataaataagatatggtgcgccgctcgagccggccggagcattatttcaattatctcaaacctgtgcgtctgcccctttccagctttcctctcaaacggagagatgtactcggatcagatctccaccgggcgcaagcgctccatccatgaccgccttgacggcgacctccctgccggcacgggcgccggcggccgtgtccgtcacacggtgtccaagaggcaacgacagatagatgaaaaatggaagcatgatctgtatcgggaagatgatgaaccagcttcaaaatcaacagatccgaaggatttgcgattgaagcttcagaggcgaagttttcaacaagattttaccagcacaagaagttctggtgtgcgtgatctacgtgagaagctatctggtataatgaacccacagccatcaaatgctgacccaccaaagccaaagccaaagccagtatcggaggttgttaacatctcaaggcgtcaaattgctgatgaaatgcatgcacgccaaaataagaaaccaccaaagcagacttcatcgaagaagacatctcagccaaaggctgaaagtccactcgacagtttcctgagttcccttgggcttgagaagtactcaattaccttccaggcagaagaggttgacatggcagccctaaggcatatgacggacagtgatctaaaagctttgggcattccaatgggtcctcggaagaagattatccttgccttggaatcgagagcataagggaatgacaagggagtacagtgtaggaaggtgggggatatgctaggcatgctcgtgtgcaagttcgacaaaaactttgtatccacatatcttggaaagggtacaacaacaatgattttatgggtctcttgtaacgcataccctgtcctgttgagcatgttcagcgaagtttaggattgctagaaggcaggccacggcgtctattgctgtaacttgtttccgtgttaattaagtggtgcggtatacatgttgaggcagttgggttcgtcttggaatgctatatcctataactacttgggtgtttggttcgaagaatgagatattacatcatcttctcacttttcactaaaaaaaaaaaaagtggaatggaatgagtttatccatcactccttactaactcattccttagttagtacctcggccgcgaccacgc

SEQ ID NO: 20264 - DNA, 1219 bp, Zea mays
cattgggtacctcgaggccggccggcagagaggcgttggctcgtgtatttttgcaaatatctcctatcccttttctccctcccgcgatctcctccgctcgacgcctgtaccccgccgtcccgcgtccccggtccagctcgaaaccctagacctgtgcggctgtccctattctccccaacggaaagatgtactcggaccagatctccaccgggcgcaagcgctccatccacgaccgccttgacggcgacctccccgccggcacgggcgccggcggccgtgttcgtcacacggtgtccaagaggcaacggcagatagatgaaaaatggaagcatgatctgtatcgggaagacgatgaaccagcttcaaaatcaatagatccaaaggatttgcgattgaagcttcagaggcgaagttctcaacaaagctttaccagcacaaggagatctggtgtgcgtgatttacgtgagaagctatctggtataatgcacccacagccatcaaatgctgatccaaagcccaagccaaagccagtatcagaggttgttaacatctcaaggcgtcaaactgctgatgaaatgcctgcacgtcaaagcaagagagcaccaaaacagacttcattgaagaagacttcacagccaaaggctgaaagtccactcggcagtttcctgagttcccttgggcttgagaagtattcgattaccttccaggcagaggaggttgacatggcagccctaaggcatatgacggagagtgatctgaaagctttgggcattccaatgggtcctcggaagaagattatccttgccttggagccaagagcataagggaatggcaagtgtaggaaggtgggagggatttgctaggcatgctcatgtgcaagttcgataaaactctgtaaccacatcttggaaagggacaaagggtaacaacgacaatggtttgtgggcttcttgtaacacatatcctgccctgttgagcatgttcaacgaagtttaggatgttagaaggcaggccacggcgtgtattgatgcaacttctatttctgtgttgattaaatggtgcggtatacatgttggggctcctaagttgttcttagaatgctatatcctataactatatttttcttatccacagggtatgctatatctgaagctaggtgctttgggtcgcaaaaaaaaaaaaaaaaaaaaaaaaagtactctgcgttgttaccactgct

SEQ ID NO: 20265 - DNA, 1042 bp, Zea mays
cggttcgacccagcgtccgtttttcaattatctcaaacctgtgcgtctgcccctttccagctttcctctcaaacggagagatgtactcggatcagatctccaccgggcgcaagcgctccatccatgaccgccttgacggcgacctccctgccggcacgggcgccggcggccgtgtccgtcacacggtgtccaagaggcaacgacagatagatgaaaaatggaagcatgatctgtatcgggaagatgatgaaccagcttcaaatccgaaggatttgcgattgaagcttcagaggcgaagttttcaacaagattttaccagcacaagaagttctggtgtgcgtgatctacgtgagaagctatctggtataatgaacccacagccatcaaatgctgacccaccaaagccaaagccaaagccagtatcggaggttgttaacatctcaaggcgtcaaattgctgatgaaatgcatgcacgccaaaataagaaaccaccaaagcagacttcatcgaagaagacatctcagccaaaggctgaaagtccactcgacagtttcctgagttcccttgggcttgagaagtactcaattaccttccaggcagaagaggttgacatggcagccctaaggcatatgacggacagtgatctaaaagctttgggcattccaatgggtcctcggaagaagattatccttgccttggaatcgagagcataagggaatgacaagggagtacagtgtaggaaggtgggggatatgctaggcatgctcgtgtgcaagttcgacaaaaactttgtatccacatatcttggaaagggtacaacaacaatgattttatgggtctcttgtaacgcataccctgtcctgttgagcatgttcagcgaagtttaggattgctagaaggcaggccacggcgtctattgctgtaacttgtttccgtgttaattaagtggtgcggtatacatgttgaggcagttgggttcgtcttggaatgctatatcctataactacttgggtgtttggttcgaagaatgagatattacatc

SEQ ID NO: 20266 - DNA, 1271 bp, Zea mays
tccgaattcgcggccgcgtcgacccctggcctgtgaaattggaagttctacattgctttttctttgtttcgtggggcatctatctatgcaggagtatatcacagatggactatgggtaatgcatcaggtggtgagcgcgctaaatttgctggcagggttgctaacgctatgattgactgtgcctgggacttcataaatagagtaaatgtcctgcaagaactgccttctaagggttctcaagtcttaggagcatcgtggcaagaatttcacagagaggaagaaagttcaacttctgaaaagaatcaaggaaaatttgttcctagtgaaaaggttatgcagcttcgaaagaaactaataaagtttatcgaagatcacatatacccaatggaggctgagttctacaaacatgcacaatcaacctcaagatggacaattcatccagaagaagaaaatcttaaagcattggcaaagaaggagggcctatggaacttgtttattccgctagacagtgcagcgagagctagaaagctattgtttgaagaccattctcaaatttcccttggaagttcgaataatcttttgctgggcgcgggtcttacaaatcttgaatatggatatttgtgtgagattatgggacgttcagtttgggctccacaaatatttaactgtggtgcacctgatacaggtcctgttgaggtatggcactaaagagcagcagaagcaatggctagttcctttattggaagggacaattcgttctggatttgcaatgacagaaccacaagttgcatcttcagacgcgacaaatatagaatgctcaatatccaggcaaggagatttttatgtgataaatggaaggaagtggtggaccagtggagctatggatcctaggtgcaaaatcctgatattaatgggaaagacagatttttctgcacctaagcataagcagcagtccatgattttagtggacatcaacactcctggggtgcagataaagagaccattgttagtctttggttttgatgatgcacctcatggacacgcagagattacatttgaaaacgtgcgtgttccagtaacaaatatcctgcttggagaagggcgtggttttgagattgctcaaggaagacttggtcctggaaggttacatcattgcatgaggctagtaggagcagcagaacgtggcatgaatctgatggtagagagggccttaaacaggaccgcatttggaaagaggatgcacagcatggttcctttttatcagatcttgc

SEQ ID NO: 20267 - DNA, 2199 bp, Zea mays
ccggccggggggaagacagactgagtctgacagactgacagagagagagagagagagcacacgcaagacgagcgtcgccttctcaatctccgaatccccccccacccggcacgagctgcctaaccaaatccgtccacgctgtctcgtcccctcggcatcgcagtctcctacccaaatcgtcctcgcttcctcctccccgaactgacccgctgctgccgataggatagtaggatgacgaagctgacctcggagctactgcggccggtggttccggcggcggcgctggacgaggcggcgctgctgcgctacctggtggccaacgtcccgggcttcccgggccacgcgcccgcgctatcgctgacccagttcgggcacggccagtccaaccccacctactgcatccacgcctccgcgcccggcggggggccgcccaggcgctacgtgctcaggaagaagccgcccggggccatcctccagtccgcgcacgccgtcgaacgcgagtaccaggttctcaaagctctgggggatcacacagatgttcctgtcccgaaggtttattgtctctgcacagatgcaagtgtaattggaactcctttctatataatggagtatctggaaggaataatatatcctgatagcgcgttgccgggggtaactccatctaaaaggcgggctatatatttgtctactgccaaaactttggctgctatacacaaagttgatattaatgccattggattacaaaagtatgggagaagagacaattattgcaaaagacaggtagaaagatgggagaggcaatatcttgcatccactggtgaagggaagcctgcacgttaccagaggatgcttgatctagctcgttggttgaaagaacatgtaccagaagaagattcctcaccaggaccaggaacaggccttgtgcatggtgattaccgccctgataatctagtttttcatccaacagaggaccgagtaattggcgttattgattgggaactatctactttggggaatcagatgtgtgatgttgcttatagctgcttgccatatattattgatgcagcacccagtgcaaggacttcttatggagggtttcaagatactggcattccagatgggattcctcaactggaagagtacctttctgtatactgctcttttgctgcaagaccctggcctgctgcaaattggaagttctacattgctttttctttgtttcgtggggcatctatctatgcaggagtatatcacagatggactatgggtaatgcatcaggtggtgagcgtgctaaatttgctggtagggttgctaacgctatggttgactgtgcctgggacttcataaatagagtaaatgtcctgcaagaactgccttctaagggttctcaagtcttaggagcatcgtggcaagaatttcacagagaggaagaaagttcaacttctgaaaagaatcaaggaaaatttgttcctagtgaaaaggttatgcagcttcaaaagaaactaataaagtttatcgaagatcacatatacccaatggaggctgagttctacaaacatgcacaatcaacctcaagatggacaattcatccagaagaagaaaatcttaaagcattggcaaagaaggagggcctatggaacttgtttattccgctagacagtgcagcgagagctagaaagctattgtttgaagaccattctcaaatttcccttggaagttcgaataatcttttgctgggcgcgggtcttacaaatcttgaatatggatatttgtgtgagattatgggacgttcagtttgggctccacaaatatttaactgtggtgcacctgatacaggtaacatggaggtcctgttgaggtatggcactaaggagcaacagaagcaatggctagttcctttattggaagggacaattcgttctggatttgcaatgacagaaccacaagttgcatcttcagacgcgacaaatatagaatgctcaatatccaggcaaggagatttttttgtgataaatggaaggaagtggtggaccagtggagctatggatcctaggtgcaaaatcctgatattaatgggaaagacagatttttctgcacctaagcataagcagcagtccatgattttagtggacatcaacactcctggggtgcagataaagagaccattgttagtctttggttttgatgatgcacctcat

SEQ ID NO: 20268 - DNA, 1659 bp, Zea mays
atcaaaaaaatagtgtctgctttctgctctttggttgcgttttttctttgtatgttccaaatcaaaaataaaataggcattgtcagtgttgcaattgtgcaatgtaaatgagcccaacccacaaacacaacagaaagcacgacacatattcaacagcttcaaatctgctgcaagtagcagaccctactcatcttattcaatctctgctatgtcaaaaaccccccaataaaaagctttttgctacaaggaacaacagcagctcccatggttgagggcaaaaagttcctcctcctcattagtacctgcttcgccacgcgttccagttaagcttcagctgttaccacagaggagagacctcgtggactcccctcgacagccgaggatcaaacacgttgaactcacaccttcgcagggtatctaggaggacctaggccggcaaggctgggaggagcacagggatcgcctctttgggcacggacgatgccaactcccgcgccttgtgcaggtgagcctctgcaacagatgtgaccttgaaaactacgtctggcagcctcacgcccgccctgacctccgacctgccaccctcccgtgtgatgagcaggccgcattcctcggccacactagctgggatataatgtaccgtcccttgcttatttacatggtgcggcagcgccttgagcagtaacagaagcccgctggccttaccgatgtgagaggcggcgtggtcagccacggtagactgtattccgccagcctgcagggtcatgtaaaggatggtggactgggtgtcctctgcatacctctccaactccgcgctcgtcccaggaatggtgccttcctcacggttggtgtcgttgatcctcgcctccacggaccgcttcagccagtgcttgctaaccttatggtctgcgatgaccgaagagagcgcgtgggcaactaggtgctcgaccagcttgttgccaaagaccttgtcgaccgcctccttccaccagaggaggcgcatgaggccggtccgggggtcggacaccacatccatggcccttgctgtctggatgttgaaggcgcggaaggtgaacgcggccttgcgcacggccggggccaggtggagaaggcagaggtagtggtggtagtcataggcgcggacttgcctcacgcagtatgagagtgctgcccgcaggctactgcttgctgcaggcgtgccgccgctcatgaaccctgccttcctatatcaggaaggaaggtctcttgatgtatttcaggatggactaaatgttgtcattcttggaacatgtagaatctggcatgcctttgctaacctaggtgtgcttcattcaatgatacacgacacaacgtccggtgcagcaatgtttgaggacccttgaaggtgccaacttcctttccgtcgttgtaggctggttgagagtcactgaacttgagatgacctgataagattgatgaaattcaactggttctcacggactacgatttgtaactctagcttctcctggcctggaactctggagcgccgccgatggccgagaatgcagacgagcggggaagatgaggttttttgggagaggagagtgcgagattggagatggggaggaggagagagcgtgagatttggagacgctggtacgaggagagacctagaaccat

SEQ ID NO: 20269 - DNA, 2450 bp, Zea mays
acccccctctatgcgactttcagtatagactatagttttttttttttttttatcaaaaaatattgtctgctttctgctgtattaatacaaacaggcattgtatgttccaaaagaaaaataaaacagtcactgtcagtgttgcaattgtgcaatgtaaatgagcccagcccacaaacacaacgaaaagcacgacacatattcaacagcttcaaatctgccgcaagtagttattcaatctctgctatgtcaaaaaacaccaataaaaagctttttgctacaaggaacagcaacagctcccatggcacaattgaataaccctaaaccctaacagcttcaaatctgccgcaagtagttattcaatctctgctatgtcaaaaacccccaataaaaagctttttgctacaaggaacagcaacagctcccatggctgagggcaaaaggttcctcctcctcattagtacctgcttcgccgcgcgttccagttaagcttcagctggtaccacagaggagagaccccgtggactcccctcgacagccaaggatcaaacacgttgaactcacaccttcgcagggtatccaggaggacctgggccggcaaggctgggaggagcacagggatcgcctctttgggcacggacggtgccaactctcgcgccttatgcaggtgagcctccgcaacagatgcgaccttgaaaactacgtctagcagcctctcgcctgccctgacctccgacctgccgccctcccgtgtgatgagcaggccgcattcctcggccacactagctgggatataatgtaccgtcccttgattatttacatggtgcggcagcgccttgagcagtaacagaagcccgctggccttgccgatgtgagaggcggcgtggtcagccacggtggactgtattccgccagcctgcaaggtcatgtaaaggatggtggactgggtgtcctccacatacctctccaacttcgcgctcgtcctaggaatggtgccttcctcacggttggcgtcgttgatcctcgcctccacggaccgcttcagccagtgcttgctaaccttgtggtctgcgatgatcgaagagagcgcctgggcaactgggtgctcgactagcttgttgccaaagatcttgtcgaccccctccttccaccagaggaggcgcatgaggccggctcgggggtcgaacaccacatccatggcccttgctgtctcgatgttgaaggtgcggaaggtgaacgcggccttgcgcacggccggggccaggtggagaaggcagaggtagtggtggtagtcataggcgcggacttgcctcacgtagtatgagagtgatgtccgcaggctactgcttgctgcaggcgtgccgccactcatgaaccctgccttcctgtatcaggaaggaaggtccctgcaccacacaaacaaaaaaaaggcacatggttagattagattctgaatatacaacagccgagatttgtgcacatgttcagattagttagggcatgtttggattcattggcaataaaaattagctagctaatagttgctaacttttagcgggaagctgtttgcatccatgtgctaataggtagttagatagtgagttgaaggtgcatatgaatcattagcaactccaaatcctgctaatggaactagtaatatttagcagcccttccgttaaccattatcagattattagcaggtctgtttggatcaactagttttaattttagttgctaatttttagtgctaacggatctaaacgggtccttactgataaaggaagtgagagaaactccaacagattggctataattaatagctaaatcctagtattttgtcattttgtaaaataaaatccctcgaaaaggaagaggtccacaacagccttgctattttgcaaagttacatagcaacacccatgattagctatatatggctaataaaaatcaagggatagcttactttctattttacaaaatcagatagcacatctattaaaaggaacaacaaaaattccaaatatatgaaaaggaacacctgcttcagtttcaggggttcatatttgatacatatatatgaaatggagtgcggaaattgcagggaaattagacatgacatgaccaaagttaaactgcaattggtttggggctgatgaataacaatatccagtgcaaacaacaatgcagacgcagcatatcgggtcgaaagaaatgtagaaacataaatgttactggcttcgatggtgacctgacctagcagcctagaaggtgggatgggcgactgaggaagggagaccacctggtgtaatgattgctagggaggccattaccgtgcaccggagagttagagcacggtgacggtggctggccgccggaggcgcaccgcgaagggcatggatccgcatgctcaggcgcagtgttattaaaactaaatttaaacgacgtttaaacat

SEQ ID NO: 20270 - DNA, 856 bp, Zea mays
tcgacccagcgtccgaacccatctgtctattgggtatatgtatgttatgtaatatagtatgaagtccgacccataccaccacgcctagactgtgcctgcatccctcatcgctcggctcaatcgctgatcagttctgcggccggcgacgtgtgctagctcacgacgacgacatgggctcggcggtgaagatcgggacgtggggcggcgacggcgggagcccctgcgacatcacggtggcgccgcggcggctggagagcatcaccatccgctggggcaaggtcctcgactggatcgccttctcctaccgggaccagagcgggaagctgcacaccgccggcccctggggcggcaacggcaaaggagagggcacggagacgatcacactggaggcctcggagtatgtaacgggagttgcctggtccgtgggcccgttcaagttcaagaacgtggagcgctgcatcacctccatcaaggtcgtgaccaacctccgcagctacggccctttcggccacggggtggacagcacgcaccacagcttgcccgtgatcgacggcagcgtcgtcggcatgttcgcccgcgcaggggattttctcgacgccatcggcttctacattctcccagacgccctccctgctctaaaaccgacgacggaccctgctgaacaagaagaaaaagaaaaggactctggccatgaacaagaatgggaaggcaaagtctaaccaagaagaaaacgaggactccaaaaacgagaaggataaacccttggtcgtaagtttcgttttctacgacgaaaaatgaatcggcggatatctatttgtggctcttgtgagtcttcagctggtgttcgaactattaa

SEQ ID NO: 20271 - DNA, 2917 bp, Zea mays
cgggggcagggaggacgaagcgaccagatgactccagacttgcgtcacggcgggatcgcttcgcatcgcatcttccgatctctctggctcttggcctccggccgtcctgcctgccgccgctctgcgtcacgacatgctcgctgctccaacttcatgctccggtgactcacgtttcaggcagcagcaccaccccaggcactcagcggccagcacggttgtcagttgtcaccctcctaccgcatggccgcagcgctaacgtcctcgaccagacctcggccccaggaacaaccacattgacgaactcgcgcggctcgccaatcttgctcgccttgtctcgaaatcgaacgtctgggagctgcctggcccagacaagtttggtggcgagagcaaaccaaatttggtctgggagctgagaagatgattgattttgaataatttgcctgacactagagctaaactagtgttgagtgtcccttgattgagttcctgaaacataagttatgtctccattaacccaggtaccactcgtcgacactctcggaaaaggcaaagaaaactttagaccttgttcgtttgtgtcggatcggtgggtcggaacgattcctagccggattgcttctctaatttatataaactttgattagctggaacgattccgggtgcaatccgacgtaaacgaacaagtcctttggccttgttcgtttatgtcggattagtgggtcggaacgattcctagccggattgcttctctaatttatataaactttgattagctaaaacgatttcgggtaaaatccgacgtaaacgaacaaagccttaagcatgtttgattgcaagaggattgaaagtaattgaggtggattaaatcctgttatatttaaaattgtggagagatgcatatacggccaggtaagttaagtgtagttttttttttcttctaatttctagaactccagttatattatttccggtcgctgcagggaagcgtggtcctggtacgtggaggccgcacagccgcgcatgccaacaaaccagacgatcactgggcatccaaatatacgcctagattgtctggttccaactacccatctgtgatctgtctattgggtatatgtatgttatgtaatatagtgggaccctcgggcgccccccccataccaccgcgcctagactgtgcctgcatccctcatcgctcggctcgatcgctgatcagttctgcggccggcgacgtgtgctagctcacgacgacgacatggtttccccttcagttcctctcctttaatttccctcttgctagctccaccaccagaatcagacggtcgaatatatcattcacgactactggagctgatgacaacgcaagtcacaataagcaaacataatctctctgctcgttttcctctgtgtcgtcctgccgcgcgcagggctcggcggtgaagatcgggacgtggggcggcgacggcgggagcccctgcgacatcacggtggcgccgcggcggctggagagcatcaccatccgctggggcaaggtcctcgactggatcgccttctcctaccgggaccagagcggggagctgcacaccgccggcccctggggcggcaacggcaaaggagagggcacggagacggtgagttcttcttcgcctttgcattgacgagcagacatgaggatccatctacatcttgcacatgctgcacgcagatcacactggaggcctcggagtatgtaacgggagtggcctggtccgtgggcccgttcaagttcaagaacgtggagcgctgcatcacctccttcaaggtcgtgaccaacctccgcagctacggccctttcggccacggggtggacagcacgcaccacagcttgcccgtgctcgacggcagcgtcgtcggcatgttcgcccgcgcaggggattttctcgacgccatcggcttctacgttctcccagatgccctccctgctctaaaaccgacgacggaccctgctgaacaagaagaaaaagaaaaggattctggccatcaacagaatgggaaggcaaaatctaaccaagaagaaaacgaggactccaaaaacgagaaggataaacccttgtcgtagttcgttttctacgacaaaaaatgaatcctaatctttgtcggatatctatttgtgctcttgttgtgagtctcttcagctattgttccaactattattaatatatgtacatgcgtgggagctatgcattgtaataatcaattttcagaaaataaagagtattttcccttttttttatatctacatgttttctaattttaatttactatattaactagcaaaatatatccatgcgttgcaacgagtcatcaaaacattcatagaaaatagtgacgtaaacaatacatatttattgctagaaggcctagggtaacccactctgttagactttgcttgttaaaatgttagcaatggctcgatatatgcttttgtagtttatccaaccttgggccaagtaaagatatgtttaactctcttataggttacttcaaacctagaatggcctccagtttcactagcatgtaaggaggaacatgtgtcatcttaaggacctagtcttgtggccccatggacctgcatccaagtgagtatcctatggtacaaagtacctttcgaacttagagtatttttacttttagtggcccttagacacttgggaccttaggcctaggggccctctatctagtgctataactgggcctccctttgatcaaggattaggagagattcctaggggttgggaccttaggaggaaaattgttgccatagtgttcctcgaagatagcctcttaaggtgggactcttaagcatgtcttgccagcagtcaggggtatagccttcctcgagcgctaacaatcctataataaaaagaggatgatcatagag

SEQ ID NO: 20272 - DNA, 1029 bp, Zea mays
  misc_feature (991)..(992): n is a, c, g, or t
  misc_feature (999)..(1000): n is a, c, g, or t
  misc_feature (1012)..(1012): n is a, c, g, or t
ggtaccctcgcaggccgaactacccatctgtgatctgtctattgggtatatgtatgttatgtaatatagtatgaagttatgaagtccgacccataccaccgcgcctagactgtgcctgcatccctcatcgctcggctcgatcgctgatcagttctgcggccggcgacgtgtgctagctcacgacgacgacatgggctcggcggtgaagatcgggacgtggggcggcgacggcgggagcccctgcgacatcacggtggcgccgcggcggctggagagcatcaccatccgctggggcaaggtcctcgactggatcgccttctcctaccgggaccagagcggggagctgcacaccgccggcccctggggcggcaacggcaaaggagagggcacggagacgatcacactggaggcctcggagtatgtaacgggagtggcctggtccgtgggcccgttcaagttcaagaacgtggagcgctgcatcacctccttcaaggtcgtgaccaacctccgcagctacggccctttcggccacggggtggacagcacgcaccacagcttgcccgtgctcgacggcagcgtcgtcggcatgttcgcccgcgcaggggattttctcgacgccatcggcttctacgttctcccagatgccctccctgctctaaaaccgacgacggaccctgctgaacaagaagaaaaagaaaaggactctggccatgaacagaatgggaaggcaaaatctaaccaagaagaaaacgaggactccaaaaacgagaaggataaaccctgcttgtcgtagttcgttttctactacaaaaaatgaatcctaatctttgtcggatatctgtttgtgctcttgttgtgagtctcttcagctattgttccaactattattaatatatgtacatgcgtgggagctatgcattgtaataatcaattttcagaaaataaagagtattttccctaccctttaaaaaaaaaaaaaaaaaaaaaaaannaaaaaanntaaaaaaaaaanggaaaaaaaaaaaaaaa

SEQ ID NO: 20273 - DNA, 1262 bp, Zea mays
aactacttcctccaatctcccactcattactcagcttaggaaggtccagggcctccagctccgatccaccacgctacgctagctctatgccggactcctcctcctccgccggcacaggcggcatggccccctcgagctcggcggcggcgtccattgccgcgctcgcggccgccgcggcgtccggcgacggctcggacgactccggggcggccaacaacaacggcgcgctgccgctgccgctgccgccgccgcacggggtggaggacaacaacagtcccgcggagctggcgggcgcgggtggcacctcccgggcggtggcgaggagggtcgcggcggccggcgcctccccggcggcggcggcgaggaggggcgccgccttgaacgccgcggcggccggcggcgccgggccgagctgccaggtcgagcggtgcagcgccgacatgggcgtggagaagcggtacaaccggaggcacaaggtgtgcgacgcgcaccgcaaggcgtccgtcgtcctcctggccggcctccgccagcgcttctgccagcaatgcagccggttccacgagctgtcgcacttcgacgacaccaagcgcagctgccgcctgcgcctggcggggcacaacgagcggcgccggaggaaccccgcggaggcgcaggaccagcacggcgggcggggcgacccggggagccaccacctccagatcagataaaaacctactacgtcagcatgctctctctcttctgtcatgcaggacgcacgcacctagcgtcgtcaccgatccatagtccgatatgtgtctcaagtgttgtgtgtgcgcgctctcgccgcctacccctgtcctgcagtgttgcgtagtatatggttctacgacctacacgtactgctgctactactgcgtgctaactttaatctgatggcagtccacagctagctagcacatcacctcctgtaagtaatgtgcttatctatatgtgcaccgaccggaaccggaggcgtgcgtacgctgatctgccacgaagcctactagtagttaaatgtaacgtaacctgcaggcaattaagcagggcgctgctatatatagcgtaattaattgtgcgtatgggtatggtggttcgattatcggatgtgtaatccctgtacgtggccgggcccgtgccaaacgtacggtgacctgtgcaggctctgtgtgtcgatgatgttgtactctgataatgatataatccattgtggtaatgtatgctatttaataaaaaaaaaaaaaaaa

SEQ ID NO: 20274 - DNA, 1860 bp, Zea mays
cttttaaggatctttcatgctttcgataagtgtgtataattatcttctccttcaactaactaatatatagttttttttttttttttgtcctgtcgacaaaatccatgagtatagcacaaatatgaactggtatcatacatcgttcgtagctttgatgcatttgtccaggcgatcttttggattcaagactgtcatagtcgtcgctcatcagtaaacgtgccacagatcaaccatcacattagtcgaatggaagaaggtccagtaacagcggcaactttctgagccttctgcgtttctgatttatacaggcctttgagctctttctttgctttccgggcttctctcttttcttctttcactgctgcctttcttgccttcttctcctcttttgtttccttctcagctccttttttaaatttatcagtgacagaagcttctacaggctttactttcttctccttttcaccatttcttctcctctgtggcaggtattctactggcagtttctctttcccatgaagcttgatgatgccatttgttgtagttgtttctccagggaaaaccctagggaaccgcgctctggagattcctggagtttcaattgtcccaggatgattatcaaggttagagaatgtggaaacaatggtctcacagtcccaaacttcagattcatcgctgctttccgaaacaagcacaaccacctcttcttctgcagtttcatttaaatatctttcagcatattcagcacatttttttatcacaagagcagattcatccacctcatcagccatgcttgaatccagtttttgacgaacaaaatctgctggtgttctatattcttcatcaacacatacattctgattttggaacaatttcagttcatcaatagcctcatttggcagttcatattccccacctttaacacccatgtcatcatcatcactgtctccatattcctccaaagcaagcaaatcaaattgttcatccagcaatcgtctcactcttggctttggctcatcctcctcaaaatcgaactcctcctcttcaacatcactgaagacaccattccactcttgcttttcttccatgtctccatcctcatcctcctcctcctcctcagcttggttagctatgatgacaaaatcctcctccagcccctcatcctcggacccaacatgagacacatcgctctcatcgagcaacctggcgatatctgggtcgacagccttctcaattcgcctcactggcgcagtcttggcagccaccttacacatcgtcttcccctcgtccagttcaccctcgctgagaccaatgcgtaccctgcttgcatcataagccttgacatcgagcgggaggggctccgggcgaccggtggagctggggacgaaggatgaggctgcggcggcggcgggacggagctcgcggaggtgggagaggtagttgtaaccgtcgtcagggaggccgagctcgaggatctcgcggcggacgtgctccgggagggggccggatgcggagccgaagtttccattgccggcggaagggtcggaccgggatgggtcgaaggagtcctcgtcggcgaacccggggacagtgtagtcgttgttgtcgacgcgtacgaacacgcggtcgttggggtcggcggcgccggcgcgcgggaagaggcggaaggtcgcaaagttgcgggccttgcggccgcctcctcctcctcctcttgctcccatattggcggcagcgacggtaaacggtggcgacgatggataggttagggttttgggatttggagagcgatgctgacaataggaagaatgaaaacgtaggttacaacggcgaaactgcccgagacttaaccataatctattt

SEQ ID NO: 20275 - DNA, 4225 bp, Zea mays
gaaaagaaaaagttgcatcaacattcacgggtaggaaaaggtgcagaattcactctatatctcagcacagcacagcccagcctggagctccagctcctggcaaaaggcagttttgcagagcttcagaccacagagtacaaaactgacaataagcatacttgaacagtgaaggggaaatcaacagcagtaatcagaacagtaagtaggatgaaatgggtaatttctctcatctgatagactgatccctctcctggactgagttctagatcaccaaaaaaaatacaagtatatacaccattcgtgacctagctagtatgtacagcagcttcgtctttcaagactgcagaggagcatacaaaggaggaactgaagaatagatggaagccaagtcactgtcgcagtattctcaccgagctaggaaagcaaatgtggcgagccttcactgttgctgctccgagcattttcatgtgtccgttgatgcttggccatttgcacatcgcgggtgaactgggtccttgattttgcataaggagcttcccttgctgcagctaatcttttagcacggagaatgttctggcgtctcttccaccagcacgcagcgaatacaactaggaatagaatagctaaaagcacgccgaaagccatgccgatctttgcagccacggatagatgagggccacactcacgtaacccaggtattccacatagtccggcattgtccgtgaagttaaatctagctctgtgcagaggccttcctcccaaactggctggaacacgaccagaaagacgattgccattcaggttcagtatctgtaatgatgtcagctcgccgaggctctctggaatagatccattaagctcattgtatgacagatccagtacttgcaccacagagatggtacccagggagattggaatgttcccctttatgctattgccactcaagtttaatctcgtgccgaattcggcacgagtccaggtggccaaggacgaggacatggatcagctggagatggagatggagctcagcggcggctccgggagcggccacctggacggcctgctcagcttcgccgacgtggacgacgaccggccggagcagaagccgcagcacagcggcctcgagctccagacgacggcggatgccgccggacagcagcagcagctggccaccgccaacggcaagaagaaacggtaccaccgccacacggcacaccagatccagcagatggaagcgctgttcaaggagtgcccgcacccggacgacaagcagcggctgaagctgagccaggagctggggctcaaaccccgccaggtcaagttctggttccagaaccggcgcacccagatgaaggcgcagcaggaccgcgccgacaacgtcctcctccgcgccgagaacgagagcctcaagagcgataactaccgcctgcaggccgccatccgcaacgtagtctgccccaactgcggccacgccgccgtcctcggcgagatgtcgtacgaggagcagcagctccgcatcgagaacgctaggctcaaggacgagctcgaccgcttggcgtgcatcgcgacccggtacggcggcggccgacagccgagcatgtcgtcgtccgcgctggtctgcttatcggcgccgccgccggtgctcatgccgccgctcgacctcgacatgaatgtctactctcgccatttcaccgaccagtccccagtcatgggttgcggcgacctcatccagtccgtcctcgggccgccgtcgcagcagatcaccgggggcgccgagcaccacgcctccacgccgtcgttcatgggcgccatggcgcctgtccaggagcaggacaggcagctggtgctcgacctcgccgccgcggccgcagacaccctcgccaagatgtgccgcgcgggcgagtcgctctggctgcggcgccgtggcgcgagctccgaggtcatggtagccgacgagcacgcccggatgttcagctggcctgtcaacggcggccagcaggatagcagtgcctcccctggcggcgccgcggccaggaccgagggatcaagggacggcaccgtggttatcatgaacagcatcacgctggtggatgccttcctggacgctaacaagtggatggagctgttcccttcgatcgtatccaaggcaagaaccattcagatcataaaccatggagctgcatctggtcatatgggcagtggatctctcctcttgatgcaagcggagttgcagttcccgtctcctttggtgcctgcgcgagaggtggtgttcttcaggtactgcgtgcacaacggcgacgaggggacctggtccctcgtcgacttcccggccgaggggttccagctggaggcactgcaaaccccatctgttgtaaggtgctgtaggcgcccctccggttgcatcatccaggacatgcccaatggctactctagcgtggtgtgggtggagcacacgcagattggtgcacaggagaagccactgcaccaggtgttcaaggactacgtcgccagcggctctgccttcggcgccacgcgctgggtatccctgctccagcgccaatgcgagcgccttgccagtgagctcgcccgcaacatcgccgacctgggagtgatccgcacaccagacgcgtgcgcacgtctgatgaagctgtcacagcggatgatcactagtttctctgccaacatcagtgcttctgggagccaatcttggacttcactctcagaaactacagaggacacgatcagggtcactactcgcaagaacacggatccggggcagcccagcggtgtcattctaaccgctgtctctacaagctggcttcctttcaaccatcagaaggtcttcgagcttcttgccgatgaacaacagcgttgtcagcttgagattatgtcaagcgggggctcacttcacgaagtggcacatattgcaaatggatcacacccaaagaattgcatttctcttcttagaatcaatgctgcaagcaactcatcccagaacgtggagctcatgctgcaggagagcagcacccaccccgacggcgggagcctcgtggtgtttgcgaccgtggacgtggacgccatccaagtgacaatgagcggcgaggacccttcctacatccctctcctcccgctgggcttcgccatcttcccggccgccaacccttcggctgcagcaaccagcgccgcaggctccggcgacggccaaagcagcccagcaggtaacgccgacgagcccgccagcggctgcctcctcaccgtgggcatgcaggtgctcgctagcgctgtgccctcggctaagctgaacctctcgagcgtgaccgcgatcaacagccacgtctgcaacgccgtccaccagatcacagccgcgctcaagggcgctggggcgagcggggccgctgaaccggcggctgctgcctccgagtagtaagtagcaagagcgggagcagaggagagcagatccatacaccacaacaaaagccaaattgccttccaggtccggttgtttctgctgacagacatcgcaggtgcaagagagggtttgacaggagcccgaaaccaacacacggaaagttcaaaacccccccttctctttcccgccatatgcctcttaaaatgacaaaaatacccctgaccgaacgaagagaatggtgggggcattttgatcattttgggaagctagtgcggtgtcatctacagctactggaaaagaaagggtcctgtcaagctctcacttgtgccggccgattctctatcacgcagaaaacaatccggggcagcttggtcatgcaggtgttgctgctggtagctctctctctctcggtctgttcccttgctcagaagtcagaactgtgaagaaggttagcttcgattggtatgcttatttcgatttttgtaataataataagacgggagatttacctagtagttcgcgcgtaatggtcgggcgtagagccgtgtaactctgtattagaagagactgaggacttgattgtttaggagagcaagagaaaaggtgcgagaggaggagtcaagagcgaaccaaaccagttgtgaccatctgatcccaggctatcagggaagaagggtcttggttcgggaattgacttgttccctctctgcaccgcctgtttgtgctgctactcaagctcgtttgattacgttggtaggttgttttctcgtgccaaaaaaaaaaaaaagggggaggggaaaaaaaaaaagagaaaaa

SEQ ID NO: 20276 - DNA, 9046 bp, Zea mays
  misc_feature (8188)..(8188): n is a, c, g, or t
tcggcaggggctggtcgttcaacccgcctcacagactgcttcgactgggtcctggtcgtttgccccacttcgcggactcgctcaacagggttttggtcgttcaccccgcttcacagacttgcttggcggggacttggtcattcgcctcgccttgtagactggctcgacgggggcctggtcgttcgccccgccttgcagcgacatggggcgtggtcgttcatcccgcctcgcagactggatcgacggggacctagtcgttcgccccgcctcgcagactcgcttggcgaggacttggtcggtagataggccagagagaggtttataggcctggccttgggtaccacgttcctgggtacccgatagagcctttagagcatattcaacaatgtgactaataaaagttccctataatttaaaaatgagtatattttatggaatttagaacaccaacaaaacatcccgctctaacagtaaagtctcaaatctagattatagggtagcccattacggtgtagtatatttgaggcacttgagatgatgccctataatttgttgaccaaagtttgtaaaatgaggcattgttggagtatttttttctgcgtagagccacatatttcaatttgaggcaccagtttgaggcattgttggagatgctcttacaagtgtgaaaagtatggattttagggcttgtttggtttttagggactaatttttagtccatctattttagtctataaaaaattcgtttttcgtatttgacaatttagatactaaaatagaataaattgaggctacaaaaccaaatactaccttcttagcactcttgagctgctagtatacactttttgaaaaaggcatgcaatactggtcgatatcagcggtgatctcggttggtgcgtagtgaaagcagggaatagaagagaagatttggtgtgatctcgtgcattggttgcttagcagccgactaggctactaggctaggcagcagcagtacggcaccctcgtcctcccctggtgcaattactgtgcaaaatctgcgtggcacacgtacgcacgaggcacgctcccgccttcgtttcctcctctggtggcacgcaacacatgcatgcacgcacggcatggacgatgcgtactcgtactactcggtgccgggtccggttccggggccgggtggggcgggccggcgggggccgggcacggacaggcctagcgttgcaccacagctagcctggcgcagaccactctcatcatctcacatgcatgtccgccgccttgctgtaacgcggtttcgccacgcggcgggcccgatatcgcgcgccggccagatcggacggacgggcccatcctaggatggcgccacggcgggaatgaaaggaaggcgcgcatgcctcaggcagggatcggagaagaccggcagacgacaggccggagtgagctgttgacttctgttgacgccttcgtcagactctggtcaagcacgcgacagcgacacaaacgcaacgcaagcgaaacggcgcgggggatcggagccggtcgccggtgacgggcacgcggcggtgctcgcgcccgggtttcactggcgcaggcccgcccgttactgtgccgcgcagttattgcgcgcaacgcatgcatttactaccgcctgtcgttcaccttcacccccgcgcgcgctgtaatctggccccctaattaccgcatttatttgtaccgcccgcccacgatacgttctgggcttttccggctctgcgcagcctctacgggtgcgtgagtatgacacgcgggccccgcgcgcgtctcctggctgcgcagcgcagggcgtccacgcgctggaggggaagagcaccgtcgctgccacgtgggctccgtgacggtccagcgcgcgtgggtccgtgaagtcagccgagcgcgtcgcagccgcaggtcgagtcacgcggaaggaaagccagaataacaagtcaaagcggaggcgtcacatcacacagacacagtggacaacaagtaacagcgccggctggccgtgtccgtcgctgctgctgctgctgtgaggaagacgagagcacagggcaaacggaggagaaggagaaggagaaggcggccgacctcttctccgtcttcaaccttgcgccgcgtccagcgcgtaggtgaggagccgagtttagtagagtactctactaaacaaacaagcaaagcaaggccgacgaatcgagggagagggaggaagcaggccagcacggggtacgccgaggcacagaacaaccgacagggtatttactccccccgcccttgtctcgcccccatttctcgccctttcacttccatcgctcccctcctcctctccgattctctccgcttcctccaaacttttccctttcctacacctctcgctaaatcctcttcctctcatcctgtactcgccctgccatgcttcgccgtggattttaaccgcttgcttctattcggaggaacacagtcatcaggcgagccagccagggacgggagtaagagagaaggggttcttccatttatttttttcctctcggttgatctgccgcgccggccggtcgaggaagggaggaagaagtatgtttggggactgccaggtcctatcctcgatggccgcggtggccggggcctcctcgtcggcggacacgctcttcatccccaacccaggcgccctcgccgggttcatgtcctcctcctccgccgccgccgccatgccattccaccatttctccaccaccgccgcctccctcgtaccagtaagtagagcactccgtcgccttaacgctagcttttgtagcgcggggttttgagtctcaaatggtatggcccgcccgtgtgcctgtgtatatatgcagaaggaggagggcggcatcatgggtgcgctccaggtggccaaggacgaggacatggatcagctggagatggagatggagctcagcggcggctccgggagcggccacctggacggcctgctcagcttcgccgacgtggacgacgaccggccggagcagaagccgcagcacagcggcctcgagctccagacgacggcggatgccgccggacagcagcagcagctggccaccgccaacggcaagaagaaacggtaccaccgccacacggcacaccagatccagcagatggaagcgtaagacacacacatatatacgcttgccttttcatataataataatcttcttctccgatatattataatctcttacggatgcatgcatggcaatggcaatggccggcattgcacggacgacatacgcacaggctgttcaaggagtgcccgcacccggacgacaagcagcggctgaagctgagccaggagctggggctcaaaccccgccaggtcaagttctggttccagaaccggcgcacccagatgaaggcgcagcaggaccgcgccgacaacgtcctcctccgcgccgagaacgagagcctcaagagcgacaactaccgtctgcaggccgccatccgcaacgtagtctgccccaactgcggccacgccgccgtcctcggcgagatgtcgtacgaggagcagcagctccgcatcgaaaacgctaggctcaaggacgaggttggtgccgcctcggccgctccctccctagtccctacctacttagctcgctgcttaaaccctaagcgccacactgcactgcatgaaagaatcctgggctaacactcttcatccatccagctcgaccgcttggcgtgcatcgcgacccggtacggcggcggccgacagccgagcatgtcgtcgtccgcgctggtctgcttatcggcgccgccgccggtgctcatgccgccgctcgacctcgacatgaatgtctactctcgccatttcaccgaccagtccccagtcatgggttgcggcgacctcatccagtccgtcctcgggccgccgtcgcagcagatcaccgggggcgccgagcaccacgcctccacgccgtcgttcatgggcgccatggcgcctgtccaggagcaggacaggcagctggtgctcgacctcgccgccgcggccgcagacaccctcgccaagatgtgccgcgcgggcgagtcgctctggctgcggcgccgtggcgcgagctccgaggtcatggtagccgacgagcacgcccggatgttcagctggcctgtcaacggcgggccagcaggatagcagtgcctcccctggcggcgccgcggccaggaccgagggatcaagggacggcaccggtggttatcatgaacagcatcacgctggtggatgccttcctggacgctgtgagttccctgttcccttttaatacccgagctgatggaagaagaataacacgggagtatagatttggcaaaacctactgattttgttgtgctgattcaaaggaataaacttttttcctaactactataacttctgatttggcagaacaagtggatggagctgttcccttcgatcgtatccaaggcaagaaccattcagatcataaaccatggagctgcatctggtcatatgggcagtggatctctcctcttggtaactagctagatcatctcttgtttattttcaatctgaaagttacatcaaactgagaagattgatcgatctgttttgcaaatgaacgaatgaacagatgcaagcggagttgcagttcccgtctcctttggtgcctgcgcgagaggtggtgttcttcaggtactgcgtgcacaacggcgacgaggggacctggtccctcgtcgacttcccggccgaggggttccagctggaggcactgcaaaccccatctgttgtaaggtgctgtaggcgcccctccggttgcatcatccaggacatgcccaatggctactctagcgtgagcttttcaattcacttgtgctgttttatttgtgcgtgagcatagggttctttggtgatgcctactcagccagcactggtcactggggttgacacgttatttatctgcatgcaggtggtgtgggtggagcacacggagattgttggagaggagaagccactgcaccaggtgttcaaggactacgtcgccagcggctctgccttcggcgccacgcgctgggtatccctgctccagcgccaatgcgagcgccttgccagtgagctcgcccgcaacatcgccgacctgggaggtatgctctactacctgttacagcaagcgtatataatgtttgctatatatacatgtttgctgctggatagctgtacactgtagttaaaaaagctagctagcttgtttgtccaaaatcataggtcatgccattaatttgttcgcgcgattctcggatgtggacattgctgtctgcactatcctgcctgcaaactgtcattgtggtggactcatttcaatagaatttcagatttttaatcattttttcatgaacatacacgaacatttatttcattattaagagggagaaaagcaagcacgaatattagaatgcttattaccatatgttttttttgatcattttggaatgaactagatatgcatatggaccatttactagaacatttgatctgctctatgataactacttcattcactttttattttctcatcatcaccagcatcttcaaaaagtctaaccatcatgttctttttcactttttctttgtaactaccagtgatccgcacaccagaggcgagaacaaatatgatgaagctgtcacagcggatgatcactagtttctctgccaacatcagtgcttctgggagccaatcttggacttcactctcagaaactacagaggacacgatcagggtcactactcgcaagaacacggatccggggcagcccagcggtgtcattctaaccgctgtctctacaagctggcttcctttcaaccatcagaaggtcttcgagcttcttgccgatgaacaacagcgttgtcaggtactacctatatttacgatttcaaacatgcatcgcatcgttttggttctttgtttctgttgcaacaagcttgagattagtagtgtcttcatggatgttttaattttgcagcttgagattatgtcaagcgggggctcacttcacgaagtggcacatattgcaaatggatcacacccaaagaattgcatttctcttcttagaatcaatgtgagtacatcgtttctgctgctgactgttggggtttgttactcacagccctcatatttgagggcttcaagagcataatcacttgagttatccattttatggtgcttattattcagttcttagtacttattttgggagagcatcgtagcaacgacctagctctgaaatcatactgaatgtgattttgtttcagactagtaactaggcctattgtctgaaggataagaatttctttccctggtgcagacttactgcagtaactgcactctggtgtagaacagttgataattttaatagttccaaaagcacttactattggcaaccaatgtcaaggacaagaaattaacaccagctacttgagctgtacagtactcaagatgccacaataaatgagtttgatctatctgctccgagtcttaagcacatgcatcattgcaatttcgctaccagattttcagttccatttgttgtcagtagcaactcctcctagtttcatctggaatgaaaggaatataatgtctaatcacatattgtcgcatgcaccaaattactttatacataatccccaaaatacagtttacttgagcattaagcattgttatgactgaaaacttttcattgcatcttctgatgaaaaccaacaggctgcaagcaactcatcccagaacgtggagctcatgctgcaggagagcagcacccaccccgacggcgggagcctcgtggtgtttgcgaccgtggacgtggacgccatccaagtgacaatgagcggcgaggacccttcctacatccctctcctcccgctgggcttcgccatcttcccggccgccaacccttcggctgcagcaaccagcgccgcaggcccggcgacgccaaagcagcccagcaggtaacgccgacgagcccgccagcgctgcctcctcaccgtgggcatgcaggtgctcgctagcgctgtgccctcggctaagctgaacctctcgagcgtgaccgcgattcaacagccacgtctgcaacgccgtccaccagatcacagccgcgctcaagggcgctggggcgagcggggccgctgaaccggcggctgctgcctccgagtagtagcaagagcgggagcagaggagagcagatccatacaccacaacaaaagccaaattgccttccaggtccggttgtttctgctgacagacatcccagtgcaagagagggtttgacaggagcccgaaaccaacacacggaaagttcaaaaaccccccttctctttcccgccatatgcctcttaaaatgacaaaaatacccctgaccgaacgaagagaatggtgggggcattttgatcattttgggaagctagtgcggtgtcatctacagctactggaaaagaaagggtcctgtcaagctctcacttgtgccggccgattctctatcacgcagaaaacaatccggggcagcttggtcatgcaggtgttgctgctggtagctctctctctctcggtctgttcccttgctcagaagtcagaactgtgaagaaggttagcttcgattggtatgcttatttcgatttttgtaataataataagacgggagatttacctagtagttcgcgcgtaatggtcgggcgtagagccgtgtaactctgtattagaagagactgaggacttgattgtttaggagagcaagagaaaaggtgcgagaggaggagtcaagagcgaaccaaaccagttgtgaccatctgatcccaggctatcagggaagaagggtcttggttcgggaattgacttgttccctctctgcaccgcctgtttgtgctgctactcaagctcgtttgattacgttggtaggttgtttttaaaaaaaaaaaaaaaaaactcaagtgcggtcttgccctggttggttggttggatggatgggagtgaatgtgtgtgtgtgtgtggtggtggtgctggccttttgtttcttgcgtcgacctactccgtggagggctctgcgggcgcagcgcagggacttgaataccctgcctttctgctgctctctactgcatcgcattggatcctgtggctttgctcgagattgatgtcctggcgcacactgctantgtagaatggaggaccaggccagccagtttttgagctgcacaaggcaatgcaagcgtcagccgctgctgctgctgctggtggttatttacacctgcgtactatgcatggagatgcggtgtctggtgatcaatctgatgggtagttgggatgatgcccccctcataaatagcttaccagggggctgggaggggccacggccagctcttcttcccgcagctgcattgcattttttttgttatttctgtaggatgcttcaggtacggtttatgtggtgaaactttggagtagcagcaccaacttgtgttgttttagagggtgtttggttctctaaactaaagtttagttcgtgtcacatcgattgttatgatgccaattataaatattaaatatagtctaattataaaactagttgcatagatgaaggctaaacaatgagacggatttataatgattagcaaatatttattgtactatctcacgagcgaatcatagactaattagacttaatagactcgcattaccattttagtccttatctgtgtaattaattttgtaattatattttatttaatacttctaactagtattcaaatatctaatgtgatgaaactaaaattttgtctctagcatccaaaaggacgatatcaaatccctttagattggttagaccctatggaccttttctaagcccctataaagccaatctgagactactacctctatgatgtgtgagatcctaatctaactgagaggtaaacgtagattataccttcctgtccagcattaaggcggcagtgacgattataatgacttcctgtgtagggatgtcacctttttctgagttcctcctcttccac

SEQ ID NO: 20277 - DNA, 1535 bp, Zea mays
cagtcaggcctatttgtcttataaaaaaaatgcaaataaattgtgtctgaagacatgttcctgctattgtgtgttggttatataggtaacaggctaatatggtcacacacacaaaaaaaaaacttacctaatggacacagctaatacaatacttattgagcaagaatatggtacatcccagccctcctcctacagctaaaatagagagcgacgggaggatgaaaagagaagagaactagtttacaaaggacaagcacgacaaaaatacagttcagagggggttcagttcagtcacttaggccataaacgcgttttgctgaatcaagtgtgttgccaagaagcatggcaatcgttactggtccaactccgccaggaaccggagttatagcagaggccacattcactgcttcttcgaagcagacatccccagttaggcgataaccgtagtcactggttggatcctcgattggatttgtcccaacatcaatcaccactgcaccttgctttaaccagcttccccttacaagattggccactccagcagctgatatcacaatatcagattcacgggtaatagcctctggatttgttgtgaaggcgtggataacactgacagtggcatgatgccgctgtaaaagtaaggaagtgggcaatccaacaactttgcttctcccaatgacagatacatgcttgcccatcagttcaatcccagaatggagcaataattcaatgcaagcctttgcagcacagggaacaaacaaaggatttcggcttcttagtgcaagattaccaacatttaagggatggaaaccatcaacatccttattcagactgatggtgctcagaatcctttcctcatccataaactctggtagaggcaactgcactaggatgccatgaacagatggatcctcattaaatctggacactgaatccatcacttcatcttctgaacagtttccaggcaacttcgccaacaaagatttaataccaacttcctcacagccttttgttttgtatcgcacatatgattcagaatctcttctatcaccaaccaaaacaacagctagaccaggcacgtgtccaactgaacatttcatttgacagacctcttcagcaatatgtaacctcatgtcctctgcaatggacttgccatcgataatggatgcagtgcgatcataatcagcttgggcacaccgcggaggagactgcggcgtcgtgtcacgcgatgaagggtcccaggtgtcggggaattccggtccaagaaggaggctgctgctgctccgccgccgccgccgcggactccgcgtccccgccatgtcctcctccgccgctgcagtctctacagcatcgtggagcctgcgcgccgccctggagaacaaggatacgaagggaccagatttccggcgtgcggctgcggctgcggctgcggcggcaagaacggcggcggcggcgccacccatctccgtcagcgcgtcccaccgctcgtgtcaaaactcaaaacatgggatatcagtgaacgtttgggccttttt

SEQ ID NO: 20278 - DNA, 2271 bp, Zea mays
agtcagtcaggcctatttctcttataaaattttgcttttttttcgtgtctgaagacatgttcctgctattgtgtgttggttatataggtaacaggctaatatggtcacacacacaaaaaaaaaacttacctaatggacacagctaatacaatacttattgagcaagaatatggtacatcccagccctcctcctacagctaaaatagagagcgacgggaggttgaaaagagaagagaactagtttacaaaggacaagcacgacaaaattacagttcagaggggggtcagttcagtcacttaggccataaacgcgttttgctgaatcaagtgtgttgccaagaagcatggcaatcgttactggtccaactccgccaggaactggagttatagcagaggccacattcactgcttcttcgaagcagacatccccagttaggcgataaccgtagtcactggttggatcctcgattggatttgtcccaacatcaatcaccactgcaccttgctttaaccagcttccccttacaagattggccactccagcagctgatatcacaatatcagattcgcgggtaatagcctctggatttgttgtgaaggcatggataacactgacagtggcatgatgccgctgtaaaagtaaggaagtgggcaatccaacaactttgcttctcccaatgacagatacatgcttgcccatcagttcaatcccagattggagcaataattcaatgcaagcctttgcagcacagggcacaaacaaaggatttcggcttcttagtgcaagattgccaacatttaagggatggaaaccatcaacatccttattcagactgatgatgctcagaatcttttcctcatccataaactctggtagaggcaactgcactaggatgccatgaacagatggatcctcattaaatcttgacactgaatccatcacttcatcttctgaacagtttccaggcaacttcgccaacaaagatttaataccaacttcctcacagccttttgttttgtatcgcacatatgattcagaatctcttctatcaccaaccaaaacaacagctagaccaggcacgtgtccaactgaacatttcatttgacagacctcttcagcaatatgtaacctcatgtcctctgcaatggacttgccatcaataatggatgcagtgcgatcataatcagcttgggcacaccgcggaggagactgcggcgtcgtgtcacgcgatgaagggtcccaggtgtcggggaattccggtccaagaaggaggctgctgctgctccgccgccgccgccgcggactccgcgtccccgccatgtcctcctccgccgctgcagtctctacagcatcgtggagcctgcgcgccgccctggagaacaaggatacgaagggaccagatttccggcgtgcggctgcgacggcaagaacggcggcggcggcgccacccatctccgtcagcacgtcccaccgctcgtgtcaaaacatgggatatcagtgaatgtttgggccttttgggccacgttagcctgctagggatgatgattcgatctcgtaaccccgggcccacttggcgcatgtcattccttaaaaattgaacaaaaggcaaataggaatgatagggcctacacaatctatataaacacctaataataatctctgtgggtagccagttaaccctctacatataagagcatctcctagtctatcttgaaatctagggctcaatttattaaaaaacaacactaagagcatcttcaacaatatgccctataaaagttgtcacgaaaaagatctccggaccccctggggcccgcctataagggagagcgtgcgagagaaggacctccggctgcgagaggccacccgtcagtgaggaggcaatggaattgcctatccagaaagcactcgtcccaaaaaagccacgaggcatcgaacccggggtcggcgtggcggagtagtagaggggggcaaggctaaccggaaggaaaccactcgagtgggttcctcgctcagcccgatactggcccgtcgtaagtagtcagctgcattaactacgcctgacaccaggtcgcagtaaagagtcaatctgcccctccactcatgaccttcacagcccctcggcttacggctcactcatggcctacgcaaccctctagtcagcggcgcactcatgacctacaagcctctcagcctaccgagcactcatgacctatcaagcctacgcttgagagcatgaatcatccacaggacccgcaacgcgacgagcc

SEQ ID NO: 20279 - DNA, 1026 bp, Zea mays
cccacgcgtccgcccacgcgtccgcccacgcgtccgcggacgcgtgggcgagcccaacttgcacccgcaccaccaggctcacagccttacctgatccttgacaattctgctccctcgccgccgccgccgccgccgccgcccgcccgtcgtcgctgcgcttcggtacccgcgaagcaaggccccgcctcccgtgtacccgccgccgaagaagggagaggagcagatgaaagcggggaggaagaacctgcggcgggcgtgcgacgagggcgccgccgtcacgctcgccgagggagagagcatcatgcaggtcctcacgctgcgcggctccaacgtcatcgaggtgatggacggcgtgggcgtcaggtccctggccttgttccccgccaagttccagaagagcttctggatcaagaacgggagtttcgtggtcgtggatgccagcgggagggaccaggcgctggaatcggggagcaagatcgcgtgcgttgtttcgcgagtcctcttccacgaacaagttcgggccctgcagaagtctggtaactggccggccattttcaactcagctccgactccgaatgaagcttcagaggcgggagcagaagcacaggctgcccaggttgacgaggaaccagattccgatgaagaagacgacgatcttccaccacttgaggcgaacacgaacaggaataggccgtatgaattgtattctgattcagacagtggttctgacgcttgaaaagtaccaaggccatccatcctgtgcgttttgtctccaaggtattcgtgatgtgtgaatggaatggctggacctggatggctggattcatatgtgccatgtcatgtatgttagttagcatgctgttattctgcaatggaatctgtgttttctgatactagtcattaagctagatcaaggaagctgggtttgtttccactgagggtccgttcggttcttgggggactgcccacccccaactattcctagccagattggttatctaatttatataaggtttgattagatgg

SEQ ID NO: 20280 - DNA, 2298 bp, Zea mays
ccttgatgcttcttgttctggtcgtgttgatctgggtatgttcttcgccatcattgctccaatctgttcaggccctgtggataggcgcaagcgtatcgtctttgatgcacttctttggcgtcctgctagcgaaggaagcaatggccagataaggaggagcgatgcattgacctacgttaagcttcttcgggctgtttatatacccaccctccgccctcgcgtcctgctcgaaatgcatggggagtccgaccctaccatggtatcatacacggaattcttagagatgttcaatgatccggattggggatttgggatcctgagcactctggtgaagctcgaagagagtgaccacatacgccatggtagccacacatgctccatctgccggtaccctatcattgggtcacggtttaaggaaacaaaacactcattcagcctgtgcaaccggtgctacagtgaagggaaggttccttcggccttcaagttggaggagtacaggttcaaagaatacggtaacgagtcagaggccctcattgataagtgcatgtgcttcaatttacattctaagaagctggaaaccgatgcctgatcattcaaacttggatctcaagtgctcaaagcatgaatctgtgtatttcctaggtgcaaagatgtctagtcagctctcccactctcttgtaaacaaaggtgccatcattcggagtttctctaaatgtgtcccagttactaataaccctgatgtgctagctggtgttttaagtgtacggaaacgagtaaatgggaattccatacactctgttaccccagtccaatacaaccttgctgacccttgcatatttttgtttgagcaagaacaattttggggttctcttcaatgctttttgcctttcgtctcatatgttgtgtacttcaacttacggtctccggggcgcctagcatgtgtctctgtattgcccagctatggtgtaattgtttgcttggcactggtgagttcaccgtgattagaaggattcgaacttccccaattctgcttcctctgcctgagcacctgtgaaatggtatactgagctgagccatgtaagagaaagcgctggtttggtataacgaactgagcgtctgagccaactaagagagagagctgaacggatgggccagctatccactcagccatatggtcaaaatcgaccaactcttgatgcattaatctgactgccacacattttttacaaagttgttttgccttcacgtacccttcgcaataacaccatgtgttgtctctggtttcttctgtaaccttatcattgggttttaaggctcaaacccaacgaaacatgagaacttggtggcctatggtttcttctgtaaccttatcgttgggttttaaggctcaaacccagccgaaacatgagaacttggtggttttaaagataaatcaccaaacctctacaggtatactttataagtgcctcccacgttctggaaatgtgccttgttggtcctaaatcatgtcggcaacatgatctgctccgccatgtccttgcactcgtcggtgtccccaagtgttagccaccacatctagtcacctagcttttctagttccctagtcaagacccactgctcgtctctcaccactcagcacaaactcatatgaccttcatattagccatcgactaccgtctctagacatcacactacacaccacaagccaagagatatgttgcatatacatactcatgccccagttagtccacatgattcaagatgttataatcactcagaaacacgaactgcgaggcacatatcaaccttgtgttcatagagatggcaaggacaatgtttggcaaaagatgcctaacctagaggttgtagtagttaaggatgtggagaaagaaatgagaaagaggaaaaatttagaaccaccattacatgagaataaaaaaatgatgtattctcctcactcctaaggggtccacgatggagatgtctccaaacagacatggtttgaagtcggtggtatgatccgtcctaggagcccttgcaccttgtctaaccctccttgtatagcactctccctcgaggaagcttattaagggcaaaggatgtagccattgcagtgaacaagggaaggaaagacagacacgaagaaaaaaacaactcaagaaagatgaccagtgggagaaggcaaggacaaaaaggtttcaagactacatgaaaagaaaggcaaaataccacacaaaggcctatttaaagccaaacgctctctccctctctttgatctagggttaggaacctaaaaca

SEQ ID NO: 20281 - DNA, 3657 bp, Zea mays
  misc_feature (3518)..(3519): n is a, c, g, or t
  misc_feature (3522)..(3522): n is a, c, g, or t
  misc_feature (3524)..(3524): n is a, c, g, or t
  misc_feature (3527)..(3528): n is a, c, g, or t
  misc_feature (3533)..(3533): n is a, c, g, or t
  misc_feature (3537)..(3537): n is a, c, g, or t
  misc_feature (3542)..(3542): n is a, c, g, or t
  misc_feature (3546)..(3546): n is a, c, g, or t
  misc_feature (3556)..(3556): n is a, c, g, or t
  misc_feature (3574)..(3575): n is a, c, g, or t
  misc_feature (3578)..(3579): n is a, c, g, or t
  misc_feature (3588)..(3588): n is a, c, g, or t
  misc_feature (3599)..(3599): n is a, c, g, or t
  misc_feature (3605)..(3606): n is a, c, g, or t
  misc_feature (3609)..(3609): n is a, c, g, or t
  misc_feature (3611)..(3611): n is a, c, g, or t
  misc_feature (3613)..(3613): n is a, c, g, or t
  misc_feature (3615)..(3615): n is a, c, g, or t
  misc_feature (3625)..(3625): n is a, c, g, or t
  misc_feature (3631)..(3631): n is a, c, g, or t
  misc_feature (3633)..(3633): n is a, c, g, or t
  misc_feature (3635)..(3635): n is a, c, g, or t
  misc_feature (3637)..(3637): n is a, c, g, or t
  misc_feature (3644)..(3644): n is a, c, g, or t
  misc_feature (3648)..(3648): n is a, c, g, or t
  misc_feature (3655)..(3656): n is a, c, g, or t
tgtgcatgtctcaagttacattaaaaaaattcactatggaattatagtgtttgtatgcatatatttattactaaagcgcacattgtttaaaccatctaatttatcgactatatctactaaatgctaaacaaagggttaccaaccatctaacattgtgtgtctaggaaaacactgcttatgcagatgtctagatctcatatcaaaccttacctgggtgattattattcttaaaaaataagcttgtcattctttgctggatacttgttttagagttcctacttctccccttcattaaagctcagagtgaacggctgaggcaatctatactggagaaagttcaggcaaagcaatttgaggcactggcctcagttgaggacaagatattcagaaaaatacgggataaagaggcggaagtggaaaccatcaacaaaaggaactctgaactagaggaccagattaagcatttgggagtggaagttggtgcttggcagcaaagggccaagtacaatgagagcctgatcaatgcactcaagtacaacttggaacaagtatgtgctcaccagagcaaggacttcaaggaaggctgcggtgatagcgaggtagatgacacggcgtcctgtccctatggtggtgctgtcaatttgcaactgatgccaaaggagaacagacaaccgaagaatttaacggcttgcagggtctgtaaatcaagtgaggcatgcatgctcttgctgccgtgtcggcatctttgtctatgcaaggagtgcgagagcaagctgagcatctgccccctgtgccagtcctccaagatacttggcatggagatatattatgcatagaatataatttatgtatcacattagtatcgtacgagatactgctatgttaatacgtcaatctattgccgaagttcagaacctatgtaccactattgacttgccactggatcaaaaaaagactgccgtttatggtagatttaacgcagcaaatttctttgcgaagcttaaaaaaaaaacaaaaaccaaaaagacatggcagagtttgtcttgtgcgactgattgttaccgtctatgtatttccattagcagaccctttcaggcagtgtttggaactcaggaaatttcaccagtgctgtgttttcgctgctaaattgaattgatttatgtgaaatttatccgatccctgtgtttttttgctgctaagaaattggatcgatttctataaaattcatgtgcgatttctgtgacctggattggattcctatcttgatttttttctctaatttatataagtttctctaatttatttaaattttgatgagcttgaatgaatagcctcaaagtgcggctgccctctactgcctttctatggtttaagtattatacaattcgaaagtattaattatgtatatgtcaataaagagtgtcaacttgtaagcgaaggcttcttctgccacaaggttttgtaaaattcaatatacctgtaaaataagaagtcaaagtgttgcgtggagtgcaaagcatcctccatagatttggtaatttggatattgaacagatcaatctcttaaaaagagccatctgctgctgctgctttaagattttcgagttatatatccatggacaattatacgattggtctcgggcagatccctcacccatccagctgctgtcgccgcagctgtaccgtactgccactccaccgctcacagcactacagcagcacagcgacgcgcgagagcgagacgcgccccggccccgccgccatcggcgagcagctagcgtatcttgtgtctctccaaagtccagcccaaacccgcgccgatgttgaccagtggcgggcgggcgggcggaacgagcaccggcgcgggggcggacggcggagcgccctatccatgtgaacctaacgaacgctgcgagccaggcttgccaacgcggtgccactgccacccctcgtgcggtcgtgcccacccatccaccgtcatcattagcatcgtctcctctcgttagcagtcgcaagtagccagcagtccagcacacgactccgccgccccttccgctccgtcctcccctcctctccgctctccatcctggccgggcccacccggcattcttgaactcccccttcccgcatcaaatcccctacccgtgccgtcgctgcgcccgcgctgcgtgcccgaattttcgccgtaatccggctggtttttcccgtgcgcagcgggccgtaatggcgctgtccgcgtccgcggcgtcggccggccgggggtcgcggccggagaaggtgaggaggatcttcgagcgcttcgacaccaacggggacggcgggctagaccggaacgagatggccgccctcgtcgtcgccgtcaacccgcgggtcaagttcagcgaggaccagatctccgccatcctggacgaggtgttccacacctacggcgaattcatcctccccgacggcaggggcctctccctactagggctgcttcgcacctacgatgacggcgccggggacgtcgaccgcgactttctcgcgctctccctacccgccgtcgactccgacgcctcctccccggacatcgccgcaggggacgctgccgcccactcctccccgccctccggggctgccgccgccgcatcgctgctcgacgaccacgccaagccgctcggcgccggcggcgctgcgccgtcggtcagctcccgcgccgccgtcgccgcgccggcttgggcgacctcgcccaaccacggcatcgccttcgactcctcctggggactcctcgacgacctggagatactcgtcaagcgcctccgctcaaagcagctgcggaagggctccatcgacggcgccggcaacaacaacttcgactccttctccgaggccgggtggtccagggagatctccggcgcggcggattccgcatccaccgccgctccgtgggacgagacgagccgcgactacctcaccttcgtcaaggaactcgccgtgcttccgcacgcggcgccgacgcctcccgctcgcgcgaggaggcattcgacaaccacatggtcatcggccgggcggctttctgagcaccgcctcttccgagacgccctagccagcttccgccgcgcctgtgagctgcagcccactgacgtccgtccccacttccgcgcggggaactgcctgtacgccctcggtcgccatgcagaagccaaggaggagtacctcctcgcccttgaggccgcggaggctggcggctcacagtccgcggacattctcccgcagatccatgtcaaccttggtattgccatggaggccgaggggatggtacttggtgcctgtgagcattaccgagaagctgccatactgtgtccatctcatgccagggcactcaagctcctggggagcgctctctttggcgttggggagtaccgagctgctgagaaggcactggaggaggccatcttcttgaaggaagactatgctgatgcgcactgtgaccttgggtccgctctgcatgcagtaggggaggatgaccgtgccatccnntantnttnngacanaaanttgancttnaacctggccntgatgatgccttatatannaanngggggattnaacatggcacncaatgnnatntntntncggactgaanaaaatntntncntcttgancttnaacattnng

SEQ ID NO: 20282 - DNA, 4361 bp, Zea mays
  misc_feature (13)..(13): n is a, c, g, or t
  misc_feature (1927)..(1927): n is a, c, g, or t
  misc_feature (2221)..(2221): n is a, c, g, or t
  misc_feature (2261)..(2261): n is a, c, g, or t
  misc_feature (2272)..(2272): n is a, c, g, or t
  misc_feature (3819)..(3819): n is a, c, g, or t
  misc_feature (3972)..(3972): n is a, c, g, or t
ctacatgcatgtnctgctcagccgacgcccgcgacggaaatggcttggtggcttccagacgactaggcctctgctctgctgttgatcgccagcgtgaagtagatcagtatcgtcgtccccacgctcgacctgcttaatggcaggagaagagaaacaatgtcgaccagacagaccgacatcagagaggaaccggccggcggcagagccactgcggaacgtgatttgtctgcaaagaagtaggcactttacagcgtcgcgaataagagcagaatcctccgagggttattgacgggcgtgatgagccggccaaacctcctgctgctccttccttccgcggagtcaatgaggaggacaggcgcgcagggagtgcagtgacaaccagggcccgctgctgctccagctgagatggcacaactgcggtcatatctcgtccggccggcccgaagcatactacgtacacaacagccggcagctagcggcagttcatggccgctactgtgtttacctttgatgataagttttctggtcagatcctcttgctgctccagctcatcaccacccttcatttccatccgattcgaacccttgcgtgacaaggccctctgcaggtgaagagagcatgggcttacaaactcagaaagtattggcacttggccgttcaaatcttcaagtaaaggggcgcgggcatacgatcatttttggacttccggagcagcatttatcaggtggttgaggcagaccctcgatatccaacaccgcattggcggttctgtccatagctcgtgacccagccggggggcccctgcggcaaatgcttgatcacaactcatgacaagtacgaacagtacagaataccctatcagtgtgtgcgcttgcatcatctaatctaaacacatgagcacactaattaatgtgtttgacccaccgctaccagtacaacaaagcgttgtttgggaaagcacagttgcacagcggcataaaatccaagcacggtactactggatatgtataatggtatttaatatattgtgatatccttcccaacatgcagcggatatgtctatgtctatgcgcttgcatcatctaatctaaacacatgagcatactaattaatgtccttgacccaccgctaccagtacaacaaagcgttgtttgggaaagcacagttgcacaggggcataaaatccaatcacggtactactggatcagtggtacatgtataatggtgtttaatatactgtgatatccttcccaacatgcagcggatatgtctatgcgctagtattataggaacaaaacctgcagctttgcaaccatcccctggcaaaatatggcaggtggcttggtggccggattaaacagaaaaaaaaagggttcccacacgctctcgagaagaactcaagttaaaactggacagatcagttgatcacacatgctatccagctaaaactcgtgggggctaaaacaaaaggctgcacaggtttggtgtagtcgtttgttgagccgttgcaacttgcaagcgaccagtgacaaattattattaaaaagaaaaaaataggacaagaaatggggagtcagtacctgtccactccctttttctcgcagcgggttcctcgaggcagatacggatatgaaccgtgaaatccctcccacttcttccgagcactcagctgaagggcagtcttgtttatcttcccaaaaagctgaagaagttaaccagcggacctttttaattaaccggagatactgtaaaaaagacgaaaaagggatgtgaaacaaagtgaacttgtgtggtggttttctgccgcgataaactggatggactgactgaagaatccatcaccgcccattacagaaaacaaagaattttcgtttggagggcagggcatgattgcgcggagcagaatgagcaatccggcgggggggncgggcgcctcctgaccgccggtgtcggagtaggccgatccaggtccggctggaatggatctccgtccgcccccgccgcgggttcagaggaggagaagtcgatgcggcggcggaatggtatggtatcaggcgtgggagtgcggtggggagagcctgcgcgagatgcggaagcaatgggtgctccttctacctgccgccgtcccgatgcctcggctttatcgacggactggggggaggggaggcgcgggcaggaccagacggagggagaggtgggggaggtggcgaaggcggaagngcaagcggaaggaagaagagtgcagtctggagtggtaaanggcggcaggancaggagcaggacagacaggaagccatgaagggagcaggaaggaggcggtttggtttggctcacgaggcgctctcgcccgcgccgcgaagaccagttccatggaccggagccctgtagcttgtggggggaggatgaaggggattggtcagacggccatgggcacggtgcagccgagccagatcaatggcgcggcctgcaggtgggggccagccgcccagcacgggcgcggcaatcgaaggcggtgtcagtgagcgagccgtgttgggctggcctggccgtgtgcgtgacggcgtgggggccgggcagccccgtgccgctgctcctgcgactgccagctacgtaccggacgaccagatcaccagacgtgagggcagatgatttcggtattccgtccgtcacgtcgtcgccgcgccggcgccgcagtattcgccatttcgttgcgtgtcctcgcgtttgcccgcggcgcggttttgggtcgtgcatatggacaaaataaggttcggtgaccgagagggagagggatccatcatccattcgcaatggcaacgccgccgctactgtccgggtcgtcgcctcagatactctaacagtgcgtttggatgttggaatttagactcggaattcagaattggaattgacaaacccgaattctggtgtttggatggtcacagtatttggaattggaaatccaccaaattccagccggtattcaactctacacacgcctccactctccaattccgaccctccaccctctgatttgctcggaattgaactggatttggtattggatctgatttccaaagccaggctgatttggtattggatccaattcaatttccaccagctccaattccaacatccaaacggagcataagtgtaaaaggagttgtgtttccaataaaacatgatactctttctagagctcttcctgaaaaaaagagggagagctagagtttgcgttgaagccctaccaaaagggaccttaatatctcataaagttttaaattatttagtcctcttataatttatttttttgaataatattaaaccctaaatctaaaaggggtttggaatatagaaacagtagaataaaatacgtagtttggtgcactgctcataggtgatctggttcgtggcctgtctatttgggccggccactccggtatttccagacaatagagggggagtgtgacttggcccaaagtaatgtatcttttgcttacatatttagtttcgctacactgtttgtgcctaatactagatggctctatctgcagggcgcgcactgatccagttgtgtgaacactccctttggtggagtcttgtatgatcaccagttcaccactagcaagaagatcaacgacaatcttaggcttgtctcaatagccttgcatttacttttccatattaatctgcttgtgtcatcatcttgtaataaaaatcatcgtgtcatcatctttctgttggtttgcaattttctatcataagccttgtattcactttttcatattaatctgcttgtgattgtacttgcttagcttgtntaactaagttgtagttgctcttctaaatagatatacttatgtagtgtaactaggtaataatagtgctactctagtgctaatgttgcttaggctttgtacgttttgctcatgcatgggtatgtgtaggggctcctaatgtgcttagagtgctanatgcatatgtttgtgaccttgccaactaaaattatttaggtgattttttacagcgtattaccttaattattttacttactatcttttgtaaggtgtttgtgataaatagaggggtatagtctcaactaaaccgtctagtttaattttgtttttatattagttaacatacatacaattagttttataaagaactattcacccttctctaccctctcgatcctacaatacttctcttgtaacaggcgccctgcaaaatctaaaaaaccctaacctccatcgccaccgtgtcaccttagcgaccgtaccggaccttaccgctaatcgccatggtacatgagacaaactagattgtacagtgtagacagtggatgctacattaaagaatttcg

SEQ ID NO: 20283 - DNA, 1661 bp, Zea mays
cccctaattatggtccccgacagtagcccccgagcctcgaagggagtgttgacactcgcttggaggcttttgtcgcacttttttgcaaggggaccgacctttctcagttgtgtttgtgggtgcgcgcgagcgcacccgccgggtgtagcccccgaggcctcggaggagtggtttgactccttcgagggcttagcgcgtttcgtgatgcttcggccggtctggttgttccctcatgcgaactggccgtagcccgggtgcatagtcgagtcccaagttctcgggctggtatgttgacgctgtcaacggtttggccggagccgggtttgcgagagcagcccccgagcctccgcacagagcgagaggacggtcaaggacagactcggcttttttacatacgcccctgcgtcgcctttccgcaaggaggaggggggaaagcgccatgttgccctcggagggcgccgaacatggtgtctccagtgagttgctaacgggtaatccgagtggacgcccgtgccccattcgttaggggtcggctagtggcccggaggcgcgctccaaaagtacctgcgggtgatttgccggacccggtccccttttgacggggtccgagggctcgatgcctccctctggtgggattccgttacaaaatcgttcccgtcggtctcggaaatgtcctagggtacctcgggagcgtagcccgagccttggttatgtatcgaacgtacccagggtcatccctcgctctgcgtgctctgaggcggctgtcagaacccttcgggggccagcctacgaacccctgatcagtagtgggcgcggagcccgagtggcctgaggcggccgttgaacccttccgaggggccagccttcgaacctctgaccagtagtgggcgcggagcccgagtgctctgaggcggctgttgaacccttccgaggggccagccttcgaacctctgatcagtaggggggctcggggcccgcttccttcgcggagaaggatccctttcggagtatcccctttcccggtccctgtggcaagagagagaaagaggaagtggaaaaggatacgaaatcgaatgacgtggcgcaccttttttgacgcggtcattatggcggaggtgaagcgtcgcctgcttcgcccccctaaggtgccgcctgtcctgccgcagagttaatgcgatgggtcgagtggttcgcgggggcagccgttgtgcgtgcgcgagccgttcgaggaacggaacaccggtgcgtcgtctttactccatgggagagggctctcttgctgtcccaggaggggacgtgagtctgcaggcgacttgactgctgcttccacccgtctgccactgccattactgccggcccatttctggccgtgtcgaccgtcgcgccttctcccgcggctgactgacccgtgatcgatggtgatcgatgtgctcggttggcactgtcgggtcatgcgtagggtcgcctcgagtcgtggcaccagttcagcagtcgagaaggcgcggtactggcgcgagtggcggtgcagtttctcgctcgtagtaaccggcgcgccggttacatgacgtgtgggcctgggcctccatgctggacgcgtcgaagtcgaatgggtgtgcccccttggtgcggttgcatgccgcctgcatggcggtcgcccttca

SEQ ID NO: 20284 - DNA, 1465 bp, Zea mays
gactcctaccgccgggccggccgcgcggggccggccggcgaaggcctatttcgtcgtctctcgctccctcggtccttccttcacccatctcacccgcgacccgcccctttcccctaagccatctccttcctcctcacctcgccatggcgttcttctctcatcaccatctccagcagccacacgcgcagcagccagtgctcccttccttcaggaacgcgctaccggtgcctgtggatggccagatcccagcgcccctcaccttcttcaacccgccgcctgccttcccggagcaacccgcgcaggcacctctggtggatgcggtgggcttgacggcagctgcggggcttgggtggaggcagccgagggagcaggaactgcttggggaaaactcccagatgtcgtccattgattttctgcagacgggctcggcagtgtcgacggggttggcgctgtctctggaggaccggcgccacggcggcggcggggctgggaactcctctggcgattcaccgctgctcctgctgcccatgctggacgatgacatctcacgcgaggtccagcggcttgacgctgatatggaccgctttattaaagctcagagtgaacggctgaggcaatctatactggaaaaagttcaggcaaagcaatttgaggcactggcctcagttgaggacaagatactcagaaaaataagggacaaagaggcggaagtggagaccataaacaaaaggaactctgaactagaggaccagattaagcatttgggagtggaagttggtgcttggcagcatagggccaagtacaatgaaagcatgatcaatgcactcaagtacaacttggaacaggtttgtgctcaccagagcaaggatttcaaggaaggctgcggcgatagcgaggtagatgacacggcgtcctgtcgcgatggtggtgctatcaattttcaactgactccgaaggagaacagacaaccgaaggatttgacggcttgcagggtctgcaaatcaagtgaggcatccatgctcttgctgccttgtcggcatctttgtctatgcaaggagtgcgagagcaagctgagcttctgccccctgtgccagtcctccaagatacttggcatggagatatattatgcgtagaatagaatttatgtatcacatgagtatcgtacgagatactgctatgttaatacgattaatctattgccaaactttagaacctatgtaccagtaccactatgacttgccactggatcaaaagacactgccgttgatggtagatttaccgcagcaaatttctatgaaaaacgcattgttggtttgtgcccctagtagacttggcagagtttgtcttgtgcgactgattgttaccgtctatgtatttccattagcagaccctttcaggcagtgtttggaactcaggaaatttcaccagtgctgtgttttcgctgctaaattgaattgatttatgt

SEQ ID NO: 20285 - DNA, 1314 bp, Zea mays
atttttttttttgccatttgccacccccaactcccgagggcccatttcgccgtctttcactccatcaccccctctcccccgtccctttcccctcagccctcagccctcagccatctccttccccctcacctcgccatggcgttcttctctcaccaccatctccagcagccacacccgcagcaggcaccgcccccgaatcagcagcagccggtgcttccttccttcaggaacgcgctaccggtgcctgtggatggccagatcccagcgcccctcaccttcttcaacccgccgcctgccttcccggagcagcccgcgcagacaacgctggtggatgcggtggggctgacggcagctgctgggcttgggtggaggcagccgagggagcaggaactgcttggagaaaactcccagatgtcgtccatcgattttctgcagacgggctcggcggtatcgacggggctggcgctgtctctggaggaccggcgccacggcggcggcggggctgggaactcctccggcgattcaccgctgctcctgctgcccatgctggacgatgacatttcacgcgaggtccagcggcttgacgctgatatggaccgcttcattaaagctcagagtgaacggctgaggcaatctatactggagaaagttcaggcaaagcaatttgaggcactggcctcagttgaggacaagatattcagaaaaatacgggataaagaggcggaagtggaaaccatcaacaaaaggaactctgaactagaggaccagattaagcatttgggagtggaagttggtgcttggcagcaaagggccaagtacaatgagagcctgatcaatgcactcaagtacaacttggaacaagtatgtgctcaccagagcaaggacttcaaggaaggctgcggtgatagcgaggtagatgacacggcgtcctgtccctatggtggtgctgtcaatttgcaactgatgccaaaggagaacagacaaccgaagaatttaacggcttgcagggtctgtaaatcaagtgaggcatgcatgctcttgttgccgtgtcggcatctttgtctatgcaaggagtgcgagagcaagctgagcatctgccccctgtgccagtcctccaagatacttggcatggagatatattatgcatagaatataatttatgtatcacattagtatcgtacgagatactgctatgttaatacgtcaatctattgccgaagttcagaacctatgtaccactattgacttgccactggatcaaaaaaagactgccgtttatggtagatttaacgctgcaaatttctttgcgaagct

SEQ ID NO: 20286 - DNA, 3207 bp, Zea mays
  misc_feature (3185)..(3185): n is a, c, g, or t
aattcggcacgaggcacccatccagctgctgtcgccgcagctgtaccgtactgccacccctcgtgccggtcgtgcccacccatccaccgtcatcattagcatcgtctcctctcgttagcagtcgcaagtagccagcagtccagcacacgactccgccgcccctttccgctccgtcctcccctcctctccgctctccatccccgcccggcccccccggcattcttgaactccccctttcccgcatcaaatcccctacccgtgccgtcgctgcgcccgcgctgcgtgcccgaattttcgccgtaatccggctggtttttcccgtgcgcagcgggccgtaatggcgctgtccgcgtccgcggcgtcggccggccgggggtcgcgggcggagaaggtgaggaggatcttcgagcgcttcgacaccaacggggacggcgggctagaccggaacgagatggccgccctcgtcgtcgccgtcaacccgcgggtcaagttcagcgaggaccagatctccgccatcctggacgaggtgttccacacctacggcgaattcatcctccccgacggcaggggcctctccctactagggctgcttcgcacctacgatgacggcgccggggacgtcgaccgcgactttctcgcgctctccctacccgccgtcgactccgacgcctcctccccggacatcgccgcaggggacgctgccgcccactcctccccgccctccggggctgccgccgccgcatcgctgctcgacgaccacgccaagccccgctcggcgccggcggcgctgcgccgtcggtcagctcccgcgccgccgtcgccgcgccggcccggccggcctcgcccaaccacggcatcgccttcgactcctcctgggggctcctcgacgacctggagatactcgtcaagcgcctccgctcaaagcagctgcggaagggctccatcgacgggagcggcggcgccggcaacagcaacttcgactccttctccgaggccgggtggtccagggagatctccggcgcggcggattccgcatccaccagccgccccgtgggacgagacgagccgcgactacctcaccttcgtcaaggaactcgccgtgctccgcacgcgcgccgacgcctcccgctcgcgcgaggaggccttcgacaaccacatgatcatcggccgggcgctttccgagcaccgcctcttccgagacgccctagccagcttccgccgcgcctgtgagctgcagcccgctgacgtccgtccccacttccgcgcggggaactgcctgtacggcctcggtcgctatgctgaagccaaggaggagtacctccttgcccttgaagccgcggaggctggtggctcacagtccgcggacatcctcccgcagatccatgtcaaccttggtattgccatggaggccgaggggatggtacttggtgcctgtgagcattaccgagaagctgccatactgtgtccatctcatgccagggcactcaagctcctggggagcgctctctttggcgttggggagtaccgagctgctgagaaggcactggaggaggccatcttcttgaaggaagactatgctgatgcgcactgtgaccttgggtccgctctgcatgcagtaggggaggatgaccgtgccatccaggagtttcagacagcaattgatcttaaacctggccatgttgatgccttatataatcttggtggattgaacatggacgcaggtcgttttgtacgggctgcggagatgtatactcgtgtgctgagcatccgaccaaaccattggcgtgcacagctaaacaaggcagtggctttgcttgggcagggtgagtctgaggaggccaagaaggcactcaaggatgcgtttaagatgacacaaagggtggaagtgtatgatgctatctcacatttgaagacattgcaaaagaagaagccaaagccttccaaaggaaaagatgacggtcaaggggagcaggcttatgttgttgtggaggcatccaagttcaagagggttgggaggaagactaccttgcggcaggatttggccaatgctctagatataagggcctttgagaggatgacaaaactaggtcactgcgatgtggagcttcttagaaaagagatgaatgagactgatgtccccgtatcttactcgggcaccggcatccctgagaagtcaatacgcaaagcagctcttgaggttattctccgcaggctcctctcttttctcaagccagacacctttcagggtgccatcaaggcaatcaacgaaagaattctctctgtccttgatgctcctggctctggtcgtgttgatctgggtatgttcttcgccaccattgctccaatctgttctggccctgtggatatgcgcaagcgtatcgtctttgatgcactcctttggcgtcctgctagcgaaggcagcaatggccagataaggaggagtgatgcgttaacctacattaagcttcttcgagctgtttatatacccacgcatggggctagtgacatgctcgaaatgcatggggagtctgaccctaccatggtatcatacacggaattcttagagatgttcaatgacccagattggggatttgggatcctgagcactctggtgaagcttgaggagagtgatcacatacgtcacggtcgccacacatgctccatctgcctgtaccctatcattggttcacggtttaaggaaacaaaacactccttcagcctgtgcaaccggtgctacagtgaagggaaggttccgtcagcgttcaagttggaggagtacaggttcaaagaatacggtaacgaatccgaggccctcattgataagtgcatgtgcttcaatttgcattctaagaagctggaagctgatgcttgatcattcaaactttgatctcgagtgctcaagcatgaatctgtgtatttacctaggtgcaaagatgtctagttagctctcccactcccttgtaaacaaagttgctgccattcagggtttctctagatgtgtcccggttactaatatatgaccgtaatgtgttagctgttgttttaagtgtacgggaacgagtaaatgtgaattccatacactctgtcgccccagtccaattcagccttgttgaaccttgcatatttttgtgtgagcaaaaacaattttgggagtctcttcaatgctttttgcctttcgtctccgngggggggacccggtacccatat

SEQ ID NO: 20287 - DNA, 4175 bp, Zea mays
cagttcaaatttccaaccacattcattttgcatggttatcttcattgaggattacacccttccataaaaacacaagaaatttttattttttagggagatctttagcttccaaaggagagaaaagtctattttgttgagcccccaaagaaaactctctcgagtacaaatcagctgtggccaacaaattttgccactgaacaaatttttctccactcaccacattaaaaagatttagatattactcttttagcgatatattcaaaggtcatccatacacaaaccaccttagccatcaactatctaaaattgaccctgattaaaaaaattcatctttaatcttcatgaggtgcatagcaaatacttgtttttgagaatttgatgtcaaacttcatccttattgatgatcatttgctaagtaagcaaatattattggtagctaggttagcaacacctaaaccaacaaagtcttttatttgacaaataattttgtagctacagacagggaatttagaagacttggatgcttgatttttcttatttccatttaattttaagttctgtggaagatgctgtacggtaatgcgtgcttgctcgccaacaaaccgacggatcttgagataacccagttgacgttcagatgttgatgccactaaaaagtgtttccccagtaaccgcaacgtatctaacaactatgaatttgttttgggaagcataagccaatttcaaacatcgatgctttgacaattgtatattcatctcatgcattgatgattaatgcatcgaggaattgcattccatgtgataaatctccaaaggctagatagttcaaaacaatttagattatagtcagaacatattataatctcaaatcctaaactcgtacgagtaccatttagcatttaaaacctaaagcaaaggctagatagttcaaaacaatttagattatatggtcagaacatactataatctaaaccctaaactcgtacgagtaccatttagcatttaaaacctaaagcatttatagcctgtactaatggaattattttaattttaaccgttcttcatttgagcataatcatctcggatatcaaccaacaaggaagaataatactaaactttacgcaaaatcagaaacaaattctataagacacggctcacacacatgtgtccaacaaatcctccacgagatcagagcgcaagcctccctcgcggacgagatctctgggtacatccctctcgcaaacgaagaaattgccacaaaacatggcgaggttttgggacagagtgcgtttgctgtgctcgaacatcaacgaaacacaacccaaaaaggacgaacagttctttcttttagaaagtagtagaaaagatgtgccagccgaaagggcccagaaaatcaccgagggtgtcagatccaggtgagtttaagctggctcggattcaatctcgcaagatggcagtatgattgccgattgcctgaaccggatccagttcaaggtccaaacaagaagctgatcttgcaaaccacacacgatttttgtctagatcaacgaaaaattcaacacaaaaccactaatatggcgcaatcaatgaaaaaacaacacaaaaggattgccaagcttaacggttcacaaaagctagaagggaacggaaacacgtcgaccaatcgagtttggagaatcgaggatggcggcgccggcgaggtgaagggtttcggccagtagaggggatatatatgcgcacgggcacgagggttcctgattagggttatcacgtgctgacttgggccggcccaatgttagctcacatggaaacaatgggccgagcggggagtgtgcacagttcaggaacggcccgttgaaaggctaaaaaaaatactaatcgaacgggtttcccgagccgagccgaagccgatccaaaatccgaccgttgccaagagcgctcccctaccctttttcccctcctcgcagtcgcagcagcagcgcacaccagaaaagcttttctgcctcctctccaccttgcttcccgcaactaccacgcacgccgaatacttggcaagaagaaaccctttctcgtcccgttgaactggcgccgtcgactccaccggggcacgctgtcgcgggttgctctccggtcctcgttctccttgctgctgaatccgctagtgggggatcgacctgatttctcctgtcctggtaaaccctagcgctctccccctccattccttccttttttttttgccgtcattcgctgtgatgtgaaccactgaagcgaaagcctaacgtacttcggtccgtttggtctattcttgggatgccctgtatgtggatttgttcgctgttccgagcttagccctccgtggcccttctcttcttgagggcacacaaggtctcagtggggttcataatccatcatttaggagcggttcgaagactctttcattgttaatttgtttgcagatgcagatcggatgcttatgcaaaatgccagttagatcttgattggcttgatagtagaggatatgtgcattttgaacttttgatgttgttgggttcactaatttagtggtgcttccgtctatgtcatctcaatggaaagtgctatcacataggtgtgcaaataaagtctgcacagccacatcaccaggatcctatctaggcactgtctccccttggtaaatcgtactcctcggttcttttttatttgtcacggtttagtttaaaaatgaactatcgggtgacaaatattctagaatggaggtactcgttatgcagttttgctacatggaatttcataatcgacctctgtaagatgaaatgcaactcttcccctggttgtgtacttctgaattctgatccagtttagtatgtttgcagtttagtggtacttcaaatccatattaaattaagcctctcagagcttatttcaaatcttgttcagtttctgtacatcagaattcagaaataccgtatagaagtcagcatttattatttctatattatgattagtttctctttatcagtcaattggattttagcccggctttcaaggtagagaaagaagctgtctggtccatcatggccttcccaactccagcttctgtttttgttgacgagaaccaacagataaatagaggtgagattgcatttttatcaaaaactaattcgtgaaaaggatttttcctgaattagatacatctcttttatctaaatgttcaggtaagagggctgctggatcaaggaccaaagggctgaagccgtcggagaatcctgggaatctagagaggagagctcttcaggatttgtccaactttgccaaaggcacaggtttgaagggcacttccaccctgaaagagaggtcccagcgcaaggcttttagtaatgtgaccaacactattaaaggcactgctttgaaggacaggcccatcacgaaagagaaatctacccagaaacagaggtcacagaacccagtgaaaatattatctgatgaagatatcaaactgtgtcatgagtgggctaaggatggggtggaagggtttcactcaacacaaaattattctcagaagttggataaggatctgctagccaaacgtgtcaagaagaaagtggcgtcagtaaactcagccttgcgtggttggtcagatacggtatttgattctctgatgtttccagctagggaggttttatatgaaccaaaagtgctggagctggaacctgagattctcccggacatcagttgggatctccctagttcagtagatggtaaagcaaagctggatgaagactgtcttgcctatgatcagcttgaccagtacccatctttggagaacaatccagttacatttgagctgagagacgagccagcgatcccgcagctgggagtgcattgaagaatcccgcagctctgcttgctgctttgctctagaatgctagtaggtcttgaacccctgatgtttttctccagctatgttctggtggatgtgtgggtggtgtaggatttcacagtttgatcactagtgcctgatccagcggaagcgacagcgcttcctatgcttgctgatgggcgatggttgtggaactgctgatggtataattctaatgttttcagcaaaacaaatctatatggtctctatttattctcctgaatcgtatgacttggcagtgcttgtcctaaatata

SEQ ID NO: 20288 - DNA, 1324 bp, Zea mays
caagagcgctcccctaccctttttcccctcctcgcagtcgcagcagcagcgcacaccagaaaagcttttctgcctcctctccaccttgcttcccgcaactaccacgcacgccgaatacttggcaagaagaaaccctttctcgtcccgttgaactggcgccgtcgactccaccggggcacgctgtcgcgggttgctctccggtcctcgttctccttgctgctgaatccgctagtggagatcgacctgatttctcctgtcctgtcaattggattttagcccggctttcaaggtagagaaagaagctgtctggtccatcatggccttcccaactccagcttctgtttttgttgacgagaaccaacagataaatagaggtaagagggctgctggatcaaggaccaaagggctgaagccgtcggagaatcctgggaatctagagaggagagctcttcaggatttgtccaactttgccaaaggcacaggtttgaagggcacttccaccctgaaagagaggtcccagcgcaaggcttttagtaatgtgaccaacactattaaaggcactgctttgaaggacaggcccatcacgaaagagaaatctacccagaaacagaggtcacagaacccagtgaaaatattatctgatgaagatatcaaactgtgtcatgagtgggctaaggatggggtggaagggtttcactcaacacaaaatgattctcagaaggttgataaggatctgctagccaaacgtgtcaagaagaaagtggcgtcagtaaactcagccttgcgtggttggtcagatacggtatttgattctctgatgtttccagctagggaggttttatatgaaccaaaagtgctggagctggaacctgagattctccgggacatcagttgggatctccctagttcagtagatggtaaagcaaagctggatgaagactgtcttgcctatgatcagcttgaccagtacccatctttggagaacaatccagttacatttgagctgagagacgagccagcgatcccgcagctgggagtgcattgaagaatcccgcagctctgcttgctgctttgctctagaatgctaggtcttgaacccctgatgtttttctccagctatgttctggtggatgtgggtggtataggatttcacagtttgatcactagtacctgatccagcggaagcgacagcgcttcctgtttgttatgcttgctgatgggcgatggttgtggaactgctgatggtataattctaatgttttcagcaaaacaaacctatatggtctctataaaaaaaaaactgaatcatatgacttggcagtgc

SEQ ID NO: 20289 - DNA, 2306 bp, Zea mays
  misc_feature (2249)..(2300): n is a, c, g, or t
ttgggaccctcgaggccggccgggtatatctgtatcttcaaaatggaaacccagagacacgaaggcgacttgcagtttattgcttgaaggatgcttatcttcctcaaagactgttagataaattgatgtatatctataattatgtggaaatggcgagggtcactggtgttcccatttcgtttctactttcgaggggacaaagtattaaggtcctctcgcaactactcaggaaagccacgcggaaaaaccttgttataccaaatataaagggtcaagggtctgggcaagatacctttgaaggtgcaactgttttggaggcaagggctggattttatgagaagcccatcgcaactttggactttgcttctttgtatccatccatcatgatggcatataacctttgctactgtactttggtgccccctgaggaggcccgtaaactcaacttacctccagaattcgtcaataaaaccccatctggtgaaatatttgtaaaaccagaactacagaagggtatacttcctgagatccttgaagaactattagcagctcggaaaagggcaaaagcagatttaaaggaagcgaaggacccactcgaaagggctgttcttgatggtcgtcaacttgcactgaaaataagtgcaaactcagtttatggtttcactggagcaactgttggtcagttaccttgcttagagatttcttcaagtgtgaccagctatggacgacagatgattgaacatacaaaaaagcttgttgaagataaattcacaacagtaggaggttatgagcatactgcagaggtaatttatggggacactgattctgtgatggtacagtttggtgtttctacagttgaagatgcaatgaagttaggaagagaagctgcagattatattagtggaacctttaccaagcccatcaaccgggagtttgagaaggtctattttccttaccttctaatcagcaaggcgtggtcggcgccgtggtactggacgaatcctgagaaatttgacaaaatggatgcaaaaggtattgaaactgtaagaagggacaactgtttactggtaaagaacctggtaaccgagtgccttcataaaatactggtagaccgtgatgttcctggtgcagtccaatatgtcaagaacaccatatctgatctattaatgaatcgtgtggacttgtctcttcttgttataacaaagggtttgacaaaaacgggagaagattatgcggtaaaagctgctcatgtggagcttgctgagaggatgcgaaagagagatccagctactgcacctactgttggtgaccgtgttccttatgtaataattaaagcagcaaaaggggcaaaggcatatgagaaatcagaagatccgatttatgttttggacaataatatacccattgatcctcaatactaccttgagaaccaaattagcaagccacttttgaggatctttgagccaattctgaagaatgccagcaaagagttgcttcatggaagccacaccagatctgtttcaatctcaactccttccaatagcgggataatgaaatttgcaaagaaacaattaacttgccttgggtgcaaagctgttatcagtggtgccagtcagacactttgctcacattgcaagggaagagaagcagagttgtactgcaaaacagtagcaaatgtttctgacctggagatgctctttgggaggctatggacacaatgccaggagtgccaaggatctctgcaccaggacgttctctgcacaagtcgggattgccccattttctatcggcgaaggaaggcacagaaggatatgaccgaagctaggctgcagcttgatcggtgggacttctgagcttggaaattctcacatggctgcctgcgtctgcttatattgctgtggaagacaggaagctaccgtcgaccgcatcataatgcatgtgaagatgagactggacttctgcgagcatccagtcacacttgcgtccgtgtcacgtagactgacttgccagtacgattcattagcatgttttctgcttaggttttgcgtaatagtttaggtgtgagttggtacttggtagatggtaggtgtcaccttcctgtggctagtgccgagaaaaatgcttggtcctgagatgaggtgctgattatgtacagggcagaagcaatctggagcagttattatgtaacagagtgagacgagacaatttgaatggcacatgagttctctttctgtctaaccccccccacnnnnnnnnnnnnnnnnnnnnnnnnnnnnnnnnnnnnnnnnnnnnnnnnnnnnccccgg

SEQ ID NO: 20290 - DNA, 1457 bp, Zea mays
acattggttgttcttgcttctgcgaaatttctcttataagtccaattaatgcccatgttgaattacatcaggacattattactctacagcaacgagtcgcatggtattggtagcctaatttacaaaatatccaggacctcggcatgcatctgaaatggcagttcatctcactagattagtttctacaggcaaaaagaaaaaagtaccgtcacatcacaaaaggtccgggttcagtttgcttgctcacattccaaatgatcagaattttgtcgctgtttcaggctttcagcaatctggtggtcctcttctcggagctaccgcaatctgaggtggccttgtgcctaccaaacctttggcaagctccgagctcctcaaaaccctcagccttttagcagttgacacaaacacattccacggcacgtcccctaccagcatcctgtctccttcgttgtcttcgtagaccagggtatattcgccagatccatccaacaattgagagaatatctttccagcagttggagacatatccttttgagcttgaagaaaaccgtggaaaagctctttgacgcccagtgatagcctctcgtagctgtcgtaggctgcaaggtctactttccttccgatggggatcccgtccatgttgatttttacgagagggttcttcttgcaggcaggcttctccttcctgctagcttcgctgttctgtggctcggtgggttgtttggaggagcttccatgatgatgatgagcaaggtttctcctgaaggatctgaccgggggccaaccgacaaccggagccgaaggccttcttcccagctgcaggacgtgtgctccgctgtgcacggtcgcagcaggaggggcgtgctgtggcgtcggcgggcagcaggaccctttctgtctctcactcgcggccgcggctgccgtcttctcgtccagtgctagctcgttcccacatccagctccggcctgctgctccatccgctcgtcgcggccttctgtcttggcctcgacggcggtgtcgaagaaccccctcttcgtcccagctgtagctgcgtctaccgcaggcttggaggggttacgtgggaagcacccgagcgagagggtcggggtggtcgtcgtctctcgctgtagtacgcctccatctcttggcacggtagctgtcgttccttcttctacgagagtgagacccggaggcccgagcttgagctccagcttcgcgtcctcctcgcccccgaagccgccgctgttcttcgaccttcccgcgtcttgcgcttccctccccttccgttctttcccgtccgggatgagatctagcagccgaggaagaggtggtcctcttcttcctccggagtctcccatggagatggatggagtggttcttggtgcactactggttcggggacttgaggtgaggagagagagacagtcaaaaagaatgacaccaccgtacttgccgg

SEQ ID NO: 20291 - DNA, 640 bp, Zea mays
aaaaaaaagagagttagaaagaactatatttttggaatggatggagtattttttttagggaaatatgaaatgccataatacattgtaagaatggtttgtgggctgacagaaaacatgtttgtttttcttctgtaccattgtaagaattgtgtttcacgctttggaacatagtaggccattgtgccctacccttgactgtcatctagacatcgacgggacttactttgggacaacattcccccacttgttcctgatgacatacccgcatttgaagccccagaagccgctgcagcaatacgttcccagggtatttgggttcaaaatccgtaagccatgacaaatttgaaggttgaatgtataaaaggttcaaatagcgccctgttatctgctggccccgcagtgttcacacgacacgtcatcggaatacacctgacccgcggctgacctccctagtctggtttcttgctctggcctgaaattctgattgatgcttgtggtttgtttagcctagtgaatcaatccatatttttttacgatcatacgtattatggctttatggtttacaaccatctaatttttgtggcacggttcatattcgttttttactctgattgtttactcgttaaaaaaaaaaaaaaaa

SEQ ID NO: 20292 - DNA, 1516 bp, Zea mays
actagtctacaagattcaccgtgaaccttagcagcacaaagggcaacggccgcctgccgctccaaagcagcccgtggttacgtcagcgcccgcgtactgctcccttcttcctcgttgctccgcccccttttgtcgtcgcgtcctcctctcgaggcctcggcagtcggcacgaggacgcgcgatcccgtcaccgctcacctccttctccaaacactgactccgcttcccgtccccatcccgctgcgcaagatcgggaggggacgaagagaggtcgaccgggaggagatgcaccgagaccgaggcgtctctgcggcagcgatacccggtgaccggaagcggatcggcgagcctatggacagatcgtctccatctacgtcgtgggggttctccggagggcgcgagaaggagcggatcggcgtgggcaagcagccggagatgcctcgctccggcggcggatccaccgccatgtccaagagcaagctctctgacgaatcagaaactgacagcgaagaatcagatgtgagtggttctgatggggaagatacttcgtggatttcatggttctgtagcttaaagggcaatgaatttttctgtgaggttgatgatgactacatacaagatgatttcaacctctgtgggctaagcaaccaagttccatattatgactatgcacttgatctgatattagatgttgaatcttcccatggtgatatgttgacagaagagcaaaatgaacttattgaatcagctgctgagatgctctatggattgattcatgttcggtatattattacaagtaaagggctgtccgcaatgctggataagtacaggaacgttgagttcggcagatgccctcgagtgaattgcagcggccaaccatgccttcctgttgggcaatcggatgttcctcgttcaagtacggtgaagatttactgccctagatgtgaagacatctacactccaagatccaaatatctaagcaacatcgacgggacttactttgggacaacattcccccacttgttcctgatgacatacccgcatttgaagccccagaagccgctgcagcaatacgttcccagggtatttgggttcaaaatccgtaagccatgacaaatttgaaggttgaatgtataaaaggttcaaatagcgccctgttatctgctggccccgcagtgttcacacgacacgtcatcggaatacacctgacccgcggctgacctccctagtctggtttcttgctctggcctgaaattctgattgatgcttgtggtttgtttagcctagtgaatcaatccatatttttttacgatcatacgtattatggctttaatggtttaacaaccatctatatttttgttggcacggttcatattcgttttttactctgattgtttgcccgttcgcttactgcttctacactatggattgcatctgtaacaatccaagaacaaatcagttattgtgtgccgcatttacttagattgtcaaaataggagtatgatgatggcatctt

SEQ ID NO: 20293 - DNA, 1530 bp, Zea mays
tgttgtgcatgtcgtgcgcccatgtccccgtctcgtcccaacaaggagagcgagcgtgcgagttttcccattttcttttcttaatagctttaatcaggtagagacaactcgactatttaagttaaccttactcctcctaaagtaacaagatggttccgaagttaccaccatattatacatgtgtgagtgagtctttggaatttatagaaattattatttgtgccaagcccaaattatttgtgttatggaaattcccaagttatttaattgtgctctgcagtagacccaaattaaatagcttctaatatgtaaattaatattaatggaaatgaactgaacttatatcccggtatcataatcattttgatggtagcatatagaacaaaatatatttactcattctcaagtgtaactgctatttgcaactactagagcatgcaatatttctttcgaagagattaacgtgagaggaaacatgcgtgttttgccaatacaataaaatatttctcagtagcaacttctaagtaacaatatttatccatctatttttattcttttccgattgatttttttgtcagaaaaatcaaagaacgggaattgaatttgtctcagccacaaatgacatagaaaatattaatccaactccaacacttgcaaaaaaaaaattgcaaaccaaccagctaacccaaccctatttcggtcactcacgcacggccagcccgccaattgaatgagccgccgcccttgcttcgctcgcgaccgctcgcgctgccgcaccagagcccctatggcgattggcgctctcgacccgggcgggcggccagggagagatcaccggccgtcgagcgagcagtctcccaattccacccaataactaataacatctcctcgaacgccaggttccttggaccactatatccaggagcgacgaagtgatccacccgccagccatggagatgaagaaggtcctctgcgccgccctcgtcgccgccgcctcggccaccgccgtgctggcctcggtcgcctccgaggcgccctccgaggcgcccgccggcgcggccggtggtgcggctggccctagcgcaagcggcgccgccgccgccgccgtgcccgccgccggggcgctcgtcgcctccttcctcgcctactacctccactgagcgacgacgcgcggggcggcaacgttgggatgcatcgtgtttggttcatccgattaattaattgttttttttatttacgtggtttgcgattggttaattgtttgtttgttcgttcgtttcgtggtcgtgtgaattgtcgaagggtttgttctgtaatcgtgactcgatgctaatattattatgatcccaattttattttaaaaaaaaaaaaaaaaaaatagccgccgaacgatgggcgcgtgctgacgtggtttggtgaatctgttaaactcctcccggccggccattgttcgaatcagatacatttcgctttcatcaaggaaaagaaaaacgaaattgatgcatttttattccacacatcgaatactgc

SEQ ID NO: 20294 - DNA, 1173 bp, Zea mays
ctatctgcatccatctcttggccacacccactgaccgcgccacaccacacctgtggctctccgcctcgagatgctttacacggtgtagctggcaagaagccaggaaccttccctgttccctcccgggcgcaaaggggctcacttttaatttcctcgagaggggactgcctcctttctccggcggcaagccttctcctgccttgttgcctgccactcgggctgtcctccttcttgattcttggcaccgtcggtttaatttcgcgaaatggcggcaggggtgtcgctcaagatggccggctttactgcgtcgtgctggccggccgcgagtccgctgccggcggccagcggaggagggcacaggcagcagctaacatccctcactctcggtacctgacctgaccacgagagcaacatgggcggaggacacgacatgcacgggcagcactacggccacaacggcggcgtgaagggcttcgtgtccaacctcgtccacggcggcggcggccatggccatggaagcggctacggccatggccatggaaacggctacggccatgggaatggcggctacggcggcggccacgggtaccctcctcccgccgccgccggcgcgtaccctcatccgcacggcgcgtaccctcacccgcacggcggccacgggtaccctcctcccgccacctaccccgcgcactcggcgcactacgggcacacggggtcgtaccacaccagccacaacagctacggcggcggcggcggccaccacggcatctacggcggcggcaagcacggcgcgttcggcggcggcaaccgcaagagcggcggcggcaagttcaacaagtggaagtgaagcgaccgaaacgaatcaaaacaacaccctcagtctcgcttcgcacacgtgcacccgcacacgaatcctagtgctacataataaagtgcaagcaggcaggaggcgtacgtgtgcgagtgagtgctgctgctgcggcgaccgtgtgaccgtagtcgttatttgtgtgtacggaataaagtggtgagcgctgagacgtgcgtgtcagcctagtaataactaaaataatggccgtgttcacgtaacgtgctcgccgtatgtaccatcgtgtgtaccggccgtacgtatgtacaagccgagtgcaataatacagtactatgtgtattatt

SEQ ID NO: 20295 - DNA, 1707 bp, Zea mays
tctatattttataaaactatatacatattttaaaacatgggttattgcgttcttgctcccactttgattccaattatgattttgcccatgcttttcaaactttgtgatattttgcccctacttttctcagatgaagctgaaaattacccctgttttgtgaatttaccccactttcctccgcaaagtaagggtaactttcagctttaactaagaaaagtagaagcaaaattataaagtttgaaaagtagaggcaaaatcataattgggaatcaaagtgtgggggcatgcaagaacacgatagtccctttaaaacaatgctgagatatataaatatttgatttaggataaatgtaacacacgatacgcggagggagggggtaataaaaactccaaacatgcaacggggacgagacgtgccaggtgtgcggttctgtggccgtggaatgttaaccgtgaaatatggcaagcatctcgcgcctttgcgtttgggcaagagaattggaatggaatccaatacgcggccacctgatatgaacgaagctccttgaagcatattgcatgaggtcgggagtgatacgtgtgcggattcgccgcaccacgaaaggcattataaattcggggcagccagcctccctcgttgcagcggccgcggcggcggccagcggaggagggcacaggcagcagctaacatccctcactctcggtacctgacctgaccacgagagcaacatgggcggaggacacgacatgcacgggcagcactacggccacaacggcggcgtgaagggcttcgtgtccaacctcgtccacggcggcggcggccatggccatggaagcggctacggccatggccatggaaacggctacggccatgggaatggcggctacggcggcggccacgggtaccctcctcccgccgccgccggcgcgtaccctcatccgcacggcgcgtaccctcacccgcacggcggccacgggtacccttctcccgccacctaccccgcgcactcggcgcactacgggcacacgggcgtcgtaccacaccagccacatcatgccgtttgttatttgacgtttccgcggccggccgcgcgcggtttgttatcctggctgcgttgcgttgcccggggcacacggggtcgtaccacaccagccacaacagctacggcggcggcggcggccaccacggcatctacggcggcggcaagcacggcgcgttcggcggcggcaaccgcaagagcggcggcggcaagttcaacaagtggaagtgaagcgaccgaaacgaatcaaaacaacaccctcagtctcgcttcgcacacgtgcacccgcacacgaatcctagtgctacataataaagtgcaagcaggcaggaggcgtacgtgtgcgagtgagtgctgctgctgcggcgaccgtgtgaccgtagtcgttatttgtgtgtacggaataaagtggtgagcgctgagacgtgcgtgtcagcctagtaataactaaaataatggccgtgttcacgtaacgtgctcgccgtatgtaccatcgtgtgtaccggccgtacgtatgtacaagccgagtgcaataatacagtactatgtgtattattaaatcccatgctctgcatacagaaaaggacacatgctgctgctttagtaatgctgctagaaaattggcttgattatatcactgacagctctagctgttggatcttgactg

SEQ ID NO: 20296 - DNA, 2524 bp, Zea mays
gccgggtgattttgagaatccatggctgaaggtaccttaaagcaaaatccgctatccaatggtcatggtggaacggacacaatagcaggattattagcatcactgatggaagttgtgcggacaacagtagcatgcgagtgtgtatatgttcgagcaatggtcatcaaagctttgatatggatgcaaaatccccggccggcttttgaagtgctaaaatctatcattgcatgcgagttgtctgacccagcctggccttcctcgctcctgaatgatgtcctactaaccttacatgctaggttcaaggcaacccctgatatggctgtgactctgcttgagattgcaagaatttttgccactaaagttcctggaaagattgatgctgatgttctacagttgttatggaagacatgccttgtaggagcaggaccagatgggaaacatacagccttggaagctgtaactatagttcttgatctgccaccacctcagcctggttcaatgtctggactcacttctgttgatatggtatctgcctctgatccaaaatctgcaatggcactccaaagattagttcaagctgctgtttggtttctaggagaaaatgctaattatgctgcatctgagtatgcctgggagtctgcaacaccacccggtactgcattaatgatgctagatgctgataaaatggttgctgctgcaagttcccgtaatcctacacttgctagcgctctgacaaggcttcaaaggtgtgcatttagtggaagctgggagatccgcattgctgctgtacaagccctaactaccattgcaataaggtctggtgaaccttatagactgcagatatatgaatttcttcatgctttggctcttggaggtgtgcagtcaaacttttcagaattgcagctaagtaatggggaaaatcaaggtgccagtggtactggtcttggatctttaataagcccaatgcttaaggtcctagatgaaatgtatagaggccaagatgatcttgccagagatattcgccagcatgataacagcaaacaggaatggagtgatgaggaactcaagaaactttatgaaacccatgagaggcttcttgattttgtttccttattctgttttgttccaagggctaaatacttgccccttggtcctaccagtgccaagctaattgagatctaccgcaaccgtcataacataagtgcttctggtggtctaagtgatcctgctgttgccactggaatatctgatcttatgtatgagtccaaagaagtacataaagagaccaatactgtccagtctggtattgatcccgatctggcaatggcctgggcagcaggtttggaagacgatgtttgggcaaacaacgctccagctgtggataaagtaaaggacttccttgccggtgctggaactgatgctcctgatgtggatgatgaggaatacatgaactcgaggccatcagtcggatatgatgatatgtgggctaagacaattcttgaaacttacgatgcagaggaagatgatggtaggtactctggtggatcctctcctgaatcaactggttctgttgaaacctccatatcgtcccattttggaggcatgaactatccatcactgttcagttcaaaaccgtcaagtcatggggcctcacaacaaacgatacgtgaagaaccaccctcatattcgacgtcagtactacagaggaaggaatcatttgaaaacccccttggagggggtggaggacgaagtttcggatcccacgaggatgaagataagagttctggtaaccctcagtctgggaaagctttgtatgacttcacagcaggcggtgatgatgagctgagtttaaactctggagaagaagtggagattgaatacgaggtcgatggttggtattatgtgaagaaaaggaggcctggaagggatggaaagatggcaggtctggttcctgttctgtatgtgagttcatgataacagccgtgtgtatcgtttcccacacttgtggaagctgtttggagttcatgggcttaacaaaaaggcacactggaatgctcccgagagatcttcgcataaactcgtgcccgtcgtataggcacgtggccttgtggaagcaggtcatatccagtcatcttggggttcgtatgatgctgcagtgctgttcctgggaaagatttacgtgttgatttgtctggacccacaccacgagtcattcaattgattgttttttgttgctaaggtggagactcttcagaggttaaaccgttcatctgtgccattttgctgccgtctgtgttcaagaaggcaatttcgtcgtctccagttcgtgttgtgcgatatatattctagtaaaattgtagaggcatcatttccccggcatatattattttggtcgtgtatggtgtgattctggtggtaaaatagtgtcattaatcttgtgtatatttgtttccgggtggattacagagtatataactataagggggtgtttggtttaagaaatcaagcaaaaaaaaaaaaaaaa

SEQ ID NO: 20297 - DNA, 2512 bp, Zea mays
ccccgcgtccggccctgcaatggcccagtctggtcgtccatgttcctttgaactttctctctcttgcttcccccgagcccggactcagactcactcccgtcccccctgcctgcctgcgcgcgctctctgcctcgtggcggcgacgacgccctcctccaggtggccaggccatcgtcggatcgtattcctcggccccttctccggtgatgagcacccagaataaaaggctcaaggatgtggaggtcagtttcccaatcgtctacggaaccatttccttctggctcggcaaaaaggccagcgagtataactctcacaagtggactgtatatgtccgctcggcaaacaatgaggatctgagtgtcatagtcaagcgcgcggtgtttcagcttcacccgagtttccagaacccgacgagagtcgtggagcagccgcctttcgagctgtccgagtcggggtggggagagtttgagatagccataaccctttatttccacagcgatgtctgtgacaagcgcttggatctgttccatcagcttaagctgtatccagaagaggaagctggacctcaatcgaccaaaaagcctgttgtcgtggaaacgtacgatgagattgtcttccccgagcctacagaggcctttttcctacgcgtgcaaaatcatccagcagctaacgtgcccaggcttcctcctggtataaccttgcctcctccaggccctatggaaattgttccgtatgaaaagaagcgaggtgacactaaggatcatcctttgagtcagtggttctcgaatttctctgaggctgacgagcttttgaaactagctgcagctcggcaacaggttcaggttcacatagccaagctgagaaggcagttaaccatgatagaaggaatgccccagcaatcgaaagccttttctgtccctggacagcagtttaggcacatctaatgtagtgcacctggtttgtaaggaagatgttggaatggaacctttcagcaactgcttgacagattgggttctgtgtattcgcattgaagtcgctgccttgggcttgcaaatgacctgtatattctatgaagtgtagtaccgttaggctcataagagaacactactagcatgacctgttctttttaactttttcttatatctccattcccgttcgtttccctatgaaaatggcatgtcctcgttgtggctcttcagtatttttttccttgtatatggtggtgatggatctgccatagcgaaagagagtaaggacaaactaggctcacctcctaaccacacatgggggcacgggttaacagtaagtagctgtgctgaactgttgattagtgcgacattatgtgatgatcttgttttttgcacaagccttatgtaaccacacatgatgtcatcttccagtcaatatattgttgatctctgtgccgttttctatggatgaaatgaaactttgcatatcagcatgcatgctccatattttctgatcacaagctacagtatccagtaaaaggaatctgaagacatgggtgggactgggagtacagctcttatacttcactcttctctagtgtcctgtgactggtcctctaagcgccttcatgagtagttgtgcactgtgcaagactatgccagcttgtctgggcattgcagctactcatgtgactagcaatgttgactcttgactgtaaagtttcgagctgccgacattttttttacacttgtcataatctgccgtccactccctgcttttgaaactaataaggcatttttcttttgtcttgggtcaagaaatcattcaaggtgagtacactatctttttattaaacatgtaaagtctaagtcttagctgtttcgtgtgtcctaagaatggggaaatgaacccaacgccatgagcaaaagaaggaccacccgtctgcctccgccgatccatcgcctatcggcgtgctggtgacgactgccatgcaagtgcggctctctgatctgttttgacctggcacaaggttgcacatttggtctgaaaaagaaatcaattatccggaggaaacaaagcagatgccgaggtaaccggagcagagcccttaattctctgcactatttcttcccttctcgttacaagaacatccttttaaacaagtttttactacatacgataatggatcaatatcgcaataggacggcaaccagtttagaccttatgtatacaacataaatttacatgtgttggagtaaattttagttcaaaatttcacatcgaaccacttgtgtggatatcgagctggatcgttaagcaatcgggctagagaatcagtttagttcggtttgccttgatcttgcgagccatgacaaaaaaatatacacatatatataacaatatagtcaattgctagttaattttatactaatttaacatattgaaaagagtaataatactcataattcatatattacatcaattaaacctaaaattaacatagttcattagtttttagttcattttatacaaaatgtagact

SEQ ID NO: 20298 - DNA, 1159 bp, Zea mays
ccggccgggagatcactcccgtcacctctgcctggctgcgtgcgctctctgcctcgtacgggcgacgacgccctcctccaggtggccaggccatcgtgcggatcgtattcctcggccccttctccggtgatgagcacccagaataaaaggctcaaggatgtggaggtcagtttcccaatcgtctacggaaccatttccttctggctcgccaaaaaggccagcgagtataactctcacaagtggactgcatatgtccgctcggcaaacaatgaggatctgagtgtcatagtcaagcgcgcggtgtttcagcttcacccgagtttccagaacccgacgagagtcgtggagcagccgcctttcgagctgtccgagtcggggtggggagagtttgagatagccataaccctttatttccacagcgatgtctgtgacaagcgcttggatctgttccatcagcttaagctgtatccagaagaggaagctggacctcaatcgaccaaaaagcctgttgtcgtggaaacgtacgatgagattgtcttccccgagcctacagaggcctttttcctacgcgtgcaaaatcatccagcagctaacgtgcccaggcttcctcctggtataaccttgcctcctccaggccctatggaaattgttccgtatgaaaagaagcgaggtgacactaaggatcatcctttgagtcagtggttctcgaatttctctgaggctgacgagcttttgaaactagctgcagctcggcaacaggttcaggttcacatagccaagctgagaaggcagttaaccatgatagaaggaatgccccagcaatcgaaagccttttctggtcagtaaaaacttgttgtttttccgatgattatgctggtgggttatctggtgacgaattgaacttttacttatcttctatgttcagtccctggacagcagtttaggcacatctaatgtagtgcacctggtttgtaaggaagatgttggaatggaacctttcagcaactgcttgacagattgggttctgtgtattcgcattgcagtcgctgccttgggcttgcaaatgacctgtatattctatgaagtgtagtaccgttaggctcataagagaacactactagcatgacctgttctttttaacttttcttatatctccatt

SEQ ID NO: 20299 - DNA, 4060 bp, Zea mays
cttcagttttgaaaacagagattttagtcagcttgccaaacacctttctgttcactcccaaataccccctaagggtttgtggtttggttggttgctttaattcgaaccgatttggactggctcgccaagccaaggtgtacatacgtatgcgctcattgcaaacacccctggtcactgacaggctcgtgctgggtgggttacgcgaagagggcaattagttctcgtagatttatttgaaattcttggaggctagtccacgtcgagtttggttaaaacatgacaaagcgcgccgcgccgcggtgagtatcttggagcctgccctatggcacgagccaagtggctaatccccgcgagcacatgcgtgtcctaccagcgtccaatcttgtccaccaaaacaaatccccgcacaccatacccagccaaaaccaccaatttgacgctttgcccccaagtccaacccagcccagcacaggacgcgcgcggccgcgcccgcggctacatataaccctggacggagcgctggcagctgcacatttgatttcattcgctgcaagcgcaagcgcggcagtcgagctcgccgagctcgcgatcaccggcagctcgctcgctcgccaatcgccatggacccctgcgcgttcgtgcgcgtcaccgtggaccagctcctcctcaagctccccgccgtgccgcgccccagctccagcgccggggtgtacccttccaactcgccctgcttctgcacgctcaccctccaggaccacccctcctcgctctcccgcaccgcgctgctcccgctcgcgtgcgcctcgggccccgccgcggcggcggcgcacgccgaccccgtcgtgctcagcctcgacgccgacgccgtgcggaggctctcggcgcgccccgccgccgagctggtcgtgtccgtgcacgcgggcccgacggggaccacctgcggcatgggcgcctcccgcgcgctgggccgggtgcgcgtcgccgtcgacgtggcgcgcgccgcggccggggagaccgtcgtcgcccgggacggctgggttgacgtggggaagcccgcgtcgggtccgtcggcgcccccccgcgcctccgcgcgcgcgcagatccacatggtcgtgcgggcggagcccgacccgcggtacgtgttccagttcggcggcgagccggagtgcgggcccgtcgtgtaccaggtgcccggtggagccgcccgcggagggcagcggcagccggtcttcccctgccggttcagcgccggccggagggcagccaggagcaggttggtatttagcctggcgtgctagctgtttacctgacacacatttctgtgtgccccttgcaacattttcatcagtttgcttgctcgttcagttacccttgtcctcgcgctgtcagtattttgtttggtcgtccttcatcgtttggatctgatttcataactactagtaagtgcttgtgtagttcatagttccagacacgcactgggccaagaaatgccaggtagctagacattagcgggcaagggtggagcattaacggttggtccaaatgaacagatggattcagactgatatacaaatccaatggtcaaaagtttaaagctcatggataaacagataactttaaaacagcaaacctgcacaaacaaaataataatggagtttggtcatcagatagcgggtggacatttataaacaagccaatgacagttaacatgagctaagcaaatgaagtgcgtatatctacctgtaatgatcgactttgcatagttctattatgtacgtactttaaaagctcccttcctttctttttctattttgcctttattttttttcttcttcactccttccaataataggatgccagctcttggatactttgttggttaccataggaggagtactacaagcattatatatattggcaccgccgcttgataaatgtatattgcaacctccaacctgcgcttgcgactgaacctaatttatctattcgccatggaagctagcatttctctttgggatcaaaatgaattggtgaacacatcacaatctttatgattgcaagagagagagagagagagagagagagagagagagagagagagagagagagggtaaaatcaaaccagatcgatcaaattaccattagtccttcagtctgactgcttgaggactcaagttggttctctagataaaccttcagtgtcagtgctgttcagatccccatgctagcttccagctagcttattaagataccagaaaagaaaattgcttctactctacgtacgtagcattgatctcttaaatctgaacacatccgtcatgctcagatagagtacacacaccaaccgtgcatgtgatggacttaccagcctagttgcctttttcttgaaaaaaagattgttctcacatagctggctgagaatcttcccatacacatcacgtccaactaatcttgtcgcatgcacacttggcaccacgccaatatatctgtgccagcaatgcaaccatgcgcctgcacgttacgttcaacgtaaactaatctttgcatgcgcgcttgaaacttttgaccagatcgctgacgccgcagtcgtccatgagccggagcaccagccgcaggctgcggtcctggctgagcagcaccctccacggcgaaggccgcgacggcgcgcactcgcgacgcgagcagcggaagggctggacggtgacgatccacgacctgtcggggtcccccgtggcgccggcgtcgatggtgacgccgttcgtgccgtccccgggctccggccgcgtctcccgcgccaacccgggcgcctggctcatcctccaggccacgggcgcggggccgtccagctggaagccgtgggcgcggctggaggcctggcgcgagcgcggccccgtcgacgcgctcggttaccgcctggagctggtcttcgactcgggcgcccacgagtgcgccgtccccatcgccgagtcgtccatcagcaccaagcgcggcgggcagttcgtcatcgacccggccacgttccccgaggcggccgcgggcgctgcctggccgctcgccggcggcttcgtcatgggctccactgtcgagggcgagcggcgcgcgagccggcccaccgtgcaggtcggcgtgcagcacgtggcgtgcatgggcgacgtcgcggtgttcgtggcgctgtccgcggccgtcgatctctgcatggacgcctgcaggctcttctcgcagcggctcaggaaagagctgtgccaggaccaggacgagtgagagagagagaccggcccgagcgacgtgtattagaagagctcctgggtttgcttgcctttttgtgctgtgagttgtgtgattaattctagccggtttagttgctatgtcttgtggaggtgatggccctgtggctgtttttagtgtaggctgggtcggatcacaggaacgggacgggggtttgtagtacgttcgttgcctcattcaattctttcgattcttttacacatccatcttcttgttcaattcgaaagatacattcggcaaaggagctggagggcagtatcagtatgctagctaccgggcgggtgctccgcgcctctagggcggagccagcccttttttggggtcagctgaccccggtaaatttctatagtgaagatctagtagaaaatactgataaccccgataaaatttttgctagcttcgctactgcgcctccgcgctgcgcttcttgtgattaacgcgaagacggcgtcgtgctgctgcagcacctccatctgggcgtccagatcttcacgaccatccggaagcaacgcctccagatccagatcccatgcataagaacacacccaccccttttttttttaaaaaaaaaggggtcatccccgctatttcattaagaaatagacaccaacaaacacataatcagaatgagatcaacagaaacctcaataaaatcgcagccccatcgcaacagatgcaaatcagactaccgcaagactgaacacaaccatcaaccgccaatgcacaagagcctgtgcccagaactctcaagcctgcgtgctctctctcaactgcg

SEQ ID NO: 20300 - DNA, 459 bp, Zea mays
aaccgccttctagcagccgccgccactaggggcatttccagccgccaccgccactacgggcggttccagccaccgccgccatggcgtagcgcacggccacgacaaccggcaatgcgggcgcggcctaccgacgtggcactcagccagcgcagggcaaccggcaacgcgggcgcggccaggcagcgcgacgctcagccagcgcaggcgcgtggcagcccccgtcccggctcggtgccgcgcacgccggagtctccgcgtcgaagcgactacccatgccgccgaaacagtcgacatccgcgtgtggtcgtgtacgctggggtcgcacccgcgctggggcggcgcatgtcgcggctacgccggtgacgcgcccgcggggctacgcctgcgtcgccgaggacgcatgtccctggtcggaggcgcgtccgcgcacagcaggccggccacccaggccaaaaggcg

SEQ ID NO: 20301 - DNA, 964 bp, Zea mays
aaatactgtcatcacccgtgcctgtgtctcacaagcccactttccccagtactctactcacccacccactcacggactcatctactgagcagcgcggtgggcatccgagcgagagggcgagcgcggaaggatcggaattccgaaggttgggcatggaggcgagcggcgagaaggctgcggtggtgcgacggctgatggaggcgaaggaggtgtccgggaagaccttctcgggaatcgccgccgagacgggtctcaccaacgtctacgtggcgcagctgctgcggcgccaggcgcagctcaaggccgacacggtgcccgcgctgagggcggccctgcccacgctcacggacgacctcatcgaactcatgatgcagccgcccttccggtcctaccaccccaacatcgtccacgagcccgccatttacagattgaatgaagctgttatgcattttggagagagcatcaaggaaatcatcaatgaggagtttggtgatggaatcatgtcagccatagacttctattgttcagttgacaaggttgaaggggccgacggaaaagatcgtgtggtggtcacatttgatgggaagtatctaccttacactgaacagaaatctgaacatatgatgtctaggccaacccgcaagacatcttgatgtggctggtgaggaggagaaacatgatcgtagtggttggtatcgggctcagcaaggatcgagcatgccattttctttgtgtagtccaaatcatcaacacaataaacagacctatattgatgataactgtcaaaaggaacattaaagtcaatgttctacctggcatgattgctggactgtattggatgatgctgagataaaaagagagaaaaagtgaaacaaactggattcaaattcatttttttcttcaaaaaaaaaaaaaaaagcgccctcgaagctaaaagcaaaaaaaaaaaaaaaaaaggccccta

SEQ ID NO: 20302 - DNA, 3939 bp, Zea mays
  misc_feature (1628)..(1628): n is a, c, g, or t
gtataatgggtgcgcggtcgcgtgggaggattcaaatttcaaacccacgctctagtagaaccagaggtcgttgttatgtagtgaatataaactattttttgaaaacacgcaaaaaaatataatcctttatgttaggcaggaccacgatatcatcaaataggttgtgtctaagattagtccaccagacataatctatttagccatttatattttcatggtatttaaaaaaccaaaaaattcttattaaccataaaatcagaaaagtcctagttgggacacgatcacacgacagtcgagcaggggtgggaatttggttttaaccgatagttcggttcggtatatttggtattccaaaatttcggtgttgaggtttctgaaaccgatcggtgcgtggcgaaaccaaaaaccgagcagttcggtatcggtgattttattcggtattcagtgaccacagaacttgaatcaagtttcaatgaacacaaaacaaaaacaatagccgcggacactaggcgttttcattagtcggcacaaatcagaagctaacaaaatcaagaactacacctattaagaagctagcacctgcactcaccgtttaagtagctagcaaaagaggagattgaaacccacgtggtgcagcgagacgagaggcatcctgtgagtgatgcacgagagccgatagacacccacagccacacacgatgacacgacacgatccacctggccgttgcgttacacgccgcgccgcacacatcagtgtcatactgtcatcacccgtgcctgtgtctcaccccgggactttccccagtactctactcacccacccactcacggactcatctactgagcagcgcggtgggcatccgagcgagagggcgagcgcggaaggatcggaattccgaaggttgggcatggaggcgagcggcgagaaggctgcggtggtgcgacggctgatggaggcgaaggaggtgtccgggaagaccttctcgggaatcgccgccgagacgggtctcaccaacgtctacgtggcgcagctgctgcggcgccaggcgcagctcaaggccgacacggtgcccgcgctgagggcggccctgcccacgctcacggacgacctcatcgaactcatgatgcagccgcccttccggtcctaccaccccaacatcgtccacgagcccgccatttacaggtgcgcggcgcccccccatcccctttgcaaacgacgacggggggcaatttgctttcccccaatctgaatcggaacgtgactcgtcaggcgagcgtagcgaaatcttgtttgtttaattggctacaccaagcgcttggggtctagttagcaagggatatatttgttctccaggaatattgcggtttagtgcagtttgacgtttgaataactctgactcaatctcaagtatttgggcacagctttcctatgtttaaacagagacttttggcatttcagaagactggtttggattaaagacgagagaaccaaaaaaaaaaaaaaaagcggcccccaaatgtgctttgcttaaaactcttgctctataggtatagtcttaagatgttctccctattgagttaagaattactgaattaatgtaaaagaatgtatgaagtccataatccanatactaggtaactcctaggcttaagataatggctcatatccttggtttggaatgttccgtgcctgcaggtttgcatgttgagcttggcggtcttcaatattgttcttttcgacagcctgataactagaaactggttccaaattgtagttcactttggccttttcaggtttaggaattaggataacttattaactttaaccaaatttacaggaaaatacaccaatatgtacaacatcaaattttgtgtcgttaagagggctgtttggttcccagccattggctctgttttggactgcataatcccaccgtgttccgtgttatgcagtagccaagctgcggtggctgagcggtacgtaaaatcacatccatagttcattctcacggtgtgtgcgctgctgtggcctgtggtggcgataattgaagagaccgcgtggcgtttggtggcgatttgttcggctgccaccttgggcttcgtggtctcaaacagagccataatttgccattaataaccttaggcaagtgtgggtgtggcaagccacaaaacatgtcggtagaaaatttggagccgtactttgccatgtgtaagcaaatcttgccacacgtttttactctacgacatgtggagtacaaaaaccttataatcttacctaaggttaattgtcaaccaaatacttgcagattcagtcaaacttgcctaaggggcttgttcggttattttcaatccatatggattggaggggattgatacggattggaggagattttaacttactagggattaaaacccctcaatccatatggattggggtagaaccaaacaagccctaaggtgaattacgacaaagtgtggttggcaaccaaacacccccaaaattctccatgaaatatattctaaaaatgcttttatttgaacctattgatgtcatataattttctaaaaacctggtcaaagttaatgatctttgacttaggaaaaagccaaagtgaactataattcgaacggagggagtagcttttatccagagctttgttagtttatttcagtttatcagcactaacaagatattagaataacctttttgtcaacattgttactatatgttgctcacagattgaatgaagctgttatgcattttggagagagcatcaaggaaatcatcaatgaggagtttggtgatggaatgtaagagataccagtgcttcatttatgcataaattcctgttcctggtaatctggcatgaactattatgtgatatagttagtaaatccattagttatgattatgaacggataatcctttaaaaatatggacacctggattcacatttgagattgtttttgtgctatatgctgttgctgtgatgttcacttgtacttgtagacacttgttaggacctggaatgctttgaattttgtgcagctttatttaagcctgagcctgacgaagcctctgtaaccacacacttgaaaaggtccagcttgcaagtatattagtgtggaaaactggaaatcctgtccatgaagctccattgaatatttttctaaaaaaaattgaatcgtatttgctaaaatggtgttatcatattaccattgcttcttattgcagcatgtcagccatagacttctattgttcagttgacaaggttgaaggggccgacggaaaagatcgtgtggtggtcacatttgatgggaagtatctaccttacactgaacaggtccgtgtcttcttcctgttttttcagctgccactctgttacttgttagctcatggtgctgaactgctgaactgcatctgcttgctagccatataataccaaacatatagttcttttcagacagttagtgtgtacgctaccagttgaagttgtaccaaataaataatccatgaatgggttggcagggtagtgatttaattagaatagtcaacaatatatgtcgataatattatcacctgactagcccatatgaacacatactgatgccgtttcacatctgcaggtcgccgcacaggtgcccgcgtcgccaacccgcaagacatcttgatgtggctggtgaggaggagaaccatgatcgtagtggttggtatcgggctcagcaaggatcgagcatgccattttctttgtgtagtccaaatcatcaacacaataaacagacctatattgatgataactgtcaaaaggaacattaaagtcaatgttctacctggcatgattgctggactgtattggatgatgctgagataaaaagagagaaaaagtgaaacaaactggattcaaattcatttttttctctatatcgtgtacattcccg

SEQ ID NO: 20303 - DNA, 4028 bp, Zea mays
  misc_feature (1305)..(1305): n is a, c, g, or t
  misc_feature (1613)..(1613): n is a, c, g, or t
  misc_feature (1900)..(1900): n is a, c, g, or t
gctaatttacgaggagaatctattaagcctaattaattaattggtagcacatttttttagcaaaatataggctaatcatggattagttagatttaatagattcatatcgcgaattagccatggcttatgtaattagttttgtaactagcacatgtttagtcatcctaactgtcatccaaaatccggagtaactaaactttagtctggggatccaaataccctgtaagatggtttccacaacattaatcaaaagcaccaagtaaataaaatttattatgcagcattgaagctaaggaggcgaaagagaaaaaatagtttgtcttttaacttttgtggcgaatgttttgccgctcctacaactaggggtgatagtgaatcatgattgaaatatttcttcaatatccatttgagttgttagaagattcattttggttcttaattaattttagttcaaaaataaatagaaatagagtatgatcttaatgatatgatccttaaattctatttttgtagtgtaaaatttagagtctactggctatatctcttttaatggatacttgatcgtcattggtcttttctctgggtggatgctttgcaaccaagatcgtgttcctgtcatcatgtggcggatgctttgatctccatgggttgtgcagactgcagagctgccctctggttgatattttgctacagttattagtggatgaccgtgttatctccttggatggatgttttgccaccaccgggttgatttcttcataagaacgctattgggtgtcatagccgatggttcccctgctctgtctcgccgtttctgtttttcttggtatcttatgataatccttggattacctcgcctgaccttatactcaaaacttgtattttagtaatgtaatatgtttctacctctttctaatgaaatatgtatccaagataccgtcgaggaaaaaaattattctgatttcagaccttaggcatgcacaacttaattaaatgataggtctctataaatattatgttttgactgtatttatgatctaagacttaagattgtattaaacagtttttttagctttatcttatatttgaaaaaccgattcaaaggttcaagagtgtgcatgcccttatatccatctcctagcgagagggaaatggaaatacaaaccgtagcagcagcgctgtagcggagacccatttcttcaccaccttttctgtatccatactccctccaacaagaaaaggtaatcatacaaaagtcatgcctcaacggatatgattgctcgaacacagataaacaaagacaanattccgacaacattctgcaccctgtggacaatgccaattgtctagcatattagccatagacaaagttccatctctctcttacgagaaaatttgaaatttgtattcccaagcctctcaagatttgatatcctgatctaactgactcacagtagcatcacatatcattatgataagagtgtcaaatcttaaaatacttataaattaggttgttcatagtgagcagcgctatcgcatacagcaccgcagatagagtggaatatgcagtagaaagttactgcaacggtgcaaccatgtactcattcaacaantataaactaagggagaccaccaccaacgttatttttattttttagagtgtatacccggcctactacaaacaagggaggcccacctgcatagcaatacaacagcatgatgcagttgagtgtgagatgaaataggattgaaaaaataatataatatatggtggttggtatagagttgagatttagagtaaacatgactacgtaggattgtagtatagagtaaataattttgatgacaaggccaaaatattttttttggtagaaacttagagcatatgagtatatatagnctaaatcatgaatgtgacatccttgttcttcatgtccatcctgtttgataaagtgaagaactttagggaagtgtttggttccacccaactaaagtttagtggctatcacattgaatgtttaaataataattactgatactaaatataatctaattataaaactaattacataaataaagaccaaaagacaagacgaatttattaaacctaataaacctatatttaatactcataatttatagttaaatgtttggtgtgatacaaaactaaactttaaaaacagtggaacagtagccaacacttagaaagattcatagtaatatagtatcttcgtgtttctgaagtgttgctgcaatgctgctggctgctagacagcccttgctctgctgcgctgcaagtttgcaatgttcctcccgggatgcgccccccgcggctttgcctggaaaaagatagaggagtaaaggcgacgcaacgtggggcatggctgcatgccacgcctgttcaattgctcgaggcggctgcggcgatggcgggcgctcttcgaatcgattggtttggcacggcagacggcggtgcgcgaacgcgcgcgcggctttgctctcctgcgcagcgcaggtaggcaggcaggcagcaatcatgcgcggtgtgttggcgcggcagggcggcatggccggatgggccaaggagtagtgctggcgtatatggttcctgttgattttgtaggtcgagaatgaactactgtgtgagttacttctaatcataattcataggtatttcacaattcctgcaccaaaacaaacactttgctttgctcattcattccctctgtggcaaagaatgtttccatcatcaatatactgaaagcgaacatataaaaggtactaaccaaaaagttgcttcaaaggcatgcttttaaagaaaataacaaactaacggtgtctctgaagcacatgtcggactgactatgattgatcccttaactagtctgaaactctgaataaacaagatttttttttatgaagtagaataattatcaagagtacaagactgaccaaggatgtgtctcactgtccctgtcgcagcgctcctccactccgtatggtcatcttctgcctgcactgcgcctggagctaaaagctcctgtaaaaacatcatgccgtctcttcacaccttgccatcattgtttcgcttgccactacgagagctgaagtagaagcaaagcctcacgcaccgtaccgtacctttgtttgcttgcttgctagctagctagctgctacggcctctatataagcgcaaagaattcaagcgctcacactaaccggagccatggcaaagaccgccgcaatgccggcagcggtggcggtgatcgctctcctgcttattacgactctacccgtcgggcgcggcgaggagaggaggcccaccgcggcgcacccgcacgggctccccttcgagagcccgctcgcgctgtctccggccgcttacgacttcttccaccccagcgcgcgcgcccgtcgagatcgcggcgtcgccccggcgccggcgccggcgctcgcgcctcgcgggcagcagcagcagctgagagagtccgcggtccgaggaggaacatcgtcggcaagcgtggccaaggccgaccgggaagaagggggcgtgggccgcccgtggatacgcacgggcgccacggccacaaggtggcgggcgtgttcgtcggcgcggcagcggccgcgctggtggctatcggcgttgcgtacgccgtggtgcggcgccgggtcgtggcggcgcgcggtggcgcgggcacgggcgcgggcgcgcccaagtcgaacgcctagcgtagtgtgctggtagcctggtagcttcagggctggtttgcgacgtgtgtcgtgtgtggtagctgtaggtgggctcagatagttgcgccgggctgtttgtataaatatggaatgcaaggtgctctttgtttgggtctaccggaaattatccagatgcaagatgctgccgagcgggggagggcgctatcctttttggagagtcagccagtcccagtcaagactctgcaatttggacatcacttttccatagatagaagtggcaccgttgaccttcctcgagcttgctttgagttcaagtc

SEQ ID NO: 20304 - DNA, 3854 bp, Zea mays
  misc_feature (1590)..(1590): n is a, c, g, or t
ctgcagtacaaggacaggagactaatattataactgatctcactctcaaggtatgattctgatttttactgataggctggaaaaaaaacgtacttatcgagtttagtaaaacctctctcaggtgcttgggctggacatttgtgctgacgttattattggcgatgagatgatcagaggaatttctggcgggcaaaagaaacgtgtgacaactggtatgcatgcaaagtctgcaaaccatgtgcccttacgcagacctgtgatcaaatcaccaatttatagttggaaccctaattcattgcaaattatctcaggatttgtctattcttttttcccttttgtgcaggggagatgctaacggggccagcaagggctttatttatggacgaaatatccactggtctggatagctcgagcacatttgagattgtaaagtttatgaggcagttggtccatgtaatgagtgaaaccgtcatgatctctctgctccagccaccgccagagacatacaatctttttgatgacataatcctgctatcagaaggatacatagtgtaccatgggccgcgcgagaatatcctagaattctttgagtctgccggtttccggtgccctgacaggaaaggtgtcgcagactttcttcaagaggttacttccaagaaagaccaacaacaatactggtatcttgatcaggagcagtatcattatgtatctgtacccgactttgcagaacgtttcaaatcattccatgcatgccagcagatgcagaaggagttgcaaataccttttgaaaagtccaaaactcatcctgctgcgttgaccaccagaaaatatgggctttccagctgggaatcactcaaggcagtgatgtcaagagagcagctattgatgaagcgcaactctttcatctatattttcaaggtcacccagttgatcatccttgcactcatgtccatgactgtgtttctcagaataaagatgccccatgggcagattgctgatggcaccaaattctttggggctctgacttttggtttaataacgatcatgttcaatgggttcgctgagctacaattgaccataaagaagctaccagttttctacaaacatagggatttcttattcttccctgcatggacctttggagtggcaaacatactcttaaaagttcctatctcgctcgtggaatcagtagtatgggttgttctcacatactatgtgatgggctttgcacctgctgcaggaaggttctttcgtcagtttatagctttctttgccacacaccaaatggcaatggctttatttcggtttcttggtgctgttttgaaaacaatggttgtggccaatacttttgggatgtttgtgctgctcattattttcatttttggaggatttgtcatccgtagaaatgacattaaaccttggtggatctggggttattgggcatcacctatgatgtatagccaaaatgcaatatctatcaacgaattccttgctagtaggtgggctattccaaacaatgacacgactattgatgcaccaacagtaggcaaagcaattcttaaatccaaaggcttgtttactgaagaatgnggattttggctttccattggagcccttataggattcattattttgttcaacagtgctctacctttgggcccttacatatttaagtcctagtagtggctccaatgccctagtttcagaaggtgaagatgatgtaaatggaatagcattgaaaggaagaagcagagatgcaatgtcccaagttgtatccagtgatccaggcactaatggagcgacaaacacgctagctcagtcgtcacgagtcactttgcctttccagcctcttgcactttgctttaaccatgtaaactattacgtcgacatgcctgcagaaatgaaggaacaaggattcacagaaagccgtttacaactactctctgatatcagtggcacttttaggccaggggttctaacagcactagttggtgtgagtggagctggaaagaccactttaatggatgtcctggcaggaaggaaaactagtggagctattgaaggagatattaccctgtcgggataccccaaaaaacaagaaacttttgcccggatcagtggttattgtgaacaaactgatatccattctccaaatgttactgtatttgaatccatcacctactctgcctggctgcgtctttcccctggtcgcggccgtggtacaaaaaagatgtttggtggaggaagtgatggcccttgtagagcttgatgtgttgcgcgacgctcttgtgggtctccctggagttagtgggttatcaactgagcaaagaaaaaggctgacaattgcccgtggagctggtagcgaacccttcaatcatcttcatggatgagccaacttctggtcttgatgctcgagctgcggcaattgtcatgcgtacagtaagaaatacggttaacactgggccgtactgtggtctgcacaatccatcagcccagcatcgacatatttgagtcttttgatgagcttctgcttttgaaacgtggaggtcaggttatttatgctggtgaacttggtcgccactctcacaaactagttgaatattttgaggcgattccaggtgttccaaagatcacagaaggatataatcctgcaacatgggtgctggaagttagttctcctctatctgaggctcgattgaacatgaattttgctgaaatttatgcaagctctgtgctttataggaaaaatcaagagcttatcaaggagttgagtattccccgatcagacaaccaggacctgtcatttcctacaaaatattcacagaatttctacggtcaatgtgccgcaaacttttggaagcaataccgttcctactggaagaatccgccctacaatgctatgcgctacctgatgacatgtctcttcggccttgtatttggtaccgcggccgcgcccaaccgacacaacatagattcacaacaagatttatatagtctgcttggagccacttacgctgctacattctttcttggggcttcaaattgcatcacggttcagcctgttgtatcgattgagcgagcagttttctaccgtgagaaggcagcggggatgtactctccgttatcctatgcatttgctcagacatgtgtggaggtcatctacaccatcttacaggggatactgtacacagtcatcatatatgcgatgatcggatacgactggaaagcggataaattcttctatttcctgtttttcatcactgcaagcttcaactacttcacattgttcggcatgatgttggtagcatgcactccctccgcattgctcgcgaacattctcatcacgtttgctctacctctgtggaacctctttgctggattcctcatcgttagaccggcaataccaatttggtggaggtggtactactgggcgaaccctgtgtcgtggaccatctatggcgttgttgcgtctcagtttggcgagaacgaaggtgagctttcagttcccggtgggacgcccgtggtggtgaagcagttcttgaaggataatctcggcatccagcatgacttactcggctatgttgtgctcgtccatttcgcctacgtcattgtgttcttcttcgtattcggttattccatcaagttcttcaacttccagaaacgttagcgggatcatttgtatgtaattaatcggtcgccgtaagttctagttctagttctagttctagtcaaagcaagtgcttgtttgggaggaagcctgtatgcaagtagcagtgtattcctcttgtttcttcaatgcaaaaatattaaaaggaagatgacgaatgcaaaagtgacatgtcttgttcctttta

SEQ ID NO: 20305 - DNA, 1448 bp, Zea mays
ggatcagtgcacagaactattgatgcgagtataaatcatcttccagtcttggtatgtctgttgcaagctcctagatatatggagttgctggcaatggcaagcacattttaatcactgaaaattacaatgtaagcactaccctagtcgctgaactggttagcatcagtagttccagaaaacttggtttctcctatgctgcttcctgaggtagacgccgagcagcttgtagtacgtccagcgccccttcccgccggcggtctccagcagcacctcggagctggcgtggaagccgcccttgccgaacgcctcgaacacgattgggtccgtagccacgacgggctcggcgtcgccgtcgaggcggttgaacgcgaacgtgaggttccgcgcgaggcggcgctcgaggtaggcgtcgacgaagcagccgtgagtgacgaggtccggcacgacgccgtcgcagcgcatgtggtcggcgctgaggtggaggtcccagaacacggacgcgtgggcggacgcgtgggcggcggcgtgggcggtcgcctgaggtccggccggaacccggcggccaccatctccaggaacgcgcgctgcagggacttcatcttgaagttggccgcgaaggagaggaggtagaggttccagagcaggttgccgacgtcgcgccggcggaggccggcgtccgccgcgaacgcgccgagcctgtagtacttctgccgggagatgtacgcggacgcgacggcgcggatggcgccacgggtgatgagcagcccggacttcctgtgccggcggtaggccgcctccatctgcgggatggttccggcggccgcgtaggcccggacgaaggcgtccccggtcgcggagtcgacgcggaggccaaggcggcccatttctaggacggcgtcctccatgcgcgccagctcgcccgcggcgccgaggcaggagacggcgagcgggtagagcgcgcgtgccgcgccgcggtcccgcgccgagagctcgcgcactgcgtggaggatctcgtcgaagcggcccaggcgcgcgtacgccggcagtaggcgcggcgccgcggcgggcaggcacggcgcggcggagctgtgcaggagctgcgcccagagggaccgggcctccgcgaagtccccggcctcggcgcgcgcgaccatgagggccgccgccgcttccgtggcgtccggagcggcagctcttagacggggcacggcagcggcacgccgaggcggagtctgtgcgcgcgtcgagacctggcgagccgaggacggagcaagacgacgagtgggtgggagggaaatagagggtgcaggatgaaccggccgccatggtggaagcagcagcgagcacatctcatcgtctccacggctcggtgtgtggtgaagctgtcaaaccttgtccacccatgccagaactcgatctttagcggataaaaaaaaattctcgaagcg

SEQ ID NO: 20306 - DNA, 567 bp, Zea mays
ccgttctacggcaccggactcgccgactcatctcccactcccagccttatcctcttcctcgatcgcatgcatggtcctcattcacatacaaagagatagagaaaaaagagaaaagcttgcgagcgatggtgactatgtctggcacccgcaccgccctggcgcacgagggcttggattatggtcccaggctggtggcgccgcgccgcagcaggctaagcgtcgtcgccgttgcggtgcggaccaggccggccagcctcgcagtcccgggcctcccgcccccgacgccggagcccgtgctgccgtcgccgcccgtggccgcaggcgtcgcggcggtgctgctcgaggcgggcgtgccgcccgcggacctccggcgcgcggcggggatgtgcccggagctgctgtccgtgcccgcggaggccgtcgcggccgcgctccggttcctgacggaggaggcgggcgtcccggaggcggagctccagcgcgtgctccggcggcgccgcgcctgctcgtgtgccccgtggcggcgcggctgcggcccacgctctacttcctgcgcgcgctcggcgt

SEQ ID NO: 20307 - DNA, 857 bp, Zea mays
aatcacggcgaggtaccgaaaaaaaaaagcaaaggggagcctgtcgtgtctgaccgaggacgaaagaggcgcaggcgcaggcgcacatcctccccctccccttgccggccgtcgcctgctgctgctgtcgcaggcgcgccagcgctaccgacccgccgatgagcgtctagctaggcatcatctccgcgacgagtcgaccatcctgcatccacccacccacctacccactgcatcccctcttcctggttcctctacggcttgcctgcgaaccacccctgcgccgatccacctccgctgcctgtctgccttcttctacatataatcgcgccggcctccgcctcgtcgcctgcgacccccaccacagaaccctccccctcacctccgctatcctcctccctggccgctccccgacagactccgatggccatcgtcgagaccgccgctgccgctgccgaccaccccgcgccgccgcgcgaggaggaggcgccgggcgccgccgccgacgccggggagcgcgaaatgcgggatctggaggacctcctctccaagctcaaccccatggccgaggagttcgtccctccctccctcgcctcccccatctccggctccggggccgggcacggcgcccacacgcccgcgccgctctccccagccgcctacggcttctacccggtcaacgccggcttcgcggtcgcctcgccgggccaccgcggcgtcgtcagcttcccggcggtcgccgacgcccacgccggacgcggcatgaagaaggacggagccggagggtttcgcggccaccgccacccccggcaggcggcggaccaatagccgcaccagcatggcgcagcgggacgaggcca

SEQ ID NO: 20308 - DNA, 1952 bp, Zea mays
  misc_feature (1912)..(1912): n is a, c, g, or t
taggggccttttttttttttttttggccgcgtttttttttttttttttaagcactccgatcaaacgatgttcatttactgcaatgcgaaggttcaacattgttcacaaccattaccatccaaacccaagcaaccgaaacctattttaggcttactgctccgattatatacagacaaaacctgacagtaccaagctggagacgtcacaaaccgactgcttcaaacaatggacatggaagacgccccaaattaagaggaagaagaaaagatagtccagaaacaaccgccatacaggtcataagtctaataacattagtgacctcaaatctccaacaaaacaacaaattagcgacgaactggcactaacaaccctgagcatctcactacatccgccttacatggtcaatgccattgccatcatcgacctgcttcaactccccagcttgagcgcccagggttcatcgccgaggatccgtgctcttctaagcctcctccaaccgcaagggcgtcgcggctgagatctggagatgtggtacgaaacctgccatccttgtcctccaacaggttgctcagacctgctcctaaatcaccaatttcagccgccatcctaggctcatcccaagccactggttttctacccatctcaatgtcgccaacagctctccccatgtttggactcatgaaaccattcgttggacggggcctcagaccatgctcctgttcgaccctaccacagaagttgttcttggaaggagggatcgttgtaaagaagatctctttgatgttttccatgactcccttgttgtatgggttgtctcgctgatcatagcgatacctgaagttctcatatgttgtctgatttgtgctcatgagatacagatggaacacagagaggccaccaacaaaccaaactgcaatgaatgtgtagatgattaaggcaatagatgcaggggtctttgtcattgccttccaaattgttatctgctcggcatttctgatcttaataatgaacacccagcagaacccaaagacatacaggcagagcaaagttgttgagaatacaaacatatagaagaacctgtaattcctaagtcctatgcattgtccaacccaggggcagtgatggtcaaaacgttccacgcagttgttgcagatagagcaatgggagcaacgaggaggcctgtacaacatgcaagtgtcacagtattttgtcttcacagtgattccgttgacaacaacatccttcactcggggcaaacgcacgggtggagtctggttagccccaacctctgcattgccatcaaacccttcgggttctggaggatgtgcattgcgaggtatgatccctggatctctcccagaagttagaagcagaagactcagatcatatgctgtgaatagaactgctgcaatcataaccggcaatcccagaccataagagaacttatccatcaattccttcgcaacgaacgcgcagaagattgataccggcgcgacaataaggaacatggtgataaacagggatcttgcatcagggccaaatatgaacctccccttcagtagaaacacattgttccccttccatgccttgtacaccagcggcgcctccccgccgacgccggcgctcgctccgttcatcgccgccgcccgttcagccgcgaatagccgtcgagatcacggcccggatcatcacatagcccgacagtcggtggcccgggatcgccgcgccgcaggtggtgtgagctcgcaatgccgctccccctacggccctaccccaccccaccgctgcgcctcaggagagagagaagcgagacggacgagaagaagatatgagaccaaaaattcgcccgcttcgagggttttttttttttttttttttttttttttttttttttttttttttttttcggttnaagtcttaaataacactctggttataacgaacccggccgg

SEQ ID NO: 20309 - DNA, 1465 bp, Zea mays
taaactcaggtttcttgtcctgaccaataccagagtcacttaacccgtgcagccgtcctagaacctacattcccaggatccaagtacagaatcatgaaataaatagggaggaaatcgagtagccaactgttgtgtttggagccaacaatgagcagacgaatttaccaagctcaacgagggaatcccaacatctgcgtacgacacgggtcaatccagtgccggtccctaggaagaaaggaacagctaattcgagccgcgaccacgaggccgcacagatccacgccacacccgcaacagaggaactaagggaggggaaaaaaaaggcgcagaggggaccaaacatgagcctccccggcagtagaaacacattgttccccttccaggccttgtacaccagcggcgcctccccgccggcaccggcgctcgctccgttcatcgccgccgcccgttcagccgcgaatagccgtcgagatcacggcccggatcatcacatagcccgatagccggtggcccgggatcgccgcgccgcaggtggtgtgagctcgcaatgccgccccctaccccaccccaccccaccgtgcgcctcaggagagagagagagaagcgagacggacgagaagaagatatgagaccaaatggagggctctgctggggacatgtagtaatatcttctcgtggtggtcccatgttgcgtcttgcctaaattttgcacaaaagccctccgagtttccgcttattttgccccccggcgcggtagcgaacagcaaaacccccgccattcacgcttgcgcagcgcagcgcaccgcaccgtgtaggactagactgtaggtagtagagcttccttaccttttccgaatgttccttccccgttctgttaatatttttaaaaaaagattttgtgccaactttttctgtgtctgcagaaagtttgcttgcttggggttagtgcagccgaagggctacttgtccaccaaatcattgctggcaggtggttgaacaaagatagcaggggcttgttggattctcaaatgctaataacttgagatctgtcatctgtgacagtcagttctattttattcacaaacagactgcttcagaagaagaagtgttgtttggttcagctacagcctgtaatggttcagttgttgatatggcacaacaacaaaaaggcactgtcaggtcaaaagagaaaccgatgcccctttcttctgcatgtgccacagctgaacaaccttctgaagtggagtcagtggttttggcctgcacaagcacaacaaacaacaaagatggctagcggctagggagaactagacgggtaaacgccgggaatatatgatttcatgcacaaaaaaaaacacggaggccttaaccacttctacttttacaaaattatacgagttcgaaatcaggaaggctcaaccaacaccagatatcggaagcgaagcatcggtagggttttatagcc

SEQ ID NO: 20310 - DNA, 1802 bp, Zea mays
gcactccgatcaaacgatgttcatttactccaaagcgaaggttcgacattgttcacaaccattaccatccaaacccaagcaaccgaaacctattttaggcttactgctccgattatatacagacaaaacctgacactaccaagctggagacgtcacaaaccgactgcttcaaacaatggacatggaagacgccccaaattaagaggaagaagaaaagaaagttcagaaacaaccatacaggtcaaagtctaataacattagtgacctcaaatctccaacaaaacaacaaattagcgacgaactggcactaacaaccctgagcatctcactacatccgccttacatggtcaatgccattgccatcatcgacctgcttcaactccccagcttgagcgcccagggttcatcgccgaggatccgtgctcttctaagcctcctccaaccgcaagggcgtcgcggctgagatctggagatgtggtacgaaacctgccatccttgtcctccaacaggttgctcagacctgctcctaaatcaccaatttcagccgccatcctaggctcatcccaagccactggttttctacccatctcaatgtcgccaacagctctccccatgtttggactcatgaaaccattcgttggacggggcctcagaccatgctcctgttcgaccctaccacagaagttgttcttggaaggagggatcgttgtaaagaagatctctttgatgttttccatgactcccttgttgtatgggttgtctcgctgatcatagcgatacctgaagttctcatatgttgtctgatttgtgctcatgagatacagatggaacacagagaggccaccaacaaaccaaactgcaatgaatgtgtagatgattaaggcaatagatgcaggggtctttgtcattgccttccaaattgttatctgctcggcatttctgatcttaataatgaacacccagcagaacccaaagacatacaggcagagcaaagttgttgagaatacaaacatatagaagaacctgtaattcctaagtcctatgcattgtccaacccaggggcagtgatggtcaaaacgttctacgcagttgttgcagatagagcaatgggagcaacgaggaggcctgtacaacatgcaagtgtcacagtattttgtcttcacagtgattccgttgacaacaacatccttcactcggggcaaacgcacgggtggagtctggttagccccaacctctgcattgccatcaaacccttcgggttctggaggatgtgcattgcgaggtatgatccctggatctctcccagaagttagaagcagaagactcagatcatatgctgtgaatagaactgctgcaatcataaccggcaatcccagaccataagagaacttatccatcaattccttggcaacgaacgcgcagaaaattgataccggcgcgacaataaggaacatggtgataaacagggatcttgcatcagggccaaatatgaacctccccttcagtagaaacacattgttccccttccaggccttgtacaccagcggcgcctccccgccggcgccggcgctcgctccgttcatcgccgccgcccgttcagccgcgaatagccgtcgagatcacggcccggatcatcacatagcccgatagccggtggcccgggatcgccgcgccgcaggtggtgtgagctcgcaatgccgccccctaccccaccccaccccaccgctgcgcctcaggagagagagagagaagcgagacggacgagaagaagatatgagaccaaatggtcgaggtacccaatg

SEQ ID NO: 20311 - DNA, 2058 bp, Zea mays
tagtagtagtagtagtagtattagtagtagtagtagtagtagtagtagtagtagtagaagtagtagtagtagtagtagtagtagtagtagtagtagtagtagtagtagtagtagtagtagtagtagtagtagtagtagtagtagtagtagtagtagtagtagtagtagtagtagtagtagtagtagtagtagtagtagtagtagtagtagtagtagtagttgttgttgttctcgtaccagctggtttttttttttttttttagacacgaaagacatctcaaattaagagaaagaagaaaagaaagtccagaaacaaccgccatacaggtcatgagtctaataacattagtgacctcaaatctcaaacaaaacaacagattagcagcgaactggcactaacaacccagagcgtctcactacagccgcttacacggtcaatgccatcatcgacctgcttcaactccccagcttgaacgcccagcgttcatcgccgaggagccttcctcttctaagcctcctccaactgcaagggcgtcgcggctgagatctggagatgcgctacgaaacctgccatccttgtcctccagcaggttgctcagacctgctcctaaatcaccaatctcagctgccatcctaggctcatcccaagccactggttttctacccatctcgatgtcaccaacagctctccccatgtttggactcatgaaaccatttgttggacgaggccttagaccatgctcctgttggaccctaccacagaagttgttcttggaaggagggatcgtggtaaataagatctgtttgatgtttaccatgattcccctgttgtatgggttggctcgttgatcatagcgatacctgaagttctcatatgttgtctacaaggccgaggtagggcaactgattagcaattggcgcagcatacttcatcagtcaaggatatgaatacatccttcgtgggagttgggaacagttttttacctgatttgtgctcatgagatacaaatggaacacagagaggccaccaacaaaccaaaccgcaatgaatgtgtagatgattaaagcaacagatgcaggggtctttgtcattgccttccaaattgttatctgttctgcatttctgatcttaacaacgaacacccagcagaacccaaagacgtacaggcagagcagagttgttgagaatacaaacatgtagaagaacctgtaattcctaagccctatgcattgtccaacccatgggcagtgatggtcaaaacgctccacgcagttgttgcagatagagcaatgggagcaacgaggaggcctgtacaacatgcaagtgtcacagtattttatcttcacagtaattccattgacaacaacatctttcactcggggcaaacgcacaggtggagtctggttagccccaacctctgcattgtcatcaaacccttcaggttctggaggatgtgcattgcgaggtatgatccccggatctctcccagaagttagaagcagaagactcagatcatatgctgtgaatagaactgctgcaatcataaccggtaatcccagaccataagagaatttatccatcaattccttcgcaactaatggacagaagattgatactggcgcaacaataaggaacatggtgacaaacaaggatcttgcatcaggaccaaatatgaatctccccttcagtaaaaacacattgttccccttccaggccttgtataccagcggcacctccccgccagagccggtcccgacgccagcgctggcgctcgcttcgttcatcgccgccgcccgctcagccgcggatagccgtcgagatcacggtccacatcactacatagccagcggcacagcaacctctcggaatcaccacgcggcgggtggtgtgagactgtgagctcgcaatgccgtccccccaccccaccgctgccgccgctgatgtcgcgggagagagagaagagagatgggagatgagaccgaatggagggactttgctggggacgagaaatttgccattattttttgattaggatgttctaggtaatggtctcgtgc

SEQ ID NO: 20312 - DNA, 1299 bp, Zea mays
  misc_feature (459)..(459): n is a, c, g, or t
gagaactggggagagtcagctatggctggtagccctatgactgacacatctacagatccagacactgatgagaggaaccagatgtttgaacaaggacttgttgctgtccccacagcttctgattctagtgacaaatcaagggacaaactagatcagaagacacttcggcgtcttgcccaaaatcgtgaagctgcccggaaaagccgtttacgaaagaaggcatacatccaaaaccttgagagtagcagattgaaacttactcagttagagcaagagcttcaccagactcgtcaacagggtatttttatttctacatcaggagatcaacctcaatcaacaagcggaaatggagctttggcatttgacatggagtatgcacgctggttggaagagcacaacaaacatgtaaatgagttgaggcttgcagtcaatgcacatgccgggtgataatgatctccngtggtattgttggtagtgttatggcacactacgatgaatttttcaggctcaagggtgtggcagctagatcagatgtttttcatgtgctgtctgggatgtggaagacccctgctgagagatgtttcatgtggttaggtggcttccgatcatctgaggttcttaagttactggcaggtcacctagagcctcttactgatcagcagcttgttggtatatccaacctgcagcagtcctcccaacaagctgaagatgctctttctcaagggatggaagcattacaacagtcgcttgcagaaactctagcatctggatccctgggccctgctggaccttctggcaatgttgcaaattacatgggacaaatggcgatggctatgggaaaacttggcaccctagagaactttctacgacaggctgataatctacggctgcaaacacttcaacaaatgcaacgcatcttaaccacccgacaatccgcacgagccctacttgcaataagcgactacttctctcggctgcgtgctttgagttctctttggcttgcccgtccaagggaataaattcaattaactcataaataggattttttttgtactgtctctagtatgtcaattagtttcttcacattgctcatgtgttgatgggatatttggatctaagatcttatgaatggatgacatgtatgtgttcaagtgaacgctcagttcatattttaggccatcatgggttaattttggagaaaaaacgagttgtaaatacatctggaataatctaagatcttatgaagggatgatattggaggataagatcgatgaacaaataatgcaacatcactggggg

SEQ ID NO: 20313 - DNA, 1998 bp, Zea mays
ggctttgcttttaccccccaaccttttcgacaggaccctgcttgctctacagggttctcccggaggcagaaactctttgcttccgcctggctcgcgatgcttgtttgggtgcgcgggcctgcggcgaggtgaggcgacggcggcgccgggcggttgcatggtggccgatggagagtagacggggagggtcgtcggcggcggcggcggaagatgcgggcggggcgatgccgagctttgggccaacgcagcacgccattcgcgcaggcgcagatgtgaacagcatgcaaccttctcgagttactgactttggggcactggcacagtctgctggattccgaatagaagatcttgctaaccttaatgcaaatgctttgttcaatctgaagccaaattctcatacgattgacaacagtcctctccagtttggaaattacggaaagtctatttcttctcatataaatactacagaggcaacaacagctgcaacaagaattgaccctcagctgtcagcacagcaaacaggagcacaaccaattctggtggcgttaccaactggtaacatggagaattggggagagtcagctatggctgatagccctatgactgacacatctacagatccagacactgatgagaggaaccagatgtttgaacaaggacttgttgctgtccccacagcatctgattctagtgacaaatcaagggacaaactagatcagaagacacttcggcgtcttgcccaaaatcgtgaagctgccaggtaaagccgtttacgaaaaaaggcatacatccaaaaccttgagagtagcagactgaaacttactcagttagagcaagagcttcagcgggctcgtcaacagggtatttttatttcgacatcaggcttttatgttcatgttgtctgatctgtaggagctttggcatttgacatggagtatgcacgctggttggaagagcacaacaaacatgtaaatgagttgaggcttgcagtcaatgcacatgccggtgataatgatctccgtggtattgttggtagtgttatggcacactacgatgaatttttcaggctcaagggtgtggcagctagatcagatgtttttcatgtgctgtctgggatgtggaagacccctgctgagagatgtttcatgtggttaggtggcttccgatcatctgaggttcttaagttactggcaggtcacctagagcctcttactgatcagcagcttgttggtatatccaacctgcagcagtcctcccaacaagctgaagatgctctttctcaagggatggaagcattgcaacagtcgcttgcagaaactctagcatctggatccctgggccctgctggaccttctggcaatgttgcaaattacatgggacaaatggcgatggctatgggaaaacttggcactcttgagaactttctacgacaggctgataatctacggctgcaaacacttcaacaaatgcaacgcatcttaactacccgacaatcagcacgagccctactcgcaataagtgactacttctctcggctgcgtgctttgagttctctttggcttgcccgtccaagggaataaattcaattaattcataactaggataatttttttgtactgtttctagtatggccattagtttcttcagaacgctcatgtgtcagtgagatatttggatcatattgtaggccatcatggtttactggacaactttgtaacaattttggagagaaaaaactgagttgtaaatacatctggaataatctaagatcttatgaagggatgatatgggaggatatgatggacgaacaaaccagtgcaacatcactcgggtgatgcggcgtgattatatccaaactaaacagttgaatatctgtttgcagagttacgttcttccaaaggaatcacagtactgcgtaggtcgtccttcctgaacaatcaggaatcatgctcctcgagcatgtattggcgataactcatgatgaatttgcgggtttta

SEQ ID NO: 20314 - DNA, 495 bp, Zea mays
caattatttgtttgctcttcgcgcgcgacttcgtttacgcgtcatcgtgctgttcgcgcgcataatcacgttgacttgtgtgtgtcgcgcgccgtcatgcgcgttgtttcgcatgtggtggcgtgctgattcgcacgtcattcgcgttggtcgcgcgcgctgttatgtgtgtcgtcagcgtgctatgtcgtgtgtgtccacgcgtcgttctacacgctgtcgtgctgttgcgcacgtcgtaaattcgtctcgcttatactctctcgttttaattaaattacttatttaacagacaattgttagtatagcggattaatcgaactaaatggtagatattatttacatttgataatgtcgaattaaatgtgatagttaatatttgtttagcctaaactcgttaacttctcgaccgtggcttcgactatcgcatttctttttcctcgcgtgactgtagtaacgcgctctatttagtattgcatgttttgattatgtttc

SEQ ID NO: 20315 - DNA, 1119 bp, Zea mays
ttttttttttttttttttttttttttttttttttaacccttaacgtttgtgccgttaattatttcattgtaaagcggaatggtggtacactttccagagtactcatgaaataaaaagcggtgcagtacagctgaaaccacaaactagtaggaatgaaaacctaaagcaggctgccagttgaatgtaacctgcagaaccacacaatgcggcaacatttgtggatagacctctgatcgaaacttaaaaacgtttttgtttgacagagtcgggagtcgggacaaacatcacgagattcgactggctactcagttactgaaggacacgcatgctaacttgactgttcagacagaaactcctgtttttggtgatgaaggcattcatcgcatcagtcttcgtgtggaatttaaccagcatcattcttatgggctctgggacaccagctcttagaaaggtttcaaacggtggaggctcaaagttcgtgccacacaaaaaacgctctatgtcgtctgcgagggcatttcgtgggactccttgcagtaataccgctttcccatcgaaggactttttgagatcccatgtttcacgacttatctcatcaatcctgtgcagacgattctgatttgcttgcctaattgcggtggtaaacattgccttcgaagaaaacctcaacaaagcagccaatggagcatatcccttgttgtattcaatcttcacatcatccaatgacaatccacatctgtcaaggtgatggataatatcagttttcaatatgttcttctcaagacgactgcctccaccaatgacactgtaaaaccttccataggctaatccttcgcgggatgccttgaagaaagagtcatcctgcgactctgcggccgtggcggcggcttcgccggatgcatccgcggagaagagccgagcagacaccggcgcagacacggcgaagcgagatgaggtggtatctctcgatgcagtgacgacgcggcggagggcggcagcagcgagcctcgacatatctccggcggcggtgcggcggaacggaagatggaggaatcaggaatggcgtcggcctcgggactcgggtcgggggagcactggccggtcgctaatgggtctccg

SEQ ID NO: 20316 - DNA, 1152 bp, Zea mays
ggccgcttttttttttttttttttgtttcgcgcagattcgaacccctagcgtttgtgccgttaattatttcattgtaaagcggaatggtggtacattttccagagtactcatgaaataaaagcggtgcagtacagctgaaaccacaaactagtaggaatcaaaacctaaagcaggctgccagtccaatataacctgcagaaacacacaatgcggcaacatttgtggatactggatagacctcagatcggacttaaaaggctttttgtttgacaaagccggggcaaacatcacgagattcgactggctactcagttactggagaacacgcatgctaacttgactgttcagacagaaactcctgtttttggtgatgaaggcattcatcgcatcagtcttcgtgtggaatttaaccagcatcattcttatgggctctgggacaccagctcttagaaaggtttcaaacggtggaggttcaaagttcgtgccacacaaaaaaccgctctatgtcgtctgcgagggcatttcgtgggactccttgcagtaataccgctttcccatcgaaggactttttgagatcccatgtttcacgacttatctcatcaatcctgtgcagacgattctgatttgcttgcctaattgcggtggtaaacattgccttcgaagaaaacctcaacaaagcggccaatggagcatatcccttgttgtattcaatcttcacatcatccaatgacaatccacatctgtcaaggtgatggataatatcagttttcaatatgttcttctcaagacgactgcctccaccaatgacactgtaaaaccttccataggctaatccttcgcgggatgccttgaagaaagagtcatcctgcgactctgcggccgtggcggcggcttcaccggatgcatccgcggagaagagccgagcagacaccggcgcagacacggcgaagcgagatgaggaggtatctctcgatgcagtgacgacgcagcggagggcggcagcagcgagcctcgacatatctccggcggcggtgcggcggaacggaagatggaggaatcaggaatggcgtcggcctcgggactcggggtcgggggagcactggccggtcgctaatgggtctcctcggggcgcccaatcgcccgggggcgtg

SEQ ID NO: 20317 - DNA, 689 bp, Zea mays
gcgatttatttccgagacagctcaaggccaaaggcaaaggcagcgcacgtacgtgttgaggtggcacttgggcacttggcagcagcttgagttcttgagatcgaccgttttgcgttgtgatggcggtcgcgggcagcaggatcaagagtaaggtgcgggagtggatgcggaagcggatggcgccgaggaggaagacggccgcggccgctacagggagcggtgacaacagcggcggcagtaagtcggcgtcggcgccggcgccggcgccggcgcagtcgtcgccgcggcggaagctcctggcggccgcgctcccgtcggcgctgcggtgtaggaagccgcgcgggaacgtgctggcggcgctgttccagcgcgcggcgtaccacctgctgtggctcgtggagtccgtggtggtggtcgcgcagctctgcttcttcttcgtgcgcttcggcttcaggctgtgagaaaaaaaagaagaagaaaaaagaaaacctcagcctgagggaacgatgcctctgattctgtcgattgtttgcattctttttctgctggccatatctccagtggctctttcgatttccaacaccacaagctgtaagtaacgtgttcttcttgtgttctggagaaaatgtgtatagtgctaaattgaaaaaaaaaagttttttattcccgatcccggtagacatgggaga

SEQ ID NO: 20318 - DNA, 2343 bp, Zea mays
ctgcagtatctacattctggtcggcagacaccatgcatgtctctttcgacgagccatctgtactgtactgtactgtactacatgacgcagaaacaggacaggccaacagcaggaaaacgaagggacggcagtgcgacagcgcggccgccgtggttgttgcatcgtgcggtggagcttcggtagcgccctcgttatttaatggctcgcacccccccgccccgcccgggctccgtgtaggtttattgcatacgtactagctaccactgttggtctgtcacgccggaggcaggtcgcagttattactttaacccggggccccatcggcgatggcggccaacggcggtgaccacacgagcgctagaccgcacgttgtcctgctccctagcgccggcatgggccacctggtcccgttcgcccgcctggcggtggcgctgtcggagggacacggctgcaacgtgtccgtggccgcggtgcagcccaccgtgtcgtcggcggagtccaggctcctcgacgcgctcttcgtcgccgcggccccggccgtccgccggctcgacttccgcctggcgccgttcgacgagtccgagttcccgggcgccgaccctttcttcctccgcttcgaggccacgcgccggtccgcgccgctgctcggcccgctcctcgacgccgccgaggcgtccgcgctcgtcacggacatcgttctggcgtccgtcgccctgcccgtcgccagggagcggggcgtcccgtgctacgtcctcttcacgtcctctgccgcgatgctctccctatgcgcctatttccccgcctacctcgacgcccacgccgccgccggcagcgtgggcgtgcgcgtcggcgatgtcgacatccccggcgtgttccggatcccaaagtcatccgtcccgcaggcgctgcacgatcccgaccatctcttcacccagcagttcgtcgccaacggtcgctgcctcgtggcctgtgacggcatccttgtcaacacgttcgacgcctttgagccggacgccgttacggccctgcgccaaggctccattactgtctccggcggcttcccgcctgtgttcaccgtggggcccatgcttccggtgagatttcaggcggaggagacggcggattacatgagatggctcagcgcgcagccgccacggtctgtggtctacgtcagcttcggcagccgtaaggccataccgagggaccagctccgggagctcgcagccgggctcgaggccagcggcaaacggttcctgtgggtggtgaagagcaccatcgtggaccgggacgacaccgccgacctcggcggcctgcttggtgacgggttcctcgagcgagtgcaggggcgcgcgttcgttaccatggggtgggtggagcaagaggagatcctgcagcacggttccgtcggcctattcatcagtcactgcgggtggaactcgttgacggaggcagcggcgttcggtgtgccggtgctagcgtggccgaggttcggcgaccagcgcgtcaacgccgcactggtggcgcgcagcgggctgggcgcgtgggaggaggggtggacctgggatggagaggaagggctgacgactcgaaaggaggtggctaagaagataaaaggcatgatggggtatgatgcggtggcggaaaaggcagcgaaggtcggcgacgccgccgccgcggcaatagccaagtgcggcacgagctaccagagcttagaggaattcgttcagcggtgtcgggacgcggagcgtaagtaggctcgactgatttctgcgagcctgtaacagatacttggttcctgtgacgctgactgtagatcattttcggttgctagagttattttcgccggcctcttcctagccggctgcttatttttaggttggtctttgcttaaagccgccgaaaattaagctttgaaccctatctaattcaatcttttctcttccacgcactcgtttctttcaccgcgcgatgcctccacgctctcggcatccacgcgcggccgccccgttctctaccgaccgagccgtcgccccatctgccgccggccccaaccgggccagccaccggcgtctccgccctcggcaccagccagcagtccaaccaccgctgacgtcttcagtcgggccgcgccgcctcctctgccaccagccgaacggtcatcgccctcgcgtcgagctcccgtcttctgccggccacccttaagacgagatgttgattttttttgttattttatttattattttcgtggtcgttatttacgaaattactaattaacagttttattacggtttaaaggagttgatttgtttaattgttcctttaaccacacatttttactttaat

SEQ ID NO: 20319 - DNA, 2208 bp, Zea mays
gtttttaaaatcattcatattataaatgtagtttagagacaatatatacacagaaaatcgagtagaggctggctatccgagaagagaaagtctcctgtatttttgtcatttagtctctaaagcaatgttgtacatgtcttaaaaaggactgcaattttagttacgagacatgagtttgtctagattcgtagatagaattggcaagataatgaaactttggatattgtaacgtgctcgttctgtaaaaagaaatgatattatcattagctgccaccagccgtgaatctcatacgttgggctgttgcatcaggtagggtcattgcttctctgtcggatgatacgagtgacccatcgaggcctgttttattagatctgaaatcctcttctgagaaaagtggagctgctaaacagatcctcggcgctcgccatgatttcaccgacgccgcatcatgatggttttgcactgttgagctcgtcgtcagcggaggcggactcgcaaaccaccaccggagaagattgagaagggtccaacggcaacggcaacgagaccaagatcaccataacgccgtccgtgatcctacttcctaccctactgttccgtcccaccccacggcggcgtccctagcttaaaccccgaaccatgtgggcctgggacccacgtcgcagtcaaacaaggcccacctattaaaccccaacagcgtccttcctcccctgctctcccgtttctctctctctctcaaccccacgcccccttctctgccattattgcccgcgcagccatcctctctctctctccctcccgctcagtaatcagtatatggggacgtcctgctcctcgcttcctcatccaatcctcccacttcctcttcttcctctcatcctgcttcccctcgcgtgcgcagacacgagcgcgcgtgtccgtcactcccgtgcgtgcgatatcctccacccgcctcagcccgctgtccccctgctcatcgcccgatcgccgcgacttataccaccatcagccagccaccactccctcctcaacattccgcttctctagtcccgaacaccggccggcactcgttagggggaggtgtgccggtgtgggaggtactctgctagccgccagtacatgtgaggtccatgggggaggaggtggcggtggtgctggagcccccacggcccaagtcgccgccgaggtacccggacctgtgcggccgccgccggctgcagctggagctgcaggccctcaaccgcgagatcgacttcctcaaggtgaggcatcgccggcaggaccgttccctttctgtgattctgtctcgtccccctttgacttgccctaactaaaaaaaaactttcaaaaaaaaaaaaaatcaccaccagctgcagtaagcatccgattcgtcgcgcgctctcgttttctaggaaacatgtgcagcgtgtagaaggggggccagtactagcgtgtgcgtgtgggggagatgcactagtttaatggcaggttggtgtgcaaaatctgatcgttggagcacaccacgccatttatttcgtcttcgtttggggatgagagccttaaaaatgcggagggatggagggagggagggcggcggatcccggcagctattcccgacgcgcgacaggctcgcccagcccagttgccctcttcgggcgtgccgcggctgtacctcttgtcctcttgggccgtgcggttcggttccttgggagaaaagaggggacgggggcatgggcagtgccgcagaccgcagtgggcagtggcactggcgcgctgcccgtgtcagagctgcgcgtggagcggcgggtgggcgtgtcccccttccgttcttgctccgcggacacgcacacggcatggcgttccttcgtcaggcactagcgctatcatgagtgttcgtgcagcagaggcaaaggtggtgcgctgcacggtgcaccgtacagtacagtacatgtactactggtgtttatgggctgggctgccacagttttggggctttctatgttctggactagattttgtgttttttttaatcaagggaaacgagtgtccttttgacgccgtgctctgctttaaggagcagatttgcgacgctatccaggtgagtaaagcacttcatttaatctttactggtcaagtgtgctttggtcttctttttatttatatgatgtccaaagcactggaggtagctgcaggtcgaaactaaagga

SEQ ID NO: 20320 - DNA, 657 bp, Zea mays
taggcccgcttttttttttttttttttcccccagtacaggcatcgcatatgtttgtctgtaagtaattcctcacggaactcatactcaggttaaattttcaactgtgaagttaaatgtagtggtcgcagagttgtgatgatagagaactgctatacagaagttaacaagcaccaactctccagataaaatggcattgctgtcatatcacattacacgtcgcataagaatttatggttcctgttctttgctctcagttgaagccactatattttccccatgttgcttttctttcttgcgctttggaagaagcccttccgcggacatcagttcatacaacttgcgcatgattgtctcttcttctacctgcagtttatgcaactcatgggacattgctccatatgtttccattagtgcttgattttgcttgtctaaatgcttggacacttcagccgaatgctttggatccattatcaccaaacaacttgatatgtctccttatgttgccggggagaaggatggcgtcgtcgatcggtcggtgatttgggaaccctaggccgtcgtccgcaaaatcactggtggtgaaagctaggtgaataaccccctcctccgtgtagcgagagcagcttagcagagttaatcagagcagccctggccgg

SEQ ID NO: 20321 - DNA, 1235 bp, Zea mays
ctaataactgaactattaactaaactattgtttagatgtcttcagctaattttagcacagctaactattagctcaaacaccccctaattcagagggtgactgtaggtcatgcacccaacacactactatttacccgtttaaaatcatatatcctgctacaggaggccttcgtattacaattcgatagcttaattaggtgtgccagagctcaagggagctgacaaaaccaaatagcatgtcacaattgtgcatggaacttatatgggatgaatcagaattcgtaacaattgtgtcgccaaaacgaaaagaaagagacaagcagtcttgtgtgtaataatgtccctggaaatagaagaaagggaaaacaaaatataaaacctcagttgaagcatatgagcgaaaggaatgattatgtttgtctgtaagtaattcctcacggaactaatactcaggttaaattttcaactgtgaagttaaatgtagtggtcgcagagttgtgatgatagagaactgctatacagaagttaacaaccacgaactctccagataaaatggcattgctgtcatatcacattacacgtcgcataagaatttatggttcctgttctttgctctcagctgatcccactatattttccccatgttgcttttctttcttgcgctttggaagaagcccttccgcggacatcagttcatacaacttgcgcatgactgtctcttcttctacctgcagtttatgcaactcatgggacattgctcgatatgtttccattagtgcttggttttgattgtctaaatgcttggacacttcagccgaatgctttggatccattatcacccaacttgatatgtctcctgccgcttgcggttgcagatgacggagttcggaggcggtcgatggaagatgtcaggaggaggaggccgacccgatcacccgacaccgcgaatccgcgacacgcgagcgacggcggggggacgagctcggagtcggaagggtcggcggcgcaagtgcgcagcaccgcaagcctgtgaggggcgaggctgcgagttgcgacggccgacggtgcgaaactacggcggcgcgcggcgtcaatggaacggccgaacggtcacaagcgaacaggcgaacgggcggcggccgacgtgcacctgcgccgctgcgggtgcggctgtgcccgtagcggcgtagccccgtcccccgtactggaatttagagttagagtttggggaatttt

SEQ ID NO: 20322 - DNA, 1226 bp, Zea mays
  misc_feature (1218)..(1218): n is a, c, g, or t
gggttttttttttttttttattcaaaaggagaagactataaacatgtaattatacaagagaaacttgcttgcttgaaataaaaaaaaagaaatagaaagcccgctaaactattagctaaactgtttggatgtcttcagctaattttagcacagctaactattagctcaaacaccccctaattcagtgggcgactgtaggccatggacccaacacactgctatttacccgtttaaaatcatatatcctgctacaggaggccttcgtattacaattcgaatattcgatagattaattaggtgtgccagagctccaagggagctgacaaaaccaaatagcatgtcacagttgtgcatggaacttatatgggatgaatcagaattcgtaacacttgtgtcgccaaaacgaaaagaaagagaagcagtcttgtgtgtaataatgtccctttggaagaagcccttccgcggacatcagttcatacaacttgcgcatgattgtctcttcttctacctgcagtttatgcaactcatgggacattgctcgatatgtttccattagtgcttgattttgcttgtctaaatgcttggacacttcagccgaatgctttggatccattatcaccaaacaacttgatatgtctccaaaggaagaagtggacaatacagtcagaagcctagaaatgattaggtgtagctcagctcctcgtaaattgttggtatattcagaaataaaaatatatatgagcgtccatataatcaaattattcgacgtaatgacaccactgatgaggtaatcagaagatgttgtaacgtgaatcaatcacaccactgatgaggtcgatgggtgagctcttcggataaacccgagatatgtgatattgtaggttgtagcacgtactgcaatttccgcgtatggaaacaccgctggttcgttgcccgtccacaagctttctctgtagcgctcggcacgaagaggaagaggcggcggagggagcgacgacgccgaggagaagcccccaagcgggggccgaaacgagctgacgtatagaaatccgctcgtctctccgtttctgccgcccccgagcgtcgagcgccgagtctgctctactgccggcttgccgccttccgcagtccacagacggcacagcagtgagcaattcgtctagttcattgggctttttttttttttttttttgaacaccccggcccggccggcccctncgagggta

SEQ ID NO: 20323 - DNA, 971 bp, Zea mays
gagcaaaaggaatgattatgtttgtctgtaagtaattcctcacggaactaatactcaggttaaattttactgtgaagttaaatgtagtggtcgcagagttgtgatgatagagaactgctatacagaagttaacaagcaccaactctccagataaaatggcattgctgtcatatcacattacacgtcgcataagaatttatggttcctgttctttgctctcagttgaacccactatattttccccatgttgcttttctttcttgcgctttggaagaagcccttccgcggacatcagttcatacaacttgcgcatgattgtctcttcttctacctgcagtttatgcaactcatgggacattgctcgatatgtttccattagtgcttgattttgcttgtctaaatcctcgggccacttcagccgaatgctttggatccattatcaccaaacaacttgatatgtctccaaagaaagaagtggacaatacagtcagaagcttgtatgaggatgtgttgatgatttttccgtactatggaaaacaacccactccaaaaacattctctgggtaacagcccaccgtgcagaagatgttgtaacgtgaatcaatcacaccactgatgaggtcgatgggtgagctcttcggataaacccgagatatgtgatattgtagcacgtactgcaatccgaaaacgaagaggatggttccgcgtatggaaacgccgttggttcgttgcccgtccacgagctttctctgtagcgctcgacacgaagaggaagaggcggcggagggagcgacgacgccgaggagaagcccccaagcggggccgaaacgagctgacgtatagaaatccgctcgtctctccgtttctgccgcccccgagcgtcgagcgccgagtctgctctactgccggcttgccgccttccgcggtccacagacggcacagcagtgagcaattcgtctagttcattgggc

SEQ ID NO: 20324 - DNA, 3824 bp, Zea mays
  misc_feature (3733)..(3733): n is a, c, g, or t
  misc_feature (3735)..(3735): n is a, c, g, or t
  misc_feature (3738)..(3738): n is a, c, g, or t
  misc_feature (3740)..(3740): n is a, c, g, or t
  misc_feature (3761)..(3774): n is a, c, g, or t
cactcacaactctcacaaggtaacttatttttgtctctataaaatacacataagtcataataatattgtatcatcattaatcactaaaacctctaagtacctatatgtttttaataattatcattaatcctaagcatatttaaaacaactacaatagatagcaagtagtttcttagttttatcattatgcaaatgtagaaacaaactcattatataatcaatagttctatctgtaggtatcatgtcctcgtcatagggtgaatatcgtttgtgcacttgggcctattggttagaccatgatgtcacaatgatgcaataagagctaaggtttcagctaaatacaaattaaaatcatagaggcgtggaatgtaaaacatgaaaaatacataaagtaaacagtaatttgtcacaactaataatgaatttattagttgtgacaaatgtagagcttaataatgtagagcttatgtagcatctaaatgagtattttattaaaaatgaagtgagagactaaaaataatgaattttggttagttgtattactaaatttatccaaaagttctggacttgtttggttcgcgtctaaccatgccacacttttcctaaggttagtcgctcgaattgaagaactaattttagacaaaaaaaagttaggtagagtgtggcaagttatgtagcgaaccaaataggcctaaaatggaaatgggccttaaatccatttctataattgttttggtgcttgatgagtgatgaccatcacaaccagattaactaactagtttgctaagcatatgatcacatgtccataagataacaaaagatggttgaaagattgacaaaactcaaagtctaaaaaatgatagggtcgcagaccatccgacaccaagggtagaccgtctgcggtacactttttagatactggacaggaactgtgttgattcacacatttatggactgtccggatccaagtcaagcaccgcccgtcaccaagtacggaccatccaactataatttgcagatcgtctccctattcaatatttattcaacccgaaggtgataagttgaagaaataacttttagcgctaggcccagaccatccgggatcaaggacggaccgttcgcatgacatcaccaaggaaagatagtcattgatctgtcaattatatcaactgagctatcagatcctaccattgtgagaggcacgaactgtctggacataggccatggagcattcgcgagtgcgtagaaacagaagaaagggcataacaactatatctttggttgagggctataaatacaccccaaccagcctcgcattgcatccaagcaatcctttcagtctcattaaatacaagagctagagcattcactccaacattgaaagcaacacctctaagagatcaaagccatacaagtgcctcactagagagattagtaaattgagatagtgccctacgtaagagtattctagaggagtgtgtgttgtgctcttgagcatggagttttgactcccattgagattgtaaaggctagcaagagtctccaacattgtggagtaccttgcgggagatttaggtctcttgataatttgagaaaagaggcctcaagtttgatctttgggatcactcgagagggttgaaagagaccccatcctttgggacacctcaactagagcgtaggttctttggaaccgaacctcagtaaaccaaatcacttgtgtcttttatgtgtctttatttgtgatttatgttctccctcttctattctaaagctctctccactctgatcatattacttcccgtgctaacgcttaatcgggaatcaaagttttgttttgagtgttaaattttaggtttcgcctattcaccccctctacgtgactttcaaggcccctagtactcatacaacacagaaatttaggccattatgtagcacgggttgatgggctagcgatctaagtgcatgtacaatcctgagctcttggatcggttttttatgtatatgggatagctaagagactgcatacaactatgagcccctagatcataaatatagttaagagataatatgtttagagagtcatatagagacgagctcttaccgaaaagtctatctcttgtactttttttagttagtcctataaagactcctcatgagaccccatattaaatgggttgaatatgctcggggcatataaaataggtgtcttgagttgtatcttcggctgtgttttttttgcttgcagtaccatgcaaagggttcgggcttgtacatgatgcgctacaacaattttttgggcgggtctcaagctaatcaaagattcatagttatttacaacgtgtttggtttgagaaataggtagttcattttctcactcctcattttcttgtttgatttgtggaatgaaatgagttgattcatcaccatttcatgactcataggctaataattagtaataatatgagaaatgtgtttattccaataaatttatagaatggacttatgatgcatcatcttctttagaatggattgtttttttaaaccaaatactccttaatgttcgcatgcccgatgcatccgtgaaccatctgctctaacccatctgttcgaaaaaaacatagaatttaagaaatgcactaatcatttgattttcccctagaatagttttttttcctttcacccttcagttaccacgtgtgtaatccagtcaccgctgcttttccagttaagatttcaacttcgctattgctgacatggtcccgtatttcctaactttgggatgggaaggactcccgaaggagcataagcatggaactgccattttcgatttacgtatggaataaagtcttgaatttaaggtttatgttgtactatcgtgcaatcctgcaatacttcagttgctgcccacggaaagaaaaaggtgtagaccattgtattttaccggtattagggtcgtcctctctgaaattgaaagcgagaggtgcatctgttcagcacgccaaaaaaagacaagaggggaacaattggcatgaaggtcaggtgtaacagaaatctcctgctgccggccggccggcctgcctccctgctccatgattgtgcaatgagcagcatgcatcttcagttccgcaagaccgcaacaagcatcaagagtggctataaatttggctgccctcctgctgaaagcaacagcttctctcccagctgtggatagttatttcctttgcactcatatttgttggttttcacgagggctccgagagaaatacaaactggtgcagaatcatgatcaaagacttgtggtccttgaagtgaatcggctcgttttttctgcctacaccttcagacatggtgcttgatgcctatgcgcactataagctgtctacgaatatgagcagatcacattggctgtaaaagccggcatgtgtctttacatatagcatgtggattattagaggaaaccgaaaccacatcacatccatacagtggcgaaagacacagtagggctaagtattgcggctttggtagttgtcatatctaaacttttgatagtcttatatgttagagtactcgttagggttttgattgtctcctgtgtatttaccctctcgcacttattgtaatgggcctggcccaactatcgagtgtatcaatacaacgccgcccaaccccactcaagggttagggtttcccacattatatcttctatgttagaataaaccatgtctaaaaaaananaananaaaaaaaaaaaaaaaaaaaannnnnnnnnnnnnnaaaaaaaaaaaaaaaaaaaaaaaaaaaaaaaaaagggggggccgttttaa

SEQ ID NO: 20325 - DNA, 1016 bp, Zea mays
atcccgggcaggcagcggtctgcctccctccatcgtccccccctccaggcagctgcagctccatcatgcaggtcctccgtctggcggcgcggccaggcgccgccgcgaccatcacggacgacgacgagggccccttcttcgacctggacttctcttcctcctccgtccgggcctcctcgaccagctccgcctcggcctcctcggacgacgccgccctcacgctcacggacctcgacctcgccatctccctgcaccggagccgctccgcctcgccctcctactacgacgcgcgccgcctctcccagctccacttatttccctcccacgcgccgccgctcctcctcaagccgggctccgacgtcggcctgcaggcgcacagctccgcgggcgccgctgccagcagcaccacgaacgccgcgctgtacggccgccgccgctgcagctccgccggcagcggcgcgcggttgtcgctgcgggcaattcatggagtgccctaccacgccgggcggcgacggggaggccgagcgcgagccgccgccgccccgcgccgccgtccggcggtacctcgccgagatctccgtgcggctgcggcggagcgtgcgtccccgccgcctgcgcaagagccggtccgccgcagcgccggcgacgcaccgcgacgactcgctggccgagaagcaggacggcattgccagcgccatcgcgcactgcaaggagtcgctccaccgggggctggcgctggccccgtccgtgtcaccgcagtcgggccgggctgcaacgagtcgcggtcctttggttttgtctagttcttagtttgtgtaatgttgggttgttagaggcttggaaaaaaaacaaaaaagaactctttttaggctttctttacccgctctaggtagatgaggaaaagttcggggcgccatgatggcggcgacagcaaaagccaaaaggcgccgcgcgcgtacgtacggcaggccgcggttggacgaggatctgtgcgtggttttctgatgggcctcggg

SEQ ID NO: 20326 - DNA, 891 bp, Zea mays
  misc_feature (646)..(646): n is a, c, g, or t
cattgggatcatcgaacatcggagagatgcgcgcgggcggcggcgcgcctccccgacacgcaccactctccccgaccgcctccgccactgccacgctagtacccgcttctgtcgccatgcccacgccgcgcctcgtacacctccgccacctcctctcattccgctccgcccttccccgcccgctgggtcccaaccaaagccacccgctccccgggtcggttcacccgtcccttctcctcccccgtgccatggctggtgtcgcatacgcaggtctggcgacggggtcggcggaatacgaggaggtgctcgggtgcctcgcgtcgctgataacgcagaaggtgcgcgcggacaccggcaaccgcggcaaccagtgggagctcatggccaagtacgtccagatactggaactggaggaatccatcgcgcagttgaaagtggttcacgttgctgggaccaaagggaagggttcaacatgcacatttgctgagtcaatccttcgatcatgtggtttccacactgggctcttcacttcaccacatttgatggatgtccgcgagcgatttcggcttgatgggctggacatttcagaagaaaagtttataggtatttctggtggtgctggaagacactgaaggacaagactggntgatggtgtaccgatgccggcctactttaggtggatgtccttgcactgctcgcattcaagatcttttcagatgagcaggtctttttaaccatttagtgggtgtaggaaggatatcccagcttctttttaaatggattttgaagccttttcccagtatgaggaatttgtagatattgcctcattttatatgaaaataaattggtagaaaagcatatcttgtgtatctgtgtacagtagtggaatat

SEQ ID NO: 20327 - DNA, 4103 bp, Zea mays
  misc_feature (224)..(224): n is a, c, g, or t
ccgccactgatagacgatggatcgaactcgtcaaaatactattgtacaagcagccttgcaacagttttcatgatgaaccttgttcataacttgaaaaccgtgcagagatttcttagcaaaattctaatataaaatactccctttaccccaaatcaaaattcgttttagcattttaatagattcatacaataattaatatatgtattttgtatatatctagattngttatcatccatttagttatagacataaaaataaaaagttaaaacgaatactaatttgaagaggagtataagttaacaacagcttagcggttgctaggtatagatgggcccaagcacatgttgctcacccgttcacaaaaggcgggtcgcggtcggcccaggatgacagccctgataggcccgtggttagttttctgcagcctaaccgatggcccataaagtcgggcaccgtagaacgtgactttgaaaactcgatgtgcgccgggccagattataggttgggcccaggaaccctgctgcccgcccccccgtcagctctcccgtcgtcctgcaggaggcgcagagcagccgtcgttcgggcaatggctttcagtttaccctttctctgatttgaactttgccgaattccaatttcaaaccaagcagcgtatacgtgtcgggatccagctgcaaggataggatagggtactttgtcagcaggctgcggtacacttgctgtttcagagcttcttcctcctggctcgcgtgaaagaaaaaaaaaaccctgatcgcacgaggacaaatcagcccgacgacaccgttaaaccacaagcccccaccctctcgcacttttggagtaccagacgtagcacaaccaaccgagtacgtatgctcgtacttcgtagatgttgttccctagcttcttttctttggttcacttctctgatgctgcctgaaatgtccagtccaatggatctctcgttacatggatatattattttggaaccaaaatcttgctggttttcggccatatgcgtctgcttgtgttcccctctggatatatacgccatgattctgtctaaaacaacgatcttgtcttcttgataggagtgactaggagtatacttcttgtgtcctcatgttcaccgattcccctctccgattcgtttctcaggagaggggctgttcatgaaggtgtggaggtacgtactcgctgttcctctacacgtcgccagcttggtcgtcgcgtccgcggtcaacctcgacatggccatgggcgcacgcaccgtcgctgtgagcttcttacgtgcatgccatgagtatcatcaactagtaggctattttttttaaatgatttcgaggttactgtttcagacgtgcgcaacaaatggttataacaaataacatccatatcttataatgctatttctttatcagttcatctataggtcttggcttttgatccagtccttggtcaaaggtgtagagtcacggaactgacgcctcatcggtccaagatccctcttttggagcattttctgtggccttcggcacgcaacccatcggttgaaatgatctgttctcttgctctgtcggttgaaaaggtttgatttattgatccgttgacatgttgcaaaactattgctgcattggtagtttggactttggagcgggatgtataggttggcagatcgctccaggctcttccgctcatgtatagctggagctacgaataagtcatcttggttctgacttctgaaatggcgtgttcaacgacttccattctgcaggaaccaatgagctggagatcgaagtaggctgctatgctgaacagaacaatgcatgtgttgcgagctacaggaaagccggaagcgatgtgaccagctaccgtgaagctgccatgacgattttaattaacatatagaatgtggcgatagaattagccacacatggccgtcagtagtgtcgtgaacgagtcaaacctgccatcatgattcttatagcctgcgttcagatccttaaaacggccgccacagctacagcttgttcgcggcacagcatttggcaactcaatacccagctctcatcaggagctcaacaaagtctgttaggatgctgagagcaacgcacctcgctttcaggtttctcccctctcagctctcagccgcaattggttgtcgtgctttagttctgcttttgtttctttcatgcacgaactatccctttcttaagcattcccgccgattactgatcgtggcttcttgaacgcaggagggacaagggtacggctgcgggagccgccttgcgtggcgtcgtcggtggcttctcgacggcgtcagactcccagtcccaaaggctagccggcaaggtcgccgtcatcaccggcgcggccagcggcatcggcagggcgacggccgccgagttcgtccggaacggcgccaaggtcatcctcgcggacgtgcagggacggcgccggccgccccgtgcccgccgagctcggcccggccgcggaatacgcccgctgcgacgtcacggacgaggcccagatcgccgcggcggtggacctcgccgtggcgcgccacggccgcctggacgtgctgtacagcaacgcgggcgcgccgggcgcctcggcgccggcgccgctgccgtcgctcgacctcgccgacttcgaccgcgtcatggcggtcaacgcgcggtccgcggtggcgtgtctcaagcacgccgcgcgcgtcatggtgccccgcggcgccggctgcgtcctgtacacggggagcactacgggcatgctcggcggcctcgccgcgctgccctacagcctgtccaaggccacggtcatctccgtggtgcgggccgccgcggacgagctggcgcggtcgggggtgcgcgtcaacgccatctcgccgcacgccatcgccacgccgctgctgctccgctccctcgccaggctgcacccaggcgtccccgacgagcagctgaagcgcctggtggagactggcatgagcgacctccgtggtgcggtgctgcaggtccaggacgtcgcaagggcggccgtctacctggcctccgacgaggccaagttcgtcaccgggcataatctcgtggttgacggtgggttcacggccagcaagcggatcggcacgccggcggcaagctcaaccgctagctgaccattctcctggacaggtcctgcgaataattataaatcaatgtacttggttgatcgtgagttgtgagttgtgaccggattgatatgaaacctagcattctaaagtatcaaccagcgttacattatcagtgatgccgttgcaaataactcacccaccaatttcattaactcatccaagctaaggcttttgtttgaccagtcgagaatttgggtctgtttttgtaactgcttcaccaaactccaaattcaacaaaaacaatttcacttcaaaaaaatttagtcaaacggtttgtattgatgaaatctaaattcataaaattgatggaactaggagctgaattcaccatttcgtgaagctccacaaaagttgctccatcaactcaatttagcggagttaataaaaagagaacatattcgtgcacacgagtctttaagcacatagttgcacatgaactaacaaagtttacaaaaaaatctaaaaaatcatacatattcgttccaccctactctaattatatacgaaatttcaagctcaaattcgaattacataaagagtaatagaaaagataaaatttcggacaagtttaaattagaaaatcggctaaaatgttctcttttttattacaactaaaatataacaaatttaaatttgaaattttgtatataattagagtagggtggaaagaatatgtatgattttttgtgaactttgttagttcatgtacaacctatgtgcaccaaagactcatatgtaccggatatgttcctaaaaaaattacccacaagaccactattgtcactcattacacagctcatcgatccattcttctgtttttatcgcttatttcttcacaatcttttgataggacctagatagctaggggtgaataggcaaaatattcacaatacttacaacaataactagagccaaaatgtttgaatatgcttgaagc

SEQ ID NO: 20328 - DNA, 506 bp, Zea mays
caagacgtttgacatagatggcgacgaaaagatcagcaaggacgacttcatgacgtgtcttgggaggttccccgttcctgattgcgtttctttgcagccccgatcaatggggaagtgtacatcgagatagtctgaaggcaaggcgatgccgtgtaagagcaaccaggcgcagttcaaagatgaactagcaggcgacaaatatttgagaagggagttagtattatattgtcattacggaatctgctgtgagatacgcgctggactgatagattgtcgatggaactgagaatgcacatagaaagcatttctaatgtactcctgtaagaaaacttttttggacaaacaatgaccctgtaacctcaaattgtgttttattcttgctagattgattacataacaaagccccacgtaggtatatccagatacataaccttttgaacattgtaacctcatgttcggcgagttgaacatttgtttaaaccatttagatgtaatgtatatttaga

SEQ ID NO: 20329 - DNA, 2279 bp, Zea mays
  misc_feature (892)..(916): n is a, c, g, or t
ggatagcaaaaacgaaacggcgaccacaaacaaaacagcgactcccttgttgccggctatcgcttttgcctccgtttcgctttgataaaagccgggtcccccggcccccccccgctcgcctcccctccctccctccccgccgctgtctccggcgaccgccagcctcatcgtccatggcctctacatgcctagcccccgcctccctctccacgcccctgctctccgactccatcgcgcgcgcgcccgccgccaacggcctcgccaccaaccaccgacaccaccacgacgacgacagcgacggtgctgcggcagtctccgtttgcgacgacggcggcggggacccgttcgcgttcctctcggaggaccggccgccgagggaccgagggccgtccccggccgacccgttccgcaacggcacgccggcgtggggcggcggcgtgtacgcgtggtcgaggacgctgctgctcctgccggtcgcgttggtgcggctggcgctgttcgggctctccatcgcaatcggctacgcggccacgtgggtggctctccgcgggtgggcgaacacgcacgggaggccgcgggtgggcggcgggcctatgccggcgtggcgccgccggctcatgtggatcacgcggatctcagctcgctgcatcctcttctctttcgggtaccattggatcagaaagaaaggaaggcccgctcgtagggagctcgcacctattggtgtttccaatcatatctcgtacatagaacccatattcttcttctatgaattggtcccaaccattgtttcgtcagagtctcatgatgccctaacccatttgttggaaccattattccgagcgatgcaggttatatatgttgacagattctcaccagcttctcggaaggctgnnnnnnnnnnnnnnnnnnnnnnnnnagcttgcaatagcttcccgcgggtcctgttattccctgaaggtaccacaacaaatgggagattcctgatttcgttccaacatggtgcattcatacctggctaccctgttcaacctgttgttgtccgttatccacatgtgcactttgatcaatcatgggggaatatatcgttattaaagctcatgtttaagatgttcacccaatttcataatttcatggaggtagagtaccttcctgttgtctaccctcctgagatcaagcaagagaatgcccttcattttgcggaggataccagctatgctatggcacgtgccctcaatgtcttgccaacttcctattcatatggtgattctatgattatggcacgggcaatagaagctggaaaggtgaatggctcaaattacatggtagaaatggcttgggtaaaagatatttatggtgtgagcacagcagaagcaatggacctattggaacatttcctggcaatgaatccagataacgatggacgtgtgaaagcacaagatttttgggctcattttggtctggattgcagtcctctgtgtaagaagatatttcactactttgatttaggcattaaggaatcgattacgttccgtcagttcttggttgggtgcgcgcacctgaggaagcaacccttgttccagggtgcctgtgagaccgcctttgagaagtgccgggatcctgaaacatctgagatctccagggcacagctagccgatgtcctgcggttaagcatgctgctgccgtctggtgatagaatgctggacctgttcaagacgtttgacatagatggcgacgaaaagatcagcaaggacgacttcatgacgtgtcttgggaggttcccgttcctgattgcgttctttgcagccccgatcaatggggaagtgtacatcgagatagtctgaaggcaaggcgatgccgtgtaagagcaaccaggcgcaggtagggccggggatccctccgtttatgcaatgggatacccacctgtatttgggttgcatcgagtggctgaccaatatagtgcgtcaattttgtttcgttgcttctttcaaatactcacttcgttcttttttatttgtcgtgttttagttcaaagatgaactagcaggcgacaaatatttgagaagggagttagtattatattgtcattacggaatctgctgtgagatacgcgctggactgatagattgtcgatggaactgagaatgcacatagaaagcatttctaatgtactcctgtaagaaaacttttttgaacaaacaatgaccctgtaacctcaaattgtgttttattcttgctagattgattacataacaaagcccaacgtaggtatatccagatac

SEQ ID NO: 20330 - DNA, 2437 bp, Zea mays
  misc_feature (209)..(209): n is a, c, g, or t
agccttaggatagattgtttggtcccactcctcaacgaggagatactgtagctcgccggattttcttacatctgagctatttagatagatgataaataagatactcgtcaaaattatataaattttttttctcactctttgtatatgtgtcaaactttttgttcaaataaaaaggtacctataaactctaacacatggagacacgtggnatttttttaaaggagggaaatagagatcccgtgaaaacgactccgaaactgcaagggccaataagcaaaaaacgaaacgacgaccacaaacaaaacagcgtctctcacttgttgctgcctatcgcttttgctttgataaaagccattactcccggccgtccattgctcgccgccgccgccgtctccggcgaccgaccgccagcttcgtcgtccatggcctctacaagccctaacccggcctctctctccgcgcccttgctctccgactccatctcgcccgcccacgccgccaacgggcacgcagccaaccatcggcaccaccacgacggcgccgtcgcggcctccgtgtgcggcgacgcgggggacccgttcgcgttcctctcggaggatcggccgccgcgggaccgtgggccgtccccggccgacccgttccgcaacggcacgccggcgtggtgcggcggcgcgtacgcgtgggcgaggacgctgctgctcctgccggtcgcggcggtgcggctggcgctgttcgggctcgccatcgccatcggttacgcggccacgtgggtggctctccgcggatgggcggacacgcacgtgaggccgcgggagggcggcgggcctatgccggcgtggcgccgccggctcatgtggatcacgcggatctccgcccgctgcatcctcttctcattcgggtaccattggatcagaaagaaaggaaggcccgctcctagggaactcgcacctattgttgtttccaaccatatctcgtacatagaacccatattcttcttctatgaattattcccaaccatagtttcgtccgactctcatgatgccctaccatttgttggaacaattattcgagcgatgcaggttatatatgttgatagattctcacctgcttctcggaaggctgctgtaaatgaaataaagagaaaggcagcttgcaatagcttcccgcgggtcctgttattccctgaaggcaccacaacaaatgggagattcctgatttcgttccaacatggtgcgttcatacctggctaccctgttcaacctgttgttgtccattatccacatgtgcactttgatcaatcatggggaaatatatcgttattaaagctcatgttcaagatgttcacacagtttcataatttcatggaggtagagtaccttcctgttgtctaccctcctgagatcaagcaagagaatgcccttcattttgcagaggataccagctatgctatggcacgtgccctcaatgccttgccgacttattattcatatggcgattctatgattatggcacgagcagtagaagctggaaaggtgaactgctcaaattatatggtagaaatggcttgggttaaagatgtttacggtataagcacagcagaagtgatggaactattggaacatttcctggctatgaatccagataacgatggacgtgtgaaagctgaagatttctgggctcattttggtctggattgcagtcctctgtgcaagaagatatttcactatttcgatttagacattaaggggttgattacgttccgtcagttcttggttgggtgcgcgcacctgaggaagcaaccactgttccagggttcctgcgagaccgcctttgagaagtgccggggtcctgaaacgtctgagatctccagggcacagctagctgatctcttgcggttaagcatggtgccaccttctgatgataagatgctggagctgttcaagacgttcgatgtagatggcgacgagaagatcagcagggacgacttcatggcgtgtcttgggaggttcccgttcctgatcgcgttctttgctgccctgatcaatggggaagtgtacatcgagatagtctgaatgaatgcctgaggcaaagcgatgccgcgtaaaaggctggagctgccagtgccaggcgtaggcaggggatccctccgtttatgcaatgggatacccaccgggtgctcctccactttgagaccaaagcaactgtagtattgggtattgggttgcatcaagtggctgaccagtgtagtgcgtcgattttgtttagttgcttcgttcgaattattattggccatttaccgaatctgttgagatacgcgctggactagtagattgtcgatggaactcagaacgcaaatagaaagcatctgtaatctgaactaactgagaaaacattttttttttggctctctaacctgctgaagttgtgttttcttgct

SEQ ID NO: 20331 - DNA, 1090 bp, Zea mays
taggtcacaacagctagtactcccagccgatctccacccagccagcactgcaatgtggatggcacctagcatctattggagagaatgggaaggaagaagagagaaggagagctgatctctaggaggaactcatgggcgacggcgccgggagcagcgacggcgttgaggacggcagccatgcccacgcagactaatcctcacaacggagaattaagcagtgtccagcgcgcctaagagagaatccatgtctataccagcgtctgcacgttgtgtgggtttttaaatcatcgaatcccttctcagcgcctccgtttcgtcgaagctgggtgtgtcgtgttttataatggcaaaaatctccttgtttcctagccgctaggctgttcctcctcatgccacttctcgctctttggcttaggcgcaggagcagaggcctcccatggcgccaccctctccccctgcagctttccctccctctcggccacgccctctgtcctagctccctgctagccaccatctccaagtcggccatgggccttcccccatgccctcttctgctccaaggcataggagcctaaggtcctccatcagccgaacttgctccttctgtcatggcctcgcgctcgacggtggcgactcgtcttcccaagcgcttagtgctccacctcaccgtgccaccggccaacctcgccggccgagcccctccccagcgcccagcctcccccagctgggtgtcccttaagcacagggagctttagctcgttctccttcgcgtcccccttgttcctcatctatgcaggcctcccgcccttctctggtcttgccatggtgggagccgcagccccaagtttgtgaccttgcctcggctccactgtgcgtcgccgctccccctgtgcactcgcttagccccgctttgcacactcgccgctgctcctccatgagcgttgcttgctcgacaaaatgcacaacacaccacacgtcgtcggtaccttgcagcagcaaggaacccctgcatcgtgccgctacacccgcgccgtcgatgcttgctaggcgctcgaccaaatgcctaagccagcctcacccctgcaggtcg

SEQ ID NO: 20332 - DNA, 2553 bp, Zea mays
acagggaatcagtgcgagttcatcaacatgaaagaagcagcaacaattacaagaccttcatcattcatccatcggccaggcatagacagacccaagccgcaggctaattttcaaatcacacacattccaggtgatgatgagttcttctaaaccaacatcagcagcactacctacctaccaaacacccaaggacacagctacaaaactagagctaaccatactatcgctttgatggtggcctcccatcgtcatcatcgtcaccatcatcatccccgtcgtcgtcgtcttcttcgtcgtcgcctgacctcttcctcttcgtagaagtctgcgccttcacagagtcctcaccgtcatcgtcctcttcatcgatctcctcatcgtcggcatcctcaccgttttcttccggttcaaagtcgctcgagtgctcttcgtcttcagcccgcccaagaggctgaaccagatactcggttcccagtcccgctcctgcgaaattaaacaagaaaatcaggagatctaaaataaatccattgaaaattcacaagagactagccaaatatataagtccataaaaggagatctgaaataagttgttcgtcacttttccaaaaacagcctcagtgatttgccataaagacaagcagtaattacccaaggaaagatcgatcaataaaccaaacaaccagatctgacaatatcaatgggatcagactgacgtgcaaggtataatccagaggtggataacatttatctaccctcagtggaataggttatcatcatttcccaactgacgctaccttttttgcatttgaccactaggtcctgatttgatgtctcgtttttttattaaacaaaaaaagagagaggacgacaaatcagttgtctcgtttcccaactgatttgctgtctcagttgtttagatttatcaaaaacaagcaacagtaataaagatataaaaaggtcactggatggttcctgtgagaaacagtcagcacaaatcgatccatgaacaagttggcaacatatgctttggatcagaacggcaatcagttttcttgcagcacagggaaaaagctcttggctcccctcagaaacagcctctgatgagaatcatcatctccaaaagcacagagaacttaaattttgtagaaaaaaattacagaaaaaatatcaagatttgatcttctttgcaggtgattttgttcttaaacatgacttgttctctttagaatttttgcaggtgattttttaccatagaagagaccagaaacgcacgaacccttgcgtggaaacataagtaataatctaagcagatccaatttctctgggaagaaactgttccagaaggactagtaaacacggatctgcggcacgcacaagacggctgaaccagatactcggttcccagctcctcctcctgatcgtcttcaccgtcgacctcttcctcgtcgtctgagtcctcgtcgtcgtcgtcgtcgtcatccccgtcatcgtcgtcgtcgtcgtccgcctccccgtcaccgtcgtcgtcgtcttcgtcggagatctccacaacccctgccgcctccttctcctccccatccacctcctcatcatcatcctcctcgtcaccgccttccccatcgtcgtcctcgtcaccgtcgccctccccatcgaccgcctcgtccccgtccaccacctcctccacctcaacttcctcggccgctttcttggcagccgctgccttcttaggtgccatctcctccgccgctcgctcgtcagcctccgcctctactgccggcttcatctctacgaaatcggatctgattgggtgatgcttcggtggagggaaattgggggggaaattttgggcgaatttgtaagcggcggggacgaacagggggcggtggagggactgggtttcggcagattggctacatacgatcctggccgtccgtgacaagaacaagcacacggatcggtgacatggcgcacgatcgaacggctgccaagcctttgttcggtcggggactcgagagaacggctagggctgacgtcatcgcgagagtattttgcggtcctggtcctgtgtagtccgtatacgcgggcctggcaacccactctcgagatatgggcctgcctgccaatatcctttgttttctcaaaattaactttgacctcgtagtcgaagaatctcaagtttaaaccaaatctatataataaaatgataccatacatggtactaaataagtttttttgttgaattttttattaattgtattttgtagcataactgttttttgattatatagatttgatcaagtttgagatattttgatttttaaaaatggtgaatattttggaacagatgaaaaaatcgagaagttttatgagaactccataaataagtttttgtagcacacatgctatcgctgagtgaggctattattaaatgcactgagctgctaaaattaatctagtatttttagccaactaacaattatttttaatgcattcaaacaatccctaaatatagtacagaaataatatatcttgctcaaccaagtagaaccatgg

SEQ ID NO: 20333 - DNA, 976 bp, Zea mays
  misc_feature (7)..(7): n is a, c, g, or t
tattttntttttttttctagggaaaaaaatccgattctagttaaacccataaagctgtctagacagacaattagatttttttttttacagtgaatcagtgcgagttcatcaacatgaaagaagcagcaacaagtacaagaccttcatcattcatccatcggccaagccaaatcacacacatatcccaggtgatgatgagttcttctaaaccaacatcagcagcactacctacctaccaaacacccaaggacacagctacaaaactagagctaaccatactatcgctttgatggtggcctcccatcgtcatcatcgtcaccatcatcatccccatcgtcgtcgtcttcttcttcttcgtcgcctgacctcttcctcttcgtagaggtctgcgccttcacagagtcctcaccgtcatcgtcctcttcatcgatctcctcatcgtcggcaccctcaccgttttcttccggttcaaagtcgctcgagtgctcttcgtcttcagcccgcccaagaggctgaaccagatactcggttcccagctcctcctcctgatcgtcttcaccgtcgacctcttcctcgtcgtctgagtcctcgtcgtcgtcgtcgtcgtcatccccgtcatcgtcgtcgtcgtcgtccgcctccccgtcaccgtcgtcgtcgtcttcgtcggagatctccacaacccctgccgcctccttctcctccccatccacctcctcatcatcatcctcctcgtcaccgccttccccatcgtcgtcctcgtcaccgtcgccctccccatcgaccgcctcgtccccgtccaccacctcctccacctcaacttcctcggccgctttcttggcagccgctgccttcttaggtgccatctcctccgccgctcgctcgtcagcctccgcctctactgccggcttcatctctacgaaatcggatctgattgggtgatgcttcggtcccggccggctgggggggacctttt

SEQ ID NO: 20334 - DNA, 632 bp, Zea mays
  misc_feature (33)..(33): n is a, c, g, or t
  misc_feature (55)..(55): n is a, c, g, or t
  misc_feature (76)..(76): n is a, c, g, or t
  misc_feature (91)..(91): n is a, c, g, or t
  misc_feature (95)..(95): n is a, c, g, or t
  misc_feature (138)..(138): n is a, c, g, or t
  misc_feature (149)..(149): n is a, c, g, or t
  misc_feature (158)..(158): n is a, c, g, or t
  misc_feature (161)..(161): n is a, c, g, or t
  misc_feature (631)..(631): n is a, c, g, or t
ttttttttttttttttctttttttttttttttntttttttttacagggaatcagngcgagttcatcaacatgaaanaagcagcaacaagtncaanaccttcatcattcatccatcggccaagccaaatcacacacatntcccaggggangatgagttnttntaaaccaacatcagcagcactacctacctaccaaacacccaaggacacagctacaaaactagagctaaccatactatcgctttgatggtggcctcccgtcgtcatccccgtcatcgtcgtcgtcgtcgtccgcctccccgtcaccgtcgtcgtcgtcttcgtcggagatctccacaacccctgccgcctccttctcctccccatccacctcctcatcatcatcctactcgtcaccgccttccccatcgtcgtcctcgtcaccgtcgccctccccatcgaccgcctcgtccccgtccaccacctcctccacctcaacttcctcggccgctttcttggcagccgctgccttcttaggtgccatctcctccgccgctcgctcgtcagcctccgcctctactgccggcttcatctctacgaaatcggatctgattgggtgatgcttcggtggagggaaattgggggggaaattnt

SEQ ID NO: 20335 - DNA, 1285 bp, Zea mays
gggaaaaatagaagctatatttttttcgttgacacaattttcaaacaagttctaaatatgacaagaatcaactgactgcatttgaaccaaaactttcgtacagatagcaccaactacagtaatggacatgtagcccgaccagatatcagcctattcaattatcggctatttaccagagtgacacaacccgaaccccactgattaaggaaaagggcaaggaagtcaactttctgaattttgcgtctccataaatatgttacacatcgaacctaagcatctccatgggactaagtggaacctttgaggctccatcagatgcatgttccggaaccaccttcctccaagagagtagaacagaaaacccacatatgatcctcaaactgcttgtacaataatggtccaaccagttccaagtgcttcctgcacgtcctgacgtccatcatcatccgccatcacgtgagcggaactctgctgccctcaaattcatttcatatctcaggattttgttcgcccattggatactctaatacagcactgtcagcagcttgttcagggtgcttgattgaatcgatgtcagatgaaacaggcgatgctgcttctgcctcaggtgctgaagatccaagcataccaccactcttcttttcctctcctaactcggcatcacaaagcataacatcgtccatggaattcagctgcttctcactttcaacctcaataccaggaactgcagtatccttctcagcaacatcaccaggttcagcttcttcctccttccattccacaaactcgggttgactctcttttacatccggagtcagtggcctgatatcatcttcctgtttgtcaatggtaccatttgccaagacggtgtgaccagactcttcgtttgcgtctttgttggagactggtagagttggttcagaaccttctgtgtcatctattacttcgccaagaatgacttcatcatcctcttttagtgcggatatttctgaatttggagatggggaagcttctgggctaaccaaaccatcattcagtgccttgtcctcgtcaaatgcaaaccagttggaatttgtaaagagcgagccactttcttggtcgtctccaaggcgaagggaggagattactacctctgcagattcatcatcaaaatatacatcctcatcatcccgctcaagtgatgcttgagcctcctcgttgccatcgttactaaaaaaaaaatatttaaatgcctggcttaaattactagcaagtgcagccacatcgtagtccctatctcggaagt

SEQ ID NO: 20336 - DNA, 5723 bp, Zea mays
  misc_feature (1016)..(1016): n is a, c, g, or t
  misc_feature (5366)..(5366): n is a, c, g, or t
aggcttgcctgcagtagaaataaaagcaaaaggaagaactaaacctgcatgtcctgagaaagtctgtaggcaagtccttcctttccatagcttaatagtggaatcacttgaacctatgaaaaagtgtgaatatgtaaattgttaatcaaacgctagaaatttgtgttcataaatttatcagaaagtcatccaaggtaaatattgttttatggaatctagatgagccaacaactctaagaaaaggattatgttgtcactaaacaaaggtcacacatagtgcatccagattttttcttaaacaaaaggatttgcttttgaaaaccaagcgcacgtattacctccgtccctaaataaatcagcttctaaccttgttctaagacaaacttttgtaattttgaccaaatttataggaaaaagaacagaaatatatatgacacaaatatcattagatacaccatgaaatatattttcatagtgtacttatttggtatcatatatctagatattatttcttagaaagttggtcaaacttacaaaaaattgacttaagtcgggtctagaagttaatttattcagcgacggagggagtacaaactaagcaattacacttccaatatagcatgattttggtcccaaaattacagcattgaactgtttataacaaccatgtagtgctagtatcagttgccaaaatgccagataacaaaagaaatgataaatcacatgaacaagttacaggatagcagggcaccaaaatacaaaatacatgcacaggaaccaataaaatcattcatgtaaagtatatcagaagatttaccagtgaagagttcccctgtgggcagctttagaacagtttgcactgcaaccttgtgcgcttcccaaacctctatagcattgccatttctccaacgtcttacagtactgcatgcacaatgtgtgtcagtgaagtagaacagaggcactatagtaagaaaactggatgtctattaaggcatcccattagaaaaagcacttcnaacacggagtaatcagtaaaggtgcttggataatgaagcaacacagaatactgcttttctatattttgtatatgttgtacacatcttcaagcatagcacttttttaaattaacagaacacacgcagaggatgaacttaaaataagcaagcaagccaaggaaagatgccacaagaacatgtagcattaggaatttaggatcacacttgtctatgagagtttaccaatccatggatgaagagatgatgtcaccgttagtgtccacagcgagtccagtgacttgcgaactgtgccccttcattgtctcggcaacttctcctttttgcagatcccagaggaaaacaaatgtgtccattccaccagagacgattccaccttcaggaaaacggtctgaaggaggtatccaagccaatgggccgacaaaactcgaatgtcctgcgagtgtcttggagagaacatattcgctctccttttctgggttccgggtccagaacttcacagtacggtccctcgatgatgtcgcgatcccagcatcgccgcatacacagatgccacgaacctgaagaagaatgaacatgataaggcatccatgaaacaagtgtctacacaatatacgatgatgagaagacgtagggcctgtttggttcgctgcctaacttgtcacactttgtctaacttttttgcctaaggttagttcttcgattcgaacgactaaccttagacaaaatgtggtgtagttagccacaaaacaaacaagcccgtagttttgacaacaacaaggatgatcacaaagaaacgattgaactgtgatatgaattgttgaatgacctaatctggtgattcaaggatggaccctaaatcagcagcacgacaagaacatggtggaattgcactttaagcagaacaacggaagtctatgttctctggcctgcagagaaactaatttaactggcattcactgagtcaccaatctacttagcaaaaacagcccaaaatacagtgatctcaccaccgacaaaccccctgaggttactcctgcactaagcccactgaatccactgccacagagtgaactcacagtatgcatcggaaggtaaattgcatcgctccaatgcacccacaactccagggaacgcaacaagatcaaaagccccagcgatcccgccgcgggcggaaaccggcccccatacaggaccgagggctggggccgacgagcggggcgccgggcggatcgagaccgagggtatcgccacaaacttggagcggaagtaaacggagacggggcagcagtggcgagaatctagcggtgaggggagagggggggcggcagcttacgtcgtcggtgtggccgtgcagctgaagtccgaggcggtactcggccatgtcgccgctgtacggggcgcggcggagcgggcgagggcgacggaagtggtgggggacccgattggtggtgttggtgcaggggggagtgggagacgagtagacggcgaggtgttgggagtagggagttgggaggacttgggcacgtgcggagcggctgtttcgttcacttttgtgggccgggtcctgttcctccgtttacacaatctgggccgtggaaagcgagcacgaacggcctggctggcaccacgtctccatgataccgttggcagaaagatgttgggtgaatgggccaaatgccaaggcctagatagaggcgatcggatatggcccgaagagagttgggctcttataataagcgggggcttgatgatagctttggagcaccaaagtcagccatgaacggcgaaaatgagcagttcggctccggcacgtgtcactccttttgtttccgttttagcgcatatcatgctgcaagcctgcgactgcaactcgtagtatagtatccactatccaccggcggcgacgtacggttagcaagcgataatccgatcggcgaccggagttcagagcagagcagagcagagcagtgcggagcagttgctggcggaaaagcatggcacggcgatggattggccggagatgcttattgacggagagcagtcagtatcccaaacgtaatagtctcagtcattgtgatacgtggaacatacgtactagtgcaagtctgtgaactttagaaatgttatatatctaaaattgtaatcttttaatagtacatatctaaatttctctttattcatctcctctcctctgctattattgatcagtctggcactggcactggcagacaccaaatttacagacacacatgcataaatgatctcatcagtcatcacgtacgtgatcacgaccgatcacaactcgcaacaaaccaacagctaaaccaaaccaaaccacctcgatactattagtagtagcgataattcgtatcagtggacgagcaggaagaagcagtgcaccgcatgccagtagaggaaggagtacacgagctttagctatagctacggccacgccctcctctaatacatcccagattcactcagcaggtggcggcgcagcgctcggtgcagtcgaagctgcagcctccgccgcctccgccgccgcccccgttcttgccgccgtagctgaaggtccggaagcagcgcggcgggcaggtgaggcgcttcccgcggcagggcccgtcctgcgggcacaccgtggagggcggcaccacagcgccgcgccggtacccgagaccgccctcgccccagccgccgaagaacccgccgccgcctggcaccccgccgccgctgaaccgcggcatcccggcgaagaaggcgcccgggtcgccgccgccgccgcccgggttgcggttctcgttgttgttgttgttgcgggcggccgcgtgtagagcggcgagcagggtgaggagcagcaccgcggcggccgccctgccgggcttggtggccatgggaaagagagggaaaggctgctgcttggggacgacaagtttgggaggaatcgaatccaaccgggcgggcggggcgcgttggatgcgttgcgtcctgtgttgtgaggagggatcgattacggcgcggcgcggcagctacttatcatgctggacagcctgcgcgcggcgcgacgggagacgacagaggcgggcgggggcaacgcaagtggaagtggtggattcggagaagactttgtggggaaagtggataactaactggaagggggtggggcggtgctagtgcaaatcctgcttcctgcagctcagcagctgctccggagtcgaacgcgttggtcatctcgatcggcttcagtcaccatcacccccatcagagtgcggtctaggtgtagcacaaattaacggttgacagctgacagggcacgtgtcccggaacggagccacgggctgctacgcctttgtttgccctgcaaattgcaagcttgcctgctcgctgcccctgggttaattagccaggacgacctatccagcttcaccatgaccgtgcatactgtattactgtactccagtactcctctcaacgtctcggagggcgcggcgctgcacggcgctcgtctttaatggcgaactgtgggcgggggccatcgtcgtcggcgagtgtgccgcgggcgcggggcgcccgcgagtactatttgttgtacggtgggctccggccggggccgccgaccttggcagtctgcagcctctcgggagtccaaaacaagaccctgcaccgtgcagtgcccatgccgccctgcctctgcccgcgtgccggcctgtttcgccggcgcagcgcacccaccccttcgtcgtccccggcgccggcgggcgcgcacgctcccccctggtgcgtgtgcggtgtggttgcctggttggcattacctcacccgtcagacagtgcttcacctctgggtttttttttattttcatgcacggcgggaggtttcaaggcgattgacttgtagcattataacgataatgctaaattaaattcatataaatcaatatatcgcaacatgtaaatttgaagattaattgttaggcccaagtacatgttctaactcgtctggggggagtatatgaaataagggccaaccccaggacatgaagtatgtagaataatgcatgaaaaacgtacgaaaagtgcatacgaaaaatatggcaactcacctcattgcctctcactcaccttatcaatctcattctatgtcttgcatacttttagactatcttcactcattcactatttcaaaagttaccttacaaacagtgcaatctacggtaaaaaatagtactttgcacggccgtttattggcctgctagcgatgaccttaccctctccccgagtccccccattaatggcataaaagcgtaaaaaaaactaagggcctataggtatgaataaaacatacgtgccaacagntaaaatacgagtaaattcgatctgcttcacatatcatgtatcatttgaatctgcgttatccattcaccacaggaaaactaggaaaataggtcagcctggttaaaaacgtctcggtctaaagctgagtagaaggcatacagatacagactaggccaacttaccgagtcgcaacagtggtgcacctccaagtattactcgccaattgaacctttagataggtataaatgtaatcttatataaagatatacctcagctcgatcatatgcacagatgaacaatgccaccgtttcaagggtattatgtattaatatgtcgaagctcttgtattaagcatatgtattaacacccaaacattta

SEQ ID NO: 20337 - DNA, 3371 bp, Zea mays
ctcggtacccctggtacaaggaacgaagttttcttttttctgttctgctgggggaaacaaagaacaagaggggaaaataaaatctatatatttataacagatgaattaagcaccaagcacctgggaaaaatagaagctatatttttttcgtttacacaaatttcaaacaagttctaaatatgacaagaatcaactgactgcatttgagccaaaactttcgtacaaatagcaccaactacagtaatggacatgtagccagaccagatatcacctattcaattatcggctatttaccagagtgacacaaccagaaccccactgattaaggaaaagggcagggaagtcaactttctgaattttgcgtctccatgaatatgttacacatcgaacctaagcatctccatgagactaagtggaacctttgaggctccatcagatgcatgttccgggaccaccttcctccaagagagtagaacagaaaacccacacatgatcctcaaactgcttgtacagtaatggtccaaccagttccaagtgcttcctgcacgtccatcatcatccgccatcacgtgagcggaactctgctgccctcaaattcatttcatatctcaggattttgttcgcccattggatactctgatacagcactgtcagcagcttgttccgggtgcttgattgaatcgatgtcagatgaaacaggcgatgctgcttctgcctcaggtgctgaagatccaagcataccaccactcttcttttcctctcctaactcggcatcacaaagcataacatcgtccatggaattcagctgcttctcactttcaacctcaataccaggaactgcagtatccttctcagcaacatcaccaggttcagcttcttcctccttccattccacaaactcgggttgactctcttttacatccggagtcagtggcctgatatcatcttcccgtttgtcaatggtaccatttgccaagacggtgtgattttcgactaggactcttctaggtaatgcgtctcgggcggagactggtagagttcgttcagaaccttctgtgtcatctattacttcgccaagaatgacttcatcatcctcttttagtgcggatatttctgaatttggagatggggaagcttctgggctaaccaaaccatcattcagtgccttgtcctcgtcaaatgcaaaccagttggaatttgtaaagagcgagccactttcttggtcgtctccaaggcgaagggaggagattactacctctgcagattcatcatcaaaatatacatcctcatcatcccgctcaagtgatgcttgagcctcgtcaatgtcctcgctactgtagataccatatttaaatgcctggcttaaattgctagcaagtgcagccacatcgtagtccctatctcggaagtcttcatcatcgctatccctaccacgatcctgcagtgatgttggtcgaccgcaagcccactggtaaacattttctaatgcattacgcttcgtcagggtactggcatgccactcaatccaatcagaattttgctgcaaatgtgattgaaccatgatgtttgtgttgaccagctgaaggagcctgttagctatccgtgtcatatgaccaacaattcctatccttgggggagatcttccctctgaagacatagtatgcttagttaaatctgacgacagagcagagttcttctctgcttccagaattcttgtaacaagtttacagtcatcaaggacatggccaatcagtcgatcctgcttactctccaaacatgagccgatgatattctcgacatggtggtgcaagaagttgttaaacgggtactcaaaaaatagatctatagcatgcttgattgctcctagttgaatcagtcgtgtttcggcagctgcactaccaattgatagaagaacagagatgaactcaacaatcttcaagcgatgtttcccgagtggaggttgtaagctaccgtatgttgttggcagaacattttcagcagatgaaacatccagcagcttcaataaatcccctaggctatccagcatgccatttactgtctctggacttgcggtgacaagtgttccatggctcaactgactacggaaagcctgataggaagccgatacaagtctcttaggatctaacaaagatatgcacactgataatgagtggaccagcaccgatttaggccttgaatcttcaaaagcatgttgaaataacctccctacgaagcttggactggaaatctttgcagcaagtgctggaggggcgtatctggttactgcacaaaggatttcagcagcatttgcgtgaacctcagcagaatctgatgtgctgaacttgtcaacaatcatctcaaggacttgtatgtcatctaaccattgcatagaatctgcatggcttgaatacatagtttcatctgcaccgattaagcgaatcaaaacctccatgatagaagtaatcccaataagatcaacaagctggctaactatttcaggatggccctgcacataatgaactagttgaagtgtcttcctcatcgccaaacaaattactaccttagcaaagtaaccagccaacaatgtcccatgagggtggtcaggttttaggaaggagaaaagcaaattcataagatcttcatcctccactaatgtcttcatgatgacatccacgtcacatgtaaatatttcacaagctataaatggaaatctaaatatccttttcttttctgcatcttcaggagcctcctctacaatgtagcagagcaattgctccacttgaaccttatcccgcaaaaaattgattaagcgggtattcagtgctttgcactcctgaattatttcatcctcatcaagaagatcctccaacttaaaattttccttgtccaaaatagtatccacaggtgatgcagcggagaatcccggcacgtgccaaaacatcttgcacagtgacaattatgtcagtcccacactgtcacgatatcacaacctaagcggatttagagctgagatttccacatcatgagctggtatccggtggccagcggaggggagacgggggctccgaacccaggcacaggcgcacagaagcccgtcgtcgtcgtcgcggcggcggcggcggaacagcgagtgagcacagcgcgccctctcgcgatccgaagctttggaggcgctcgccaagccgagctggatccgggtggccgccgcgaaaccctataattcgccaatcgcgagatgaggaggactgggaggtcggaagggcgcggaggcggaggtggagtggaggcggatgaagggaagcagcagggcgaggccggaagaactttttttttttttgtatttttttcccggccggctcgaggtcccaatg

SEQ ID NO: 20338 - DNA, 1779 bp, Zea mays
ggccgcttttttttttttttttttggacaacggttattatcctggttaatgtgaatcaacaaatttacactgtatatatgcatgtatctgttaaaaggcaactgagcccatatctgcatacattgccctcagaagcagaatcatagatctaggttcctatatagcagtatgaccacctgtatcccttcggtgattgcaaatttccacactacaaaatccccacctttttttacctcctcccagcagccaagttgattgtagaactacatgactctagatcgatggatctcttctccgctctgagaagtgtccaagatacccggtcctgcagcatctacactgcccactgtaactctaaactgcactttttttaccagcacaaatctaaaagtacttgagctcatcagatcaaataaaagagctcaaggcatcgtatgatacggtgtttgttggattatctgtacattggtgaagttgagaaactttgaactccgcacccttgcaggcttctgaaagaggaggtttggcgtacccccctagtactccttggatgacaactttgtaactcgcctcggtgaagtgtagaccatcccatgagatgtattttgatgggtcagggcacactgtagatccaggacgcccgcacagtattgaaggggaacagttgtacggagcgtcacttccgcagcacgcattcagtgggactgtgaagccaaacttgagtggggcacggaatatgttcaatgcagcaccgtaataatcagcataaatgatggttacatcagggtgaagattcctgagtttctccaactcctcctgaagcatcctattatggtactcagcaaattcattgagccacttaatgcagcctgtttgttcctcatagtaaccctccttttggctctgaaagattgcaagatataatgggacacaccctattgggaagttccctggaacaactaacttctttgctccaagatttataaggtccgtgatgcccgagcttatggcgccaacaacattaggaacaatttcatgtagctcatcaacagatttctccctaacgattaaatggttgtaatcatttccgccaatctctcccacaaacaaaagtgacttggacattatttcatttagctctgtctcagatggtgcaatgaatgggagaagcttcttgaaccattgcatctgctcatcaagggagtgaggcgtccatgtaggctccacaccgcgctcacggaagaacgagccattgagagcagttgcgccgccgactgcaaagtttgcgccattctggaagtccccactgcctaggtaaggtggcacatatggcaacccaaatgcctctgcgaagaagtcgagcaggttgcggccgtcggaatagcggccggagggacgcccgaagaaggtctggccgtaggggaggttccgcgcggggtccgggaagtcgtcaggcacggagagcaggaagttgccggtatccgtgagcgagtccccgaaaccgaacatccggtcgaagcagacgctccctcctccagcttccgcttccgcttccaccgctgccaacaccaccatcatcccggcgaagaacagagtcgcccaagatggaaatgccatggcaaaacgacggcccgcgccgatccggagcagagggcaagttccagaagagggagacggggacggagacggcggggtgggcgttggcatggggtgggggtctgggggagagaggacgccggaacggacgaggaagcccggccggcctcgaggtacccaatg

SEQ ID NO: 20339 - DNA, 1800 bp, Zea mays
ggcccctcgttttcttttttttttgtatcaatgaagctacaatgtatatatgcttgtatctgttaaaaggcaattgagaccatatcaagtactgcatacattgccctcaggagctgatttaaaagatctaggttcctatatagtagtatgaccacctgcagagactgtcaactttcgttgtcccttctacagcctgcagtagtaagctgctaaggaaaacatagcagagcaaagtagtgcactaagcaatcgcaaatttctgcactacaaactcccctcccgtttttctcctcctcccagcagcgaagtggattgtagaactgaatgaccctacatcgatggatctcttctcggctttgagaaagtgtccaagatgttcggtcctgcaacatcatctatgctgcccactgtaactctaaatgcacttcttttacgagcagatcaaataaaagagctcaaagcatcgtatgatacagtgtttgttggattatctgtacattggtgaagctgagaaactttgaattccgcacccttgcaggtttctgaaaggggaggcttggcataccccccaagtactccttgaatgacaactttgtaactcgcctcagtgaagtgtaggccgtcccatgagatgtattttgatgggtcagggcacactgtagatccaggacgcccgcacaatattgaaggggaacagttgtatggggcatcacttccacaacacgcattcaatgggactgtgaaaccaaactggagtggggcacggaatatgttcaatgcagcaccatagtaatcagcataaatgatggtcacatcagggtgaagattcctgagtttctccaactcctcctgaagcatcttattatggtactcagcaaaatcattgagccacttaatgcagcctgtttgttcctcatagtaatcctctttttggctctgaaagattgcaagatataatgggacgcaccctattgggaagttccctggaacaactaacttctttgctccaagatttataagatccgtgatggccgagcttatggcaccaacaacattaggaacaacttcatgtagctcatcaacagatttatccctaacgattaaatggttgtaatcatttccgccgacctctcccacaaagaaaagtgacttggaaattattttgttttgctctgtctccaacggtgcaatggatgtgagaagcttcttgaaccattgcatctgctcatcaagggagtgaggcgtccatgtaggctccacgccgcgttcacggaagaacgagccattgagggcagttgccccgccgaccgcaaagtttgcaccattctggaagtccccgccgcctaggtatggtggcacatacggcagcccaaatgcctccgcgaagaagtcgagcaggttgcggccgtcggagtaacggccggaggggcggccgaagaaggtctggccgtagggaaggttccgcgcggggtccgggaagtcgtcgggcacggagagcaggaagttgccggtatccgtgagcgagtccccgaagctgaacatccggtcgaagcagacgctccctcctcccgcttccgctcccgccgccgccaacaccaccaccagaacccccgcaaagagcagagccgcccatggcggaaatgccatggcgaaacgacgggccgcgccgatccggagcagagggcgagttccagacgagggagaaggggacggggacggagacggcgcggtggccgttgacatggggtggggggaagagggggacggacagcggcccggccggcctcgagggacccaatg

SEQ ID NO: 20340 - DNA, 1952 bp, Zea mays
ggaccaacttactacagatagcaaagacaccaagttttatatagtaagggctgcaagttgtataaacgggcttggatacctaatctatgatgtcaacattattagccgagcatagtaaattaagtacccctttccaaattataatgtgttctggcctttctagatttatagcttttgtcacgcaccaagatataagttctgtatagatacatattatctagaaataccaaaatgtcttataatttggaacggggagtaacaaacatgatcaaccttgttcccgattttcacaccattctaactgcaggattttgttcaaagcattctcatatttctgtttgagaattggaacccagattaagttcggtggatgaaactaaaagaaaactcaatggtatcaaaaagaaaaggaaggatgtgtgtaccttgtgtttctcaggaagttgtagtgtccgttcatcagctttctgttgctcaattctggccacgttgagggaatcattttggtcaacattttgcagggattatgaatttattattggcaagattataaatacagttcagaaactttctgaaatgtgcaatgatagataagatgtgtacaataaacgatagccctataacaatcaatcatgataaaaagttcaaagttagagactcacctgagagctgtgatactcagggcccatagtcaaggagaatgtaagaaaacattagatgactcgttttctacagtaatcagtagttcatagttcaggtaaaggttcagatcggaagaattgtaaagtttaaaaatgtggagttacttacttggatttggtttggttaagcaaggtttaccttcatcgatagcgtacaatacatatgaatccttacatatccatgtgagatgcaaaacataactactaaagcttgcgttgaaacaattaaacccaaacttagtcatagaacactcacataaaagtacgctaaggttcactacttggtggcataaatctcgagtaggaaccgagatgaaagcatttggtgcaggttttcgaatacgtccttctgaggacgacttcagtagctggggcatcggcacggggcgtcgaggcagagggcagctagggggtgtcgaggcagagggtggcgctgggcaggaaattggcccatttagaccaaagttgcttgtatgacaaaacctatttatgtagaaacagtcaggcatggcccatttagaccaaagttgcttgtatgacagaacctatttatgtagaaacagtcaggcaaaagttttgtgctgcggcaagtgctgccagctgttgacctgaataaaaatagagctaagtatacagaaatagtggtacatgcagttctcaaagattaagttgagatacaaaaataaaaaatagcacatagcagtatagcacagatcaatcaaatagagctaagtattaagagaggaatagagaaagcatgaagtaactaaccaaatctttgtgggataggtaagcattctttttttcctgctgagaaacagttaactggtcgaatgcagtccatccatgtttgaagctcatagaagcccaaatcatctttgacaaaaaaaaagaagatcatagtttcattctgataaacagtgtgattatcatcccctaatacacgcgccctttcatttgagcagcgacccgaggagtgaatgctagctctgaatacaatggaacacaattatagtagtagagattaacacaattatagtatattaagacacctgattacgtttttgttcatccaagtttggaggagctgagcttctcctagcatgaaattgttgtacaaatttttatatttaatagatgtcatgtaagtagaaagcaaaaggtaatttcttctatatagcttctgccccaagctggaggtaaaaagggataagaaaatcataccgacaacccattaatatttatatacta

SEQ ID NO: 20341 - DNA, 1715 bp, Zea mays
ttttttttgtaccaaaggtcgtttatatgtataacaaatgaattatgcattaagtacctggaaaaaaatagaaactatattctttagtttacacaaatttgaaacaagttctaaatatgccaacaatcgactgcatttgagccaaaattttcgtacaaatagcatcacctattcacctatcagttatttacctgggtcacaactagacccaccgaaaggagaaggaagactactttcagaattttgcgtctcgatgtagcccaaagactataggcacataacaataaccaccaccaaattatgttacatatcaatccatcagacaagttgaatctttgaggctccatatccgggaccaccttcaagtgtacaacagagaacccacatatgatcctcagactgcttgtgcaataatggtctgaccagttccaagtgcttcctctgaaattctgctcctctgaaattcacttcatatgccaagctcatcactcttcttttcctctcctaactttgcatcgcaaagcataacatcatccatggaatccagctgcttctcattttcaacctcaatatcaggaactgcggtatccttctcggcaacatcaccaggttcagcttcttcctccttccattcaacaaactcaggttgactctcttttacatccggagttggtggtctgatatcatcttcgaatttgtcaacggtaccatttgccaagccggtggaaccagattctttgtctgcatctttgttggagaatggtagagttggttcagaaccttttatttcatctataatttcgccaagaatgacttcatcgtgttcatcatcctcttttagtgcggatatttccgaatttggagatggggatgcttctgagctaaccaaaccatcattcagtgccttgtcctcgtcaaatgcaaaccaattggaatttgtaaagagcgaaccactttcttggtcatctccattagtccattcttattgcaaacatcaaatgtgcttacaaaaggaagaacagtaatcatattaaatagtaaagaataaacctttcttggtcgtctccaaggcgaagggaggagattacaacctctgcagattcatcatcaaaatatacatcctgtggcagatataataaccagaaaaaaacatcaaacatcaggagatacaatctgttcagttcaatgcaagatgatacaatgaatctaaacagtacttctgaatatacctcatcatcccgctcaagtgatgcttgagcctgcatgtataaacaaaagttactaaataaattttaaaaactgttaatgtgttggcatgttgcaactacagaacttggctgtttaggtccatcaaaattaaggatattttttaatgtaattcagcattttggatctcagaaaaaaaattattcaatcttttaatttaaatcaatatgcctatttataaagcactaaagtatgctaatagaccaaacgagaaacaactgcactaatcaagagaaactgacctcgtcaatatcctcactactgtaaataccatatttaaatgcttggcttaaattgctagcaagtgcagccacatcgtagtccctatctcggaagtcttcatcatcgctatccctaccacggtcctgcagtgatgttggtcgactataaccagagaataaagcagaattcagcatatgacctttcatcccagttagccaaagcagggg

SEQ ID NO: 20342 - DNA, 1660 bp, Zea mays
  misc_feature (1647)..(1648): n is a, c, g, or t
  misc_feature (1653)..(1653): n is a, c, g, or t
atttcgaacaatacttttacgtgttttttctttttagtttttttgaatcaatgaagctacaatgtatatatgcttgtatccgttaaaaggcaattgagaccatatcaagtactgcatacatttccctcaggagctgatttaaaagatctaggttcctatatagtagtatgaccacctgcagagactgtcaactttcgttgtcccttctacagcctgcagcagtaagctgctaagaaaaacatagcagagcaaagtagtgcactaagcaatcgcaaatttctgcactacaaactcccctcccattttttctcctcctcccagcagccaagtggattgtagattgtagaactgaatgaccctacatcgatggatctcttctcggctttgagaaagtgtccaagatgttcggtcctgcaacatcatctatgctgcccactgtaactctaaatgcacttcttttacgagcagatcaaataaaagagctcaaagcatcgtatgacacagtgtttgttggattatctgtacattggtgaagctgagaaactttgaattccgcacccttgcaggtttctgaaaggggaggcttggcataccccccaagtactccttgaatgacaactttgtaactcgcctcagtgaagtgtaagccgtcccatgagatgtattttgatgggtcaggacacactgtagatccaggacgcccgcacaatattgaaggggaacagttgtatggggcatcacttccacaacacgcattcaatgggactgtgaaaccaaactggagtggggcacggaatatgttcaatgcagcaccatagtaatcagcataaatgatggtcacatcagggtgaagattcctgagtttctccaactcctcctgaagcatcttattatggtactcagcaaaatcattgagccacttaatgcagcctgtttgttcctcatagtaatcctctttttggctctgaaagattgcaagatataatgggacgcaccctattgggaagttccctggaacaactaacttctttgctccaagatttataagatccgtgatggccgagcttatggcaccaacaacattaggaacaacttcatgtagctcatcaacagatttatccctaacgattaaatggttgtaatcatttccaccgacctctcccacaaagaaaagtgacttggaaattattttgttttgctctgcatacatgtaaaatttcagtggattgagtattcagaactccaaattctgctgtgtgttcgatgacaactaattacatgaaaccaactgtcagaaaatccttgtctttagagtgccctttatgctttctatttaggttgtcgtttatgttaaataagcaggatagcagttggcctgacgcatgcacagttcatgtggggcaagtctcgcgggcgtgcgcattaggcaacatgcatgcatcatgcgtgcccacacgcttcagttgcgagtgcacacgttccagtcctttgtggctcggttagttgagtttaggtgtttttatttagtaatctaaactagaaaagctgcattgtttttagcggcatcaaatccactctctcatgttcatatccagttcttcgcctcccaacctctctggcgtttttttttttttttttttttaattnnttttncccggcc

SEQ ID NO: 20343 - DNA, 1394 bp, Zea mays
ctaccgtatgttgttggcagaacattttcagcagatgaaacatccagcagtttcaataaatcccctaggctatccagcatgccatttactgtctctggacttgcggtgacaagtgttccatggctcaactgactacggaaagcctgataggaagccgatacaagtctcttaggatctaacaacgatatgcacactgataatgagtggaccagcaccgattttggccttgaatcttcaaaagcatgttgaaataatctccccacaaagcttggactggaaatctttgcagcaagtgctggaggggcatatctagttactgcacaaaggatttcagcagcatttgcatgaacctcaggagaatctgatgtgctgaacttgtcaacaatcatctcaaggacttgtatgtcatctaaccattgcatagaatctgcatagcttgaatacatagtttcatctgcaccgattaagcgaatcaaaacctccatgatagaagtaatcccaataagatcgacaagttggctaactatttcaggatggccctgcacataactaactagtgggagtgtcttcctgatcatcaagcaaatcactaccttggcaaagtaaccagccgacaatgtcccatgggggtggtcaggtttcaggaaggagaaaagtaaattcataagatcttcatcctccactaatgtcttcatgatgacatccacttcacatgtaaatatttcacaagctataaacggaaatctaaatatccttttcttttctgcatcttcaggagcctcctctacaatgtagcggagtaattgttccacttgaaccttgtcccgcaaaaaattgattaagcgggtattcagtgctttgcactcctgaattatttcatcctcatcaagaagacattccaacttaaaattttccttgtccaaaatagtatcaaccggtgatgcagcggagagtcccggcacatgccaaaacatcttgcacagtgccagttatgtcagtacccacactgtcacgatatcacaacccaagcggatttagagctgagatttccacatcatgagctggtatccagtggccaacggagaggcgccggacgatccgaacccaggcacaggcgcaccgcaggtcgtcgtcgtcgtggcggcggccgcggtgagggcgggacagggagagagcaaagcgccctctcgtgacctgaagctttagaggcgctcgcgaagccgagctggatccgggtggccgccgcgaaaccctagaatttgccaatcgcgagatgaggagtgggaggacggaacggcgcggaggcggaggtgggggaagggaagcaagagggcgagggttcgatcgcgccgccgacctggtggagaggcagggagcgaccctcgtgccgaatt

SEQ ID NO: 20344 - DNA, 892 bp, Zea mays
cttccattccaaaaactcgggttgactctctttacatccggagtcagtggcctgatatcatcttcccgtttggcaatggtaccatttgccaagacggtgtgaccagactcttcgtttgcgtctttgttggagactggtagagttggttcagaaccttctgtgtcatctatcacttcgccaagaatgacttcatcatcctcttttagtgcggatatttctgaatttggagatggggaagcttctgggctaaccaaaccatcattcagtgccttgtcctcgtcaaatgcaaaccagttggaatttgtaaagagcgagccactttcttggtcgtctccaaggcgaagggaggagattactacctctgcagattcatcatcaaaatatacatcctcatcatcccgctcaagtgatgcttgagcctcgtcaatgtcatcgttactgtagatgccatatttaaatgcctggcttaaattactagcaagtgcagccacatcgtagtccctatctcggaagtcttcatcatcactatccctaccacgatcctgtagtgatgttggtcgaccacatgcccactggtaaacattttctaatgcattacgcttcgttagggtaccgcgtgccccgcccacgccaatcagaattttgctgcaaatatgattggaccatgatgttggtattggccagctgaaggagcttgttggctatccgtgtcatatgaccaacaattcctatccttggtggacatcttccctctgtagacaatgtatgcttagttaaatctgacgacagagcagagttcttctctgcttccagaattcttgtaacaagtttacactcatcaaggacatggccaaccaggtgatcctgcttactctccagacatgctcgtgcc

SEQ ID NO: 20345 - DNA, 1604 bp, Zea mays
ttttttttttttttttgggataaatgaactattacacatcttttcaattattgtgacgtaaaatagctcggatatcattccccagattcagattttctgatctagaatactcctattacataatactatattttgctaacttgctcctctgaatgtacgtactcaaatttcatcagcatatggatggcaggatgggtgcatcattcttcagtttgtaagcatatatgcatctgaatgtgtaaacttcataagggtttctttttttaatctcaatccaaatggattggaaggaattgagtgggtttaaatcagtcaaaatctctcctaatctctctcaatctcctccaatccagctctctataatataccaacacagcggtctgtatgatcaatctgcgatacaagattacaacatcgtggcagtatggctgctttctgttggttgacgccatgagaaacctgtagcttcaaataaccatgcaattacgtatatatgccgcccatatatatcaacataccgttgtcccacacaatccctacttgcagtgcaggcatctcttcatagaaagaatcttctaacctgctccagagttaaaaacattatcacattccatgacccaatccgacaaaagtttgcaatgaatcccttgtagaaagcacaaggtccatcattctttagtgtcttggcaaaacaatcaagagtacttttgtacattgaatcacccatcattcttgatttcaccacatccaccggagagccaatgcaaacagcaaaaaacccagcaccaagtccagctaaaagatgggtaaaaacgttatcagtaaacccaggaagttttagaaacatctgtttgaactgatcatagctggccaactcggcagcgttaattatggcattgcgtgcgacatttggaccaaggccagtccacaaagctccaataccttcctgtctgattattgtaggatatgcattaagggctccagaataactcctcttgacagtgttagcctttccatcagcttgcaacctaactttaacaagatcagttggatttgccacaacaattgctatcacacctgtggtaagcgcagcaagaatcttgcttagtaaactgacatcacccacaacagcacctccgacgaagaaaaccttcacaggctcatacaagctgatgcggaggccgccatagaggaactgacggtggaggccggggatgacgcccttccagagcgcggcaaccccttcctccctggcgatgcacatgattgtggctagcgtgcctccagcagcagcagctgtggctgctgcagccgccggtggcagcggtagtggcgccttcctttgcagctggagccgcactttggctgtgtccaaaggaatggtgcacacctctgcgaagcaggcggcgaaggcgctgctgaagaagacggcggtgaaggaggaggaagtcgccatgctcccctgtctcaccggcggcggccgctcgtggggctcgtgggggtggggctactctgcctgccggaaccctgaactggacaagacacaggagcccgggcccgggactctcacccgtcttctatgccaatgcgggtactccatcgat

SEQ ID NO: 20346 - DNA, 2138 bp, Zea mays
ggccgctttttttttttttttttttcggtgttgcgttttttactagtgatgaggaaacgtttgccatcgttacaagacgtgcgccaaattggcacctcactgcgttaaatgtgcattcaaaccaaatgtgaaatgtccatcccttgttgggctcaaggatttacaagctgttaaatgtgcatacagtttgtgacagcgatattggtgcaagataacattgcaaggcaaaccaaaccaaattaatagcacaatcatgtttattaaaacatgggggcaagcttttcgcaggaaaaaagcagatcaaccgcccggaagtggggaaggcttgatgcaggctctagcacttcacaaaggaatttgcaaacccattctaatatgtctcgacgcagcgaaactgtggtgatggcaaatccgcacaaccatcgatgggcaaacgctcaggctgactatcctcttcgggcacactggtttctgcacactatacacaacacccctcctgcagctgatcgaattttcactccacataccctcatttagctgaccaattttcttgtcagcctctttgctggagggatatcgtcagacttcccaagaaagtccgacttgccatgtccggccttcatcatgggggcagcaggcttcacagcgctccgtgttctagaggtcacagacatttgggatagtttctctgtaattgatgagaccttctgtattgctcctcggccagtttcaggcaagctccgtgaatgcctaagtacaggattccctgggctattccgagctggtacccgattcgtagttagtttattgctagtctcggttggcttcatacccttttgggatggctgacgatccaaattaagttttctttgtacaccagtcttagataaaccatttaattttgcggatgcattgctatgagatttcattgtagatagagttccagttgagaatcttctagccacactgttctctgaatttccttttgatccaacacatggaggtgttctaggaagtgatgaagcttttggacggacaggaagtggaacacatgtacaaccctgaaaaaaggtatgctggaggacttctgcggcctttggtctcttgctaggatcccatgagcatagtgatgagatgaggtcaattgcatcgctactggctgttgtcatcacctcggccagttgactgcctttgatctgtgggaactgatacttcattgcttctgcaagtgacaatccttgaggccaagattgctcatctggactaccgatgacattgcatatcttgtgaatctcatcagcttcactagttccaggaaagagaggatggagtgtcaacaactcagccattatggcacccattgcccacatatcaactgcagaatcataagcagatgactggagcaatacttctggtgcccgataccagcgagttgagacatattctgtatatggcggcaaagatgaaacttcccttgcaagaccaaagtctgctagctttatgacatctttgctaactaacagattctcaggtttgaggtcacgatgaaagtagcccctctgatgcatgtaagcaagagcctgaaatatctgaaagcaccagttgcgtacttcagactccgagaaaggcttgaccttatccttcataagttggtagagattacactccatgtattccattatgaagtataatatatcattttctcggataacctctttgagcttcacaatgttaggatgattcatgcgccgcaaagactttacttcacgcaaacccatacattcctcaaaagaataatactttttcttcattttcttaacagcaacaacttcaccattctgtttatttatagcacgccatacactcccgaaagtcccatcgccaacttccttaatcaacttgaatctatccattgttgtaatatccgaggtgtctcgtgcaaatttcccccttcagatgaacagccaacacaggcaagtgttcgccaagtccggccggacccgtcgcttgcctcagatagtacacaaaagacaaatagctaactagggccgcaacagatgtaagctgaacacagcaaatatatcaacccccacttatatgagcaccatctacatgtagatgtctggcatagactgaaa

SEQ ID NO: 20347 - DNA, 2422 bp, Zea mays
  misc_feature (111)..(115): n is a, c, g, or t
  misc_feature (119)..(123): n is a, c, g, or t
  misc_feature (139)..(144): n is a, c, g, or t
tcaaggatttacaagctgttaaatgggcatacagtttgtgacagcgatattggtgcaagataacattgcaaggcaaaccaaaccaaattaatagcacaatcatggttattnnnnncatnnnnncatgcttgacgcaggnnnnnngcagaacaaccgcccggaagtggagaaggctcgttttttttttttttttttgaacaatacaaaattaatagcacacatcatgtttattaaaacatgggggcaaagttgacgcaggcaaaaggcagatcgaaggccaggaagagggttaaggctcgaagcaggctctagcactccacaaaggagtttgcaaagccattcctaagatgactcgatgcagcaaaactgtggcgatggcaaatccgcgcgaccatcgacaggcaaacgctcaggatgagctagcctctcttcggcacactggttcctgcacactatacaccatatccctccaccctcctgcagatgatcggattttcactctacgtacccttgtttagctgaccaattttctcgtcagcctctttgccggagggatatcgtcagacttccccaggaagtctgacttgccatgtccggccttcatcgtcggggcggcaggcttcacggcgcttcgtgttctggaggtcaccgacatttgcgacagtttctctgtgattgatgagaccttctgtactgctcgtcgaccagtttcaggcaagctgcgtgaatgcctaagtacaggattccctgggctgttccgggctgggacccgatttgtagctagcttattgctgttctcggtcggttttgtactcttctgcggtggctgacgatccaagtgaagttttctttgtacaccagtcctagataaaccgtttgattttgcaggtgcattgctatgagatttcatcgtagatagagtcccggtcgagaatcttctagcaacactgttctcggaaattctctttgatccaacacatggaggtgttttaggaagcgatgaagctttccgacggacaggaagcggaacacatgtacaaccctggaagaaggtatgctggaggacttctgtggcctttggtctcttgctaggatcccatgagcatagtgatgagatgaggtcaattgcctcgctactagctgttgtcatcacctcagacaattgactgcctttggtctgtgggaactgatacttcattgcttctgcaagagacaatccttgaggccaagattgctcatctggactaccgatgacattgcatatcttgtgaatctcatctgcttcactggttccaggaaagagaggatggagtgtcaacagctcagccattatggcacccattgcccacatatcaactgcagaatcataagcagatgactggagcaagacttctggtgcccgataccagcgagttgagacatattctgtatatggtggcaatgatgagacttcccttgcaagaccaaagtctgctagctttatgacacctttgctaaccaacagattctcaggtttgaggtcacgatgaaagtagcccctctggtgcatgtatgcaagagcctgaaatatctgaaaacaccagttgcggacttcagactcggagaaaggcttgaccctttctttcataagttgatagagattacactccatgtattccattatgaagtataatatatcattttccctgataacctctttgagcttcacaatgttaggatgattcatgcgccgcaaagactttacttcacgtagactcatacattcctcaaaagaataaattttttcttcatctcttaacagcaactgcttcgccattctgtttattcatagcacgccatacactcccgaaagtcccatcgccaacttccttaatcaacttgaatctatccattgttgtaatatccgaggtgtctcgtgcaaattttccccttcagatgaccgcccaccccaggcaagtgttcgccaagtcctagctgatcaatctcttgcctcagatagtacacaaaagacaaatagctaactagggccgcaacagatgtaagctgaacacagcaaatatatcaaccatgtagatgtctggcatagactgaaatataataacttcagcaaaatatcgcatcagcctgcttgttgttgagcatagaggaacatataaccactatgtgtagttcacgagagaggagagaggagtgttcccacgagctaagacacagcaatcaagagtttctttcgagaactgcttgcgttgaaggagatatgcccagcagatcactttttccatgtctcagatgaatgcttcaagctcccaaattcactgctgctgcaatcttactctgcgggcgaggacagagcttagggtggtgtcgtcgccgccccccccacgtggttgccggagtgggggggggggggggggggactatc

SEQ ID NO: 20348 - DNA, 1375 bp, Zea mays
caaaatctcgaatcacaattcacaagcgctggttgcttttttttttttttttgccaggaaacatatataaggatttcatcagcttaaccaaacagtatgcttatgatttaagagtccaccacctacctacctactactccctaaaaccaccctactgcctccctaatacacccgcggccactaaacacccccactagaaagagtacaacagagcgagaccggcaagctatctacaactccctccccaaaaaatcaagtccgcgccaagtcacgcgcagaaggcctggcggcgcggcgcgagcgcgaagagcgcctccaggtccggcggctggaagtagccgttcttgggcgggctgcgccgcttcccgaagtccggcacggccttcctcggcgccgcggggcacggcagcgtcgccgggatgcggcactcctcgcgcttcggcgtctcccacccgccgcagccgtaccctccacctcccccgcccacacctgcaccaaccgccaccgctgcggccttctctatgccaacgctgctctccatggcgagactgattttttttttcgagggaagaaggaactttgctttcctctcttttttttgaaacgtgggtttgcgagggaagagacgcggctggcggggcatataaggagggggccgaggcggcggcgggagggaggatcgggcttccgaaggacggaagtggacggctccgtgctccgcaaggtgggccggaatcggtgacgtggcggaccccgcgccgtccgatccagcgagtgggaattaagcgggaaagggtgcgcggaggggcgggaagccgcggtccgctgtttcgatttaaaacttctttagacggagggcatgtgttctgtggtatcacggatcggtccttcctgggaccacgagacgagacgagggggggttcctgcgagttagctctgtgcgcgaggggtcctagtgtaagaatactgggccggaaggagaaaggatacgccggcccgcatcggattccactgcgttgcgtggcctgtttacgcgtgccaggtgtacgggtcgtgatgggcgaccgaatacggtggggtccccgacttcggcgcgcgctgcccccatacccacgcacgaccccaccgcacgccgtggactcggccttggtgcgccgcggtgggcgggccgcagggccctccgcggacggtccacgtgagccggacgcgggaggcgtggttcggggctgctggaatcatcccttccgcctcggatccctgggcagctgggcccgcatcgggaggagatcgggcggtctgctttgctatgctactactcctgctctggtctcgtcgtgggaaaaatactgcggcgcggcgctttgtgtgactcgga

SEQ ID NO: 20349 - DNA, 3403 bp, Zea mays
ttctatgtagtggactttaatgtggtagtggagacaacatcttcgagagattagttaaatggctcgtaaagctaaattttggctattcaacagactcgttatttagcttaccaagttattagactctccaaattggcttcctcactagctaaatttaactagccactctaactagctaaactagatctaactagccaaactagatagattgtctgttggaataagatattatatatatagtatatattttaagaaatgataaataaagagttaaatagagagctaaaaataaagaatcgcttgtagatggtctgagtctttctccgataaggtgtgcaaaagaggtgtgctaaaacatcctgtagcggacgcagcgatagccgctaaaggctactctaccctaaatatagagaatcaaacggtcttttatggtctctagcagcgtcctctaaatttagataacgttgttggattatatatatagaatttctctaaacggtcccctatccatttgaatactttaaataaccggtttaacaaaactaaatatatgtataatatttcagagtatgataaatacatatataaaaaataaaaaatatctctaatatagatatttacaatagagaacgtgatttaaaggatgatgttgaaaagaaagaagatataaaagataaatttttttagaatagaccgtaaatgacgaatataaactgagtgtcgccaaatgcggtgaactcgctaccgttcactattgtctcttacctcccgcgccgccgccttctgattcactcccacgctgctcggaagtcagaaccctcttgtgttgtcgcgtcgaccgagcatcacatcgtctctgtggtatgtctccgatgacattgagctcccccccttccgcgcacgctccctcgactccccatccaatcctcacacagcaagcccccaatctctgccaccactctcgctccggcaattgttcctcgaggtatgatgtggggttcgatggtggcagcgactctgattagacggcgagggtgcggtcggaagcggtgagagggcgaggggcacaggatgggacgacttcgtgatgaatcgggcaagggtttcagcggtcgttgacctgcccccaggtttcttcaagctaatccagccaccagcccaccatcgctgccggtgccgttatcagcttatgcgacgaagcaattctggaaggccgagactacaacggaaagccgctctttgatggggtggctagcagacacgtactgatacgaaaacccttctccattctctttctgtttcagtaatatatttttattgaagaattagatggtaatttagttctttaatttggaaacttatgcaatttgttgtggtcaatttatctgcatccatttttgctttcttatctggcttctgaaaatatttcttaaaaaacttatgctggttcttgtggctactaatttatctaatattgaatttacacgttgaaatgaaatgcaatactctctctgatccaaattatattccaaatattgcctcacaaatgagtcatccaacaatgaacactgtaattggccaggagactgagaatgttatgaaaccatgttgcagttcatcacaactacctaagtcctttggttcatgtgacttgcggattaaacagacttatatatcttcaaggcaacataattcttcagttcacttgaataatatggcaatgtaattcattgagtttgcattgttaggtgaataaacgttttgctcaatctactccatgtcccaggctgttgcaagagcagcatcagttaattgatcagaatgacagtgacccaatttccatgtgtgctctgcctacggcgccctcagcaaaaccaaaacctgatgttgtgttgttctcttcaattattttgttaaatttttacgttgacatgccagttatatataaagacagaagatgtataccagtcttggtatggcaacgttccttctttcaaaaaatccttgcattcttatttagtagtatgtattgttttgaagactgtaaattatagtggatgacttcattgtgcatgcattgagcagaagccatcaccataccaaatgcagattgttctctcacctccaattgtgccactgcatctcctccttcattgtgtatgtgatggagcttgctgttgtttttgagatctcgtgtgatccttccagctatatcaaaatttctctctggctttttgtatcttgtgtgacatcgggttgtgtcattataaaataactatacaaatttaagttcacaactaccagtacgctcaaatacagacaaacatgtgctgtgatggttatgaaatcctgtaaagattcatgaccaatttgttgaaaaactagtgtatcaaacatcagttggcacaagtatatagttcacttgttgagcagtcttcaatgtattttctcaatgcagagatcaatgctattatagattctgaaatctctgtccaacaaattaatataatcattgcttgtcaatgtacaattgttaagttttgccaacatgatagtatttggatgctctcgtgatttataggagtgagtgagtgggactcaattggagtggtcccgataaatttgttttatcctaaataatttatgaggccacaaatttcgaattttaaatagttaatttaaaatttaacttgaatacgtacataatttataattgacaaacaatgcaattttgagggaaaataaattggaataagaattttgttatcactataaatatagagaaccgaatttagaggacactggagatagagaagatataaaagacgaaatcttttagaatgtgcttctttagataatgaaatttaggtgatgttcctgaagacatcctaagcttggtcatcctaagcttcgtccagtgcagctactcctgggagctccttcccttccagcaactccaaacttgcaccacccccagttgaaatgtggctcagagagtcggcgacaccccccttctcaacagctgcaatggagtctcccccaccaactattgtagtgacgcccttgccactaagctcggctaacttcttgccaattgccttggttccaactgcaaacttgtcaaattcaaaaactcccatgggtccattccagatgactgtctgagtagtttccagggcagaactgaacgccgaaatcgaatctggacctatgtccagacccatccatgcatcaggaattgcagatgcaggaacaacctggagagctgactgctagcatcaggagcaaacttatcagcgacgaccagatcgaatggcaacataagggagacacccttctcctccgctcttctaaggagagaggtcgcaagctcaagcttgtcatcttcaaccaaggaagaacc

SEQ ID NO: 20350 - DNA, 3453 bp, Zea mays
cgatcctaactgaaattacaaaaaggtcattgcatatgatgaaacatttttcgaaccaaggaaagttttccgtttccattagcgtcatagtggaaatttggatatgacaaaattggatgcatggggattttttctctctcgaaagcgcaggagaactgcacgattatatatttaagaagaaagagataaggtccaaaaggaccagtacatcactaggtgcttacaaagaacaactcaagttaatcaatgtttctctgatttagtacattaaaaaagaaacaggcagtgaattatcttaaaagaagtcttgtgggcagagctaattggtagaatgtgaacctgtgaagagtattgtgtcatatcattatctaatacctttttaaggttaacttaacttctctcccaattaacaaggctaaaagaatggatgtcgttgctggcgaaacagctggtgtggaggggcagctcttgctgctatatcctgtccttttcatattacaggtatgttgcgtgtgcaattcgaatcatggcagatccgggtgttttgtcgaactgagttgccactcgaaccctccagaataagttgctggtccttcatgcataaatcatgtctaattggacccatttgtttgttgcactgatgcacctggtgcggatgctcccatgttttcagggtttcgaagcatatgttggagttttgcttcttcagacggctttgcatgggcttgcttccgaatggcaggcaagaatgattcaacagttatcactattgacagtcgaatgtcagataggattaaaaaaaattctctagctgcccttgaatgaatttattgcctttcccaatgtttgaaattctgggtggtggtattctggagggataggtcaaactgtcttgaatagaatcatgacatgccacttgggcacttgtcctgaactgaaatttacacctcaattttgtttttttaccaggtcttaagtctgcgggatcttgctggtggttatggcagtcggcaactttgtccacactatggagacactggtactgaaactgaggtttaaagcaaagatgaagaaagcgaagagcagacaggatcgcccgcatcaaaattgacaggcatcatcgtccttggaaaacaaggatgctgacaccgcctcttttgtaaatcctttgacccacattaacattttttgcctgcttgtcattctctctctctttttttttggtaattggccctgtaacattgaagttgatattccacacaacacggtggatgaaaccatatttgttcgctcttggatgagaactgagtttggcatgtactatatatttttctgtatgaaacctctgggttctgaaataagatgatgtgtatctgaagctgtgaattgacagaggggctctatacaaataatggagcagaggcttttgtaaggtcagatgttgtcatgtagtgtacttgttatacagagatcggtatgaatggttagcagatctttcttttcaacaatcataatatgaggtgtctggtcctccaaaagctttcggccacaacctgaatgacaagcactcccctgcctctgcctgctacacaggatcactcaatcattgaggggcgatagtgtcttgatggtttgaggtcatggtacaatgcaaaggatagtgtctcgggactaatccatttttcttacaatcctaaattttgtacccctaactaataaacatcaaggacaatgcaaggaatcatgtgagctccagcagcttgctgagctggatatggtggccgtaacccgccttggcgatggacctcgccgctttctccgcgatggcggcgcgcacctgcgccatcgacggccggagcccgggctgcgcggccaggcactccacggcgagctcggccacgctggcggcctcctcctcgtcgagcccgccgtccccgagcctgccgtcgacgagccccgccaccccgcgctccctgacccgcggcaggatccgcgccgtcaggttctgggcctcggacgccggcggcaggccggtgacggcctcgagcagcagtacgccgaagccgtacacgtcggacttggtggacacgatgcccgtgcggaggaagaaggggtcggcgtagcccggcgaatcccacggcggcgcgcgccggcgccacggccgccgagaagccctcgcaggcggagcccaggtcgcagagccgcgcgccgccgtcgaagaggagcacgttggacgccgacacgtcgccgtgcaccacggcggtggaggtgccgccgccgccgccgcagtgcaggtgctccaacgcgcacgccacgtcgtggagggcgcgcatgcgctgcgcccacggcagcggggcggccgccgtgccgtggagcgcgtccgccagcgtgccgccggcgaggtactccagcaccagcgcgccttcttcctctgcatgcatgcagtaacaatcattagtttaccactctactcgactcgacatgggtaaattcacttgggatgggaatgggacagcgaggcgacgaccaagctgaagtgcagcgcaggtttgacgagaggaggtgggggagtcgccgtacaaaaaataaatgaataaatagcggttgctctcaactctcgttaggtagggagtaaagtgatgtcacgcgcgcggcaatttggaaatgcattttttttccagatcactactataaagcctgctcgatcaggtcgtctacccattcgtttccctttctttttgggtagtatattatttttttttttttttttttaaaaaaaacatgagcttgactgacttcgtgtgctaataagcaaagtgtaaacagaatagtatataaaaaaaagaaaaaaacatatatttaatttgcaccgtggtcgtcggagtaggcgaggagcgcgacgatgttggggtgtcggaggcggcggagcaggtccagctcctgccggaaggcgcgcagccggcgctcgccgccgcaccagcggtgcaccttgacggcgacgggcgagccgtcaaggagcctggcgaggtagactgcgctggagccgccgcggcccaccacggcggactcgtcgaacccgcctgtcagcgcctccacctcccgccacgccagccgccgcggcgcctcctcctcctccttcttgacggctattgacgctgctcgctgctgctgctggttggccgctggcggtggctgacgatggcgtggcgctgctgctcgcgcctcggcgccggaggccaggaagtggcggatgaggaggaaggcgatggcgccggaggccagcaggaggacgcagcagaagagcaaggagagcgccacggccacgtccatggcgcgcgccccccggccggcctctcgctctcgctctcgctgctgtcagaagccagcagccgcccacaacgtaacacggaaccggaaggaaaagtggtggcaagttacaaggccgagcttgat

SEQ ID NO: 20351 - DNA, 1445 bp, Zea mays
  misc_feature (1428)..(1428): n is a, c, g, or t
  misc_feature (1431)..(1435): n is a, c, g, or t
  misc_feature (1438)..(1438): n is a, c, g, or t
aaaaaccgaaatccaaattccaattcaatccctccgtcgctcgctccaatcatccccaccgcttcaccgcccgcgccacccaatgtcaggcgacggcgacgcgcgcggcctcgaggcagcggcggccaccgcggcagaggcggcgcgggagctgcgcgaggcggccgcggccctcgtcgccacccgcgccgctgaggaggacgcgctgcgccgccgcgccgtggcgctcgaagccgacgtccgccgcctccaggcctcgctccacgccctcgatccctccacgctcgacaaggtcgaggaggaattggagcgtgccagggtggcaatcacggatagtgatgtggcttcgtttcttcccagcaagcggaatggcaagtttcttaagacatttctaggccctgtgaatgtgcgggtggcgaggaaggaagataaactcaaaatcaaggatgagtacaacaattatagggataggacagcctataagtttctgttatttccatctatcctcctcctactgagatggtggatatgggatggatgccttccagcattggctgttcaaatttaccaggcttggttactatacctgtacacaagctttgctttgcgtgagaatgtattaattgcgaatggaagtgacattcgtccatggtggatatatcatcactatctagcaatgctgatggctcttattagccttacatgggagataaagggacagcctgattgttctagcaagcagaggggggtgcaacttttcttgcgctgggcaatcatgcaaggcattgcaatgcatctacagaatagataccagcggcaaagattgcgtactcgaatagctctaggaaaggctaaaagaatggatgtcgttgctggcgaaacagctggtgtggaggggcagctcttgctgctatatcctgtccttttcatattacagggtttcgaagcatatgttggagttttgcttcttcagacggctttgcatgggcttgcttccgaatggcaggtcttagtctgcgggatcttgctggtggttatggcagtcggcaactttgtccacactatggagacactggtactgaaactgaggtttaaagcaaagatgaagaaagcgaagagcagacaggatcgcccgcatcaaaattgacaggcatcatcgtccttggaaaacaaggatgctgacaccgcctcttttgtaaatcctttgacccacattaacattttttgcctgcttgtcattctctctctcttttttttttggtaattggccctgtaacattgaagttgatattccacacaacacggtggatgaaaccatatttgttcgctcttggatgagaactgagtttggcatgtactatatatttttctgtatgaaacctctgggttctgaaataagatgatgtgtatctgaagctgtggagacanaannnnnaanaaaacac

SEQ ID NO: 20352 - DNA, 1325 bp, Zea mays
cccctgggaagcttcgctagccccgttggatctatgtgctttgtgcatgatgcaagacaattattgaaactagtgctttataggagtagatagatagatatttatttatggttaggtgagaagaggaggaacatatcacacactccgcacgtgacgcacgactatagttaaaacggtggaaacttatgctttataggatcagtgattaaagtagggttgtcaatcaggcggttcagaacgggtccctacaggtttataccttttcccacggtgtcacgggttcgggacctaaatatgtcgagtttgggacggtttttgatttctaaccacggttttatcacgggacccgaaacctgaatcagtcgtccacccctccgctgctacactcgcacgcagcccaactgacaacagtcaatagcccaagtgccctgtcgtcctgtccacgccctcagccaaaccctagcactcggtcgcgcacaggcacaacgcagcgcactcgcgccgtcggcattcagccgtcgcggactcgccgcccacccaggtcccaggctgggagagtggcagacacccactccgccactcgtcctcagccaccgaccaccgtccgtggttccccgttcgccaccggccaccgccagtccaccacccccccggcgcggcggcgcccctcctcctcccacacagcacacatgcgcacggcttcagctgcagttcatgaacacgactgaaggattgcaatggttctgttttttctgaatagcaccatgccaggactgccatccgagaaaggagtcgatacccaacctcatcttgcgaggctttggcaccatcgaccgtgtgaaggcgaagctggagcaggcctgccctgaagtggtgtcatgtgccgatatcttggctctggtagcaagggacgtcgttgtactggtaagaagctagtaggattaatcttgatcctaaaattttgtccttcaactagcttaggatgattgtccctaattatttcctgtgctgtgcaacagaccaaaggggcctcacggggatgttccaatctggcggagagatggtagaagatcggtgaagcaagatgcactggacaacctccacgcgcccttcttcgatgttggtcggaacatgtgccagttcttcatgcccaagggcctcaacgccaaggaccagattgttctgctaggtaacatactgaaatttctctctactatgtctttatattagttgaaaaatgcaaggcatgcacctgtcccgatgcatgattgatactgctggatctcgcccggttcttgaatgcagtggcagaagacgaatttttt

SEQ ID NO: 20353 - DNA, 864 bp, Zea mays
aagcttaagcatggcacaactccattaaatattacacatctttacctacacatcaaaaggggcagaatttaagctggtgttatccagagccacatattggacaagattctgaggctctctctgtctagtggctgcatgtgtctagatgttacaaagcatcacataacagcacaaatcaatatcaaagaacctatctcatatagtaacttaacaacatgctattatttggtgctgtccagacatcacataacagcacaaagcacaatcgaagaaccactcgctactattgcacaacaggctcacaaactcaatcactcactacctaactacgcatcacattccagcagctgtctggcagggatcagaacccgactccagttgcgttcagtggcagatggcggtccttccagaagcaagcatcgggtgccaaccgcgctgatgatcgcatcggctctgacttgcaccttttcagaacgaacggggcgtaggcgcccgcattggtgaccggcggcaactctagctttggcttctgttctgttgttgctggtttgagtgccagtgtcttctggacaactggacatggcatgggcacagctgagttcaccgtcaatggatctttgctctcttgtacatctttcacaacggtgttgccttcagcattctccttttttacagtctccactgttccagtagcagaagccttctgttgcctgtggttgtagttattcttgccctggtaagacttccaatgcacgaagtcagtactgcagaccctggtctccttggagacctccatggagagctttggctcatacatcatcaacatgaggcaatctggtatttcgccactcttcttcctcctct

SEQ ID NO: 20354 - DNA, 1055 bp, Zea mays
ttttttttttttttttgccaagtgaaagctgcagggtggttgaaatatatcaaataccaagcttaagcatggcacaactccattaaaatattacacatctttacctccttcagctatgcatataacatagttggacaaacactatgaagggaagtggatcgggtaagctgtggcattagcaaccaccagcaataatttaccaatttaagcatatttaaacagatgttatccagagccagatattggacaagattctggggctccgtcatgtggatgcatgtgtctagatggtaagcatcacataacagcacaaagcaggatcaaagaacctctcccatatagtaacttaacagcatgccattatttggtggtgtccacacatcacataacagcacaaagcacagtcaaagaaccactcgctactattacacaacaggctcgcaaactcactcactacctaactaaatgtcacattccagcagctgtctggcacggatcagaacccaactccagccgcattcagcggccgatggcggtccttccagaagcaagcatcgggtgccaaacgcgccgatgatcgcatcggctctgacttgcaccttttcagaacaaatggagcataggctgccgcattggtaactggcggcaactccagcttcagcttctgttctgtggtagctggtttgagtggtggtgtcttctggacaactggacatggcatgggcacagctgagttcaccgttgatggatctttgctctcttgtacatcattcgcaatggtggtgccttcagcattctccttttccttagtctccactgttccagcagcagaagccttctgttgccagtgattgcggttattcttgccctggtaagacttccaatggacgaaatcggtgctgcagacccatgtctccttggagacctccatggagagcttcggctcatacatcatcaacaggaggcaatctggtaactctccactcttattcctcctatgtatcactggtactgtcccaccttcacactcttctgctctagtttctactttctct

SEQ ID NO: 20355 - DNA, 1816 bp, Zea mays
  misc_feature (1806)..(1806): n is a, c, g, or t
ttttttgttttttttttttttttttgtggactagtggcagcagtaatattatatcttaactgattgagttaagcacaagctgaaacatcacatccagatactacctactaaaaggacagaggggaaacagggctgtgcaaatgccatcaatcaggaaggtgatggccagagaaccattatactgaaagcttctgtggctcatggctagcagaactgaattggcatgcataagcagtggtgtacagacggttagattcggccatgtcactctcctcgccttccactcctaaaaactgagacgtctttccactcgaacagctcctttcagacagcaacttctcttcggataaagccttctcgagcctctcctcaaatggcgttgcatgccaactcaccttttggtcttctttgtacttatttgttgaattgggaatgccatttccatcccgcaatttagaggtaaaatttgctggcagtggcaccttatctttccaatgtgctgcaaccattccaataataggcctatcctcatctgaactcttacccgaatgagacctgtctcctgccatggcctcatctctgaatgtcttcttaggatttgggggcttcaaccattgggctaagcttgggagctccagttctgaattatcgctcttcggtaacttctttctggtggcatggatagttgcctcagttttcggggacttctccacagatgttgtgttcatgctctctcttatcttgtaagaagatggtacagaaccctcagagctctggaaaagggagcattcatcagatattgaaatttccatggagaccacatggtgattctttgcgcactttggttcctctgttttttcagggtgaaaggattcttcttttgagaccccacattcttcaagatccagagcttggtgttgctcttcatcctgcacaagtgcctccatgttgttctcattcatcgaatctttcacattatttgcaagggaagtagcggaagtctgcaactcatcgtttgtttttgaagaactcgttgcatctggaacagtgaaactctgatgagaccttgaaggagtttcacatttctcaaccttcggcgcttccatgaaatgtagatcatcagacacaacaggaagacatcctgaatgtgtttccttctgatgaactgaatcagcatatttgatgagcgctccttgaatgttatttgtagtttgcagcaacgcaccacagcttctttggataatggcctgatgcacaagctcctgatccatctccttcctctcgccactctcgtccgcccacgagctcgccacttgcgccgtccttgatccctcatcttctcgctggaacacggcggagagcgcgttcctcgacggcggcctggccctcctgcccgcgccatcctggacctggtggctggtcgtcgtcgtcgtcgcggggggctgggacggatgcgcgagctggccgccggtgcccttcacctcgccatcgccgccggacgcgcggaagcaggcgaagaggcaccccatcatcccccctcctcctctgccgccgccgccgcgcggcgtggatttcgcccgctttgaggaagagctgggccgtacctcgtggcagcaggagagaggactgaggaggaggttttaggggaagagtaggtgggaggggtttgaaatttaaaatggggaggagagacgaggcggggccggaggcggaggcggaggccgagggaaggagagaagagaaagtcacggcggagtcagtggagcgctccgggaagtgggagtgtgggtgggagactggggactnctgggaggcc

SEQ ID NO: 20356 - DNA, 1765 bp, Zea mays
taggggccttttttttttttttttttctttttttttttttttttttttttttttttttttttttttttttttttttttcgaagggaccaacaatattttatacttgtcaactgaggcagcaacagtattagagttaattatatcttaaacagttgaggtaagcacaaactgaaacatcacatccggatgctacctactctaggacagaggaaaacagggctgtgcaaatgcaatcaatcaggagggtgatagcagaaaaccattgtactgaaagcttctgtgcctcgtggctagcagaattgtcatgcataagcagtagcatatagacggttagatccagcagtatcactctcctcgccttccactcctaaaaactgagatgtttttccactcgagcagttcctttcagagagcgacttctcttcagataaagccttctcaagcctctcctcaaatggtgttgcatgccagctcaccttttggtcttctttgtacttatttgttgaattgggaatgccatttccatcccaccatttagaggtgaaatttgctggctctttatctttccagtgtgctgcaaccattccaataataggcctatcctcatctgaactcttagctgaatgagatctgtctcctgtcacagcctcatctctgaatgctttcttaggatttggaggcttcaaccattgagctaagcttgggagctccagttctgaagtattgctcttcagtaacttctttctggtggcatgaatagttgcctcagttttcggtgacttctccgtagatgttgtattcatgctccctcttatcttgttagaaggtgatacagaaccctcagagctctggaaaagggaacattcatcggatattgaaatttccatggagaccacatggtcattctttgcacactttggatcctctaatttttcaggggggaagaaatcttcttttgaaaccccacattcttcaaaatcctcagcaagatccagagcttgttgttgttcttcaccctgcacacaggcctcagtatcgttctcatttgttgactcttccacgttattttttaaggaagtagcggaagtacgcaactcatcatttgtttttgaagaactcgttgcatctggtacagtggagctctgatgagaccttggaggagtttcacagttctcaacctttggcgcttccatgaaatgtacatcatcagacataacaggaagacatcctgaatgtgtttccttctgatgaactgaatctgcatctctgagcacactttggatgttgtttgtagtttgcagcaatgcaccacagtttttttggataatggtctggggctcaagctcctgatccacagtctgttccgcccacgagctcgccgcctgcgccgccctcgatccctcatcttctcgctgaaacacggcggagagcgcgttcctcgacggtggcctgatcctcctgcccgtaccatcctgttggatcgtcgtcgtcgtcgcgggagccagggacgtgttgcggtctccggcgcccttcgcatcgccgccgtcgccggacgcgcggaagcagccgaagaggcaccccatcatcccccgctcctcctcctcctccgccccgccgccgcgcggcctgtattccccgcccgcttcgaggaggagctgagccgcgcctcgtggcagcaggggagaggaggaggaagcaggtgggagaggggtttgaaatttaaaatggaagggggagggggcggagccgcggaggccgatggaag

SEQ ID NO: 20357 - DNA, 2185 bp, Zea mays
ctatttaagtctcagccattcaatcatttagcaatttattacaatttcaactatcctattacagatttagtcattctcttacagttagagtttcagtcgtccgattagagtgggaggacgcatggggatggtgcgtggtgggatggttgatcaaccattcaaccatttagcaatttattacaatttcaaccattctattatagttttagtcataatgttacagttagagtttgagtcgtctgaatatagcgggaggacgcatagggtggtgcgtggtgggatggttgcagtgtgcgggttgattagagtgtagcacttagcatgccggttggcgtgcgggaatgggtcggatgcacgagtttaatccgatgacggctcgcgagattagttaggtttggtcaagatgataaaattttcattctatcacattaggtaatgtgataaatagcgctatatatatacaacattatttgtcaccctaagtgaaaaccgctcgggattagcgaaaaccatttttcaaatttgaaattacaaaccactcgaaaaatagcgaaattcggagaaatttgctcggtttttcgataacgataaggtaaacctgagtaactagtatatgtaaaaagtcgcgacataagtctgaactccttgctcctcccgctgattcgctccgccctccgcccatgtctggccgcgtcctcctccgcgcggctgccttcggcctcgccgccgcgggtgcggcgtccctgcatgccgtgtccaagtggacgcctcccggggagatccctcccttcgacctgtccgtgaagttcaatctcttggaatccgcgaacggtctccaggccgccctgctccgcgcgcacccgctcttcggtgtgcacctccatgacgtccgagcccgcgccgaactcgacctcgcgcgcgttgacatggagatttgccatggcggcgatcccgccgccgccgcggacctccgcctcctcctcgcgctcctcgccgtgcgcgacggtcgcgcggacgaggcgatgcggctctacgaggaagcgttccgccacgcgcctttcgacccccggccccgcgccctcgcgtataacctctgtttcctctgcgggcgagaggacgaatctgcggcgtggcgaagtgcttacgaccgcctcgtcccgggctccatccagtacccgggatgggagtccgataaaacaagggagctcgtccacgagctcgtgatcgcggcgacgctgggcggcgtgaacgtgctcctcgaccctgagtggtacttggtcatgcacgtggccagcaaagctatggacaaggcgctggtcgcagcgctgcaggacaaggcgctatctgcgacggagaggcttcagttccgattgctccgcgtgttcctggacaacttcatggaggtggaggcggagctggccgaggacgactgaggaggcatcgtcttcggggtcatcgtaagcaaacttgcacggttatatacttgtctcatcctcacatcaaatgaatgaatgccatcgcccaaatttgagtttccaaagagcagggtggtgtggatcgttcaatctagttgcacaaggaattttatatgcacaggctaattgtttaacgagtttggtttgtgctccctgctggatcaattgatctgtcaggcagacaggcccaaactgtatccttcgttcagaattaatgcacaggtttggtttgtgctccctgctcgttcagaattaggacaaggcgctaattgtttgattttaaccttccttgaacaggtttagtaggttcaggtaaattaagcacaacataagaggcgatgaatagtgtttatgatctatatcctcctcgcggaaccatttattgatgccaatgaagaataacattggcattgcttatgtaccatcttaaaaaatgcatatatacttgaaagaaaatacattagtttttgcatggctgttatattcaatgcactctttcatttatgggtgcatataaggtctagttcattgaaacagatcaatgtcttgtttcattgtttgggtgatatatgacagtgtttaccatgcatttttaatcaatttgctggcagtatccttttcacaaaaaattctggatttctggtaacatgatttgtatgcgtaaacgatttttaattgtctgactacataaatactaccccacgttccaa

SEQ ID NO: 20358 - DNA, 1260 bp, Zea mays
  misc_feature (1216)..(1216): n is a, c, g, or t
  misc_feature (1224)..(1224): n is a, c, g, or t
catgcaccatgtatgtttatgcattggaaaaaacatagaggacatgttgatggtctccatgatggaaggaccacgccgcacggagaagcccaccggtgtcatcttccgcaaggtccgctcggtcgtccatgtccgttcgtcctcttcctgggcggttggcgcgtgatctggcgagacctcccaatgggtcaaaatctattttgtgcttggcgatgtattccttaaggaccgccatgctcttctcctttggcgcggtcagctgcttcgacaaaggataccatactcattgttgatagcaaatgattgggttccctaaaccaggtttgcttttactcttggatcaagactcacctggctagccgagtagtcgtccatcgcgttttgaacccggtcagcctgttgtgccgacctgcaggttaaagcgaatgaaatgaaccatcatctgtaacaaggtgctatatcaatgacaagcagcaacaaagcgtaacacactaaaggcaagtttttttaacaacctttggtctaatatttgccattataatagcatatagttgtacttgtagaatataaatagcagatacaaaacataacaaagcatacctttagtatatcttgaaactatttagtgtataaataaaagtaccaattattcaaaacatatatcaaagtttcattccaacatctggcttgaatatgtagacaaaatgatttaaatagactaaccaatgatcaatgttagtggttctacttcagcaattgtaaagggatgcttattttttggtcacgatgcggtgccgtgctttcagccgtggaattatgtttaatggagtggtcaaaatttatgccgccatgtcagtccaccagatcagaagcgtctgtgtcctgtggcagcatgatgggctgacctctgaacaaatggacaagccttccccaacccagaacgaaagaggttcaatggttcggcatacaacttcagaagtcgactattttttcgtttatttttttagagagcagattcatagtttgggcatcaggcacaggttttcgctcaagtttgtgacgtcttaacccattttgcttgcagtcatgcatggagaagtacagaggaattgcacccaagaagtccttggtatccaaggtactactcacgctattggaccaaacaacatgaatgctagcgtatttagaagttttgatcactcccaactaactaatncctattgncatgcctaatgcaggaccacgagcacgcctactttg

SEQ ID NO: 20359 - DNA, 2701 bp, Zea mays
  misc_feature (857)..(857): n is a, c, g, or t
  misc_feature (868)..(869): n is a, c, g, or t
ctacctggaaaaattattctgggaatcaacaaacgaggggttcactttttccgtccagttcccaaggaatatcttcattctgcagaacctcgagcccccccgcaatttggtagcagaatactgctgttttctttaaaatgcgagttgctggtgtccttcatatctttcaatttgaaacaaagcagggcgaggaaatatgtgtagcacttcaaacacatataaatgacgtcatgctccgcagatattcaaaagcacgctctgctaatagtgtgacatcgcaaaatgatgttaaccatgcatataagccaccaaatattgaaatgtatgagaagcatgtcctagaactgacaaaaacagttgaggaatctcagaagcaagcagatcagttgcgagaagatctacagttgaagacaaaacaagaaacagagatgcaagaagagttggaagggctaaaagacaccttgcaatccgaacgacaaagttccaaagaagtaaaaaatgagcttgataagctaaaatctctatgtgatgagaaagaatctgctttgcaggctgccctgatggaaaaaagtagacttgaaaccagattgacaagtagccagggccgtgagagagatactttgacaactgtaggcagcgtcaatagtgacattgagatgcttaccaagcttaaggaggatttgaaatcataccaaaaagagctcgatgcatcaaaacaggtctcgaagaagctcatgtcagaaaagaatcttcttgaccagaaggttcaaaggcttgaaagaatgaaaaatgaagagaaaagccgcccggaaaaggtttatgcggatgaatgccgtaaactgaaatctcagattgcntgaattggagnncagaaattggaagagacacgatccttaaatgtggctgaatcaaatcttgctgtaagaaatgctgaagttgatagcttgcaaaatagtctgaaagaccttgatgaactaagagagttcaaagcggatgttgaccgaaagaatcaacaaactgctgagattcttaaaagcacgagaccattacctagaacatcctaatcgaaaatctttataagcaagaacaagttctgcgaaaacgttactataatacaattgaagatatgaaaggaaaaataagagttttttgtcgcttgcgccctctaagcgacaaggaactttcttttgaggagaaaaatatagtttgcagtcctgatgaatttacaattgcacatccatggaaagatgagaagtcgaagcaacatatatatgatcgtgtttttgatgcaaacacaagtcaagaagaaatatttgaggatactaagtacctggtacaatcagctgttgatggatataacgtttgcatatttgcatatggtcaaactggttctggaaagactttcactatttatggttcagataacaatcctggtcttactccaagggccacatctgaactttttagggtgataaagcgcgatgggaacaaatattcattttcattgaagacatatatggtggagctttatcaagataatcttgtggacctattgttgcccagaaatgtgaagccgctaaagttagagataaaaaaagattccaagggtgttgttactgttgaaaatgcgacagttgtgagcatttcgagtattgaggaactgagggctataatttcaagaggctctgagaggaggcacactgccggaactaatatgaatgatgagagttcaaggtctcatttaattctttcagtcattattgaaagtacaaatcttcaaacccaatcatatgcaagaggcaagctaagttttgtggaccttgctggttctgagagggtgaaaaaatctggttccgcaggaaagcaactgaaagaagcacaaagtataaacaaatctctttctgctttggctgatgttattggtgctttatcttctgatggacaacatataccttaccggaaccataagttaacaatgcttatgagtgattctctgggagggaatgcgaagaccttgatgtttgtgaatgtttcaccagcagagtctaacttggaggagacttacaactcgctgatgtatgcttcacgcgttcgatgcattgttaatgatacgagcaagcatgttgctccaaaagaaatcatgagattgaagaagttgatcgcctactggaaggagcaagcaggcaagcggagtgatgaggacgagctagaggaggtaaaggaagagaggatctcaaaagagagagcagacaatcgcctgactggctgacaacttgacacaaccactgaatgctcctggttccgttcttccattacctggagaagaggtgattgatgctgatgagcatttgcaactgccacgagttctgcgatcgctctctaacagaatgttccgatatcatctgacctgtacatacagtagctacgtattatatactatggcagcgatgcccgtttgtacaaagaggaatgtagcacacattgatagaaagggaaaaggttgtgtgactgggaggcttgatgcgccctaagcctataacagctggatcatgtctttttccccccttggagcaggtatttaaagcataatgtgagcgtccttacacaaaaaaaaaaaaaaaagtgtaaaaatcgggtagccttggatggtcagtttatcgggttgtttggatgattaaacacgtaaacttcactttggacg

SEQ ID NO: 20360 - DNA, 3265 bp, Zea mays
  misc_feature (2850)..(2850): n is a, c, g, or t
  misc_feature (3186)..(3186): n is a, c, g, or t
  misc_feature (3200)..(3200): n is a, c, g, or t
cggattcgatcaatcgatcaccagttcaaatatataactttttttttcagcttcctacatcagcagaaacatcacgtccaatccaattctatcgttggcagtggcaggtaccattcctcattgatacgttgggtccccgccggacacggactgttggagagcagcacaccaatccttaatgcatcatgcaatgtacgtaacacgttgcaactcaagaaagattttgcatcgaatagttaattctctgagggatggtaaagttccatgggtggtgggtgggttcatcctctttctctctctctcccccatgcgttcctcttcacagtctttttacacacaacaagagcacggaatttttttgatacagagtgtagtgtctgtgtcccaaacctgcgtgctcacgcgattcgcggcgtcagccttcgctcatcgggacggggacggcgacggcggcgcggcagacggggcaggcgggcgtcctggcgagccacgggtcgacgcaggcggcgtggaacgcgtgcgcgcaggccggcatcgcgcgccaccgctccccggcgcgcgcggcctcgaggcacacggcgcacgcgcacgagcacgagggggaggagcaggcggcctcatcgtcaccgttgccgttggcgcgcggggaggagggggaggggaaggtgaagctcggaaggcggtggatgtcggcgggcgagagccccgcgcggagagactgaggcggcggcggcgagggggcagggtcgagcgacgggacgcggtagcggctgccgccgcggtggcgggatgcgcgcgcggcgaggacgaggacgaggaggagcagggcggacgcggcggcgaagaggaagaagaccgcgagcgcgaacggctgcacggcgagcgagaggaggcgcgcgcccgcgcgctggcgctcgcggggcccgtgcttgttggcttctcctcccggtcccggggcgagctcgccggctggagcgggcgtggccattcgggtgaggcggggcggtcggcgtccttggccggcgtggctggctcgggcgttccacgctgcggggtgtggagtgtggactcgaatattcagacaggaattggaagggctttggctttggctttgctttccccggccggccggccggcctttgagccctttgcccgcgttcggtacgttggcgggtgtgtctgccgactgccgtgagctcgaccgttcggtggttcttgttattttaaaggaacgagtggggttattattattattattactgctaatataaaaccagtcaaagcaagtcgcattacttgcccgctggtaggagggaggggtttcatgcgaagttgtcgaattatctgtggttgatggcaggacactttaataaaaccatgtggatggtacatgtcaacatcattatagctactttgaaaactctaattttcacaagtgattcttattttcataaaggaaaaacaaactatttttttgtgaaaatgaaaatcccttggtgtaaaatatggtttccaaactagtctttatgatttcaataaaaaaatcagtgaatccgacgggatgcgtatataaaggatagaaaaaccaataaatctatatctatatctatctatctatatgttatacttactatttgcgaaacatttgtttcgaaactgtttttaattatttcccgtatcgtctgtcatgctatttgtaccctccgatttatttctgttttctaacttctcgtagtcatcctaccagacaacactgggtttataggaattagaaaaaggactattagcgtctgcttttttcctatatataaatataaattaaaacaggaataggaagacaaccacaacgacaatctatgcctgtatctctagtatcaaagtgctaaacgattccactgagcaatctcttgcattttttctgatatatatataactttacggtagtatctttctctatctataatccttatataaaacgtagtaatctattatctatctaatattaaaatcttgtacctgcatctgccagaaaaagccagccgaaagagcttgttgatatgatctggattcatgactcatgcttatacaagttagaataatctgatttgattgcgacatagtataatgtatacaagcacatttggtatataaataaatataactatataacattaacacctttgccctctctctctctctctctctctctctctctctctctctcttactttttcatctgttttatccatttttttgtactacgtgttgttttcttgacttcttttcccatctacccttttcttggaaggcagaggtggagaacgtcgcgtcttgaaattacgtcgcctcatcaaataatcatgcatgtttgtcctctagctttgctactgctaggtagtgtacgaacgaacataaagcttatcaagcggaggacgattctagccctatctttgtccccgtccctattcagtacctctatttcctaatagttaacgtatctctttttctatctctaactaacactccctctatcccgtattagtgttcgttttagcacttcaattttatgtctatatattattcaaatatataatgatgaatttagacatatatattaattattgtatgaatctactaaatgtccaaaataaattttaatttaatacagagggagtatatatcaaatagcgaagcatttttttaatatactttttttattttctataacaccctggaggtctatatgtatttccttcgtttctttttagttatcgctggatagtttaattttacactatccagcgataactaaaacgaaacagatgaagtatcatgtatgccgcttttctntagccttgctacggcgcgcgtgcgtacgtgtctgatacgatgagcacatattgatattgattggaggaggagacaaggaccatggcaaagaatccccattccaaatcttaggcatataggatgataggaattgaccaacgggaacagttgctttgtcctattcgcgccgtacgtagcagtagcagcgcacgccaagcgaatgtgacgtacgcacacgtcccaccgcgcaaaggaaatcgtacacatgtttggcacggtaacagttgatgatcttcaaacactccttgcgaaaaaatccttcagttgatgttgagctaagcggctggccggccggcnggcataggtccctncagtttcgtcggagaaaaaaaaatgatgcttcaagtgaagacagttcacctgtgctgtccaggag

SEQ ID NO: 20361 - DNA, 550 bp, Zea mays
atctgtggtgtttatttcaatgcaccagttcttctctccactgcctaaagtcaaagatgacaaaccagctgacttaatagagttggaagacacacaaaatcaccggtcatccgaatcttcttttgtaaatatgactgctggtgctgctgttgatgcgagccatcggattggaactgatgagaggcaacccctgttgcctacatgaactagtttcttgaggtttggtgtagcattgtaagttgaataaactattgtacactgtaaaggcaaaggaaagaaagaactaccaacatcttctccattttctttcatttttgggacgaggccggccggtggcctgccatctgtggccgtgggagtgacagagcagcatacattttgataggcgtataattcaatagggattttccagatacggcacttgtaacagaattttcttggaggtgtatatgaacaacggcgatgtgacaatcttttctgtacggaacatttatactattgagtgattgatttactattactatgttgttactcaaaaaaaaaaaaaaaa

SEQ ID NO: 20362 - DNA, 2171 bp, Zea mays
ttgggaccctcgaggccggccggggcggcccgcttcctcttcccaccttccctcctcccttctccaatcatccctttctggctttctcctcccccctgagaccccgagtcctgccggattccgagatcccggaggcagcttcccacgggctcctctcactacggtagctggatcaaaccatcgtgctctcgtctcgacagaaaccccggccgaaaacccagccggacccagccctgttcgccgcgcgcgcggtgcccaggccgtgccagatctgcgagatccgcgccgacaccgctacgactatcaccaggtggatgctctcgtgatctctcggaggccgcggggactgagcagcgtctcggcggcggcgtggcctgcatagccgtcggcgtgccgagatgcaacggaacggggtggtggaatgcagcgtgtgccgctcccgggtggtggtgccgagcccccggagcgtgtccagggcgtacgacaagcaccgcaacaagatgtcgtccaagttccgggcgctcaacgtcttcctcgtcgtcggcgactgcctccttgttggtctccagcccatcctagtgttcatgtcaaaggttgatgggaagtttcagttcagtcccatcagtgttaactttctgacggaggttatgaaagtcatctttgctgtcgtcatgctcataattcagtctagaaagcaaaaggttggagaaaagccacttttggcacgttcaaccttcatacaggcagcccgtaataatgtacttctagctgttcctgctcttctatatgcaatcaacaattacctaaaattcatcatgcagttgtacttcaatcctgcaactgtgaaaatgctaagtaacctaaaggtactggttatagcttttcttctgaaatttataatgagaaggagattctcagttattcagtgggaagctcttgctctattgcttattggaatcagcatcaatcaactccgaactgtacctgtgggcaacacagcatttggtcttcctgtcactgctattgcgtacatatatacattgatttttgtaactgttccttcagtggcttctgtctacaatgaatatgccttgaaaagtcaatatgacactagcatctatctccagaacttgtttctgtacggatatggagcaatattcaacttgcttggcattcttgggactgtcctattccaagggccagagagttttaatattcttcgaggccattcaagggccacaatatttctcatatgtaacaatgctgcacaaggcattctatcttcattcttctttaagtatgcagacacaattttgaagaaatattcgtcaactgttgccacaatatttactggcctagcttctgctgcatttttggggcattccttgaccattaattttctcctgggcatatcagtggtgtttatttcaatgcaccagttcttctctccgcttgcaaaagtcaaagatgacaaaccagctgactcaatagagttggaagatacacaaaatgaccgcccatctgaatcttcttttgtaaatatgactgctggtgccgctgatgatgcaagccatcggattggaactgatgagaggcagccgctattgcctatatgaacttgtttgttgaggtaggacagaagagaggggatagaagaagaggctcctttttgccgtgtgagcaacagatttgatgtagcattgttaggcgaataaacagctattgtacactgtagaggcaaaagaaacaaataaacgtggtttccattttctttaaattttttggggataccttgggagcggcagaaatcatacattttgatagacataattcaatagggatttctagatacgatacttgtcaaaaaaaaaaagaattcatggagaaacaacggctgtgataatggtttttttaggaaccttttctttatacaattatactattgattaattgttatactattactacattgttacctgattcaaaaaaaaaaaaaaaaagcccccttctgcgcaatcatagtctctttggccaagttgtagatgttgcgcgtgccgctgattactgtactggcttgttcgacgagaaggcgtagttgtagtcgtggccgccgatctccccaacatgaccaggaagaatgagccagcctctcgcataattccccgctgcag

SEQ ID NO: 20363 - DNA, 1230 bp, Zea mays
cccacgcgtccgcaacaattacttaaaattcatcatgcagttgtacttcaatcctgcgactgtgaaaatgttaagtaatctaaaggtactggttatagctgttcttctgaaatttataatgagaaggagattctcagttattcagtgggaagctcttgctttattgcttattggaatcagcatcaatcaacttcgaactgtacctgcgggcaatacagcatttggtcttcctgtcactgctatagcatacatatatacattgatttttgtaactgttccttcaatggcttctgtctacaatgaatatgccttgaaaagccaatatgacactagcatttatcttcagaacttgtttctgtatggatatggagcaatattcaacttccttggcattctcgggactgccttattccaagggccagagagttttaatattcttcgaggacattcaagggccacgatgtttctcatatgtaataatgcagcacaaggcattctatcttcattcttcttcaagtatgcagacacaattttgaagaagtattcgtcaactgttgccacgatatttactggcctagcttctgctgcatttttggggcataccttgaccattaattttctcctgggcatatcagtggtgtttatttcaatgcaccagttcttctctccacttgctaaagtcaaagatgacaaaccagctgacttaatagagttggaagacacacaaaatcaccggtcatccgaatcttcttttgtaaatatgactgctggtgctgctgttgatgcgagccatcggattggaactgatgagaggcaacccctgttgcctacatgaactagtttcttgaggtagggatagatgactctttttttgcggtgtgagcagcaggtttggtgtagcattgtaagttgaataaactattgtacactgtaaaggcaaaggaaagaaagaactaccaacatcttctccattttctttcatttttgggacgaggccggccggtggcctgccatctgtggccgtgggagtgacagagcagcaaacattttgataggcgtataattcaatagggattttccagatacggcacttgtaacagaattttcttggaggtgtatatgaacaacggcgatgtgacaatcttttctgtacggaacatttatactattgagtgattgatttactattactatgttgttactcaaaaaaaaaaaaaaaaaaggccccta

SEQ ID NO: 20364 - DNA, 880 bp, Zea mays
ccggccgggccgggccgtccctcccgccccgaccttcctctcttctcccctcacccctttctggctttctcctccgccgaggccccgagtcctgccggaattctagatcccggaggcaacttgccacgggctcctccgctccggtcgctgaatcgtactatcgtgctctcgacagaaagcccggccgaaacccagccggaccaaagccctgttcgccgtgcgcgcggtgccccgggccagatctgcgagatctgcaccgacaccgctacgcctatcacgagcctgtaggtggatgctctcgtgatctctcggaggccgcggggactgagcggcatctcggcggaggcgtagcctgcttagctggtggcctgccgagatgcagcggaacggggtggtggaatgcagcgtgtgtcgctcccgggtggtggtgccgagtccccggagcgtgtccagggcatacgacaagcaccgcagcaagatgtcgtccaagttccgcgcgctcaacgtcttcctcgttgtcggcgactgcatccttgttggtctccagcccatcctagtgttcatgtcaaaggttgatgggaagttccagttcagtcccatcagtgttaactttctgaccgaggttatgaaagtcatctttgctattgtgatgcttataattcagtctagaaagcaaaaggttggagaaaagccactcttggcacgttcaaccttcatacaggcagcccgtaacaatgtacttctagctgttcctgctcttctgtatgccatcaacaattacttaaaattcatcatgcagttgtacttcaatcctgcgactgtgaaaatgttaagtaatctaaaggtactgggtatagctggtcttctgaattttataatg

SEQ ID NO: 20365 - DNA, 1648 bp, Zea mays
cattgggtacctcgaggccggccgggataaattcgttcgctgctccggccgggcccggaagggaaccggtttggtgaaccctgcgttcatacgcagcagcggcggctaaccctaacttcaaaggcataggagtaacagtcttcgcacaaatattccctcccccaaggcccgaagccccgaaactttccggatctttcttccgccgcttcatcttctttgcgcaaaactagttttgtttctcgttcttctcttcgatttcggccgaataaagatggcgtcggctgcgcgcctcctcgcgccgatctccaggcgcggcgtcgtctctgtggctctggcgggggtggagaggcggcggccggaggcggcgtcgctcctgggggcgcctgtgctggctacggtggaagcctgcgcttcgatcaaggtcattcctttgtcgaatcagctggctcgatactcgacaactgcatttcagaggtttgggttttcaacttcagccccccaacaagatgataaggagacaaacaagcacacagatgatggggttaatagaagtgttggagcaagtactggagcttcaagtgaagccaataatgtgcctggaaccgagaaggcacaggaagcaggttcacttgattctatatccaagtctaacaggaagaggacagctaaacgaactgcattttctgattcagattcagaagacctagacctatcaaaggaggaccttgtgaagctgcttcttgagaaagacgaatcattgaagtctaaagatgaagagtttaaagatatgaaggataaggtcctacgcagctatgctgagatggagaatgtccttgccagaacaaagcgtgagtcagagaacaccaagaagtatgccatacagagcttctccaagagcttgttagatgttgcagacaatttgtctcgggcatcatctgttgtcaaggcaagtttctcaaagatagattcatctaacgattctgatgaagctgtaacactactgaaaaccctactagagggtgttgagatgactgagaagcaacttggagaggtcttcaagaagtttggagttgaaaagtttgatcctttgaatgagaagtttgatccaaataggcactatgccattttccaaattcctgatccttcaaaaccatcaggaactgttgctgctgttgtgaaggttggctacatgttacatgatcgtgttcttcgccccgctgaagttggtgtcactgaaggtggtccaactgaagaagagccagaggagtaatctagatcaaacggaggttgctggctgcacgtatatctatgactactgccctttattggttggataagcatacatatcataggttatgtttttaactagatctgtgaggcaaatcactatttttgtagcatgttcaacgaggcaatttgttcaagctagtccagaactctcctttttcttgctcggtaataaaaacgagattgtagaacatgtacatcaccgaaattgcttgccaaagacggattattgcagcctgcattaataggaatactgacaatgagcgtgccacaatcaaaggtggtctgttttgaatgataatgtttgaatgaagatgggactgccgagatgtgtgctggggcacaaacaaacgaatgtcga

SEQ ID NO: 20366 - DNA, 1462 bp, Zea mays
aacttcaaaggcataggagtaacagtcttcgcacaaatattccctcccccaaggcccgaagccccgaaactttccggatctttcttccgccgcttcatcttctttgcgcaaaactagttttgtttctcgttcttctcttcgatttcggccgaataaagatggcgtcggctgcgcgcctcctcgcgccgttctccaggcgcggcgtcgtctctgtggctctggcgggggtggagaggcggcggccggaggcggcgtcgctcatgggggcgcctgtgctggctacggtggaagcctgcgcttcgatcaaggtcattcctttgtcgaatcagctggctcgatactcgacaactgcatttcagaggtttgggttttcaacttcagccccccaacaagatgataaggagacaaacaagcacacagatgatggggttaatagaagtgttggagcaagtactggagcttcaagtgaagccaataatgtgcctggaaccgagaaggcacaggaagcagattcagaagacctagacctatcaaaggaggaccttgtgaagctgcttcttgagaaagacgaatcattgaagtctaaagatgaagagtttaaagatatgaaggataaggtcctacgcagctatgctgagatggagaatgtccttgccagaacaaagcgtgagtcagagaacaccaagaagtatgccatacagagcttctccaagagcttgttagatgttgcagacaatttgtctcgggcatcatctgttgtcaaggcaagtttctcaaagatagattcatctaacgattctgatgaagctgtaacactactgaaaaccctactagagggtgttgagatgactgagaagcaacttggagaggtcttcaagaagtttggagttgaaaagtttgatcctttgaatgagaagtttgatccaaataggcactatgccattttccaaattcctgatccttcaaaaccatcaggaactgttgctgctgttgtgaaggttggctacatgttacatgatcgtgttcttcgccccgctgaagttggtgtcactgaaggtggtccaactgaagaagagccagaggagtaatctagatcaaacggaggttgctggctgcacgtatatctatgactactgccctttattggttggataagcatacatatcataggttatgtttttaactagatctgtgaggcaaatcactatttttgtagcatgttcaacgaggcaatttgttcaagctagtccagaactctcctttttcttgctcggtaataaaaacgagattgtagaacatgtacatcaccgaaattgcttgccaaagacggattattgcagcctgcattaataggaatactgacaatgagcgtgccgcaaaataatatacctagaaaaaaaaaaaaaaaaaaaatataaaaaaaaaaaaaaaaaaaaaaaggggcggccgccgactagtgagc

SEQ ID NO: 20367 - DNA, 528 bp, Zea mays
cgcgcctgctacctcccctgatccgcatcatcgaagcctcgtttgtgacctcgccggtgtcatacaaacacgaagagagagagaggaaagttgtagccgccggtgccacctagtgacgggaacgccgttcggggccggatatggagctgaggaggtagagtagatgatgggcgggtgtcgctccagggatgaatcagagggtgccgccaaccgtggggatccttgccggttgccctcctcgcccatcaccacagagtgctcttcatcggatcgcaagaacaggaggtcgccaccgatggaactcggacttgtggcggcgtgttttcctgagaagaacaggtggttcaagaggagccacataacgaggagttcgatttgatctaggtggcgtctcccagtttgactttatggcgccaaggatggactttagttcgatctatatttatcctttattttgtaagacttccgctatgtaacaagtactctgatgttattgtgacatttatctctatacactctgttattatg

SEQ ID NO: 20368 - DNA, 3144 bp, Zea mays
  misc_feature (310)..(310): n is a, c, g, or t
  misc_feature (1012)..(1012): n is a, c, g, or t
  misc_feature (1846)..(1846): n is a, c, g, or t
  misc_feature (1974)..(1974): n is a, c, g, or t
  misc_feature (2032)..(2032): n is a, c, g, or t
caaaaaaaaaggtaagacaaagtagtgtgacaagttagacagcaaaccaaacatgctacttttgtgtatggatcaatggcacgggctaaatatatacccggtacggtctacacattgtcatgccacttgttagccaacttttgaaccttaggttacgttgcgcacgtgtcttacgaaaacgaaacgatgtggagattaattgaagattgtaccggtgactctggagaacatgtgtcgtgcactagcgtggagctagcaccggcaatttgcaacatgggtatcatgtagtgtatgaattattaagcacacnaacattgtgctccgtcagcccacatgtttcatgagaagcacttattgtagagtgtacgtacgtacgttaggagagcagagcgcggtgcgccccctgatttgtttggagtgattgggaaaaagaaaagaaaagggaagggaaaggaaaggaaaggaaagggggcacgtggaacatgtgaccgcgacaatatcctcctgccaaccggagcgctccacgcgcctgcacgcgaaacgtggatctctgaacccaccaaacaaaaacaaacgacaaacccagggagaaaggacgcgcgagacggagtcgccggagggccccgcgcgcaggcggggcggatgccgtcccgtcccgccccgttcggccgggtcgcactcggcactcgcaccggatggatgcggtcgccgtcgcgtggcgtggaccccgtcgtcgaagatgcgagcggaggcggcggcggccgcctggcctggcctgtggcatgtggcctggcttgcctagcgaagtagtcgccgcgcgtcgcgtggagtggatggagggaggctctggatggagttggagccccggccttccggtcggcaggtgggacttggccgctcgtcccagcgcctcgccccggcagcctgcaatgcaagtggccggccagcgacttgtcggtcctggagcttgaccggctcgctcccggtcccagtcccaggcccgtgcacggangatgtgtgtgacttgtcgatggtgcgattcttctctcccgttttttggttttcgtctcggtggtctcgtcaaagttctgatactgctgccactaccgccagtgtgtgacttgtctgctcgcagtcacgtgcgcaaactgtgcgtgcggcacggattcgaagctttggtggtacagtacagtagctgtggtggggactgcgtggcaaaagtcaagtcttgtcttggccaaggttctggctttttttgtttttttttctacgcgctagctgttgcatcttgctgcagagtaaatctgtacacccattttttgatataaacggtcgatatatgtgggcttgagaaaatggtgtattcttcgttgtacaacccacatgatgtattacagtttttttttaaaaaaaatacgtatacatgttctctatacactactagagaaatgaccttccgtgtattagtaccggttactttagcaattctttgtaaaaaccaatactaattgtccccttttggttctcgccaaaggtctttagtattggttattgtaacaaccattactaaaggtccattttcagttcttatccagaggtacttaataaccaatactaaagtgtaacttttgccttccacatacctatctcattctctttaataaccaatactaaagtcttgaccctcgctcgtgccctccttaactaagtttatagtattaatgttgatctcataataaaatgcctcaactttaaaattaatattggttactcggtacccattgagaatccgatattatagctcgttccaaatcaatattcttttttagtaatagtggtttacganagggagcttagcccgagagtaagcttcttcacaataaaatggctaaaagcagctgcatatatgaggattgaatcaggacccaactactagctacccgagacatgcatgcacgggcggtttactgatgnagaaacatatctagtttagaaaccctatttttttcaagggatttcaattttacacggnaaattagttcattttttcttaggaaaatagaaatcacttggaaaaatggagttaccaaactaacccttaatcttgactgaagtgcatcagctgtcatctccattccacgataaaaacaaagagcagccaattaagcacgtgcatgcggaatatatatatatccatatattccggaaccttatgtatagatgtagctagtttggtggtagtcatgattcaaatggctggtcaatcaaccagtttgactgtgtgtggaaacaagttcagagcgtcagactcacagagacggtccaagacgacgaaccttgcaaatcatgccgatgacgtacagacagacagtcgatggtgcccgtagtagtgggtacgagaataatgcatgcatgatgtgtgtgacatggcgcggcgcgctaatgaagttttaacagccccatgctgaccggccggcggagctagctagctagttagctggagtacgtagctcccaagtcctgaccgaactgatgcatcgtcgtcgtcgtgcaggcacggtgtgcatgtctggacaaaaaacaaaattaaaggtgaatggatgcagtgccgtggcgaggaggaagtgtatagagtggaaagaagagagaattaaggactccatttttttcctcacgccgccggcagctcctggactatctttttcacgcaagtggtgcgtctcacctcacctcacctcaaccatcaaatcatcaattcatcctggaagaactcgatgccacgcactgagcgggagggacgccaatccgtgggccgctggcgggcgtcaataccactgagcagggtctctctctctctctcacacacacacacacacgcaatagcttgcgtctttacctcacgttctggaagggggtagtttgcctctcgagatatgcagtgggggcgaagcaccaccgggggaaaaaaaaggcgagacagtggaaaaacagagaaacactttgttgcctaataattctgttttgtcaaagcaggttggagcagaatgaacggaatatgccatgaccccgtgtaaccccgatcactccgcccggcggccgcggtcgacatgtttaatttggtcggtaccaatttacttaccgcga

SEQ ID NO: 20369 - DNA, 2057 bp, Zea mays
tgcaagtttagactgcaagaaacaaggaatattattcaatcattaactgaccgttgctactatatcaatttattcattctttgcattggctagctaaaatgtcagaacaaaacaaaatcaaaactgaagtactctcgattattctagcaagttctagttgccgtgccaacaggtcagattcgattgcatcaacagtcttgcactatagcatacctacccaacatggatggtgaagactagtttgttcgaagctcaattttcttgcgtggcggttaaaaagcagtggcgaaggacaaaaaaaaataaatgaggtatggcaacatacctggtttctggtagaataaaaagaaaaaaatggtgcaaactgcaggaatgtacctggtagctaggagaagaaagaaaaacggaccaacagaagggattatatatcgaccaaagcacaaccactactccacatatgctttagtactcaagtgagatataaaatttgaggtatggcagctgctatattgcgccataatgggtactccgtcactgttaaaaagtgatgggagtctcatatatcgtatatgcacagtgcacctatatgatgcatagatattattagattatattataatatataaacttatagttaatgacataaatattggtatttattataaaaatgttaaactcaaaggctagtttggtggggctttagaccatcctaaaatgcctccgtatctctagttttgggcttttggctcctcttgtgaagctaaagacgtttggcaaaaataaatctagtgacaatttattactccgtccataccaaattaatattcgttgtatgaatctgggcaaatgtagaaaacaaattcattaattattgtataaatctattaaaaatgaaattggattttaatttacaacagatagagtataattctacaactttaaagcacttacatcatgggaaaccgaacgagctataaaaaaggatcagccttcttttcaactcatattttccttggccttttgactaagttaaaatgtaacatttgctcttgtcggtttaatatatgaaatataaaccatatgttcagtttcatattaaatttattttttatatgtatcaaatataattgtgtgccgtcgtaacatggatattgtactatctagttacgttaaatctgtaaggaagatcagaaaacactgcgttttctcaactctggtttcggagccctctttgcaagcgttgtttttaaatggccatttggcatagctctatattaagaatcataaaaaagtccaaatcggagctacaccaaaaggagacttttttttttttttttccttgaatagtttgattaaaaaccggtattgtacaattttttcataacggagatagcacgaaaactggatttttcatttcacattttcagcaaattcacacggccacgtgggacatggatattcaagggacaaggggcaccacgttgtccatttccctgccggtacctctactttatcactagtcactaggctacgaaacagtgccgcggtgcgcgcacacacagccgccacagcccagacccctcgcctcggcctcttttaaatatcgcgcattccggcgccgcaaatggctcacgcggcgctgctccattgctcccagtcctccaggagcctcgcagcctgccgccgcggcagccactaccgcgccccttcgcacgtcccgcgccactcccgccgtcgccgacgcgccgtcgtcagcctgcgtccgatggcctcgtcgacggctcaggcccccgcgacggcgccgccgggtctgaaggagggcatcgcggggctgtacgacgagtcgtcggggctgtgggagaacatctggggcgaccacatgcaccacggcttctacgactcgagcgaggccgcctccatggccgatcaccgccgcgcccagatccgcatgatcgaggaggcgctcgccttcgccggcgtcccagcctcaggtgcgcctgcgaatactcaggtgcgtctacttttcgattaggatgttctaggtaatggtctcgtgc

SEQ ID NO: 20370 - DNA, 1388 bp, Zea mays
ttgggagtcactaggctacgaaacagtgccgcggtgcgcgcacacacagccgccacagcccagacccctcgcctcggcctcttttaaatatcgcgcattccggcgccgcaaatggctcacgcggcgctgctccattgctcccagtcctccaggagcctcgcagcctgccgccgcggcagccactaccgcgccccttcgcacgtcccgcgccactcccgccgtcgccgacgcgccgtcgtcagcctgcgtccgatggcctcgtcgacggctcaggcccccgcgacggcgccgccgggtctgaaggagggcatcgcggggctgtacgacgagtcgtcggggctgtgggagaacatctggggcgaccacatgcaccacggcttctacgactcgagcgaggccgcctccatggccgatcaccgccgcgcccagatccgcatgatcgaggaggcgctcgccttcgccggcgtcccagcctcagatgatccagagaagacaccaaaaacaatagtcgatgtcggatgtggcattggtggtagctcaaggtacttggcgaagaaatacggagcgcagtgcactgggatcacgttgagccctgttcaagccgagagaggaaatgctctcgctgcagcgcaggggttgtcggatcaggttactctgcaagttgctgatgctctggagcaaccgtttcctgacgggcagttcgatctggtgtggtccatggagagtggcgagcacatgccggacaagagaaagtttgttagtgagctagcacgcgtggcggctcctggagggacaataatcatcgtgacatggtgccataggaacctggatccatccgaaacctcgctaaagcccgatgaactgagcctcctgaagagaatatgcgacgcgtactacctcccggactggtgctcaccttcagactatgtgaacattgccaagtcactgtctctcgaggatatcaagacagctgactggtcggagaacgtggccccgttttggcccgccgtgataaaatcagcgctaacatggaagggcttcacctctctgctgacgaccggatggaagacgatcagaggcgcgatggtgatgccgctaatgatccagggctacaagaagggcctcatcaaattcaccatcatcacctgtcgcaagcctggagccgcgtaggaggaggccaaggagcacaagttacaggcacaggcacaggagtgtcatgtgcaataatgtagattcgtggccccatcgccgtctactcatctgtactgcaccaaaatcaacattctcctaggacatgttaaataattttctgccactcgtcgagatatttcaaattcactgttccacaaaaaaaaaaaaaaaaacggcgaccagtgagctgtccggcc

SEQ ID NO: 20371 - DNA, 1108 bp, Zea mays
  misc_feature (9)..(14): n is a, c, g, or t
agcagtttnnnnnnaacaacaaatggcccaataggtgcgtgaccagccacctaaattatgacatcctgctcaagccgtgtctgtgatgacacctggaccagatgccttccgccatttccatggggctgcctcatgtcgaccataagaccccgctcggacctgacaggagaagcagtgtcttcaacagggacaggccatcttatagttcccttaccagggttattcaagcgtgcagaatcattgttcctgtcaacaattttcttggtagagtgactgctcccattccaagttgcctcattgttacgagaacctgacgagctctcagttgtaccaaactgggatgagggcttccgggctttcatcgccttttcaggtggtgattttggccacttaattgtcccattgctgtatccttggccaatccatgattcagtgctccttctcatatcacataagatctcagcggcgcactgtatctttggcgatacttgagatgtttttaaaagagaataatcactgtcatgcttctggaaaccatctaaagagtcaagatgatcctggggctgcagttgctgagaaccatgctcacccccaatttttctggagtgaatgttttgtacaagtgatccagaagttgattctgtgccacacaaattatgttgtccatcacatggatccttttttcttttttttgctgcttccatctcttgaagccgagatcatcaattctatggacagacgtgtcttcatgatctagagaagtgaggttggagccaacccgcacccattgccactgggagttactcctacttgatccatgtttaccacagtcaacaccttgtcgacagcccccagcctgtgaatgtgaccaaggaaatggtggcaaactagctccatgaactgtcatggaaggcatataaggcttaactgcagctgtgctctcccttccgggtgctaaaagagagtctagatcttgtcgatgaggaagagttaaacggcttaagatatcttttggatgacaaagtgcactatcacagagattaatttgtgatgggtccttaaccaagaggggtggcttgtcaccacattgttctttgatatcacagca

SEQ ID NO: 20372 - DNA, 3441 bp, Zea mays
  misc_feature (821)..(821): n is a, c, g, or t
gatcgtagtggtgtgttgagcagttaattaccaaaacacttagaaatggcccaacggcacatttctctttcagtagtggttatcatcaaatctgcatggctttaggtgatgaatggaaaactgtatttaaaactaagttcggtctttatgagtggttaataacatcttttggtctcactaatgcacctagcactttcatgagattaatgatcgaggtcttacatgcttttattgagaaatatgtggtagtttattttgatgacattctcatttatagaaaatcacttgatggacatacggagcatttgtgtgttgtttttattgccttataagatgcacggttgttcgataactgtgaaaaatgcaccttttgcaccaatagtatcttttctaggatatgttgtcatctcgcaggaatcgaggtgggtgaatcaaagatccaagccatcacaaggtggctcataccttcttcggtcacgccggtgtgtaattttcttggtcttgtaggttttttagacgttttgttcgcgattttaacaccattacacacctcttcacgaattgaccaagaaaggaatgccattttcatggggtccacgtcaacaaaaggcttttgatatgatcaaatccaagctcacagaagcaccattgttacaacttcttggttttgataaaatgtttgagctcaaatgtgatgcaagtagtttaggcatcggtggcgttctccttcaagagggtaagccaattgcatttttagtgaaaaaaaaagagtagtccatctctgaattattccacgtaccacaaagtacttaatgttttanttcgtgttttgccatttgcaagcttggcaacacagcggtgtggtaaatcttaaaagccacataatcacgttctgccacaacaataatcaacggatgcaataataaaacaaaaatatagttcacatctgtttttttaatgaagacacagatgacgatttaacatgcctaacgacagaacactgagcttccaggctccaaccattaaacacgaccggatccacgatttaacatgcctaacgacgcggcactgagcttccgcagctggatcctctacggtaacttccgaccaccgccgtgatccacccgcggctacgtccagaaagttaccgcagataatccgctcgcgccgtaaactactgagggctgacgcctggaacgcaattacctcgcctgctattattgcttttacgaataagtcgacacataataatagtactatataatacaaaacgggcgactttgagacgagacctgtgatacgatggcaataaaaaataaattacactaaatacagcagtttccccccaacaacaaatggcccaatagatacatcaccagccacctaaattatgacatctgccaatgttctgtgacctcttatgaaacagttgcctggttcccgctgtcccccagacgatataccgtaccctatgattttgacatgaataatgtacacttcacattctcctgttcttctccctattccaatctcctgcagatcctagagaagaggtcagtgttgccttcctcaacttctgctggttctcatactccttctcaagccgtgtctgtgatgacacctggaccagatgccttccgccatttccatggggctgcctcatgtcgaccataagaccccgctcggacctgacaggagaagcattgtcttcaacagggacaggccatcttatagttcccttaccagggttattcaagcgtgcagaatcattgttcctgtcaacaattttcttggtagagtgactgctcccattccaagttgcctcattgttacgagaacctgacgagctctcagttgtaccaaactgggatgagggcttccgggctttcatcgccttttcaggtggtgattttggccacttaattgtcccattgctgtatccttggccaatccatgattcagtgctccttctcatatcacataagatctcagcggcgcactgtatctttggcgatactgcttttggggaaggaaagctcacgtaagtattatcaaaataagataaactgaaaatgagtaatactagatgaatggacagaaaatattattttccgatatagaacgagtgcctagctatagggataaagaattcctaggtacttctattctggcttaacttgcaaatgctacatgataacacatatggcataatatggttcagtataatgtttaatatgtgaggccaacaaagcatttgtacaagtacatctagaatagtgttctataagcaaaatacttttgtcgaaatattcaaatttcttagcaactactccctccctcccttccaaattgtaagtcattttagcttttctagatacatatagtatttcttagcagctactccctccattccaaatctctgtccgttcgaagttataggccattctgacttttctagatacatatactatatttagacattgtgtatatctaggtgcacaacaaaatctatgtacctagaaaagtcaaatcaacttacagtttggaatgaagtactattttcagcaaggtaatatgtatatcagagtaactttttcccaaatagactttggcctaccttgagatgtttttaaaagagaataatcaatgtcatgcttctggaaaccatctaaagagtcaagatgatcctggggctgcagttgctgagaaccatgctcacccccattttttctggagtgaatgttttgtgcaagtgatccagatgttgattccgtgccacacaaattatattgcccatcacatgaatccattctacataattttgctgcatccatctcttgaaggagatgatcaattctatggacagacgtatcttcataatctagagaagtgaggttggatccaacccgcacccattgccactgggagtaacttctacttgacccatgtttaccacagtcaacactttgtcgacagcccccagcctgtgagtgtgaccaaggaaatggtggtaaactagctccacgaactggcttaactgcagctgtgctctcacttccaggtgttaaaagagagtccagatcttgttgatgaggaagtgttaatcggcttaagatatcttttggatgacaaagtgcagtatcacagacattgatttgtgacgagtccttaaccaagggggatggcttgtcacaacattgctccttgatatcacagctagaggtgcatgcaggaggaggtttcggacccagaatcacacccccgccctttccgtggcaatagtccatgtcagaaagcatagaaaaagcttttctaacagagactaggagttcctctttcgtgcgcaataccttctttcctttatctcttcctaagctggaatacttgtaggtgccatcaagaagttcactccatcagaggttctcaatgttgtcgtcgtga

SEQ ID NO: 20373 - DNA, 1669 bp, Zea mays
ccggccgggggaatttttcgattccccctagccgcgaccttccctctccctgtctccttttccctcacggcagcactgcagcagcagccagcatagttcttcctcctccctgcttcttccctctgccatggatgcgagctccaagctcctgctcatccagccccccttctccatctcaccatggacgccaccatagcagcagggtaggccgatgtcctcccctggtttatgcgctggacatctccttcctcccacttcatgccggccctgctcctctccacagagccgagttcgacgtccctgccatggtgggcgctcggcgcccgagctccattcctccatgccagccgacgcctctagcaggacgcgcgctcagccgcgccagggccgctctccccatgttcccctcaaatccgagcttccctggcgtccttgccctgcatgaactccccatgggcgctggaggcgcccagcaccgcgcaggtgtgcggcaaggcttgaccgacgcccttccctggtcggctttgagcattgggtcgagcccctctttttgccatggcactaggcccctgctcctcctctcttccccaccaaaatagcaagcctccgccatgcccaagtgttctctcgagctcgccgtcgggactcccaagtcgctgcacgcctctgcccaggctccaaatccatggccggaatcctcactggaagtgacgctagccgcgagcctcactgctcccttgtccatagttgttgttgtccatcgccttgaagttcccccgtcgtcgtgtcgcttcttcgcctctcccccgtagcacgcccctccccggcagctcaccatcgatccccatttcggactgttgttgccatgtaaatggggtgttcgacgaaatgctaagtagggcagcgagtcgtggagagcatcatcgatcttgctgtgctcgtcattttctcatgcagccccgccgcccatgcaactccagcacgtcgatgccgtctcccagctcgtccctaccgtgcccatcgctgtcccatgcctcgctgtgctgcactagctgcagcagcacactgcccctatgtcttacccttgtagcacttgcgtgctgttcgacaaaatgcccagcagcaacatccccaatgtgtagtgtcgtcgctttttggtgccctgctccattcctgcccgtcgacgccatcctgttgttgccacacaaaacagcagccgcagtagctcctccatggcgcgtgctccaccttgttgcatcgtggtgcccgtcatgctcctccggctttgctccgctctccggtacacgttggcgcgttcatctccacgccatgtgtgcagcggcaccgaccgggtttgtttatggtaagccgatttgttgtttcgggtagtgttcgattaacggataaaatatattttggtaattacaatgattctttatgtgttgcacaaatgcatcgtggtaatattaaatcgtggttaaacgccttgttatataatagtgtgttgattgtcacaacttttaatgcgtagggtatgcttagtgttccaagcagcgaccaataagtagtctacattattttgtattgtatatatatataaatttgctggcgtaagtatgcacgaagagtgtgccattgaacatgtgtgctggagtatgttacatcaagt

SEQ ID NO: 20374 - DNA, 1561 bp, Zea mays
caggctgccgtaaggcagcggatctggttcccccccccccccccccacccccccaaaatggttgttttttttttatacaaaacgaccacaaaaacaagcgtcctgctagttctatacatacaacaaaaattaagcgacgacgacacaagtgatgatactatgaactgatttattgaaggggggaaaactacgactagggcataattacatctttgggaatatacacatccgatgcttgagggactcaatgatgcaatcggacctgtgccaattagcacaagagaatgcggtcagccagaatatcactttgacgcaacagtagcagccaaggcattgcgccagactagcagttcagaacttttcacgacaggacaggacaaaaaaccggacttatcgaacatcatatcactcttgagacccattttgagaatcttcttggcaaatatttgatgatgatttgcttggattgattattgcaggcatccattgctcaggaatgacaataaaataagcagacatggctttcctgaaccgcttcttatattgcataggtgaaatgacagttggagaagcgttcttcggcccacctagaatgccagaagattttacccatgtttcaaggtgcttgtcccatgtatactgcctcataaaatcaataattcctaagaccagttcatgtttctcctcgtcgactcccacaagcaaggaatagtccatcacatcgattccagctaggaaagatgtaccgtcacagtcagccctacagattataagaaaacagaaaaaggtaacctatagttacaagaagataaacttggaagcatcagcacttcaagtgatggaaccacagatcaagtaaaaaatgatcaagatggcttagcaagttatacaagaagtcagctcaccgtcatgtttgctattctcaacacataaatcacagcaatgcaatatgtgatactattaaggcccaaagctactcaggagcaggtaaatcaaatttcaaagcaaagtggaaacatgacatgcagccatgcagattcatattccattatctgtcaagtttagtattgttctcttaaaactggaaacacaacaaaagccggtcttctaatttattatattaaagattagccttttaaaaaaagaaaggacaatttctctcttactctcgctgtatactacgactatacaagaacttaaggaaaacaaatgaatataggtctgctaaaagaggattaaatgggaacagagggattaaaaacaagaatgctcagctatgattacgagtcacaaccacccactttggtgctaataagaagctagattctgatccaaaaaatcaggctgaagattgttgaacaaaagaagtgaagttgaagatagctctggaagccactgcatttcctataagctttgatgaggataaattgatgcaaacttacagctaggaaagatgtatcgttccaaacagctctttccagtagccgctttgccttgttcccaacaaaaatcggtgaagttggcattgcttcaattaagttctggtcaagaagaacctgtt

SEQ ID NO: 20375 - DNA, 4861 bp, Zea mays
  misc_feature (283)..(315): n is a, c, g, or t
  misc_feature (326)..(354): n is a, c, g, or t
  misc_feature (378)..(382): n is a, c, g, or t
  misc_feature (713)..(717): n is a, c, g, or t
  misc_feature (884)..(906): n is a, c, g, or t
  misc_feature (1286)..(1290): n is a, c, g, or t
  misc_feature (1552)..(1557): n is a, c, g, or t
  misc_feature (1745)..(1751): n is a, c, g, or t
  misc_feature (1764)..(1769): n is a, c, g, or t
ccacgcgtccggcttcatcttgctgatcgtgtccgtggcttcttgatactccgtgactgtctccgtccgaagcgagtgagcaagccgaccaacagcggctgagattcgctgcaacgtcggtatcaaaaggtgtccgagcggttgagattcgcgtgccatgtccggattcagtgccgcggccaacgcagcggcggctgagcggtgcgcgctcgcgttccgcgcacggcccgcggcctcctcgccagcgaagcggcagcagcagccgcagccagcgtccctccgnnnnnnnnnnnnnnnnnnnnnnnnnnnnnnnnnctccgcctctnnnnnnnnnnnnnnnnnnnnnnnnnnnnncgccacgtccgcggaccgcgcgtnnnnngaccttatcggaaagttcacgctggattccaactccgagctccaggtcgcagtgaacccagcgccgcagggtttggtgtcagagattagcctggaggtgaccaacacaagcggttccctgattttgcattggggagcccttcgcccggacaagagagattggatcctcccgtccagaaaacctgatggaacgacagtgtacaagaacagggctctcaggacaccttttgtaaagtcaggtgataactccactctaaggattgagatagatgatcctggggtgcacgccattgagttcctcatctttgacgagacacagaacaaatggtttnnnnncaatggccagaattttcaggttcagttccagtcgagccgccatcagggtactggtgcatctggtgcctcctcttctgctacttctaccttggtgccagaggatcttgtgcagatccaagcttaccttcggtgggaaagaaggggaaagcagtcatacacaccagagnnnnnnnnnnnnnnnnnnnnnnntgcacgagctgagttaatagaggaagtaaacagaggtgtttctttagagaagcttcgagctaaattgacaaaagcacctgaagcacctgagtcggatgaaagtaaatcttctgcatctcgaatgcccatcggtaaacttccagaggatcttgtacaggtgcaggcttatataaggtgggagcaagcgggcaagccaaactatcctcctgagaagcaactggtagaatttgaggaagcaaggaaggaactgcaggctgaggtggacaagggaatctctattgatcagttgaggcagaaaattttgaaaggaaacattgagagtaaagtttccaagcagctgaagaacaagaagtacttctctgtagaaaggattcagcgcnnnnngagagatatcacacaacttctcagtaaacataagcatacacttgtggaagataaagtagaggttgtaccaaaacaaccaactgttcttgatctcttcaccaagtctttacatgagaaggatggctgtgaagttctaagcagaaagctcttcaagttcggcgataaagagatactggcaatttctaccaaggttcaaaataaaacagaagttcacttggcaacaaaccataccgacccacttattcttcactggtctttggcnnnnnntgctggagaatggaaggcaccttctccaaatatattgccatctggttccacattgctggacaaggcgtgtgaaactgaatttactaaatctgaattggatggtttgcattaccaggttgttgagatagagcttgatgatggaggatacaaaggaatgccatttgttcttcggtctggtgaaacatggnnnnnnntaatggttctgannnnnncctagatttcagcacccatgatgtcagaaatattaagttaaagggcaatggtgatgctggtaaaggtactgctaaggcattgctggagagaatagcagatctggaggaagatgcccagcgatctcttatgcacagattcaatattgcagcagatccagctgaccaagccagagatgctggacttttgggtattgttgggctttttgtttggattagattcatggctaccaggcatctaacatggaataagaactataatgtgaagccacgtgagataagcaaagcacaggataggtttacagatgatcttgagaatatgtacaaagcttatccacagtacagagagatattaagaatgataatggctgctgttggtcgcggaggtgaaggtgatgttggtcaacgcattcgtgatgagatattagtaatacagagaaataatgactgcaaaggtggaatgatggaagaatggcaccagaaattgcacaacaatacaagcccagatgatgtagtgatatgccaggccttaattgattatatcaagagtgactttgatataagcgtttactgggacaccttgaacaaaaatggcataaccaaagagcgtctcttgagctatgatcgtgctattcattcagaaccaaatttcagaagtgaacagaaggcgggtttactccgtgacctgggaaattacatgagaagcctaaaggctgtgcattctggtgctgatcttgaatctgctatagcaagttgtatgggatacaaatcagagggtgaaggtttcatggttggtgttcagatcaatccagtgaagggtttaccatctggatttccggagttgcttgaatttgtgcttgaacatgttgaggataaatcagcggaaccacttcttgaggggctattggaagctcgagttgaactgcgccctttgcttcttgattcgcgcacgcatgaaagatcttatatttttggacattgctcttgattctaccttcaggacagcaattgaaaggtcatatgaggagctgaatgatgcagccccagagaaaataatgtacttcatcagtcttgtccttgaaaatcttgcgctttcaattgacgacaatgaagacatcctgtattgtttaaagggatggaaccaagccttggaaatggctaagcaaaaagacgaccaatgggcgctctatgctaaagcatttcttgacagaaacagacttgcccttgcgagcaagggagaacaataccataatatgatgcagccctctgctgagtatcttggctcgttactcagcatagaccaatgggcagtcaatatcttcagaagaaattatacgcggtggatcagctgctactctgtctgctcttctgaaccgatttgatcctgttttaaggaatgttgctcacctcggaagttggcaggttataagcccggttgaagtatcaggttatgtggttgtggttgatgagttacttgctgtccagaacaaatcttatgataaaccaaccatccttgtggcaaagagtgtcaagggagaggaagaaataccagatggagtagttggtgtaattacacctgatatgccagatgttctgtctcatgtgtcagtccgagcaaggaatagcaaggtactgtttgcgacctgttttgaccacaccactctatctgaacttgaaggatatgatcagaaactgttttccttcaagcctacttctgcagatataacctatagggagatcacagagagtgaacttcagcaatcaagttctccaaatgcagaagttggccatgcagtaccatctatttcattggccaagaagaaatttcttggaaaatatgcaatatcagccgaagaattctctgaggaaatggttggggccaagtctcggaatatagcatacctcaaaggaaaagtaccttcatgggtcggtgtcccaacgtcagttgcgataccatttggcacttttgagaaggttttgtcagatgggcttaataaggaagtagcacagagcatagagaagcttaagatcagacttgcccaagaagattttagtgctctaggtgaaataagaaaagtcgtccttaatcttactgctcctatgcaattggttaatgagctgaaggagaggatgctaggctctggaatgccctggcctggtgatgaaggagacaagcgttgggagcaagcatggatggctattaaaaaggtttgggcatcaaaatggaacgaaagagcatattttagcacacgcaaggtgaaacttgatcatgagtacctttcgatggctgttctcgtgcaagaagttgtgaatgcagattatgcttttgtcattcataccacaaacccatcgtctggagattcttctgagatatatgctgaagtggtgaaagggcttggcgagaccctcgtgggagcctatcctggtcgtgctatgagctttgtttgcaaaaaagatgaccttgactctcccaagttacttggttacccaagcaagccaattggtctcttcataaggcaatcaatcatcttccgttccgactccaacggtgaggacctggaaggttatgctggagcaggattatatgatagtgtaccgatggatgaggaggatgaggttgtacttgattatacaactgaccctcttatagtagaccgtggattccgaagctcaatcctctcaagcatagcacgggctggccatgccatcgaggagctatatggttctcctcaggacgtcgagggagtagtgaaggatggaaaaatctatgtagtccagacaagaccacagatgtagtatgtatgcatctattagacagctcaataagcactgttgtacgcttgtatggttgggacatatgggcgttatggcatgtatagttgtatgcctagatgtacaacacgtgtactcgtatatatatatataaatgctgaaacaagcattggtcctgtactgtagtttctacatttcattgtcaccaataattaagtgtactcctatggctgggagtctatgaaaatggacgtgttgacttattgggtaataaataatttatatatatacttgtgcaagaattttcgcctaccgacttgcta

SEQ ID NO: 20376 - DNA, 4161 bp, Zea mays
ctctaactgcaaggaggctacattcgttccatctgttgtttgagtgtcctttcagcttggaatgctggcagtatgtcggtattcagtggaatcttgagctagatttctttctaatgttcgaaaatgcgaagagcgcttttgcccgacgcctcttcataaaaattgtggcttttgtgacttggaccatctggaagcaaagaaatgatttcatctttaaaaatatggtcccttcgttttctacatggatgatttgtttcaatgacacgttggagcttcagatgtttggatttagccctacccttaatttttgagtatcctcttctttctctttcttaattttttagtatcctcttctttctctttctcttttttctatccagctcgttcggttcctttgtttcatcttgttatattttatgcaataaataaagctgtgccgcaggtttcctctacatcctttttcttttcaaaaaaacgtcacagactatccaagtaatttcttcacaaaactaccaaaggtagcatgcagtggcataggcaaataaatttcttctaaattgtataaaacacaatagtggcttgctctaaatttcatcaatcatcaatactgtgattcgttttagatcttgtgccatcaacgcggccatatcggccagtgttgaggggtcaaaccggggatcgatatcctaggctgcagttgattgtgggctaactaggcaatgagctgtaagtatatgctacgtaacgtacatatttttgtcgttcttgccaaaatcaagcctcagcttaaattcgtttctagcagtacttttgattgatataataagttctaacgattttgcgtatgtgtatgttgaagatttgtttgattttgttgccacatgcttgtccgaaactagttgcagcacctgaaatctgatgcaaattcaagtgccatataaatgacggataaaattaaggacaccaggaaatatatgattggctcaaaaactgaatgtaacgctgtcagttatcgcttctcagagcaaagcaagtacaataatatgctgtaaaataactaattgttgaggtaaaagagagataaaaagaaagagaagagagagataaagctgtaaaaactaatactacatattagaaaaaatattatatacacccaggatgtaaaaccactactttgcagcttttcatatccacaccaatagaaaaaaaattaggcttgctagtaaaatctcacatgttcatgttgctacgtctttccactgatggtggcatggtgctacttttttttttcagtgcgctgaaaatgatagaagcaggaagggagaggatgcgaaattggcattgtaattcggtctcttgctacctccaagcgagaagataattacaggtcgcgtctcgtagcgtccacccacgccgacgccggactgtgcgcattcttcgggaacgggacagaggagagaggcgagcgagcaacgagacgctgcgctgaccgcccgccccgcccgcgcccattcctcctcccactccatcctcctcccccgcagcccgcgcttcgccgctcgcgcctccttcccatcctcttcttttcaccgccacccctcttcgctctttcggagccaccgtgagtgcgccgcggcttcatcttgctgatcgtgtccgtggcttcttgatactccgtgactgtctccgtccgtgcgtgcgctggcttgatcctggcggttcttgttcttgcctgcattccactcgttcgcttcctcgcgataatatctgcttcgtcttttttttttccttctggtttcttctggtatgtgtaggaagcgagtgagcaagccgaccaacagcggctgagattcgctgcaacgtcggtatcaaaaggtgtccgagcggttgagattcgcgtgccatgtccggattcagtgccgcggccaacgcagcggcggctgagcggtgcgcgctcgcgttccgcgcacggcccgcggcctcctcgccagcgaagcggcagcagcagccgcagccagcgtccctccgacgcagcgggggccagcgccgccccaccacgctctccgcctctagccgcggccccgtcgtgccgcgcgccgtcgccacgtccgcggaccgcgcgtcccccgacgtaagcacctcatgcctgctctatctttcgccgctgggccatcatcagctgatgttctcccactgtttggcaatttgcctgcttcattttcatgtctttccgttgctcttgtcgcagcttatcggaaagttcacgctggattccaactccgagctccaggtgcgaccgcgggattccaggttcattcacccatctgctacgatttttatctctataacactattggtgcattgtgtgggaacaggtcgcagtgaacccagcgccgcagggtttggtgtcagagattagcctggaggtgaccaacacaagcggttccctgattttgcattggggagcccttcgcccggacaagaggtgtgaggcactgcttctcttgccgcttttgatgataaaacatgtctcaaacatgctcgtatgccatttgctgccgtcgaagcttctcttcccgcttttgcactcagtcacacatgctcttatgccatttgctgcacttccttttagattgaatttgatgtacttgagctacttggctgcagagattggatcctcccgtccagaaaacctgatggaacgacagtgtacaagaacagggctctcaggacaccttttgtaaaggtcagtcgtcttgcatcaaggatctttgtgccaccacggaacagtagttactaatgtccataactgtgcagtcaggtgataactccactctaaggattgagatagatgatcctggggtgcacgccattgagttcctcatctttgacgagacacagaacaaatggtaatgctgctgtttggattactttgcagcactgtttgtttatttgaatgaacaagatatcaaccatctgaactctactttggacaggtttaaaaacaatggccagaattttcaggttcagttccagtcgagccgccatcagggtactggtgcatctggtgcctcctcttctgctacttctaccttggtgccagaggatcttgtgcagatccaagcttaccttcggtgggaaagaaggggaaagcagtcatacacaccagagcaagaaaaggcaagcttttagtactaaacattccatcgtccatcttaatggaagttgatgcactaagttattagtaaactaaaagtaggtagcggttgcatttttctccaggaggagtatgaagctgcacgagctgagttaatagaggaagtaaacagaggtgtttctttagagaagcttcgagctaaattgacaaaagcacctgaagcacctgagtcggatgaaagtaaatcttctgcatctcgaatgcccatcggtaaacttccagaggatcttgtacaggtgcaggcttatataaggtgggagcaagcgggcaagccaaactatcctcctgagaagcaactggtaatacattgattcaacagcgtaaaatagcttgttgatttgatgctttgtggaggttcttatttcacaatttgccaggtagaatttgaggaagcaaggaaggaactgcaggctgaggtggacaagggaatctctattgatcagttgaggcagaaaattttgaaaggaaacattgagagtaaagtttccaagcagctgaagaacaagaagtacttctctgtagaaaggattcagcgcaaaaagagagatatcacacaacttctcagtaaacataagcatacacttgtggaagataaagtagaggttgtaccaaaacaaccaactgttcttgatctcttcaccaagtctttacatgagaaggatggctgtgaagttctaagcagaaagctcttcaagttcggcgataaagagatactggttaggatccttgacagatatcctttgcatttcccgcccttgcttccaccaggctaatcaagcttctctcttcttaaggcaatttctaccaaggttcaaaataaaacagaagttcacttggcaacaaaccataccgacccacttattcttcactggtctttggcaaaaaatgctggagaatggaaggtaaaactccaatttttttgcatttgttaaagctgcaagcag

SEQ ID NO: 20377 - DNA, 588 bp, Zea mays
cccacgcgtccgcccacgcgtccgcccacgcgtccgcggacgcgtgggttttttttttttttttttttttttttacgaaagcagaactactctattgtttcaacgaaccatccccacaaccaactccattcgtggctcatgagcagtgggctcgagtggtttggtcgaggcgtttagcgcgaacacactgcgtgccctcgttattgcctgccgatcgcaggagcaggaccgcaacagatcaaagcctcatgcagcctctaaatgcaaccgcaaccgtcaccgaggctggatgccgccccgagccctgagcctctcgcgggcgaactcgccggagaccggcgcccgcctgtgccgcggcggcgccccgaactcctgccgcggcgacgacgactcgtcctgggccctgtgcttcagcggcggctgcggcggctcgtcgtcgtcgtccgctggctgttcctgcgcccccgcgctgctgctgctccagccgaactccccgacgcgctggtgatagcacttgacggccaccgccagcatgaacaccgcccagacgcgcgacgccgtggacgagacgttccagaccagcgtgaa

SEQ ID NO: 20378 - DNA, 2130 bp, Zea mays
cgtcagcccctctctctcccggcgtggggtggccatagcttcgctgcctccacttgtcttctttgtttcaccatcagttcaattcagtttctcgccggtcgccgctggcttgctagttgctactgcgcgcacttcagctgcccgctgttgtaccgcggactctacctcatcattcgccttgctgcctccgccgcctaggtcgcgcaggttcggacgccatgaccgcgacgccggcggtgatcgggctgagcgcccgcggcaaccgcctcctggccacctcattcggttccgctgagctcgctcccccggacgcgtacccgtcgcggcagttcgccgccgcagcgcccaagctcaccgtcgtggcgcaccgcgcctccgcctccgcctcctccccggccgacatcgggggcgccggccacgcgcgcgcgcacgccatccgggcgctcaggaaccactccgcgccggcgctggccccgcctcctccggctgacccggctccggagctggactccaagttcgagttcgagttcgagtcctcgctggaggccatcgtgctgctgcagcgctccatgctcgagaagcagtgggagctgcccttcgaggacgacatctcctccacggaggacgaggacgaggacgagaggtccacggtggtggtggcgcggtcgggcgtctcggcgcggcagcggcggatgagcgggcggcggcggggcgcggtcgttggccggaagagcgtcaccgtcagcccggagctgatgcagagccggaaccgcatctacctccggggcaccgtcagcaaggacctcctcacgcacaagcaggtcgtccagctctccaggaagatcaaggacggcatctggcttcagcaccaaagatccaagctgaaggagaaactgggcaacgagccgtcatacaagcagctggcgcaatcgctgcggataccagctcctgagctgcgagcgaggatgcgcgagtcgtttcttgcgagggagatgctggcgatgagcaacacccgtctggtggcgtggtcgcggccgaggtacgacaacctcggcgtcgagctgccagaccttattcagggtggcctgatagggctgctccgtgggatcgagaagtttgatgcctcaagggggtttaggatctccacctacgtgtattggtggatccgtcagggggtttcaagagcattggccgacaactcgagatcgttcaggctccctacttatttgcacgagaggttggtagccattcgcggcgcaaagtacgcgttagaagaccaaggaattgctccgacagtagagaacatagcggagtcgctcaacatatccgagaagaaagtgcacaacgctacagaggctgtgcacaaggttatttcactggatcaacaggcgttcccctccttaaacggcctacctggggatacactccatagttacatagaggatcaaaacgttgcaaatgatccgtggcacggatttgaggaaaggtacctcaaggaggaagttaacagtcttataaattcaactctcaacgagcgcgagagggacattattcgattatatcatggcataggaaagcagtgccatacatgggaggatatcagcagacaattcgggttgtcgagggagcgcgtgaggcaggtagggctcgttgcgatggagaagctgaagcatgctgcaaggagggaacatttggatgcgttgcttgaggaatactgagtgagatgttcttcgcttgagtcggttaattccaccgttgcagtggttgtatatactcggaaacataggggggcaggcacatcatccttgaaaggcttcactgccactcactcactctgcagataactatacatgtacatctgtgacgatcagtaggcatgcatagttaaagcatctgtggctgcaaaatcgtcaaggcgatccaacaaaaggagaaccttttttttggtcttggaagctttacaaagtgtgatgtggtatgtatatgcaaatgtaatgtatcagtaattcagtagagcaataacgtttatgtcctggatttgtattcttgtccagttacatagaaggaaaaaatgcttacaactgcaaaaaaaaaaaaaaaaaaaaaaaaaaaaaagaaaaaaaaaaaaaa

SEQ ID NO: 20379 - DNA, 1421 bp, Zea mays
ccccgcctcctcttcctcctcctctccgcccaacgtcgggcgcggcggggagctggtcggaagagcgttgccatcagcccggagctgatgcagagccggaaccgcatctacctcaggggcaccgtcagcaaggacctcctcacgcacaagcaggtcatccagctctccaggaagatcaaggacggcatctggcttcagcaccaaagatcaaagctgaaggagaaactggggaacgagccatcatacaagcagctggcacagtcactgcggatatcagctcctgaactgcgcgcaaggatgcgcgagtcgtttctcgcgagggagatgctgacaatgagcaacatccgtctggtcatatccattgcccacaagtatgataacctcggtgtcgacttggcagaccttattcagggtggtctgattgggctactccgggggatcgaaaaatttgatgcatcgaggggattcaggatttccacctatgtgtattggtggattcgtcagggtgtttcaagagcattggctgataactcaaaaacgttcaggctccctacgtatttgcacgagaggttgatagcaattcgtggtgcaaagtacgcgttagaggatcaaggaattgctccgacaatagagaacatagcagagtcgctcaatatatcggaaaagaaagtgcacaatgctacagaggctgtgaacaaggttctttcactggatcaacaggcgttcccctccttaaacggtctacctggggacacactccatagttacatagaggatcaaaacgtcgcaaatgatccatggcatggatttgaggaaatgtatctcaaggaggaagttaacaatcttataaattcaaacctcaacgagcgtgagagggacattattcgattataccatggcataggaaaacagtgccatacatgggaggatattagcagacaatttgggttgtcgagggagcgtgtgaggcaagtaggactcgttgcgatggagaagctgaagcatgctgcgaggaggaagcatttgaacgcattgcttgaggattattgagtgagatgtttttcgtttacacaaatgcagtggctgtatatactcggaaacatagggtacatcatccttgaaaggctttactgctactcactcggcagataactatacatgtacatttgtgacaatcaataggcacgattcagatatctatgtctgcagctgcagtcatcaaaacgagccaacaaaaagagatgtttttttccttggggaagcttcgtaaattttctgtaatgtatcatttagcacttatcagcccagaagagcaacatttatgtactggatctgtattattatctagttacaattacatggtgttgacgctttttcggagcgccaaaaaaaaaaaaaaagggcggtagctcgcgatctag

SEQ ID NO: 20380 - DNA, 797 bp, Zea mays
  misc_feature (791)..(792): n is a, c, g, or t
  misc_feature (795)..(796): n is a, c, g, or t
gccaaaatcaggcagacgcgagcgctcccgatgaaccctttctctgtgaaaacctccctctgctcctccatcccgccgccacgttgtcgcccctccctctgctcctccatccggtcgccgccgtgaggagtaccatcgtcagctcaggtatcggatctatttctccctcttccagcgaagagcctgcgcggtgtaaggattctcggatctatttcgccgagtagggtcctgttgggcggccgcctggttcccgggtcctgttgggcgtgaatcttggctgcccgtgtcttcgtccgcctggttcccgggttcgagtaggatcctccgcatgggtcttggcgtcctcgcgagtaccagctgtttctcttctgaagacgtgggtaccagctgctgctgcactggttcactcctgctcttgagcaaataagccatggcggcaaccgaatcactagccgggttgttgctagttggctacgatgcaacaaatctagagcactttgttgctagttgcccatctagttcactcctgcattggttcacttctgctagttgggtttcgttgttgctagttgtctaaatttgtcgtagtagtattgttccacggacccaacaactatacatgtacatctgtgacgatcagtaggcatgcatagttaaagcatctgtggctgcaaaatcgtcaaagcgatccaacaaaatgagaaccctttgtacttgagttgcatctagattcgttgtcacaaaaaaaaaaaaaaaaaaaaaaaaaaaaaaaaaaaaaaataaaaaaaaannaanna

SEQ ID NO: 20381 - DNA, 866 bp, Zea mays
  misc_feature (762)..(789): n is a, c, g, or t
  misc_feature (853)..(864): n is a, c, g, or t
atccgaattcgcggccgcgtcgacgcaccagccgccccggcaaggggaagatgcgcagccgccgctacatcaaccgcaagggacccctcattgtctacggcgctgagggctctaagatcgtcaaggccttccgcaacctccctggcgttgatgttgccaatgtcgagcgcctgaacctgctcgacctcgcccctggtggccaccttggtcggttcgtcatctggaccgagtgcgcattcaagaagctggatgaggtgtacggtaccttcgacacgccatcggcgaagaagaagggtttcttgctcccgaggcccaagatggcaaacgctgatctgtcaaggctcatcaactctgacgaggtgcaatctgtggtgaagcccatcaacaaggaggtgaagcgtagggagcctaggaagaacccgctgaagaatatggctgcagtgctcaagctgaacccgtacctcggtactgcacgaaagatggcagccctagcagaggcagcgcgtgtcaaggccaggaagcagaagcttgactccaagaggaccaagctcagcccagaggagacttctaaggtcaaggctgctggaaaggcgtggtacaagaccatgatctcagacagcgactacacagagtttgagaacttcaccaagtggcttggtgtcacacagtgattgtctggtggtagtttgtcatgtcagaaattatgattttgtttgctattgccaactgtcgcttgtcattggtatcttcaggcatgatatnnnnnnnnnnnnnnnnnnnnnnnnnnnnccgatgatctctttcttccagacacatattacaccaattatgagaacgaagttatgcattttcnnnnnnnnnnnntc

SEQ ID NO: 20382 - DNA, 4304 bp, Zea mays
  misc_feature (2947)..(2947): n is a, c, g, or t
  misc_feature (3266)..(3266): n is a, c, g, or t
ttacatttgagattatccttcaatcagatattattcctccgctcttttttttacaatacttacacttaaaacttgcgccaaccttttattcgcattgccagactaaaactgacatgtgtcctacaaacgtggcaaaaataatacaagtatgcaacacattagtagcaaatattattaccagctacatatataactaaatattaacaatactaatatatataactacacattaacaatactaatatatcactagatattaacaagacgtcatcacattttttttttgaaaccttaaacccaaaaaccgaatctagacaataaaattactaaataatacacctcaacatggtttcttagtaacaaattgtggttggtttaccactgctcgggcagtttatcgtcgccatttgacgagaagccgacgaggtttactaatgagaccattattttaatgggctaaaataaattaaatttagatatcatgcataccaaattacacactagaatatgtagttttttatcatatttttatattttcttttcaaaaaatttaaatttggactgaattttgaaaaaccctgcacgcccgagccccgctttcaacgcacacactgtccatttggcacagtcctcaactcccactgccatgcgggccagtcgacgcgatacagtgattactcttccgcaagtcaaaatcaacgccccagatctcacctcccaaaccctagacctctcacacgcgttcccccacgcccgaggtggatcactcgcggcgcgccgggacccttttccaccccgccgccgaagccaccgtgccgctagccttccccgccgccgcaaaatggccgcctccgcgcgacccctggttaccgtgagggccctggagggcgacatggccacggactccgccggtgttccgctggcggacgtcctccgcgcaccgatccgcccggacatcgttcgcttcgtccacaagctcctgtcctgcaacagccgccaaccctatgcggtgtcgcgtcgcgccggacaccagacctccgcggagtcctggggcacggggcgtgcggtatcccgtatcccccgcgttcctggcggtggtacccaccgcgccggccagggagcgttcggcaacatgtgtcgtggtggacgcatgttcgcgcccaccaagatctggcgccgctggcaccgtcgcgtcaacatacaccttcgccgtgtcgccatcgcctccgcactctccgccaccgccgttccgtcccttgttctcgcacgtggccaccgcgtggagtctgtgcccgagctcccgctggtcgtttcggactccgcggagtccattgagaagacagcccaggccatcaatatcctcaaacagctcggtgcctacgccgatgctgagaaggccaaggattctgttggcatccgccccggcaagggcaagatgcgcaaccgccgctacatcaatcgtaagggacccctcgttgtctacggcactgagggctctaaggtcgtcaaggcctttcgcaacctccctggcgttgatgttgccaatgtcgagcgcctcaacctgctcgatctcgcccctggtggccaccttggccggttcgtcatctggaccgagtgcgcattcaagaagctggatgaggtgtacggtaccttcaacgcaccatcagcgaagaagaagggtttcgtgctcccgaggcccaagatggcaaacgctgacctatccaggcttatcaactctgacgaggtgcaatctgtagtgaagcccatcaataaggatgtgaagcgtagggagcctaggaagaacccactgaagaatatggctgcagtgctcaagctgaacccgtacctcggtactgcacgcaagatggcagccctagccgaggcagcgcgtgtcaaggccaggaagcagaagcttgattccaagaggaccaagctcagcccagtacgacgatcttctctggtccagtttcattttatacatctgtatatagattattagctgttcattgtattctacaccagcattgtattgtttcagtaccatactgtttatttgaaattgattgtgtatttcagcatgttttatgcaacctaatattatagggcatgatatatttattgaattaggttgtattgtgttatagcttaggtcgtttgtcgaactgttaacattgatgctgcatttttggtgtgccgctcaagctgtcaattctattgctggattagccctatttctcaatgtctgggagtttgctagtctaactgatgaattggttgcttgccctagtttgtggtgaatcatgtattctttctacattgaactcaccaagctacctgcttctctaacttctaaattaaatccatgaaatatgccttgacaatgtattttttggaactgtagattttagtatatgtcttgtaaaagcttggccagatttgagatgtttaatttaggagtaggacaaaactaaaccaaccttgactgtagctcatcatttccaccatagatttacttgaatacgtgaactgaatgacacatgattgtttcaccttttgctgatgttcttggtcctagacacctgctctgttgtcagttattttgcatgtatattgctgttcccatacggtagattgctagtgttagatgaactgtgcgttgcatttcaccactagattgattactaatgtcttctttctagccaatctggctacacataatctttatctaggcgcttagaaaaaaaattgtacccagaaaaggccaaatgacttccaatttggagcatctcatagtactggagtgatgtgctgatatgtaatttcctttcaggaggaggcttctaaggtcaaggctgctggaaaggcgtggtacaagaccatggtttcagacagcgactacacagagtttgagaacttcaccaagtggcttggtgttacacagtgattntctggtccaacccttattgttttgccaattcagagattatgattttgatcgctgttgtcaaatatcctttgttattggtatattctgacattagttttggctttggtagtttttttttaccgctggatgtttacttccagacacctattacaccttttatggaaacgaagtatatcgattctcaacactcaccgtgcttctgtttttggcagtattggttactcgagtattcatgttcagttgtattagtgtatgcattttctttgtgcccttctgtttgttgggtatataatagtatatatgttcagttgtttgttcngtttctttgaagcatgtttcttcagttcttgccaggtggtaattctgattgcagtatatccactgtcccaaaatacgaggattttttacttttagatatcctgtttgactctccgttttattttttttctataaatactatttattttggtatgacttattttattagtagaggtaccttaataatgacttatttagtttttttgtttgcacaaaaaaatgaatatggtatgtcaaaaatgttactccttaagtctcaaaatattagttattttaggtcctaatttttatatctatgtgcagatagatgatgataaatttgaatacatatatcaaataaatacattaattatattatgaaccaactaaaatggtaaaacgaattttatttaggatagtagatcctatatctcatcttctaatttaaacttctgtaagaccatcgcaatttacaatgtaaaaaagtgtttttagtgattatataagtgcaatgtaccactataagacctaaggatcctattatattaggatcgagctttatttctattcatttttgaactaacatttatttagttccttaccattttgtaaagaattatttggatcgtgatccattaccacacatatccatatggtcacgaaaaacaccttttgcacggtagattgtattgtttgtatagtgtagtttgaatatggttattgatatggataacatgccggagatggtctaaacaaatttagtagaacaatgtcatctactgttatgatccctattttataccgtctattgactactgtagaccgtctaaagatgaaaccatctaattgcatgtctgaatgtttgcgtggctaagaaattcatgtctccttttgctctgcttctgtagatatagagttgggacttggatgcataaactagtggacccttaactcgaatttatttcgctgctttgcaacgctatccagctacatttttctgcatattctctttctgagaaagtgggtggagcgcttttgcgcttctcggatgtggatgtat

SEQ ID NO: 20383 - DNA, 1694 bp, Zea mays
cattgggtacctcgaggccggccgggaaaacctagacctctcaccacaatctctcacataaaaggtcgatcactcgctgcgcgcctccacccttttccaccccgccgccgaagccaccgtgccgctagccttccccgccgccgcaaaatggccgcctccgcgcgacccctggttaccgtgagggccctggagggcgacatggccacggactccgccggtgttccgctggcggacgtcctccgcgcaccgatccgcccggacatcgttcgcttcgtccacaagctcctgtcctgcaacagccgccaaccctatgcggtgtcgcgtcgcgccggacaccagacctccgcggagtcctggggcacggggcgtgcggtatcccgtatcccccgcgttcctggcggtggtacccaccgcgccggccagggagcgttcggcaacatgtgtcgtggtggacgcatgttcgcgcccaccaagatctggcgccgctggcaccgtcgcgtcaacatacaccttcgccgtgtcgccatcgcctccgcactctccgccaccgccgttccgtcccttgttctcgcacgtggccaccgcgtggagtctgtgcccgagctcccgctggtcgtttcggactccgcggagtccattgagaagacagcccaggccatcaatatcctcaaacagctcggtgcctacgccgatgctgagaaggccaaggattctgttggcatccgccccggcaagggcaagatgcgcaaccgccgctacatcaatcgtaagggacccctcgttgtctacggcactgagggctctaaggtcgtcaaggcctttcgcaacctccctggcgttgatgttgccaatgtcgagcgcctcaacctgctcgatctcgcccctggtggccaccttggccggttcgtcatctggaccgagtgcgcattcaagaagctggatgaggtgtacggtaccttcaacgcaccatcagcgaagaagaagggtttcgtgctcccgaggcccaagatggcaaacgctgacctatccaggcttatcaactctgacgaggtgcaatctgtagtgaagcccatcaataaggatgtgaagcgtagggagcctaggaagaacccactgaagaatatggctgcagtgctcaagctgaacccgtacctcggtactgcacgcaagatggcagccctagcagaggcagcgcgtgtcaaggccaggaagcagaagcttgattccaagaggaccaagctcagcccagaggaggcttctaaggtcaaggctgctggaaaggcgtggtacaagaccatggtttcagacagcgactacacagagtttgagaacttcaccaagtggcttggtgttacacagtgattgtcacgtccaacccttattgttttgccaattcagagattatgattttgatcgctgttgtcaaatatcctttgttattggtatattctgacattagttttggctttggtagttttttttaccgctggatgtttacttccagacacctattacaccttttatggaaacgaagtatatcgattctcaacactcaccgtgcttctgtttttggcagtattggttactcgagtattcatgttcagttgtattagtgtatgcattttctttgtgcccttctgtttgttgggtatataatagtatatatgttcagttgtttgttccgttaaaaaaaa

SEQ ID NO: 20384 - DNA, 2061 bp, Zea mays
  misc_feature (1243)..(1243): n is a, c, g, or t
gtgataaaaaattggctattgtaataattctttttttaagaattgcaagtgaccgtgatgaaaagtcagctattgaagtactttaagaattaaaatacgtctcgctgttgatcttaatattgtctaccactcaatgcataatgctgttaaattctaaaatagaccttagcccaatctaaatcaacgttccagatctcacctcccaaaccctagacctcacacccaagctctgagatataaaggggggtccctcgcggcccgcccggacctttgccgccccgcaggccgcatccgaagccaccgagccgctacccgtcgccgccgccgcgaaatggccgccggcgcgcgccccctggtctccgtgagggccctggagggcgacatggccacggactccgtcggtgtcccgcttccggacgtcctccgcgcgccgatccgcccagacatcgtccgcttcgtccacaagctcctgtcctgcaacagccggcagccgtacgcggtgtcgcgtcgcgctggccaccagacctccgcggagtcctggggcacggggcgtgcggtgtcccgtatcccccgcgttcctggcggtggtacccaccgcgccggccagggagccttcggcaacatgtgccgtggcggacgcatgtttgcgcccaccaagatctggcgccgctggcaccgccgcgtcaacattcacctccgccgtgtggccatcgcctccgccctcgctgccaccgccgtcccgtccctcgtcctcgcccgcggccaccgcgtggagtctgtccccgagcttccgctcgtcgtttccgactccgccgagtccattgagaagacagctcaggccatcaaggtcctcaagcagctcggtgcctccgctgatgctgataaggccaaggattccgttagcatccgccccggcaaggggaagatgcgcagccgccgctacatcaaccgcaagggacccctcattgtctacggcgctgagggctctaagatcgtcaaggccttccgcaacctccctgggcgttgatgttgccaatgtcgagcgcctgaacctgctcgacctcgcccctggtggccaccttggtcggttcgtcatctggaccgagtgcgcattcaagaagctggatgaggtgtacggtaccttcgacacgccatcggcgaagaagaagggtttcttgctcccgaggcccaagatggcaaacgctgatctgtcaaggctcatcaactctgacgaggtgcaatnctgtggtgaagcccatcaacaaggaggtgaagcgtagggagcctaggaagaacccgctgaagaatatggctgcagtgctcaagctgaacccgtacctcggtactgcacgaaagatggcagccctagcagaggcagcgcgtgtcaaggccaggaagcagaagcttgactccaagaggaccaagctcagcccagtatgataatcttctcttccttttacactttatacatatgtatatagattcttacctgttcatagtagtctacattaattgttcattctttagcattgtatatttactgcttcagtactgtaccaattttcgccattgattgtgtatttcaacattttatatgcagcttaatagtctagcgtatgttatattaattcaattgggttgtatcgtgtcatagcttagtcgattgttgacaatggtactattcggtcttagtttctagatagcgttgatatggttagctaacatgcatgtcactgaaccttttttgaggaactgttaacatcaatgctgctgcatttttagtgtgccattcaactaatgagttagccctgtttcacaatgcctgggactttgctagtttaactaatgaattagttgtttgctctagtttgtggtgaatcacgtattccttctatctggaactcacgaagctactgcttctcttactttaataaattaaatccatgaaatatgcattgtcagtaaatttatttggaactgtagattttaagatgttgaacttaggacaaaataaagcaacctacagtttggaccagagggaataccctttccttgactgca

SEQ ID NO: 20385 - DNA, 1276 bp, Zea mays
ggtaaaaaactatttgttatatttcaaattaaaatttttgacttttatagcccataattaaattttattagaagagagccaaagcaacgcagaagcattacacagcacgaattcaactaatctgttacttatttgcttgagacagctgcttgtccttgtcaatgtccttgctggtcaccggtttgaggggactagtatcatccggcaagggctcgaggtcggcgaagcccctagccgcctcgatgatggccaccggcaggccgaggcacttgcccacgatctccttcttcatctcctgcagctgcttgaggagcaggtcctcctcctcccccttgctgccttctttgccgccgccgtccttgttgcgcttgtcgtccttggcctggtcgtactctcttctgaagagcttccaggcgtcatcaccttcgagcttgggcgggcggaccacgaggcccgtgcgcgccatggtcttggcgtcgtcttccttgcggcaggtcaccagcacggcgcccctgtgtttcgtcttgggcaggccgtaggcgaggcggtccccccactcgccctccgccggcggcagcagcgtgaggttgctgtaccagcatccctgtgcgtcgtcgtcgtcgtggcggtacgcccggatgtcgtcgaacacgatcatgtacgacgtcttggacaggaccatgttgaggatgtagagcagcactcctgtagttcaaatcgtgcgtcgaatttagtctatgttgccattgcattgccgtgaatcgtagatcgactacacctaccgattttggatttctcgacggcgcggctgttctctaccttctccttgagcagctcctcgtcctttgcctgcctgctggcatctccaccggcgccggcctcggtgacgacgacgctgccctccgccttcttctgctcggcaggtctggctgcggccttccggagctcggcctccgttctgcccctggcgtctctgacgacgctggacttgtcgacgacctcctcgaccttgtcggtgtcgaggccgaggttgtcgagcatccggtagaggaggttgaagcggtcctccgagtccggcgggccgacgcacacccacaggcggagcgcgaagttgtccttggccttgtcgtgcacgaacaccttctgcgccagcgccgtcttgccgctgccgtggatgcccgcgatgcccgcggcccggaacatccgcgcccccgagccgtcggcggcggccacgagggcgtcgatcacctcgccggcctccttgtcccacccgtag

SEQ ID NO: 20386 - DNA, 3740 bp, Zea mays
tttttttttttttttttcacggaaaggtcacttgaattattgagttaaaaccgtcagtcctcacatagtcaacaggcacatcaatacatcattcatcatctcgggctgtccctgtccttctcgtatacaattcctctacgggctttagccagtctaaagcgacagtaacttaggggagcatgaaccctagcagattacatggcgggcttcaccgagtgtcgctaaaatcatactactactatatactgttggatagccgacggtacaacacaaccaccatcctactcggacagacgccctggcaacaacaacagatcagcgcagcacatgctacaggggaggggaggggaactgcaacaacatacacaaaaatggatttggaagggagggagggtgtggtactgtggttggggggaatatctgcggtgttgttgctggtcggtgcgatgatggatacaatggtaacaaggaatgtatcgcgccaggggtacgctgactttgttgatctagaattctgacatgagcagcttcgggcctggcttcacgctcacgaagtcgaaggggttcggttggtccacgctgatgtagtccttcgtcgtcagcaccaaggtctcgaagaacatcctcgacgcttccttccgcgtcttcccgcgcaccagatggtcgatggcgacgctcttcctccccagaccggagtcctcgtcgaacagagtcttgagatatctcgcgacacccctggtgcgagaagaccagccgctgttgtcgagagactggaactcgctgggatttggctcgaagtcgtcgtcgaagtcgtcgtcgttgtcgtcgtcaccatagttcagaaaatctgtatcaacgccatgaatcgcactcccaaaatcgttgcattccttcacttcatagtcattcatcatatccagatccatatgagaacccgtgttgttttcttggaagccagaattatctcctgtagcagacgcggcattttcatcctccgttggccgaggaaaaccagaagcatcttgattatactccaccgtgttttcatcctctgttggtcgaggaaaaccagatgcaccctcgcgtccctcaaccgtattttcatcctctgttggtcgaggaaaaccagagacatcttgattatactccaccgtgttttcatcctctgttggtcgaggaaaaccagaggcatcttgattatactccaccgcattttcaccctccgttggtcgaggaaaaccagaggcatcttgattatactcaaccgtgttgtcatcctctgtttgtcgaggaaaaccagaggcatcttgattatactccaccgtgttgtcatcctctgtttgtcgaggaaaaccagaggcatcttgattatattccaccccagtaatctcagaagcagggacctcagtactcccaaaaagattagcgtctctatgaacaaaatgattaaattcccttgtcatgccgtccactgcatgagcacaagcttggccagagttatctagaaccacatcttgactagaaacatttgcatcattactcctctgcagatcagatggaacaccttgaaaatggtcactatacaatgtatctacttgagcatgctctctgtcaggaggtgccacttcgggctcattaccactggaacgcctggccacctcttgaaactgagtgccgacaacaaaatcattagatgcacggttaacctggtagtcaggaggaatttgcaaaccaaaagcagctgtagcgccatatgcaacatttgcgcctgacaacatggcatctgattgaatcccatctggtatgtgaagtgggccatcaatagtagcagaaccaaacccagcaatatttctatattctggtattgtttcaggcatgtctaattgaccacgtagttccatgctctgaacagcagggtgtacaatagtctcatatgtccgattgtgtaaattgtttagctcctcagataggcaggaaaagatgggctcgtggaataaatcatcttccagtgaacctttctcaatcatccatatttcggaacgagtgcatggagcctttttacgaatgcgccgtatatcctcagtattgatcaactgttgccgtatagtatcagcatgcagaaccatggcatcatctatctgcacttttctcttgagtgtacccatcttcgaccccaaccttgggcgtttcagagatgattcccttggtggtagtggtgttgaatcaagtgtgaacccaggggtcctaccgactaaaatagatgccagtatatcatcatcatgaggaacaaaatcattggttcttttaacatgtggtcggctaggcaactttttagtggtctcactctctaaagctggtaagctatattccaggtgtctttttctgcttgtaaggctgcctattatgttacttccatcagattcaattgttcctttttccgcagttatctgccccaagtcaatcgcatgattgaattcagcattaggagctgtcagcattttctcaggctcggcaaattctgaagttgatagttcattcagtctatcgttagatgccactacttgttgcattgcttggacttcatgttgaaaatctgcacttagtacttgtgcatcaaataatgggccatccatctgtaccaggttcaccacagatggtccagcagaaccatcaacacatggctctgaatcatttacagccaaaggtacatcttcaatggttgcattgacagttaccgtttcatcaaccgatgcagctataccatcagagccgaccaacttatcagcagcagcttccaagtgtgaagcttgaccctgggatggtaaaccctcacttgtgtgctgttgcaccgatgcatcagagtcctgcacaacagaagactcaacttgcaccggtttcgccaatccaagttctgtcatctcagcacccaccacatcactggcatttcctgtagctgaatggagaaaatctgaggctggtgcagcaggagtgtcagcctttgcagtttcatcattagttgatggtgatgcctttctctgtggactcagaacaggactttcatggactctggaaggaactgtctcttccattaaaccaggtgtagctggggcctgagcgctaatgaactctggtgatgcaggttcatcacaagtaaatgggctaggttgatagtacgaagttgatgggcctgcaatatcctcattattatgcaataatatatcattcaaatcaggagtctgtacattgtaaccagtccagttacggatactgtttcctcctaggtcatctgcattcagtggacctaactttacatgactagaaggcccaccgtccatgttgctgtatccttcagctgttatgtttgtacttttgttatcatcaatctccatatcagtagaagggaccgaatgaccgaccttgaataataataccatcatcagactcgagatgaattgagtggtccttttcaagaattaattcctcctccaaggtccaagccaagtattgtgatgaactgccatcaccaaattcttttcgtctaggccaagacattgggaattgttgaagtattcctggtttttcttctggggttggtcttgcaaaggggttctgctcttttgtgctcacaggagtgatcaggtatcgccttgaaacacggcttctggcaggttcaaaagcattcaaggatcgaagtttctcagggcaagaggtttgtagaggtgcgtgtgggcctcggtgcc

SEQ ID NO: 20387 - DNA, 2207 bp, Zea mays
  misc_feature (2197)..(2197): n is a, c, g, or t
  misc_feature (2200)..(2200): n is a, c, g, or t
gagttaaagctgtcaatcctgacataatatcatatcgtcttgttaccaatacgcaattcctacgggctttagccaagcaaatacaattatacaatagctttaggggatcggaggggagggagccagcgctatcagattacatggcaggcttcacaggtgtcactaaatcatatatacagccaacggtacaacatagcagccatcctactcgagccctagcgcgcgggagatgctacacagaggaggataacttaacagcaacaacaacaaacaaacaaacaaacaaacaaacaaaaatggatttggaggggtaaaggagggggtgcggtaggtcggtgtgatggatacaattggtaagacgtatgtatggcgccaggggtaaaagctggcttgggcggtctagaattccgacatcagcagctttgggcctggctttattctcaccaagtcgaaggggttcggttggtccacgctgatgtagtccttcgtcgtcagcaccaaggtctcgaagaacattctcgacgcttccttccgcgtcttcccgcgcaccagatggtcgatagcaacgctcttcctctccagaccagactcgtcgtcgaataaagccttgaggtatcttgcaacgcccctggtgcgagaagaccaaccactgttgtcgagagactgaaactcgttgggatttggctcatcgtcgttggcgtcgtcgaagtccccgccgtcatcatcgtcgtagttcagaaaatctgtatcaacaccattaattgcactcccaaaatcattgctttccttcagttcatagtcattcaccatatccaggtccgtaagagaacccatgttgttttcatggaagccagaattatctcccatagcagacacatcattttcagctggtcgaggaaaaccagagccatcttgattatattccaccgcattttcatccttcattgatcgaggaaaaccagaggcatcttgattacatcccaccgcatttacatcttccgttggtcgagcaaaaccagaggcatcttgattatatcccaccgcatttacatcttctgttggtcgaggaaaaccagaggcatcttgattataatctaccacattttcatcctccgttggtcgaggaaaaccagaggcatcttgaacatcttccgttggtcgagaaaaaccagaggcatcttgattataatctaccgcattttcatcctccgttggtcgaggaaaaccagagacatcttgattataccccaccgcattttcatcctccgttggttgaggaaaaccagaggcaccttgattatattccaccccagtaatctcagaagcagggacctcattactctcgaaaatattagcattactatgaacaaaatgagtaagctcccttgtcatgccgtccgttgcgtgagcgcaagcttggccagagttatctagagtcacatcttgactagaaatgtttgcatcagtactatgcaaatcagatgggacatcttgaaaatggtcactatacagtgtatttacttgagcacgctctctgtcagcaagtgccacttctttctcattaccaataaaaggtccagtcaccccttgaaacagagtgccaataacaaaatcattagatgcaccgttaacctggttgttagaaggaacttgcaaactaaaagcagctgtagcgccatatgcatcattggcacgtggcagcatggcatctgattgaatcccatctggtatgtgaagtgggccatcaatagtagcagcaccaaacccagcaatattgctatcttctggaattgcttcaggcatgtctaattgactttgcagttccatgttctgtacagcaggatgtacaatagcctcatatgtccgattgtgtaatttgtttagctcctcagataggcaggaaaagatgggctcgtggaatatatcatcttccagtgaacctttctcaatcatccatatttcggaacgagtgcatggagcttttttacgaatgcgccgtatatcctcagtgttgatcaactgttgccgtatagtatcagcatgcaggaccatggcatcgtctatttgcactttcctcttgagtgtgcccatcttcgagcccaacctccggcgtttcagagacgattccctcggtggtagtggtgttgaatcaagtgtaatccaggggtccttctaccgactaaacccggccggcccncgngggtacc

SEQ ID NO: 20388 - DNA, 1220 bp, Zea mays
ctgcaggacgcgatcggttgcttatgcttacgcacgttcagagatcaggagtcaagtgactgttgcacacgaagcatgtgtactgtgactacctgtaactgacgggcagaagaacctggcattacggatacagcgaaaaccaccgtcagatccagtagcatcgttctcctgcctgcatacgaggcacagtcgttcgtcagatccaggagtggcaggaacagccgcacgggcaaccctgccaccgcccgagctgtttgttcttgggggggtgacatacgacgaccgtgcgacacaggaacgctgtcgatgacggcagcttgttcctggcctcctcatcggatgagcaccgcagcatgctttttcccagtccgactgactaacccagatccagcatggagaaatggttcacaagaaaggtcagtccaataatagctgagttaaagctgtcaatcctgacataatatcatatcgtcttgttaccaatacgcaattcctacgggctttagccaagcaaatacaattatacaatagctttaggggatcggaggggagggagggagccagcgctatcagattacatggcaagcttcacaggtgtcactaaatcatatatacagccaacggtacaacatagcagccatcctactcgagccctagcgcgcgggagatgctacacagaggaggataacttaacaacaacaacaaacaaacaaacaaacaaacaaaaatggatttggagggggtgcggtaggtcggtgtgatggatacaattggtaagacgtatgtatggcgccaggggtaagctggcttggacggtctagaattccgacatcagcagctttgggcctggctttattctcaccaagtcgaaggggttcggttggtccacgctgatgtagtccttcgtcgtcagcaccaaggtctcgaagaacattctcgacgcttccttccgcgtcttcccgcgcaccagatggtcgatagcaacgctcttcctctccagaccagactcgccgtcgaataaagccttgaggtatcttgcgactcccctggtgcgagaagaccaaccactgttgtcgagagactgaaactcgttggggtttggctcatcatcgttggcgtcgtcgaagtccccgccgtcatcatcgtcgtagttcagaaaatctgtatcaacaccattaattgcactcccaaaatcattgctttccttcagttccccgcgt

SEQ ID NO: 20389 - DNA, 2162 bp, Zea mays
cccatgcgtccggaaggcgcatgccacggtccccatccccaggaaggcgcaggctacggtccccatcttcaggaaggcgcaggccacggtccccatccccaggaaggcgcaggccacggtccccatccccaggaaggcgcaggccacggcccccatccccagaaagacgcagaccacgatccccttccgataaggacagagttgcgcactcaagggggcaagaacaaaatatagatgatatttccaccgaggccgccgggatcgttggcaataattccccagattctgagcatagattgtcaaagtccttgaggcctcctaactatgaagaaaggaattccacacgtgacagttcttacaagaactcaggcaaacctatacctagtcagggcagcacagatacaagtggagatgaggaacacagtcgtgctagagaaaatgcccggaaagcaaattcatgtcgtaggaaaacaaaggatctctcggcaggtctgcaacctaagaaaatcagtgctggtgactcaagccccagagacaaatctccattcattttacaacagagtggcaaggtcgtccaaaagaaacaccccgatcaattgtcagaatcatcagaagatgagcttgctggtagaagaacaaagcatcaaactgattcacctgatgattctcgtcgaaaacagcattccccgactagaattgaaaatgatgagtcttattcaaagggtggtagaaacagtgagcatgtcatgagaggtttgcgtgatgattctgatgatgctattgatacaaagaaatatttgtctaaagtcaatgaggactcccaatcggacgatggaagtcctttgaaaaaaactaagaaaaaaacagatggtaataggcacattgattctggtagttcagggtctgaagagcctgacaaacatagaacccactcggagaagcgaaggcacaagaaaactcataagcataagaaacagtatgatgatagttccgagtctgattctgagccagatggcaaagacgcaaagaggaggaggaggaaggaagagaagaggctaagaaaagaggaaagacgtcgaagacgtgaagaacgacaccgcagaagggcagaacgccatgccagcaaacgaaaattaaagaacaccgatactgttactatgccttcagactctgagaaggatcgggattctgattcagatggtgatgttaggaaaagagtttcaaacgctggaagagaagagtctgatcagaagaaactagaaattgaactccgtgagaaggcccttgaatctcttagagcaaagaaagccatcaacaactagactgagaaattttttgtgacacatttgagtttctattttcaagtggaagtgtccttatatgatactatttaatgttctgtgtgtttatgtggcagttgatctgatgattcctgagctgtttacttgatgcagctgaattcaggcttagcagccagttatctggtaatgtttgcttctacagatttgtacgcgaaccataaccctgaaaaggatatgttttgttatgtgagcatctgcttccttttttttcattgtgtgaaatgctcgtctcatgtttctttactagtgtatgatgttgtgttatcgcatacgctgttaaaaaataaccttgcacaatatctttacttgtttattggaaagaaataataataactaagaccaagtactgaatctgaatgtgggcataattgccatgtgcttgctgcataatgctactcttatttattttttctttcacttttgtggacacttagctgctgtatactgtgccactttgttgatttgaatttgggttattggcagattagctccatgtgcacaagctttttatgttcctcaggatgatatgatcaacgcctcaacaaaaacaagttggtaacatattgattggaaaattctgctaaagcattccttcttagtttcaggtttgtgcagcagtcaatattatctgattaataggttctcatatcagaaaacaatttcaggcactcgataatttacgatgcctagggggctagactgatattaatcattactttcagtaacttatttatgatattgactgaagaaaaagaaaccctgtgccaccttctttcacatatggaatcagcaaaccagggg

SEQ ID NO: 20390 - DNA, 1038 bp, Zea mays
  misc_feature (14)..(14): n is a, c, g, or t
  misc_feature (16)..(16): n is a, c, g, or t
  misc_feature (20)..(20): n is a, c, g, or t
  misc_feature (1020)..(1020): n is a, c, g, or t
gagagagagagagntnactngtcccccccccccccccccatccccaggaaggcgcaggccacggtccccatccccaggaaggcgcaggccacggtccccatccccaggaagacgcagaccacgatccccatcgcctggaaggcgcaggccatggtctcggtctccaataagacgtcagtccccatctccaaaacgccagaggacatcaccaagttcaccgaagactcgttctgcaaatcgacctttatcgccagagggaaggaggagtaccagtccgtacaatagcaggagtcctaatcgctctcgccagagtttaagtaaagatactgagaaagaaacaaatggcaccccttccgttaaggacagagttgtgcactcaagggggcaagaacaaaaatcagatgataataatagggatggtgcaaggattgttggcaataattccccagattctgagcatagattgtcaaagtccttgaggcctcctaactatgaagaaaggaattccacacgtgacagagaggtctcatattcaatttggcagttcttacaagaactcaggcaaacctatacctagtcagggcagcacagatacaagtggagatgaggaacacagtcgtgctagagaaaatgcccggaaagcaaattcatgtcgtaggaaaacaaaggatctctcggcaggtctgcaacctaagaaaatcagtgctggtgactcaagccccagagacaaatctccattcattttacaacagagtggcaaggtcgtccaaaagaaacaccccgatcaattgtcagaatcatcagaagatgagcttgctggtagaagaacaaagcatcaaactgattcacctgatgattctcgtcgaaaacagcattccccgactagaattgaaaatgatgagtcttattcaaagggtggtagaaacagtgagcatgtcatgagaggtttgcgtgatgattctgatgatgctattgatacaaagaaatatttgtctaaagtcaatgaggactcccaatcgnacgatggaagtcctttga

SEQ ID NO: 20391 - DNA, 903 bp, Zea mays
  misc_feature (2)..(3): n is a, c, g, or t
  misc_feature (7)..(7): n is a, c, g, or t
  misc_feature (10)..(10): n is a, c, g, or t
  misc_feature (13)..(13): n is a, c, g, or t
  misc_feature (16)..(17): n is a, c, g, or t
  misc_feature (19)..(19): n is a, c, g, or t
  misc_feature (21)..(21): n is a, c, g, or t
  misc_feature (30)..(30): n is a, c, g, or t
  misc_feature (36)..(37): n is a, c, g, or t
  misc_feature (795)..(795): n is a, c, g, or t
  misc_feature (802)..(802): n is a, c, g, or t
  misc_feature (809)..(809): n is a, c, g, or t
  misc_feature (825)..(825): n is a, c, g, or t
  misc_feature (832)..(833): n is a, c, g, or t
  misc_feature (835)..(835): n is a, c, g, or t
  misc_feature (843)..(843): n is a, c, g, or t
  misc_feature (847)..(847): n is a, c, g, or t
  misc_feature (858)..(858): n is a, c, g, or t
  misc_feature (877)..(877): n is a, c, g, or t
  misc_feature (879)..(879): n is a, c, g, or t
  misc_feature (882)..(882): n is a, c, g, or t
  misc_feature (884)..(884): n is a, c, g, or t
  misc_feature (886)..(886): n is a, c, g, or t
  misc_feature (890)..(890): n is a, c, g, or t
  misc_feature (894)..(894): n is a, c, g, or t
  misc_feature (897)..(897): n is a, c, g, or t
  misc_feature (899)..(900): n is a, c, g, or t
  misc_feature (903)..(903): n is a, c, g, or t
tnnccgnggnggnggnngntnttttctaantagggnntccccccgggcttcaggagagctcactagtcccccccccccccccccggtcactttctcctcgccatcgccgctcaccagctcgtgtaccaaggaggtcaccatctcctgcaagtcgaaggtctcctgttcgacgcagattctcaccaggtagacgtacatctccatctccagtaaggcgcaggccaaggtctccatcacctgggaggcgtaggccaaggtctccatcacctgggaggcgtaggccaaggtccccatccccaagaaggcgtaggccaaggtccccatccccaggaaggcgcaggccacggtccccatccccaggaaggcgcaggctacggtccccatctccaggaaggcgcaggccacggtccccatccccaggaaggcgcaggccacggtccccatccccaggaaggcgcaggccacggtccccatccccaggaagacgcagaccacgatccccatcgcctggaaggcgcaggccatggtctcggtctccaataagacgtcagtccccatctccaaaacgccagaggacatcaccaagttcaccgaagactcgttctgcaaatcgacctttatcgccagagggaaggaggagtaccagtccgtacaatagcaggagtcctaatcgctctcgccagagtttaagtaaagatactgagaaagaaacaaatggcacccctttccgttaaggacagaggtgtgcactcaagggggcaagaacaaaaatcagatgataataatagggatggngcaaggntttgttntcaataattccccagntttctgnncntatattgnctantttcctcgagncttccttaatatgaaagananggncntntcancccntgnanngan

SEQ ID NO: 20392 - DNA, 1809 bp, Zea mays
ctcaccaacaccaaaaggcacaagcctcgcccctccctccctccctccctccctttccaatcctcagaaccaataaaccgtagacgagagaagttacgagcttctccttgtcccgtgtcttttcaaggatagcccgggcgcagccgcagcatttcttggcgtcggtgtccgcgggttggcgactaagcaatggcgacgaggaaccaccgcgccgctgccgctccgcagccggcgaacagaggtgccgcgagggtcgccgggaaacagaaagccgccgccgccgggggacacgccgagccctcggtgacattggcaacgtcgtctccgatgccctcgacagggcgatcaagctgccggaggggatccatcgccccatcaccaggagcttcggcgcccagctcatgaaggccgctttggcgaacaagaacgccgacgccgccgtagctcctgctcagcctgtagcggcgcgcgccgttacgaaaccagctaggaaagtgactacgaagaacgtccctcgtcctggcgctgggcaggctcccaaggagaacaagaagccatcagcagagggtgccgccgccggcagcggccgctctgtgcagaagaacaggaggaagaagcccgcgtgcacgctttcgaccgtcctttctgcgcgttctaaggctgcctgtggccttaccgagaagccaaaggagcccatcgaggacattgacaagttcgacggcgacaaccagcttgctttggtggactacgttgaggacatctacacattctacaagaccgcccagcatgagagccgccccattgactacatgggcaaccagcccgagctcagccccagaatgcgctccatcctcgcggactggctcatcgagtctcaccgaagattccagctcatgccggaaacgctctacctcacaatatacatcgtggaccggtacctgtcgctgcagcccacgccgaggagggagctccagctcgtcggcgtggcagcgttgctgatcgcctgcaaatacgaggagatctgggcaccggaggtaaatgacttaatccatatagccgatggcgcgtttaaccggagccagattcttgccgccgagaaggctattctgaacagcatggagtggaaccttacggtccccaccccgtaccacttcctgctgcggttcgcgaaggctgccggtagtgctgatgaacagcttcagcatacgataaacttctttggagagctcgcgctgatggactacggtatggtgatgaccaatccttcgacggcggctgcttgcgctgtgtacgctgctcgcctcacgttggggaggagtcctctctggacagagaccttgaagcaccacactggcctcaacgagcagcagatcatggaaggcgccaagacactggtcggatctcatgctgctagtgctagccctgatgcgaggctgaaggccgtctaccagaagtacgccacggagcagtttgggcgtgtggctctgcacccaccggcaccggctgctcttcccgaccttgtctagagtttttacttgacaagctgagggatttggttgagttcgctttgattgacaagttcgagagttgttttcgtatactctattctcgcgagtgtattagacactagtagtaacaactattcataactatatgaataaccacaatgaaaatttatgattggctgaacttctttcgaaagactgtgaggtatttccacagttttgtaagactgtcagaatgaaacggttcttgattaaaaagagctgctgtcaactgcatgaagaagcatgttttaaaaaaaaaaaa

SEQ ID NO: 20393 - DNA, 3292 bp, Zea mays
  misc_feature (552)..(552): n is a, c, g, or t
  misc_feature (723)..(723): n is a, c, g, or t
  misc_feature (1406)..(1406): n is a, c, g, or t
ataccatgtcggtgactcagctgtcagtgattggtaatttagtgccatccgtaaagatggcaaaaattaaatgtctcaggtatagatgatatggttggagatagtcttaacacaatgactcctagaacggaagggcttacctacaatccaattcaagaatctttcttactgcccttttcactatttccatgtgcatttggtgccctgctttgctgtggcagtactgtagtagattgggttttgcacaatatataggcatctggattattgattctgggaatttgtttaggcatcatagatgcgtttagggtaaaggtagtcaaaattgagttgatgatgcactccactatgctgatcagctttgcttgtgcactggtagtacataatcgattctttgcaatgctatatccgcaaaggattttcttgctgatataagcagctctctgaaaatggagggagagaacaacatgaaattagtccaggagttacaattctatcttgtatagtttcacatttaattgctcttgatttcatggctaaactctcgatacnttttctttctttcttctctatctttttcatttctttttctatctatgtttccctctgtatttttttaagataaaataaaagcgcgctgtaggggtttaccctacagcctttctccctcaaaaaaacatttaattgctctttttgctggaacagttttttcttcttccctanaagcatcttctttgttttgaaacatctgatctaactccttactaaacatggtctgatggtcggtggttcacagtcaatatcagtcgataggtctaatctggtaaaggctgtatgttttggttcagattgggatggtttcagtttctgattgggataggtgtgccatactgatgtttttccttttcttattgatatattatacgaagttgcattttagggtaacttgttctaaccttctgatagatactttggcgatatcctgtgccgttgcatataatattctttagtgaccatacatgattaaaatatgtagatttgaattgttggtattcataggcagtatgaccattccactttttcttgcacttttaacttgtaagtagtcatcagttagatctgctttctgacatgctatggtttttatttaaatattaccagttaacaatcttaaatagaggtaaagagattaatcttggattttgtgtcttattttttattttctgttgcacaggagtacatgacttttgagctaagtgtttttcgtgaggtaacatgatttttttcatagcaattcaattgaacctttccattcagaaagataatataattcgacctaaaaaactcggtcgatagaggaaagatcgtcccacggtattatattaataagaagctcattcggagcnccgatcgagaaaggtcacgaaagttgggcctccgtgcagcataagggtccgcccccctatagaccaaatctttactcgtgctgagccctccaaacatacatacaaggatcccctataggccagttcatctcgtgtgtacacaaccagaggaaccaacgagtgacctttttaactccagcctgaaattcgctcccactgggattcgaaattggcctgaggagtgctactcagaccacctaatcaactcaagctagaggcctttcgcaatataatccaacctttctctaatttaaacttaaaacaatgaatttggccattggctattaatttcaccggccgggattgaaaaacatctatgcagtttaaaccttgactacttgataactagatatgacccgtaggggcttttctttcatcagttcatttgccagttttgttacatatcctgaatgtggtcggtcatataatataattgttaccttggtgaagtcctaatgtcttgattacctaaacagttctcataaatcattgtcctcataacttgtaatgggtggaagccagtatgatgatgactgggtgttgcccagtgccgatatcactcttgttctggttgggaaacttggctatggcaagagtgcaactggaaatagcatccttggacgggaagcatttgtatcagaatattcacatgccagtgttactaatacttgtcagttgggaagcactaccctgaaggacggccgcaccatcaatgttattgatacaccagggttatttgatatgagcattacatcggacgaggctggtaaagagattgttaaatgcatgaacatggctaaagatgggatacatgcagttctgatggttttttctgccacatctcggttttctcgagaggacgcaagtacagttgagaccattaaagtcttctttggtgaaaagattgtcgaccacatgattttagtcttcacttatggagatttagttggtgaatctaagttgaagaaaatgttaaataatgcgccagagtatttgcagaatgttgttgagctatgccaaaacagagtggttgtcttcgataacgtgactgaagaccgaaggctccaagcgcagcaacttgacaaattgctcgatgtagtggattcagtttgtgcaaaaaatggaggaaaaccattttcagatcaaatgttcactagcatcaaggaggtgcatgatagagaaaaagaggtgcatacctcgggatattcagatgagcagatatctgaattgaaaaaggagattcatagaactagggatgaacagcttgcgcacataaccaacatggtcgaggaaaagttaaactgcactgtggagaagttgcaacagcagctcatggaagaacagaacgcaaggctggaagctgagaaggtggcgtacgaagctaggctgaaatcagaagcggagatccagaagctcaaggagagcctcaagaaagctcaaatggaaaatgatgagttccggaggatggcgcagagccagggcagtaaatgtgctatcctataggcattagtacttgctagaaattggtggagctatcgtgctgacgcgtctcttgtacgtagtactttctctgttccaaaaatatatagttcaatacaccttagggcttgttcgtttattctaattccatgtggattagagtgtattgaaatggtttgcgatggattttgacttgcgatgatttaaaccgactcaataccagccaatccacatggattaaccgtgaaacgaacaagcccttagtagagatgactacgagagtatccaaacaagacctcgtcggacatgttagcctgaagcttgcttatggacatattggatatagtttttgggtgagaacttttgaa

SEQ ID NO: 20394 - DNA, 1648 bp, Zea mays
attgggacctcgaggcggcgggagcccgaaaacagaaccatcgtacgggtgacgtggccaacacttccgtttttgttccggccaggcggctcgtgtccccgcagtcggcaggagcgcggacgcagatccgacggcctaggggcactccggggaggccacgcatcgcggccgttttaaaacgtcacaggaggaggagataggcacacggcgtgccgcggtgggcgaccttttttgcaccgggagataaatcgacagcaccctgacctcaagtcctcaacccgcaggccgcagctgctcccgcccgccgcgcaagcggccaagcgccgccggttcttctcgagcaattctcataaatcattgtcctcataacttgtaatgggtggaagccagtatgatgatgactgggtgttgcccagtgccgatatcactcttgttctggttgggaaacttggctatggcaagagtgcaactggaaatagcatccttggacgggaagcatttgtatcagaatattcacatgccagtgttactaatacttgtcagttgggaagcactaccctgaaggacggccgcaccatcaatgttattgatacaccagggttatttgatatgagcattacatcggacgaggctggtaaagagattgttaaatgcatgaacatggctaaagatgggatacatgcagttctgatggttttttctgccacatctcggttttctcgagaggacgcaagtacagttgagaccattaaagtcttctttggtgaaaggattgtcgaccacatgattttagtcttcacttatggagatttagttggtgaatctaagttgaagaaaatgttaaataatgcgccagagtatttgcagaatgttgttgagctatgccaaaacagagtggttgtcttcgataacgtgactgaagaccgaaggctccaagcgcagcaacttgacaaattgctcgatgtagtggattcagtttgtgcaaaaaatggaggaaaaccattttcagatcaaatgttcactagcatcaaggaggtgcatgatagagaaaaagaggtgcatacctcgggatattcagatgagcagatatctgaattgaaaaaggagattcatagaactagggatgaacagcttgcgcacataaccaacatggtcgaggaaaagttaaactgcactgtggagaagttgcaacagcagctcatggaagaacagaacgcaaggctggaagctgagaaggtggcgtacgaagctaggctgaaatcagaagcggagatccagaagctcaaggagagcctcaagaaagctcaaatggaaaatgatgagttccggaggatggcgcagagccagggcagtaaatgtgctatcctataggcattagtacttgctagaaattggtggagctatcgtgctgacgcgtctcttgtacgtagtactttctctgttccaaaaatatatagttcaatacaccttagtagagatgactacgagagtatccaaacaagacctcgtcggacatgttagcctgaagcttgcttatggacatattggatatagtttttgggtgagaacttttgaacaacttccttgtttttttctctcacgttctaatgctcttttctcctagctgtatgcgcacaaaaaacacacc

SEQ ID NO: 20395 - DNA, 1366 bp, Zea mays
gggcgggcccacacctgtgccgttataacggggggtaacccggaggccgccggggtcccgctggtgtggtggcgtcctttttttccgccgggagataaaccgaccggacccctgactgcgacccgcagctgctcctgcttccgatccgaacttctctcgcccgccggttcttcgcgagcaattcttataaagcatcatcatcaccacttgtgatgggtggaagccagtacgatgatgaatgggtgttgcccagtgccgatatcactcttgttcttgttgggaaacttggctatggaaagagtgcaactggaaatagcatccttggacgggaagcatttgtatcagaatattcacattctggtgttactaatacttgtcagctgggaagcactaccctgatggacggccggaccatcaatgttattgatacaccagggttatttgatatgagcattgcatcagacgatgctggtaaagagattgttaaatgtatgaacatggctaaagatgggatacatgcagttctaatggtttttagtggcacatctcggttttctcgagaggatgcaagtacaattgagactattaaggtcttttttggagaaaagattgttgaccacatggttttagtttttacttatggtgatctagttggtgaatctaagttgaagaacatgctcaatgatgcgccagagtatttgcagaatgttgttgagctatgccaaaacagagttgtcgtcttcgataacaggaccaaggaccgaaggctccaagcgcagcaacttgacaaattgctctatgtagtggactcggtttgtgcaaacaatggaggaaaaccatttacagatcaaatgttcactcgcatcaaggaggtgcatgatagggaaaaagaggtgcataccttgggatattcagatgagcagatatctgagttgaaggaggagattcatagaactagggatgaacagcttgcacagataaccagcatggtcgaggaaaagctaaaccgcactgtggagaagctgcaacagcagctcatggaggaacagaacgcaaggctggaggccgagaaggtggcgcatgaagctatgcggaaatcagaagcgcagatccaggagctgaaggagagactcgagaaggctcgactggaaaacgaggagttccggaggatggcgcagagcagtaaatgtgctatcctatagtacttgctagaaaaactctgtgcggctatcgtgctgacgcgtctcttttttttttgtctgtagcacctttttttaaccgtttatttattacgcgacaactgttatgaagacactgctttgcttccgtatattatcttcttttttgcgcaaaaaaaaaaaaaaaa

SEQ ID NO: 20396 - DNA, 905 bp, Zea mays
gtgcggccgctcaggccggccgtttcagaattatccgaagttccgaacccaagccaagccccagggtccgaccgcagaaccgacccaaaatgtcgcccgcctgctccatgctcaccaccgcgtcgctctcctccccgctcccagccccgcgcctccgcgccgccgccgccttcgctccgccgcgccgcgcggcagtcacactcgtcgtgcgcgcggcgtccgcatcttccaagtcccctgccacggcggaggcggccccgaagaagaagagggcgaccggcatcacccagccgaagtccgtgtcgccggcgctgcaggcaatcgtgggcgacccggttattccccgcaccgaggtcctcaagcgcctctgggcctatatcaaggagcataacctccaggatccctctgataaaaaggtggtggtttgtgatgagaagctgaaggtcctgttcgcggggcgggagcgagtgggattccttgagatcgccaagcttctcaaccctcacttcgtgaagtgatgaggaggagccaggccacttccaggaatcgagttagcttatatggttggttggttacttgtggctggcctagagggtgcgcgtgcgttgggttttggtagcctgagttggctcgctcgactttgtagaatgctgttgttagcttttattagtagccttcagctcgtagcctggtatgcagttagcgtgtgtggtgttctgctatggtttaagtttaaccactgtccatagtcagtcaatgttagcttccttgtccttgcaatggatgttgctgtgtgaattatggtccaacatggattggttgctctgctatggtttagtcactgcccagtcagtctatatatattttttgatggtaaaaaaaaaaaaaaaaagaaaaaaaaaaaa

SEQ ID NO: 20397 - DNA, 918 bp, Zea mays
gtacccccccggggccgtgccgggctagaagttccccacactcttccacagaccccattggtcatctccaaaaccccaaaccctcgttcaacatagccattatccgaagttccgaacccacgccaagccccagggtccgaccgcagaaccgacccaaaatgtcgcccgcctcttccatgctcaccgccgtgtcgctctcctccccgctcccagccccgcgcctccgcgccgccgccgccgcctcctccttcgctccgccgcgccgcgcggcagtcgcactcgtcgtgcgcgcggcgtccgcatcttccaagtcccctgccacggcggaggcggccccgaagaagaagagggcgaccggcatcacccagccgaagtccgtgtcgccggcgctgcaggcaatcgtgggcgacccggttattccccgcaccgaggtcctcaagcgcctctgggcctatatcaaggagcataacctccaggatccctctgataaaaaggtggtggtttgtgatgagaagctgaaggtcctgttcgcggggcgggagcgagtgggattccttgagatcgccaagcttctcaaccctcacttcgtgaagtgatgaggaggagccaggccacttccaggaatcgagttagcttatatggttggttggttacttgtggctggcctagagggtgcgcgtgcgttgggttttggtagcctgagttggctcgctcgactttgtagaatgctgttgttagcttttattagtagccttcagctcgtagcctggtatgcagttagcgtgtgtggtgttctgctatggtttaagtttaaccactgtccatagtcagtcaatgttagcttccttgtccttgcaatggatgtggctgtgtgaattatggtccaacatggagtggctgcaaaaaaaaaaagcggcc

SEQ ID NO: 20398 - DNA, 914 bp, Zea mays
tgcggcgctcgcgccgtccggcacacgacgccacagaccccattggtcatctccaaaaccccaaaccctcgttcaacatagccattatccgaagttccgaacccacgccaagccccagggtccgaccgcagaaccgacccaaaatgtcgcccgcctctcccatgctcaccgccgtgtcgctctcctccccgttcccagccccgcgcctccgcgccgccgccgccgcctccttcgctccgccgcgccgcgcggcagtcgcactcgtcgtgcgcgcggcgtccgcatcttccaagtcccctgccacggcggaggcggccccaaagaagaagagggcgaccggcatcacccagccgaagtccgtgtcgccggcgctgcaggcaatcgtgggcgacccggttattccccgcaccgaggtcctcaagcgcctctgggcctatatcaaggagcataacctccaggatccctctgataaaaaggtggtggtttgtgatgagaagctgaaggtcctgttcgcggggcgggagcgagtcggattcctcgagatcgccaagcttctcaaccctcacttcgtgaagtgaggaggagccaggccacttccaggaatcgagttagcttatggttggttacttgtggctggcctaaaggagggggcgcgtgcgttgggttttggtagcctgagttggctcgctcgacttcgtagaatgctgttgttagcttttagtagccttgagctcgtagccctggtatgcagttagcgtgtgtggtgttctgctatggtttaagtttaaccactgtccagtcagtcaatgttagcttccttgtccttgcaatggatgttgctgtgtgaattatggtccaacatggattggttgctctgctatggtttatcaataaaaaaaaaaggcccgccccta

SEQ ID NO: 20399 - DNA, 2591 bp, Zea mays
ggcacgagccgtcgttgggcaggatgctatcaaaactgctctgctgcttggggcgattgatcgtgagatcggaggcattgccatctcagggaagcgtgggacggcaaagacagtgatggctcgtggtttgcatgctatgcttccacccattgaagtggtggttggttccattgcaaatgctgaccctaactcccctgacgaatgggaggatggtttagctgatcaaatacagtatgactctgatggtaatgtcaaatccgagattgtcaaaacaccttttgtgcagattccacttggtgtgacggaggataggctcattggatcagttgatgttgaagcatctgtgagatcagggactactgtatttcaacctggtcttcttgctgaagcacatagaggtgttctttatgttgatgaaataaatctattggatgatggcataagcaatctacttctgaatgtcttgacggagggagttaacattgtggaaagagagggcattagctttcgccatccctgcaaaccacttctaattgctacttacaatccagaggaagggtctgtacgtgaacacttgcttgatcgtattgcaattaatttaagtgctgatcttccaatgagttttgatgaccgcgttgaagcagtggatattgcaacacggtttcaggagtctagcaaagaagttttcaaattggtggaagaaaaaactgaaactgcaaaaactcagataatttttgcaagagagtatctgaaggatgttactattagcacagagcagctcaaatatcttgtcatggaagctatacgaggtggctgtcaggggcatcgtgctgagttgtatgctgcccgagttgcaaaatgtctagctgctatggaaggacgtgaaaaagtatttgtggatgacctcaagaaagctgtagagctggtcattctacctcgctccatcctatctgataatccacaggatcagcagcaagagcaaccacccccacccccgccgccaccacctccagaaaatcaagattcttcagaagaccaagatgaggaagacgaagaccaagaggatgatgaagaagaaaatgaacaacaggaccaacagatacctgaggagttcatatttgatgctgaaggtggtttagtagatgacaaacttcttttctttgcccagcaagcacagagacgacgtggaaaagctgggcgagcaaagaatgtcatcttctcagaagataggggccgttacataaagcctatgcttcctaagggtccagtaaggaggttagctgttgatgccacgcttagagcagctgcaccataccaaaaactgcgcagagagaaagaacgtgacaaaacaagaaaggtttttgttgaaaagactgacatgagagccaaaagaatggctcgaaaagcaggtgctctagtcatatttgttgtggacgctagtggtagcatggctctgaatcgtatgcagaatgctaaaggtgcggcgttgaagttgcttgcagaaagctacaccagcagagatcaggtttcaattattccttttcgtggagattatgctgaggttttgcttccaccatcaagatctatagcaatggcccggaaacgtcttgagaagctaccatgtggtggtggttctcctttagctcatggcctaagtacagctgtcagagtgggtctgaatgctgaaaagagtggcgatgttgggcgtatcatgattgttgcaatcaccgatggaagagctaatgtatcactgaagagatccactgacccagaagctgctgctgcttcagatgcaccaagaccttcttctcaagaactgaaggacgagatacttgaggtggctggcaaaatatacaaggcaggaatgtcccttcttgtcatcgacactgagaacaagtttgtatccacgggatttgccaaggaaattgcaagggttgcccaggggaaatattattacctccctaatgcttcggatgctgtaatttctgctgccaccaagaccgccctgacagacttgaagagctcatgattttgcagcagcggcacccgttttctgtaccttttgataggggtggtgaaccttcattcatgcagtagtttttgtgtaggcctctacaatgacagggggaaacaaacccgagcatggcatcgtgtaaagtgttaaggtccaatggcctcctgtccacgtttggcgatgtaaatcctccgtaacatagcttgaaccattgagtgtcacgtagtgccatggctagcagttaaaagtaccatgcgtcatgaatgacggggtggacagtggtggttaaaaatggcagacccatcgtgtggctcgaataaggaggtagtcgcggtacgtgctagaaactgaaaggaaaaagtatataaccctctagcctttaggttttgacaatagaataaatgaataataatccctccaattctattgtcaccctagcccttagccccttaagagtctacattacctattcaccttaaaatctggttgtttcatcctcttagctttataaattcagacaaataacttttgtggttttgatgacgtgatattaatttaagtgacactagttttatct

SEQ ID NO: 20400 - DNA, 2241 bp, Zea mays
  misc_feature (12)..(12): n is a, c, g, or t
gtatgactctgntggtaatgtcaaatccgagatgtcaaaacaccttttgtgcagattccacttggtgtgacggaggataggctcattggatcagttgatgttgaagcatctgtgagatcagggactactgtatttcaacctggtcttcttgctgaagcacatagaggtgttctttatgttgatgaaataaatctattggatgatggcataagcaatctacttctgaatgtcttgacggagggagttaacattgtggaaagagagggcattagctttcgccatccctgcaaaccacttctaattgctacttacaatccagaggaagggtctgtacgtgaacacttgcttgatcgtattgcaattaatttaagtgctgatcttccaatgagttttgatgaccgcgttgaagcagtggatattgcaacacggtttcaggagtctagcaaagaagttttcaaattggtggaagaaaaaactgaaactgcaaaaactcagataatttttgcaagagagtatctgaaggatgttactattagcacagagcagctcaaatatcttgtcatggaagctatacgaggtggctgtcaggggcatcgtgctgagttgtatgctgcccgagttgcaaaatgtctagctgctatggaaggacgtgaaaaagtatttgtggatgacctcaagaaagctgtagagctggtcattctacctcgctccatcctatctgataatccacaggatcagcagcaagagcaaccacccccacccccgccgccaccacctccagaaaatcaagattcttcagaagaccaagatgaggaagacgaagaccaagaggatgatgaagaagaaaatgaacaacaagaccaacagatacctgaggagttcatttttgatgctgaaggtggtttagtagatgacaaacttcttttctttgcccagcaagcacagagacgacgtggaaaagctgggcgagcaaagaatgtcatcttctcagaagataggggccgttacataaagcctatgcttcctaagggtccagtaaggaggttagctgttgatgccacgcttagagcagctgcaccataccaaaaactgcgcagagagaaagaacgtgacaaaacaagaaaggtttttgttgaaaagactgacatgagagccaaaagaatggctcgaaaagcaggtgctctagtcatatttgttgtggacgctagtggtagcatggctctgaatcgtatgcagaatgctaaaggtgcggcgttgaagttgcttgcagaaagctacaccagcagagatcagctttctgccttgccatctctctcaggtttcaattattccttttcgtggagattatgctgaggttttgcttccaccatcaagatctatagcaatggcccggaaacgtcttgagaagctaccatgtggtggtggttctcctttagctcatggcctaagtacagctgtcagagtgggtctgaatgctgaaaagagtggcgatgttgggcgtatcatgattgttgcaatcaccgatggaagagctaatgtatcactgaagagatccactgacccagaagctgctgctgcttcagatgcaccaagaccttcttctcaagaactgaaggacgagatacttgaggtggctggcaaaatatacaaggcaggaatgtcccttcttgtcatcgacactgagaacaagtttgtatccacgggatttgccaaggaaattgcaagggttgcccaggggaaatattattacctccctaatgcttcagatgctgtaatttctgctgccaccaagaccgccctgacagacttgaagagctcatgattttgcagcagcggcacccgttttctgtaccttttgataggggtggtgaaccttcattcatgcagtagtttttgtgtaggcctctacaatgacagggggaaacaaacccgagcatggcatcgtgtaaagtgttaaggtccaatggcctcctgtccacgtttggcgatgtaaatcctccgtaacatagcttgaaccattgagtgtcacgtagtgccatggctagcagttaaaagcaccatgcgtcatgaatgacgccccgggcggcggtggttaaaaatggcagacccatcgtgtggctcgaataaggaggtagtcgcggtacgtgctagaaactgaaaggaaaaagtatataaccctctagcctttaggttttgacaatagaataaatgaataataatccctccaattctattgtcacc

SEQ ID NO: 20401 - DNA, 2701 bp, Zea mays
ggggcattgtgggtagttccgggtaggtgtttgagccttgatgttggtggcccctacctatcttgggaactgtaacagtggggggtatttggtgcatgcaagcgggacaagcaaaattgggagttatcaattatctgtgctactggtgctctgttgatgatcctcttgttaggctaaatgccatagcaagttttggagtgtcaataatgctagttttggcacggtgagcctgaagctaatataataataaaaaatgaatccaggaaggataaaaagcaatactagcaaatacggaaatagtaataagaaagaaagtgaatcaaggaaagagagtgagggatagagagaaactgcaaaaaaaaaaaaaaaaaacacgtagagaaggaacgacggcccagcccaggaaacacgatacggtccagagtcgagaggaagagaaaaaccccgtccccctcggccgccgaagcgaaacagcctctggccgctgcccgaccccgacgccagctgcccagttcttcgccggcgacgagcactccaccaggtacgcccaccccttcccttcctccttgctgccgtgcgaaaccgatcacccgaaccctcactcgagctacttgcttacctccgcgtcttcggatctggtctgattgcgtcttcggatctgatctgatctgactatgacctgctcctttctggttatatcctcacctcacgtggagaagacgagaggggattccaagatgccgagggccaccagcgacgcgaagctcctgatccagtccctcggcaaggcgtacgctgccacaccaacaaatctcaaggtagcctagccttactcgatccgacctccccttctcccatctccccccgcggtcgtcctctatcccctctaactactccgtgtgctgacacacctgcagattattgacctctacgtgggttttgcggttgccactgcccttattcaggtataagtttttttcttcttctaaaacactcgcttatgtcttcatatgtgcaaccatcttgttcaaatagtgttgaaagcctcgaaacatggttaggggaattcatctgaatagcctggagtgtatactatactatcccgcatcagccgatgttctttcctaacatgattccgcctggagtgtatactatactatccctgtggatttctggatttcggttttggctaaacctaacatgggacacgccaaaacacacggccttgtcgtttggttgtgatatagcagtgggtaggtaggcagtcatcagctacatgcacaagaaatattatgagaaggctgctctgctaaagccatcaactgatatgttgtgtatgtaattctcagttgtggattgcaaacggtcaaacttgcatatttctgctctgcctaactgttggcaaccttactgcctgggtactgtagtgctgtgccttcagttgaacttttgcgaaattctgtatgctcttcagtgtttgactggatatatgaacttatcgtccttattttcttaaattatggaatttatctgccctcaaacatgattcgtagatataggcacaatgtgtcttatgctcttgctttgtcaactgtacattcttattcagtttgcaactcttctcagccaccggttacaacacagcagtcaacttgcaaatctcagctttatctagctgttggcaacctgattgcgtggatgttgtggcaccattcttaccactgtaacttttgcaaaccgtatgttcttcagtggctgataggatatatcaacttgttagctgtcattttctcaaaaaaatcaaagaattcgttgtcctcaatcatggttcttaggttgaggacaagctatctttgcgcacttgtgttgtcaactgaacattattatttgagttgtttctgcaacatatctagtaatcgcccttggatgctagtagaaacgaaacaccttcagagacttactggtatgctatttattgtggaaaataaaacaggttgcttacatgggattggttgggtcgtttcccttcaactccttcctctcaggagtcctttcatgcataggaactgcagttcttgctggtacgagcttcttacgctttgtaacccttttatcttgtgcatgatacgagctaacccacacatttctctttttaccttttttctctctctctcgtttagtttgcctccgcattcaagtgaacaaagacaacaaagaattcaaggtattgcttcgttccatcttcatatgctaggacccgttctacttcgaaaatatggcatgacgtcgtgttccaaaacatttcccgcaggaccttcccccagaaagggcctttgctgatttcgtcctatgcaatctggtgctccacctagtgatcatgaatttcctcggataagcaactgctgcaccatgttggttaaaggttttgtagccccaggttgtggtcgctgattgtcgcctttaaatgtttggaactgtcgtgatcgtgatgtcgaatatccatatgatctgttgaaggattacttgtgtaagctgagtattcccggagggagctattagtcgaatggacagtttgcccagcgctgagaatgtaacctagcatgttctttatttgaagaataattcatttttcactgaggtatgctgcaaataagcaattcctggggaattgtcgagccaaaaaaaaaaaaaaaaaaaaaaa

SEQ ID NO: 20402 - DNA, 1035 bp, Zea mays
gaggccggccggggccttgcattttcatcccctcccatctcccgttcgaattcgcgtcgggccgccacatcccagttccacctccctcctcgggccgccgtatcctagctgcctctcttgcttcttcagcaacggcgcgctagctactagtaagagtataagaaagaaagtgaatcaaggaaagagagtgagggatagagagaaactgcaaaaaaaaaaaaaacacgtagccggccggcgacggcccagcccaggaaacacgatacggtccagagtcgagaggaagagaaaaaccccgtccccctcggccgcagaagcgaaacagcctctggccgctgcccgaccccgacgccagctgcccagttcttcgccggcgacgagcactccaccagacgagaggggattccaagatgccgagggccaccagcgacgcgaagctcctgatccagtccctcggcaaggcgtacgctgccacaccaacaaatctcaagattattgacctctacgtgggttttgcggttgccactgcccttattcaggttgcttacatgggattggttgggtcgtttcccttcaactccttcctctcaggagtcctttcatgcataggaactgcagttcttgctgtttgcctccgcattcaagtgaacaaagacaacaaagaattcaaggaccttcccccagaaagggcctttgctgatttcgtcctatgcaatctggtgctccacctggtgatcatgaatttcctcggataagcaactgctgcaccatgttggttaaaggttttgtagccccaggttgtggtcgctgattgttgcctttaaatgtttggaactgttgtgatcgtgatgtcgaatatccatatgatctgttgaaggattacttgtgtaagctgagtattcccggagggaactattagtcgaatggacagtttgcccagcgctgagaatgtaagacctagcatgttctttatttgaagaagatataattcatttttcactgaaaaaaaaaaaaaaaaacccaaggcaagcgcgc

SEQ ID NO: 20403 - DNA, 3787 bp, Zea mays
tcatgaatttgtggatatttatatatcattactaattattatgtagatgtacaacttgtctgaatttttgaagtcaaatgagggtacatgttacggtgtattttcgtttcgaccgtaaccagtgtgtttttccataacgaactttcgtttatgatttttctaaattatcgatatcgtttccgtttctggagttattatttttatttcattttgaggaaaatataaaagcaaaaatggttttaatgtttatcgattgttttcaccccctagtcgtggctacattatgtatgtaaaaccacaacatcacacaacatgttttatatgatgtaagatcgtcagtttggttcaacttatttctgaggagcttgtttgaaaatctggttatagggagaatctagctgtggaaagaatctgggtatcgtggagattacattcagaagaagataaaagtgttaatagggtttatgatgtaaaaagtgacggttttctactattgcaacgactcgaacaattcagtgttcacatttattttaaacgtttttgactaaaaatgattttcatagaagcagactaaaaaactgagtgtttgacagtttataatagcttctgatggctagaaactaaataaccgaaacaaacaggatcttaaagtgccagtacatgtgaacttgatcttgggaaaggggcagctatattttttgtctggtaggagctcccatacttagcggtttcaagagctcctttgttctaaggtagagaccttagaaattcaggggtccacagccaccgtgactaagagaactcagaggatgtttaggatgactctagattccagctctagtgtagagctataatttataatatcaatttaaatagttttataaatatttttaatctaaataacaaataaaatgacttatctaaatgtcttctaaagacctacagttccagcttcacgattttctagaatatttaataacctgtttcacgaactctactaaattttctagagctgtcccagacagggcctaagtcttagggtttatgttgtccccatgaagtgcgatggccggatcaaccttattgctccgagattttttagccataagatcaagtcctccagtaatggaaagaccctatctctagagccaaggtggatcctcgagtcatgggtcctcgaagcatcggtccgacagtagtgggacctctattaatttttttcatcaaaattaataaaagacatcttgatagcatctagtagcattatgatatttcatgatgacaattataaaaaaaaatagtttcattgtatacctgtcaggcttggtacttgggttatccaaaaataagtctttttagaactccgagttaaggcgaccatctctgttcgatacttgcaggtcatcatctgcacaatctgaaacaattggaaggagcgttgcaggagggtgctccaatagcaagttgaaactcatctaccactttactaaaaaaaaaagaactccgagttaccggaaatgctaactcacccgctgaaagatgctactgatttaggtaatactagttgaaaactcaaatcctcttgagattagagagaaattagttcatttccacccccaatttccttacatggccaaagagatttgagttttcacccaactcactccaatcgccaagaaatttgagtttccaccccaatccctctaattgtcaagtggatttgagttcccagactagcagtaaagtttgtgtccactcgtacccattataaatggaaaagaaaaaagaaaaaagaaaaataaatttcctgatccaatgatgctgctgtgtgctgtgccaattccgaatactagatctagatctctagagccaatttatttggaaaaccacgcattttttttcgccagccgaaatgccgaataattcctcaactaggatgaaaatcaaggacggtgctgtccatgataaagatcttggaggaacttcagtcgggcccccccttttgttttttgcattaaacacgcatgataacgcggattaccatttctcaaagatcagatcaaaacatggatcaagatccaacacgtccatgtacaaaaactagccactacacatcacgcgaggtggctcccgattattcgacttgctgcacggctccaattcagttcatcaccatacacgcatgcatcgtggcgcacgccactcacgagcgcggcgcccatgcgcccacaacttattacgactcgtcaccaaccaaccaaaccaagccacccagcaggtccagtccaggcgtgtgtgctgtgctctcctctaccggccgccggccacatcacgccgccgaggcgcccttggcgtcgccgctgcagtagtcgcgaacggcctcgagcttgaagggcggggcgtcggtggcgagccactgctcgacggtgaacagctgctgcccgcaccccttgtgcgggcccgtggtggtgacctccacgtagttgcagtaccacccgtggtggtcgccggtgccgtcggtggccagccgcatccagcacggcgccttcgccatgcagggccccgcggccgctgaagatgtccaggttgctgcgctcgaagtaggagtagccctgccccatgagcccgccccaggcgggcaggttcgagatccccacgccgttgccgtccgcggcggccagctccagcgtgacgttcgcgtccgtcccggccttcaggatcgaccccgtccggatgaacaccgtgtacacgcactccatgctgtcgtcgcccacgccggaggcgtccgtgcctttgatgagctgcgagtgcgacggcagggatgacggatccaccgcatggacggacccgacaggtgatgcatgtcaagagacgcatgaaaggacgggcgggcagctggttaccttgatctcagtcggggtatcgcggccgtgcgccggcactgtggcggacgcggccacggcgaggaggaggaggaggacggcgagcttggccatgggatcccaatgcaatcaggcgactggattggatgagctcggccttcggggaatgggggtatgcggatcatattcatatagggacaccgaagtgtagtttttgtgtttgtggccttgtggggtccacttgtcactgtggcgctggtccgatccgatcagagtaatgtccgcccatttgacacggatccatgcatcgagcgatctggaggattattcaaaggagaaattcatgggcagatggggcccatctcacctgctgtcgtacaagctgagcgggtgtgtcatgtgtgcacgatattgtcactgtcaccaccccccactcaccgtcttgtacgaattatagcggtaacaatgctcaatcaccttgggccttggccatccactgtttttaatcgtaacttatagagtagtttatagataataaaataagatctataatgcatagttctattgtacagtttcatatgcctaccaattaaataatcgcataacaatgttatgaaataaattgtttttagtgaagttttacttagacccgttccgaaccattagagctaattgtttttagataaagtaacaagtccgtctttcgcactcatagatgaggcttcaggccaaattattacagcccacaactaaatgaattagcgaataagttggtggctgattaattttagctgggtcgaaggagctaacaactaatagctatttgaaaagtacaattaatagttggctagtttattagctgattaaatattaattttagaggtaaaggaccttagtttccaacg

SEQ ID NO: 20404 - DNA, 923 bp, Zea mays
ttttttttttttttttcttattttttttttttgtttttttttttttttttttttttctcttctctcgattattcgacttgctgcacggctccaattcagttcatcaccatacacgcatgcatcgtggcgcacgccactcacgagcgcggcgcccatgcgcccacaacttattacgactcgtcaccaaccaaccaaaccaagccacccagcaggtccagtccaggcgtgtgtgctgtgctctcctctaccggccgccggccacatcacgccgccgaggcgcccttggcgtcgccgctgcagtagtcgcgaacggcctcgagcttgaagggcggggcgtcggtggcgagccactgctcgacggtgaacagctgctgcccgcaccccttgtgcgggcccgtggtggtgacctccacgtagttgcagtaccacccgtggtggtcgccggtgccgtcggtggccagccgcatccagcacggcgccttctccatgcagggcccgcggccgctgaagatgtccaggttgctgcgctcgaagtaggagtagccctgccccatgagcccgccccaggcgggcaggttcgagatccccacgccgttgccgtccgcggcggccagctccagcgtgacgttcgcgtccgtcccggccttcaagatcgaccccgtccggatgaacaccgtgtacacgcactccatgctgtcgtcgcccacgccggaggcgtccgtgcctttgatgagcttgatctcagtcggggtatcgcggccgtgcgccggcactgtggcggacgcggccacggcgaggaggaggaggaggacggcgagcttggccatgggatcccaatgcaatcaggcgactggattggatgagctcggccttcggggaatgggggtatgcggatcattcattccggcccggccggcctcgag

SEQ ID NO: 20405 - DNA, 1300 bp, Zea mays
aaaaaactcctcggccccagcattttcgtgcaaggggcgagccgccagctactgctggccttttccctcacacaagtcacacgcacacccgctagcccccgtcccccgtcccgcccgtaccttcctccgccgcctccgtcctcgttccaaccgtgggcagcaggcaggcccaagtatctgcagtagattggtggagaggaagaagacggcaggcacccacgcagatcaaacgtgctccgccacccttggtttcggcgaatcggcgccgtacgccgtaaatcgagccgtctccgagcagatcgacgcgctgcatagcaattcgacccgtctccggccaaatcgacgtccagagctgcaaattgacccatctccgcgctgacctccgcttgtgcctgccgaggagcgccgaagttacgcccttctcgtgaagacatccttgataaacctgatggctatcgcggagagctgtgttgatgcggtggtcatggagatggtggctgtctactgcggtggcctctatgccgccaagccagagcttgctgcccgccgcattgaggccatcggctttcaggttgggcaccagctctctgagagatataccatggagcgtccacgatttagtgatcatcttgaagcaatcaaatttatctgcaaagacttctggtcagagctgttcaagaaacagattgacaatctgaaaacaaatcataggggtacctttgtccttcaagataaccgttttcggtggcttactcgtgtttctctagatccatatacagagaacagagattcaactgaaaatgattctgcagcattgggtgatacagcagcccaaacaactaccatgcttctgtatttcccatgtggattgataagaggtgccttgactaacttaggaattccgtgttctgtctctgctgacatgtcaaaccttccagcatgttcgtttgtggtgcgcataaagacatgaactgtgagaaacgatacaagtacagcatgaagatctgacagtacctgcttctggttcaagcgggttgaacattgaagacagcagtatttgggcatgcattagatgtatcgtggtactgcatttagccccgtttgttttttgttttcttttcctccaggaattacttgttttcactatctcaaaatgactttcccgcaacctcctcatgagagcatgtacaaccccatttaagggctaagtgaaaaaatacaaaatacgggctcttcgcgaagaatccgtcttatcatgactttctatacacgtcttttagctgtatttaaaaaaaaaaaa

SEQ ID NO: 20406 - DNA, 1264 bp, Zea mays
aattcccatagcatgattccaaatttctttgtgaacaaaatcccacccaatcgctgtcgttcgacaccgtcaacggcggccgcgcgctcacgtcccggcgatcccttgccggcggccacgggccgtgacagactcgagcccgtccgccgccttcgccgcgccgcctccgcctcctccatcgcacgccgactccgctgcctccatcctcgcacgtccgcttccactgtctccatccgctcgggagccgccgccctccgcgctaggcctcgcctccgtctggtctggattcttggacatcttggcgctccgcgtcgccgacttctcgcaggcggagagtgagcatccttgatagacctgatggctatcgcagagagctgtgttgatgcggtggtcatggagatggtagcagtctactgcggtggcctctacaccgccaaaccagagcttgctgcccgccgcatcgaggccatcggcttccaagtcgggcaccagctctctgagagatataccatggagcgccctcgatttagtgatcatcttgaagcaatcaagtttatctgcaaagatttttggtcagagctgttcaagaagcagattgacaatctgaaaacaaatcacaggggtacctttgtccttcaagataaccgttttcggtggcttactcgtgtttctctagatccacgtacagagaacacagattcaactgaaaatgattctgcagcattgggtgatactgcagcccaaacgactaccatgcttctgtatttcccatgcgggttgataagaggtgccttgaccaacttaggaatttcgtgttctgtctctgctgacatgtcaaaccttccagcatgttcgtttgtggtgcgcataaagacatgaactgtgaggaatgatacaagtacagtacggaaattcgacagtatctgcttgtggttcaagccgggttgaacattgaagatagcagagtttgggcatgcattagatgtatcgtggtactggagaaatattcggtgtagctgttggtttctgtttccgtttcttccagcagttacctgttttcactacctcaattgtttcccctcatgagtcatgaccgtatttcagagtttatgttggccattcctgcactctaggtagccgcaactggcaccatttgtgagagttaaactatggttgttggttgcattatctctgtggcctgtgatagcacccttcttaaagcatgattcttgccattaaaaaaaaataaaaaaaaaagaaaaaa

SEQ ID NO: 20407 - DNA, 1434 bp, Zea mays
ccggccgggagactcgagcccgtccgccgccttcgccgcgccgcctccgcctcctccatcgcacgccggctccgctgcctccatccgcgcacgtccgcctccactgtctccatccgctcgggagccgccgccctccgcgctaggcctcgcctccgtctggtctggattcttcgacacctgggcgctccgcgtcgccgacttctcgcaggcggagagtgaagagctgtgttgatgcggtggtcatggagatggtagcagtctactgcggtggcctctacaccgccaaaccagagcttgctgcccgccgcatcgaggccatcggcttccaagtcgggcaccagctctctgagagatataccatggagcgccctcgatttagtgatcatcttgaagcaatcaagtttatctgcaaagatttttggtcagagctgttcaagaagcagattgacaatctgaaaacaaatcacaggggtacctttgtccttcaagataaccgttttcggtggcttactcgtgtttctctagatccacgtatagagaacacagattcaactgaaaatgattctgcagcattgggtgatactgcagcccaaacgactaccatgcttctgtatttcccatgcgggttgataagaggtgccttgaccaacttaggaatttcgtgttctgtctctgctgacatgtcaaaccttccagcatgttcgtttgtggtgcgcataaagacatgaactgtgaggaatgatacaagtacagtacgaagattcgacagtatctgcttgtggttcaagccgggttgaacattgaagatagcagagtttgggcatgcattagatgtattgtggtactgcagaaatattctgtgtagctgttggtttctgtttccgtttcttccagcagttacctgttttcactacctcaattgtttccccacctcttcgtgaccgtattccagagtttaggttggccattcctgcactctaggtagccgccactggcaccatttgtgagagttaaactatggttgttggttgcattatctctgtggcctgtgatagcacccttaaagcatgattcttgccatgattcgtgtgctagtactcttctaagcatgatttttgctaccatgattaattgattgtgaagtgcaaattgaataattcagtgtttatggcaaaatttaaagggagacgagaacaagcatgcagtggtgagaatgtaccgttaaattaaagagaaaatcccttcaatgccattaaaacttataccaatccctttaatgccatcagaatttatagcttcccttcaatgtcttcaaatttaaattttaatcccttgaatatcattaccgttagtttggagctaacaccgttagttcaattcaaagtcaatctctgcaacgctactcaaatctatactgagcccttcaatgacact

SEQ ID NO: 20408 - DNA, 1376 bp, Zea mays
cccgtttcccggccgtccccttcaccaatccaatccaactccaattcgtcctccgttcctccccctcgaggcctacgcacaataatttcgatctcgagtcctcgaatcctgccttttcctccggtcaggaaagcatgagcttgatttccggcgcttctcgccgtcgagctcgaaccagaagataagaagaatccgctaggggtgagccccatagaagatggccccgcacccgcacccgcaggaggacaaatcagatcgccacagcagcggcgccggcgcgtcgagggagcaggaacagcggccgtccaaggcatggggaatcctcatcttcggcctcatcggcgtcaccaccgccagtttcgctattactcaagttcgcagaagcatggagtggttctacactcagacaacatcatcttggacttggaggtatacaagtaataactcaagtcgtggaagcttcagtgaggaagctaagaaaagatattatcagcgaatgcagcaggaatatgaagaggaacaagagagagttcaaagaataaggcatatgcagagtgtcttcaacagagagaggaataaatttggacgaggttatgaaagctggagggagaatggccctcctggtggctacaattacatccctcgggatgattggtattggcagactgatacttctcactcagaacataaaaataggcggacgtacacgccggcaggacctagggtttatcctatgtcgcatcactatgcagttctaggtcttgacagatcacgagcgacaccatatacagatgcagaagtgaagactgcttttagaacaaaagcaatggaagtgcatcctgaccaaaatcaaaatgatagagatgctgcagaagagaagttcaaggaggttgtcaagtcttacgaagcaattaaatcggagagaaacaacggtgtaagttgatgcaaacttgcagtgtggtcggatcatgtggtaaagactgggaccggatcatgcgggaatcagttgtgccttgtatatgtaatcaattgttgccggcagcttgataaaatggttcttctgttgctgttgaggacctgtagcacgagttccatttatgagcttgcgcgatgtagatttggataggttcaaaagatgtgctttttgttcatttagccactaacttgacgtgctcacgtcataaatgccataaactgggcaagtgcacagaccacaaaggcgagcacttttgttgcgagcttgcttggatgtccattcattcatatgtgttggagtgaaatagagtttagtttaaaatttgtaccatctcactttaatacatatgatttgaaatagatacatgatcatcaaacaaaaaaaaaaaaaaaaagcggcc

SEQ ID NO: 20409 - DNA, 1152 bp, Zea mays
cctcgaggccccccccggggccccatggcacacggtcgtttgaggcattgcgagtcccgagtcgactctctcccgtttcccggccgtccccttcaccaatccaatccaactccaattcgtcctccggtcctccccctcgaggcctacgcacaatagattcgatctcgagtcctcgaatcctgccttttcctctggtcaggaaagcatgagcttgatttccggcgcttctcgccgtcgagctcgaaccagaagataagaagaatccgctaggggcgagccccatagaagatggccccgcacccgcaggaggacaaatcagatcggcacagcagcggcgccggtgcgtcgagggagcaggaacggcggccgtccaaggcatggggaatcctcatcttcggcctcatcggcgtcaccaccgccagtttcgctattactcaagttcgcaaaagcatggactggttctacactcagttgaataaagtgcagtcaacatcatcttggacttggaggtatacaagtaataactcaagtcgtggaagcttcagtgaggaagctaagaaaagatattatcagcgaatgcagcaggaatatgaagaggaacaagagagagttcaaagaataaggcatatgcagagtgtcttcaacagagagaggaataaatttggacgaggttatgaaagctggagggagaatggccctcctcgtggctacaattacatccctcgggatgattggtattggcagaccgatacttctcactcagaacataaaaataggcggacgtacacaccggcaggacctagggtttatcctatgtcgcatcactatgcagttctaggtcttgacagatcacgagcgacaccatatacagatgcagaagtgaagactgcttttagaacaaaagcgatggaagtgcatcctgaccaaaatcaaaatgatagagatgctgcagaagagaagttcaaggaggttgtcaagtcttacgaagcaattaaatcggagagaaaaaacggtgtaagttgatgcaaacttccagtgtggtcggatcaagtggtaaagactgggaccggatcacgcgggaatcagttgtgccttgtatatgtaatcaattgttgccggcagcttgacaaaaaaaaaaaaaaaaaagcggcc

SEQ ID NO: 20410 - DNA, 1435 bp, Zea mays
ggtaccccccgcgccgtcggctcccgtttcccggccgtccccttcaccaatccaatccaactccaattcgtcctccgttcctccccctcgaggcctacgcacaataatttcgatctcgagtcctcgaatcctgccttttcctccggtcaggaaagcatgagcttgatttccggcgcttctcgccgtcgagctcgaaccagaagataagaagaatccgctaggggtgagccccatagaagatggccccgcacccgcacccgcaggaggacaaatcagatcgccacagcagcggcgccggcgcgtcgagggagcaggaacagcggccgtccaaggcatggggaatcctcatcttcggcctcatcggcgtcaccaccgccagtttcgctattactcaagttcgcagaagcatggagtggttctacactcagttgaataaagtgcagacaacatcatcttggacttggaggtatacaagtaataactcaagtcgtggaagcttcagtgaggaagctaagaaaagatattatcagcgaatgcagcaggaatatgaagaggaacaagagagagttcaaagaataaggcatatgcagagtgtcttcaacagagagaggaataaatttggacgaggttatgaaagctggagggagaatggccctcctggtggctacaattacatccctcgggatgattggtattggcagactgatacttctcactcagaacataaaaataggcgggacgtacacgccggcaggacctagggtttatcctatgtcgcatcactatgcagttctaggtcttgacagatcacgagcgacaccatatacagatgcagaagtgaagactgcttttagaacaaaagcgatggaagtgcatcctgaccaaaatcaaaatgatagagcacaacacaaatgtttggactggtgcagatgctgcagaagagaagttcaaggaggttgtcaagtcttacgaagcaattaaatcggagagaaaaaacggtgtaagttgatgcaaacttccagtgtggtcggatcaagtggtaaagactgggaccggatcacgcgggaatcagttgtgccttgtatatgtaatcaattgttgccggcagcttgataaaatggttcttctgttgctgttgaggacctgtagcacgagttccatttatgagcttgggcgatgtagatttggataggttcaaaagatgtgctttttgttcatttagccactaacttgacgtgctggtgtaaggacactacacgctcttagccaggttagcaagaaaaggctcagccccaatcttacagatgcaggcaaccaaataatccctatataaaaggcggactagatcatgagacgttcctcggtattcggtaacaatagaaatgacagagcatcaagctctttgctgaggaaaaaaaaaaaaaaaaaagcggcc

SEQ ID NO: 20411 - DNA, 2764 bp, Zea mays
gacgaaaatataatactaaaaaatatttcaatgtaacatgatctcagcaactggggagaccggaatcctgatcagcacgttacagcaagtattttagcatgtggaacattttgctcgcaggttattgaatacataaggttcttgcaagagaaggtccaaaagtacgagtcagcccaaccagaaaagaatcacgaggactcctccatgccatgggtactaacatagccacgttatcacgttcatcgcagtactggcaaacatccaccatggttgagcatgtcaacctctgatgcagacaacaaaacactgagcaagaacgagaaacaaactctccaagaggatactcaaagtctttctgatgcttactctcaagggtttgttccgaaactactgttgtttatgatggtaattttgctatatctgcaactaacaagagaaaacattatttacatcagacttctaaatagattgacacaagctctaaaaaggtcgggagtagacccatctcaagctagtatatctgtagagatcagtatggacagaagagcaacagaacctaataatatacatgacaatttgaaggtaataacagcacattaaagtatatcagcacgttaatgcttgcaaagttgctagacttatgtcatggcttattcacagaatcagccatttctttactacttctttttaaccttacctgacaggatcatgaatgtgaagatattatacatgtgaccaagaagcttcggggcgagagaagcaagatctccagctcaaactgaaattcaaactgtggcgacaagccgacaacagaccaggactttgtcgacgaaattgacaattgatggaatgctcttatttatattgaaatcacaattactgacctaagcctccattcaggtacaaaggaagctgctcaggggagggtagtcataaagctccccaattcagacattcctcctcatttgtaaatgcaattcagattgtaaaacagtgtacatgtactgctctctcaaaatttgtcaattcaacaaatatggtagtattgcaacgtttttgtatcaaccttccacagtacatgcattcaatcggcaactagacctatataaacagcaaggcaattgtaaattatactaagcttgtgatttgctgcaagcgccaacgaaccattgggatgttttctgcatatcatcagattccctttccatcaacatggtccgcaggaaacgaattgtagtcacatcacctggcgctccgctgcatctgcgacaatgggcagacgtggtgtcttcccgagcaggcaggcgccaccgccgtacaccaaggagacgagcaggaagaggaagaccgtgctctccatgctctggaagatctcgaacccaaccccaccggagggcgcgaacgactgcgcgagcaggtcgggaaagatgagcagcacgtcgagcacgacggcctgcatcgcgttgaagcggacgaagcgggagaacgcctgctggttccgcacaacggcgaagtagagcgtgaggaagaggaggaagggcgtgagcggcgatgagtggaagagccgagccgcgggggccagcgggcggagcagcgcgccgaagaaggggaactgcgtgagaaggaagcgcccgtggtgcgcgccgtcgaggaacgggtataggtaggcgaccgcggccacgaggcggtcgggcgcctccacggccccgctgttgtcgtttttgttggaggcgcgcggcgcgggggccaggagccgacgaggggtcgcgttgttgggggcggcgaggaggacccgccggtgcgggatgctgaggaggcgggatgtgccgtcgcggtggagcaggcgcgggggcgagaggagaagcgaaacggcggatgccatgtgatcctctgctcggtgcggtcgaggagtggagattttttgggtgagtggccttgtgggggccggcccgcccggcgggccccgcgacgcgtccggatgagggcaaggcagtggcgccgcgcggctgctgcggtgcagccccctccgcgcgggtgggagcctgggaggggagatttttgtggagctccgggggatgtgggtagccgagtgggagacgaggagattggttggtggtgcctgcttctgcctgcctgcctggtgcagtgcgagtgcgggccgtgctgctgcggcgtcgcgggggaggaaggacgggcgcgtgggcgacgcgcggtgagcctcacgtgggcctcgcgtgggccgccatgccggccggcatgcgctcgcgccttgcagcgtggcccgccatggtaaaaattgggattcatcgctttgtcatcgttttgagaggattcgtctgaaacatgtcatacacgttatgatatcattttatcgtttaataaatcgaaaaaggaaatatatatatatatatatatatatatatagggacattgagagtcaattttatagggagacgaacatcagcgatcaaagtgcatgcacaaacaacaatagaggcaaaatcatccctccatgtccctataaatatatttttttttctttttatttttttaaacaatcaaatgatattatagcatatgcggcatgtttcataatagcaaagtagtgaagtctctcaaaacgatttccactccgggagagctgacatgggcggaatcgaccgctcctacattgtcctcataaaaaaggacactgctgcatgtttggttcaccgctaattgtgtcatattttacctaagattagtcatctggatggaagaacta

SEQ ID NO: 20412 - DNA, 1550 bp, Zea mays
accaccaccacccttctctcctccgcatctccctttaccattgtctcccccctcgtccgtcctcctcgccgccgcagaccaccgccgccgccgccgctgccgctgcgaacccttgtgaatcttcgttgtccgggctgtggggggcaggcatggcgctccggaggctgctgcaggggagcgtcctgccgcggataatcggcagggatttggcaccggccgtggcgccgttttcaacggagtctggggagaccattcgtgccacgctctttcccggcgatggcatcgggccagagatcgctgagtctgtcaagcaggtattcaatgttgcaggggtaccaattgaatgggaagaacactatgtcagtacagaagttgatcccagaacagagagttttttgacttgggaaagcctggagtcagtgcgtagaaataaagttggcttgaaaggacctatggctacacctattggaaagggccatcgatctttgaatcttacattaaggaaagaacttgggctctatgccaatgtcagaccttgcaacagcctcccaggttacaagaccagatacgatgatgttaaccttgtaacaattcgtgaaaatactgaaggagaatatagtggtcttgagcatcaggttgtgagaggtgttgtggaaagtttgaaaattattacacgccaagcaagtttgagagtggcagagtatgctttccattatgccaaggccaatggccgggaaagagtctctgcgatccacaaagccaatattatgaggaagacagatggtcttttcctcaagtgttgccgtgaagtggctgaaaagtaccctgaaattcaatacgaggaggtcatcattgacaattgctgtatgacgcttgtgaagaatcctggtctttttgacgtattagtgatgccaaatctctatggtgacattattagtgatctatgtgctggtttgatcgggggcttgggcctaacacccagttgcaatattggtgaaggtggcattttctggcagaagctgttcatggttctgctcctgatattgctggcaagaacctcgcgaacccgactgctcttatgctgagtgctgtcatgttgttgcgccacatgcaattcaacgacaaagcagaccggatccacaacgccatcctccagaccatcgccgaggggaagtacaggactgctgatcttggtggaaaggcatcgacatcagagtttacaaacgcagtctgtgatcacatctgagaaacggatgtgattcttccttctgattgttttgtcatcctaatattttttgtcacatatgagaggagctttagctttaagaggttaactggcagcacctcgaacttctttggggtgtttaacacggtttgagaccgtcaaataattttgtcacatttcttgctgttcagaaattctttcaacattggaatggagccaagaattgtctgtaataatcaacatcagcattataacagtatgtagggtttatcttattcaaaaaaaaaaaaaaaaaaaaaagaaaaaaaaaaaaaaaaaagcggcc

SEQ ID NO: 20413 - DNA, 1606 bp, Zea mays
cactccatagggccattgggtccctcgaggccggccggcatctccctttaccattgtctcccccctcgtccgacctcctcgccgccgcagacgaccgccgccgccgctgccgctgccgctgcgaaccctttgtgaatcttcgttgtccgggctgtgtggggcaggcatggcgctccggaggctgctgcaggggagcgtcctgccgcggataatcggcagggatttggcaccggccgtggcgccgttttcaacggagtccggggagaccattcgtgccacgctctttcccggcgatggcatcgggccagagatcgctgagtctgtcaagcaggtattcaatgttgcaggggtaccaattgaatgggaagaacactatgtcggtacagaagttgatcccagaacagagagttttttgacttgggaaagcctggagtcagtgcgtagaaacaaagttggcttgaaaggacctatggctacacctattggaaagggccatcgatctttgaatcttacattaaggaaagaacttgggctctatgccaatgtcagaccttgcaacagcctcccaggttacaagaccagatacgatgatgttaaccttgtaacaattcgtgaaaatactgaaggagaatatagtggtcttgagcatcaggttgtgagaggtgttgtggaaagtttgaaaattattacacgccaagcaagtttgagagtggcagagtatgctttccattatgccaaggccaatggccgggaaagagtctctgcgatccacaaagccaatattatgaggaagacagatggtcttttcctcaagtgttgccgtgaagtgtctgaaaagtaccctgaaattcaatacgaggaggtcatcattgacaattgctgtatgacgcttgtgaagaatcctggtctttttgacgtattagtgatgccaaatctctatggtgacattattagtgatctatgtgctggtttgatcgggggcttgggcctaacacccagttgcaatattggtgaaggtggcatttgtctggcagaagctgttcatggttctgctcctgatattgctggcaagaacctcgcgaacccgactgctcttatgctgagtgctgtcatgttgttgcgccacatgcaattcaacgacaaagcagaccggatccacaacgccatcctccagaccatcgccgaggggaagtacaggactgctgatcttggtggaaaggcatcgacatcagagtttacaaacgcagtctgtgatcacatctgagaaacggatgtgattcttccttctgattgttttgtcatcctaatatttttttgtcacatatgagaggagctttagctttaagaggttaactggcagcacctcgaacttctttggggtgtttaacacggtttgagaccgtcaaataattttgtcacatttcttgcggttcagaaattctttcaacattggaatggagccaagaattgtctgtaataatcaacatcagcattataacagtatgtagggtttatctcattcacgttcttgaaataaaaagccaactggtcagaatgccagctgtgccatgttaatcctggttttctaaaaaaaaaaaaaaaaaaa

SEQ ID NO: 20414 - DNA, 1650 bp, Zea mays
aagcatcaccatcgacggggcgagggtacacggaacaccagccgtccgatccatatcgacggccaggtaaatcggaggaagcccggaagaagtctccttccagcaccacccttctctcctccgcatccccccggccggttcctccttgccgccgccgtcgctgtgccaagccttgcgaataaccgttgtccgggctgtggggggcagacatggcgctccggaggctgctgcaggggagtgtcctgccgcgggtaaccggcagggtttcggcaccggccgtggcgccgttttcaacggagtccggagagaccatccgtgccacgctctttccgggcgacggcatcgggccagagattgccgagtctgtcaagcaggtattcaatgttgcaggggtaccaattgaatgggaagaacactatgttggtacagaagttgatcccagaacagagagttttttgacttgggaaagcctggagtcagtgcgtagaaacaaagttggcttgaaaggtcctatggctacacctattggaaagggtcatcgatctttgaatcttacattaaggaaagaacttgggctctatgccaatgtcaggccttgcaacagcctcccaggctacaagaccagatacgatgatgttaaccttgtgacaattcgtgaaaatactgaaggagaatatagtggtcttgagcatcaggttgtgagaggtgttgtagaaagtttgaaaattattacccgccaagcaagtttgagagtggcagaatatgcttttcattatgccaaggccaatggccgggaaagggtctctgcgattcacaaggccaatattatgaggaagacagatggtcttttcctcaagtgttgccgtgaagtggctgagacgtaccctgaaattcaatacgaggaggtcatcattgacaattgttgtatgacgcttgtgaagaatcctggtctttttgatgtattagtgatgccaaacctctatggtgacatcattagcgatctatgtgctggtttgattgggggcttgggcctaacacccagttgcaatattggtgaaggtggcatttgtctagcagaagctgttcatggttctgctcctgatattgctggcaagaaccttgcgaacccgactgctcttatgctgagtgctgtcatgatgttgcgccacttgcaattcaacgacaaagcagaccggatccacaacgccatcctccagactattgctggggggaagtacaggactgctgatcttggtggaaaggcatcgacatccgagtttacaaatgcagtctgtgatcacatctgagaatcggatgtggttctttccttctgattgttctgtcttcctaatatctttttgtcgcatatggggaggagctttagctttaagaggttaactggcagcacctcgaacttctttgggtggttaacacggtttgagaccgtcaaatatttttgtcacatatcttgctgtccagaaattttttcaacttcagaatcgagtaaataattctgtaatcaaaaaaaaaacaacagcagtaggtagggtttatttcattgtcgttcttggggcggccgcctccccggtgggaataccagttgggacatgttaatcctggggttttcatttatgcatacaaagaatcaaa

SEQ ID NO: 20415 - DNA, 979 bp, Zea mays
cattgggtacctcccggcccttcccttctcctctcttccccgaaagagaggtcgcggacggaacccttccaccctcacctcatcccacaaccttcgattccttcacgatcttacctcgcgcgctcgccgattcctcgatcgagtcccgcgcgattcgctttctggtcggattctctcccccgaagcatgcagccggaccagcctgtgatcagcttgcgccccggcggcggcggcggcggcccgcgcgccggccgcctcttctcccccgccttcgccacctccgtctctggagacttcctccgcccgcacggcgggggcgcctccggcatctccaagatcggagattcacattttgagccacgtgagcgtgttcgatacacaagagatcaacttctcgagctgcgtgagattgttgatgtgtctgaggaaattttaagaatcaagcaagagattgatgtagagcttcatggtgaagaccagagctgggttcgcaatgattcaactgttcaaggacaagcacaagctcaaacacaagcacagaatcgctatgctgagactgatagccgtgattggcgtgcacggtctgcacagctgactccgactaatgaagaaaaatcttgggacaacataagggaggctaaagaagcctatgcctctagcggtaggcagcaagagcaagctaacaggcaagatcagttaagctcccagtttgcttcgaaagctcaggttggccctacccctgctcttattaaggctgaagtgccctggtcagcccgaagaggcaatctctcggagaaagaaagagtcttgaaaacggtgaaaggtatactgaacaaacttacaccagagaaattcgatcttttaaagggtcaactaatggaagctggaattactactgctgatatattgaaggatgttatatctctcatatttgagcaggcagtttctgagcccactttctgtccaatgtatgctcacg

SEQ ID NO: 20416 - DNA, 3161 bp, Zea mays
  misc_feature (232)..(235): n is a, c, g, or t
ccggccgggccgcgcgccccatccgctctcttccccgaaagagaggtcgcggacggaacccttccaccctcacctcatcccacaaccttcgattccttcacgatcttacctcgcgcgctcgccgattcctcgatcgagtcccgcgcgattcgctttctggtcggattctctcccccgaagcatgcagccggaccagcctgtgatcagcttgcgccccggcggcggcggcggnnnnccgcgcgccggccgcctcttctcccccgccttcgccacctccgtctctggagacttcctccgcccgcacggcgggggcgcctccggcatctcctagatcggagattcccattttgagccacgtgagcgtgttcgatacacaagagatcaacttctcgagctgcgtgagattgttgatgtgtctgaggaaattttaagaatcaagcaagagattgatgtagagcttcatggtgaagaccagagcgcgcgtcgctatgagtcaactgttcaaggacaagcacaagctcaacccctagcacagaatcgctatgctgagactgatagccgtgattggcgtgcacggtctgcacagccgactccgactaatgaagaaaaatcttgggacaacataagggaggctaaagaagcctatgcctctagtggtaggcagcaagagcaagctaacaggcaagatcagttaagctcccagtttgcttcgaaagctcaggttggccctacccctgctcttattaaggctgaagtgccctggtcagcccgaagaggcaatctctcggagaaagaaagagtcttgaaaacggtgaaaggtatactgaacaaacttacaccagagaaattcgatcttttaaagggtcaactaatggaagctggaattactactgctgatatattgaaggatgttatatctctcatatttgagaaggcagtttttgagcccactttctgtccaatgtatgctcaactttgttctgatctcaatgaaaagcttccgacattcccttctgaagagccaggtggcaaagagatcacattcaagcgtgtgatattgaacaattgtcaggaagcctttgaaggtgctagcaacttaagagctgagatttctaaattaactggccctgaccaagggatggaaagaagagacaaagaacggttggtcaaacttagaacacttggaaatattcggctaattggtgagctactcaagcaaaaaatggttcctgagaagatagttcatcacattgttatggagctattggggtctgggactgataaaaaaccatgccctgaagaggaagatgttgaggctatctgtcatttcttcaatacgattggtaaacagcttgacgagaacacaaagtctcggcggatcaatgacacatacttcatccagatgaaggagctaacaatgaatccccagcttgcaccacgtttgaggtttatggttcgtgatgtgattgatctccggtcaaataactgggtgcctcgacgtgaggagattaaggccaagacaatcagtgaaattcactctgaggcagaaaagaatcttggattacgtcctggagcagcatctgtcattaggaatggccgtagctcaccaggagggccactttcacctggagggggatttccaatgaatcggccaggaactggaggcatgatgcctgggatgcctggttcaagaaagatgcctggaatgcctggtttggacaatgataactggggaagttccccgttctaaatcaatgccaagaggtgactcgattcgcaaccagggattgttgcttaataaaccatcaacagttcacaagacatcatctattaacacgaggcttcttcctcaaggcagtggtgcggcactaataggcaagagtgcacttttgggaaccggtgtctcagcatctcgtcctctcagctttacgcctgggcccacaccagctcaaactacaccaaaaccaatacgtgcagcaccagctgttgtccctgctcctgataaacaggccagtgctcccaaggggaacactgctgagcttcagaagaaaacaatagctcttcttgaggagtatttcggcatacgtattttagatgaagcccatcaatgtatcgtggagctgcagagtcctgattactacccagaaattgttaaagaagctgtcaatcttgccctagataaaggcaccaattttgttgatcctcttgttaggctactggagcatttgtacacaaagaaaattttcaagactcaagacctggaatccggttgcttgttatatggtactctgctggatgacattggcattgaccttcctaaagctccagcacaatttggtgagatcattgctcgcctgactttgttgggtgccttgagatttgaagctctggaggttattttaaagaaaatggaggatacctacaaccgcaaagcagtttctaatgctttcatgaaaaccttggaagcaaacccatcaggtcaggctatcttaggctcacctgctgctgctgcagtaatagacgcttgcaacagccttttggaataatcttcctagcagctttggcctatcaaccttttcagattctgtatcttgcgaaagacggtctcgtgtactctctatagtttaggtgtcaaggaattgaggaacagacaattttgagctgtataattttgcgagatcagatgagtgttgattgttattgtttcggccaagaaggaaagaaagaagccatgaattttggtcttgggcgaccaacttaatttgcaggagtcctagatgaacaaggctaaatatgttgttactatgtccacctaaaatgttgttagttattttcctgtgactacacatttttgtaacgttgtactatgattttggaatgttttattgggtacaatatattgtgttatttaggagtcaaaactatctctaggtcctggtttaccctgttgctgccgtgatgttggctccctaattcctttgggcgacttagcgtatgttggctccaattcgtttgggctttgtatttccatgctgtttgactggatatttgatgggtctctttgtttgggtttgttccgcttcttgccgtcaaaagcttttgcggactacaaaatgtctcagcttatataagaatcgctttagtaaaacagtacaaaatca

SEQ ID NO: 20417 - DNA, 2929 bp, Zea mays
  misc_feature (2860)..(2865): n is a, c, g, or t
  misc_feature (2876)..(2876): n is a, c, g, or t
cattccggccgcgccccggccgcatatctacctcgaaagagaggtcgcagacggaacccttccaccctcccgacaccaccttcgattcctctgcgatttccccccgcgcgctcgccgattccttgatcgactcccgcgtgattcgctttctggtcggattctctctcctcaagcatgcagtcggatcagcctgtgatcagcttgcgccccggcggcggcggcggcccgcgcgccggccgcctcttctcccccgcctttgccacctccgtttccggagacttcctccgcctgcacgtcggtggcgcctccggcatctccaagatcggtgattcacattttgagccacgtgagcgtgttcgttacacaagagatcaacttctcgagctgcgtgagcttgttgatgtgtctgaggacattttaaggctcaagcaagagattgatatagagcttcatggtgaagatcagacctggattcacaatgattcagctgttcaaggacaagtccaaggtcaaacacaagcacagaatcggtatgctgagacggataatcgtgattggcgtgcacggtctgcacaaccgccttcggctaatgaagagaaatcttgggacaacatacgcgaggctaaagaagcctacacctctagtggtaggcaacaagagcaagctaacagacaagatcagttaagctcccagtttgcttcgaaagctcagtttggctctacccctgctcttatcaaggctgaagtgccctggtcagcccgaagaggcaatctctcggagaaagaaagagtgttgaaaacagtgaaaggtatactgaacaaacttacaccagagaaattcgatcttctgaagggtcaactaatggaagctggaattactacagctgatatcttgaaggatgttataaatctcatatttgagaaggcagtttttgagcccactttctgtcctatgtatgctcaactttgttccgatctcaatgaaaagctcccgacattccctcctgaagagccaggtggcaaagagatcacattcaagcgtgtactattgaacaattgtcaggaagcctttgaaggtgctagcagcttaagagctgagattgctaaattaactggccctgaccaagagatggagagaagggacaaagaacggttggtcaaacttagaacacttggaaatattcggctaattggtgagctactcaagcaaagaatggttcctgagaagatagttcatcacattgttatggagctattggggtctgggccagataaaaaaacatgccctgaagaggaagatgttgaggccatctgtcatttcttcaatacgattggtaaacagcttgatgaaaacccaaagtctcggcggatcaatgatacctactttatccagatgaaggagctaacaatgaatccccagcttgcaccacgtttgaggtttatggttcgtgatgtgattgatctccggtcaaataactgggtgcctcgacgagaggagattaaggccaagaaaatcagtgaaattcactccgaggcagaaaagaaccttggattacgacctggagcagcatctggcattaggaatggccgtagctcaccaggaggagcccttttgcctggaggggcatttccaatgaatcggccaggaactggaggcatgatgcctgggatgcctggttcaagaaagatgcctggaatgcctgggttggacaatgataactgggaagttgcccgttctaaatcgatgccaagaggggactcgattcgcaaccaggggccgttgcttaataagccatcaacagttcacaagacatcatctattaacacgaggcttcttcctcaaggcagtggcgcaggactaattggcaagagcgcacttttgggaactggtgccccaccatcacgtcctctcagctttgggcctgagcccacacctcaaattacaccatcaccaaaaccattaagtgcagcaccagctcttgcccctgctcctgataaaccagccagtgctcccaaggggaactctgctgagcttaagaagaaaacaatagctcttcttgaggagtatttcagcatacgtattttagatgaagcacagcaatgtatcgaggagttgcagaatcgtggttactacccagagattgttaaagaagctgtcaatcttgccctagataaagggaccaattttgttgatcctctcgttaggctactggagcatctgtacacaaagaaaattttcaagactcaagacctggaatccggttgcttgttatacggtgctctgttggatgacattgggattgaccttcctaaagctccaacgcaatttggtgagattattgctcgcctgactttgttaggtgccttgagatttgaagttatggaggagattttaaagaaaatggaggataccatgtaccgcaaagcagtttttgatgctgtcaagaaaaccttggaagcaaacccatcgggccagacaatcttaggctcacatgctgctgtaatagacgcttgcaacagccttttggaataatcctcttagcagctttggccaaccaactttttcagatgctgtctcttgcgaaagacagtgtcgtgtattctctgtagcttagatgtccaaggaacgcagtaccaaagatgcgaggaacagccagttttgggctgtataattttgcgagatcagatgagtgttaatttattattattattattattattgtttggaccaggatggaaagaaagaagccatggattttacccttgggcgaccagcttattttgctggaggccccagatgaacaaggctaaatatatgatgttttcgtgtccacttgaacagttgccagttcttttcctgnnnnnntcgactacacncccggtaacgttgtactatggttttggaccgttttgtctgttacagtatattt

SEQ ID NO: 20418 - DNA, 715 bp, Zea mays
gatcgcggcggcgacaagggggcgacgaggcaggcggagcgggcggcgactacagcggcagcagatctcacggaatggtgaactctccactgccttctcttgcgtagatccagggttctgcttgggagcccgctgtgctgacccaggggattcgtgtcgcaggcggcgaaggcaatctcgagccccgtgccggtggagtggtacccgacgctggccgtcgtcatggtatccgtaggcctcatgttcaccgcctccttcttcatttatgaagcaacttcatcccggaggagccgtagcctgtcaaaggagatcgcaacagcagttgttgcttctgttttcttgggctttgggtctctgttcgtgcttcttgcaagtggtgtttatgtctgatgactggctatgggccgtgtgtgcttgtgttctgcatcccgagttgtagacttggttatgacagatcctcaaagctgttgtcctaacgaatatagagcatttgaacttattctagaacgatgcatgggagcaaccgagttaaagcaacgtttccttccaggtctgcattatatatcatcaatctaaatccctgttccctatgtttctgcttattccaggtctgcttatttattactccctccgtttcgttttagttgtcgctgaatagtgtaaaattgaactatctaacgacaattaaaaagaaacggagtgagtatgtattccc

SEQ ID NO: 20419 - DNA, 738 bp, Zea mays
actcctatggccggccggggccgggattattcggatccgaagcccactaaaacttgcgatcgtcccggacggatccatttggctctggtcgtcacaaagttgtttgtgcatcgcggcggcgacaagggggcgacgaggcaggcggagcgggcggcgactacagcggcagcagatctcacggaatggcggcgaaggcaatctcgagccccgtgccggtggagtggtacccgacgctggccgtcgtcatggtatccgtaggcctcatgttcaccgcctccttcttcatttatgaagcaacttcatcccggaggagccgtagcctgtcaaaggagatcgcaacagcagttgttgcttctgttttcttgggctttgggtctctgttcgtgcttcttgcaagtggtgtttatgtctgatgactggctatgggccgtgtgtgcttgtgttctgcatcccgagttgtagacttggttatgacagatcctcaaagctgttgtcctaacgaatatagagcatttgaacttattctagaacgatgtatgggagcaaccgagttaaagcaacgtttccttccaggtctgcattatatatcatcaatctaaatccctgttccctaaaaaaaaaaaaaaaaaaggcccctagccccaataagccccccatttcgttttagttgtcgctgaataatgtaaaattgaactatctaacgacaattaaaaagaaacggagggagtatgtattacc

SEQ ID NO: 20420 - DNA, 775 bp, Zea mays
gaccctcgtggcggcgatcgtctctgacgtaccagtaccaatctggctccgctcgtcacaaatccgtctgtgcatcgcgtcggcgaccaggaggcgacgaggcaggcagagcgggcggcgactacagcggcagcagatctcacggcatggcggcgaaggcgatctcgagccccgtgccggtggagtggtatccgacgctggccgtcgtcatggtatccgtaggcctcatgttcaccgcctccttcttcatctatgaagctacttcatccaagcggagccgtagcctggcaaaggagatcacaacagcagctgttgcttctgttttactgggctttgggtctctgttcgtgctccttgcaagtggtgtttatgtttgacgactgcgtatggggccgtgttcttggattcagcagacttagggcatgtacaagtctgagactccatttttctatgagacagctaagagactatatgacataactttaagactcagtattataaatgcagttaatagacaacatgcgtagagtcgtaaagaggcgggctcttagcgaagagcttggctcttgtattttttttcatatagtcccttagagaactctcaagagaccatatattaaatagggttgtacatgcacttagtaattgattgtaggatatgccagatcctcgaagcttgtgttgtcctaacggatatggagcatttgaactttcaaactttctagaacaattacttaaacaaccaagttacagtaatactcaaacgtttctccct

SEQ ID NO: 20421 - DNA, 2021 bp, Zea mays
tttgctcttcggtgcttctgctgggatgcaaaccaatttttgttccataccataccaataccagacgggagaatacatcatcagaacgttcccggcccgccacttgacagcaaaaagaatcatccctccctctccctcacgaatgcctaattctgcaaagactgcatggttccattccaaggtgccttctacctctagtactaactactgcctacaacaggaggaggacgacgctgaagagcagcgcggtggagacgatgcggacgagtgacgagacgtcgccgaacgcccggtgcgcgccggagcctccctccgtggagttggacgacggcgccagggaggtgccgttcatcaacgacgtcccgttcttcccagcataaacacaagatccgtgactcgggtcggtcgtcgtgaccaccgcgacgccgctgaagtagcacgtcccggagcccattcccatgccgtggtagtaggcgttgaaggcgtacgtggcgtgcgcgtccacggtgtccgggtcgtagcacggctggccctgcatcagcacggagcagtccaccttcccggggccgcacgcccagtccagcgccgcctgcagcatcttggggtccgcgccctcccgcgccacgcagtaggtctggttcgtcgtgtcgttggccagcaggacgccggagcccgtcaggtgcagggtgtaggcagggacgccgttcatgtcgaacaggccccagtacttctccgacgtggagcccgggcgggtgtcctcgtcgtacagctcgtagacgtaggtcggcacggccaccccggggtgcttcggcgtgccggtgctgttcatcacgtggcggatgaggttgctgttgtacgtgtcggcgttgtcggaggtggcgtcgggctcggaggaggagtcgcccttgtgcggccacccggtctccgtcaccatcaccggcacgttggtgacgttcaggtacgccatggcgaagtaggcggcgtccaccaccgcgtcgaacacgttggtgtagtgcagcagggtgttggcgtccacggcctccttgttgggcggcggcggccggaacagcgcgtagtccagcgggatgacgccgttggaccgcatgtagtcgtagtaagggtacacgttgagcatgagcggcgaccccgtggactgcaggaacctgagcatcggcaccagcacgccgtccagcgaccggttgaagaaggcctgggacggcgggaacgagtcgaggatgatggacgacgagtgcggcgtcgagaccttgatgtaccggtccagcgccgcggccaccagcgcgttctggaggtagcgcatggcgggcatgagcagcggcgccgcgttcggctgcgccgagagcacctcggaccccacggcgatggccgtgatgttcacggcggggaagtgcgcggccacgttgcgcgccacccagttggccgccgtcgcgttcgagttgccgatggccagcagctgctcgttgggcacggacacgatgacgcggatgccggtgttggacagcgccgccagcatcgccgggtccgcgtcgtagaggcgcacgtggcggatgttctgcgaccggagcagcgtggtgatctgcgtcggcgctggcaccgacgacatggccgtgccaatgttcacgccaatgtacgcaccgtcttcaccgtgaactgctgcagcggacagcgagaggacgaaggagatgaacaacagcttcctcatgttcccgcaagagaagcccgccccggccgtggggaacttgcagcgcctcggttgggggttctccccccctgtccctctctcgacgggaaatacgagaagcgacttactacctttgctgcagcctctgatccagcattcggccgagcaggatgctaaaaccaacaggagcagggacaagaagtggaaggaagtgggaagaagagacgggaaggaaggaaggaagagcatccatgcactgcggtgcgaaggcaggcagagaggtgtaaggcaacttggggttcccggccgcccgcggggccca

SEQ ID NO: 20422 - DNA, 1944 bp, Zea mays
ttttttttttttttttcaacatcaaattttatacatatctattttaaaatattaaatttgttctaacagttccgattaccactttcatcgcacatgcacaacggagcaactgctgggatgcaaaccaatttttgttccataccataccaataccagacgggagaatagagcatcagaacattcccggcccgccacttgacagcaaaaagaatcatccctccctctcgaatgcctaactctgcaaagactgcatgattccagggtgccttctacctctagtactaactactgcctacaacaggaggaggaggacgctgaagagcagcgcggtggagacgatgcggacgagtgacgagacgccgccgaacgcccggtgcgcgccggagcctccctccgtggagttggacgacggcgccagggaggtgccgttcatcaacgacgtcccgttcttcccagcataaacacaagatccgtgactcgggtcggacgtcgtgaccaccgcgacgccgctgaagtagcacgtcccggagcccattcccatgccgtggtagtaggcgttgaaggcgtacgtggcgtgcgcgtccacggtgtccgggtcgtaacacggctggccctgcatcagcacggagcagtccaccttcccggggccgcacgcccagtccagcgccgcctgcagcatcttggggtccgcgccctcccgcgccacgcagtaggtctggttcgtcgtgtcgttggccagcaggacgccggagcccgtcaggtgcagggtgtaggcagggacgccgttcatgtcgaacaggccccagtacttctccgacgtggagcccgggcgggtgtcctcgtcgtacagctcgtagacgtaggtcggcacggccaccccggggtgcttcggcgtgccggtgctgttcatcacgtggcggatgaggttgctgttgtacgtgtcggcgttgtcggaggtggcgtcgggctcggaggaggagtcgcccttgtgcggccacccggtctccgtcaccatcaccggcacgttggtgacgttcaggtacgccatggcgaagtaggcggcgtccaccaccgcgtcgaacacgttggtgtagtgcagcagggtgttggcgtccacggcctccttgttgggcggcagcggccggaacagcgcgtagtccagcggaatgacgccgttggaccgcatgtagtcgtagtaagggtacacgttgagcatgagcggcgaccccgtggactgcaggaacctgagcatcggcaccagcacgccgtccagcgaccggttgaagaaggcctgggacggcgggaacgagtcgaggatgatggacgacgagtgcggcgtcgagaccttgatgtaccggtccagcgccgcggccaccagcgcgttctggaggtagcgcatggcgggcatgagcagcggcgcggcgttcggctgcgccgacagcagctgctcgttgggcacggacacgatgacgcggatgccggtgttggacagcgccgccagcatcgccgggtccgcgtcgtagaggcgcacgtggcggatgttctgcgaccggagcagcgtggtgatctgcgtcggcgctggcaccgacgacatggccgtgccaatgttcacgccaatgtacgcgccgtcttcaccgtgaactgctgcagcggacagcgagaggacgaaggagatgaacaacagcttcctcatgttcccgcaagagaagcccgccccggccgtggggaacttgcagcgcctcggttgggggttctccccccctgtccctctctcgacgggaaatacgagaagcgacttactacctttgctgcagcctctgatccagcattcggccgagcaggatgctaaaaccaacaggagcagggccaagaagtggaaggaagtgggaagaagagacgggaaggaaggaaggaagagcaatgcactgcggtggaaggcaggca

SEQ ID NO: 20423 - DNA, 1899 bp, Zea mays
  misc_feature (1877)..(1877): n is a, c, g, or t
  misc_feature (1893)..(1893): n is a, c, g, or t
gcgcccgcccaacgggcaatgtgagcagctgtgccgcatcagcgaacgactgttacttgtttaattgcagcggggtcggcccaggcaggagcccagaacaagacactgccaggtggtcccagtaaagactctgtcaaaccaaggagtcaaacgaaacactgcgctgcgctccgctgcgacctgcgagcagagacactcgaggactgcacgtctgcactgcactgcaagcgcgcagggcaatcaacgggcgatccgtgacgctaattacctaggagcagtcgttagcgccgagcccacctcatgatgagcaccgaatcaagccacgctccagcggcggtcaaaggagcgactgccagtgattactctcactgggagcagcacgggctgtcaagtcactgacgaactttgcacaacctctgagtgacagcccatcaatgtcattttgcctggcactgaggctagtggcaacacgcagaaaagatggagcactaataacggcagacatgtaaggcccaaaaaggctggtgctagttctaaaaatgtgcaaactcggctaggaggagtctgtggccaacaccttgtatctactcaagctaaaccgctaaagctttacgtgcgctaaaagccgatcagagattcatgctacgctggcgcaaacttctccaacggaaagctgggtgaaataggagagctgtgcagagggtgttggtgttgctgcgcgttcatgtttggccgtcggtacaccaaatgggcaagtgatctgccagtagtatagtatactgctggcagtattcctttccgtggctgcaagtactaagagacagtctgattattaatatgataatgacagtggatgttcctaccaacacgcataacgcccatatacaaactggagcacgtgacgggagcgacgggcgagaacggagcatggggaaacaaacacggagaaggaaggaatcctagggggagtgtccagtcaaatccaacccccaaaagttatctgtgccggtaaacaatactagctcgtagtatgttgttctagtatctgagcgaacccctttttaacattaccttagggtgtgtgtttgttgtattataaattaatttgtgctactctactgagaagacggctaatgatagaactaataagcagaccacaaaacgacaaagttaattcttgaccgctgctgtcaatcgctccggggatgctccatgattgcaacgagaaaacaagaagcaggcgtactaaaatctgagctgagaaccaacgcagcgagcacgaacgtggagatcgatcgatccatccatgcctacggaagcaagaagagtaagatgggtgcctcaggcattcacgcgtaaaaggccaaacacatccggaactgcataaaacggatcaaaacagagagcgcgaggaaccttaccgtcttcaccgtgaactgctgcagcggacagcgagaggacgaaggagatgaacaacagcttcctcatgttcccgcaagagaagcccgccccggccgtggggaacttgcagcgcctcggttgggggttctccccccctgtccctctctcgacgggaaatacgagaagcgacttactacctttgctgcagcctctgatccagcattcggccgagcaggatgctaaaaccaacaggagcagggacaagaagtggaaggaagtgggaagaagagacgggaaggaaggaaggaagagcaatgcactgcggtggaaggcaggcagagaggtgtgaaggcaacttggggttataaatatgagaatatataaaaggagggtcttttgtacaaaaccaaggcgggggccgagggcccagtaggaggaggaggagcccatcggtgggcagagctgcaggtcgactntgttggacccccagtnccgagc

SEQ ID NO: 20424 - DNA, 3201 bp, Zea mays
ggcagtgtaggtgagcaactgctgggatgcaaaccaatttttgttccataccataccaataccagacgggagaatagagcctcagaacattcccggcccgccacttgacagcaaaaagaattatccctccctctccctcacgaatgcctaattctgcaaagactgcatggttccattccaaggtgccttctacctctagtactaactactgcctacaacaggaggaggacgacgctgaagagcagcgcggtggagacgatgcggacgagtgacgagacgtcgccgaacgcccggtgcgcgccggagcctccctccgtggagttggacgacggcgccagggaggtgccgttcatcaacgacgtcccgttcttcccagcataaacacaagatccgtgacctgaagaaagaagcacccgagacagccagtcatgcttccaacaatacaagcgcagatggcgagtgtgagatgatggtaagcgtgagtgatcttactcgggtcggtcgtcgtgaccaccgcgacgccgctgaagtagcacgtcccggagcccattcccatgccgtggtagtaggcgttgaaggcgtacgtggcgtgcgcgtccacggtgtccgggtcgtagcacggctggccctgcatcagcacggagcagtccaccttcccggggccgcacgcccagtccagcgccgcctgcagcatcttggggtccgcgccctcccgcgccacgcagtaggtctggttcgtcgtgtcgttggccagcaggacgccggagcccgtcaggtgcagggtgtaggcagggacgccgttcatgtcgaacaggccccagtacttctccgacgtggagcccgggcgggtgtcctcgtcgtacagctcgtagacgtaggtcggcacggccaccccggggtgcttcggcgtgccggtgctgttcatcacgtggcggatgaggttgctgttgtacgtgtcggcgttgtcggaggtggcgtcgggctcggaggaggagtcgcccttgtgcggccacccggtctccgtcaccatcaccggcacgttggtgacgttcaggtacgccatggcgaagtaggcggcgtccaccaccgcgtcgaacacgttggtgtagtgcagcagggtgttggcgtccacggcctccttgttgggcggcagcggccggaacagcgcgtagtccagcgggatgacgccgttggagcgcatgtagtcgtagtaagggtacacgttgagcatgagcggcgaccccgtggactgcaggaacctgagcatcggcaccagcacgccgtccagcgaccggttgaagaaggcctgggacggcgggaacgagtcgaggatgatggacgacgagtgcggcgtcgagaccttgatgtaccggtccagcgccgcggccaccagcgcgttctggaggtagcgcatggcgggcatgagcagcggcgccgcgctcggctgcgccgagagcacctcggaccccacggcgatggccgtgatgttcacggcggggaagtgcgcggccacgttgcgcgccacccagttggccgccgtcgcgttcgagttgccgatggccagcagctgctcgttgggcacggacacgatgacgcggatgccggtgttggacagcgccgccagcatcgccgggtccgcgtcgtagagacgcacgtggcggatgttctgcgaccggagcagcgtggtgatctgcgtcggcgctggcaccgacgacatggccgtgccaatgttcacgccaatgtacgcacctgtacgcgatgacaacaacaacaaataaatgcagagaaccaaagtgtaagaaatctttctttcttgatgtaagttacgagtgatagaaatctaacgacggtaacaagagcatcacagttttcctggtaaaaaacgccaaaacttaacagtcagatgtttatatgatcttctgattaatgcgagacaggaaattgcgttgtaaggcagcaatcctcaatataaaaacgcattctttcgagcaaagctgtgtggaagaaaaaataaaataaatcgttcgtacagtctagagtaatgtaagaaaggacgaaatgcatgataccaccatgcgttttcgtagcgaaaacaaacaaacaaacaaaagggaaatcgagctagctgtaaaagcacaagacaggccaacttggtacggggaaagacgttggaaacaggagccccctcaccatgctgctgtcccgggcccggccatccacagaaaatcctgggcaatgtgcagtggccagtgaccacgttgattccggtgcgtcctgctgctgttgctgcagtagttgcacggccaacgggccaagcgagcagctgtgccgcgtcaccgaacgactgtgacttgtttaattgcagcggggtcggcccaggcaggagcccagaacaagacactgtcaggtggtcccagtaacgactctgtcaaaccaagcagtcaaacgacacactgcgctgcgctgcgagcacgagcagcgacactcgaggattgcagtgcagtgcactgcactgcaagcgcgcagggcaatcaacaggccatccgtgaagctaattacctaggagcagtcgttagcgccgagccaacctcatgatgagcaccgaatcaaaccacgctccagtggcggtcaaagccaaaggagcgactgccagtgattactctcactgggagcagagcagcacgggctgtcaagtcactgacgaactttgcacaatctctgagtgacagcccatcaatgtcatttgcctggcactgaggctagtggcaacacgcagaaaagatggagcactaacatcggcagacatgtagggcccagaaaaggctggtgctagttctaaaaacgtgcaaactcgtctcggaggcaaccctcctcaggcttggtttgggtactctagaaatgagacggattgaagtggattgagatgtattgggagagtttttgatctattggggatttaaacactcttcaatccctacaaaccacttcaatccaagagtacccaaactaggcctcaggctaaaccgctaaaaaagttttacgtacgctaaaagcgatcagagattcatgctacgctgtcgcaaactcctccaacggaaagctgggtgaaacaggagagctgtgcagagggtgtttggtgttgctgcccgttcaagtttggccattggtacaccaaatgcaaatgggcaagtgatctgccag

SEQ ID NO: 20425 - DNA, 2104 bp, Zea mays
ccgaccctagcgttgggtgttgtaacaatctctacctgaaaccccaagcatcctctttgctcagtcatcacgatcaacccagcaggcaggccggcgcgtgcgtttttttttttttgctgggaagcaaaccagtttccgttccatgccaatagagaaacccagcagatgacaagagcatcagaacagaagcacatccgcctccgttcgacagcaaaaaagaatcatccctgcttcacgacgaatgcctaactctgcaaagactgcattgattccagggtgcctagtaactacaacaggaggagggcgctgaagagcagcgcggcggagacgatgcggacgagtgacgagacgtcgccgaacgcccggtgcgcgccggagcctccctccgtggagttcgacgacggcgccagcgaggtgccgttcatcaacgacgtcccgttcttcccaccataaacacaagatccgtggctcgggtcggtcgtcgtgacgaccgcgacgccgctgaagtagcacgtcccggagcccattcccatgccgtggtagtaggcgttgaaggcgtacgtggcgtgcgcctccacggtgtccgggtcgtagcacggctggccctgcatcagcacggagcagtccaccttcccggggccgcacgcccagtccagcgccgcctgcaacatcttggggtccgcgccctcccgcgccacgcagtatgtctggttcgtcgtgtcgttggccagcagcacgccggagcccgtcaggtgcagggtgtaggccgggacgccgttcatgtcgaacaggccccagtacttctccgacgtggagccgggccgggtgtcctcgtcgtacagctcgtagatgtaggtcggcacggccaccctggggtgcttgggcgtgccggtgctgttcatcacgtgccggatgaggttgctgttgtacgtgtcggcgttgtcggaggtggcgtcgggctccgaggaagggtcgcccttgtgcggccacccggtctccgtcaccatcaccggcacgttggtgacattgaggtacgccatggcgaagtaggcggcgtccaccaccgcgtcgaacacgttggtgtagtgcagcagggtgttggcgtccacggcctccttgttggccggcagcggccggaacagcgcgtagtccagcgggatgacgccgttggagcgcatgtagtcgtagtaagggtacacgttgagcatgagcggcgaccccgtggactgcaggaacttgagcatcggcaccagcacgctgtccagcgacctgttgaagaaggcctgcgacggcgggaaggagtcgaggatgatggacgacgagtgcggcgtcgagatcttgatgtaccggtccagcgccgcggccaccagcgcgttctggaggtagcgcatggcgggcatgagcagcggcgccgcgttgggctgcgcggagagcacctcggagcccacggcgatggccgtgatgttgacggcggggaagtgcgcggccacgttgcgcgccacccagttggccgccgtcgcgttggagttgccgatggccagcagctgctcgttaggcacggacacgatgacgcggatgccggtgttggagagcgccgctagcatggcggggtcggcgtcgtagaggcggacgtggcggatgttctgcgagcggagcagcgtggtgatctgcgtcggcgccgggaccgacgacatggccgtgccaatgttcacgccaatgtacgcaccatcttcaccgtgaactactgcagcggccagcaggaggacgaggtagacgaagaagagcttcctcatgtttgccgccgcaagagaagcccggctcctcccgagaacttgcagcctccaatctgttgtagttctccccagtccctctaaccaccaacggggaagaagaaaagcacctaccgcctttactgcaacctccaatatgcctgatccagcattcttcgatcgagcaggatgccaacaccaagaggggctcggccaagaagtggaagggggaagaagagacgcgaagggaagggaggggagtggaggcaggcagtcagctggccggccgacttgggctctatacccccgccccgcccgcctcgagggtcccaatg

SEQ ID NO: 20426 - DNA, 2900 bp, Zea mays
aaccggtatctatgcttctgtgaatgtcccagttcgagttcctctgccaaacacatttgcatttgatatctttcaaacaacttcctttcctaacatttgcgcctatgaaaacaatggccaaggtaatactacttctcaaatatttgtcgcccactagttcattttgaactaaaacgcgacaaataaaaaaacagagggagtactagacaagacaattaaaacaagattatgtgtgtagtactctggttactatacaggaacaaagaacaaagaaagacgaagccaactagggtaggggaagtaggaagttcaacaagattaccgaaacacatctcctcaccagtgaggttgcaaagagcaactcttgtatagttcaaaacccaacatggcaacaccacaagtttcaacacacgaaatgcaacatgaattaaggaacattcagtatgaaaacaaacttgcagctaggtcgcagcatgaacgaaacaccaatggaggcttggaatgcatatatacaaaagtgagttagtgactggcctcaaaactggatttcacatgcacatctacggtagtagggtttgtcaaacagttgcagaatcaggtgtggcttcttaaaacagtagatctcttcacatcctaatatcctataacacttcatcaactataatgcaccagtagcaacacaaacaagcctactgccagcattgctcaagtggaaacattactaagcacaattaaaagcgccttctttgttttttttttttttttttaacaaaaaaacacagaatcagattcaatagttcttacacagaaacattgcagcagaaacgatcgaggggtgcttaaaaaaactatagcatgtctaagcatgaaagagaaaaaaaaacaaatgtgatagttttcgcattagccataagaagacatgtatcaataccagcggatcatgtcttccacgacacagataattaaccaaaaaagggaattttcttgcaaagggtaaaagaaccctctattcccttcaagcaagggtcgcttctgcactcttcccaccctcaccaccattagcagaagatacattgttggcctctgcctcagcaactgcatccatttcctctgcagtggcgtcaacttctccaagcgggcgaacctgctcctcctctggaagtggctcttcaacataatcattctcaaacgcatcagatggtacctcatagatcctcaactgtggctttgctggatctttgacaaacacatacttgccctcttcaaacttcatgcagatgtccacaattgacttgacgattccccacatgtttgcagtgttgaggttgatctgtgcagcaaaatcccttggcttgtatcccatcacagtgagcacagaatggttgtactgatcacgggggttcacccgtgacacatagcccaacttcatcatgtcagcaccagcaagcaaagcctgggcagtccagcgagcaagtttgttggcattgttcttgagctctgtagcaaggacagctccacgctgggtctcaagcttctgcctccagtcaacaccagtaatctttgaatcaaactcatttagggcattgacggtaataaactggcgagtaccactttgatcaacactgacagcatgcacctcacagcgagcaacaaggctgatctcatcattcaacttccaacggcggtagcggtagccaacagatgcagcctcttcaccctcagaagcaaatgggttgggctcgtcaaagttaaccttctcaccattgcggtgcagcacctgctgagagaagttctggttgatgtaggtggcctcaacagcgagcgagtgtgcggagttgatgtcatccttgttctcaggaagctgctcctgcgcagtctcattgacagtgagcaggtcgagctgggagccatcacgcttgtcaaggaacagcttgttgcccacacgctgcacgacaatgtcccacgacaggatgctgcggggcgtgcacatgagagcggcgaggatggcatcagtcgcgaacaccgtggctttgtcctcctcagcgaggcggcggatgacagggtcgtcggtggtggtgaccttgaagaagttgcgggacttgaagcgctcgagacggcgcgcggccttggggttgacacggtcataggcccgatcgtaggactcgacggcgccgcataagaggagatcctcgggctggtcggacacggagaaggagagcttggtgaagttggcgaaggggatctgctcgcgcatggtccagtcgggctggatgtcgacggagggcttggctgacgacgagggctggttgccccggaagccagggtggtgatgtgagcggttgttctggaagtggcgatcgcggcgtgcgcgctccttctcggccaagcggcggcgcgcctccacctcctcgtcttggcgctgtgggagctgctggcgctggttgaagcgccacttggggccgaaccgttgcggccgcggctgcggcttagcatcgacgaggcggaacgaggagtcctcggccccggcgacgagcgagtcgtccgcggaggtgaagtcgaatacggagtcccgtgacgccgcggcgaaggcggcgggaccggcgtggttgcgcgtccagtcggcgatgcggcccagcttgtcggagcgggagaagggcgcgaaggggatggaggcaccgccccccagagactgcggaatcgccgggacgtcaggaggaccccagccgtcggggttgaacgggacgacgcccacgtcgaagcccatggtttgcggcggcgatgctggattggatccggaggctagaggcggcggcgcggcggcggctggagtgggattacgagggaggaggggcttagggttgggtgaaaatcgaatttcttatatccgtgccccggccggc

SEQ ID NO: 20427 - DNA, 1250 bp, Zea mays
  misc_feature (723)..(759): n is a, c, g, or t
aacgaaatttgaactattttagacaatctatcctaacgtgcatggattgcgatggatacatgagcacgtaaacaagagccggataaggctaataatacattagatccctcagctcattaacatcaagctgagccttgtttgatccaggacaactttggtcaacaaccattttaaaccataaccaacagggtgcagggggggaggtagcctgacagagtgatagggtacaatgaagcagcgcatagtcttcgatccatcctccagcttccaagccagccagcgtcagttgaatcccagtttgagttccaggccgccgccgcttggtggggtcgaccctccaccttccccgccgttgttccaggcctgagaatgagcaagctgcggccaaatttgcaagaagttcttgtcgcacaacccgtagcgctcctcgtggcgtcctctgataatgttctggaggcagtcgatctcgccgccgatcttgcggtccttctcggagcgcaccctgtgcacggccgcctccaggctgtgctccagctgctccagcgacggcaccgtgtactgctccccgtcgtccaccgtcatgaaccgcagctccttctccatgagctcgcacatccgctccgccttctccagctccgcgcgccgctcctggcgaacgtcggcccagaccttgctgtgcgtcgcggcctcgtacctctcgaccaggtccttgacagtgggcannnnnnnnnnnnnnnnnnnnnnnnnnnnnnnnnnnnnggagaagagcagcagcagcaggtcgacgtcgcacaggacggcgagctcccttgccttcttgaagagcccgtccctgcgcttgtagaaggtggactgccgctgcgtcgggttctcgatccgctttatctcgctgcggcccctccccatgtcgtcgtcccggactcgcaaacgcgcggcgctgcagcagcccccgccgagctgctctttgcccgtcgttgcttgctttaaattggaggggctgctggggtgctgccgtgccaactgccaaggcaggatgagccgatgaggccggctgctcgactgctcgttgacgcagtaccgagacatgatagtctagtagtctagccgctccacgggctagcttctaggtaactttgtctttgtgtcagggggggtgcgttgcgtggccgccgccggttggttggttggtcgctcgctcgctcgtttcaactttcgcgaactgtacttttgaagactggaagtgatctgca

SEQ ID NO: 20428 - DNA, 879 bp, Zea mays
  misc_feature (523)..(523): n is a, c, g, or t
  misc_feature (773)..(773): n is a, c, g, or t
  misc_feature (797)..(797): n is a, c, g, or t
aaaacaatatacttccatcggagcagcaaaggtacttgatcccacctgaataatgggagtacattaacacatcaaactcgagacttgtttgatctaagggacaactgctgaccaacaacccaactcaaccaaaacctacagaagtacagtacccaaggaacagagcatagtcctcgagctttccagccagccagcgtcagttgagacccagtttgagttccaggccgctgcttggtggggtcgaccctccctcctccctcgttgttcgatgcctgagagtgcgcaagcttgttgcacaacccgtagcgctcctcgtggcgtcctctgataatgttctcgaggtagttgatctcgccgccgatcttgcggtccttctcggagcgcaccttgcgcacggccgcctccaggctgtgctccagcagctccagcgacggcaccgtgtactgctcccccgtcgtccacccgtcatgacccgcagctccttctccatcagctcgcacatctgctccgccttctccagctnccgcgcgccgctcctggcggatgtcggtccagaccttggtgtgcgtcgtggcctggtagagcttgccggaggtggagaagaggagcagcagcaggtccacgtcgcacagaacggagagctccctagccttcttgaagaggccgtccctgcgcttgtagaaggtggactgccgctgcgtggggttctcgatccgctttatctcgctgcggcccctccccatgtcgcccgccgctcccctcgtcccggactngcaaacgctgcctcactgagcttngcacggccgtgaacagctcgctggatgtaacagtggggagggaaggggaggggagccagcgacaccgtgcgagccaagctat

SEQ ID NO: 20429 - DNA, 1042 bp, Zea mays
  misc_feature (10)..(10): n is a, c, g, or t
ggagcacgtnaacaagagctggataacgctaataatacattagatccctcagcacattaacatcaagctgagccttgtttgatgcaggacaactttggtcaataaccattttaaaccataaccaacagggtgcaggggtaggtagcctgacagggcacaatgaaggagctcatagtcttcgatccatcctcgagcttccaagccagccagcgtcagttgaaacccagtttgagttccaggccgccgccgccgcttggtggggtcgaccctccaccttccccgccgttgttccaggcctgagaatgagcaagcttgtcgcacaacccgtagcgctcctcgtggcgtcctctgataatgttctggaggcagtcgatctcgccgccgatcttgcggtccttctcggagcgcaccctgtgcacggccgcctccaggctgtgctccagctgctccagcgacggcaccgtgtactgctccccgtcgtccaccgtcatgaaccgcagctccttctccatgagctcgcacatccgctccgccttctccagctccgcgcgccgctcctggcgaacgtcggcccagaccttgctgtgcgtcgcggcctcgtacctctcgaccaggtccttgacagtgggcacggtgggcgagaggtagtggtacagcttcccggagccggagaagagcagcagcagcaggtcgacgtcgcacaggacggcgagctcccttgccttcttgaagagcccgtccctgcgcttgtagaaggtggactgccgctgcgtcgggttctcgatccgctttatctcgctgcggcccctccccatgtcgtcgtcccggactcgcaaacgcgcggcgctgcagcagcccccgccgagctgctctttgcccgtcgttgcttgctttaaattggaggggctgctgcctgctggggtgctgccgtgccaactgcctgccgaggcaggatgaggccgggtgctcgactgctcgttgacgcagtaccgagacatgatagtctttttcgattaggatgttctaggtaatggtctcgtgc

SEQ ID NO: 20430 - DNA, 1045 bp, Zea mays
tttttttttttttttttttttttttttttttttttttaatttttcttttttttttttttttttcctgcggccaacaaaaacaatatactccaatcgaagcagcaaaggtacttgatcccacctgaataatggagtacattaacaccaccaatcgaagcagcaaaggacaactgctgacaacgaccactcaaccaaaacctacagagtacagtacccaaggaacagagcatagtccacgagctttccatccagcccagcccgtcagttgagacccagtttgagttccaggccgctgcttggtggggtcgacccacctcctccctcgttgttcgaggcctgagagtgcgcaagcttgttgcacaacccgtagcgctcctcgtggcgtcctctgataatgttctcgaggtagttgatctcgccgccgatcttgcggtccttctcggagcgcaccttgcgcacggccgcctccaggctgtgctccagcagctccagcgacggcaccgtgtactgctccccgtcgtccaccgtcatgacccgcagctccttctccatcagctcgcacatctgctccgccttctccagctccgcgcgccgctcctggcggatgtcggtccagaccttggtgtgcgtcgtggcctcgtacctctcgaccaggtccttgacggaggggacggtgggcgagaggtagtggtagagcttgccggaggtggagaagaggagcagcagcaggtccacgtcgcacagaacggagagctccctagccttcttgaagaggccgtccctgcgcttgtagaaggtggactgccgctgcgtggggttctcgatccgctttatctcgctgcggcccctccccatgtcgcccgccgctcccctcgtcccggactcgcaaacgctgcctcactgagctcggcacggccgtgaacagctcgctggatgtaacagtggggagggaaggggaggggagccagcgacaccgtgcgagcctagctagctatgcgttgcccattgcctgtttttgttgagcttccggcatgggggagaagat

SEQ ID NO: 20431 - DNA, 709 bp, Zea mays
tgcggttacgccccacctaaatcagggtcactgacgcaatggccactacaaaaaaaatccattgccttggattgatcaaagacaagtttctattcaaatatgtcattgcgcctacaaaaactttaatagttcggtcatgagatgctcaacaattaaaaagtactcgctgttgccacaattggttcctctgaatgacaccgatcacacctaaaccgaatgaggggaaagatgttcttgactttgagctgaactgatgctatggctgctaatagtcagtctcgccaaagcaggtgcccataacaacgaccccgccctctcctgaggccactcagattcagattttttgacaatatgtacttgtctgaggtaatagctctccaaccacttcactagcgatgacgcctcaggacctgttctttgggggtttcaccttgtatatgcgcactatccagtttgaagttgtaaatgcctcctccaagtattcaagctttatatctttgttgccaatctccactcctcgtacacggtcataccctggaggttttccatattctgtggtaagttctccaaatcggtagtaacaaagcttgtacattaggcagttcagcatttttggtgctgcccccttgtcaatacgatattccccgttaacaaggtaatctggctctttgattacagggaaaacccctccaccaatacgtaccatcca

SEQ ID NO: 20432 - DNA, 2686 bp, Zea mays
ggggttagtgccgaaaatttttttttttttggtttgatcaaagacaagtttctattcaaatatgtcattgcgcctacaaaaactttaatagttcggccatggatgctcaacaattaaaaattactcgctgttgccacaattggttcctcaccgattacacctaaaccgaatgaggggaaagatgttcttgacttcgagctgaactgatgctatggctgctaatagtcactctcgccaaagcaggtgcccataacaacgaccccgccctctcctgaggccactcagattcagattttttgacaatatgtacttgtctgaggtaatagctctccaaccacttcactagcgatgacgcctcaggacctgttctttgggggtttcaccttgtatatgcgcactatccagtttgaagttgtaaatgcctcttccaagtattcaagctttatatctttgttgccaatctccactcctcgtacacggtcataccctggaggttttccatattctgtggtaagttctccaaatcggtagtaacaaagcttgtacattaggcagttcagcatttttggtgctgcccccttgtcaatacgatactccccgttaacaaggtaatctggctctttgattacagggaaaacccctccaccaatacgtaccatccataagaacttgttgatatcatctgaagaatatccagtaacacctccaaatacaacaagcacatagttcacatcaagtgactgcatgatctcatatgcttcatcttcataagatgacatagcacgtccaacagtagctatgtgtgtgttattccatgtattattatcaacaatgacagttctgttacccatagctgtaatttggtatccatagtcccaccaagacataatcttagcatcaggaggagtgttctgacgaagccaatagtatgcctcacgataatcatcaaagataactcttccaccattatgaccccttgcggccaaaactatagatggagaagagtaagcctcagatgtcacccaagtgcagtgtatggcatacctactgagcaagtaaaaggcacccagaagaagaccaatagcagcattgtgttggaatggtaaagattgatcaactacacccttagcagctgactttgagccagttgttttcccagaagtagtctgtggacttctgctctttgtcctgatcaaagtggttaggttttttattgtagcagatgcagcaatagcactaataaggcaaacggctggtgctgccacaagaattaaccggaccatcacaccagcaaagtacatacttgtgaggccatacataacaataaatattgtggcatctgacaggcgcttgaaacagaaataaaggccagctgggaacagaaaaaggaggatgtggaagtcaaacatgaaagatgaccatgctgttggttgatgctcagaaacagatgcgatgattggtatatggtcctttgcataggtaggatctagcagggagtaaaatcgtcctgtccaaggagagatgtaaccagatgcagtgccaataccaagagccagggtgccaacagtaatcacacatgtaagggtaattcgaaggaatgacttaaacagtctggcatcgtttagcaggtattttacccagtccaagaagaagaaaacctgcaaaaggaagaagactcccatagcagccatgtgctctccggactgcacatgttggaatccaacaaaacggatctgcatcgcaagcaacatcccaagcacatacatgcaattgtaggccacgtagagcctttgtgagtacctcccggtaacaagcagcacaagcacatagagcgggacgagattgatgatgaacacgtagcctccccatgccgacaccatgtagaagtagccgaacgccgaggcaagcgcccaggcgagcgacccggtgttgacggcgcgcacgaagaggtagaaggtgagcagcagcgcgaagatggcgacgccctcgttatcgtaggaccccgcgacggagcgggagatgtagccagggacggtggcgatgagcgcggcggcgacgagccccgccccggagtcccagatctcgcggccaaaggcgtaggcgacgagagtggtgttggcggcgaagaaaggcgcggtgaggacgcagacctcgcggatgtggacagcgagggagagcgcgcggaggaggcggtggagcagcgcggcggtcaccatgagacccgggaagagagtccccccgacgacgcgcccgagcgggtaccagctctcggaatcgaaccagttccagaactcgctaaagccgttctcggtgaggaagagcgtggtgcggtaattgaagtaggggtcgaactcgtggatcatagactcgtagcggaggacggagaagaggcggacggcgaaggcgagaacgtagatgagcgccagcgccgagacgcggagcagtagctcctgctgcttcgtcttgagccgcagtgaccggagcggcgccgggagggaggccagagcggagggtgccatggcggcgccacgcagtgatccggacagggtcactactcactagggtttcatttcatgcgcgcgacgtctggggcagggggggtttagtgtggaattcgtttggtccggaccggccggccgcgggcgggcggggaagacgagtgcggcgagagcgagagcccggccgg

SEQ ID NO: 20433 - DNA, 2839 bp, Zea mays
aggaaaaatcccccttaaattttaatcctccaaaatccctgcactttttttttgttccaaaggggacctaaaaactgcactagcgcctacattgggtgatgtaaacacataacagcgaacagaatcaacagtcatattttgcgtttagtgccggatactttgtcttgccttgcgcattgatcaaagacaagtttctctactcaaatatgtcattgcgcctacaaaaacttccagagttaggtcaagaaatgcttaacaatcaaaaagtactcgctgttgtcacaattggttcttctgaatggcaccgaccacacctaaaccaaatgaggaccttcgacctgaactgatgctatggccactacagcaagtctcgccaacgcaggtgcccataataaccactctgccgtctcctctggacactcagatttttgacaataatttacttgcctgaggtaataccaactacctcaggacctgttctttgggggtttcaccttgtatatgcgcactatccagtttgaagttgtaaatgcctcctccaagtattcaagctttatgtctttgttgccaatctccactcctcgtacacgatcataccctggaggttttccatattctgtggtaagttctccaaatcggtagtaacaaagcttgtacattaggcagttcagcattttgggtgctgcccccttgtcaatacgatactccccattaacaaggtaatctggctctttgattacaggaaaaactcctccaccaatacgtaccatccataagaacttgttgatatcatctgaagaatatccagtaacacctccaaacacaacaagcacatagttcacatcaagtgactgcatgatctcatatgcttcatcttcataagatgacatagctcgtccaactgtagctatgtgtgtgttattccatgtattgttatcaacaataacagttctgttacccatagctgtaatttggtatccatagtcccaccaagacataatcttagcatcaggaggcgtgttctgacgaagccaatagtatgcctcacgataatcatcaaagatgactcttccaccattatgaccccttgccgccaaaactatagatggagaagagtaggcctcagatgtcacccaagtgcagtgtatggcatacctactgagcaagtaaaaggcacccagaagaagaccaatagctgcattgtgttggaatggtaaagctcgtgccgctgcccccctgccacctgcctttgaaccagttgtttttccagtagtctgtggacttttgctctttgtccggatcaaagtggttagattttttattgtagcagatgcagcaatcgcactaataaggcaaacggctggtgctgccacaagaattaaccggaccatcacaccagcaaagtacatacttgtgaggccatacataacaataaatatcgtggcatctgacaggcgcttgaaacagaaataaaggccagctgggaacaagaaaagtaggatgtggaagtcaaacatgaaagaggaccatgctgttggctgatgctcagaaacagatgcgatgattggtatatggtcctttgcgtaggtaggatcaagcagggagtaaaaccgtcctgtccaaggggagatgtaaccagatgcagtaccaagtccaagagccagggtgccaacagtaatcacacatgtgagggtaattcgaaggaatgacttgaatagtctgtcatcatttagcagatatttcacccagtccaagaagaagaaaacctgcaacaggaagaagactcccatagcagccatgtgctctccggactgcacatgctggaatccaacaaaacgaatctgcattgcaagcaacatcccaagcacatacatgcaattgtaggccacgtagagcctctgcgagtacctcccagtgacaagcaacacaagcacataaagcgggacgagattgatgatgaacacgtagcctccccatgccgacaccatatagaagtaaccgaacgccgaggcgagcgcccaggcgagcgacccagtgttaacggcgcgcacgaagaggtagaaggtgagcagcagcgcgaagatggcgacgccctcgttgtcgtaggaccccgcgacggagcgggagatgtagccagggacgatggcgatcagcgcagcggcgacgagccccgccccggagtcccatatctcgcggccgaaggcgtaggcgacgagcgtggtgttggcagcgaagaagggcgcggtgaggacgcagacctcacggatgtggacggtgaggtagagcgcgcggaggaggcggtggagcagcgcggcggtcaccatcagacccgggtagagcgtccccccgacaacgcgcccgagcgggtaccagctctcgaagtcgaaccagttccagaactcgctgaagccgttctcggtgaggaagagcgtggtgcggtagttgaagtaagggtcgaactcgtggatcatggactcgtagcggaggacggagaagaggcggacggcgaaggcgagcacgtagatgagcgccagcgccgagacgcggagcaggagctcctgctgcttcgtcttgagccgcagcgaccggagcggcgccgggagagagtccagcgcggggggcgccatggcggcgccgcgcagtgatccggacgccgagatctggacggggtcactagggtttcatgcgtgcgcgagctgggcagagggtagtgtggagttcgtttggtctggatctgagatcagcgggcggacggacgggcggggaagacgaatgcagcgagagcgagaccaagcggaggcgacggcaagtccgccgggttcagggtcgaggattctac

SEQ ID NO: 20434 - DNA, 1770 bp, Zea mays
ttttttttttttttttctttttttttttttttttttttttttttttttttttttttataaaaaaacagctttattgctcccgacctcccgtccacctcttacgctaacagaacaagaggatgcgacagggttaaatccaataatcgacgtcggaacgtctaagcccgttttcttacaaactttgtcaaagaaaaacgaaaaaaaatccatttgacctttattaagcacccaaatcttctacatgtacaagcagagggccttatacctgtgctatgatacatcttactaccagggcaagatcaggaaggaactttacaaagaagcaaacgaagtcgggattctaggagagcggctaccggagcccaagagcaaaatatttctgacggtttcctcgctaagcgaagggtgtcttcaaccacaccgtttatggtgcaggcatgctgagaaccatgtcagcatgtacatctgaagccgtgatcatctcggttggaccactctgtaatgaagaatcaaatcttctggctttttccatatatatgttcgcacagtagccaaactcatctctggtgatagaacctggttattgcacaatatctcaatacatggctttgttttttgccatggctttagtccaagccgcgaagaactatctagaactgagagctgtgattgagcagaactcaatcccataacaaacgcatcagagcctccatccaatggtttgtcaagaacgagtttctcaaccacatagttagctaccttgtgaattcgcaatatccgtggagcactaagcttcccttgagttatgtttggtgcaggcgagccttcagcagggtgtaaataaaacccgcattttgtattctccttgggatatcgattgagagtaatgcagtccacacaccaccatggaagatcaccctcagttccatccaaatcggtaattctctttctccatggccctccactagaaccttccgtgataattgatggaggtgaaactgtagaaaactcaaatgatggaagcacatgagttgcatggttttgagtggcatcgtcgacctcaggtcttgaccggggcgagtctttcgacggaacatctttccctattgaactatcaccattacacaagctgtgtgaactagatttctgctttcttttactccaatgaattagcaaaccacgaagagtctcttgagccaaattaatcttgagatcttcttgtgctccagcaacatttaggtcaaccgcatatatttctgcagaaaagcattgtggagtatccaggtggacagacaagcaccctaatcgagcatccatggtgaaccaagcaggtatgcttaccatctcaaacaactcctttttcttgtcttcgaaagaaaccttgccaaaatcttcaataacagcaccccgagtgatctcccacaatttgactgaaccagtggtatcctttgtcagtacatgtcttctattattcattatttcatgttgaactattgctggaacccctgggacgacaaaagatggctctttgtatacagggacaggtgctgatccttctaaagaagctcttgcccttgagaatgacaaattcccagctaagaatgagccacccttttggaaaaccttttggggtgtgagcccttcagctggccatccatatacagaagaatcagttgttgccacccatattgtgtcatcttgcagagacaactgtagaatagggcattcatttgtgcaaggtaaaacactctctcttgtggataagtctgt

SEQ ID NO: 20435 - DNA, 4809 bp, Zea mays
  misc_feature (34)..(34): n is a, c, g, or t
  misc_feature (3473)..(3473): n is a, c, g, or t
  misc_feature (4760)..(4760): n is a, c, g, or t
caccgccggtgtagggtagcgctcggcgtccgcntgtcacgatcgggcggcgtgcatctcccagggttacgatcgctggtcgcccgtcgcgccgggggtacgggttcatgagccgagggagccgaggcctttttctctgtgtgatggtgcgcgagttctggatcgtgcatagccccggttgggaggtcggtgcctgccgggactattatgtcacgggttttgtcccggggtcatatcgtcgtgggtggctcgcgaggcgcttaggcgtccctcctttggtgccggggggggggggagtggaccgcgctccccctgcgtgactgcgtcgtccgtcgcggggatggcgcgtggggcctgagccacggcggcggcggcggatgccctggggttgggctccggagggatgggccccactcctaagcggggaatcgctagctcgcagatcgaaagtcgaaggatgcggcggcggcgcaaggacgggtgacacctagtggcggcgcgtgcgacggcgccagcgtaggggggatatgttcggctggctgtccggtaggtcccgctggccggagcgtgcggagatcggggagggcaagcggtgtggtggtggagcaggcgaggagagaaaggaggaaggcgacaggtgggtgcggggattttaatgaccgggtcgccctcactcccaggtggcgccgcggggcccgggagcagaatctttcggcgcggcatggacccaccggtcagctacgtgaggtcgtcgcaaggctcgtgagtggacgggcattaatgagggggcgcgagcgcgatgatggccgcagctgtacacggacagggacaggtgggtggattagggcgggggcagggtcccgcgggcgcgggcccccctgtcagcgggagccaaagcccaagacctaccgctccggattcctggaaagctcatgtctctacccgctccgtgtcgtcacggtatccttcacccgaaagcgggctccgtaggatgacgctttcgctttccgggctcaggcccggtggcgggccctggagtgagagcggcggtgatggtcgatggtctacggtcagtatccgtccgtgggcccgtggccccagagacggcgggcgcgaccctacccactgaaacctcttcccataatattatctcgattcttgatgttttttaatctaaatctgtactatactgctctattaaaaatctaatatgagcatctggcactacaacggcttcaccctccgtgttgacactttagacatgctccacacgcccccgccttagtgttgttccccgtctaggtgtcgccccctcgcgcgcatctcgtggcaacgggtacatgtctagtaatctgttaagaacctaattttggtatctggtgctaccataacttcatcctcgacgttgacattctagacccgccccacgcccccacttgcccagcggtctctcagctactgccctattgacctagcgactccatagctagttattgcgcttgtatagcactcgaccccgccgcgctaccatcaggccacgcataacttagtgttgaaaaagaaacaataattatataaaaaaatatattacagggcaagcactcgaatccacgtctctctctctctctccataaatttgtggctaaccgtcaggccgcacgtatattagtgtttagaaataaacagtacttgtatttaaataaatatctcagtacatatttatatgatatataaaaacgtagcaaaacaaggacaaccggctagtatttaataaaaaaaaaactgcagcattatataacgactccttccaatcttttgatgatcttttgacgctttaaaaaacttgctcccaacacgctcaaaaagacttgcgcacgacttgaggtcagctgcgggcgacgacgatagcatggctatctctcgctctcgcccgtataatacggagcacgcgttcaagcgaaaagaagggtgagagagagacgagaagcgggcaacgcgctgacacgaacgagaggcgacgtgacggcttttgattggtccatcatgattgccgttgcaagaaaatttaaaaaaaaactaaaatcataaatgtcatcctcaatcccactataaatacccctacgagatggagcactatttcatactacaccatttcatctcaaaccacagcgcaaatatcgaaataagtgttggtaaattacttgattttaaaatagaaaagatgatgtcactactatagtctaaggttacaggggcgaaaggggaatggtgcattggaaccagcttgactgaatgtcctcagccaccggcggaaggacagaaggaacttgattatcgttggccgcgtgtagccacagcaggccgctagccgctcctgggctgcccctgcctggctacgccctaccgttgatcgtggccggctacttgccgtcctaggttggctggccggtcccggctagctggctggctggcccccggttcctgtgttctagccgattgctggctgggaagggcgcaccggagagtacccgtacggtgtcctcaataatcctacttatacgtacggtacctccaggtccaggacaccgcacgctgggcccacgcggctgcgaggcgacgacgcatgcaatggaaaaggaggtcctggtgtcgggactcgggactcgggaggcgccgcgccggtggagccgagatggatccggacgcgggcggtcggatggatccgccgcggtgatgatcgcgtccggttggtggcggccggcgctttaccggacaccgcctcggggccaggcacatgacgcgacacatgctccgggcacggccagcggggcgcgcgtggtgaggccgtgagagtgactgtgtgctctgcattccatttttccttcttccaggagccaggccacgggccggaatatgccagcccccagccggtactgtccgcgtgaccgagactgtttgacgctgcagcgcccggcacggcaggtccaagatccgctcgtttctgctgtctcttgcgggcgctgcaaacacagccgatcaggattcacggtgggtaacaaattgacgggcagagatagtcaattcattacttatactccagcagtaatttactacctatctcccaatttatattttttttgtcaagtttaactggctcgttttatttaacttttttcgaaaaaatgaaaaatttaaagctatactcaaagtatgttatagagttgaagatatcatagtaaaatttaacaacgatttataatttttttaaataagacaagccgattaaacttgagttaaaaattcacatgaattctaaattgaaacggaaagagtatttttgtatatctaattatatctatagaagaaaacacgaatattagtggttccagataagttgtatgatataaaacattcagcaactcccatggtccgtagttccgtacagtgtacgatcttgagtttactattatgangagaaagtacatataaaagaacagctttattgcaaatgttcacaagatctccgagtctacagcctttgtaattcgtcgcagctgaacagctctttttttttttttttttttatataaaaaaacagctttattgctcccgacatcccgtccacctcttacgctaacagaaccaagaggatgcgacagggttaaatccaataatcgacgtcggaacgtcacggtctgagccgagaaccagcccgttttcttacaaactttatcaaagaaaaacgaaaaaaatccatttgacctttattaagcacccaaatcttctacatgtacaagcagagggccttatacctgtgctatgatacatcttactaccagggcaagatcaggaaggaactttacaaagaagcaaacgaagtcgggattctaggagaaaggctaccggagcccaagagcaaaatatttctgacggtttcctcgctaagccaagggtgtcttcaaccacaccgtttatggtgcaggcatgctgagaaccatgtgatctgaagccgtgatcatctcggttggaccactctgtaatgaagaatcaaatcttctggctttttccatatatatgttcgcacagtagccaaactcatctctggtgatagaacctggttattgcacaatatctcaatacatggctttgttttttgccatggctttagtccaagccgcgaagaactatctagaactgagagctgtgattgagcagaactcaatcccataacaaacgcatcagagcctccatccaatggtttgtcaagaacgagtttctcaaccacatagttagctaccttgtgaattcgcaatatccgtggagcactaagcttcccttgagttatgtttggtgcaggcgagccttcagcagggtgtaaataaaacccgcattttgtattctcctttggatatcgattgagagtaatgcagtccacacaccaccatggaagatcaccctcagttacatccaaatcggtaattctctttctccatggccctccactagaaccttccgtgataattgatggaggtgaaactgtagaaaactcaaatgatggaagcacatgagttgcatggttttgagtggcatcgtcgacctcaggtcttgaccggggcgagtctttcgacggaacatctttccctattgaactatcaccattacacaagctgtgtgaactagatttctgctttcttttactccaatgaattagcaaaccacgaagagtctcttgagccaaattaatcttgagatcttcttgngctccagcaacatttaggtcaaccgcatatatttctgcagaaaagcatt

SEQ ID NO: 20436 - DNA, 1993 bp, Zea mays
tttttgttttttgtgctataatatgaaaatatatttaatggaggatctaatagtatacatttgatattgtaaatgttattacttcattgtataaatttgatcaaacttggaaacactttgactctctaaaaatcttgtaatgacttatattttggaacggatagagtataaccaaataagaactagcactgctgcttcatcttatattttgtgaatcctcgaatatatgatctgaggacagcaccaggaagtgataagaaacaataaaacttcccaggtccccttttacaaagagtgcagaaatcatgacaaggggagtgaattaagcagcgtcagtgaagagtgaataaagcacctaaaacccaatcattctctccattctaccattctatacaaaggtttggacaaggactatagctacataatgagcagaatgcttaaatacacaagaaattatcatgcatttcataagcacgctaactctcagctttgccctaattgcctctcatggaacatttccccaagttgttcatataggtatttttgctcctcataggtcaggtttcttagaatctgatccaagattatctcaacagagaagttctgaggtgcaatgaatgactggtggtatatgtatgcaaacactgccataaccatttggcaatccattctatcagtaattccaccatgcccaggtatgctgtcaccaaaatcctttattttgaaagccctcttgaagccactcgcaaaaaatcctccgaatggtgctattattgacgcaaataaacctagggctaaagcatgccactgcacaggcataatggctagatctttccatgggaaccaatgtggcaccgactctcccaatgagtaatgctctggcttaaacattggaccaggatcacaataaagccacccagttgacagatcctttcttgggcatgtcaaccattggaaacggcccattacatttgctaacagaaatgcagagatgatagttgtcacggatgcaccaataaaaccttcccatgttttctttggggacaacttgattaatggtgttctcccaagaaagaacccaaataaataagcaaatatatcgttgatcacaataagtgaagcaggcaaaagaaaccagaatatcccttcaaatatgtttgccacagtgaaagcagactgtgcaaaaaccgttagaagtatcatgtgcgtccaggcatactgtttgaactggtacttgtatgtctttttcttgagagtcaaaataaaccatacaaaacctgcaatataaagaaaataacagataaacatctgatactttattaggccactaacgaccttataaagcaagtgatctgaagttactgtattcacaagctgccgactaagaaagcgcccataagtgtacagcattgccgtgaaaaagaagtgccaattcagtagcctgaacccaggaagttgtttctcttcactggattttctgagtaggttgaaaagttctcttgccatgtatatttgaatcacaaccaccatagcccagatatatagatgacccacataaataataaaggcaaagcctccaatcatccatactgtagaatatgtacggataagcattgatttatacttgttctgatcattgacaagcaacggttgtccattagctctattcccatctgtggaagcctcagatggatgtttgcgacgtcttacacgccctacatgagaagcagaaacatcgctagagctagtgtccctttgcatcactggtactccaaagttactcgaggtcccggagaaggggagggtggctccggaggggggaccgggagaatatgcagcagcaccgccgccttgccggcgatgggggcggcgcgcgcggagcaggtcctgtggagagagcgctgcgagcagggtgctgcgggaagggcgcagaggggagagaagcctgcgagagagttgtgccgctcggcccacgcgtccgcggacgcgtggg

SEQ ID NO: 20437 - DNA, 1949 bp, Zea mays
tttttttttttttttttttttttttttttattttttttggtaaaacatcggggatatattgtgaatcctcgaatatttgatctgagcccagcaccacgaagtggaaagaataaaactttccaggttcccttttacacagactgcagaaacgatgacagggggagtgaattataggcagcgtcagtggagactagagagtgaataaagcacctacaacccattcattctctccattctaccattctatacaatggtttgggcaagggctccgtatacattcataacatgctggcatgctgccatacatgaactaaatgcacaacatatcatgcatttcataagcacgctaactctcagctttcagccaatgagccaattgcctctcacggaacatttccccaagttgttcatatacatatttttgctcctcataggttaggtttcttataatctgatccaagattatctcaacagagaagttctgaggtgcaatgaatgattggtggtatatgtatgcaaacactgccataaccatttgacaatccattctgtcagtaattccaccatgcccaggtatgctgtcaccaaaatccttaattttaaaagccctcttgaagccactcgcaaaaaatcctccaaatggtgctattattgatgcaaataaacctagggctaaagcatgcccctgcacaggcataatagctagttctttccatgggaaccaatgcggcacccactctcccaatgagtaatgctctggcttaaacattggaccaggatcacaataaagccacccagtcaacagatcctttcttgggcatgtcaaccattgcgaatggcccattacatttgctaacagaaacgcagagatgatagttgtcactgatgcaccaataaaaccttcccaagttttctttggagacaacttgattaatggtgttctcccaagaaagaacccaaataaataagcaaaaatatcgttgatcacaataagtgaagcaggcaaaagaaaccagaatatcccttcaaatatgtttgccacagtgaaagcagactgtgcaaaaactgttaaaagtatcatgtgtgtccaggcatactgtttgaactgatacttgtatgtctttttcttgagagtcaaaataaaccatacaaaccctgcaatataaaggaaatagcagataaacatctgatacttaattaggccactgacgaccttataaagcaagtgatctgaagtcactgtattcaccagctgacgactaagaaagcgcccataagtgtacagcattgccgtgaaaaagaagtgccaattcaggaccctgaaccctggcagttgtttctcttcactggattttctgagtaaattgaaaagttctcttgccatgtatatttgaatcacaaccaccatagcccagatatatagatgacccatataaataataaaggcaaagcctccaatcatccatactgtagaatacgtacgggtaagcattgatttatatttgttctgatcattgacaagcaatggctgtccattagctctattcccatctgtggtagcctcagttggatgtttgcgacgtcttacacgtcctacatgagaagcagaaacatcgctagagcttgtgtccctttgcatcactggtactcaaaaagttactcgaggtcgcggagcaggagagggtggccggttcagagttggaaccaggggagtacgcagcagcacagccgcctcgccggcgacgggggcgacgtgcgtggagcgggattctgtggagaaaccgcgggtccgcggcctgcaccgtgctgcttcgggaagggcggagatgggagagaagcctgcgcgagagttgtgggcttgtggcgctccgtttcccagctgctccttcccggcccgcgccgagcggtacccgttcctttaacccctcttttggcacagaatccaaaat

SEQ ID NO: 20438 - DNA, 1837 bp, Zea mays
ctcgaggccggccccgccgtcctccaaacgggacctgccacgtcacgtggcaacgcgtcataggtgtgagtgtgagtgtgtgacactgacatctgagaccagctctcctgcttcgcggctgtctctttcatcggccacccacggcggcggagcatagcagtaagcaagcagcggagacgccggagagcggtgaagaagcatggagatggagcagctctgctcgctgctccgcgacctcgacgcgctcaagcagcatcccgacgatctcacttccaccatcgatcggatgcgggagcggctagtggcgatgatgaatccggcagccggtgccgcttctcgatccaagattaaggacatgagtgcagaagtggtggacaacaatccctacagcagacttatggcgttgcaacggatgggcgtagtggagaattatgagcgcatcagggactactccgttgccatcgttggcataggtggcgttggtagtgttgccgcggagatgctcactagatgtggaattggacggctgttgttgtatgactacgacacggtcgagttggctaacatgaataggttgttctttcgcccagaacaggttggaatgaccaaaacagatgccgctgtacagacactttctggaataaatcctgatgttgtgttggagagctactcattgaatattactacagtcaaaggtttcgaaacatttttggcaagtttaaaagcacaaagttctcatgagcgtagcactggagttgatcttgtcttgagttgtgtcgataactatgaagctcgtatggttgtaaatcaggcatgcaatgagcttggtcagacgtggatggagtctggtgtctcagaagatgctgtttctggtcatatacaactgctggttcctggtgaaactgcatgttttgcatgtgctcctccattggttgtagcatctggagtggatgagcgtacacttaagagagaaggtgtttgtgctgcctctttgccaactacaatgggtgttgttgcgggtctcctggtccagaatgctctgaaatatttgttgaactttggacaagtttccccttacttgggatataactcacttaaggattatttccctgcaatggaaatgaggccaaatccacaatgctcgaatccagcatgtgttcacagacagaaagaatatatggaatccaaacctgctagagatgcagcagcgaagactaagatggaagctgaagcatccacagaaaatgaatgtcctgtccacctagacaatgagtggaatattagtgttgttgatgatgaagaaactgagacatcaagcattcgaaacactccagatatcctaccagaaggtcttgtccgtgagcttccagacgctgattcatacgcaggaccagctgctccagtgagttccagcgctattgatgatgatgatgatctcgaggagctccagcgtcaacttgatgccctaaacgcatcttagccttaataagtaggctagttcatctgcgccttaattggcttctccccaatcccaacttggatggggaagatgatttacatactgtttttcggagttggtaaattcatagcaccgtggtaaaagaaaaaggagaaaatgatagctatactggttttgggagttttgacttacagttttggttgagatctgagaacatgtgcatgtctgagccagacagctcgtcggtaatggtactaatgtctgaatttttgttgctgttgatattcaaaggttttatctggaaccgtcatttcttattgagaggttccactaaaaaaaaaaaaaaaaaaaaaactgcgggggggggcccggtaccca

SEQ ID NO: 20439 - DNA, 1690 bp, Zea mays
atggagatggagcagctctgctcgctgctccgcgacctcgacgcgctcaagcagcatcccgacgatctcacttccaccatcgatcgggtatccccccacccgggtgcaccatggatctcggcagttttatagcaatctccccttctcccgtgcctttccaaatcttgatcccggctcatctgattgctagatgcgggagcggctagtggcgatgatgaatccggcagccggtgccgcttctcgatccaagattaaggacatgagtgcagaagtggtggacaacaatccctacagcagacttatggcgttgcaacggatgggcgtagtggagaattatgagcgcatcagggactactccgttgccatcgttggcataggtggcgttggtagtgttgccgcggagatgctcactagatgtggaattggacggctgttgttgtatgactacgacacggtcgagttggctaacatgaataggttgttctttcgcccagaacaggttggaatgaccaaaacagatgccgctgtacagacactttctggaataaatcctgatgttgtgttggagagctactcattgaatattactacagtcaaaggtttcgaaacatttttggcaagtttaaaagcacaaagttctcatgagcgtagcactggagttgatcttgtcttgagttgtgtcgataactatgaagctcgtatggttgtaaatcaggcatgcaatgagcttggtcaaacgtggatggagtctggtgtctcagaagatgctgtttctggtcatatacaactgctggttcctggtgaaactgcatgttttgcatgtgctcctccattggttgtagcatctggagtggatgagcgtacacttaagagagaaggtgtttgtgctgcctctttgccaactacaatgggtgttgtcgcgggtctcctggtccagaatgctctgaaatatttgttgaactttggacaagtttccccttacttgggatataactcacttaaggattatttccctgctatggaaatgaggccaaatccacaatgcttgaatccagcatgtgttcacagacagaaagaatatatggaatccaaacctgctagagatgcagcagcgaagactaagatggaagctgaagcatccacagaaaatgaatgtcctgtccacctagacaatgagtggaatattagtgttcttgatgatgaagaaactgagacatcaagcattcgaaacactccagatatcctaccggaaggtcttgtccgtgagcttccagacgctgattcatacgcaggaccagctgctccagtgagttccagcgctattgatgatgatgatgatctcgaggagctccagcgtcaacttgatgccctaaacgcatcttagccttaataagtaggctagttcatctgcgccttaattggcttctccccaatcccaacttggatggggaagatgatttacatactgtttttcggagttggtaaattcatagcaccgtggtaaaagaaaaaggagaaaatgatagctatactggttttgggagttttgacttacagttttggttgagatctgagaacatgtgcatgtctgagccagacagctcgtcggtaatggtactaatgtctgaatttttgttgctgttgatattcaaaggttttatctggaaaaaaaaaaaaaaaatgaataact

SEQ ID NO: 20440 - DNA, 1261 bp, Zea mays
ttgggtacctcgaggccggccgggtcaaacgaagaaaggcttatggtggatacctaggcacccagagacgaggaagggcgtagtaagcgacgaaatgcttcggggagttggagaccagcgctcctccggcccgggggtctctttcatcggccacccacggcggcggagcatagcactgatagcagtaagcaagcagcggagacgccggagagcggtgaagaagcatggagatggagcagctctgctcgctgctccgcgacctcgacgcgctcaagcagcatcccgacgacctcacttccaccatcgatcggatgcgggagcggctagtggcgatgatgaatccggcagccggtgccgcttctcgatccaagattaaggacatgagtgcagaagtggtggacaacaatccctacagcagacttatggcgttgcaacggatgggcgtagtggagaattatgagcgcatcagggactactccgttgccatcgttggcataggtggcgttggtagtgttgctgcggagatgctcactagatgtggaattggacgactgttgttgtatgattacgacacggtcgagttggctaacatgaataggttgttctttcgcccagaacaggttggaatgaccaaaacagatgccgctgtacagacactttctggaataaatcctgatgttgtgttggagagctactcattgaatattactacagtcaaaggtttcgaaacatttttggcaagtttaaaagcacaaagttctcatgagcgtagcactggagttaatcttgtcttgagttgcgtcgataactatgaagctcgtatggttgtaaatcaggcatgcaatgagcttggtcagacgtggatggagtctggtgtctcagaagatgctgtttctggtcatatacaactgctgggtcctggtgaaactgcatgttttgcatgtgctcctccattgggtgtagcatctggagtggatgagcgtactcacccttgctttaaaaccccccaaccctaggtttgccccattgcaatcagtgcttaggaagggatgaagtcaacatggaggactttgaagagtttcaggactactatgagttctagtcgtgtttagtggcaaacccccagttagctgcctgtgaaggccttatcctctacgtttcgtattccgcactttgattatgtcgatgactatgttaagttaatgactctgtggatgtcttggacatcttgatgtaataaagtacctgcccgggcggccgc

SEQ ID NO: 20441 - DNA, 587 bp, Zea mays
atcgaaaacttttccctaccctaagccctttctagggtcgctgtgtgggtacgaccaccgtagtcgtgggtgtgtcgcccgccaccgtcggaccacggattcaccgccgtagaagcctagggatcggtccgggaggcttcgtcgcatcgccggcgcgctctcgtgtgcgcggcgggggaagtcgaccaccccaccgacggcaatttctcgtcggaattgtgttggatcatgggattgcgcccgcacgtctctggctccgcccacacacctcagcaccgtgcggtcacgaggatctgaagaatcactctggtacctggaatctcaagtgtcaggttgtccccactgcaatcagtgctcaggaggagatggaggcaacatggaggactttgaggagttccaggaccatgacgagttctagttacattagtggcaaacccccagtcagatgcctatgaaggccatatatgctatgttcgcttttctgcactttgataatgttaatgactatgttaagtaatgactctgtggatgtcttggacatcttgatgtaataaagtacctttacgccaaaaaaaaaaaaaaaaagc

SEQ ID NO: 20442 - DNA, 2162 bp, Zea mays
acccatcccccgtgcggtcgcatcgcatcccccaccccacccaccatctcgcctcctctcccgcacgaatctgccaaagccacgggccgacagacaggggtcgtggcgggagagagagagagagatcgccctctcgctccgcgctcactcgctcgtccgccggcgatgctgaggaccaagaccccgcggccgcgcggcggcaaggcgcgccgcgccgcgcccggggccgcctcggcggtcaagcccgccaaggccgacgggaggtcgccgtcgggagagctctcgctgcagctggagcacgtctccctcacctccttgctctccgaccgccgccccgcatccgggctcacgcgcttcgaggtgctcctagaggaagaggagtcgggctgctaccgcgccgacccgaccccgcagccgccgcgacttcctgagccacaatctatgcccccgccggcgccggcgacgacgacgacgacgatctcgcaggcatcgccggtggacgcagacgagaccatggaggagaaggcttgcggcacccccagcccggccttcttctgcaccccggactacatcacgccggagatgccgcaggtggccaacgagttcgacgacgacgataaggagaacatcccctgcccaaaatctccggagaagtcagcgaaccctcgtagcaagcggtacagaaccgattgttctcccaaagctcgggaggttacggacttctctttcgaccatcagattacgccggttctgtttgacagcctgactcgagatgattcggaagaagagcagccgaagcagcctgcgctggaaaagaggggtggttatgtctcccagtcagcagtggctctgcgttgccgggtgatgcctccgccatgcgtcaagaatccatacctcaataccgatccatgcatagatgctgctgtttacggtgggaggcagtgcaactcagcagtattctctccttcaattggtggtaatggtctttcacgctatcgaactgatttccatgaaatagagaaaattggttatggcaacttcagtgttgtgttcaaagttctgaataggatagacgggtgcttgtatgctgttaaacggagcatcaagcaattgcataatgatatggaaaggaggcaagcagtgaaagaagtccaagctatggcagccttaggttctcacgagaacatagttcgatatttcacctcttggtttgagaatgagcaactttatattcagatggaactctgcgaccgctgtctatctatgaatcggaaccagccagtgaagcgtggggaagccctggaactgttgtatcagatctgcaaaggcttggatttcatgcacgaacgtggcatagcacaccttgatgtgaagcctgataacatatatgtcagaaatggtatttataagctcggggattttggctgtgctacacttgttaaccggagtctagcaattgaagatggagattcacgctatatgcctccggaaatgctgaatgataagtatgagcatcttgacaaggttgatatcttttctcttggggcagccgtctatgagctaataagaggcaccccgcttcctgagtctggatctcactttacaagcattagagagggtaagatcgcattgcttccagggtgcccgatgcagtttcaaagtttaatcaagtctatgatggaccctgatccggtgaggcggccttcagcaaaggagatcctgagacacccttcgtttgacaagctccacaaggcctcatcgaagtagaagtgctgccgcgcccccatcagatcagagcagccggcaaagggaattccgcagctgcgtcacattcaccatcagctgctcccaatttttgtgtatctatctatctatatgcgtgtgccatgtgccctgttctgatactgtagaagatggttggaaacgaagcagggatctgattttaactccaggaactggagcacgagcagcgtctgtaaaggactaaaaggctgtggctgctgttgtgttaaggttgtgcctctcttttggtttctgatgcacgcttggaaccatcaaccctgtgcctttttttggggtgcttgttatcagttgcatttgggcagcgaatgctaatttggatccaaactctccagttaaaaaaaaaaaaaaaaaaaaaaaat

SEQ ID NO: 20443 - DNA, 2685 bp, Zea mays
  misc_feature (7)..(7): n is a, c, g, or t
ggggggntttttttttttttttttttacggcccccccctcgtgtttgtggcgtttttttggtgcagagcaaatttgttctcataataatgctttaagtctagaactatgccaagcaaacaaaccctctataaatgggtctgacatggcatacagattatgaacatagaggcaagttgtgagcagcaactagtgctgataacacggagcactcacggttgtcatacaaagtgctctaacagctacaactaggatacaaatctggccagatcctcaatcaaatcccgtcttcacgataccgaaccatcaaaccgacactgtccacactacgcaacacagcctccaggacagttttccaatacatcagatcatcatatccactgttgaaacgtcaatcaccctagcaacaacaggcctctgctcatgaacggtggcacagctgttgcccagcgatttcggcacttgttgcttcaaagacaggaagggggatggatagttggtgttgatgtcaccacagcccttttctttcattgctggaaccttctcggtcaaagatatgccaaatattttgcaactgtttttgctaacttccctgttgtctgaagcagcggcaacagcgggatgagatttctcaacggtcacatctctgtttcccgttcctccagaaacatgatgagcctggagcatcgtcgtttgctcagttcctccgatgcctccagcatggacaaacattgcgcgtctatcctctttcttattcacgtggaaatgcccaaattcaaatggggacatctttggatcacctcgttgaaacatcaggacagatggtggggatgaggattgagatggaacagctggtgcttgttggccacgaaaagcacatccatgtagctgtgcgtgccacttgctggcctgagtaggcacatgagaaccatcttgctgatggaagccactattactcaagcttgcatcgaccagagttcctctgtagggatgaaatacttcttgaccttgcaagaccttttggaatcttggagactccccaaagcctgagcaacggtaggaaaacctagggcttccgagtggtgttctgacaccaattcttggaacccccgggataatgttactcgcatcgttggagcaacttcgttcatcaatgtactgcatgttcgttgcttcgcatggctgagaagttgcaacagcagcattgtcatgagttctataacccagtaattcttgaccttgcaagaccttgtggaattgggcagattccgcaaaatcaggacgaccgcttccatttggaactaggtagtctggattaacatggggaagacatggtttcagtctctttgcatttggtgcagacatgtgagatcctgaaactgaactagtcagctcaatctcccaaggagaaatcctgtttggttgacgaaaatctacatcgtcatcccatcgaaccatcaaacatttccatttcgaaccacgccacatggggtcagcatcaccaattcctgctatgatccctgtgcatcttctttcagaagcatcatcgctctcatatctcactttgaacctcgaaccagcagaaaatggttgactgaagctcttgataaacttcgaaaatggtataatgaattcagattggcttaatctggggttgtagtagatgtggaacacacttttggtggccacagcatgtgcaacattaggtagtgaaccaagatttgagcactggttataaagagctggaaaagcagatccatttttaagctgagctgcacggcgcactccaagtcttagctccccattatcacccctcaaaaatagtacggcgtcccctgagacaagcttcttcttgttgacaaaggcactccatccagtggttaaaaggtgtctgcggggctgccctcgataaatgtggcggaacctccactcggttccgtgcaaatccttggccacaagctcctgcgacggtcgctgctggctgtagtccagaggcgggaagcagtcctcggcggcgcggcgtggcacggagaagccgccgtgcgtgctggtgtcggaggccgtgagcgtcttgcagaacatgtgcggcatccgcgagaaccgctgcttcacggtttccccttcgtcgccgtcctcggcgctgccgtcctccgaccgtccgcgcagccgcctcgcgacatcctcgttctcggcgacgagggcgagctgggcgtacacctcgtccgtggacgcgtccgcatggagagtgacgtcgacgacgcggcagaagacgtggggcggcagggcgacgggcggcggcgcgcctccgccggcggccgcggcgtcgccgaggtgctcgatgtgtccctgcgggaggtacaccacgacgctccctttcctcggcagcggcgcgccggggccggcgcaggcgtgccacagctcgaggcacaccgcggcgctcggcctcggctggttcggcggcggcggcgggaacgtggccgcggagctggtccggctctgctgggagcaggcgttgccgggctccgcctcctcctcgtcctcctccacggtgtcgttgaggtcgatccccgccatggctgctgcgggggcgcgaagcacgagaagggggagcgggagccgggagggaggcagggagctagcaagtgattaatgaggagggcctcgtgccgaattcctcgtgccgaatt

SEQ ID NO: 20444 - DNA, 1331 bp, Zea mays
ccagcgcgacattgcacgagaggaggttgccggccgcaggggctaggaagccgcgcgtggccacggcgcggagtcgcccgccagctgcctgctgccgcggccccggccgggtgatcctgtcgtccccatccccttgctccagcgcgcggtgtgcacaggcagctaggctcatggcggccgctacccctagtccccacagcgcaagggtcgccgttgtcaccggcgggaacaaagggatcgggctggaggtgtgcaggcagctggccagcaacggcatcaccgtcgtcctaacagccagagacgagaagcggggcgccgccgccgtagaggagctcgcggacgcgggcctctccggcgtcgttttccatcagctggaggtcaccgacgcccagagcattgctagattggccggtttcctgaaggcgtggtttgggaagctagacatcctggtaaacaatgccgctatcggtggggttcagtcacttcccgttgaaaatgttggcgaaaagatcaagggcatggacgcgttccagatggcggagctgatgcggaagagctgccgggagacaaacgacaccgcaaaggcaggcgtccagacgaactactacggagtgaagaacgtgaccgaggcgctgctgcctctgctcctgcaggcctcctcctccggcggaggaagggtcgtcaacgtctcctccgacttcgggctgctacgctatctcaggaacgaggaggtaaagcatgagctggacgacattgagggcctgacggaggagaggttggacgagctgctgagcacgttcctccgggacttcgaggccggcgcgctggaagcccgcgggtggccgacggagttcgccgcgtacaaggtggccaaggccgccctgaactcctactcgagggtcctggcgaggcggcaccccgagctgcgcgtcaactgcgcgcacccgggctacgtcaagaccgacatgaccaggcagacgggcctgctgaagcccgcgcagggcgcggccaacgtcgtcaaggtggcgctgctcccggaaggcggccccaccggcgctttcttcgcgctaggcaaggaggcgccgttcgtgtgacgctgccgtactgggctggcggtgggttgatgggttcacggtccggcgctgatgcgccgcctctccgacttgcctggcgcctgctatctactacctctctgtgctgcgcagcgtagtttgcttatttgggcacggccaataaagaaaggatcgctgctgcctcttagttagttgggttctgttagtactaaacttcggttaataaaataaaatccccccaaaaaaaaaaaaaaaaaa

SEQ ID NO: 20445 - DNA, 3278 bp, Zea mays
  misc_feature (1255)..(1255): n is a, c, g, or t
tgatggcgcgcgcctgatgatggtgagcgcgtgaaccaatcatgcttttatgagaagcaggtttcgtcattttaccattatttttggcacaaggttaggcccatttttcccgatcggctgatgcaggccttgtacgcgtgtcgttgaacgcctggagtggcaggttaggcccatctcgacgccggtgaggaatatgcgggacccacgcgcttgtctcagcgacgtcggtcgacgccgctatgcatgggctcacgagcaatggcgatgccagccgtacacaggtacctggtggttgtatttaatcctcgttttcattttatgaaatggtaaaattagtcttggctcatgctcggacaagaatggatcttcacgtcaagtacatattcatgaactcttttgtatgcaagtgaaaatatgattgtgtatctgtcacaactcacaacatactcgggtaaaaatgtatcttcacgtcagataagaattcgtgaactctactgtgtgtctgtattcaagtaaaagtacgattgtatggtcgtcgccgctggagaaaattgccgtcatctaccgatctacgtcattgcgtgcgtccttggcctggaccgtagtaattgctcagtctccgtgtcgttgcgtcttcagttatttccaccgttcattggatgccggcagcacattcatggttgtgggcacaaaagttcaatggcacgtttggtggcgagattcttctaacacaacttcacattcacatcttcatcccacttaacttaaaatctccacctttttttacggatttggttgaacagatctattattgactagagatggaagccaaagaaattaaaatctgaatctgatttcgataaacatgaagcggatagagctgtctcagactcccaaaaaaaatcgaactgcgtctagtttcctctcgatcccgtgggtctcaccatccccgtgcgctggaggacgagaaggcgaggaggaaccgcctcgctctcggtgacggcacccgcgctctgtcacggtgctagccagtgaagtccgacgccggcagaggccgatggaggagcccggtgcggtggacaaggacaagcgactgtgtcccgttagaccaggcgcgacccatgtataaatcagtgtctcaaatctgtgttttactatatctattatattaatcagagtaatcaataaattaaattaccaatcagctattcttcctatctcgagcatagaaccaagacaaagtgtgtttgtcaanatatatgtcttgagtttttttatattaccctctttaaatacattcgaagacatagcttaagacacctattttacatgccctgaagacacagtttaagacaccagttttacatgctctgagtcctcagcggtggagaggcgatagggacgaccgagatgagggagatgagataaggaaaataaaattttgtcctatgacaggtggcgttaagtataaagtggcctcaatttaaagttgcttctccaacaaggcattactatgtgctggtgaaatatccatggaacgtagtactctgctaacaaccaccaaccacacatcgctggtcaacataaataacctgacctgtcgtccccattcttgtgatcctgtcgtccccatccccttgctccagcgcgcggtgtgcacaggcagctaggctcatggcggccgctacccctagtccccacagcgcaaggtacgtgtcatccgacgctctggcgtgtaatctgtacacgagttgaaactggttggccggcgtgtgtgatctctactctggtagggtcgccgttgtcaccggcgggaacaaagggatcgggctggaggtgtgcaggcagctggccagcaacggcatcaccgtcgtcctaacagccagagacgagaagcggggcgccgccgccgtagaggagctcgcggacgcgggcctctccggcgtcgttttccatcagctggaggtcaccgacgcccagagcattgctagattggccggtttcctgaaggcgtggtttgggaagctagacatcctggtgagtccccttaattttgaatctgtgaaaggttcggtggtgtaggtggctgtgactgtggctgatgaaggagagccactgtgtcttactaggtaaacaatgccgctatcggtggggttcagtcacttcccgttgaaaatgttggcgaaaaggtgaggtcacatgtcccccgatcgaaattatgcatgcatgctcagatttttttttcagatcctatcctaagccacgctctgatgaaacggtttacatggtggtgcgccgtgcgcgtggaataatggaacagatcaagggcatggacgcgtttcagatggcggagctgatgcggaagagctgccgggagacaaacgacaccgcgaaggcaggcgtccagacgaactactacggggtgaagaacgtgaccgaggcgctgctgcccctgctcctgcaggcctcctcctccggcggaggaagggtcgtcaacgtctcctccgacttcgggctgctacgcgtaagtaagctgttccggtatctgatcataccgtttcagattccgttccgttccttcgaccaacgccagcagctgctgctgctggatctgaaacaaagaatgcagtatctcaggaatgaggaggtgaagcatgagctggacgacattgagggcctgacggaggagaggctggacgagctgctgagcacgttcctccgggacttcgaggccggcgcgctggaggcccgcggctggccgacggagttcgccgcgtacaaggtggccaaggccgccctgaactcctactcgagggtcctggcgaggcggcaccccgagctgcgcgtcaactgcgcgcacccgggctacgtcaagaccgacatgaccaggcagacgggcctgctgacgcccgcgcagggcgcggccaacgtcgtcaaggtggcgctgctcccggaaggcggccccaccggcgctttcttcgcgctaggcaaggaggcgccgttcgtgtgacgctgccgtactgggctggcggtggtggggacttcacggtccggcgctagtgcgccgcctctccgacttgcctggcgcctgctatctactacctctctgctctctgtgctgcgcagcgtagtttgctggtttgggacggcgaataaagaaaggatcgctgctgcctcttagttagttgggttctgtcagtactaagcttcggtaataaaatacccctagatatgaccatattttatcaaaaaaaaaaaaaaaaactcgagggggggcc

SEQ ID NO: 20446 - DNA, 1261 bp, Zea mays
tcgacgacgtcgtgccggtcgtccccattcttgggatactgtcgtccccatccccttgctccagcgcgcggtgtgcacaggcagctaggctcatggcggccgctacccctagtccccacagcgcaagggtcgccgttgtcaccggcgggaacaaagggatcgggctggaggtgtgcaggcagctggccagcaacggcatcaccgtcgtcctgacagccagagacgagaagcggggcgccgccgccgtagaggagctcgcggacgcgggcctctccggcgtcgttttccatcagctggaggtcaccgacgcccagagcattgctagattggccggtttcctgaaggcgcggtttgggaagctagacatcctggtaaacaatgccgctatcggtggggttcagtcacttcccgttgaaaatgttggcgaaaagatcaagggcatggacgcgtcccagatggcggagctgatgcggaagagctgccgggagacaaacgacgccgcgaaggcaggcgtccagacgaactactacggggtgaagaacgtgaccgaggcgctgctgcccctgctcctgcaggcctcctcctccggcggaggaagggtcgtcaacgtctcctccgacttcgggctgctacgctatctcaggaacgaggaggtgaagcgtgagctggacgacattgagggcctgacggaggagaggctggacgagctgctgagcacgttcctccgggacttcgaggccggcgcgctggagtcccgcgggtggccgacggagttcgccgcgtacaaggtggccaaggccgccctgaactcctactcgagggtcctggcgaggcggcaccccgagctgcgcgtcaactgcgcgcacccgggctacgtcaagaccgacatgaccaggcagacgggcctgctgacgcccgcgcagggcgcggccaacgtcgtcaaggtggcgctgctcccggaaggcggccccaccggcgctttcttcgcgctaggcaaggaggcgccgttcgtgtgacgctgccgtactgggctggcggtggtgggttcacggtccggcgctaatgcgccgactctccgacttgcctgacgcctgctatctactacctctctctctgtgctgcgcagcgtagtttgctggtttgggacggcgaataaagaaaggatcgctgctgcctcttagttagttgggttctgttagtactaagcttcggtaataaaataaaatccccccagatagatatggcaaaaaaaaaaaaaaaa

SEQ ID NO: 20447 - DNA, 2149 bp, Zea mays
tatttgtttgccttctttttttatggcataagttcagagaggttgaactgttaaggagttacttttcttgttctacttctatcattttgcaaatccattatagagtggtcgggtgaggtcgcagcactgtttactcatttgatgggaaatcaatatctgttgtttattgagtgaatcttccttgatcaatcagaggttaacaaatcaacaattccatctttgggaacgcataacagcgctgaaggtatgaaccaatggacagacctaattccacatgagtggggtctagagaacggataaaccaagacaaacatttatccagatttcctctcgtcagaagatcaaccacaatctgtgccttcttgtcctttgtaactaaagtctttaaccagatcttgctagaaaatgtgttcatggatctctcgatgaaattagctgttatccccaggggagtgattgtggatgggttctaatggctcctcctaagctagcaatcggcaagaatggcgaaccttgcgccaatcatagaggttgtaattccatggccacgcatctaaaagaggatatttgaacctctcccggtaggtcttaccgattatcagaaatagttggatagcactaacgcatatcagaaatagttggctagcactaacggataacgtatgttatcccagctggaaaccactactattgttacaaagggttcatagatcattacagttattatttcaggatgaatgaccgtagtggaaggggcccatgcctaagcgtctacccgagatcagtccctcctggatgccagtatttataaataactagagggtaggtaagacatccctccgggatgccactgtttatatgtagatagttcgcttcgaatctgtgacccggtaattcggtttttgtgacacggctctcatcactgctccaggcctatgaaagcttttggataactgcttaatacatatataacgtgctcattttttgaataacctatccatcgactctctctcctaaaaatattctgattattaaaaccaactaaccaagacaccttataatcccactcatggaccaggatcttactcagatgtaagatcatacttccacataaatctgcaatacgtatgtcctgtttggttttgcttctctccagcacgcctcaagcacgacgaaaagccatagcttctgccttctgtatgggatcaccatagcttgtatcatcaacagaagcagttccagtagcctctctatagatctctgcatcaatcccatgaagagtcactcgatagacaacagatactgttttcccgtcaaatgagtaaacaatgctgcgtacctcacccgaccactctggagcatgtatgttgagaattttgttcacaatgtgccatgggatgtacttgatagcgaagccattattctcgacgcgggtcttgacaagggagtccggaaccctcttcccgagctctttgagcacctcggcgagcggcttgccgatgccctcggtgggggcggtgagctcgccgccggcgaagtcgttgtcgtcctccgacggaagctccggttcctgcggccgagacgcacggacctttgcagcgaaggggcgcgcgaggcgaggggtgggcgcaaggcggaggaggcgggctagggcaccgagagccatgttgggaagcgtgcgaactgagccctcggggaaacggagggtttttcggtgggtttagttcagtttttgaacctgcttatctcttgttcagctattctagaattgtcttgtttggttactttagtacattgtattaagtggattagactgtaaattagttaaatttacacctaaaattcatctcaataaatatagattaaggtgaataatagagtacctaaataaagcctaagttgttttcggtgaaccatgtaaaatagaagatctgcattataaataatattgggaacttgttctcaaatgctatgagttaagaacaagacaacacaaaatgttaaaggttcatgtccttcgtccttcgaagcattatcttccttaggatataatgaccttcagacgaaggtcgtgaagaaagtgcattcatcatcacagtatatgttaatgaaagaagaagcatatgagatgtgagagacatgatgaata

SEQ ID NO: 20448 - DNA, 1244 bp, Zea mays
aaaggggattgggtggggcctttttggtttttccgccacttgggaaaaggggatttttttccaaggggttaaatttggttacccccaggtttttcccattcccgcctttttaaaccgccgcccatgaaccccggttatttggcttccttttgggggaatttggttccgggcccccccttggggtttgcggttttgattaactttgttttgaatttcttccacccggggggttcccttttttttaaacggccccggcccttagggcctttttttttttttttttttaaaggttaaccaaattttggccctttttaaccattttttttttttttttttttttttttttttttttttttttttttttttttttttttttttttttttttttttttttttcatgaaactcgggaatttagatactggaaagctgtttcgtaacaagcaaacagctcagaacagtagttgcatttggtactttgatagctgacatatagcatgacagcctaaacttcaaacacttgcacatacataccacatttaagaaaaagaagcatgcccagtgcaaatgggtagcccattaagggacaatggtccgccacaaacactaacattagtcaactacgagtctatgacatatcttcatggtagagatggagtccaagaccaagacgtgcacaagcacgacgaaaagccatagcttctgccttctgtatgggatcaccatagcttgtatcatcaacagaagcagttccagtagcctctctatagatctctgcatcaatcccatgaagagtcactcgatagacaacagatactgttttcccgtcaaatgagtaaacaatgctgcgtacctcacccgaccactctggagcatgtatgttgagaattttgttcacaatgtgccatgggatgtacttgatagcgaagccattattctcgacgcgggtcttgacaagggagtccggaaccctcttcccgagctctttgagcacctcggcgagcggcttgccgatgccctcggtgggggcggtgacctcgccgccggcgaagtcgttgtcgtcctccgacggaagctccggttcctgcggccgagacgcacggacctttgcagcgaaggggcgcgcgaggcgaggggtgggcgcaaggcggaggaggcgggctagggcaccgagagccatgttgggaagcgtgcgaactgagccctcggggaaacggagcgcacccgccgcctgagcgccgcacag

SEQ ID NO: 20449 - DNA, 2120 bp, Zea mays
cttgttggcttccctcagggagctgggagccctagccgccaccccttcctctctctcgtaggcagcctaacccaccctgtgaacaatacccgtgggtactgtatcacggtactgtaacacgatcccttgctctgtctctcgccagcagccacgacatcttcaaaccatacccagcaacgtcctacaacgcctcatccctacaacctacgtcgtcgcctccctggtagggactccaatcatatcaactacattccaaacaaacatggcatggcattttagaccgatgtcctagccaaatattgaaataggacaacatcagtgtgaaactacagaataattgtccccttttgtttttggaaggaacattgatcaacagattcagtttatgattaagaataaatatataaaaacgatatagcatttgacctattatggtaaggtttctagtcctaccaggaatctgccgaagggagtatgggtgaggggaggacaggctacgacctggaggtggtggctgcctcttgagcgccgtagtcaggggcgaacttaggggtgtttatcggggtcagccggcccgataaaatttataaatcctttagcaaaacactaatacagttgaacatctataccatatagcaaagccgcttttgataaccccgataatatttgactaggttcgcaactggtcgtagttgcaggaagtagttgcaggaaacggcacacacggatgtagattccagctcccatgggaagttggcagaagatatctgctattgcttgccttttttattacaaagtcgtaattatataggcctaaggccaaccgactactccacgataataggagataaaagacttatccaactactccataatattaggagataaactgataagacttattcaactaaactgattacttatctcctgatcctacgcctactctggtgggtctagtcgccttctggtaggccagtcataacataataatcctgcaaaggcattgtaatttgccataatcaaagagatcctggaaagacttacctagtgaccttgctgttgaaaaaaaaaacattagtatgggagcaatgactaacatgaaaacatttcgtccaatgtgctaccgactaacagttatatgaagatatccagttaaaggatatagaaaaaaattttttttttttttttctttttcatgaacatgtactcaagaatttagacattggaacaagctgctgcttaacaagcaaacagctcagaacagtagttgcattggtactttggtaacttacatatagcacgacagcctaaatttcaaacacttgcacatccatatcacattaaagaaaaagaagcatgcccggtgaaaatgagtagccattaagggacaatggtccgcaacaaactggaagcatgccacaaaaactaacattagtcatctatgacatatcttcatggtagagatgaagtccaagaccaagacgcgcacaagcgcgacgaaaagccatagattctgccttctgtacgggatcaccatagattgtatcatcaacagaagcagttccagtggcctctctatagatctctgcatcaatcccatgaagagtcactcgataaacaacagatactgatttcccatcagatgagtacacaatgttgcggacctcacccgaccacgctggagcatgtatgttgagaattttgttcacgatgtgccatgggatgtacttcatagtgaagccattatcctcgacgcgggtcttcacgagggagtccggaaccctcttcccgagctcctttagcacctcggccagcggcttgtcgatgctctcggtgggggcggcaacctcgctgccggcgaagtcgttctcgtcccccgtcggaagctccggatcctgcggccgacgagatgcgcgggactttgctgcgaaggggcgcgccatgcgaggagtggacgcgacgcggaggaggcgggttagagcaccgggagccatggcagggagcgggcggagtctcgactctcgaggccttcggagagtcgattcgaaaaaaacagaggggtttggttgggttttgcaattggagagtcgtcgcgttcgtctcaagcacaatcacaatgt

SEQ ID NO: 20450 - DNA, 513 bp, Zea mays
gtagcccattaaggggacaatgtccgccacaaacactaacattagtcaactacgagtctatgacatatcttcatggtagagatggagtccaagaccaagacgtgcacaagcacgacgaaaagccatagcttctgccttctgtatgggatcaccaaagcttgtatcatcaacagaagcagttccagtagcctctctatagatcatgggatgtacttgatagcgaagccattattctcgacgcgggtcttgacaagggagtccggaaccctcttcccgagctctttgagcacctcggcgagcggcttgccgatgccctcggtgggggcggtgacctcgccgccggcgaagtcgttgtcgtcctccgacggaagctccggttcctgcggccgagacgcacggacctttgcagcgaaggggcgcgcgaggcgaggggtgggcgcaaggcggaggaggcgggctagggcaccgagagccatgttgggaagcgtgcgaactgagccctcggggaaacgg

SEQ ID NO: 20451 - DNA, 1872 bp, Zea mays
gcgcgccgcttccgtgcatttgctgacgtaatcactgccagtctaccacgcctgttccagggttctgacagtagtgcttactcatactcatacccgcaagataccatacccatacccgcaagatacgcaagataaaatcatactcgtaaaaaaaatcgtacctgctcatgggtatgaaattatatccatacatgtatccgcatgggtaaaaaccaatcggttaacccacacccgattagacacccgctaaatatctattaaataacataaatctaataaatatatagcgaatatagaattataaatcatcaaatatgtgtagataaaagaagaaaaataataaataatgtagaaacatgcaagttggtacgtacaattttagcttccatttgtattggaatataaattgtagcttccagacaaacccattctacatggacataagcatgaaaagatgaaccatagaactactatataccaagaatccgtaacagaccacagacttcaaatacaaacagtgatgaatatcgtaataacaatataccggtaaaacttgaatcactagtaacgatgggtaatgagactagcgaatattgcgacttattaggccctcaaaaatggtgaacaggtccttgttttcaggaccgaagatctcataagcttgtcttaaggtatcctctctggtctgcctatgtgcgttcagctccttcacattagccaggaatgcaccaaactgctcataagataatctatttctgacctgacgaaagaactcctttccatcaactcttgttcgtcctgtttgacttggagcgtcaaatggagagctatgctgaccagaaaagcctgaggacctgtcattaaacatattcatcgatgtaacagagattgaatgtcgccttggcggtgataccgatgcaaaacgccttggaggtgagtctgggggagtcatccttggtgtgctattgtatgattgcaaaaatacatgtggacggggtggccgcctaggtgcatctgggtcaacttggttattttcctccgttactgaacttgcggtttctgaaacctgtgatgatttggaagtcgaaaatgcagaatcttcatctgatggtgcagaggagaaatttgaagctgctgcagctctttccctgggagcagtattatcactgctgtcatcttcctggagtgactgcacaagtgtcttcttgaaaacttccaacttggcgacatctctgttcaacttcctaacggtgttggacagctcagagttgtcccgctgcagtgcgtccttttcctcctcggcgtggcggaggcggccggtggcgacggcgagcgcggcgtcgagctgctcgacgtgctcccggaggtcctcggcctcggcgtcgcgttcggcgagctgcgagcgcaggcgcgctgcttcggcctcgaggaggccgaggcggtgcgagagcgcgatggaggtgatcttgcgcgctacgtccagctgagcgaacgggtccgatggcagcacggctatcagctcagcggggagcccaaagtcttgggtcggcgccgccgcgttgtcctcccccaccatcgcggccggcggcaccgcctcctccagttccatgtgtgccctcctgctccgcgcctctcggtggactggtgctctccgctccccctctctcgccctttccgtaccgcgagccgttatctgcccgcccgccgcccgcgggagattaggctggtggggcgcgaggtctctttgtggtggcgaaggcgcgccctgccggatgccccgcgccacgggtttgggtggggaggggtttggactttggaggcttgggcccgcgtcgctctcgctcttggtgggcagggcactgtgcagtgcag

SEQ ID NO: 20452 - DNA, 981 bp, Zea mays
ccggccgggtagaccatcccgagcgccggcacccgagcgctttcgatgtttggcggtcagttaggaagcagctcggtccaggccagaagatcacggctcttaccagcggacctcttaccaatctagccagcattatttcactgtctgacatggacgccggctctgtcatagagagagtttatgttgtcggtggagtggttagagatggaggtgatgacaggggaaacgtgttcaccgttccctccaacagatacgcggagttcaacatgttcctggatccgctggccgcaaagacggtgctagaatctggtctgaatatcacgctcatccctctcaacgtgcagcggaaggttgcttcatttgagggcgtcctcggagctctgaagcaacacacccagcatactcccgagtcaaagcttgtgcgccgtttgctgttgctgctccagcagctccagagggaacaacggaaattctatcaccacatggacatatttcttggagaagttcttggcgcagtttacatggtccaaggatctaacttggagccctctgtggaagtgaagtcaatatgcattgttgccaacacaaccgaaagcataaatgggcttattttggtcaagaagagcgcaaagccagtggatgtattgtatagtttgaatactggagcatattacgaccacctggcaaattctttggttaaccataagcaatctgctcctattggcagctttggagagcaaaaggcaatttggagcaggccacaaaaacatttagggacggacatagcaaaggatagaaaataagcaatctatttgtacaatattgctggaaaaggattagagattagattccaaaagaaaaacagtttacatcatacttcactatcttatagcgtagtacaaaattaaaggagatactcaacacagttacagttgtatgaaagggcttcagtaagcaataaaatttatcttgaatggattt

SEQ ID NO: 20453 - DNA, 1352 bp, Zea mays
ttttttttttttttttgtgttcaagaaatatcagacaacatttgtattagaatataagttgtagcttacatagaaacagaggactctacatggacattagcatgaaaaaaaaaagaaagaactatagactatataccaagaatccacaacagactacagacttcaaatacaaaaaaagtgttgaacattgtaaccaaaatataccggtaaaacatgaatcactagtaatcattggtaatgcttcaacccttgaggagattagcgaatgttgcgagttattaggctctcaaaaacggtgtacaggtccttgttttcaggaccaaagatctcatcagcctttcttaaggtatcctctctggtctgcctgtgtgcgttcagctccttcacattagccaggaatgcaccaaactgctcatacgacaaccgatttctgacatgacgaaagaactcctttccatcaactcttgttcgtcctgtttgacttggagggtcaaatggagagctatgctgactagaaaagcctgaggacctgtcattaaacatattcatcgacgtaacggagattgaatgtcgcctcggcggtgataccgatgcataacgccttggaggtgagtctgggggagttctccttggtgtgctgttgtatgacggcaaaaatacatgtggacggggtggtggcctaggtgcatctggttcaacttggctattttcctctgagactgaactcgcagtttctgaaatctgtgatgatttggaagttggaaatgcagaatcttcatctgatggcgcagagaagtttgaagttgctgcaacgcttgccctgggagcagtattatcactgctgtcatcttcctggagcgactgcacaagtgtctttttgaaaacttccaacttggcgacatctctgttcagcttcctaacggtgttggacagcgcagagttgtcccgcagcagtgtctccttttcctcctcagcgcggcggaggcggccggtggcgacggcgagcgcggagtcgagctgctcgacgcgctcgcggagctcctcggcctcggcgtcacgctcggcgagctgcgagcgcaggcgcgccgcctcggcctcgaggcggccgaggcggtgcgagagcgcgatggaggtgatcttgcgcgccacgtccagctgagcgaacgggtccgatggtagcacggccatcagctcagcgggcagcccaaagtcctctgttggcgcctcccccaccatcgcggccggcggcaccgcctcctcgccttcatctgccatgtgtctcctcctgctccgcgcctcctgtactagtgctctggcgcccttctccccggccggcctcgaggtacccaatg

SEQ ID NO: 20454 - DNA, 1252 bp, Zea mays
cgcagggacgaaaatttattcaggcctaaacaatcttgacggtttatctgctacaagacgcagcagcagcttacccgtcgggcgtggctccttttttttttttttttacaagattcacagcaagttcatgaataagaaaccctaaaaacagccattctgagtgaacacggtccagcggcctctggattatctgtcaagaccattattgactgctccaaaggcaaaccgtgaaaaaacattccaatgcagttctacttgaagcaacagatcataaacaacaacaaaaaaagatccattgtgacggtgagttacagcgcagcatgtcgaaaacatcaactgtctagggcttaatgttcttcgccatctcttccacatcaagctcaactgccagtactggaccatcctgtttcatggccatgccgctgttctcgactagaccgtgatcaacagcggttcttaaagagtaaataactctgccaaggatgtcagtcattgggacaggtccaaacaagcggctatctctagcttcctttggcttaagggctaggttgtctgccaggacccagcattggtctttctcaagcacaaacggctcatccttctcatcattagagaccatctcatagccttccagggcagccagtcgtcgaataattaaatcatcagatttctctgggtcttttaacaacacaacgtccccgacaaacacttgcgtggggctcaaatttgcgagttttctgacaaggacggctcctccagttggagatgcgatgggagccatggcttcttcccctttggtcggacacacgtaggtgagcttgccttggaataaatttttgtttaacacatcagttagctgtgtgctgctgatccggcccacatcattatatttcttcaacgagagggaaacgcagtactcgaacttttgtgcggcatagcggaaccaagtcgagagcgaaaccatcctcccaaacccctgcttgccgcctgccaagctcttccacgccctccaccaggagcgcacgcactgatccccgcccctctctgtttggggagggggctcgtcctgcccggtggccgccgctggtgcttcacgctcacgcagtccgcagagagcgggtgttgaccctagcaggtggcgctggcggcggcggaggtggccgcgtcgtggagaacctatgatttccccccttccacagccggtgggctgggcttctttcattcaagttttccttttccttttctggctcat

SEQ ID NO: 20455 - DNA, 1328 bp, Zea mays
tttaattccggggtaaaaagatccaaaagagggggcccccccctattttttttttttatttttttatttttttttttttttttttattttctttttttgccattttcttttcttttttttttttttttttttgctttctttttttttttttttttacaagattcacggcaacttcatgaataagaaaccctaaaaacaaccattacagtcacacgatgtatcctgctgagaattctgagtgaacacggtccagcggcctctgggttatctgtcaagaccattattgactgctccacaggcaaaccgtgaaaaaacattccaatgcacttctacttgaagcagcagcagatcataaacaaaaaaaaaacatccattgttaaggggagttatagcgcagcatgtcgaaaacatcaagtgtctacgccttattgttcttcgccaactcttccacatcaagctccactgccagtactggaccatccagtttcgtggccatgccgctgttctcgactagaccgtgatcaacagcggttcttaaagagtatatcactctgccaaggatgtcagtcattgggacaggtccaaacaagcggctatctctagcttcctttggcttaaggactaggttgtctgccaggacccagcattggtctttctcgagcacaaacggctcatccttctcatcattagagaccatctcatagccttccagggcagccagtcgtcgaataacaaaattgccagatttctctgggtcttttaacaagacaacgtccccgacaaacacttccgtggggctcaaatttgcgagctttctgacaaggacggctcctccagttggagatacgatgggagccatggcttcttcccctttggtctgacacacgtaggtgagcttgccatggaagaaatttttgaatatcacatcagttagctgcgtgctgctgatctggcccacattatatttcttcaacgagagggagatgcagtaatcaaacttgtgtgcggcatagcggaaccaagtcgagagcgaaaccatcctcccaaacccctgcttgccgcctgctctgctcttccacgccctcctccaggagcgcacgcactgataccccacccctctctgtttggggagggagctcctcctgcccgctggccgccgctggtgctccacgcagtccgcaagcagaggagagagcggggagcggcggcggcggaatgaaactacaaagaggaggcggcggccgtcgcgcaaagaggacctatgaggttttcccccttcccccttcccccaggcacagtccgtccgtccaccccggccggcctcgagg

SEQ ID NO: 20456 - DNA, 608 bp, Zea mays
ttatgctcaggtatgtcgcagggacgaaaatttattcaggcctaaacaatcttgacggtttatctgctacaagacgcagcagcagcttacccgtcgggcgtggctccatgaacacaagcagatacaagattcacagcaacttcatgaataagaaaccctaaaaacagccattctgagtgaacacggtccagcggcctctggattatctgtcaagaccattattgactgctccaaaggcaaaccgtgaaaaaacattccaatgcagttctacttgaagcaacagatcataaacaacaacaaaaaaagatccattgtgacggtgagttacagcgcagcatgtcgaaaacatcaactgtctagggcttaatgttcttcgccatctcttccacatcaagctcaactgccagtactggaccatcctgtttcatggccatgccgctgttctcgactagaccgtgatcaacagcggttcttaaagagtaaatcactctgccaaggatgtcagtcattgggacaggtccaaacaagcggctatctctagcttcctttggcttgagggctaggttgtctgccaggacccagcattggtctttctcaagcacaaacgg

SEQ ID NO: 20457 - DNA, 2546 bp, Zea mays
ggccgcaaattttttttttttttttttggcccgggtaatgttataatgtgtgtttatgttaggttttggccctttttggaaggttggagacaaggaaatttgattgtcatgacaccttgcatcccagaataaggagatattcgctgactttacgtcaactgcatatatcatgtacaatttaactcctccttggcaggaaccatcaaggttggttacatctacagttacaggcttgctcctactttctcaacaaccaccatatcacatacaagagatggttcgtctctttcagcacttcttttagagttccatctgcttcagtagtctgcaaatgtcgatgaggaactcaagtgcaagagatggaaaattttggtctgctgttgagcccgatcagaagtgaagagcatgggtatttcctgcaacggcatccatcttcagatagatgggattgtgggcactcactggaagcaccctcgttagtctgctgcatgagaagacctcacgatgacctaacagtgtggactcggggcaaaaccattttccttagcgagttacaactcttcgcaactctgctagatggccgcttatctcctgtatacactgcagtccatcactaccgcattggagggaactcaacacctgcttgagaaactcctggtcgtcttcaagtgccctcagtcttatattgagcagagaaatcccagccttaagattcgctacgccgctcaacttgtcaccgttggaaggagacccatcagctgttgtatgctcatgctcttcaaacagcacgtcttcttgactacctctggcgtcaccggaagcaagcctgtttgtgaaaatgccaaggttttcctccagtctgctcaaggactccaaaatgaacgccttctcgtcttcgaaaagcgacatggcgctccccacaaggtccgcgccatccaagcattcgatcgccgccggatttctgccgtcaatcgttgtgttcactgtgtcagcgccattattacgtccgtcgccgttgaacggatcgttctgcaggagcctcctgcagtgcgcgagctcagcgtccaagtcaagcaactctttctccctctccgtaagcaaatcgtgcaggtcctgaatcgccaggtggtcgtggtcagcctgctgttccatcatcctcaggtactgcagagcctccatctgcattgcagccttctcctcctgcagcctattgatcatggccatcgtctggctagccgcgaccgccgaagcgctccgttcttcctcaagctccttgtaaagagcggccattgccttcttgttgagctcaagctgtttcttcacgttctcgagagagctttccccttccacgtcgtcggcgagctggctcccttctgaaggttccagcacggagtagttcctctcgagatacggcctcttgctcgctgccgcagggttgctctcttcgttcggagcgctggtaccggggctaggagatccttcactggaagaaccatcgaggccccgcacagatgacatctgagagaggagcgccttcacttcttgctgggtcgtggaattgctgtccctggcagagatgatctctgatggccgaggagatgtcaagttggccctagcgacggaagcattcttcacactgccgttgcggtcgacagcgatgcgtgttggtgcgggcgatatgtagttgctctttgctgccccaccaccgttcgcagaaggggcgctgtcctttgtagattgtccatgcgagcctggcgaaccatctgattcatggacttcctcaatacccaccacaaaagtcttctcatttggatgatctgcaggtacactgctatcccaacactccacagcattggctgcttcagaatgcttctgcgcgccgcgagcattcttgagtggatccgaacaagaacacaaccttcttgacctggccgatgtaggccgagagagatcgccggagcatgcaacaagctggtcatgggtcttgcagtgagccagagacgagatctcagaccgatgcgcggcacagaccaagtccgaagagaaccatggcttcccgtggagggcgtggtccagcctcgcgcacaggatgcagggcggccggagcccgcagacgcgcgccagcctcgtggccgcataggacgccagggcagacacgtagagcagtacgatcacacacagctcgccgcaagcgtaggacagcatgggccagaacgtgtgcccccccagatcctgtgatcccgagccgtctttcgcagccatgtctggtcagctcacatcaaaattcgcgtaccgatgcctcaatgcagccaaggaacatgtgaatggccgattgcacggagaggaatgcaatggagggattcgaaatgtttgcaccggtcgcacccgtgggtcatcccattcccaccctctcaccggagaaccgaatcggaaatcctaaagaagactgggtagaaatccgttaggaatggtggtttcttggcagcgaagaggagtgggggggcgctcccctgtttctctctctccttctccacgcggggacgaac

SEQ ID NO: 20458 - DNA, 1876 bp, Zea mays
ttacttttggtttttgttctggtgtggcttgttctctttttttttgctttgagatgtttagctagcacagttccattaggcgaccacatggcagtatgtacattttctttttcaataaataaagaccatttatgtacacaaggtgaggtcacagggtacagttagttcatgtacaacggccgggatgtacagcacaaatacaagtcacggtgctgatccatatcgactgcgcagctgcatcgcattccataaaccaagcaccgtcaccaggccccatagagttggcttcgactcgaaattgctgctgctgaagcacaaaagtacggcatacttcctttctgcaggttaaccaccattgttgcagccagagctcagagcagcagcacatgtagtggcacactcatgattggaagagggtgacagttgcaatatatccgtttttcatcacctcgaaagcgatattctgataaccatatacaaaagttgatccaaatggattgttcatggagccttgtgtctggattgcagctcggccacagtcaccgaggatctccttgacttgttcccattttgtactaggtgttatgcaattttttgaggcattattaggctgacatgtaccttcagcttcagcgtcgtatataacaaagttgcatttcttatatgaattgaaatctgagtggccagggaagtttgtatgcaaaacaaacttctttatcctatgtgtctgtccattaaataagatatcaattccacgcgagaagtagttgtaaaagtaatctccacaaagggtcgtccgaggcctggcttctgatgcggagtgtatgaccatttggtccacctgcttctgatggataccacaaggacgacccaagtcagtccagacatcctgtggtgatgcaccaaaaggaatatgttgcccccctattgtgaaccaaagttcttcaccaagcttcgcgtgcacctcctccatatacaggctgcctgcaggcagtgcaggtaccattgctttgtccatcaaagatccaaccccaaccttgctatctgtcgagctatcatatatacaaacccgacaagtaacaggggttgtaccatctgggaattccagtggcaaatctgccacttctccattagtgaatagatttgtatactggctgggaatagggaatgcgaaggataaacctgggtagaacagcgtataaattcccctctctttgtcatatatgccagggaaagttggtccaaagagtgcatacacagccgcaaaagtggctaatgttgacgggccaccaattaaagatgtcgcatatcgcaattgcaatctcttaacatcataaatctctacgagacggagcctctgggaccaaggatcaaagcgtaggtgaaatccatggtccggaaagctaatgacaaagtccagcttgagaggctcctcgtcgaagtatttcacgtggacaacgtcgtagatattcggctgccgctctatctgtgtaaacgcatccgatatcggcatcccgagggtgaaggggccgacgccgagcccggggcggaggtcaagcgtgatggctcccatggccgtgccctcgcaccgccgccgcaccggcagcgtggcctgggacggcatcccaaccgccgccccagccgccaccgccgtggcggcgccgccacctcccgccatcgccggggacctctgcgcctgcatcctgaagtccacctcgcggccccctccttcctcctcgacgacggtttattcttcggcgtgctgatggactcgatccgatgggattcgcgtgggattgcgtgtactccaccctcgcgcgcggtgcgggcttattagctttttttgattaggatgttctaggtaatggtctcgtgc

SEQ ID NO: 20459 - DNA, 3296 bp, Zea mays
ccagccatattttctctacaactagattcttataaaagttggttagaaaaaagttgaaccaaaaatcaacattgccctccactcgagtccaccaacgatagaaagactggaaccaatatcaaactactggacaaatcatatcagtacccacatgagatgtttagctagcacagttccattaggcgaccacatggcagtatgtacattttcttttccaataaataaagaccatttatgtacacaaggtgaggtcacagggtacagttagttcatgtacaacggccgggatgtacagcacaaatacaagtcacggtgctgatccatatcgactgcgcagctgcatcccattccataaaccaagcaccgtcaccaggccccatagagttggcttcgactcgaaattgctgctgctgaagcacaaaagtacggcatacttcctttctgcaggttaaccatcattgttgcagccagagctcagagcagcagcacatgtagtggcacactgtcaaaatggaagacttcgacagttaacttagtccatgctccgtgctctggagatgtgcatattatgggcaaaagccacattgcgtacctcatgattggaagagggtgacagttgcaatatatccgtttttcatcacctattgacccataaaaataacacgatgtcacatctgatatacacagggggacacagatttggagtgtgatctaataacacccacctcgaaagcgatattctgataaccatatacaaaagttgatccaaatggattgttcatggagccttgtgtctggattgcagctcggccacagtcaccgaggatctcctaatatagtaataccaaagggttgttaaaagaacagaaaaatataacagatggcacgcaataagatagcataccggcacttgaagcgttgctaggttgataatacagattagacaaatatctacttaaaaggtaagtgctctagaaaaagcaaaggcaaagctgacattcttagtgcaagaacattagtgtgattatgctaacagcccaactatgcaaaataaaacctagtatatcattattatgtcataagtttaacattcactatttaagaaggatataaaggattcatgaaagtaatccatgaagccaacgaaataagatgaaaaaggggtgcaaaaattgtagcataaggcatttcaaagcaaagatgataattctagaactacatggcaaaaaacaaacggcattctgaaggcaaataacacatcaaggactaccagtggtaccatcaacagtgttaataagtcatgtagaacgccataccttgacttgttcccattttgtactaggtgttatgcaattttttgaggcattattaggctgacatgtaccttcagctgagaaaagagcagatggatgattggattggattattccatcacagcaaactatttttttattacaagtagttcagaccttcagcgtcgtatataacaaagttgcatttcttatatgaattgaaatctgagtggccagggaagtttgtatgcaaaacaaacttctttatcctatgtgtctgcaaggacaataaagtctgtcaatatgctattccaaatccaagccaataaaaaagatgctatttacagtgttgcacaaatcctagtgtgatgaaatactccacacctgtccattaaataagatatcaattccacgtgagaagtagttgtaaaagtaatctccacaaagggtcgtccgaggcctggcttctgatgcggagtgtatgaccatttggtccaccttgcaagatgggagaacaaacatagttagctttccagcagagaatgcaccaacgattccagagagaatgtcattctttttatattgatctttaccaaacaaaacctaataaccatatgtcacagaaatacggattagtttcatgcttccaatagctctgtataagctaaaatgttatctaaatgcttccatgagtaagcaaaaaaagtaaattcacaaggaaaccggttcagtttaacatgtcatatgttaaataatgttggcaactcaaagaaatgcatattatgtgaaatctctactctaatgcctcaattaaaactgacctgcttctgatggataccacaaggacgacccaagtcagtccagacatcctgcaggagaaattcaagtaaaagacaaatcagggcaatgtaaagttatatttttatttcagaaaatagatatgtgatgtacctgtggtgatgcaccaaaaggaatatgttgcccccctattgtgaaccaaagttcttcaccaagctgaaaacaagtataagaaaatgtttaatccactggtaagacttggtaagaatcgtaagactaaataacatacagaaatcacaactaattcatatacacggaaaagatactagtcgttgtgtgattctcactcgtgcaacaaccaacaaagcaaaaaaaaaacaacaacattaaagaagagtctaaaacaaacgtgtgattgaaaggcaaatcccacgaacagcttttttatttccttttgcttgttagtttcatacatttcctaagaaaagaggtgtctgcgtgggtggacgcaggacaggagagctaagaggtaaaactagatagtctggatcacttagattatgaaacatcaaaatatgtttacagtttcaacaaaaccagtaagctggaaacgttgtcaataagccaaaaacatagcataccttcgcgtgcacctcctccatatacaggctgcctgcaggcagtgcaggtaccattgctttgtccatcaaagatccaaccccaaccttgctatctgtcgagctatcatatatacaaacccgacaagtaacaggggttgtaccatctgggaattccagtggcaaatctgccactgccatagcaattacagaagcgaggtaaaatgttacgtaaatatgggtagtaatagaacattcacaaatcacaactgaattgcctataaggtgaataccttctccattagtgaatagatttgtatactggctgggaatagggaatgcgaaggataaaccctacaaaagcttaccagtaagacaaacccaccaacagaccaaggggaagaaaacaagatgagctgtgaaaggggggagctattttcatgacatactgggtagaacagcgtataaattcccctctctttgtcatatatgccagggaaagttggtccaaagagtgcatacacagccgcaaaagtggctaatgttgacgggccactgaaagtgaaaacaaagacaatgatcagtaaca

SEQ ID NO: 20460 - DNA, 1662 bp, Zea mays
caaaatgcgctggttgtattgcactttgcaactactacttacacaatggcggtgaattaaacggcgtgacatgaaccattacgtacaccgtttgacggaaacccattcgatgtttttgttgactttgggcggagataatatttcagtcctctttttcttaacagagggcaatcccagttgtatttttttctaccaccactgaacacatgctgacaccagcaaagccgcattctgcgtctctcgtcactcacggacaacctcttttgattatgtccactaatgttgccgtgtcacacgctcgttggtcggcagcaacagtcagctacggatccgagaggagagagagcagataaagagcgccggtgcaggtgagagagatcaaagcaactgttggtgctactggggctgctacacggctggtgtctcccggtgctctgcactacaaacttctgatccaggattataaaaatcacttgctgtagttgccacgcaccttcttctcaactctcaagcggcaccttccttttctgtgtttcccctctctctctctctctctctctctctctctgtgctagctgctagcagagcagagtgtcagtcagtgagtgcgcagtgcatgttcgccatggcaagcgccggcggcaaggaggagcctggattgttggtgaagcaggggaccaagctccacgccaagatgctctccaaggaggcggcggcgcagctcgcggtaccgtcgttccgggtgtactactccgtggcgtcggccggcgcggtgccgttcctgtgggagtcgcagccgggcacgcccaagcacgactcgtcctccgcggccgagctcccgccgctcacgccgccgccgtcctactactccgcaggccggggcggcgccggcgccggccgctccaggagccgccggcccggcctcctcgccgccatcctccccaggatcaccctccaccggtggcccggcagcagccggacgacgtcggcgtgcccgtcctggtcctccacgtcctggtcgtcctcgagttccaacacgtcgtccacgatgtcgcccgtgttcaccgtccagtcgtcgcccgccgtgcacgtgggggcttcccgcggccaccacgggcgcgcgatctcggccggcggcgcctacgacgaggccacgccgcggtgcttctcggtggagcgtgagtgctacgagaggcgggtcgtgaaggggtgcggcgtcgcggtggccttaaggaacgcgctggccacggtcgtcgtcggcaagcccggtcggcgagctgccaccagcgccgcagcatagacaggatttgattgaaattgatatggctaagaagctcagggtgtgctttgcattttgccgcagcatgtgtcatgtaacgtactcccaccgtcctaaaataagtgcgtatcaggtttatgtacaagttttttttaaaacaaaaactaagtatatagaaatactattaacatttatatcttcaaataactttattataaaagtatattccacccgcaacctctgttactattgtttcatgtatatttgatcaaattttgaagagtttgatttcacggtaagtgagattaattaaacgagcgtgatatatatatatatatatatatatatatatatatatatatatatatatatatatatatata

SEQ ID NO: 20461 - DNA, 1160 bp, Zea mays
attcagagacgagcagcaagtggacagctacagctggtgctacatacggcttcttctccctgtctctgcactcactgcaaaccgctgatcctggatatataaaattcaccttctgagccttttgtacagatcaagagattcatccggctccgagcggcgagctccaccaaacggcctcattctcaatctcaactctgaagcggcacctacttcttcactgcagtgcttccctccttttcttgcagtccctcctctcctctcctctcctccctccctccctctgtctctgggctagcagagcagagtgccagtgagtgcgcagtgcatgttcgccatgtcaagcgccggctgcaaggcggagcctggattgttggcgaagcaggggagcaagctccacgccaagatgctctccaaggaggcggcggcgcagctcgccgtgccgtcgttccgggtgtactactccgtggcgtcggccggcgcggtgccgttcctgtgggagtcgcagccgggcacgcccaagaacgactcgccctccgcggccgtgctcccgccgctcaccccgccgccgtcctactatgccgcgggcaggggcagctgccggcgcccgctccaggaaccgtcggcatggcggcctccttggcgccgtgctcccccgcatcaccctcctccggaggcccggcggcagccaggcgacgccgccgtgctcctcctggtcctcctcctcctcctcctggtcttcctcgagttccaacacgtcgtccaccatgtcgcccgtgtttcaccatacagtcgtcgcccgccgtgcacgtgggggcttcctgccgccaccacaggcctgcgttctcggccggcggcgccgacgacgtcgcggaggccacgccgcggtgcttctggaccgagcgtgagtgcttcgagaggcgggtggtcagggggtgcggcgtcccggtggccgtcaggaacgcgcttgccacggtcgtcggcggcaagaccagcaggcgagctgccaccagcgccggccgcagcatagaatagagaggctttgtttcatattaatatggctaaagctcagggtgtggtttgcattttgcggcatcatgtgtactgtaatctatgtgctttgtggtaaatcttgacgtgcaatgccaaaaaaaaaaaaaaaa

SEQ ID NO: 20462 - DNA, 743 bp, Zea mays
ggccgctttttttttttgttctttcgccttttttttttttttttttttttttttgaaatggccagacgtcgccattttttattttcactgaacaatatatacagtgatgtacttatacacaggaaatccaaatatgcagaatctaatactgcaatacgcacagatatattctttaatagaaaatacaagaattcgcaatgcttattttaagctttcacgcagccttctgtacaatgaaacactgcacactgaaagaaggcattcattcgtgcccaggaaataactatttccccagccactcgaagcagcagcagaggccccagcaaaacttcgaaggatagtctcttatgaacacatccctgctgtagccaacgacatagaagctaaatgactgcttgcgacgcgccattgtgacacgggttacaggcacaactgaaatgatgtgtctctcggaaataacccttgcagatggtggaactggcagccggctagcgatgacttctgaggagaactggttgagtgggtatgaatcagcaaaaaatgcaggagtgcactggtatgcctgtatgttgcatagctgcactcctttggctctgtggaaaacttcttcagggaccgaggcagcccctctagctgcactaacttttctagctgacagcgtcttccattgaacatgagccatgctttgagcaaggagggaaccatatccagtacatgtgttgcatgtcactaatccacgtgat

SEQ ID NO: 20463 - DNA, 1765 bp, Zea mays
gaataaaacgatactgcactgtgcatgtgtaaactgatcaaaagttatttcaaattactatacatcacgttggaaatggccagacgtcgccattttttattttcactgaacaatatatacagtgatgtacttatacacaggaaatccaaatatgcagaatctaatactgcaatacgcacagatatcttctttaatagaaaatacaagaatcacgcagccttctgtacaatgaaacactgcacactgaaagaaggcattcattcgtgcccaggaaataactatttccccagccactcgaagcagcagcagaggccccagcaaaacttcgaaggatagtctcttatgaacacatccctgctgtagccaacgacatagaagctaaatgactgcttgcgacgcgccattgtgacacgggttacaggcacaactgaaatgatgtgtctctcggaaataacccttgcagatggtggaactggcagccggctagcgatgacttctgatgaaaactggttgagtgggtatgaatcagcaaaaaatgcaggagtgcactggtatgcctgtatgttgcatagctgcactcctttggctctgtggaaaacttcttcagggaccgaggcagcccctctagctgcactaacttttctagctgacagcgtcttccattgaacatgagccatgctttgtgcaaggagggaaccatatccagtacatgtgttgcatgtcactaatccacgtgatccacatgctatacaaggtaacattcctttaccattgcacattccacatactgtatcagatccatcttggtgagcaagtaaacctctgccatgacatgcaccacactgggtcatctgatttgctttataaaacccgtgagcctgaccagcattgcatgtagggcatggtttctctccacgaccctcacaatctgagcacttttcaataatatctgaatgtggaatcttgacggtcacttctttctctggtacaaaaagtacaggaaacttagacctcaaatcaagttcccacaatccaggcaaaggacctttttctcttccatctatattcccactttcaaagggctccttttttgtaataatgtatctttcctcgatgaaggtttccaaggtgccaacatagacattgcagtcctcaatggaggtaattttccatgtgcgggcagggtgacttccccaacagcatcgatgtccaatatggtcaatgagtagctgtcggatctccacctcatccagtacatccctcccgacgctctcagaaggttggtaactgccaccatacggatatggcccttgaggaacaatcgccaacccttcatttggatggggagacggtggggcatgagatggggacggggagagcatggcgctatgaatggacggcgggtaagcataggcgttgtcgccgttgggaggtgggccctggaacgtgtggaagccagcggcggacctgacctcgtcggcgctcacctcaggcccttcccagcccccgccaccgccgcgcagcactgaagaggtgctccggcccaggaactggtactgttgctgctgcgggtccgccgcggctggcggggtggaggagaggagggggcggcgttgctcctcgccgtcgcgctcctcctcgacacccatggatccagggactgtgtttggtcgggggaggacaggaccgggattaccgagtccaaagactccgctgcgcacaaggcagaaggcacaagtgcccccgccgagctcccgagggtacc

SEQ ID NO: 20464 - DNA, 1236 bp, Zea mays
actcctatgggcgattgggtccctcgaggccggccgggcagccgcccggcacacgctcagatccacaagatactaccccagaaccgctacaccaaaccgagacgctaacccaaacggacaaacccaatcagaccgaatgggcaccgcatcaccggactccggcgaccttatcgaggtggggccggcgaggccgggatctccggtagccgtggtgaccatcaaccggccttcggcgctcaacgcgctgacgaagcccatgatgatctccatggcggctgcgttccggcggctgggtgccgacgacgccgtggcagcggtggtgctcgcgggccgcggtcgcgcgttctgctccggggtggacctgacggcggcggcggaggtgttcaagggcgatgtgaaggacgtcgccacggaccccgtcgtgcagatggagctctgccggaagcccatcgtcggcgccatcgccgggttcgccgtcactgccgggttcgagatcgccctcgcctgcgacatcctcgtcgctggacgctccaccaagttcttggacacccacgccaagtttgggatatttccttcctggggtctttcacagaagctttctcgcatcattgggccgaatagagcaagggaagtgtcactaacttgcatgcctgttactgctgaaatggcagagaggtgggggcttgttaaccacgtcgtggatgataatgaggtgctgagtaaggcgatagaggttgctgaggctattgtgaggaacaaccgcaacttagttgtattgtacaaatcggttataaatgatggatttaagctggatttggagcatgctcaagcacttgagaaggaaagaggtcacaactattacaatggaatgacaaaggaacagttcacgaatatgcagaaattcatccagggccggagttctaagaaaacaccatcaaagctgtaggttgctggtgacattttctgtggtccgtgtacgatgtacagctactgaaagcgtgttcagtagtctgaaaaataaagatgtcggtgtggcaatatatacagttaccgtcttctcatacttttacgtaagtttatgtttatttaccgtctgattggttggttgcatcgtctcgtcctagatcactgtgtgcattgactttatttgaatatttgtttggttgcctgtatatctggagcatgagttccacgagtggatacaaaataaatcattttgagaccctttgattgcaa

SEQ ID NO: 20465 - DNA, 1090 bp, Zea mays
tcttgcacatgtataccggactttgttttcaatcagttatcatttgtagtgatgtaaaaaatattatagttgtctcatgacaccttagaaccatagtattctaaaccatggttctaaaataatttgcttccaaacattctcttaaggctagtttggaaacttcatttttccaagtgatttccataggaaaatgaactaatctactttggaaaaatgaaaataacacgaaaaaatatagttcccaaactagcccttaaactatatgcgtatagctgagaaactaaatcctatgcagtacaaatcatttgggaacttccaatatttcagagagatctcggcttgccacagctcaattttccaagttggcgttcaaaattgatgatttgacgaagtactgattcctagggcaagaaattctgggataaggttacatggcatctacctgaatacagcagaacaaatggctcgctagtcactactgtatctaatgacaagatccacgataaattgcgggcatctcatccaaaatgcgacatgattacaatgatttacatcgctacaaatagaatgggcagcaatgtggctactaggtgagtcagccagcacgactgggattttgaagcaaaactgtccgggcttacaggcccggatgctgttccaccgttgctgccgttggcgccagtgcttccactgaaaatgcatgaaccatggcttggatcagtcgatgttatcatcgcggtgccattgaagttgcatgtaccaccactagactgtgttctatggtaataatcgttgaaagcataagaagcaacagctgcaatatcatctgatgcatagcatggttgcccaggttgaactgcactgcagtttgcagaaccagggccacatgcccaatccaaactatgcttcagtgcactatgggatgcacttgaatttgccacacaaaacaccccacgcaaagctggtgattcaggaatagctgtggccacgtcctcaaatgatagagaatatatagtggttgcattgggaaacataatcccccaattttgctctgatacaggccctgaccgattagtcctcggtgaacccg

SEQ ID NO: 20466 - DNA, 712 bp, Zea mays
  misc_feature (53)..(53): n is a, c, g, or t
taagaagaaccacacgagtacgcgagtacgtacgggacgacgagacgagaganaggcgtcgtcggttccgggccccccctttttagagagacgatgcatgtgttgtttattcagggagacccattcaggctatctccacttcgcaatgcgggaacaacggcaaaatgctagctagtgtagcgaaatcccaatccgtcgacccatgacttggcaagcactaggatcaacgatcaggcactggtcggctgcacgaagtgctgcgccacgatgcggcgctggatctttccggtggctgtcttgggcaggtcgtccgtgatgaacaccttcttgggcaccttgaaggacgccaggttccgccgacagtgcgccagcacctcctcctcccgcagcgccgacccgtcccgcgggatcaacgcgcagttgatctcctctccgtacttgtcgtcaggcaccccgaacgacaccgcctgcgccacgccggggaggcccagcagcacggcgtccacctcgatcggggagatcttctccccaccgcggttgatgagctccttgatgcgccccaccagccggacgtacccttggtcgtccaccacgccgatgtcccccgtgtggaaccacccgaaccggaacgccatctcgttcgcctccgggttccccttgtaacccgccgtcacgttgtccccgcggacgcacacctccccgggggctcccc

SEQ ID NO: 20467 - DNA, 1884 bp, Zea mays
ttttttttttttttttctttttttttttttttttttgagagacgatgcatgtgtttgtttattcaggttcagtcaggccatgtccacctcgcaacgcaatgcgggaacaacggcaaaatgctagctagtgtagcgaaattccaatccgtcgacccatgacttggcaagcaccaggatcaacgatcaggcactggtcggctgcacgaagtgctgcgccacgatgcggcgctggatctttccggtggccgtcttgggcaggtcgtccgtgatgaacaccttcttgggcaccttgaaggacgccaggttccgccggcagtgcgccagcacctcctcctcccgcagcgccgacccgtcccgcgggatcaccgcgcagttgatctcctccccgtacttgtcgtcaggcaccccgaacgacaccgcctgcgccacaccggggaggcctagcagcacggcgtccacctcgatcggggagatcttctccccgccgcggttgatgagctccttgatgcgccccaccagccggacatacccttggtcgtccaccacgccgatgtcccccgtgtggaaccacccgaaccggaacgccgcctcgttcgcctctgggttccccttgtaacccgccgtcacgttgtccccgcggacgcacacctccccggggctccccgccgccacgagccgcccctcctcgtccagcaccgccagctcctgccccaccgcgcgccccactgacccgggcttccgtggcccgtcctccggcagcgggtttgacgtcatcaggtgcgacgcctccgtcatcgcgtacgcctccagcaccggcgcgctgaacgccgcctccagccgctccaggatcgccggcgccagcgacgcgctgcagctgcggatgaatcggagcgccgggtacgcctccggccgcgacgcgtgccggtccaggatgatctggtggatcgtcggcaccgccgtgtaccaggtggcgcccgacgcccgcatgtcggcccagaacgtggacgccgagaaccgccccgccgccggcagcgccacggacgcgcccgaagccagcgagctcagcagggcgcagaggagcccgtgcacgtggaacagcggcagcaccaccaccgtggcgtccgtctcggcgaggcggtacacggaccggatgttccgcaccgacgccgccaggttgcgctgcttcagcggcacgcccttgggccggctcgtcgtgccggaggtgtgcaggaacagggccacgtccgacgggtcgttgggggagagagagcccgccgcgccgccgccgtgggacccgttctccggagcatggaccgggaggccggcgaggtggacagggccggccgcgtcgtggaggctggcggtggcgtgggcgagcccgagcttggcagcggcagcctgcgctgccgcgttgccctccgcgttggtgacgaggaggcgcgcctccgagtcggagaggtagaactcgaactcctcctgcgtgtaggccgggttgagcggcgccgccacgccgcgcgcgcggattaccgccaggaacatgatcaccagctcgacggtgttggggaaggagagcgcgacgacgtggcccgggagaactccggcgtcggcggcgagtcgtgcggccgccgcgtcgacgagagcgtcgagggcggcgtgcgtgagctccagcctgcccggtacggcaactgcgcggcgggtcgggaaggcggccgccgcctccttgagcagcaccgtcagcgtggtggcctccgtcgtcgccatagccatgggggggaatcggggtgggcgagagagcagagcggagatgggctgttgcgtggcgcggtgggtgagtctctttctgtttggggcttgtgcggcttgctgagctgagctgcccgtggt

SEQ ID NO: 20468 - DNA, 1469 bp, Zea mays
ttgaaacggagttcagtccaccagcagccaacactgaggacaaagcgaaaagaaaaaaaaagggaaaaggggctggtgcgcaaaaccctagcgcagtcgcatccatcatggcgatgtccatcttcgtcggcggcgactccggtgcgctcatcgcgccgtccgcgtcctcgctccgcccgccgttccgtcttgccgctggtcccaagggccatttttgtacttttcctcatggagcatctagcaatcacagccggctatgtgttgaacatcaaaggtgttctcgcagctccacccagaactatgctctttctaggaaggatttttctcctataactcaagatgtggaaggcttccttcacaatgttgttaacatgggttttcttgaccgtctgaaattagcgtggaagataatgttttctgcaccaaccacaaaggatacctccaatgcaaacatcgcaaaacagaggcttaagatgatcctgttctccgacaggtgtgaagtcagtgatgaggcaaagaaaaagatcgtggagaacatcattgaggcactgtctgagtttgttgagatagaatcaagggataacgtccaagtggatatctcaactgatgctggccttggcaccgtgtactctgtgtcagttcctgtgcgccgtgtgaagccagagtaccaggaatctgaagagcagtacagagggaaaattgtcggtgtcgacttcaaggacactggagaatcctcagggagcgttgacgtcacctttgacttctttgtacccaatgagaactaattccctggacttctatcagagtgcggtctgcaatgtttcatctgttcgttgaatttgtgagccctctgggtagaaagttagaatgctttgttctctacagtgatgtaaatatctagggtccctgtttgctccatgtttcctgtaatttggttctggaattttgtcagagacctgcgttggtaggttcttggtaaaaccataactatgttctcattgttgagaaaataacgtccagttgctgtcttcaccaactgtgataacatgccattcaaaaaaaaaaaatccgcggccccgatttgcttaggttcaacctggcattacttgatatccaattcttggggaatacaattctgttcagattgctatgtacaaaggatggcatattggcatgggtttcagaatgcgcaggtcacgtacaactgccgcgaagctgatgatgtgggctacacatctttcaaatgttctttatttacaagcgagtaataaattccaagactccttaagcatgattaaaccaaattaaaagaccaattgatataatctactaagagcaatgccaagactccttaagcatgattaaaccaaattaaaagatatgccatgaatataccaactggaacatgcagattgctaggatacaccaattgaaacatatgcaatcaaaagagaatggaattatccaag

SEQ ID NO: 20469 - DNA, 953 bp, Zea mays
atgcagccgttccaacttccttccaaattccaacgagagtccagtctaccagcctccaacactgaggacaaagcgaaaagaaaaaggggaaaaggggctggtgcgcaaaaccctagcacagtcgcatccatcatggcgatgtccatcttcggcggctgcgtcggcggcgactccggtgcgctcatcgcgccgtccgcgtcctcgctccgcccgccgttccgtcttgtcgctggtcccaagggccatttttgtacttttcctcatggagcatctagcaatcacagccggctatgtgttcaacatcaaaggtgttctcgcagctccacccagaactatgctctttctaggaaggatttttctcctataactcaagatgtggaaggcttccttcacaatgttgttaacatgggttttcttgaccgtctgaaattagcgtggaagataatgttttctgcaccaaccacaaaggatacctccaatgcaaacatcgcaaaacagaggcttaagatgatcctgttctccgacaggtgtgaagtcagtgatgaggcaaagaaaaagattgtggagaacatcattgaggcactgtctgagtttgttgagatagaatcaagggataacgtccaagtggatatctcaactgatgctggccttggcaccgtgtactctgtgtcagttcctgtgcgccgtgtgaagccagagtaccaggaatctgaagagcagtacagagggaaaattgttggtgtcgacttcaaggacactggagaatcctcagggagcgttgacgtcacctttgacttctttgtacccaatgagaactaattccctggacttctatcagagtgtggtctgcaatgtttcatctgttcgttgaatttgtgagccctctgggtagaaagttagaatgctttgttctcgacagtgatgtaaatatctagggttcctgtttgctccat

SEQ ID NO: 20470 - DNA, 1368 bp, Zea mays
acaaccaaaatccaaaaacctcgtcagtttgggaacagcggaaaaccggccccccgcccgcctgctaggtgctagcaacagcagtcgccgccgatgggggtggactactacaaggtgctgggcgtcggccgcggcgccaccgacgacgagctcaagaaggcctaccgccgcctagccatgaagtaccatcccgataagaaccctacgccgcaggccgacaccctcttcaagcaggtctccgaggcctacgacgtgctcagcgacccgcagaagcgagccatctacgaccagtacggcgaggaaggcctcaaggccggcgcgcctccgcccgccgcctccacgcacggcgccggcgccggcgtccacaggttccgcttcaacacgaggagcgccgaggagatcttctccgagatattcggcggcgggtttgctggggcaggcccccgtacccccggcggcggcgtcccctccgggttcccgatgttcggcggcgctgctggggcaggggaggcgtcgagcgcggcgtcgcagaggaaggcgccgccgatcgagcggccgctggcttgcaccttggaggacctgtacaaaggggccactaagaagatgaagatctctagggatgtccttgacgccaccgggagaccaacaaaccgtgaggagatcctgacgatcgacatcaagccaggatggaagaagggcacaaagataacctttcccgagaaaggcaacgaggcacgcaacgttgtgccatcggatctggtgttcatagtagaagaacgggcgcaccccaggttcaggagagacgggaacgacctcatctacactcataagatctctctggtggaggcattgacaggctgcacagtccaagtgacgactctggacgggcggaccctgaccgttccggtgaagtcggtcgtcagccctacatacgaagaagtcgtgccgggcgaaggcatgccgatcacgagggagccgtctaggaaggggagcctgaggatcaagttccagatcaagttccccactagcctaacaggcgaccagaaggcggccatccaacagcttctgtcttgaagctctctctctctctctgtgtgtgtgtgtgtgtgtacaatgcgaggagtgttttcgtttgtggagtagttgtagtagtgacattagctgaatgcaccgtcacgtttttttttcatgctagtgttggcctattcttttctagctttggtggagctgcagctgtttgcgacatggtcatgacgctattcagtattcagatagattatcagttgctatgtctttgttggatcgggcctgtttgtttggtttctatagcttctacagtgttttttgtctctaaaaaaaaaaaaaaaa

SEQ ID NO: 20471 - DNA, 1310 bp, Zea mays
ttgggtacctcgaggccggccggggacgtggcagcggcgtgcccccccaaacgtttcgatatcccagagtggtgtggccgccgccggcggcttctttctccccttccattccgctccccgtgacgtcaccgaccaggcaagcactccgctccaccagagccgcctcgcctgtctgtccgacccacacacctaccggagcgcgcgtcccgaggtcggcggagcagggtcgggaggagggaatggcggtggtgggcgtcctcgcgctgcagggatcctacaacgagcacatggccgcgctgaggaggatcggggtgaagggggtggaggtgcgcaagccagagcagctcctcggcatcgactcgctcatcatccccggtggcgagagcaccaccatggccaagctcgccaactaccacaacctgttccctgcacttcgagagttcgtcggaggtggaaagcctgtctggggaacctgtgctgggctcatctttcttgcaaacaaagcagtagggcaaaaaacaggggggcaggaacttgttggaggattagattgtacagtccaccgaaacttttttgggagtcagcttcaaagctttgagacagagctttccgtgccaaagctttcggagaaggaaggagggaatgatacatgccgcggtgtatttatacgggcacctgctatattggaagtaggtccagatgttgaaatattggcggattgccctgttcctgttgacagacccagcattacaatatcatttggggagggtactgaggaagaagagtattcaaaagatcgggtaattgttgcagtgcggcaagggaacatcctcgcaactgctttccacccagaattgacatcagactccagatggcatcgtttcttcttggacatggataaagaatccccagcaaaggcgttttctgcgctctccctgtcgtcatcgtcaagagacactgaaggcctgccaaagaataagccgtttgatctgcccatttttgagtaacgctaaagacaagacaaaccaaaagattgaaggaacgaagaaactgaccgtatttattatcgatcatcatttagccggttacaaaaacagccagctgagaatctgtcatactcagccgaaaaaagtgttgtctggtagctaacttgtacggataaaaaataatcacgctgtgtgctgtacgcaattctcatcagataaagcgaaacattgttttcctgggaattatagttttgctgaaggtgaccagttgaacacttgaacatggttattctttccccctccgtgcggcttggttcaagagcc

SEQ ID NO: 20472 - DNA, 1106 bp, Zea mays
gctttcggtgtgtgtgtgtgtgtgtgtgtgtgtgtgtgtgtgtgtgtgtgtgggtgcagcgctgacgaggatcggagtgaagggggtggaggtgcgcaagccggagcagctcctcggcatcgactcgctcatcatccccggtggcgagagcaccaccatggccaagctcgccaactaccacaacctggtggttccctgcacttcgagagttcgttggaggtggaaagcctgtctggggaacctgtgctgggctcatctttcttgcaaacaaagcagtagggcaaaaaacaggggggcaggaacttgttggaggattagattgtacagtccaccgaaacttttttgggagtcagcttcaaagctttgagacagagctttcggtgccaaagctttcggagaaggaaggagggaatgatacatgccgcggtgtatttatacgggcacctgctatattggaagtaggtccagatgttgaaatattggcggattgccctgttcctgttgacagacccagcattacaatatcatttggggagggtactgaggaagaagagtattcaaaagatcgggtaattgttgcagtgcggcaagggaacatcctcgcaactgctttccacccagaattgacatcagactccagatggcatcgtttcttcttggacatggataaagaatccccagcaaaggcgttttctgcgctctccctgtcgtcatcgtcaagagacactgaaggcctgccaaagaataagccgtttgatctgcccatttttgagtaacgctaaagacaagacaaaccaaaagattgaaggaacgaagaaactgcccgtatttattatcgatcatcatttagccggttacaaaaacagccagctgagaatctgtcatactcagccgaaaaaagtgttgtctggtagctaacttgtacggataaaaaataatcacgctgtgtgctgtacgcaattctcatcagataaagcgaaacattgttttcctgggaattataaaaaaaaaaaaaaaaaagaaaaaaaaaaaaaaaaaaaaaaaaaaaaaaaaaaaaaaaaaaaaaaaaaaaaaaaaaaaaaaagcaaaccacatataaaaaacaa

SEQ ID NO: 20473 - DNA, 2361 bp, Zea mays
ttttttttttttttttgaaaataacaaaggcagtccatttccgactccagtttgtttttttcttctggtctcataatatgtttgaagatccaaatttaagcaacctgaaggaactgtaaactgtttcagtgaacacataaaagagacgaaactacaacatgctacaatgcagcgaaagaggccaagtttggtttgggacaaacacacatgtcaaagaggattcagttcatcctgtgtctcttgttctgttggaggcttccaccatccacatccaatgaacctgatgcattgctcctccctctcctcctcagggatcccgaagaacctgcattgctaggctctcctgcactttcagagataccaccatccccttgtatcacagcaacagtgcttgaattagacgcttggtctgcagaaggtgcacccgcaatgcgagctccatcgactgctggctcattattttgaagattcgatgatgaagcagatcctctatattggtttggtgaagcgattcttctaaagtcatcactcatggcaccagctgtgtttgcaatgccaaaagcaagacgttccaacaattcaagtcgtcttgaattgcttcctgccagacgttccaacaatgcattgtttcctgtcagaatttctgatggattgtttcctgtcagaccattatcaggggggctagtggaagaaccatcaggacggctcaaagcttctatttgaaaccgccttgccctcatccttgaggccaatgccaatccacttaggtgatcatgttgacgaatgtcatttatttcttgcgtggctgattcagatggcccttcaagcctactcacgctgcccaggatctgctgatccagaagacgcctccatgatgacagtatcccatgcgcctcaccaagccttcttgagataggtcgaatatggtggaattgctgccagaagctttcaaggcgatgtccatgtggcctcggcgggattgtaggacctggtgacttccagtcctccacagtcttctctgcatcagaattccctcgaccatatattggagtaatatttgcctcagttacctcgcctttgcagactgggcattccttgtggctggagtaaacattcaaccattgatacaagcacgaccagcagaagagatggccacaggaagtgactaccggctcactagccatctcaaagcatatgttacactcgaatgcggtggcagtcttgctgcgttcctcagaggaattctccggggcacctaattctaagccattgggagccaccttgtttaattcattagcatcagctgcaggctcatgctggggcactggctcggtggcgtcctgcccagaagggcgagcctcggagctgaggggtggaaggtcagacctgaaccgcctcgtgcgaagccaccggcttccagtctgctcgagcagcagcccgcaccgagcggcggtgtctgggaagaaagatgaagaggccgttgacgaggaaggacgctcttcccagcccagcagttcgttggcccgcaccagcgggggcgggggcgggggcggtggcggcggatggaaggcgtaccgaagttcccgaattccctctcggagccccgagataagcgaatccggaggcggcatgttccgcggcccggggataagcagttccggaggctgcatgtacgacatatgcgcatccggaacaggcgagtcttcggggttgtaggggaagtacacctccagcggaagcggcggaggggagaggtcggcgcgggagtgggtgtacggcgggtgcatggactcaggcggcggcggcggtgcgtcgacggacgctgcggaggacgaaggagaggaaggcatcggggtgctgagggcgagatcggagccgaggtcagagcggcgcgggcgcggggtgcgggggggaccgaggtaaaggttcagatccatcctcccactgctccccacggcctcatcggcgtccatccgacggcgaaccgcgcccccacagtcccacccccgccccgccgacttggcgcgcacctcagcgaggccgggggccgcaagaagcaaaccctatctaggcgcacggacacggcgccagggtccgggtcatgggcggaggatctgggatgccctagctgcctctgtcgcgagaattaccgagcgtcagggacgcagggtgcggcgccggcgatgaggggagcggtggcggcgattgggatagcggtctagcggacgcgcggtcaggaggtttgcggcaagcggtctcagaaaaaactagggctgggttggagctcccggccggcccgcggggctacccatattaaacctcctttaaacataaatagtttatttttatcataaataaaat

SEQ ID NO: 20474 - DNA, 1481 bp, Zea mays
gggggccaacagatctcatcataaagaatcagcacgtctccaaaactccaaaattcgaatttgcttacaagtttggttcactgaagcccaaaaaaaaaaaaccttcagagacaagtatgtttacagccgaagtagcttatgaaactgccgatgggtgaccaactcagtgaattcctagctaaaatcaagcgtaacacattttccagtgttggaacaaattctcacagcaccccgaaccaaccaggcagtttgtccttggaactaatcaagtgtaacagcacagggaggatctaatcatcataatccaagccatcttcgtcgtctagctcggaactatcaaccccacccatcagcgaaaggaacacaagaactgcaacgagttgtgtggccaggaaatactttgctcttcgcctgaatttcttttcctcctccgtccgttccttcttggctctgggttttggcttataactgtggtcagcagatggtcttctcctgggggtggatgatgatgggctaggtgatgatcctaaccctgatgatgatgatgatgaggcttccagcaactggaccttgtgatgctcagcaaagctcaccaagttgtcatgcttctgcaaagtgcccctcagcacagatgtatcaggcaacgcactgagaacaaaaagaacatgtccaaggaaaagagcatcaacatctgtagggctattatcaaatagaaagacttgatcccctaatctgaaagacaatgactcatatgcagcacttgccttctggtatatctcctcttctttttctgcagcattgagctttgttataccaagtagctgcttcacatgtctagttttattccaatggagtatctttccaatgggccaagggagatcagagaagtagatatcatttgcaatgcttccatcactaaccacccagagttcatacagcaaagcattagcaagccaggacgaaaccatggccttcgtgtctagcacagtggtggatgaaatatttgggtgatttgagttcaagtcaacaattttctcatccttgagatactcaattacgcctcctttctcgttgttgaaagccacgcaatccccaaattcaacatatggtatgtgatcggcatcggggaaggaggtgtcgacgtggatgtcgaagggaacctgcgccatgcggaggtagaggagcacggggaggcaggttgggcaggccgtaggtagcccgaagcagggcttgcgcgccaccagcaccttccgcgccgccgcctcccactccacggccgccgccgatgccatcgccgaggtgagctgggtgggggtttgccttgcgcaaaggggttcttttctattcatatgttttcgattaggatgttctaggtaatggtctcgtgcgaattcctgcagcccgggggatccactagttctagagcggccgccaccgcggtggagctccagcttttgttccctttagtgagggttaattgc

SEQ ID NO: 20475 - DNA, 1926 bp, Zea mays
cggacgcgtgggcggaccgtgggtgtacattcaacgattcgacgtgtgtagtgtgtgagtttagacactggggtgaggcaataaaaaccctatcccagtaaacgccgcggcttcttccgctaccaccttcatccatcctggcgtcggtgtcttgccctgccccagcgccgccgctccttcccccaccccgaagcgccgcctcttctgcctccgtcgacggtggtggtgctcctgatccccgccgttgaactggccataggagagcaaagaggaaggggaggccacgagggcgccagtagatatattcatcttcatctcggcttgcgatatttttgaattttctattccgtattgaaggcgtcgatggccttgtccgccctaatcagcaccctcctcgccgccgccatctggtgcgccgcttacctcgccgctgccatctcctccgccttctgattcccactccccactccccaaccctaacctcccccctgtagcacaccccacctccagctttgtaggtcctactatacttgcaacctctcccgccgactcgcttcgatctacccgccctcgcgtcaccatggggtacgcgcagctcgtcatcggccccgctgggagcggccagggtcagccccctggccctttcgactcccgtagccttcccccttgcctttgggtgactgctttgctcgcccgctgggggacgggctctgatggtgttccggtgttccctctgctataatgtttcagttccttcttgtttcgtagtgatctggtagggttttgtttcccgtgcgaggcgatttccttctctgtttcgggtggggttaagtttggataaacaaattcccttttagattacaggggacagagggcaatgaactgatttcccaactcaatcccctgctgtacacatgaattaatcttgggttacggcacatgtacccttaagatcacttgcaaaaagatgtttaacttttgaatacttgccgcactggggtctagggtctgattaaggaggaggtagatgatagcttgctctaattggttacttgtggcgtgcttgcagtcaacttattgctccagtttatacgaccattgccagaccgtgggaaggacaattcatattgtcaatcttgatccagctgctgagcacttcgactatcctgtagatatgggtaatttttctgcttaattgttacaatgtaaagctcttgtccacagtaaagtattgctctgacttcttattgccttgcattttggtagatatcagagagctgatttcattggatgatgttatggaggagattgggttggggccaaatggcggtctcatctactgcatggagtatcctgttatttaagcattatatttgtttattttataggctgccaaagctatgtaattgattagttctgaactaatgcacttctgctggtgcatttttacacttattgcttgctaatgggttggacctgcaaagccagactgttatgagctgaaactggatttgctttaccttttttttgcacttgtttgttctgtgagactgatattttgagtttcaacatttattacatattattttaaagggcacggttcattactttgaccattagaacataagccctgtaaaatgtgatcatgcaatcattggatgtaaactgatgagacagaatgttgcaggatggattgtctcaaggactaatatagtcaacttatgacaatgtaataattcatgaagatattgttccttatgttcatggtgtttgttttgttaggattttatgctttcagtttctgtttccttaacaaaacctcaggcaccttgaagacagcttggatgattggtttgatgaacagctagagaactacctagatgatgattatcttgtgtttgattgccctggtatattctcgattca

SEQ ID NO: 20476 - DNA, 1640 bp, Zea mays
atccaccaccaccatgtgagcagacaaaggttggctacagaaacaggaaaagaatagtatatccgcccccatattgatcctccccacgtcgccgtgctcgttttgcgcgtccaccagcccgccccccaaccccacccagcgcgacgaagccggggggcgatcgctccagcgccgccggcgacctcgccccgggagccgccggcggtaccccgctctctgtcccgcctcaacgaaccctcaggtccaagtagttcgtttcgtgagttatccaaagttgcgccgcaaagatgagtactgctaatcgctaccaacacatcaagtcaactaagcctgttgtaggcaaagcaagaaaattgaaggatctcatgataaaaagtgacaataggatatgtgctgactgtggtgcacctgatcccaaatgggcatctgctaatattggagtgtttctttgcttaaaatgtggagatgttcatagggcacttggacctgacatctcaaaggttttatctgtaactttggatgattggtctgatagtgatatcgactccatggttgaggttggtggaaactcatatgcaaattcaatttatgaggcttttcttccaaaagatcacccaaaacccaaaccagattcaacgatggaatataggacaaaatttataagagctaagtatgagacacaagattttttgaagccaagtttgcgcatttcatcaagatcatcttttaaatctaccacttctgtgaagagtgtagatagcaatttctctagcacttcaaggaaggatgtctttgaagatacaagagaatttgttggagagttgaatatcacactggtcaaaggcaccaacttggccgttagagacatgctaacaagtgatccatatgttgttttaacgctcggagggcagaaagttcaatcaacggttaaaaaaagtgatctgaatccggtatggaatgaagtgcttaagatatctgttcctcgaaattatggacctctaaaacttgaagtgtatgaccatgatatgttctcagccgatgatatcatgggtgaagcagagatagatctccagccaatgatcacagccgccatggcctttggagatacttcacgtcttggtgacatgcaaattgggaggtggttcatgaccaaagacaacgccctgatgaaagatagcacggtgaatgttgtggcaggtaaggtaaaacaggaggtgcacttaaagctacagaacgtagaatcaggtgagttggagttggagctagaatgggttccgatcctctagactaatgataactcccctgatctttgtctaaaaatctatactcaagatgcatcgatgtttccaagctgtccacttgatggtcttggacatttttgctggatggtttgaatttgttaaaaatgtcactgtagaatatcatggtgtaactgtcggttgtactcgcgcctttcacccccctcccggtaactggttatcatgccttgtaagcactcgctgtctcttgattgttgttgcattgtcccattgaaaggacctgtgtcttgtaagagatggcaattatagccagtgaactctttgtgctgatgccatgttggcgctgtagtagctaagaaaaaaaaaaaaaaaaaagcggcc

SEQ ID NO: 20477 - DNA, 892 bp, Zea mays
attcgacgtgtgtagtgtgtgagtttagacactggggtgaggcaataaaaaccctatcccagtaaacgccggccggccttccgctaccaccttcatccatcctggcgtcggtgtcttgccctgccccagcgccgccgctccttcccccaccccgaagcgccgcctcttctgcctccgtcgacggtggtggtgctcctgatccccgccgttgaactggccataggagagcaaagaggaaggggaggccacgagggcgccagtagatatattcatcttcatctcggcttgcgatatttttgaattttctattccgtattgaaggcgtcgatggccttgtccgccctaatcagcaccctcctcgccgccgccatctggtgcgccgcttacctcgccgctgccatctcctccgccttctgattcccactccccactccccaaccctaacctcccccctgtagcacaccccacctccagctttgtaggtcctactatacttgcaacctctcccgccgactcgcttcgatctacccgccctcgcgtcaccatggggtacgcgcagctcgtcatcggccccgctgggagcggcaagtcaacttattgctccagtttatacgaccattgccagaccgtgggaaggacaattcatattgtcaatcttgatccagctgctgagcacttcgactatcctgtggatatggatatcagagagctgatttcattggatgatgttatggaggagattgggttggggccaaatggcggtctcatctactgcatggagcatcttgaagacagcttggatgattggtttgatgaacagctagagaactacttagatgatgattatcctttgtggtttgattgccctggccagattgaactcttcacacat

SEQ ID NO: 20478 - DNA, 1508 bp, Zea mays
  misc_feature (1492)..(1492): n is a, c, g, or t
  misc_feature (1496)..(1496): n is a, c, g, or t
  misc_feature (1501)..(1502): n is a, c, g, or t
  misc_feature (1508)..(1508): n is a, c, g, or t
ggccgggacttccgctaccaccttcatccatcctggcgttggtgtcttgccctgccccagcgccgccgctccttcccccaccccgaagcgccgcctcttctgcctccgtcgacggtggtggtgctcctgatccccgccgttgaactggccataggagagcaaagaggaaggggaggccacgagggcgccagtagatatattcggcgtcctccgggcccgcccgggatttttgaattttctattccgtattgaaggcgtcgatggccttgtccgccctaatcagcaccctcctcgccgccgccatctggtgcgccgcttacctcgccgctgccatctcctccgccttctgattcccactccccactccccaaccctaacctcccccctgtagcacaccccacctccagctttgtaggtcctactatacttgcaacctctcccgccgactcgcttcgatctacccgccctcgcgtcaccatggggtacgcgcagctcgtcatcggccccgctgggagcggcaagtcaacttattgctccagtttatacgaccattgccagaccgtgggaaggacaattcatattgtcaatcttgatccagctgctgagcacttcgactatcctgtagatatggatatcagagagctgatttcattggatgatgttatggaggagattgggttggggccaaatggcggtctcatctactgcatggagcaccttgaagacagcttggatgattggtttgatgaacagctagagaactacttagatgatgattatcttgtgtttgattgccctggccagattgaactcttcacacatgttccagttctgcggaactttgtcgagcacctgaaacgaaaaaatttcaacgtttgcgctgtttaccttcttgattcacagtttgtcagcgatgtaacaaaatacatcagtggttgcatggcttctctatctgctatgattcagcttgaacttcctcatatcaacatcctttcaaagatggatctggtctccaacaaaaaagatgtagaagagtacctggacccgaatgcacaggttcttctttcacagctgaatcggcagatggcacctcggtttggcaagttgaacaagtgtttagctgaactggttgatgattacagcatggttaatttcattccacttgatttgagaaaggaaagcagcatacaatatgtgctatcttctatcgacacctgtatccagtatggggaagatgcagatgtgaaggtcagggacttcgaagaagacgaagactaaccactggcactggatgctgtaggaggtgcaaactggttgctagcagtcgtgtagtgcggagtgagactttgggactgtgtatggtggcgcaggcatgcaaaaacgtcgtaggatgctgatgacagctatctggcctatgtaagacgaactaaagcagatatttggcaagtcctagtaaaatgtgtgtgcgccttgatggtcctgttctccctcnatanaatannaaaaan

SEQ ID NO: 20479 - DNA, 1557 bp, Zea mays
  misc_feature (792)..(793): n is a, c, g, or t
  misc_feature (872)..(872): n is a, c, g, or t
cttccgctaccaccttcatccatcctcgcctcgcgtcgctggcttcccctgccccagcgccgccgctccttcccccaccccgaagcgccgcctcttctgcctccgtcgacggtggtggtgctcctgatccccgccgttgaactggccataggagagcaaagaggaaggggaggccacgagggcgccagtagatatattcatcttcatctcggcttgcgatatttttgaattttctattccgtattgaaggcgtcgatggccttgtccgccctaatcagcaccctcctcgccgccgccatctggtgcgccgcttacctcgccgcatgccatctcctccgccttctgattcccactccccactccccaaccctaacctcccccctgtagcacaccccacctccagctttgtaggtcctactatacttgcaacctctcccgccgactcgcttcgatctacccgccctcgcgtcaccatggggtacgcgcagctcgtcatcggccccgctgggagcggcaagtcaacttattgctccagtttatacgaccattgccagaccgtgggaaggacaattcatattgccaatcttgatccagctgctgagcacttcgactatcctgcagatatggatatcagagagctgatttcattggatgttgttatggacgaaattgacttgcgggcaaatggccggcctatctactgcatggagcaccttgaacacagtttgtatgattggcttgatgaaccgctttacaactacctagatgatgattatcttgtgtttgatgccnntggccagattgactctttcacacatgttccagttctgcggaactttgtcgagcacctgaaacgaaaaaatttcaacgtntgcgctgtttaccttcttgattcacagtttgtcagcgttgtaacaaaatacatcagtggttgcatggcttctctatctgctatgattcagcttgaacttcctcatatcaacatcctttcaaagatggatctggtctccaacaaaaaagatgtagaagagtacctggacccgaatgcacaggttcttctttcacagctgaatcggcagatggcacctcggtttggcaagttgaacaagtgtttagctgaactggttgatgattacagcatggttaatttcattccacttgatttgagaaaggaaagcagcatacaatatgtgctatcttctatcgacacatgtatccagtatggggaagatgcagacgtgaaggtcagggacttcgaagaagacgaagactaaccactggatgctgtgggaggtgcaaactggttgccagcagtcgtgtagggcggagtgagactttgggactgtatggcgcaggcatgcaaaaacgtcgtaggatgctgatgacagctatgtggtctatgtaagacgaactaaagcagatactccatttggcaagtcctagtaaaacgtgtgcgcgccttgatggtcctgttctccctcaatgctccgttggttttttatcaaaatcaattcaacggttgccgtatttatagaaaaaaaaaaaaaaaaaaaaaaa

SEQ ID NO: 20480 - DNA, 1633 bp, Zea mays
catgtcaccaaggttgcaggttggctacagaaataggagaagaatagtatgtgagccccatataatcctccccacgtcgtcgtgctcgttttgcgcgtcaaccagcccgccccccaaccccacccagcgcgacgaagccggggggcgatcgctccagcgccgccgcgccagcgacctcaccccccgggagccgccggcggtacccccctccctatcacgcctcatcgaatcctcagatctaagttttttttggttttgtgagttatccaaagttggaccgcaaagatgagtactgctaatcactatcagcacatcaagtcaaccaagcctgttgtaggcaaagcaagaaaattgaaggatctcatgataaaaagtgataataggatatgcgctgactgtggtgcacctgatcccaaatgggcatctactaatattggagtgtttctttgcttaaaatgtggagatgttcatagggcacttggacctgacatttcaaaggttttatctgtaactttggatgattggtctgacagtgatatcgactccatggttgaggttggtggaaactcatatgcaaattcaatttatgaggcttttcttccaaaagatcacccaaaacccaaaccagattcaacgatggaatataggacgaaatttataagagctaagtatgagacacaagattttttgaagccaagtttgcgcatttcatcaagatcatcttttaaatctaccaattctgtgaagagtgtagatagcaatttctctagcacttcaaggaaggatatctctgaagatacaagagaatttgttggagagctgaatattacagtcgtgaaaggtactaacttggccgttagagacatgctaacaagtgatccatatgttgttttaacactcggagggcagaaagctcaatcgacagttaaaaaaagtgatcttaatccggtatggaatgaaatgcttaagatttctgttcctcgaaattacggacctctaaaacttgaagtgtatgaccatgatacgttctcagccgatgatatcatgggtgaagcagagatagatctccaaccaatgatcacagccgccatggcctttggagatacttcacgtcttggtgacatgcaaattgggcggtggttcacgaccaaagacaacgccctgatgaaagatagcacagtgaatgtcgttgcaggcaaggtaaaacaggaggtgcacttaaagctgcagaacgtagaatctggtgagctggagttagagctagaatgggttccgatcctctagactatgataactcccctgatccttttgtctaaaaaactatcctcaagatgcatcaaaattttcaagctgtccactttgatgatcttggacatttttgctggatggcttgaatttgttaaaaaaatgtcattgttaaatatcctggtgtaactgtcagctataatcacagcctttcatttcccccctttggttgtcatgccttgtaactactcgccgtctcttgattgttgttgtattgtcccattgaaaggacatgtgtattataagagatgggcaattatagctagtgaactctttatgctgattcctttttggcgcgcgctgcagtagctatcgtgttattggtttt

SEQ ID NO: 20481 - DNA, 4156 bp, Zea mays
  misc_feature (2905)..(2905): n is a, c, g, or t
ccggccggaaatcacctacacaaaacaactcatccctgaatcccgcaaacaccatagcagatctccgtgttgctcgcgtccattggatgcgctcgggttgctggggttcgacctccctataaagcaaggcaccgtgatttcccctagcatcccacctagccgggacctgagaacgaagagagagcgaggaggatccgccgcgagctcctctgcatctcaccggtaatcagccaatcattgaggccaagaaggggggttcgctagggagtgcacggacactggatcaaggaagacaaacagaagattcaataatttctagccgaacttgggtttcgtcaccggtccgtcccgcggcatgggcgaaatcgccgccgcggccatctcatgtgcacaccgctgcgccacccatggagagctactagggatctttgccattggttctgggtcctgcggctacctttctggggtcgaatgggacctcgagtggtggatgattgctcgccggaatcctaggggtatcaccggccgcaccacgccgttgccaggcttccccacgtctacgccacaggtaccatggattctgggtattacacaaatctcctagttaatggtattgaagaatctcaagcaactcgtggtgatgtaagaatacagcatggtcgtgcaacagccaagagttctcagggtagaagcaaaaattttagagatgaggaggacattcttcttgtgtcagcttggctgaatgtgggcatggatcctattcaaggagttgatcaaacacatggcacactatggagaaggatacatgaatatttcaatgcaaacaagaagtttgactcaaatcgttctgaagtatctttaatgaatcgttggtccggtatacaacatgatgtgaatctgttttgtggatgtctgtctagggttgaggctaggaatcacagtggttggtcaattgatgacaagatcgcaaatgcatgtgtaatgttcaaggccgaagaccccaaggataagaagttttcatacctgcattgctggaaaatcttgaaggacaagcccaagtggatggataggcggaaggaaattggaagtgcaaaaaaatcagccactaagaaacagaagacaacgacaaattcttctccagcatcaattgcaaatgcaattgtcgtagatgcccctcttgggggtgctatcatgatgaaccatcatgcagacccgacggtaagaagaaggagaaacaaaagctacgacaacgtacgtccatggaagttgtagactatctaattgcaaagaagaaagattctgaccttgaaaaggacttgaagaaagaggagaggtgcaataaagcctttgctctacaagaagaaaggatgaaattggacaaagaaaagtttgcgttccaaagacagctcgaagaagacagaataattggtttggaccttagcaccatgaactataaacaacggcagtattatgaagatcgtcagaacgagattcttgcaagacgtttcaatatctagaattttctagttttagttaagtatgctttgtcaacaaacttgttttagttcaacatttcatctaagtaccatcttgttcaagtttcagtttgtaatggtttaaaggtcatgaatcaacttccataagcatgtaataaattaatggctttatagtccaagatgatttttgctgctagatttttctgttcccagaatttcctttcccttttgcttgacaggggacatcacatggtactcaaaaagggattgaattttttcaagtttcgtgtagtggactgaaaaaaggaactgcatggtacacaacaacagaaaaaaaattacaagatctcgtttggatatttcttgaaaacataaatatttgattcatagattatcctcaccttttgtgaacacgtaactccacacatgattgcaggcaattgaagtggaaataaacagtaaccatgtttactgcacaactttgttcttattacataaagtagataaaaataaataaatagcacattaatcaattttatataactcagaatggttttgccacaagtgctcgatcaggtctgccttaagctgatagtgggtttccttgttcttgatatttttgtatttttttaatgaatgcatcgagttcaggtgaagaattgtgtgacactatcaccctttgtcccatgtcgtcgtagttgcaaagatattgtcccatatcgtcgaagttgtaaacttgttctcctccgtactcatcccgtttgtcttcaacaatcatattatgcagtatgatgcaagccatcataatatcatggagtgtgtcttcaccccacaaacgagccgacccacgaactatagcaaagcgagattgtagaaccccaaatgccctttcaacatcctttcgacaggcttcttgtgcctttgcaaaatattttttcttattaccttgtggctctggaatggtcttaacaaaagttgcccacgatggatatatgtcatctgctagataatatcttattgaataatcatgcccatgatgttgtacttaacttgtggaccttctccctcagcaagccttgcaaatataggagacctatgaagtacattaatatcattgtgtgaaccaagcatgccaaagaatgcatgccatatccatagatctttagatgcaactgcttcgagtataattgtgggcttctttttatgtcccctgtacatccgtgccatacggtaggacaatttttctagctccaatgcatacaatctatggatcggagcgtacctggaaatcctctacttgctccaattgcaagcaacctagttgtatcctgtttgttaggcaatctcatgtactttggtccgaatacctcaataacagctactataaactttcacaaagcttccagagnggtactctcaccaatacgaatgtattcgtccaaagtgtcagccggaactctataagctaacatacctaaatagcgattaaaatttaaatagacacactttaaaagtttcatggaccggttaacacacccacgcctaaaaaaaccgtaataggaaaaacgactccacacggtccacggcgtcttctccggcgaaccttcgcgagccctcggctcccctctaccaccgctgccgcgaccccgcctccggagcatcctcgggtagcgctctggcttcccgtgccgccggacgtcctgcaggaggcggcggcctccgtggcatgttgatgagggccgccgctgccctccctcgccgatcgtcgcggccctcggagccggggtcctcctcctcccgggctcccgcccctggggcctcctccagccgggctcctgcccctggggcctccttcgaccccttcgatgtcgataccgacccgccatcacggcctgagctgacgcccgagcagatcgggctttgcgtcgacgcgctcgcgcatttcgagtacaaggggaagcgccgggatgacttgtccgacgagttcagaagcctctcggtatcggatattagacatatgaaaacgatcagtgtagctcattttgcttcgaagcaaagcacggctgttgctattggatcgatttaatgtgaagcatcggggatctgctcggagtgtgttggtagaggatgccgtgtatgggtactcaataagttaaatgtcgtcgctaaagtcatctgcaatacaaggttttaatcatatttttttgttttaaaaaatagtaaaatgtcactaccatctggctcgagtttgatttctatctgtctagaagaaaaggctgccaaagtttctttacactagggtattcataaatgtaaggtgtattttatgccttacatggacagtcatctaggtcagatatatttattcgcatcattaaccttcttggagataaactcggaaggggcgttctgtcattctgtaatatggccaatctgccatatccaaccaacatctccatgatctgttgatcagctgttcttcagtctgttcacttaagagcccagttttggcgtcttatacaaatgcatgaaaatctatagaagttgtattgaaaaaacaatacaacttccatcctttaaaactttcagaaaccatcttgcataacacaacagtttataatattcttattcttttgaagcagacatgatgctgtatttat

SEQ ID NO: 20482 - DNA, 1474 bp, Zea mays
acccacgcctaaaaaaaccgtaataggaaaaacgactccacacggtccacggcgtcgtctccggcgaaccttcgcgagccctcggctcccctctaccaccgctgccgcgaccccgcctacggagcatcctcgggtagcgctctggcttcccgtgccggcggacgtcctgcaggaggcggcggcctccgtggcatgttgatgagggccgccgctgccctccctcgccgatcgtcgcggccctcggagccggggtcctcctcctcccgggctcccgcccctggggcctcctccagccgggctcctgcccccggggcctccttcgaccccttcgatgtcgataccgacccgccatcgcggcttgagctgacgcccgagcagatcgggctctgcgttgacgcgctcgcgcatttcgagtacaaggggaagcgccgggatgacttgtccgacgagttcagaagcctctcggtatcggatattagacatatgaaaacgatcagtgtagctcattatcctgttaatagagaaaagaaccgatatattgatgtcttaccatttgacgataccagagtacagctaaaatcctcagcacggcctccaaacaacgattacatcaatgcaagctttataaaggctactgagaacaacagagttgcaacatttatttctacacaaggtccactagtgaagacatttggagatttttgggaaatggtctttgaatatcagtgccctgcaattgtcatgctcacccactttgacagtattaagtgtgataaatatcttccaccgggaagtgaacggcgaacatatgggaattatgatatcaagattacaaagacaagaacagacagccaccatttacagttgcgtgatgtcaaggtgcaaaacatcgagacaggcaaggttcattctgtactccatatagaatatcctgattggcccgaccatggagtggcaactaatacagatgctgtacgggaaatctggaaacgactgcatcacattccaacggaacatcctatagttatccattgcagtgcaggaatcggaaggactggtacttacatcacaatccatactacaattgagcgaattcttcttggagataaaagctcttacgatcttgccaaaactgtaaagaattttagatcccaacgacctgggatggtccaaacagaggaacaatacaagttctgctacagggcaattgctgacgagctgaaagacctgctaaattcagatcattgaggtgggtcacatgagacggacagcaacgctgttagcatttattacgtttttttagacatttctatgtgaaggaacacttaccctttagaggagtgaattagtcaatctcagttctctttaaactatgtttgttctagtcaaaatctatgtaataaaaaatctatcatatgtgaagctatgctatgtttttgactaatcgttgctattaccaaaaaaaaaaaaaaaa

SEQ ID NO: 20483 - DNA, 2601 bp, Zea mays
  misc_feature (2316)..(2316): n is a, c, g, or t
  misc_feature (2359)..(2359): n is a, c, g, or t
caaatttgtcatggtgctagtgaaaatagtctagtctagtcaagaagcaggccatcacatttaaacacagataaatataaattatagtgttagtttacccaaactgcatgacaaggtgacttggttagtttcagaaatagatgtatctgaacagtgaaaaacaaggattaataaacagcagattaacataaactaaggtattatacaagttacagcttgcaaaaaaagtactatcctgcatgcttggaacattaaaatggaaacatcaaaacagtacttttccaataataatttacttaacttacaacatattatgcaaaccaaggagaactcagttattgatgtcatcaacatatcatgaaaacagtgtaatgatcaaaaaaagaatttgtaaaaaacactgtaggacccaatacccttgttggtaaaccgatctaagatctatatgttagcaaaagatatcttacattcagatttcagacattctgaagctgcatccccacattcttccaatgacaccactatgtccaaggcatacaatagacaatggataaggtggtctatgctacttaggcttgtttggatacgaggggcgagggctaattgttagctagctaaaattagccctagtacatccaaacatgagggcaaatagatggtccaattttttagctaattcttcaattagttgttagacaactagctagccagccttcagctaatttggactaatttttagccccaactgtaactagcttatgtatccaaacaggtgcttagtagaaaataacaaattaggctgcttctttcttcttcttcaggttaacataaatagtgggattccatgcaatccctgaaactcaataccaagtaaagccttgtttggtatcattgcaaaatgataatcctcacccagtagttccgagttgataccatacaaattgtgtgatggaacattaattgacaaaattgaaagagcacagtccacactgcacagcacgcaggtctatttagatgcagcgagatctcgcgacggatctggtctagttaacaggcaagatttatcaacctcaccagaggtagccggggatcttgatgcggaggaagagcatggccatggcgtaggcgatgacaacggcgactgcgccggcgcttccaaacgagacgcggaggctccggggcctcgtgcggtcgacggcgaggtcgaggaggatgatgccaatgccgccaaggaggaacatgaacccggaggagagtccctcgatgatgtactggccgttgacgcgccctggaaggaagacgacggggcggacggcgccagtgccggggtcctgggcgctgccgatgccagggggctcaacgatgacgtcgtacacgagtccggagacgaccgcaaagtaggtgagcaggatgagggagaagacggtcatgggagagggaagcgccaggttcgacggcagcctcaggcgggtgcgcggcggcaggaggaaggagaagggtagcacgcggagcacatggaagagtggatcgatggagtcgaagtgggcctgcgtggccgccgccgcggcgccgctgccggcggcgtgatccgatctagggggcatcgccgcgttgagtgaggagagaaaaatacagagcgacgcctggggtttgggctttttgagaaatgggggaggggtagagtacttctgctaggcatttttccgaatgttttccaggtctgcagactgcagtgctgctgtatatgttttactactgtatttattttcttctcaacaaacggatagcttagtgttgtgccaataattcaaatagtttatatatgacaaaataaatgtacatgctgcatggatcaaactacatataggccatgtcggagtttattttgaacaccataagtacacatcatgttcataacttcatacgattaaaacttgccaaaagatttaattagaaaaatacaatggtcaacacttctggtatgaaagtaactacttattttctactgtattttcaatctaatctcatcaaacataaataaaaaatgaagacaagattgcctggaaggaatttagaagtgcaaataagctaaatataatgaagtgcaggaatagcgaaatctatgtaatagaccaatacaaaccactgttctaagagttatcaactctggttgaattcaatagaatacagactgcattagcagatagcttcattgagaaaacagaaagcatagaaggaaaccagaaggttgggaaacaaaaaagctaaaattcaatttagtggctgcatagtggttcttgaagtactctttctctnagaagtgaagtttttcttgtatgtcatgaggaagaacggagcnaattttccatctaaaactctggataattttttttcgattgtacctgtttggatgtaatttttcaggttagtccacgcaaattcaattttaagcatgtgctatcagcataaagcagagaaacaaaatggttgctcgtcattggagttttagttttgtgcatgtaagttataaggcattttttatacggagcacggaaatatggtggatagatgcaccatagtgatcctcatttctagttgtct

SEQ ID NO: 20484 - DNA, 2866 bp, Zea mays
  misc_feature (133)..(133): n is a, c, g, or t
gtctttatactcagtttagatgttgacattgaagaagatggaattgaattggattaaataccaaatcaagcatggtattgaaatgagtgtaattcaaattcttttgtttggatgtcactgaattggagtttgnaattatacgatctacttccacgcaataccgaggggtgaggcttgtattggaagatgaggtttttagttatagttcaattccagggaattgtgtctctgtttccaaaaccttaattccacatgtaaccaaacaacataatttaggaaacctaattccaattcccagttctgtgctccaataactacatccaaacagggtattaacgtaattcataagattttacaagccaaacaaaatattgtaccagagagccttattctagtagccaggcacaacggcaagagatcatctagaaccctttatactataataatgggagcaattgcgaaagggtctctagctctctgttttaaaggtgtccatgaggtggtacgacgcttaggcgccttggtcgcctacctcgcctaggtgtccagcggcgagccaacgtcttgtctcaccataccgctttaaaaactatgctctacctgactgcctccataccgctttaaaaactatgctctacctaagttggttagataatctgagtagcatttctcgggttctaagttcgattatctgcgggaacaaatttcaggctatgctctacctgattacctaagtttgattagctattttgtcactctcagttatagacttctctattttagccacatgcccacaaatcatagacacaaatggtcccaaagtcatagacagaaagatatataatagcagagagcccacgttagaagggctaaaatagcaattttttccatctcggaggtggtagtgcaactagacagagagagaggactcatatctggcagcttcaggaagttactccacaaagtctgcatatgaggatttcttcattggtgctattcatttcagaccatgggagaggattcagaagggttgggcacctaacaaatgaaaatttttcatgtggttgattgcacataataggtgttggacagcagactgcctggcaaaaaggggctgcctcaccctgaaccatgccgctgtgtgatcaggctgaagaaacaattaaccacttgctggtttcttgtgttctctctcgccgtgtggttttatatcctcgtagggtcggcttacaggacttatctcctcagcctgcagatgtcgacttcgatgactgggggcaagcacatacaatgggcttgatgatcaggcaagaaagggcattaatccccttattatcttagaggcctgacctatctggtgccacagatacagacgtgtgttcaatgggatccaacctagtcttcaaaggaaacaccaaaacagtacttttccaataataatttacttaacttacaacatgttatgcaaatcaagaagagctcaaagttactgatgtatcaacatatcatgaaaacaaatgttcatttttttgtaaaaaaacaatataggatccaatacccttgtgggcaaacagatttaaattctttttttcaacaaaatacatctcacgttcagacaatctggaactgcggcccgacattcttccaatcacaccaatatgtccaagaaaatccaatggccaatggagatacagggaatgttacttaatactacctccgttctcaaatatttgtcgcccgctagttcatttttgaactaaaacacgagaaataaggccgcgcggtgggagtacaaaatgacaaattatattgatataatcaactacaccatgttgatataaatagtgtggttccacacaagccatgaaactcaatactaagaactttgtctactaccattgcataatgatatcctcgcctagcaactctgagtagatattatacagcacatggtgcgatgtaacattaattgacataactaaaagaggagtaagctagtccacgctccacagcacgcagatctatttagatgtagcgagatcttgcaacggatctggtctagttaacaggcaagattttatcagcctcaccaaaggtagccggggatcttgatgcggaggaagagcatggccatggcgtaggcgatgagaacggcgactgcgccggcgcttccaaacgaggcgcggaggctccggggcctggtgcggtcgaccgcaaggtcgaggaggatgatgccaacgccgccaaggacgaacatgaacccggaggagagcccctcgatgatgtactggccgttgacgcgccctgggaggaagacgactgggcggacggcgccggtgccggggtcctgggcgctgccgatgccggggggctcaacgatgacgtcgtagacgaggccggagacgaccgcgaagtaggtgagtaggatgagggagaagacggtcatgggtgagggaagcgccaggttcgacggcagcctcaggcgggtgcgcggcggccgaaggaaggagaatggtagcacgcggaggacgtggaagaggggatccatggagtcgaagtgggcctgcgtggccaccggagcggcggcgctgccgccggcgtgatccgatctaggggccatcgcgccttagagtggggaagggagaaaatacggggtacgcttgggtttggcgtttgtttctagttatggcactttaggtgcagcccattgctttagaagattacaatcatatcatataatgatgcaagtacatacaaagtttttataacaattcttcacacaaattatgtatccatatattcaaccgagagttatagtattcaagcatgtttgaactttctagatatgagttaattctatataacg

SEQ ID NO: 20485 - DNA, 1115 bp, Zea mays
ggcaaacagatataaaatctatgtatcaacaaaatacatctcacgttcagacaatctgggactacatgctgtcattctttcaatcacaccaatatgtccaagaaaatccaatggccaatggagatacagggaatgtaacttaatactacctccgttctcaaatatttgtcgcccgctagttcatttttgaactaaaacacgagaaataaaaaagaacggatggagtacaaaatgacaaattatatcgatataatcaactaccccatgttgatataaatagtgcagttccacacaagccatgaaactcaatactaagaactttgtctactaccgttgcataatgatatcctcacctagcaactctgaataggtattatacaacatggtgcgatgtaacattaattgacataactaaaagaggagtaagctagtccacgctccacagcacgcaggtctatttagaattttagatgtagcgagatcttgcaacggatctggtctagttaacaggcaagatttatcagcctcaccaaaggtagccggggatcttgatgcggaggaagagcatggccatggcgtaggcgatgagaacggcgactgcgccggcgcttccaaacgaggcgcggaggctccggggcctggtgcggtcgaccgcaaggtcgaggaggatgatgccaacgccgccaaggacgaacatgaacccggaggagagcccctcgatgatgtactggccgttgacgcgccctgggaggaagacgactgggcggacggcgccggtgccggggtcctgggcgctgccgatgccggggggctcaacgatgacgtcgtagacgaggccggagacgaccgcgaagtaggtgagtaggatgagggagaagacggtcatgggtgagggaagcgccaggttcgacggcagcctcaggcgggtgcgcggcggccgaaggaaggagaatggtagcacgcggaggacgtggaagaggggatccatggagtcgaagtgggcctgcgtggccaccggagcggcggcgctgccgccggcgtgatccgatctaggggccatcgcgcctttgagtgggcaagggagaaaataccgggcacccccgcgggcccccaga

SEQ ID NO: 20486 - DNA, 3161 bp, Zea mays
  misc_feature (2559)..(2559): n is a, c, g, or t
cgctcgtccttcatcgctcccggcccatcggcacgaacccgtatgatcttcactttcatcgtcgaccaccgtctctgtactgcacacctgcagtcacaagccgggagatatgattgcacaatacataatctcatacccgggttagtctaaaactcacgtcaaagtactaaccatgttggcaataactcattatcaacccgaacgacaagggtctgaagatataagtattagtaatactttttacaatctagtacttagaaaaattgctagcacgtatgcaagcttgtcttaagatcctcgtatattccataagaaaacaatagtctcaaaactcaaatttaatatatttgtaatctaattagcgtccttgtctagttcagcacctcctttacatcttgtttgcctcgcacgaacacgcccaaatggcaactactataactaatggaggatgggaaaagatgagtgtgtgctaaagttaagctccattcaacggtcgacacgtaggctggagggttctgatttcgcacacatggaatggaattaccttttcgatcacacgtccttgtccgcacagtcctcggatccccctgacccggctcggcgcctagcacacagagttagccgaatccgccgccatgtacagtgaacggaatcatcgagacccctatggcccctgtacgctagtgactagtgagcctcccctcccacggccccaccccgcaggccccaggtggtggacgaatcccgtgcgggcggcgggcgttcacgacgcggtggagggtggacggccgccggtcgcccgcgaggcacggtccgctccagcttcgcgtgcggcagcggcagggcagggcagggcaggcagccgcggggggtcctgatcctggggtctggcactggcaggcacgcgtcgtgcgtgcaacatgcgatgctgccagcgacagtggtcccttgctcctcggcgcgggcgcgggcgcgagcggaacgttcaggcagggcccccccggccccgacccggcggcatgtcgaccaaggaacatcatccggccagagtggcagccttggggtggtgtggtgtggtggcctcatcactgcctcagctcgtcgcacggtgcatgcacgatggatcgcgagatgactgattggcctggccgaactgattggccctagctttccgtgcctcggccggcctcttgcgtgcaggcgggtgtgcagtctactccggccgtgattaccttgtcttaccggtagtacgtactatgtactatgtcatttattatcatgtcgtgcttaattggacgggcggtcgcagctggtcctggtcggctctgctggcgattcgttcgccgtccttttgcagcgacgaacacgtttgcacggcaacccaagcctttttatttcctgctatgctggtcaagagagcgtacgcacgcaaacttcgcgctaattacgtagttatggttatggcacgtgtggtttttgtatgcaatccctgtcggtgtcagttgtgatgatgtggagtgtctttttagctctctgcagtgcagcatcctctgtcgtgtcgttagctaaacgaatatttgtatacgcggccgccgtcatagcttttcctagataaataggagattagtggggagcactatttctgaggccactcttgtttcatttcctaattcctaacttttaaggttccctgctattgaaaacagtgtatatagacaagttttcttcttcttcttcatgtggtactaattttattctataaaacttttattatctctcttcttcgtctttacatgacataccaacttatttaacatttataaaactcacatgaaataacctatactaataaggctaattttaaggacaacagctttctacgttttttttttgtttgataaaggaagcaattttattagtatccaaggcaatacacatcaaaaggatacaaagtcttcgtacgtttgaataacaagtgcatccctatcttcattggattagagattgaaatcgataaaagctgacttttatgccacggatggagagaccatgggcgaaggtcttggttttggaatacattcgtgtggccgattagattgagacctctaagcgatgtgtttcgtgccatgctttctctctcttagctaattgttctctttatagacatttacacgtgaaaggagattctctaaaaaaaaacctccccgttcacagcattatttgcttgtctctctagtctcacttctcctgctcggcctcctctactcgactactactccttgtcctctttcatctgaccttatctaataccatacacacaattactcccgtcgtttatgtatatgtccgatgtccaccctataagatcaagataattgatggcactccgctttgttaaaactactgaacaataattagaatctttgtatgtgcaacacaattggtagggaaacaaactgaactcttaacttttttaagggaagttattttgtcacacttaataacgaacaaatagtataagagggaaataaaatagcatatataattatattaaatttnattctttatcatagtgatctccatcactaagttctcgttcgtgacattacatttaggccataccattcacaagattcctacaaaaccaagttaaatggagaaccagacactacgacgtgatctaaaaagggagtgtccaaacaatctatctattgtatacaaatgctggttccatcaggttgatcaaatcaactcaattctgagatattataaatgcctcaattttaactatttatcatattaacaatcacgtgaggtagaaaataacaatacaccgaacttagatgtgttgccttttcgaacttaatgtgtacatgcattgttagcccgatggtgataccatctggtaagggcaaattgtgtgagtagtcacgaggaaaaagtgaactgatcttatgcccaatggtaattccagcaagtaagggcaaacaagttgtgcttctatagtggcacctacattattcatcccaatctatgctacaactaaacaaaaagtacaatatactagacatatcgcctatatgcaaaccatctagatcaaaaacttcatatgacccaactccaggttcactataggaaaatgggtatgctacacactagca

SEQ ID NO: 20487 - DNA, 2214 bp, Zea mays
cacagcaaaacatacaagatccgatgtgtccagtatttgcgttgggtgaatgtataatattatttttatgggctacatgttttcacttcaatgcaatgcgattgtactgcaatgaggtatgtagttccatgctttagggatcttgaacattgtctaattccatgcctttagggttcttcaacactatgtttcatggggtatatgcacaagtttgttttagatagttcaacattaatttgtaggccgtggtaactaatagaacactttgtttcatgtagccatggaatcggagaacgaaaagctccgtaaagctctgactactttgcttagagttgttcaaaagcgtagttgtgacatcgttgatgtcgtcaaatcagccttccagcctttcaactcaccattgttggattaaatgaaccgagcattagttgagattgacgacctcgccaaggatcttaaagacgtagcagtgcaaacccagtgggaggtagaaaatatgcctaactgtgaattaaacgaaaatcaacgagaagaggaaccaatagaggaccttctgatagaagatgcttcagaagacgagcttttgatagacgaagagtcaccaattaactatgacgaacttgtcggctacgacgatggtcgtgactactcaaccgacgacacatatccctactagtgttctaggttaaacttcagtagaagtattgtagcatgtttaggtctatgtccagctgtagttgtcggttggtatgttcatgcttttgggggagtttaatgttctggtctatgtaaactgaatccggttcagttactacaataattattgtgttatgttggactatgtttgccttactttataccatgttacatgatgactacatgctcatttatgtcatgtttgatctgcctgtattcaatagaatgggtagtgattggaaccaggtgatgtctcaatatggaagcttccttagccagattgacgagcagcctatcggaacacaatattctgaatttccagttgatgggcaacccgagggctcaagaacaccccctgttactaaaaagccaactcaaagaactaagctagcaaacttcactgctgaagaggacacaagggtatgccatgcatggcttgctgttagttgcgatcccattattaacacaggccagaaacgtcaaggattttggagtagaattactcaagcatacaactcaagacgaggaacattgccagaaaggtccacaaaatctttgatgagtagatgggatactatcaaaacacagtgttccactttcgctggatacatgatggcagtcctccgacagaatcctagtggactcagtgacgcagacaaggtaaatctttcatgtaacattttcacatcactatttagtggtttgtttgtaggttcctgttgtaaccatttgttatatgtggcagacatcactggcagcttctaggtttgcagcaattgagaagaagcctttccactttttacactgttgggccattcttaaggaccaaccaaaatggatggacaaccacatgggtcaacaacatcagcaagccaacgctaatcccacacattctaacactgtcgatttggatgcagaagaatctgtaccatcaagcttcacatccaagaggccccttggtcgagattcttcgaaggaaaaggcaaagaggactaaatctgtggacacatcttcatcagattctgagtttatgacacgcatgggtgatctttctttggagcgcctgtcagtgtacaaaacaggggttacaactgaggaaaagaagttggattcaatgaacagaaatgagaggcagaaattgctccttgaaaagaagaagttgaacctagagaaattaaggcttgaaaggcagaaactaaaggaggacaaggaagaggagataatgatcttaagcatggatttgagcaaatgtaaccctctcctccgccagtactatgaagccaagcaacaagagatactggcaagggttactgggtctacatcatctggccagtgaaggttccttacttaatatgtttgtttgtcatttatgaatgaggcgtactcggacatgttactgtgaggttgctgtcgtcagatcgtaatctggtttgtaccaaaatttttaggtcgtctttgaactatttgtttttaagttaatgttttgaaccatttgtcatggtttgtacctgaaggttt

SEQ ID NO: 20488 - DNA, 3217 bp, Zea mays
caccccacaaatgcggtttgatggcagtgcaaaagtgtttcaaagcctcatgtgccgtagattcaccagtgcgtatgtattcgtcaacggcatccgcaggaacacggtatgcaaggatacgaacaacagcaacaactttctgcagagcagatagaccaatctcacccgcacagtttggacgctgaataaagtatggatccacttgttacacaacatcaacaaggcgctcaaacacatggcgacgcatgcgaaacctataatggaaaatacagtgagtacaagtgtgaagcacgtattatggacgtaagaatagatgggcgtacgaaaaaagatacctccttgggaattgagcatccatgtacaccggttgggcgcaaaagtagttcgctcggattcttgcatcgccactcatatggtcacgatggattcgaacatgaccgggaattgaaccagcataccgacgctcgttgcgtgcacgacgcctaagatgttggtacgtcgcaacctccaactcatgttcttcatcttccatgtcttgcgtcatcctaagaaaaatattgcaatctacgtaccggttcattgttgtggagcactctaagtgaagtgttgaagcgtgagtgattatttatagaacggataggcttcggagacaagccatcctcttgttgtgcagacgaagctagtcgatggcttgttcaagaagtgtcatggcttacggtagaagcatgtgaatttgcaaacatattttgatactaataaaatactatgcgacattttatcgacaacaattacacactaaataacatcgaatgttaattaatttttacaattcgaaattattaatcaagcattgttttggagattattatttcgaaaattagtaaatacattattttgtgcatcctttgtatagcgtgaaatgggaagaaaacaaagaaaatagaaaatgaaatggaaaaaagaaatctgttaacactgtagctttagatgaccgaatttagaggacgttactggagaataagaagatatagaggacataatcttttagagtgtgctgtaaagaacagataataatcttttaggggatggaatttaggggacgctactggagacaaccttattctctggttcctgaactctattccatttaacaagattagtttagtctttgcagtacacagaattggtggcactcaattaatattctttctaacgttgggactgccctttggacagcgttaattagtaacggcaatgaaatttctctctatttgttcttgcgtgcgttagctcaaccgacgttctcgagaaacccatttcagtttagctccacccatgaatactgatcaatgataatgaatgctgctgtagtacttagtaactcccaatcctagctgttgtatataacaggcacgacacgtacggccatacgcagcatctgcacacagactaagtctcgaatcttccaatcccaacacggcaatgacgatggcaacgagcatctcggcggtggcgctgctctgcgcggccatcgtggcctccttcgtcccgctatcgtccgccggcgtctccctcgtctccctgacctgccgcaggacggcccacgagcgcctctgcatctccatcctcgcgcccgacagacggagcgacgccgccgagtcggtccagcagctcgccgtcatcgcgctgacggttgccaggaactccacgcgggacgccctgtggcgcacgacggtcctgggcggccgggctccgacgccgctggagcgtgacctcctggcgcagtgccgtgccctgtactcggagtgcctccgcgagacgacgaagacgatagccttggtgaccgctgcgagctacgacgccgcggcccgcgcctcgagtaccctccactggtacccggagaagtgcgagagcctcctgtacatgcagagggtggagtcggccatgaagcaaacaaacaagcaggtggaggaagagatgatcgcctcatcggatatcgttcacttgctgcttgctaggcgcggagcagacaaattaaacctagaataacttaggggtgtttggtttagagggactaatttttagtccctctattttataccattttagtacttaaattatcaaatatagaaactaaaactttattttagtttccatatttaataatttaggaactaaaattgaagggactaaagtttagtccctaaaaccaaacacccccttacctacggtgttgcaccgtgctcgcgttgcttaccacaaataaatacataatatggtttttttctaaacagttatctatataactattatttaatggagagaaaaattcgctgctctacctttttcatctttccagcccatctacaatatttcactctctaacatcgcatctcaggcttataataaaaagtgttctatgaaagccttaaaaggatctggaatacttagaatgggagcctgaggcgaaggtataagagattccatatcgatctcctctcgagtctcgatgaatgatgttctggtggcggtccaccgtgaagtatgatatgtacttttactttgccttttgcgtcgttcgacgcctcctcatcctccttgtcgcgccgttcggcgagctgtcgtagcacctcctcctcatcgtgccttatgaggtcatcgaagggctactgatcatcagcaaggagtgcctccatgggtggcttgatgatgttgatggtggatacgttggtgtgatctttagaatcggccatcttggggctgatttttgatagaatctaaacactcttggtcccagcagagtcgctaaaaagtttattagtgtcgatctggcacaaacactgggaagaaccacatggcggtgctctctgcgggagagcggagggtccgcgacatggggtcaaatggtctgcaacctcgctgcaggaacgactcctcctctgcactcttcccggacacggtctacacctgggtccggacggttcgcgatagcgtagaaggtcttcttcttcgtgaagaaccaggatcttgcctcccgagaggggccctatcggggaggagagttccaagggttgtcttggggtcgatgagccgcccaagacgcctctagtcaacatagagtcgaacagaggcggagaaagaggtcgagaaagactaatactaggcctagactaaggctagattactcctactactaaggaatggaaagaaccagtgc

SEQ ID NO: 20489 - DNA, 2929 bp, Zea mays
  misc_feature (243)..(243): n is a, c, g, or t
  misc_feature (440)..(440): n is a, c, g, or t
aaatataaaaaggaacaagatcattaatgaagagctattccaagattaataaggtactccctttgattccaaatttaagatgtttaggacattcacattgtctctaatgtaacactttgacttaaatttgtttggtaaaagtttagtatattaaatacaggaagttatattctatgaaatcattttcaatgatgcatatattgattattaatctatgaatctttttatggctaagttgatgangtttggcaaactagaatactaaaatggcctatatttggaattgaaggcggtattacattaagataagcttcattggtcaacattattctaaatgggtctagtttacttaggttgaaactgttgtggtaatctcacaattacgtgcactatcttcaacgccatgaaaaacaaaaatagattatccgatacgttgaatncatcggtaagggaaatgtagaaattgatgtgtttgcatgcatatgcctatgcatgttctttggaccgtgtcatatatatggaggtaaaacatacatgtctgtatttagggtccgaaagagtacacgtcgaacacctttaggaatgtttagggatgccataacatcagctacaataagaaaataggcaatattttgtgacttgtcttgaactaaagtcatgttacacaccatcatattaagaacatttttaatccaaaagtgcttgtgagttatgttaaccattccagaagcctagctatatgcctatatttttgtaatcatcagttgactctacgtcatgggacgttagataatgcttggtcgtttaaaacctatgctaaacaccatgatacccacctgcaatttagaatttgaaccacttatggaaatatttttttagataacaaaatagaagtatctaattattatttactaaaaaatagtagggttatggatggtcatatgtacgtatctagagttaggttgtttacacagctacagctataagaattcttagagctagtcatcatctcaagtttcatgaagctgctgataaactgaaagtatttgattgggcaatcttattattattgttattttgttataaaaacattctctaagccaaataatataatcctaccaaaaaaaggtgaggattttggctaatgctaatttaccaacaaagtatgtactgcagtagacaatagtactcaaaagtaaatgttggtctgttgtgtctttttattttacctgtgatgttcttatctctgggaacgtcaaccaacaacgctggtcctgcacaccgtttcaactcttttttttaattatttttggagaaaaagaaacccttcttaaagtacagtaaattctgaaagcaactttgatagcaatataccgttgaggacggcgagttcgagggtgtcgacattgaagcaggcgtcgtagtagtgctcgaagacgtgtcctagcacgtcgacgtgggtgccggagtgcgcagtgagccggagctccgagaagttagcgatgtcggagccgttgcgcatggaccgcgccagctgcaggaactcgccggagccctctgatgactcccactccggcatgtcctcgcggtagtagtggctgatgtccacgatccgcccgccgtcgaactcttcgcgccgctctggcgcaggcaccagcaccgttgctttctccgcctctgcctctagcacaccgctgcatgcctcctcagcgtgcgtgtagcccgggtgcgcggcggtctcgccggagacaaccgccaccaccggaagcagcagcagctgggagagaaggagcaggggcgcgagatccatggaatggatatgccttgactggggagtgggtgcccagcagcacagttgttgcattgtacgtgtcgagtgtcaggacgtagcagctaactaaagaacagtacaatacaaccgattgatgcgccgtgggagtctaatatttccacgtcattgcttacgaccacgttgaaaaaaaagtgttactttctcctcgtttcgttatggaaagaataacgaaggaggttggaaagagaagaagtgtacttcttaaacttaaactttagtagcttatgaatggagggcatcatatcatatacgctgattccacaagctctactttgctttgtttaattttaaagtacaatgcaggtgtgcatcggtttgataaacagctacatgccattgttgtttgtgaattgtgatgcgcaacacatttgatgactacaaaaaatacattatgtttgccttcaaccccgtcaacatcattcaactgaactagggccaaaccaatgcgaattagattattgtacaacattacaccctaaccattccagaaagccttacaatctaattctcacgatcatcgttttaccaaaaatcagttgcacaaagtgctccattcagtgtgcaaaacttaaacgaccaagacaaattctaataacaattgctgatggtggcagggagcccaaagagatataatgattggtcacaagttaaatatctgaacaggccagctgcgcttccggccagctgaactgattgttgtggtttcaaccgatatgtctatgctgcggtgctcagatgccctcacgatgctgatccgagacctgagcgccgtagctgcgcactcatctgtgccagccaatgcagatgaacccagggttgattcctccttcgccattgcaatgggctcttcaaaggtgaagattgtctgtgaccagtgagttggtgtagagagaagggagaggtggagaggacaacaggcttctccttgcagaatctgtcggtaaaccccgtgtcaaaccacaagacaatgccatagcaccaggtcactcctggcacagtggcactactttcactgagcatcagttcaaagcttgcagtaaaatccatctcactttccttcatacttgcaagatcaaa

SEQ ID NO: 20490 - DNA, 2002 bp, Zea mays
gttggattcaatgaacagaaatgagaggcagaaattgctccttgaaaagaagaagttaaacctagagaaattaaggcttgaaaggcagaaactaaaggaggacaaggaagaggagataatgatcttaagcatggatttgagcaaatgtaaccctctcctccggcagtactatgaagccaagcaacaagagattctggcaagggttactgggtctacttcatctgggcagtgaaggttccttacttaatatgtttgtttctcgtttatgaattgaggcgtaatcggacttggtactgtgagcttgctgtcgtgagttcgtaatctggtttgtaccagattttttaggtcgtctttgaactatttgttttcaagtttttgttttgaactatttgtcatgtttggtacctgaatgttttactatatgtgttgaactatttggtttcatgaagtgtgagcttggtgtagtttttgtgtagcatttgtacacacatgtggttgcatgacggtagtactcgttcttatttatttgaaacagcagcatcaagtagaacagacatgacactactacactaggacactgagacacacattacacacacttgacacatgaagtagaacagacatgacactgacacagacagtagaacaatgacaagtaaactaagacagttcgacagtagatttaagaacagccatgacagaacttgtttcattgcgtcctatgcaactccggatccatggcgcgcccagtgatggtgtatcagatcaacctgaagctgagtatatttgttgcggtctttcagttggttgtacctttgattgacgaagtcgttgcgctcttccattgaaccttgacttgtgtctgccagcactccgatgttttcaaaggttgtgttcaaagacaatggaccttcgtcttctactatcatgttgtgcaatattatgcatgttttcatgatgtccccaatgtgttcaggactccaaccgtatgcaggtccacggaccacaccccatctcttctggagtacaccgaaagctcgttctatatcttttcgagcagactcttgaatcgttgcaaagtgttgcgttctaacgtcgtaggggttacggattgtcttgacaaatgcgggccagtcagggtaaatcccgtctgctaggtaatatcccatattgtacgtgtgaccattcacagtgaatgaaactggaggtgtgtcaccgctcagatgcctttcgaaaaggtttgaacggtgaagaacatttatgtcgttgcaactacctggcagaccaaaatatgcatgccatatccacaggtcatacgacgcaacagcttccaagatcatggtaggatgtttaccacgccctgtaaacatccccttccatgaacttgggcagttacgccactcccaatgcatgcaatcaacactaccaagcataccaggaaacccacgtgactcgccaacttggagaaggcgtgcgatatcttctgcatttgctgcacggagataatacggagcaaacgcggtttggacggccgtgcaaaagtgtttcaatgcctcatgagcagtagattccccaatacgtacgtattcgtcaacggcatcagccggaataccgtaagcaaggattcgaacagcagcaacaactttctgtagagcagaaagaccaatctcacccgcacaatttggacgctgaataaaataaggatccacttgttgcacaacatcaacaaggcgctcaaagacatggcgacgcatgcggaacctcctacgaaattgagcatccgtgtacaccgggttggctccaaagtagtccgctcggattcttgcatcgccgcttcatgtgatcacgatgaatcctaacacgccctggaatcgaaccaccatgacgacgctcattgcgtgcacgtcgcctcctattgaccatgtgcctcgccaactgcaactcttcttcttcctcttccatttcttccatcaagcgcacaagaaaattgttttctaagtag

SEQ ID NO: 20491 - DNA, 2605 bp, Zea mays
ttttttttttttttttaaaataaggatccacttgttgcacaacatcaacaagggcgctcaaagtcttggcgttttttgcggaacctaccatacatttcatgtgtcataataggggtcatgaagttttgtacatggtaaaaagaatgtgttaattgtaaatacctcctacgaaattgagcatccgtgtacaccgggttggctccaaagtagtccgctcggattcttgcatcgccgctcatgtgatcacgatgaatcctaacacgccctggaatcgaaccaccatgacgacgctcattgcgtacacgtcgcctcctattgaccatgtgcctcgccaactgcaactcttcttcttcctcttccatttcttccatcaaccgcacaagaaaattgttttctaagtagggattcatggttgtggagtttgtaaaggcaaggttgagtgaagtatggaaggctcacttggtatttatagaggaagtacgcttcagatagaagccatgcgcttgtcgtgcaagggaagctaggctatggcttctcgaagaagagtactggcttacggtgcaagcttgtccatttcaaaacatattttggcaacgatattatactatgtggcgcgttaccgacaacaattacacaacaacaaaacaagcaatgtaattattattgacatttcgaatttattactttcaaaattaataaatacaattttttcgtatcatttatgtagcgtcaaatgagaagaaaacaaagaaaaatgaaaaagaaatggaaaatgtgaatctgttaacactgtagctttaggggacggaatttagaggacgctgctggagacggagaatatatagaggacagaatcttttagagtgttctataaaggacagagaatattcttttaggggacgaaatttaggggacgctgctggagaccgtattagttggtcacgtagcgggcggcgcacgtgccgtggttgctttgcttggaacagaagcgttggatcattccttgctcgtggtttaacagcggatctgctccacggctccaccccatggggaagagacttgttggttgttctcgtctctattggttggatcacgcgaccgacgcgtgacggcgtgagacggatgcgggtcgacaccacggaggtgtaacggcctaactggcagtcagtcaaatctgtcgtctctgtgctaggagcaactcatcggattcaaagcaggattggtcaatgattaaaatttattaatcacaaaacttggacaagttaaatttttttattactatttggttttctatcaagatttaataacatcgtatgcttgttttaccaaatttatggcaactttttttgtcagcttttagctacttttgtttgctaaatctttgatatattttttttgtagacactcaagcatcacctcaattccatgtgttaagaggattgagaaaacaaattttcaaacatagaaatgggtgtgtagtggatttgataaaaccccattcctatatttgtggaccctgcatgtgaatgaataaaaaagattgttatttcttccatatctggaacatgttattccctccgtcccaactcccaaatcataatttactcattttttttgccaagtttgatcgactagtcctattaaaaagcgataaaaaaaaccaagtcaaacttaaagtatattatatgttaaacaatatcaatatatcacaataaaaatcaaataataattttgatttttcaataagacgattaggcaaaatttgagataaaaaggtgaaacaaattataaattagaaggaaagagtatttcacctatttctctatatatactccatctgttctgtatggtcaccaaggtttgtcctaaattaaagttttaaaactttaactattaataataaaatattcataaaaattgaataaataaaaataaaacaattatatttattattaaaacagctagcacaatatataatttctttaattttaaaataattatttttttagatattagtggtcaaagttataaaactttaacttagacaaataccttaagacaggaaaaagacgggaacaaaggagtacagggaaaggaaagtctgtcgcgaaagggtaaagatggttcagtcgttccacggcatgagctgtgtttctacgcctaaacttcccttgcagcttcttctgctggtcgtggcttctcgtcggaaaagcgccgaaccacgtctattcatatcataatggaaaaacgcccaaccataaagtctggtagtggactggttttagggctagtttgggaactacattttcccatgggattcctatttttccaagggaaaatgaactaattttccttgggaaaatgaaaatcccatgggaaaacggggttcacaaactagcccttagtgtaaattattttagtgcgcccaacaacacatcagttacggactatcgatagtcattatctaccatcgagtagatagattttaccgtcaatattttgtatagatttttaattaaaataaaacacaacgtttaattaaaaatttaaaaatattcgagtacatagttgaacaaataaaaactacattatttataaaatcaaa

SEQ ID NO: 20492 - DNA, 1242 bp, Zea mays
ttttttttttttcaattgtcttgtgaatgaattgatgtattcttattttattacatacatagtttttttcaaactgcaatatagaaatatacactcccaaacacaaacataaattcaccccttgcaggggtggatttaaaacctggactggggtccagtatataaaactccatattgttcatgttttatgtagtatcttcagctcatattagtgtcgattggatcagtactagcccagctccatattattgggtcctcacaccatccctataaacacacgcatgaaaaccatacttctataagcacttcgaaaagactgaataggtaggtttcaagattgattgtacaatgctttttgggatggttataaccatgtcacttgatgaggatgcatcttgcaggagaaccttcagcaccccgcaatcttagtggcaagcaatgcaagatgtatattccagggctaacatgctccagattcaaggcttcgacaagtatgacctcccttttttcaagaaatactagatgagctggaatgcattcatcaaatgcgcccactgacaagtagtcaactccaactagtttgatgtctgtattatcaaccaaccattgtgcaccatcctgtctgtatttagggtccgaaagagtacacgtcgaacacctttaggcatgtttagggatgccataacatcagctgtgatgttcttatctctgggaacgtcaaccaacagcgctggtccgttgaggacagcgaggtcgagggtgtcgacgtcgaagccggtgtcgtagtagtgctcgaagacgtgtcccggcgcgtcgacgtgggtgccggagtgcgcagtgagccggagctccgagaagttagcgatgtcggagccgttgcgcatggaacgcgccagctgcaggaactcgccggagccctctgatgactcccactccggcatgtcctcgcggtagtagtggctgatgtccacgatccgccccccgtcgaactcttcgcgccgctctgggcgcaggcaccagcaccgttgctttctccgcctctgcctctagcacaccgctgcatgcctcctcagcgtgtgtgtagcccgggtgcgcggcggtctcgccggagacaaccgccaccaccggaagcagcagcagctgggagagaaggagcaggggcgcgagatccatggaatggatatgcgccttgactggggagtttttttttcgattaggatgttctaggtaatggtctcgtgc

SEQ ID NO: 20493 - DNA, 1269 bp, Zea mays
ggggttgggttttttttttttttggggggaagagtgatgggagccacatttttcaattgtcatgtgaatgaattgatgtattcttattttattacatacatagtttttttttcaaactgcaatatagaaatatacactcccaaacacaaacataaactcaccccttgcaggggtggatttaaaacctggactggggtccagtatataaaactccatattgttcatgttttatgtagtatcttcagctcatattagtgtcgattggatcagtactagcccagctccatattattgggtcctcacaccatcccatgtcacttgatgaggatgcatcttgcaggagaaccttcagcaccccgcaatcttagtggcaagcaatgcaagatgtatattccagggctaacatgctccagattcaaggcttcgacaagtatgacctcccttttttcaagaaatactagatgagctggaatgcattcatcaaatgcgcccactgacaagtagtcaactccaactagtttgatgtctgtattatcaaccaaccattgtgcaccatccttcatgaagccaacataacttgtatcaaattctttcttccacataagctttctgtctgtatttagggtccgaaagagtacacatcgaacacctttaggaatgtttagggatgccataacatcagctgtgatgttcttatctctaggaacgtcaaccaacagcgctggtccgttgaggacagcgaggtcgagggtgtcgacgtcgaagccggtgtcgtagtagtgctcgaagacgtgtcccggcgcgtcgacgtgggtgccggagtgcgcagtgagccggagctccgagaagttagcgatgtcggagccgttgcgcatggaccgcgccagctgcaggaactcgccggagccctctgatgactcccactccggcatgtcctcgcggtagtagtggctgatgtccacgatccgcccgccgtcgaactcttcgcgccgctctggcgcaggcaccagcaccgttgctttctccgcctctgcctctagcacaccgctgcatgcctcctcagcgtgcgtgtagcccgggtgcgcggcggtctcgccggagacaaccgccaccaccggaagcagcagcagctgggagagaaggagcaggggcgcgagatccatggaatggatatgcgccttgactggggagtgggtgcctagcagcacagttattgcaacccacgcgtccgcggacgcgtgggagcagctaactagagaacagtacaat

SEQ ID NO: 20494 - DNA, 2273 bp, Zea mays
tgaatatttgttttgaactatttgtcatggtttgtacttgaatgttttactatatgtgttgaactatttggtttcattaactgtgagcttggtgcagtttttgtttagcatttgttctctcttgtggttgcttgacagtagtactccttgttattgaattgaaacagcagcatgagacactacgacagtttgacactaagacagacagtacacacacttgataagaacagacatgacactaacacagacagtacaacaatgtaaagtaaacaaagacagttcgacagtagataagaacaaccatgacagaacttgtttcattgcgtcctatgcaactccggatccatgtcgcgcccagtgatggtgtatcagatctacctgaagctgagtatatttgttgcggtctttcagttggttgtacctttgattgacgaagtcgttgcgctcttccattgaaccttgagttgtgtctgccagcactccgatgttttcaaaggttgtgttcaaagacaatggaccttcgtcttctactatcatgttgtgcaatattatgcatgttttcatgatgtccccaatgtgttcaggactccaaccgtatgcaggtccacggaccacaccccatctcttctggagtacaccgaaagctcgttctatatcttttcgagcagactcttgaattgttgcaaagtgttgagttctaacgtcgtaggggttacggattgtcttcacaaatgcgggccagtcagggtaaatcccgtctgctaggtaatatcccatattgtacgtgtgaccattcacagtgaatgaaactggaggtgtgtcaccgctcagatgcctttcgaaaaggtttgaacggtgaagaacgtttatgtcgttgcaactacctggcagaccaaaatatgcatgccatatccacaggtcatacgacgcaacagcttccaagatcatggtaggatgtttaccacgccctgtaaacatgcccttccatgaacttgggcagttacgccactcccaatgcatgcaatcaacactaccaagcataccaggaaacccacgtgactcgccaacttggagaaggcgtgcgatatcttctgcatttggtgcacggagataatacggagcaaacgcggtttggacggccgtgcaaaagtgtttcaatgcctcatgagcagtagattcaccaatgcgtacgtattcgtcaacggcatcagccggaataccgtaagcaaggattcgaacagcagcaacaactttctgtagagcagaaagaccaatctcacccgcacaatttggacgctgaataaaataaggatccacttgttgcacaacatcaacaaggcgctcaaagacatggcgacgcatgcggaacctaccatagaattcatgtgtcataataggggtcgtagaagttttgtacatggtaaaaagaatgtgttaattgtaaatacctcctacgaaattgagcatccgtgtacaccgggttggctccaaagtagtccgctcggattcttgcatcgccgctcatgtgatcacgatgaatcctaacacgcccgggaatcgaaccaccatgacgacgctcattgagtgcacgtcgcctcctattgaccatgtgcctcgccaactgcaactcttcttcttcctcttccatttcttccatcaagcgcacaagaaaattgttttctaagtagggattcatggttgtggagtttgtaaaggcaaggttgagtgaagtatggaaggctcactcgctatttatagaggaagtacgcttcggatagaagccatgcggttgccgtgcaagggaagctaggctatggcttctcgaagaagagtactggcttacggtgcaagcttgtccatttgaaaacatattttgccaacgatattatactatgtggcgcgttatcgagaacaattacagaacaacaaaacaagcaatgtaattaatattgacaattcgaatttattaatttcaaaattaataaatacaatttttacgtatcatttatgcagcttgaaatgcgaagaaaacaaagaaaaatgaaaaagaaatggaaaatgtgaatctgttaacactgtagctttaggggacgaattttagaggacgctgctggagacggagaatatatagaggacagaatcttttagagtgttctgtaaaggacagagaatattcctttaagcgacgaaatttaggggacactgtatcatttatgctgttgctgtgtctgcgggaagagccgagctgaaataaacgatcattcgatagactc

SEQ ID NO: 20495 - DNA, 2432 bp, Zea mays
cattcaaacaccctaacaaagtttatatatataatgtaatcaaattcaacaagtaaattatttaccaaggcaatgcaagatcacaaactttttccgaggtatacacaagtgataatcatcgtaaaaggagaagtaaatgtttcacttctcaccttccatctgtcactcagtctacagaaccaatcctgtccttcagcattcttgacaggctctagcaatcccttacagatagcatagccaagccaggagtcaccaagggacacgacatcagctgccaccaagggacacgacatcagctgccattgcggactttggctgaacttgacccttgtccatacaccgtgacatctcagagaagatcccatcaagattagcacggaactcggcactgaatttgagcctcttccactgaacttcaacgaaatcctacaaacagaaaaaggaacatctcactaaagttcacaccatccaccattcatttttcttttaatgaattccagggtcagcccccctggccatacaccattcaagcttccatgctcacacaaatttatgcaatcatgttatgttatggtttaactactactctggcaaatgggggatgctttgcttatggtggatgagggcgaccagaccttaatccaagatggagggaaggagccgcgtagcgcgcctttccggaggggcaccgagagcgcgtaagtcttggtcttccacttctgcagcgcagcctcccatgtcccattccttgtcctcctctcctgcgtcgcctactcgcctcaaccaccgcagcggcccccggagggggcgggagcgcgaggactcgggcacggttggggaagagaaaaaggagcgaggacacggtcaggtggaataccagcgccgccaccgcgttcggcacccgctcccagccgctacggccacatgaacttatctttcagaaaatatatcaaatgaactttttttttctttgaggccacatgaagttatttttgaacaatcagatttatctttggtcaatttaattatatcagggtttttttttcttcctttgaggccacatgaacttattttttttttttttttttgcataaacttctgtccattgctgacagagaaaccaattatctctcaagcatattagcattggtctgtagacctacttggcagtatgatacttacaaccacaattaagcataaaattagctttgctctactaaataactggaaaaaagagccctaggaacctaatacagatgctgaaagaaattgacaaatcacatgtcaataaatgtagtagctacaaagaattgataaaacaaggtgagaaaatgtccacttctgcagctaaaccctgatgaaacgaagagcaagcttatcctgctatagatcttcctgcaggagtttgttcaacagagtggtcaggagtgcatcccttttttcagctcgtgcttcttctttcatccttcttcgctcctcccgttccatccacgagtgttccagcaacaaccgctcctgctccagcctctgcattgtcagccgccattgttgttcgaaaaccacccgctcctgggcacgtctctcgatcatctcccgccaccggacatcaatgtgctgttgctgcaccaggaaatcctgcagcagttcatggatgctcgaaattcctgttcttgacttctcagacattctttgatgttgctgtttcttgtcatcagctttcctctttctgttgtgcatcggcttctcatcgtcactttcttcaccatcatcgtccttgtcgtcagactccccagatgaccggtcaccaccaggtcgcttcagtttcgttttgacagaaactccagattcagactcaaggagttgttgctgcatatttctagcacgctctgtgaagacaccatgcagctcttcaaagaagggacactgcctaccattttctggatctgaagtttctttccccttgtagcggttgacgaggttcttccacttgcacttgcactgctcggcggttcgtcggtagcctcgctcccggaggcgcgcggcgacggcctcccacatcgtcttggcgctgcggcgcgccgcgacggtctcccgctccatctccccgcgcgccatgattagctcccgcgtctcctgcgcgccccactgcggtaccctctcgtcccttcctcccgctcccgcgcccgcgccgcccgcctccatcatcccacagcccaccgcccctcctgccctcgtctcctcagcgcgacttgaccaacggtagcaatccctaacgacaggctgtaaaccgcggcgaggcgcggccgcggagggggactgcaggccctgcccttaacccccgttttcttgcctcgatttgcttgctcgcctcgcttttctaagttttcttcttgcttctcgcctctgcctgccgttacttttctgcccattct

SEQ ID NO: 20496 - DNA, 982 bp, Zea mays
ttaaacttctgtccattgctgacagagaaaccaattatctctcaagcatattagcattggtctgtagacctacttggcagtatgatacttacaaccacaattaaacataaaattagctttgcgctactaaacaactgaaaaaaagagccctatgaacctagtacagatgctgaaagaaattgaacaatcacatgtcataatgtcaacaaatgtaggagctacaaagaattgataaaataaggtgagaaaatgtccacttctgcagctaaaccctgatgaaacgaaaagcaagcttatcctgctatagatcttcctgcaggagtttgttcaacagagtggtcaggagtgcatcccttttttcagctcgtgcttcttctctcatccttcttcgctcctcccgttccatccacgagtgttccagcaacaaccgctcctgctccagcctctgcattgtcagccgccattgttgttcaaaaaccacccgctcctgggcgcgtctctcgatcatctcccgccaccggacatcaatgtgctgttgctgcaccaggaaatcctgcagcagttcatggatgctcgaaattcctgttcttgacttcccagacattctttgatgttgctgtttcttgtcgtcagctttcctcttcctgctgggcaacggtttctcctcatcactttcttcaccaccattgccctcgtcatcagacagcccagatgaccggtcaccaccaggttgcttcagtttccttttgacagaagccccagattcagactcaaggagttgtcgttgcatatctcttgcacggtctgtcaagacggcatgcagctcatcaaagaagggacactgcctaccattttctggatcagaagtttctttccccttgtagcggttgacgaggttcttccacttgcacttgcactgctcggcagttcgtcggtagcctcgctaacggagccgcaccgcgacggcctccctggtaccggg

SEQ ID NO: 20497 - DNA, 1404 bp, Zea mays
  misc_feature (1401)..(1401): n is a, c, g, or t
aagtacaatatagtgaaatcgctttgtattcattcaactacaagtacttcaagcgctctttgttatattatatacaaggtcgtgtatcaatccatggagtgtctcagtgtctgtggccccaccttcagttggtgcagagattggacggaaacccaataactcttattcattaggtttacttcaatttgcacgattcttcacattccagaacgacggcatcattcaggatctgaagatgaggctcttgcagcttggagcatttccacaattagtgtcttagcatccttcctgtcttgcgcctgtcttgggaaggggattctcaacttcagaacacttccatcataaccagccttcacattaaaaccaaggctgtccacgtccagcatataagcaaaatccaccttgacagtagtggagtgttgcacaatgagctttgtatcattggcaccctcccggccccggtcgcggggaaaaaaagttgagaattgagatattggatcaacttttgcttccttatacctctgcacacattgaattctccagaaccaaggagagcagttgcaacgccagatacatagcgcacagctttaggtttgatgtgcaggaacactgaagtcaccaaagtcaacccagaaagcatcagggtgcctgcgtaggtaagcacttctcactgaatctttttcttcgtcagaaacaggaacagcatcgccatatacagtgattacagtatcagttctgtcctcaggatctttggcaacaagaagtgagcatttaggatttccagagagattctttgaatggactgctaaactactcactgctaatatggggtaaccatcctgatcacatgcaaaatcaaccattgaaccagatggataaccagcataatcctgagaatgggtagcaagaacacctctgacacttcggtccataatggtccgtatttcttcagctggagaaagacgaacagcttttgcctggtgaacgcggatcacctcgaacgcgtcagaggagccaccggcggcgtcggcaggcgccgccatctgaggcgaggaggaggaggaggccgcgaagaatcgtctgcggcggttgcggaggcgagggtataggaggggggaggcggggacgtgacggttatgccggccattagtaatttgtaggtggagcggaagcagtaggcgcgagagcgttgacggtgagggcaccgcccgagcgcccggcgtgagcaagaagggcatcgttgcgtgcgccacggagcgcggctcggtgtcggagagcctcgctggccgctttgggtcgcttcgctcggcacgggcgcacggccggcctgcgaccgccccgctgcgctgcctgtggcccttccttcctgtgcacacggtcggaggggcagaatagtgagtnccg

SEQ ID NO: 20498 - DNA, 1468 bp, Zea mays
ggccgcttttttttttttttttttagttgaaggaaggcgattcaaactttctattttcagcaccacactaggcctaggaagagaaagaattacctggccaaatttaaggtggaggatcgtatctgagtcagacaattgaaatcgtgaaaatttccgtagctaaactaatttccgtcactttgtattcattcaactacaagtacttcaagcgctctttgttatattatatacaaggtcgtgtatcaatccatggaatgtctgtggccccaccttcagtcggtgcagagattggacggaaacccaataactcttattcattaggtttacttcaatttgcacgattcttcacattccagaacgacgacatcattcaggatctgaagatgaggctcttgcagcttggagcatttccacaattagtgtcttaacatccttcctgtcttgcgcctgtcttgggaaggggattctcaacttcagaacacttccatcataaccagccttcacattaaaaccaaggctgtccacgtccagcatataagcaaaatccaccttgacagtagtggagtgttgcacaatgagctttgtatcattggcatgatccttgttcatatggcttgtgataggagttgagaattgagatattggatcaacttttgcttccttatactctgcaacattgaattctccagaaccaaggagagcagttgcaacgccagatacatagcgcacagctttaggtttgatgtgcaggaaactgaagtcaccaaagtcaacccagaaagcatcagggtgcctgcgtaggtaagcacttctcactgaatctttttcttcgtcagaaacaggaacagcgtcgccatatacagtgattacagtatcagttctgtcctcaggatctttggcaacaagaagtgagcatttaggatttccagagagattctttgaatggactgctaaactactcactgctaatatggggtaaccatcctgatcacatgcaaaatcaaccattgaaccagatggataaccagcatgatcctgagaatgggtagcaagaacacatctgacacttcggtccataatggtccgtatttcttcaactggagaaagacgaacagcttttgcctggtgaacgcggatcacctcgaacgcgtcagaggagccaccggcggcgtcggcaggcgccgccatctgaggcgaggaggaggaggaggaggccgcgaagaatcggctgcggcggttgcggaggcgagggtataggaggggagaggcggggacgtgaccgtcccggccggcctgcccactaggtaggtggagcggaagcagtaggcgcgagagcgttgacggtgagggcaccgcccgagcgcccggcgtgagcaagaagggcatcgttgcgtgcgccacggagcgcggctcggtgtcggagagcctcgctggccgctttgtggtcgcttcgctcggcacggcaagc

SEQ ID NO: 20499 - DNA, 587 bp, Zea mays
  misc_feature (6)..(6): n is a, c, g, or t
  misc_feature (30)..(30): n is a, c, g, or t
  misc_feature (35)..(35): n is a, c, g, or t
  misc_feature (44)..(45): n is a, c, g, or t
  misc_feature (51)..(52): n is a, c, g, or t
  misc_feature (56)..(58): n is a, c, g, or t
  misc_feature (60)..(62): n is a, c, g, or t
  misc_feature (67)..(68): n is a, c, g, or t
  misc_feature (70)..(70): n is a, c, g, or t
aaattnttttttttttttttttgttttttnttttnttttttttnntttttnntttnnntnnnttttnntngagcaaaagtagttttgtttctcgtagccatgagacccatcaaatcaaattaatgaagcacccatcaacaattagcaagaccgatgaactagcaaggcttcttgcagaagcacttgcgcatggccacgtcccgcttgcactcgccaccgggaaagctctccttcatgcacacctcggcgcatctgtctcgaactggagactctgcgataagcatcgactctcttccttctccgtgcttttctcctccttctccttctccttctccttctcctgctgtttcacgttctccattatcaaggcatgcatgggcatggctactcccattttggcatcgatgggttcccacctctgctgcgacgaggaggagaaacaagaataggacagctccctgagacactgccgccatccttctctcgttttatcaagaacaggaacggctgaacctgctggcggccccaaccttgatgggtgggtgacaacgcaggtcgcaaggtgtggggggatcctcgcggatccc

SEQ ID NO: 20500 - DNA, 743 bp, Zea mays
ggccgctggccgcttttttggggcggccgcctttttttttttttttttttggactgcagaaacgcttttcatgccctgcattttatcaaaagtagttttgtttctcgtagccatgagacccatcaaatcaaattaatgaagcacccatcaacagttagcaagaccgatgaactagcaaggcttcttgcagaagcacttgcgcatggccacgtcccgcttgcactcgccaccgggaaagctctccttcatgcacacctcggcgcatctgtcgctgttgaagcagaagccctcgaactggagactctgcgataagcatcgactctcttccttctccgtgcttttctcctccttctccttctccttctcctgctgctgtttcacgttctccattatcaaggcatgcatgggcatggctactcccattttggcatcgatggttcccacctctgctgcgacgaggaggagaaacaagaataggacagctccctgagacactgccgccatccttctctcgttttatcaagaacaggaacggctgaacctgctggcggccccaaccttgatgggtgggtgacaacgcaggtcgcaaggtgtggggggatcctcgcggatcccccggccggcctcgaggaccccaatcccccataggagtgctcctcgattcatcaattgcaagaggagcaagataccaccactgtagcaccacatgcaggtacgaagaaggcgacgaacatggcgaggct

SEQ ID NO: 20501 - DNA, 680 bp, Zea mays
ggccgcggccgccgctttttttttttgggccgcaggtttttttttttttttttttttttttgcagaaacgcttttcatgccctgcattttatcaaaagtagttttgtttctcgtagccatgagacccatcaaatcaaattaatgaagcacccatcaacaattagcaagaccgatgaactagcaaggcttcttgcagaagcacttgcgcatggccacgtcccgcttgcactcgccaccgggaaagctctccttcatgcacacctcggcgcatctgtcgctgttgaagcagaagccctcgaactggagactctgcgataagcatcgactctcttccttctccgtgcttttctcctccttctccttctccttctccttctcctgctgtttcacgttctccattatcaaggcatgcatgggcatggctactcccattttggcatcgatggttcccacctctgctgcgacgaggaggagaaacaagaataggacagctccctgagacactgccgccatccttctctcgttttatcaagaacaggaacggctgaacctgctggcggccccaaccttgatgggtgggtgacaacgcaggtcgcaaggtgtggggggatcctcgcggatcccggccggcctcgaggaacccaatcgcccataggagtgcattcgcggcccataggagt

SEQ ID NO: 20502 - DNA, 584 bp, Zea mays
aaggactgcagaaacgcttttcatgccctgcattttatcaaaagtagttttgtttctcgtagccatgagacccatcaaatcaaattaatgaagcacccatcaacaattagcaagaccgatgaactagcaaggcttcttgcagaagcacttgcgcatggccacgtcccgcttgcactcgccaccgggaaagctctccttcatgcacacctcggcgcatctgtcgctgttgaagcagaagccctcgaactggagactcggcgataagcattgactctcttccttctccgtgcttttctcctccttcttctccgtctcctgctgtttcgctttctccattatcaaggcatgcatgggcatggctactcccattttggcatcgatggttcccacctctgctgcgacgaggaggagaaacaagaataggacagctccctgagacactgccatccttctctcgttttatcaagaacaggaacggctgaacctgctggcggccccaaccttgatgggtgggtgacaacgcaggtctcaaggtgtggggggatccgtggcgcgtcggcggacgcgtgggcggacgcgtgggt

SEQ ID NO: 20503 - DNA, 1968 bp, Zea mays
  misc_feature (1107)..(1107): n is a, c, g, or t
  misc_feature (1405)..(1405): n is a, c, g, or t
tattaggattttattttagagtttatcgaccgacacgtacgcgcactcagagtaaaatatctaaggagctggggtgccgttttttgcccgggggcaaacccccggcacctgtccgagttccagccgcccacctcacgcaagcggcaagcccacgggcgctctctctccccctgcgcctcgtcgcctctccaatccctctcgtcctctccgctttctctctccatctcgtttcccccgcctgcgcagccagcgcaaaccctagccaacaagcgccgttctgcgaggctctcggcagcggataacttaacctgtcgcgcaaggatcgggggagagaaaccagcggcaacttacgtggatcggggttgtttggtgctgctgcggcggcgcagggatggaccggaagcgcatcaaggacgcgctcgagaagcacctggagaggtcgtcgccgtctacttccaggggcgtcgtgtccaaggagagggagcgcctcgctgccgggaagctgccgtcatcgcttggcaaggcggaggtgtctgatggtggtgagtgcgggaccgcccgcgaactttcggtggtctgtacatatttttattaccttcctcactgtgtatgatgaactgccgcaatgtatgcttggtttgaaagatgcgacttttctgtcttttttcgtgcataatattatgttgaaattttgtgttctgtgactagatttcgcggcttccatttttatggccccttcaaatgagaaactctttacttgcctgaagcggaagatggcgtgtgctttctgtttatgctggttcttttgcaacaagtgttgatataagcaatatatataccaagaaactggtaaaaatgagcaaagagccaaaaactgaacagtttgtgagctgtttgctcgaattgggttcagaagctggggtatctttgaaaaccaataatgaggaaacagatgaaattgtattgtaacataggtagttgcctagttggaaatgacttggattgctttataagtatgagatggatcaaaggttacaaagtatttatcacacaaaatcagaacatgaatgctttgtgtttttgttcttgaatactatccgaggttgntaatatcttgattcagaatgggattgtaactccaatagtaggatcacaaatcttaggatcataagtgctagagtcgtaaaatcgtacattatacttaatggaatcgtagaatcaacctaataaactaacatcagttgtaaaatcacaccaaaggattgtgattttaacagctatgatactatctctggctggattggtagacgttttggtcttttggacaaccaaactgacttgcaattagttctaccatgatgtctgaagtgtcaacttctgaccggagggagtgatagtaatatantatagtatcttatttgctgaagaatgtgatcatttcttcttcttggtaccactctcccttccaaactacaagttgttctggcttttctatgtacatatctagatactgcacacctagatatacattatgtgtacatagtcaaagctatgtatgatgtatctaggaaaaccatacaatttagaatgcatggagtacgtttcagttggtgtatgttttttgtggacaatgtaatgatagttgataaaagccagtcaagagtaaataggaaattggagttgtgaggggagactctagagtccaaaggttttaggctcagtagaactaaaacctaatatatgagatgtgacttcggcactactacacatgaaagagattttagtctggaagctcaagtagtgtctaggaaggatacctttcagtatttaggatcaatgctatagagaaacgatgatattgctgaagatgttagccatagaatcaaagtagggtggatgaggtggtgtctagcatatggcattctatgtgataagaaggtaccatagaagttaaaagacaagttttat

SEQ ID NO: 20504 - DNA, 1348 bp, Zea mays
gggtaccgggacctcgagccggccgggaaacccccggcacctgtccgaattccagccgcccacctcacgcaagcggcaagcccacgggcgctctctctccccctgcgcctcgtcgcctctccaatccctctcgtcctctcgctttctctctccatctcgtttcccccgcctgcgcagccagcgcaaaccctagccaacaagcgccgttctgcgaggctctcggcagcggataacttaacctgtcgcgcaaggatcgggggagagaaaccagcggcaacttacgtggatcggggttgtttggtgctgctgcggcggcgcagggatggaccggaagcgcatcaaggacgcgctcgagaagcacctggagaggtcgtcgccgtctacttccaggggcgtcgtgtccaaggagagggagcgcctcgctgccgggaagctgccgtcatcgcttggcaaggcggaggtgtctgatggtgaggaatttgaaactgacagtgaagattctgatgtgagtggttccgagggagaggacacgtcctggatttcatggttctgtacattgcgaggcaatgaattcttttgtgagatcgatgatgactatatacaggatgattttaacctgtgtggtctgagtaatcaggtgccatattatgattatgcacttgatctcatcttagacattgagtcttctaatgatgacgggtttaccgaggagcaaaatgaattaatcgagtcatctgcagagatgctgtacggtttaattcatgcacgatacattttaaccagcaagggtctagctgcaatgttggagaagttcaagaactacgactttggtagatgccccagggtgtactgctgtggccagccctgccttccagcagggcaatcagatgttcctagatcgagcactgtgaagatatattgtccgaaatgcgaagaacttaactatccaagatccaagtaccaaggcaacatcgatggatcatactttgggacgacattccctcatcttttcctgatgacttactcgcacttgaagccgcagaagccgtcacagcaatacactccaagggttttcggcttcaaacttcacaagccgtcatgacagagttgtagcttccgccagaagcacccctgtcacctaggttttagggagagcatcgtggccttcaaatactgttgtattattgatgtacgaattcgcgagcctgggcctcgctgtaaactattgtgaaattgtatctgttttccgatattattactgttgtgtaacctggctctaaaaaaaaaaaaactcccttggtgccactctgtcgtcaacatgcatggtttcagggcatttcacacgaaa

SEQ ID NO: 20505 - DNA, 2014 bp, Zea mays
ggttgcatcggcagagagaagctttttaaaattgaaatatttttgtaaactatttatggccaacaataactcaagagaggttaaatggcttggcgattctatatatcgaaaaaaagttgttggatgagattgatctcaatgatataagcgaggactttgtatcacaaaattttaaaaaatattattaatgatatcagataacaactaagtgtttttgactacatatattttacatttgttatcttataaacatcaaaacagtgcataataatttttatacgtcaaatattcaataatatttgtatagttatatatatttgtgtgtggcgtagagtctgggaccttatttttgttccattatttaaaaatatatatttgtgtatgaatggcgcctccatatcagattttgcactggacccttaaaaagtcaggaacggccctgccgccaacctactaattggtcaatacacattacacaaacatccgacatatatacacagctagctcgtgcccggccggggacccccccggtcccaacttacaaagcacagagaagacctacaccgcacctgcacacaaggtagcaacatgaataatccccaaaaccctaaagccagtgctccttgcaccttgccaccggagcttcccaaagaagcagtggcgaccgacgaagcaccgccgccaatgggcaacaacaacaacacggaatcggcgacggcgacgatggtccgggagcaggaccggctgatgcccgtggccaacgtgtcccgcatcatgcgccaagtgctgcctccgtacgccaagatctccgacgacgccaaggaggtgatccaggagtgcgtgtcggagttcatcagcttcgtcaccggcgaggcgaacgagcggtgccacaccgagcgccgcaagaccgtcacctccgaggacatcgtgtgggccatgagccgcctcggcttcgacgactacgtcgcgcccctcggcgccttcctccagcgcatgcgcgacgacagcgaccacggcggtgaagagcgcggcggccctgcagggcgtggtggctcgcgccgcggctcgtcgtccttgccgctccactgcccgcagcagatgcaccacctgcacccagccgtctgccggcgtccgcaccagagcgtgtcgcctgctgcaggatacgccgtccggcccgttccccgcccgatgccagccagtgggtaccgcatgcagggcggagaccaccgcagcgtgggcggcgtggctccctgcagctacggaggggcgctcgtccaggccggtggaacccaacacgttgttggattccacgacgacgaggcaagctcttcgagtgaaaatccgccgccggaggggcgtgccgctggctcgaactagcctagcttctcagttccccgtgtacaataagaggggcggtcgcggcgccgcgccgcgcccttgggttgggccgggcgctatgctgcagtttggtttgtaaactaacgagcctagggtagctggtgcacgcgcgccacctcgccggacgtcgccgtcgtcgtcggcatggacttaaccggcgggccctgttgttatttctcaagtttgtagccaacgcactgttcggtgcgttccataatttaatttaccatgttgctctcgaaatgaactactagtgtacgtgcgtttcatcacgacggtcgtccaacgtacaagtgcatgcccctgtgctggatttactggaaattaatctccctctgcgcgcgtccgttaggaaagtggccgtggtattgaataaggttttggaggtatgtacgggcatgaccgatcgaggccgtttgaccgcggctggccggtgacagcatgctgtgcgctcgagacgaaactgccgcgcgcgcatgacgtccgatcggtgcactagcgcgcacccccgcgggtgagttttgtttttattaatctaccaaatttcttcaacttagtcactgtttaaaaacccctagagttaatagttagttagctaataaattattagctagct

SEQ ID NO: 20506 - DNA, 1740 bp, Zea mays
acgttcccactttattgtgtttaacgcgtccgtccggaacccagaaagatcgcactacccggcgctcgcgcggctttctttcccaactccgacgaaggctagctacaccacctggtgcgggctcgtctccatcgcccgccacccgctccgtcgtcgtcgtccccgccgcgccgatcccgaatcgaatggggagcctggcgtccgagaggaaggtggtcgggtgggccgccagggacgccaccggacacctctccccctactcctacaccctcaggaacacaggccctgaagatgtggtggtgaaggtgctctactgcgggatctgccacacggacatccaccaggccaagaaccacctcggggcttcaaagtatcctatggtccctgggcacgaggtggtcggcgaggtggtggaggtcgggcccgaggtggccaagtacggcgtcggcgacgtggtaggcgtcggggtgatcgttgggtgctgccgcgagtgcagcccctgcaaggccaacgttgagcagtactgcaacaagaagatctggtcatacaacgacgtctacactgatggacggcccacgcagggtggattcgcctccaccatggtcgtcgaccagaagtttgtggtgaagatcccggcgggtctggctccggagcaagcggcgccgctgctgtgcgctggcgtgacggtgtacagcccgctgaagcactttgggctgacgaccccgggcctccgtggcggcatcctgggcctcggcggcgtgggccacatgggcgtgaaggtagccaaggccatgggccaccacgtgacggtgatcagctcgtcgtccaagaagcgcgcggaggcaatggaccacctcggcgcggacgcgtacctagtgagctcggacgccgcggccatggcggcggccgccgactcgctggactacatcatcgacacggtgcccgtgcaccacccgctggagccgtacctggcgctgctgaagctggacggcaagctcgtgctgctgggcgtcatcggcgagcccctgagcttcgtgtcgcccatggtgatgctggggcggaaggccatcacggggagcttcatcggcagcatcgacgagaccgctgaggtgcttcagttctgcgtcgacaaggggctcacctcccagatcgaggtggtcaagatggggtacgtgaacgaggcgctggagcggctggagcgcaacgacgtccgctaccgcttcgtcgtcgacgtcgccggtagcaacgtcgaggcggaggcggcggcggcggatgcggccagcaactgatggcaccgcgtcgtcgagtcgaaccacgtctgtgcgccgcgtgcaacgttcgttcgggtcgagtctgcgtgcaacgttctgcttcctttactagttgttgtctttccgccttcttgccgttctgttctgggctttgagatgagacgatggatggtcagtttttaatgtcagactgaataactacgtatagtactgtagtattactcggagtacgccagaatgtggtgtggtgtcagtctcaccagcaatctggatttgccaagtgtttctattttttcttcggtttgcccgagtgtttgtgattgttaagaactacgttattacggatcgtcaaatccgttcccttctgtctcgtctatagtttagacgcgagaaaatattaaagacacgtctcccattccagaagcacgatagaagaacttttatttctattttaataggttgtttcttt

SEQ ID NO: 20507 - DNA, 1656 bp, Zea mays
catcctaatcgaaaactctgcgcgctgcttcctgttcggccgtgcctgcgtgccgctcgccccagctcccagctatggcgtctggccgagagagcttctctcatctcctccctgctcaatctccagccacgcgccctccagttctgagctcctctgcgcgcgcgaagtcctctgcgccgcaccctgaagccccctgctcggcgcccgagatccctcccatggccggtgttcggtccctgcgctcgtccgaccgaactccctggccatcgcgcttgccgtttccccacgcgcaggaattcaccagtgttcggtccgcgcgcagcctccctcccagctcagccgcccatctccatggccagagctccttcatctccctcctctcagcgtcttctccgtgctcccgctcggctccacccatggccggaatccccttcctgccgagctcccatggcggcgcccatcccctgctccctccagttctccctaccacgcccaccgccggtctatgcgcgcgcgctctgctcccatgccgcgcgcctagaccggcggtggtggaggtcgggcccgaggtggccaagtacggcgtcggcgacgtggtaggcgtcggggtgatcgttgggtgctgccgcgagtgcagcccctgcaaggccaacgttgagcagtactgcaacaagaagatctggtcatacaacgacgtctacactgatggacggcccacgcagggtggattcgcctccaccatggtcgtcgaccagaagtttgtggtgaagatcccggcgggtctggctccggagcaagcggcgccgctgctgtgcgctggcgtgacggtgtacagcccgctgaagcactttgggctgacgaccccgggcctccgtggcggcatcctgggcctcggcggcgtgggccacatgggcgtgaaggtagccaaggccatgggccaccacgtgacggtgatcagctcgtcgtccaagaagcgcgcggaggcaatggaccacctcggcgcggacgcgtacctagtgagctcggacgccgcggccatggcggcggccgccgactcgctggactacatcatcgacacggtgcccgtgcaccacccgctggagccgtacctggcgctgctgaagctggacggcaagctcgtgctgctgggcgtcatcggcgagcccctgagcttcgtgtcgcccatggtgatgctggggcggaaggccatcacggggagcttcatcggcagcatcgacgagaccgctgaggtgcttcagttctgcgtcgacaaggggctcacctcccagatcgaggtggtcaagatggggtacgtgaacgaggcgctggagcggctggagcgcaacgacgtccgctaccgcttcgtcgtcgacgtcgccggtagcaacgtcgaggcggaggcggcggcggcggatgcggccagcaactgatggcaccgcgtcgtcgagtcgaaccacgtctgtgcgccgcgtgcaacgttcgttcgggtcgagtctgcgtgcaacgttctgcttcctttactagttgttgtctttccgccttcttgccgttctgttctgggctttgagatgagacgatggatggtcagtttttaatgtcaaaaaaaaaaaaaaaaaaaaaaaaaaaaaaaaaaaaattaaaaaaaaaaaaaaaaag

SEQ ID NO: 20508 - DNA, 2856 bp, Zea mays
ctcgttcccggcgtggtgtggcctggccactggccacccgtgccctatcctcttccgcacggcgtcctatatccacgggaagcacccggcccccccgggacacgcgctcctctctcgccgtcgccaaccatcgccgcctcgcgtccggacccgccgttcctccgaggaaatggctgcactgcaaccctcattttcaccagcaatgactttgaagagtagctgcagcgccctgaagttcccaaaaactgcactgttatctggttttggtggcattccacgccttcaagatgcgcaagacaggaacactagcgtcgcttatttgatccccaaggctgcttcagtgactgaccagtcaatagcagagccaccaaaaaccaagcaaaataggcacacagtcgacccaacagctccagaatttctgccactcccatcttttgaagaatgctttccaaggagtaccaaagaatcaagtgaaatcatccacgaggaatcaggtcatgtcctcaaggttccattccggagagtccatttgactggagatcagaagcactttgatacatatgacaccagcggtcctcaaaatataagcccaaggattggactcccaaagataaggaaggaatggattgataggagggaaaagctgggtagtcctcggtacacacaaatgtattatgctaaacagggaattgtaacagaggagatgttatactgtgccagccgtgagaaccttagtcctgaatttgttcggacagaagttgcccgtggacgagccataattccttccaacaagaggcacctggaattggaacccatgattgttggaagaaacttccttgtaaaggtgaatgcaaatattgggaattcagctgttgtgagctccattgaggaggaagttcacaagctccagtgggccacgatgtggggagctgatactgtcatggacctttcaacagggcgacatatccatgagacgcgggaatggattattcgcaactctccggttcctattgggactgttcctatttaccaagcacttgagaaagtaaatggtattgctgaaaatctgagctgggaaatttttagggataccttgattgaacaagctgagcagggcgttgattacttcacaatccatgctggtgtcctgcttcgttacattcctcttacagcaaagagaatgacgggcatagtttcacgtggtggctcaatccatgcaaaatggtgcttaacttatcacaaggagaactttgcatatgaacattgggatgacattcttgacatatgcaatcagtatgatgtggcattatcaattggtgatggtttgaggcctggttccatttatgatgcaaatgatagtgcacagtttgcagaactgctgactcaaggtgaactaacacgtcgagcatgggcgaaagatgtgcaggtaatgaatgaaggcccgggtcacatcccaatgcataaaattcctgaaaacatggagaaacagttggagtggtgtaatgaagcgcctttctatacattgggtcctttgacaactgatattgcacctggttatgatcacatcacttcagccattggtgctgccaacattggagctcttggcactgcacttctttgctatgtaacaccaaaggagcaccttgggttgcccaatcgtgatgatgtcaagactggtgtaatatcctacaaaatttctgctcatgctgctgatttggcgaagggtcatccctatgcacaagcttgggatgatgcacttagcaaggcaaggtttgagtttagatggcttgaccaatttgctttatctctggatccagtaactgctatggctttccatgatgaaacattgccctctgagggtgccaaagtggcacatttctgctcaatgtgtgggcccaagttttgttcaatgaaaatcacggaggatatcaggaagtatgctgatgaaaatggttatggaacagtagaggaagctgtgatacaaggaatgaatgctatgagtgctgaatttttggctgcaaggaaaacaattagtggggaacaacatggtgaagcaggaggggagatctatgtaccagaaagctatgcagctcagaaataaggtttcctcggagccatccattctaaatgaggctaaggcatcagcagctgttctggctagtggctaaggcatcagcagctgttctaccatcttatctaatgagatgtctgagagcctcttagcctggactgttgtgagatgggctgagaaagtccctttgaacctgaacaggataatgcctgcgaagggagtgtgcaattctattttcctgttttccaggaacctatcaaccccttggtggaaattgaggtattgtccatgattgcatggagctcagcaacaaggtacctgttctctacttgtttgcatttctcaaggggaagattcttaacaggtatcaggttcgtcatgacatctaacaattttatttataatgtgcaagttatttagttaaatctacacgaccatgaaatttgtcaaagtatttcctagtcctatattatctagttttacttctacgtctatctgttctttgattgtgcgctccatctattctttggtgaagcttgcgggttctactttctagacctattgagataggaccttttggcacggtacaatatcaatactgttttggtgaagggagtatatttacagtagtacaaagggagatggctaaaactgctacaatttttttagatggacgatgtttgtcattgagggtgggaagtaccaaccagattgcatttgacttcatccggccatcatatggtgttctcgtctattaataaataaccaaggaagtggttcttggc

SEQ ID NO: 20509 - DNA, 2529 bp, Zea mays
gcacgagaccattacctagagcaccctcatcgaagaagtttctcgttcccggcgtggtgtggcctggccactggccacccgtgccctatcctcttccgcacggcgtcctatatacaaggaaaggaaaaatctgccactccacacgcgctcctctctcgccgtcgccaaccatcgccgcctcgcgtccggacccgccgttcctccgaggaaatggctgcactgcaaccctcattttcaccagcaatgactttgaagagtagctgcagcgccctgaagttcccaaaaactgcactgttatctggttttggtggcattccacgccttcaagatgcgcaagacaggaacactagcgtcgcttatttgatccccaaggctgcttcagtgactgaccagtcaatagcagagccaccaaaaaccaagcaaaataggcacacagtcgacccaacagctccagaatttctgccactcccatcttttgaagaatgctttccaaggagtaccaaagaatcaagtgaaatcatccacgaggaatcaggtcatgtcctcaaggttccattccggagagtccatttgactggagatcagaagcactttgatacatatgacaccagcggtcctcaaaatataagcccaaggattggactcccaaagataaggaaggaatggattgataggagggaaaagctgggtagtcctcggtacacacaaatgtattatgctaaacagggaattgtaacagaggagatgttatactgtgccagccgtgagaaccttagtcctgaatttgttcggacagaagttgcccgtggacgagccataattccttccaacaagaggcacctggaattggaacccatgattgttggaagaaacttccttgtaaaggtgaatgcaaatattgggaattcagctgttgtgagctccattgaggaggaagttcacaagctccagtgggccacgatgtggggagctgatactgtcatggacctttcaacagggcgacatatccatgagacgcgggaatggattattcgcaactctccggttcctattgggactgttcctatttaccaagcacttgagaaagtaaatggtattgctgaaaatctgagctgggaaatttttagggataccttgattgaacaagctgagcagggcgttgattacttcacaatccatgctggtgtcctgcttcgttacattcctcttacagcaaagagaatgacgggcatagtttcacgtggtggctcaatccatgcaaaatggtgcttaacttatcacaaggagaactttgcatatgaacattgggatgacattcttgacatatgcaatcagtatgatgtggcattatcaattggtgatggtttgaggcctggttccatttatgatgcaaatgatagtgcacagtttgcagaactgctgactcaaggtgaactaacacgtcgagcatgggcgaaagatgtgcaggtaatgaatgaaggcccgggtcacatcccaatgcataaaattcctgaaaacatggagaaacagttggagtggtgtaatgaagcgcctttctatacattgggtcctttgacaactgatattgcacctggttatgatcacatcacttcagccattggtgctgccaacattggagctcttggcactgcacttctttgctatgtaacaccaaaggagcaccttgggttgcccaatcgtgatgatgtcaagactggtgtaatatcctacaaaatttctgctcatgctgctgatttggcgaagggtcatccctatgcacaagcttgggatgatgcacttagcaaggcaaggtttgagtttagatggcttgaccaatttgctttatctctggatccagtaactgctatggctttccatgatgaaacattgccctctgagggtgccaaagtggcacatttctgctcaatgtgtgggcccaagttttgttcaatgaaaatcacggaggatatcaggaagtatgctgatgaaaatggttatggaacagtagaggaagctgtgatacaaggaatgaatgctatgagtgctgaatttttggctgcaaggaaaacaattagtggggaacaacatggtgaagcaggaggggagatctatgtaccagaaagctatgcagctcagaaataaggtttcctcggagccatccattctaaatgaggctaaggcatcagcagctgttctggctagtggctaaggcatcagcagctgttctaccatcttatctaatgagatggtaagcagtatgtgaataaagctggtgttgcttaccttcagtttgtgaatgccattatgtactgtaataaaaaactctgtattgtactccctagcattatcattatgcttttgtcttctttgtatcacaatgggattgttagtgatgaaaattgcaccaggggtgcctgtgttctcaacagtctgagagcctcttacaaaagaaaaaaaaaaaatgggctgagaaagaccctttgaacctgaacacgataacgcctgccaagggagtgttgtaattgtatt

SEQ ID NO: 20510 - DNA, 1212 bp, Zea mays
taatgtaatgtataatgcctttaaatctttctttttttttttttctttgacaaatgcagtaaatgcatactttattagatatgtgcaaacaactctgtttggatgtttgcgaatagccctatatgatacatatcaacgaatgcgccaatatacatcctattgctagataaaatacagtttattttgcagtcttctgaaattctgcatagataaccacccggtagcctacggactacagctactcccaatgatagttatggccgaaatagctgcatgaccacgcctcaatcttgtggtcacaaaaaaaaaccgaactaagacggttatacacactggatggcagcaggccaggggcacggcaaccttcaaagaacaaattccgtagaaccgcagctggtctctagatccagcaaatatttgcggcatcgccactttccatcgcttgttctccctgccgctttccttctcttgttctcccctgacctcagggagaggcagataattcatacattatgtttcttcgatatcctcatccctaatatcctcaatttcttctcggtagtacaacgcatttagctcttgctgcaactgaacatgttttgtcttagctgcaattagttcatcagtcagtgttatcatcctagactgtaattctgaaattttaacaagtaatgaccgttccttctcagagttagctgtatcagccactttaccattctccatcgttcggacttgagaagatattccaggctgtgttctatcaactttctcatcctgttgcaagttactaagtaggttcatgattacatcctgctgaaacatggtctgttgcacaaggttgttaaggtggggaattaatactgaagatgatacagaactattgcagaattccttcagctgattagcgttacgcatcagcttagtattaatcaaacaatcaccagtgctggcagattttcttagcagtgaaccctctggtgatttccgtgagaggctactaagtggaccttcctgaacctttgcaagatcgacattctcagatgtaactgaaaagcggcctttaatctctactacacttcgtttggacttgtcacctgatgaatctacaaaacctcctgaagatcgaataggagctgacagactatttgcagaagcacgagttggcagtgaaagtggaccactaaggcttgctgtttttctcgcctcacttct

SEQ ID NO: 20511 - DNA, 3900 bp, Zea mays
ccctcttcgagtttttttttttttttttttttttttttttttttttttttcttgcgaatgcagtaaatgcatactttattagatatgtgcaaacaactctgtttggatgtttgcgaatagccctatatgatacatatcaacgaatgcgccaatatacatcctattgctagataaaatacagtttattttgcagtcttctgaaattctgcatagataaccacccggtagcctacggactacagctactcccaatgataggcatggccgaaatagctgcatgaccacgcctcaatcttgtggtcacaaaaaaacaaacgaactaagacggttatacacactggatggcagcaggccaggggcacggcaaccttcaaagaacaaattccgtagagccgcagctggtctctagatccagcaaatatttgcggcatcgccactttccatcgctagttctccctgccgctttccttctcttgttctcccctgacctcagggagaggcgggtaattgatctgtctcagggagaggcagataattcatacattatgtttcttcgatatcctcatccctaacatcctcaatttcttctcggtagtacaaagcatttagctcttgctgcaactgaacatgttttgtcttagctgcaattagttcatcagtcagtgttatcatcctagactgtaattctgaaattttaacaagtaatgaccgttccttctcagagttagctgtatcagccactttaccattctccatcgttcggacttgagaagatattccaggctgtgttctatcaactttctcatcctgttgcaagttactaagtaggttcatgattacatcctgctgaaacatggtctgttgcacaaggttgttaaggtggggaattaatactgaagatgatacagaactattgcagaattccttcagctgattagcgttacgcatcagcttagtattaatcaaacaatcaccagtgctggcagattttcttagcagtgaaccctctggtgatttccgtgagaggctactaagtggaccttcctgaacctttgcaagatcgacattctcagatgtaactgaaaagcggcctttaatctctactacacttcgtttggacttgtcacctgatgaatctacaaaacctcctgaagatcgaataggagctgacagactatttgcagaagcacgagttggcagtgaaagtggaccactaaggcttgctgtttttctcgcctcacttctttgtttgtcaggtattgtttgcacaactgcatccctctcaaaaccatagcccctttcagctgttgagctattgctcccaccagaagacagttgtctctgcccaacgtcatttgtccaatgattcgactctggatctcgctttgctgtagagggcaatgaatcattctctcttatgtttctttcatgtccatcagcccttcttgtagtggcagcctcgctaaaatcaaaatcaaaatcaaaagcttcattcgtggtggggctgtttccatccgattttaaagtggtgacaaaggctcgctgcctggaattgcactcatttgcaaatgactttcccaaatggttccgtgaagacaagtccttttcaacctcaatgtttcttgcaatgtcctcgtcttcttttatttcaggaggctcgtcatcatgaattaatgatgcttgagccttgagatcctcgatatcgaagttccatgcactaacgccgcgttgatattcactctgtatgaatccatgcagttttttatgataagaaagctattaaaatatctgtggcatttaccctaattgtacaacaaaaggaatgctgctaatatatttgacatgtgactatttacggaatagcatgtagggaaaaatactcagcattacacatttgtgcggagactgaaccagataagtgaaaaatacaagagaaaatgaacttcaaaaggtttccgcgatgtatccataccccaaagttcttagcacagtcaatgcctaccatttaaacatggcatgcatgtattattcttatgtgcttagccttttcaaagcttaacagtcaacttgttaacaaattatttggaagaacgtagacaggtagtatatgagcaaatattttgttatatggtactgaaattgttggactattgctgtctatcataaagtaaataacttattgtaaacattaccaattagtcataatacatgttcaacaaaaactatcacactcgaaaggtgacatgtatacaattaactccatgcaagatctgacttcagttagtatgtcaacaatgcagaattgatgaatcctgtttaccaaaaaaatgcatgcgcactaaataaaggagaactttcaactcacaactctaatatagccagagcagtattgtaatgatgataattgaaaaacaaaaggcagacccagtgccacaggctcccacatgagcggggtacggggaagagataaactgaggcaggtcttccctctgcaaatgtggagaggctgcttcaaacccgagacttagtgacactgtaagatagctctcaccactacacaggcctgcctttctactgtaatgattataattaaaaaaagggatccataatattaagaacagtaccaactaccaaacaaaacataaaaaataggaagggtatgtcacagaccagggagagggcctcctgttcagaagaaggcatttttttcaaagccaattgtgcttcatctttaagctggagagcctttacacggtcccagagaggaggtaaaccagacaagatactcttaatagtcaactctggaggctttgcatttttgaaaaatgaatgcttaagcaacttctcagctgttggtctctttgtttgatctttgaccaagcacattgcaaccatttctttaaatgactttgagaatcttttgtcacgttcataatcaagaccaggtggtgcattctggagggtcatgagaagaaccttcataggagggtatttcgaaaatggagcatggccatgtgctagttcaagagcagtgattccaaatgaccatatgtcagctttgaaattatatccagtgccaggttggagcacttctggagccatccagcatggtgttcctacaaatgtattcctagatctttgcctatcacctctatcaaacatacaagcagaaacaccaaagtctccaagcttcactaccccagcaccatcgataaggatattaccagccttgacatcacgatgtatttgaccctgccggtgaaggtaatccagagccttaagagtttccttgagaatggagccaatgatcggctcatcaaaaccttcctggtatgagatcttcattaagtgtaaacaagaaccctctgtcatgaatggcattatcacccagaggctgtgctccacaacaaatgagcagtaagccctgatgacattaggatggtctatcaagctcattatttgagcctccctttgtatttcatcgatgttgttattgagctgatcgagatccaggcacttgacagccacaacaccctcggtcggcaggaagatcgcgcggtacacgacggcgtgcgcaccgtaccccacctcctccatcacccggtagtcggcgggattcacagagaaggacggcggccccgcagcagcacccgcagcgctcgaagacgccgagcgcttcacgctaccgttcctccccatggaacccgagggcccccccccgctcccgacaagttcttccggcgcaagcgacggagctagactcacccgaccccaccaccacacacacaacacaccaccagagccgcctgccacccgggcgttgaccagtgtctcgcgcagtcgagcgtggacggcaagagagaggagctcgggaagggggaggaggaggaggaggaagcc

SEQ ID NO: 20512 - DNA, 1245 bp, Zea mays
cagagaaaacaatagctgcatactacaatcttttgaaatattcagttttttttggttggttcggatggagctgatcaaagtcatcgttctgctaaagtttaaaaaccaacaacgtttgcatcatgtcaggtacagagtagtagcatacagtgatctcctcaaagaacagagtatttgtaaaaatatggaagggacagcaatgctactagcacagtgctcataatccgtacagcaatcttttagctcgagctctgcctttctgaacgtttcaagtgcagaatccgattcactctgattttgccggagaacaagatcggggcagactcttgctcctggcaggactcctgcttgcagacttgtcacgccggggagaaataggaggggatctggatggtgatcttgccttaacaggtgattttgactctgaagcagatctagatcttgggctcctgctcttgctataactgcggcttctgcttcttgagtacgaatggctgtggcttctgcttcttgacttagagcggtttctgcctctggagcgagaacggctgcgcctagcatcatactccctcacccggacatatgtccttgaaaaagcattacggaactcagaatcatctagcttccttatcgcgtgtttcatatcttcatagttagtataatcagctattccaatagttgctccagcctcacgatacacatcagtgaaacagacatcaccagctcgccgcatatggtccttgagatcttgccatgatgctgaagaaggtaatccagtaaccataacacggtaatcagaacgttttgaggcaccgcgttgtccagcactgctatagctgctagatcgatcaaaagaagatgtgcctcgtccaccatgggctaattccacccgcaacctatggccatcaaagttgtatccatcacggccatatattgcatcttcagcatcacgtgcgtcctcaaactcaacaaaagcaaaaccaggaggccttggtggaattttcaagtcaatttccactatacgtccatacttgtagaagagatcatccacttccctctcgcggatgtcgccggggaggttgcccacgtagatcgtacagccgttccgccgggtcatcgttcctgcgacgactcgacggcggcaaggagcaaggaaggcttgagtcgaggtcgagcagcttcgacggatgccggcgtgagggtactgggaattgtggattgttcccttttacggcccgagggtac

SEQ ID NO: 20513 - DNA, 1754 bp, Zea mays
ggccccccctcgagttttttttttttttttttataacgagggcccacttgctatggattgaaactcagccaatccactttttttttttttttttttgatgaaaccgaaagcccttactgaatcattcgagcgctcttgaaacagtagtgctacagggtatccagtgagcgttacttaaacaagcatcctccccccaaaatcacaagatacacatttgcagctgcaaactatacaaaatgttgattctagattccggggcatgtaagcagttctgccatgcaccatcgaccgacagcatgagatatttattcacaccggaatagttattcccttgcttgacatgctgtcaaggatgtcgttcagggcttggcacagtccagcaatctgctgatcccattgctgcagctcttccgtgtcatcatcaaaatgtatcacagcctcaacctgatcaattgagccccgcattctatcctcataaatcatccgagatgctatcttctcagccttccttggatcaatccccagtaatgtcccaagctcatcaaagctgatatttgtgtaaagtttactggcactaaggagattatgctcgatcattgctcggtcaagcacagtcgacttatctggtaataaagctttttgatgcggcctaagctcctctgcaaatgcatcaatttctggtttcctcaaaattctttcaaggtaaaccttctgcagtattgggtatattttcaacttcgagcatctttcatccttgtacagagtagcaagaacacgggagcgttgtggaccagcaccagccaatattgtgcatgtcacagcagcactaagagcttgctcaagtgcattttcatcaatctcttcgtctccaatcttgcgttgttcaatttgagaaatgtcataatatcgaagtgcagcttccagaaatcttcttttcagatccaaaatccttgcataacagaccttgtactgtaagtttagaacctcctgatggctgttggtgaccaaaaatgaagccttgtttataaaagcctcagcattcactgcatcatcatcctctaaatagagtcgtgcaatttgaacacacttggataatttgttggtgtcatcaagcatcctgattcctgaatccaagtcaatcccactaagcatttgtgctgcttttgaccattgttgttcagactcatatagctctgcaagcttctctctaatcactaccacctgctcctcgaaggagaccacacgcggctggatctgcgtgagcgcgtagtgggcaacctccttctgcgcgtccgactccagcttccctaggtcctgcgcgaacgtctggagcaattgacgcgacaccacgagcggaacttcgtccgaaaccatgtggtcgaggaagcgcttggcctgagagatgtccggtggggaagacgagaggacggaggcgaggatgtggcggtactgctcgatcttctggcgctgatcggctatcgccgccgcgctcgcgagagagctgtccatggcttctaccggcgtcgctggcacaggtaacctgaagcaggggtggagccgtggaggcaaggagggtgtggccgaaatggggaattggggagggcgagctagggttttggcattcaatctgcgccgccgacgacggaagaattcgtgagaaatttagcgtttgcaacaaaggaaacggtaaaaagcaccagtttggtttcggccatcgtcccttaaaaagggttttatatttccggacgcgtggg

SEQ ID NO: 20514 - DNA, 3325 bp, Zea mays
aggatgccgaagaagtgttgtacactgggaggcctaacagtagcatgggtcaatctttacgagaccttgagaacgaccatgcagatttccagttgacaccacatgatcctcattctgtggttggagaagctaatttgccgcagcataatgtcccaagggacagcgatctgagtcctcttggcttactttggtctgagctggaagggcatccaaaacaacctctctcatcaaatgtacttggtgtaaatgaacgtagaaactccaagcctacaacacccaaggacattctacctgtaaacatgagacaagggccacttagcaggatgaatgaagtttctagtgtgcgtgatgagtggcctgcaaactttggacggctggacaatatgaatggccctaacatttctggcagaatccctcaggttgaagctgagcatcatttgaattttgatgggcacctcctgcttcagcagatcagacgggagcaacagcaacatcaacagcgacaggagcaattgatggcccgtagtaatttagagttttctggtgcatttcccgggcaggtgtttgattctttgcaccaacaccgacagcctatgaatcaacagcttcctgatgtagagcatcttttgagagtccagtttgaacttgagcaacagcagcaacaccaactccaacaagagcagcaccaacggcagctacagcagcaacgacaagcccagtttttgcaacgacagcaacagcagcagcagcaacagatgattcttgagcaattgttgcagcagcagctgcagggttctaattttggaccaacaaatatggttgatcaagtcttacttcgtgaacatgtatttaatgaactgcaccagcagcctcaccatttgcaaaggcagcatgatgcagctattgaacaacttattcaagccaaatttggtcacgggcttcatagggagcaccataatgatatgttggatgttctctcacgttcaaatcagagacaaatgcttcctttagagcagcaaattcttttaggccttcagcatgagcatgaacaacaacttcagtcccaacaattggcaaatgctctgcggcaacattcaggcagggaagaagaaatgcacttaagtggggtctggccaatggatgatgctgcccagtttatccgctcaggaaccagtccaaatcagagacacggttgtttcgatctcctggagaaccttcagagatcgtcatcgtttgatcatcatgaccatctagaccgcagcttatcgttacaggaacgattgcatatgggtggtctaggtattcactccctagaacgatctgattctttgcctggtggtggtcctggaccaaacacagatgtcataaatgccctatcacgccatcatggacttgggcagttggaaacacatggtgatgtataccctttgggtcaaatgcctatgcttccttcaggtgttcatcctcagcaacataggcatcaggaacagcttcctggttctcacataggaaggcgtgaaaggcactggtcagatgccaatggtcagttgcaaaatagtctaatgcaatcttcacacatcaaccagttgcagatggaagtggagaagcagaggaggaatgtggaaatgaacctttctgttgacaatccacatgcatgggcagccctaatgaataaagagaggaatgcagaacaagatttgagtgatatgattcacaagaaacttgcccttcaatcgcagcagtcccttggttttcctgatgtttctgttgcggcatcatttgggcataaagatcactttgtgcaacctgttgcggagaaccctctgagatcagtggacatgttgtcgtttgaggagtctctttcagaaaggtcactttatgcaaagtcagggcagttggcacaagagggatcagctaatctgggtactttacccaacagtattgagaacactggaaattttaaccttagaccaggatctggatcaatgtttgagcagaagcatttccttggaattgacgatgttcaaagtgacttttcagagaccacaggtggtagaacatcagctaatcaactggttgggagtgtcaatgaattaacaaggggtaaaaggcagggttctagtgcaagtttggctggggatgatactaatttttctgaagaagctgttagtaaatgatgtccatatgcaggtctgattctggcatgtcaaaaggaagctcacactccttactaaagcgctctacaagccaacatagtactacatctcagtctgtttctgcagatctgtcagtgatcaggctgaagaaagcaggacttgcatcctctgatgagaataagatggaatcaggattggcctcagtagcccagggtatggaaggctgcgttattagcaacaaagagacgggggcgtatggcatgccatcagccaccaacaatccagatgcctctggtcagtccttcagcgaagcgttgaagagttcgaggaagcctccgttgcagtacgatgcctccgaatctgcagacggtggcccaggtggtaagggcgcaaagaagaaaacgaagaaaggaaagcagattgacccttctcttcttggcttcaaggtccacagtaaccggatcatgatgggcgagattgttcgagatgattagcacgcatgagtgtacatacccggtaggagttggccttagaatcatgattggcttcaagctctacagtaaaccctaaactctgtacatgccagaaattttgtgccatggcttcacttctgcttagatcttctcttagcctctgttagttatagacttgcccgatttctcaggtttacagaagtgtcatttgtacagaacagccaagatcatcatgtatttagtggcaaagttttgttgatctgtgttaaactgtgaagatgtcgtagtgacggaacatggaacgtttgtgctgttgtttctttctgtttaggccttgttcgctctcaatccatatagatttagtgggtttaaattctaagcatgtcaaacttcttaattttttcaatctcatctaatccatgtgtcatagaaataaccgaataaggtaggtatttcatagtgaggttaaatctatcatttaatctatttatttcgtaaagctgattattcttttgatctatgtatctctaaaagctagttattcttttgtttcatggattctaatacaaacttggacactattttaatggatttgttccatacctaataagctacggataaaatatgtcttttatagtttaaaaaatctccaaacctttagcttataatctataatggatttaatcgaataaaatt

SEQ ID NO: 20515 - DNA, 4119 bp, Zea mays
cgggaaaggatatatcaaatactagtaatcgccagcacacattcctgaatcagtgaatcaggatgctgaagaagtgttgtacactggtaggcctaacagcagcatgggtcaatccctacgagaccttgagaatgaccgtgcagatttccaatcgacaccacatgaccctcattctgtggctggagaagctaatttgctgcaacataatgtcccaagggacagtgatctgagtcctcttggcttactttggtctgagctggaaggacgtccaaaacaacctctctcatctaatgtacttggtgtaaatgaacgtagaaatcccaagcctacaacacccaaggacattccacctgtaaacatgagacaagggccacttagcagaatgaatgaagtttctagtgtgcgcgatgagtggcctgcaaactttggtcggctggacaacatgaatgatgcaaacatttctggcagaatccatcaggttgaagcggagcatcatttgaattttgatgggcacctgctgcttcaacagatccgacgggagcaacagcaacagcggcaggagcaattgatggcccataataatttagagttttctggtgcatttcccgggcaggtgtttgatcctttgaaccaacaccgacagcctatgaatcaacagattcctgatgtggagcatcttttgagaatccagtttgaacttgagcaacagcagcaacgccaactccaacaagagcagcaccaacggcagctacaacagcaacggcaagcccagcttttgcaacggcagcagcagcagcagcagcaacagcaacaacaaatgatccttgagcaattgttgcagcaacagctgcagggttcaaattttggcccaacaagtatggttgatcaagtcttacttcgtgaacatgtattaaatgaactgcaccagcagcctcaccatttgcaaaggcagcatgatgcagctattgaacagctcattcaagcaaaatttggtcatgggcttcatagggagcaccataatgatatgttggatgttctctcgcgttcaaatcagagacagatgcttcctttagagcagcaacttcttttaggccttcaacacgagcagcaacttaagtctcaacaattggcaaatgctctgcggcaacattcaggccaggaagaagaaaggcacttaagtggggtctggccattggatgctgctgcccagtttatccgctcaggaaccagtccaaatcagatacacagtcgtttcgatctcctggagaaccttcagagatcgtcatcgtttgatcatcatgaacatctagaccgcagcttatccttacacgaacagttgcatatgggaggtcaaggtattcgctccctagagcggactggttctttgcctggtggtggtcctggaccaaacccagatgtcataaatgccctaacacgtcatcatggacttagtcagttggaaacacatggtgatgtataccctttaggccaaatgcctatgcttccttcaggtgttcatccccagcaacttaggcatcaggatcagcttcctggttctcacataggaaggcttgaaaggcactggtcggatgccaatggacagttacaaaacagcctaatggaatcttcacacatcaaccagttgcagattgaagcggagaaggagaggaggaatgtggaaatgaacctttctgttgacaatccacatgcatggggagcccttatgaataaagataggaatgcagagcaagatttgactgatatgattcataaaaaacttgtccttcaatcacagcagtcccggggttttcctgatgtttctgttccggcatcatttcgacgtaaagatcactttgtgcaacctgttgtggagaaccctctgagatcagtggacatgtcgtttgaggagtctctttctgaaaggtcactttatgcaaaatcagggcagttggcacaagaaggatcatctaatcttagtactttacccaacagtattgagaacactggaaaatttaaccttagatcaggatctggatcaatgcttgagcagaagcattttcttggaattgacgatgttcaaagtgactttctagagaccacaggtggtagaacatcagctaatcaactggttgggagtgtcaatgaattaacaaggggtaaaaggcaggggttctagtgcgagttttggctggggatgatcctaattttggctgatgaaggtgttagtaaatgggtattcctctaaaacttgtagatgtgttgctccattatttgctatctttctcaaggaaattcactgatctccccatcccaccaaattaccgttattatattttttttgcatgttactcagtttattctgattatctcacaataggacactgtataattctaacatgtctttgatccttagagaccttccgttgctcataatcatatcttaatgcgaagtctcgtttctggacaagagtgtgactacattatatttgtttttaaggcatatacatcatctatatggttctaactcgcttttctatagtgttcatcgtgttgttttacatgcataaactatttttcttgaatgcccacttaggtgagcgcaaagttagcttcatattgtatttataatatatagatgtccatgtgcaggtctgattctggcatgtccaaaggaagctctcactccttactaaagcgctctacaaaccaacatactactacatctcagtctgttcccgcagatctgtcagacaatcaggctgaagaaagcaggacttgcgtcctctgatggtatgtttttgcaaactgtggttaatgttactttgaagttttatgtaaaagtcagctgaatttgcttcacttaaaacaaagctgtcaattgctaaagtaatactgtctagatcacaaacctgaagtgtgagtggcttataggtatgtcctgtggtagtttgaacgagcacaatgttagcgcgcaacttgttgcacaataacaggcaacctgaagtattttttttgttactccctctgcctctggataaatcaatttctagagttgtgtgcagtcagactttgttaagtttgaccatatttatagaaaatagcgttaagatttaagacatcaatttagtatcattagactaggtacagtataaacaatatttttagaatgtgttcttttggtgtcatatctgtaattttttctataaatttggccaaacattgaagaagttcgacttatggcaactgtatgaactgatttattcagaaacggagggagtaccttgctattttatctacgaaatgctatgtctgctttacaccaatatgtttaatttcgatgatcttactgtacagagaataagatggaagcaggatttgcctcagtagcccagggtatggaaggctgcgttcctagcaacaaagagacgggggcgtatggcatgccatcagccaccaacaatccagatgcctctggtcagtccttcagcgaagcgttgaagagctcgaggaagcctccgttgcagtacgatgcctccgaatctgcagactgtggcccaggtggtaagggcgcgaagaagaaaacgaagaaaggaaagcagattgacccttctcttcttggtttcaaggtccacagtaaccggatcatgatgggcgagattgttcgagatgattagagtgtacatacgcggtaggaggtggccttagaagaatcaagattggctccaagccaaaccctaacctctgtacatgcccagccctggtgcccgctcacctcggcagaaattttgtgactgcatcttctcttagcctcttgctagctgtagtattgcccgatttctcagatttagaaaaaggagcctttcttatcggtgcccccaggtttacagaagtgtcatagttttgttgatctgtgaagatatcgtagcactggagcatggaacgtttggtgtgctgttgtttcaaaaaaaaaaaaaaaaaactcgagtctctcctggaggagaggcctcctgctgctttggttggcatcggatattgttcaactatcagatgtagaatgtcatcgcgatgtacaaacgtaataaacaaacttaggacgatcagtatcaactatatacaggc

SEQ ID NO: 20516 - DNA, 1274 bp, Zea mays
  misc_feature (3)..(3): n is a, c, g, or t
  misc_feature (1234)..(1268): n is a, c, g, or t
ggnatgcagaacaagatttgagtgatatgattcacagaacttgcccttcaatcgcagcagtcccttggttttcctgatgtttctgttgcggcatcatttgggcataaagatcactttgtgccaccgggtccgcgggccccccggtggtctctgggcatgttgtcgtttgaggagtctctttcagaaaggtcactttatgcaaagtcagggcagttggcacaagagggatcagctaatctgggtactttacccaacagtattgagaacactggaaattttaaccttagaccaggatctggatcaatgtttgagcagaagcatttccttggaattgacgatgttcaaagtgacttttcagagaccacaggtggtagaacatcagctaatcaactggttgggagtgtcaatgaattaacaaggggtaaaaggcagggttctagtgcaagtttggctggggatgatactaatttttctgaagaagctgttagtaaatggtctgattctggcatgtcaaaaggaagctcacactccttactaaagcgctctacaagccaacatagtactacatctcagtctgtttctgcagatctgtcagcaatcaggctgaagaaagcaggacttgcgtcctctgatgagaataagatggaagcaggatttgcctcagtagcccagggtatggaaggctgcgttcctagcaacaaagagacgggggcgtatggcatgccatcagccaccaacaatccagatgcctctggtcagtccttcagcgaagcgttgaagagctcgaggaagcctccgttgcagtacgatgcctccgaatctgcagactgtggcccaggtggtaagggcgcgaagaagaaaacgaagaaaggaaagcagattgacccttctcttcttggtttcaaggtccacagtaaccggatcatgatgggcgagattgttcgagatgattagagtgtacatacgcggtaggaggtggccttagaagaatcaagattggctccaagccaaaccctaacctctgtacatgcccagccctggtgcccgctcacctcggcagaaattttgtgactgcatcttctcttagcctcttgctagctgtagtattgcccgatttctcagatttagaaaaaggagcctttcttatcggtgcccccaggtttacagaagtgtcatagttttgttgatctgtgaagatatcgtagcactggagcatggaacgtttggtgtgctnnnnnnnnnnnnnnnnnnnnnnnnnnnnnnnnnnncttcta

SEQ ID NO: 20517 - DNA, 1836 bp, Zea mays
cctcgaggccggcccggacgcgtgggggcgctcagataaaaatctcacgcagtagacaaatccacgctttccttcgcctcctctcctctatcgcagtcgcggccaaggccaacgaaccaattcctctacggcccaccttcttcctacctgccattctcccatccagcacagcagggcgtctcctcctcctccctcccgcttttatcgccgcctccatttccaggacgcgtcgaattcctccatctaccgcgccggccgccgaggcccgagggggaggaggatgctgggcgccgcgaggaggcagcttggatccggtcccatgctgggacaggttttgcgaaggctccgcccggcggcggcggctgaggtggcgaggggctactccgctgcggcgaaggagatgactgtccgtgatgcattgaactctgcactggatgaagagatgtctgctgatccttctgtttttctgatgggagaagaggttggagagtatcaaggtgcatacaagatttctaagggcttgcttgacaagtatggtcccgatagggttcttgacacacctatcacagaggctggctttactggcattggtgttggtgcagcttaccaaggtcttcggcctgttatagaatttatgacatttaatttctcgatgcaggctattgatcatatcatcaattcagctgctaagtcaaactacatgtcagccggtcagatatctgttcctattgtttttagaggaccaaatggagctgctgctggagttggtgctcaacactcacagtgttatgcagcttggtatgcacatgttccaggacttaaggttctcacaccatactcttcagaagatgcccgaggcttgcttaaagctgctattagggatcctgatcctgttattttcttggaaaatgaattgctttatggagaatctttcccagtttctgctgaagtgcttgattctagtttttgcctaccgattggcaaagctaagatagaacgtgggggtaaagatgttaccattactgcattctccaagatggttggctatgctctccaggctgcagagatactgtccaaggaaggaatcagtgctgaggtgatcaaccttcgatcgatcagaccacttgatagagctgctattaatgcatctgtcaggaaaaccaaccgattggtgactgttgaagaagggttccctcaacatgggattggtgccgagatatgcatgtctgttgtagaagaaagctttgagtaccttgatgccccagttgagaggatcgctggagctgatgtacctatgccctatgctgccaaccttgagagaatggctgttccacaggtcgatgacattgtgcgggcagcaaagcgggcctgctacagggcagtaccaatggccgcagctgcctgattggtgtacagacctttctgtttttcttcctcagttttcgctctctggcagcaagaaacatgtagtattcataaggtgccggcaaattggccggaccccagactccaagcgagctagtttttgtagatctgctatggtgtgctttattccgttagtcgatatatgttgcattgtttctagtttcgaagtccatttatttacttctctatgatttctacacacggcctaataatcttgctaaggccctgattgaatggaaaatattttttgggagttttaggaaaatactacatttttgtgaaataccttggttttgagtaacagtaatatgaaggggatgtttggttagaagaaccaatccattctaaaaaaaaggtttatcaaaaacaccccaaccccacaaaaaaaaaaaaaaaaaaaaaaaagggggg

SEQ ID NO: 20518 - DNA, 1679 bp, Zea mays
ggcacgagaaaaatctcacgcaggagacaaatccagtaacccacactttccttcgcctcctccatcgtggtcgcggccaaggccaacgaaccaattcctctaccattcctcctccctcctttcctgccattctcccatcccggcagggcgtctcctcctcctccctccctcctttccatcccgtttcttcgccgcctccatctccaggccgcgtcgaattcttccatccaccgcaccggtcgacgacgacgacgaggatgctgggcgcagcgaggaggcagcttggatccggtcccatgctgggacaggttttgcgaagactccgaccagcggtggcggctgaggtggcgaggggctactccgccgcggcgaaggagatgactgtccgtgatgcattgaactctgcattggatgaagagatgtctgctgatccttccgtttttctgatgggagaagaggttggagagtaccaaggtgcatacaagatttctaagggcttgcttgataggtatggtcctgatagggttcttgacacgcctatcacagaggctggttttactggcattggtgttggtgcagcttatcatggtcttcggcctattatagagtttatgacatttaatttctcgatgcaggctattgatcatatcatcaattcagctgccaagtcaaattatatgtcagctggtcagatatctgttcctattgtttttagaggaccaaacggagctgctgctggagttggtgctcaacactcacagtgttatgcagcttggtttgcacatgttccaggacttaaggttctcacaccatactcttcagaagatgcccgaggcttgctcaaagctgctatcagggaccctgatcctgttattttcctggaaaatgaattgctttatggagaatctttcccagtttctgctgaagtgcttgattctagtttttgcctaccgattggcaaagctaagatagaacgtgagggtaaagatgttaccattactgcgttctccaagatggttggctatgctctccaggctgcagagatactgtccaaggaaggaatcagtgctgaggtgatcaaccttcgatcaatcagaccacttgatagagctgctattaatgcatctgtcaggaaaaccaaccgattggtgactgttgaagaagggttcccccaacatgggattggtgccgagatatgcatgtctgttgtagaagaaagcttcgcgtaccttgatgcaccagttgagaggattgctggagctgatgtacctatgccctatgctgccaaccttgagagaatggctgttccgcaggtcgatgacattgtgcgggcggcaaagcgggcctgctacagggcagtaccaatggcagcagctgcctgattggtggacaagcctttctgttttccttccatcggttttcgctctctagccagaaacatgtagtattcataaggcgcaggcaaattggccggaacccagactccaagcgagctaattttgtagatctgccatggtgtgctttgtcccgttagtcgatatatgtggcgttatttctagattcaagtccatttgcttctctatgatttttgtacaccgctaaataatcttcttaagcccctgaatgaatgcaaaatatttaagatgttttaggaaaatactatggttttgtgcggccaa

SEQ ID NO: 20519 - DNA, 884 bp, Zea mays
ttgggtacctcgaggccggccgggcgtttccccgacctccccactttatggagaatctttcccagtttctgctgaagtgcttgattctagtttttgcctaccaattggcaaagctaagatagaacgtgggggtaaagatgttaccattactgcgttctccaagatggttggctatgctctccaggctgcagagatactgtccaaggaaggaatcagtgctgaggtgatcgaccttcgatcgatcagaccgcttgatagagctgctattaatgcatctgttaggaaaaccaaccgattggtgactgttgaagaagggttccctcaacatgggattggtgccgagatatgcatgtctgttgtagaagaaagctttgagtaccttgatgccccagttgagaggatcgctggagctgatgtacctatgccctatgctgccaaccttgagagaatggctgttccacaggtcgatgacattgtgcgggcagcaaagcgggcctgctacagggcagtaccaatggccgcagctgcctgattggtgtacaggcctttctatttttctcccccctcagttttcgctctcgggcagcaagaaacatgtagtattcataaggtgccggcaaattggccggaccccagactccaagcgagctagtttttgtagatctgctatggtgtgctttattctgttagtcgatatatgttgcattgtttctagtttcaaagcccatttatttacttatctatgatttctacacacggcctaataatcttgctaaggccctgattgaatggaaaatatttttttgggagttttaggaaaaaaaaaaaaaaatgtgaaataccttgtgttttcgagtaacatgaagatgatgtttggttagaag

SEQ ID NO: 20520 - DNA, 2985 bp, Zea mays
ttatcacagcacacccacaagcaataagtggttcatgatgaagaaagaaaagtagtagcaatcctgggtaaaagttcaaagtgccctgattttcgcattttgtgtcatctcggatgaactttgctgctcagtcaggaaattatctgaaaagtaatagcacattatgattgctatttatattatatattattcttgtttttgtttttcacttttacatgaattcttcagccttcttgatatttgttgattctgaatccagtgctgcggtttctctgaaatgattgtcttctgtgcagatttttcatcagcagctcgattcttgatcttacaatagttggtattgattatacagagggtgactcgaccctacagggtcagcaacctcactatttgaaaacaagctgcaaaccaagcctagatcatgggagtcccgtgtacctgctgggacatacagggaaaaaagaactggtgattggtgagggcaaggtggttattggcacagacaacctcataaaactctcagccgagggggtgacatggtgtcctgggtctgctcggtttgcggccccagggaacctagctttcatgatctgtgatccaatgaagctggcctcttctcccaccgcaagatcatcctcggcatcctcatcctcatcacattcatggaagaaggatcagccaatgcaatttgggattcccatatctgtagtttgtgattggttatatcagcactggcagggcagcttggacgaggttagcaagccaaagttacctcttgttcggctgatgtccagcaggagtgatcactcaagcacctcgttcactcgtcgtcatgtgttcaagcctgacgatgagaacgatgatgcatccgtttgttcaaagcctaaacatcagcaggtatcaggtagcacagccactgcaaggatttcacatgaagcaaatcctatagttgatctgcgcacaagctgtgagcagggtgttacgactccagaaatatatgaatcgccaaggcgaagttcttgtcaggctcagaagaacgctgctgcaccaattcaactcttggacatcaacttcccacccagggttccaaagactatatttctaccattgcctctgaagcaaatgctttctgatgagaacaatgttgaaacgtcgaagccaaaatatcggtcaaaagacaatggcttcccatcagggctgatatggcaccgcaatattgaggctgagtgtagggaccctccggtagctcttcagcatatggattgcagcagcgagggacagtcgagctcgtcacctgctgagataccggagtatggatgccaagaccagtacaatagcgaggaggaaacaatgtactcagctgaaaccatggaaagcaggaacattccaagccccagggagaaacatgtggggaggagccagagctgtgttacctacagcaggtggagctctccaaggacctcatcaatgcagaatggaaccttgcgaaagcagcatacactgatccctgtgcggaagacgcactcgcagaacacgactcttccgcagaggagtcatgactacttaagcccaacagtctcctcagccatgaagaagaggaactccatggaacagcagcagcccacaaagcctcgacggagcaccatccagtcttctccaaaatggatgttttgatggttctatctatatctggttttgaggtggaaacaatgaagaaagcaagtgcctactcggtgaaagctactgctcctatgtttcctactcaaaacttacatgtaagtctgctcccttccctcagttctctacttctctccctgggttcctgtgtgcagaatggcatggataaataaagagaaacaaaaaggaaaagaaaagcaaaaaaatcatcacaaaagattacagatgaaatgtgttgaaggcggcatttgtgaggtgcgatgaggactgttatattcctgccgactctagtgttcagcttacaattttcaaactaaacatttttaatatgttttttttggtattttgctattcatccatagccatgatgactgtaatcattttgtttgctactgcttgcggccttatgtaccatgtgtgtcatcctgaattagaccaggaaataggttgagagttggctaccaagtgagtttttttttttcaattgaccgcttgtccgcagtgttggctgtgtgccatactatatagcaatgtaaatagcttttatttgaatgatgcggcagagttcattgtggtcctttcctgtattatagttcagtacttgaggaaaggtcagtttgctatagctccagttttttttttctttctaaaaggactccaactgatttcttttgtcaagcttaagctgttttcgaaaacatttggtaaaaagctcgaatgatagttttattacaatttagggttagggttcgagtttttggagggccctctatgaccatgcttagaaagggaaggatccggtgattgtggcgggttaaacggcgataagcgaagtatgcagaggaagataattggatggacggtgttggtggcggaggcggtgagatggcaatcttttcttctccgactagatttagaggtgggcaggggtagacagccggcggcaggggaaccgccggatagggatggcggtagaggtcggaggtgagggcaaactggcagggttcctcaaagaagaagagcatacggtggttggagaagatgaacagtaaggaagagaacccgtgcgtcaaatgttgcagcagcgcgccataattaagcgagtcggaacaaaaacacatcaagcacgagacatcaggagtcaaaccaagcatgaatccaactacgcatgcatcgacacggtctcctgtcgagtatctgtctccactctccaggtttgtgttgattcccccgtgcacatggaggtgctactgccactctgtcccgcagggaacatggcacagttaggccctgttcgtttacatcgga

SEQ ID NO: 20521 - DNA, 2510 bp, Zea mays
gtgaggggctccaactcgcaactccgcagctgagcacgccgaaaagctcatcagtgctcatcccctgctggcccgttctcagtcccagtgagaggctccatgaagatcctggtcgcggtgaagcgggtggtggactacgctgtcaaagtgcgcgtgaggccggacgggaggggcgtggagacggccaacgtgaagatgtccatgaatccattctgcgagatcgccgttgaggaggcgctgcggctccgggaggccggcgtcgccgctgaggtcgtcgccgccaccgtaggccctgcccagtccgccgacacgctccgcaccgcactcgccatgggcgccgatcgcgccgtccacgtgctccacgacccggaccctgcgcggcccctcctccctctcgccgttgccaagatccttcgcgccgtcgcgctccaggagaagcccggcctcgtcatcctcggcaagcaggcaattgatgatgattgcaaccaaactggacaaatgttagctggattgctcaagtggccacaagaacctttgcctccaaggttactgcgcgcttgcgctatcgttactagcagtccagtgctaattttatttcacgactcaagaatctggtgtctgatttgtacgttcaacaactgtagattggggtgggaggagacgatcgttgctttgacacactagtatacagcttgttgcatcattctccaactagaccccatgtgcttatctggataaacctgtgcgttggatttgttggagatagtgctactacatggtggccttaagatgccatttgtgggggtgagaccacgagtggcatcttagtatgttatgggctgcaattgggtctattgaaatttagcttggtttctcaaattgaggataagtggaagcttgtcgggtattacaacacatttaactttgatgtccattgttgctttcctttggtttctggtctgcgaaagggcttctagcctagttggttacgtggtttgagggcctgtttgaaacctctagagctaatacttagccaactaataaattattagctggattgagccagctaatgaactaattgttagttgtaaagtagctaacaattacctgtgatattagctgagtctgtttggaacccaacaactaatttttagtagctaattgttagttttataggttccaaacagggcctgagtagaactccttaggtcctgggttcgactcactgtgggagcgaattttcaaatcccctcgtctgtcccacaccaaagcacatgtctaaatcgtggccctggtcgcggttgttctcatatgggctacggtgccgctatatatgggtgagatagtggtttgagggttttcggggcggtcttactctcgcaagtcgagatttggtttctggtctcttcctcaattttcaccaacaatgtaaatcttttgtagctaacgcatgattggtaaaagctgaatgtaatcagatctattttctgattttgtttcattcatttcgtgttaagtttgtcctcaaacatatttgtatccttttgggagtgaaaggatgctaccccctattttgtaatatacttatgcacagcagcccttagttttcactgtaggaacttaagcaaatagaatacttaccatccaaatgtgtgtagaagaaaagtgtcactatgcaatatcctgtgcttataagctttctttctattaggtcctggtgtcgtgcttgcttcaactgttgtttatttttctgcaagcaccagtagagccctacatgtcaaaagttgatcctggccaggacaggaaaacaagaattaaaaaaaagaacaggaaaacagccacaccatttgttgtggcacaagataggtaaatagccacttcatcatgccatggttctgtcaaaccaatcaatcagtgtcttgagaaacatttcccttttttgctttgagttcgtatgtggaattgttttgagggttgcctgaagtataacaaagttacacctttcctcttgacatgtgcctgatggaagattaattgtttgttggcatgttttcagtctttacttcttggagggaatgtttttgaagtcttaaatgacattttttttgtcacaatcaaaaacatatttaaaaaagatataaccctcctctagtcaagactcaccaagtttaacttacttgggagtatatctgctgagaatctatgttcctgagtccttgtcttgtcactaacaggcaattgatgatgattgcaaccaaactggacaaatgttagctggattgctcaagtggccacaaggaacctttgcctccaaggtacccccccctactcttttgattagctggtaacacctaaaatatgagtatatgaccacccctactcttttcattagctggtaacacacataaaagatgagtatatgaccacgaaaaggactcttgccgttgcatatactcctaatctcactatgttcttattatcttcagtactattcataataacctatgcaa

SEQ ID NO: 20522 - DNA, 1088 bp, Zea mays
  misc_feature (3)..(3): n is a, c, g, or t
ccnggccggggatgacgcccgctgcttagtcagaaatagtgagaggctccaactcgcaactccgcagctgagcacgccgaaaagctcatcagtgctcatcccctgctggcccgttctcagtcccagtgagaggctccatgaagatcctggtcgcggtgaagcgggtggtggactacgctgtcaaagtgcgcgtgaggccggacgggaggggcgtggagacggccaacgtgaagatgtccatgaatccattctgcgagatcgccgttgaggaggcgctgcggctccgggaggccggcgtcgccgctgaggtcgtcgccgccaccgtaggccctgcccagtccgccgacacgctccgcaccgcactcgccatgggcgccgatcgcgccgtccacgtgctccacgacccggaccctgcgcggcccctcctccctctcgccgttgccaagatccttcgcgccgtcgcgctccaggagaagcccggcctcgtcatcctcggcaagcaggcaattgatgatgattgcaaccaaactggacaaatgttagctggattgctcaagtggccacaaggaacctttgcctccaaggttacattggacacagaaaaacaaaaagctactgttgagcgagaagttgatggtggaattgaaaccatctgccttgatctgccagcagtgatcaccacggatttaagacttaaccagccaagatatgcaactttgcccaacataatgaaggcaaaatccaaagttattaagaaagtcgccgctgaagaccttggcgtagatattagatcagacatggaggtgattgaggtcaatgaaccaccaaaacgaaaagcaggggtgattctttcatgtgtcgacgagctccttgacaagttgaaaaatgaagcacgtgtcctttaaccatttgtatattattcctcgctgaatatggtctgacgttcatttatttaagttctctctccaaatgttcagacttcagaccatttacaaataaaataagtgttaacatgaaccaattaagatactacccctgaaacatttacctattaaaaaaaaaaaaaaaagcggtttacttgattgtgt

SEQ ID NO: 20523 - DNA, 1571 bp, Zea mays
attcggctcgagctcgagccgcaattcgcttcgaacagggcagaggtgagacttgagagaaggaagaaggccatgtcgtcggcggcgcagcagcagcagaaggcggcggcagcggagcaggaggaggtggagcacgggccattccccatcgagcagctccaggcttctggaatagctgcattggatgtgaagaagctgaaagattctggtctccacactgtggaggctgtggcttacactccaaggaaagatcttctgcagatcaaagggataagtgaagctaaagctgacaagataattgaagcagcatccaagatagttccactgggatttacaagtgccagtcaacttcatgcgcagcgactggagataattcaagttacaactggatcaagagagcttgataagatattggagggtgggatagaaacaggatctatcactgagatatatggtgagttccgctctggaaagactcagttgtgtcacaccctttgtgttacatgtcagcttccactggaccagggtggtggtgaaggaaaggctctatatattgacgcagagggtacattcagaccacaaaggctcttgcagattgctgacaggtttggactgaatggtgctgatgtgttagagaatgtggcttatgccagagcttataatacggatcatcaatctagacttctgctggaagcagcttccatgatgatagagaccaggtttgctcttatggttgtagacagtgccacagctctgtacagaactgatttctcaggaagaggggaactatcagcgaggcaaatgcacatggctaagttcctgaggagccttcagaagttagctgatgagtttggagtagctgtggttatcaccaatcaagtagtggcccaagtggatggatctgctatgtttgctggaccgcagttcaagcccattggtggaaacatcatggctcatgcttcaaccacaaggcttgctcttcgcaaggggcgaggggaggaacggatctgtaaagtaataagctctccctgccttgctgaagccgaagcaaggtttcagttagcttctgaaggtattgcagatgtcaaggattgagaccatacctgctttacaggcatcttcagatccattggtctgctatttgctttgtcattccttgggccaactttcgtgttgcctcaccttgatgtacaaaacggtttcgttcacatatgtgaatgcacgcctgtgactgatttaggcgtcctgttgtaaataaaacgatgcctgttgccctgttgtgtgttgcatgtaatcgacaactctacatatcacaattatgatgtattttaggttttaatgttcgcttagcacagccattgctggatgtgcaatgtgggattatagacaagaatccacacaacaacaatggccaatcctgataaagtagttagtgacttgggcaaatagcattgtggtgatctttgagttcacttgtgataagaacagggctggtggctggtggtgaaaactaacttgtgatcggaacaggtttaatagggaaaactaaggattctataaaaaaaaaaata

SEQ ID NO: 20524 - DNA, 1113 bp, Zea mays
  misc_feature (1)..(1): n is a, c, g, or t
  misc_feature (11)..(11): n is a, c, g, or t
  misc_feature (21)..(25): n is a, c, g, or t
  misc_feature (32)..(33): n is a, c, g, or t
  misc_feature (43)..(43): n is a, c, g, or t
  misc_feature (56)..(56): n is a, c, g, or t
ncccccccctncccctccccnnnnnccccccnntttccctctnttcctccctctancccacctctacccccccccttcttcttcttttttttttttttttaaattaaagctcttgttattggcccacagaaggaaagaatgtactgtcctgtttgaaacaaatgaaccagacatgcatttccatcagcaacccacttggtcaacaaaggaggtccagcatgttctagagataaattgcgtcgattcaagaaactagaacattaaccgccacggcaaagtgcagagttaaaatgttgcttaatatacccattggcatttggacatcatgacttcagttgatcaaatgccgtcagaagactggtcttgtaagtttggatctcagcatattcttgagagtcgggagtggaactgactatagcgtaggcgccgaccttgtccaaaaatcctgcagcttcttcagattttgaaagcgcagcaagagcttttagagtttcttttcgtgttttatcatctttagcaccttccaatacattaagcagttcctgagctccccctatctctaccaccttcattcttctttggtcatccactgcaaaacgagctaaacgagaagctcccatccgcttgaacaagggatccttgacacgcaaaagcgagatagattgttgaagcaggttatcacccatgtatggaaagaattggtaaccaactaggccagcagttcctaggaagattatcttcaatatccatccaaatttcttctcaacttcttcctctagtgccctgtcatctctctcgtcgtaggtgcagagccttcgagccaagcggagccctgggccgctaccactccatccgttggccgctaccccggcgacaccacccctaggtaggaggacgccacccagcgtggagaaacgacgaggtcggcttcaggaacaggacgggctccttggggaccggattgccgagctccttggagtgggctatgtagttgcgcccaacgccgatgattttcgtgctcgccgcgaggagcctctgcgccgccgcagccgccggcatggttggtgggccggaggcgtcgacgaggaagtgaagttgacagagaagcgaatt

SEQ ID NO: 20525 - DNA, 876 bp, Zea mays
  misc_feature (668)..(668): n is a, c, g, or t
  misc_feature (710)..(710): n is a, c, g, or t
  misc_feature (870)..(870): n is a, c, g, or t
cccgccaaatgcaatctgttttttttttttttttttttataccaagaaaataaataaattaaagctcttgttattggcccacagaaggaaagaatgtactgtcctgtttgaaacaaatgaaccagacatgcatttccatcagcaacccacttggtcaacaaaggaggtccagcatgttctagagataaattgcgtcgattcaagaaactagaacattaaccgccacggcaaagtgcagagttaaaatgttgcttaatatacccattggcatttggacatcatgacttcagttgatcaaatgccgtcagaagactggtcttgtaagtttggatctcagcatattcttgagagtcgggagtggaactgactatagcgtaggcgccgaccttgtccaaaaatcctgcagcttcttcagattttgaaagcgcagcaagagcttttagagtttcttttcgtgttttatcatctttagcaccttccaatacattaagcagttcctgagctccccctatctctaccaccttcattcttctttggtcatccactgcaaaacgagctaaacgagaagctcccatccgcttgaacacagaggatccttgacacgcaaaagcgagatagattgttgaagcaggtgtatcacccatgtatggaaagaattggtaaccacntaggccagcagttcctaggaagattatcttcatatccatccnaatttcttctcacttgctcctctagtgccttcatctctcctcgtcgaggtgcagagctccaagcaagcggagcctggggcgtaccaatttcatccgtggcggctacccgggaacacgcccctaggtaggaggacgccaccccgctggaacgctcacgggnaactgg

SEQ ID NO: 20526 - DNA, 1723 bp, Zea mays
ttttttttttttttttactaaatttttaatatagtagtataaatttctatccgatgatatgtttaaaccatacaaaagcatatccgcagatcgacacctcccaagtccatggaaaaacttattgcagtctattagcttaccaagaaaaatgtttggatgcaatcccatcgcatcagcaaatgtttgccagggatttttgccgctttatcaatgtttagattttattctgtcgctctcaaggtattatgccgctttatagatcatgctctatgttcctgagtgcaaatgtctgccagtactagacctctttcatatccgattgcaatccttgttgatcccttgatacaagctaaagaactcagagacccgaggtcaaagttcagctcatgctcaaacctgaaggtagtggagttccacagacgaatcgagccgtcccttgaacctgtaatgagcattgaaagatccggatggtaacagacaacggtaacatgatctgcgtgtccttccagtgttcggacacaactcccatcctctatgtcccagatcttggcagtgttgtctcgagaaccggtgaccaagtatatatcagtaccacgactaaaccaatcgaaacattcaacaatctgacctgaatccgcagccaatgtgaactcacggcatccgtcagaacgatcgggatcccaaatctttactgttccgtctcgagcagtagcgatgatagtgctgctgctgcgatggacacttggagcaataaacgcgacttgcttcagacactggcttcccgcgtcaaatgttttttccaaatgccaggtactacgtctacgtgcgtgatagtagtgccagtagctccagatcaaaatcttgccatcgatggacgctgacagcaccagctcaagggcatcatcgtcaacagccaatgacgtgatagatttcgggtgttcacaaagacggcgtatttccttcctcgattcgcaatcgtacacgtggaggaatccacgggtagtacccgccacaatccaatcctggctggctataaatttagctgaactaactttcgctcccttaatctgaatcgtccattccactacctttgtatggtagtcccaaacatgaacaaacttgttagcttgagtgatgaccatccatggctttgtcggatggacgtctatggtgcatgctgaattgactttgcctataatctctgtatgtacatatactacgccctgcgccaggtggtcatcagagatatggtctgctgccactccgttctcttctgtaattggacctgtgtcgttcatggaagcagtagtcgtgatgctctccacatcgctatccttcttgtcctctatgtctatgtctacaagtgctaatccttccctgcttctgattgcaatccttttcgatcctttcaaacaagctacagaactcagtaatccgaagtcagcaaagttcagtttatgctcaagcctgaaggtagtggagttccatagatgaattgatccgtcagagcaccctgtaattaataacgagagattctgatggtaacagacagctctaacgggacctgcatgtccttccagtgtctggacacagcccgcattctcgcagtcccagatcttggcagttttatcttgagagccggtgactatatatagcttatcaaaatcaccaccactaaagtaatcaaaacactcgatctgatgtgaatgcccatctaatttgt

SEQ ID NO: 20527 - DNA, 2699 bp, Zea mays
  misc_feature (279)..(279): n is a, c, g, or t
  misc_feature (2691)..(2691): n is a, c, g, or t
gcggcgtcctagcggacaagttcagcagcgtcgcgctggagatggacccggagacgtctttgaggatgatggaggcggagctggcgcgggtgccgttgcgccgattcggcgagaccgaggagatcgcgtccctcgtcgccttcctctgcatgcccgcctcgtcctacatcaccgggcaggtcatctgcgccgacggtgcccgcaccattgctgcctaggccttcgcgctatgcatgctacactgagtacctgtactgaacgtgtacgtgccgacgactnccacacgcacggataataatgaatccgatccgctcgccgaattcctttttgcccgtgatttgagttcttcaaactaacttggggttcgagtttgaggtgtcgtgtgtatcatgtgcagttcaaaagacaaaagcatgctatgccaccgttcgctcgctagagcttccagtagaggcgagcgcggtggaggacgccggagacgagcgcccagaagaggatctgcgcgaagaggacgtagaggaggatgcccaccctggtggagtgccacaccttgacgaacacgtgcttcctcacccagtaaaccagagtgttgttggtgctctcgtagtaccacccgttgaggaagccctcgaagacgccttccgcggccatcacgtacaccagcatcgcgttcatgccgacccaccgcagcggcgcgaaggcgtagcgcaggctcacgacgtcgaccaagaagtagagcgctgagaagacgaccccagcggcgccggcagtgacgcagatgtagctgaacgtgtagagctgcttgttgagcgggatcgcatgcgagaagtgcagaacgattccgagaacgagaagagctacgcccatggtaacccactgcctaagcctgtccgtatggctcttcatgtggacaagcacatgcccgtagtgaacaccgacgaccgtactcagcacagcagacagtgagctcagtatcccttcaggctcgaatggcgcgacacaccacgctggggcatcctctctgaaaggcccctcgtgtggggagtcatcagtgcaggccctgtgccttctccatgccggcttctggtacatgtggttgatgcccaggactctgcggtcgatgtagcctacggcgttgcagggagggtccaacgcccccctcgtaccacacctcacctgtaggcattagggaggagcactgcagatgagttgcacttgcagacgagatcgagctagttctcgaggcccacatccgaaggctggaggaggaagtgttgggtgtgtcctctacagctggtcaactgtgaccggattgggctaaacccaactatctatctctttaaatgggcccttgattgggagggcccacgctaacctcggttggagcccccagacacacgacgctatatataggactaaggggtcgcaggaaagactaacgctagtacctcgccccaaaaccctagtcctcagaggcccccatcgcctaggcgtcggagtgtttggaaacgcgacaacctacagcggctcggatcccgatgccctgctgcttctctgcagggcgacggtatgaagatagcaacaacaacaaaggtgtgtttccccgttcctctcagtagatcagtagatcagatctacacgtcatcaaggttttactttcagttacggattggtattatagggacttaggaatcgatcctagacagtatagattctaacaatggtatcaaagccgtcctaagaaccctagatctcctaatccacatcagttttatgagatcacagaaaagtctcggatcaacatgattgaactttttttttcgtttatcacccgagaacagagtagatgagaataggatagaaattccaatgctctcggtcggtaagcgacacagtgtgtctcggcctcaaaccagagagagctctcaccactgtttagggttagggtttacgacctaaccctaatcggtacatatgtcaacagggacaaaaagagatcacagtagctcggaattttatttaaatttacaacccagaaacagtcaataaaacagaaaacacgtacagattatgtgtacagagcattatcaatataatccatgtactggttgtcagtcaaaggtacagaaatttcattcgcagaaaaataatagagctcgggtttaacaaatccgaggctcgatctgttcggtggtataaaaaaatatcaagaactctatacgattggaggaagggggtcgttttctcctgtagttccaaacagaaagaggatctcggagtaggagttaggacagaatccccaactcgaatcgagttccagaagccctgatgaaccgagttcgttattttaaaaaaacagtgaaataatgaaagggattttatccctaagagctcggcagaaatcactacaaccgatcagatcacgaacagaaatcggaacagatttcgaaaaaaaagagagagagacaacaaaaggttagctcgggctctgtggcgcacagcccagttgaagggctcggtcggccaggaaccagagttccctggcggctgaagttctgcgcggctgacagaacgaaaacagaagacagagaagggaaaagggaggcgcggcgttggccaggcgccggtgcttcctggcggctggggaggagaatagaaatgaagttagggtttccccggccgccccctcgnagggtacc

SEQ ID NO: 20528 - DNA, 1149 bp, Zea mays
  misc_feature (898)..(898): n is a, c, g, or t
  misc_feature (1146)..(1146): n is a, c, g, or t
acgttaagacaaggcgaaggtaccaggcatctctgttcatcctgtgatggagaatccactgcacagtgccgggcgttcacgaacttgctagtctagtacagtagtatatatattccgcgactgcgactacaatgggcgacagatcgtgcgcgatcgagagcgagctacctccatggcggcggcgggcagcctgagcagggaggaacggtggagcctcgccggtaagacggcgctcgtcaccggaggaagcaaggggatcgggcgcgcgatcgtggaggagctcgcggggttcggggtgcgcgtgcacacgtgcgcccgcaccgcggccgacctggacgagcgcctgcgcgcgtgggccgcggacgcccgcctgccgggccgcgtcacggcgtccgtgtgcgacgtgtcggcgcggggcgaccgggaggcgctggtggcggcggcgcgggcggagctggggcccaggctggacatcctcgtcaacaacgccgggcagagcatgttccgcgcggccacggagacggcggccggcgactacgcgcgcctcatggccaccaacctcgagtcctgcttccacctcgcgcagctggcgcacccgctgctcctcgccgcgggcgccggcgccggcgccgcggtggtgaacgtgtcctccatcgcggggctcgtcgcgtacccggcgctggcggcgtactcggcgaccaagggcgggctgaaccagctcacgcgcagcctggccgccgagtgggccggcgacggcgtgcgcgtcaactgcgtcgcgccgggcggcgtccagacggacatgttcagcagcgtcgcgctggagatggacccggacccggagacgtcgctgaggatgatggaggcggagctggcgcgggtgccgttgcgccgattcggngagaccgaggagatcgcgtcccttgtcgccttcctctgcatgcccgcctcgtcctacatcaccgggcaggtcatctgcgccgacggtggccgcaccattgctgcctaggccttcgcgctatgtgcatgctaccctgagtacctgtacggctgtactgtacttacgtgccgacggctccacacgcacggctaataatgaatccgatccgctcgccgaatcccattttgcccgtgatttgaattgagttnttc

SEQ ID NO: 20529 - DNA, 3879 bp, Zea mays
  misc_feature (2500)..(2500): n is a, c, g, or t
  misc_feature (2582)..(2582): n is a, c, g, or t
gtgctcgctttacactattttttacacgacatggtggcgccgagggtgaagccgtggtatcaacagttgccttaatagattagtatatagatgagtttgggatgacaatatcaacctgtaactcttgcttattcatattttgagctacccataccaagatacagaacgtaaacaaaagcaaaatgtactaaaaaaaactatcttgctgagagtcgtcatcggatccggacgaagccctcccggcgacggcaaagaagtaccctgcacggcaccaccgtgtcgccgaccttgacaccgggcgtcacggtaaatgcgacgctgagcttctcctcacccgtctccacgcggcggtcttcttccgcgccaagggcaggcacgctctccatgaactccgccctgtacaggctccccctgctcgcgtagaacatcctgacaccatcaccaccaccaccactctgctccgactccgagcagcccgccatcagcacccgaagcgcccacacggacctcgcggccgccgcgaacgcgcggtagagccgcgtcctcgggtgcccgccgcgggacacgaaggccctgtggtccaggttccggcacgcggccgcctccgcctccggcgacacggcggccaggtaggccgcccggcagaacgccgagagccccgagcgtgggaactgcatcagggcatcgagcgcgtcgcgtggcttcatgatcccgtggaagctgctgccggcgtcgccgccgccggtgccaacgagcagcatcgctcgccacaggtgcgcctcgatcgcgtacctcctccacgaccgcgcctgctctgcaactgcgtcgtcgctgctgctggcacaggtaccagcgccatgcagcagccccgcgaagtcgccgaccgacctggacgccgccacgaaccggctcacgagggccgccggcgtcgtcagctccttgggcacggagagcagcagacgcgtcctgcgacgctcgtcgtcgttcctgctcctgacgacccgcctgctcagcctggcgttgtcgtgctgcagcctccggagctccctcccgagcgcggcgatgtcggcgtccctccccctggcctcggcctccaggcgctgcaccagggaccaccggtcgtctaccagcggcccgatcccgcggcgggagctgcacaggcactgcagcgcggccaccgagtcgagctccgacgccacggcctcgtcggccgaggccaccctgtcggggtcgtacgggaagtgcgcccgctgcagcttcacgtaccccgacttgagcgccgacaccgcgtcgaacagcctcacgaggacgagcctcgggtcggggccggggtcgtgtccgggcttcgtggccgccgccgccgctgcctcgcggccgccatcgtcagccgccggcgttggagccgcgcaggccttggtgaggctcaacagcttggtgaggcccactaggagccccggaacggtgcatgttggagtggctggagccctcgcgcttcttgctggcgctggtgactccattgcttgtcttggcgacggcggctgcttgcagcatccagaaagaatatgatcgatcctcttcttctccttctcttattaacgaattcgcgcgacgggaataaaaaaagttcttttcttaacgaactagatccattggtggggaaataaatgaaaactctactcgtgcattcagaaacaacacagtgtatacttttttttttgcattttgtgagaatgcgtgcggtttcctagtagaaattattagtaactgattaattcacgcaggactctacgtctagatgagagagaaaaaaatgcatcgcgtgcagggtcgacgactgaatgagcaggatagatctgaagggtgccgagccgacttgaaaattttcaagcgaaacgatttgaataatgagcaaccaaaacaaatcattcgtcaagctaggctttatataccttgtcacattggccactaaactatacagcagcagcagtatatcaagttagcataacaaaataaagccaatctgcgaaagaactgtcggttaatcataggaagaaacaagaagaagaagagaaggggacgacgagtactaacctgccgctgctgcctctgcctgcctgccggtggaactgacgaactctactctagacggaccgaggaagatgagaccagagtggcagatacgccttcgcccttgcctcgcctgaactcgaaacgttcggtcggcggcggcgtcaagtcgatgcaagcaggagcaggagcaggactacgggaggtgaaacaggaaagcagggccgcaggggacagtggccagtggtggtgctgtgaagacaaggcgacatggcattgggaaccacgaaagcaaaagcttgggtttctccctctgtcaagtttatgtatatgtatgtaaaggaggaacgaaggtggccagggcatgaatccggatgattgctatcctatccataggagtgttcatatggaaaggcaggccaccggttgtggntgtgcacaagaatcatgagaactcatgcaaattgcatctccgactccaatctcccctaacactaacacattcctcagtcttngaaagctttggatatttaatttgattttttctggtttttaatttggatttttctggttttctatctccccgaacacttaatacaataccaacttcagtacattgcagtaccaagtgtccatgcctacaaggcagtacatcaaaagttctagttgcaatacgccaataccagcgctttactcgctgcaacttacgatacgaccattacgtaatagccattaaaatcactgttcttgaccaaaacattcagcagatgtacatcaagtctggcatcacatccattacaccacagttcatcatcctgagaacaggcatcacaagtctggcttgtcatcaattcctaggagatgtcttcttcacctttgtggccaccctgcttcttccttggacttggagtcatcttcttggctggtgcagtgcaggctttggtgcatggagggactggaactggaatgaccattttcagtggttgtggagcttctaaggtcaatgtcttgctgctagctgttgctgcccttgccctcggggttttatggagtaggtgttggagctctggtggtgttgaaaactcatcagtcatcaactgttgctggtgaaggttcaggagccgttgcaggttttttcgccccgggctgtgcctgttgttgggtgtgtcctctacagccggtcaatagagactggattgggcttaacccaactatcgttcctttaatcgggcccttgatcgggagggcccacgctaacctcggttggagcccccagacacacgacgctatatatataggactaaggggtcgcaggaaagactaacgctagtacctcgccccaaaaccctagtcctcagaggcccccatcgcctaggcgtcggagtgtttggaaacgcgacaacctacagcggctcggatcccgatgtctgctgcttctcagcagggcgacggtatgaagatagcaacaacaacaaaggtgtgtttccccgttcctctcaatagatcagtagatcagatacacgtcatcaaggttttactttaagttacggattggtattctagggacttaggaatcgatcctagacagtatagattctaacaatggtatcaaagccgtcctaagaaccctagatctcctaatccgcatcagttttatgagatcacagaaaggtcacagttcaatgtgatcgactcattttttttattatcatcgatcacccgagaacagaaagattagaatagactgaaataattttagatctcgagttagggttttgccccactgtcagagactgtctgtcgtgccgaatc

SEQ ID NO: 20530 - DNA, 3261 bp, Zea mays
tgatgactttaaggaatatttttcatgaactatgtaattctattgttttttaaatttgtttttgtagttttgttttgcttaacgagctatgtatttttatatctatcacattttacgtgttttatttgattatgggtatctaaacgaaaatttgttgtatcgctgatatggttgtaagctgacgataaatattgtgccgatgtggagtaggacgttatgatagatatagaatgacgattgtcgatagtcgatagtaagaccaaccggcctgacagacattcagttaattggctgctggagctgcgggaaacatgccaaacaagagagccaggtggcgagtgagcagtgacgacacctgtcccggtccccctgcgcttggtggacctgctctgcaattgcttggttgcccccactcatgccgcaacgcgtcaaaagcaaccatcatcgccaaagcaatggagggcctgcaggccaatggaagaccaagccaagaagccccctgtgttcttccctccgtctgctgccgcacccgccacagcaccagaaagattcctagtcctccactcctcctccacttgagagtgccccacgcagcccactgctgggcagaggccgcgcgcggcgccagcgccaccacccctttctcttctcccctctcccgtcacatcctccacccaatgtggcatataaatcccagatccagatctcccacctccctcttgtttgtatagccaggcagccagcctcaccatgtgatctctcgcaggtgtttcttgtgttgttccatccttattttgcattgatgtcaaggtttttttttttttgtcagacccatctacgggtggtgtctgggcgcagtggtttatcgatctcttccttgccttgtgctggtccggccgggagtggtggttcaagcgttttattgttgcagcagctcgcaaacaacgcgggaatcggtcgataaacctctgcatccagctctcactgcggttaagggcatgagctaggcagcagtgactgactgactgctgcttcttctttgcgctctgggttcctgctccttctgagtttattatgtctagtgtctcctagttatgcttgatattactctgcgcgtgatttgaccatcgaaataccgtcgtctttgtcttcatgtaccctggcgtttgcttggtccacgtattcttttattatacagtcgatgcttacacagtaaccataaattagatatctagcgtcgctttatgttttcttattgttaatggcatcttaatattttgtggttctgattagatgatgcttgcgtattttggggggtatagctagaggtatcttgggtagtggggataagttccttcttccttgctccagaaattatggttttgattggaattagggggtggacgcctagcggatcttgcttgctgccgtcacgcccttcgaatagattccagtttgttgtggcggtgagtcacattcaggacatgtcttgttcggctcagtggggggtgcgccctttacagctggtcgttagtgaatggactggtctaaacccaactatctatctctttaaataggcccttgattgggagggcccacgataacctcgtttggagccccagtcacacgacactataaatataggactaaggggtcgcaggaaaaactaactctagtacctcgccccaaaaccttagtccccagaggcccccatcgtctaggcgtcgtagtgtctggaaacgcgacaacctacagcggctcggatcccgatgccagctgcttctctgcagggcaacggtatgaagatagcaacaacaacaaagaggtgtgtttgctcattcctctcagtagatcagatctactcgtcatcgaggttttactttcagttacgaattagtattctagaaacttagtaatcgatcctaggcagtatagattctaacactcaggagtataccagcatactgagcagctatgtctttttctgttatatgctgaaaattgggttagcagccatctttgggttcaacaatattcaagagtcttattgcgggcagccaaacgcagtctttattcgaataactggtggtcattgcattgcgctgccatttcattcctttttatttaatctggcatcatagtttttgtagttttgtggtttgttctctgtttaagtgagagctaatttgagagcaagtgaattgtaggattgaagggattaaaatcatcttcctattcaaaattaaatagaaagaggattttagcccctcgtttccttccaattttcttgctcctaaacttgtcttaagggcttgtttgggagtaaggataatggaaagggcttgtttgggagtaaggataatggaggagattgaggggatataatacctcactattcatttttaaatattgagggattttagccacctctattccacttgcttccaaacatgtcctaaaagattatgtattactctcccggacgagttttttatgcataattttgtattgtttacaccacagttagaatcttcagagtaattgctattcttattgatgtgcatagcgccacaaggcttctgtttgctgccagaaatatgtgtgatcgagtagggcagtaggcaaacatgtccatacaaaatgtgttattataggacatgctgatttccaaagacatgttacgacttcgtttggctttaatacatactggcttctactgcttctataatatagtccgaataactagctttaatccgaagcggacaattaatttatgttatggcttgacattcgtggtgcatggaataacggagtaagaactttgaggagacacaagatggtctcaaaaactgtaactcaagatctttttatctcttcgacgtatttccttttcaaccaagataatttatttgcagacccctttcaaccttgtttggatattcttgtattcaccctaatctatatgtattgaagtagattagggtgaatacgagagcatatgcctttgatgtgacatttgaaatgccactcatttacccgtttcttttgctgtaaacaattgcatatatttgggtcagagaccttgacctggcaattatcaattattttagtttcttttttttccgtatcaattattctaagctactgtcaggtactactttggtgcagttaaatctacggaggcaaagagaaaaggggttcacttgaggaatagtctataggaatatatgaaggcccttctctgcctttgcaattaacctt

SEQ ID NO: 20531 - DNA, 1490 bp, Zea mays
  misc_feature (262)..(262): n is a, c, g, or t
  misc_feature (315)..(315): n is a, c, g, or t
gatcagctgaaatgccgttggactctgggcacgtccagttcaattcccttgccgaattgaaaaccttgcacacgtagtaatcgaagcgaacaggtgtctagcttggcccggacctacgcggagcttgttaggatgtgtcctccacactagccggttaacagtaaccggggtagggttaatcctaaccgtctaaccgcgccccctgatcgggggggctatcctaaccgttggttgcagcccccggtcacacgacgccatatanaatagattaagggggccgacgggtttagccaacgctaatcgctcgaccacaanaccctaatcgacactttgagaggaaccgatcccctaggcgctcggagtgactggaatcgctgtgactatgtctcagatccccgttatcccatcgggatctgagattccccctgcaggcaacattggaggagctgatccaccgccgatcaacgacgggaaccaatctcctcgacaccagcagggtgatcgacaagaaggaggaggcgggtcttcgctgcaagacgccgccgctatgatggctaggaacaacaacgacggtatgtatacctatacccctcagtagaatagatctactcatcatcgaggtattttagacacggattggtattctaggggcttaggatccgttcctcgggcccagttatttctaacatgtagcgcaagcgaccgaacaccgaagactggaagtagggacgttatgcctaaactaatataactcttgaatccattgagcacgtcatccgagtctaaaacgtgcatacataaatttactcatcggtgttagttcgaaacaacgacaataatattgtgttttagttgtgtcttatatctggagtattgtacatggtgtcaggttgaatacatgccctaaggaaatttgttttataaagagatagatgtatataattgtttggatgaggaaggattttgagtggcgtccgtccactttgttgctgttgctgtctaggcacgcgtttaaattgaaactgcaaaaggataaaggaaaaggtgatcgatcggacactacgacctttccattttattctttatttactgtgcttagcgacgatcagacacgcggagttcggacggatcgatctccagcatgagaagaaaaggctcgaaaggtcacaaaaagcgatcggaagctctacaggggattagagcggacacaattctgtctttagtagagcaatcgacagttcctttatccttctttttcatcgtgcccagtaggatgtactgtagctatcgtcggaaattaaacagataatgtaaatgaatatttttgtgtatgttagtggttaaaatgtaaagttaattacgccccgtttggatcactggaattgaattacattctaataacgccctgtttggatcactggaattgaattctattctaataataataatttaggcatatattaattaagctaattcacttttatacaaag

SEQ ID NO: 20532 - DNA, 1162 bp, Zea mays
  misc_feature (1143)..(1143): n is a, c, g, or t
acgttaagacaaggcgaaggtaccaggcatctctgttcatcctgtgatggagaatccactccacagtgtttgccgttcacgaacttgctagtctagtacagtagtatatatattccgcgactgcgactacaatgggcgacagatcgtgcgcgatcgagagcgagctacctccatggcggcggcggcggtggcgggcagccggagcagggaggaacggtggagcctcgctggtaagacggcgctcgtcaccggaggaagcaaggggatcgggcgcgcgatcgtggaggagctcgcggggttcggggtgcgcgtgcacacgtgcgcccgcaccgcggccgacctggacgagcgcctgcgcgcgtgggccgcggacgcccgcctgccgggccgcgtcacggcgtccgtgtgcgacgtgtcggcgcggggcgaccgggaggcgctggtggcggcggcgcgggcggagctggggcccaggctggacatcctcgtcaacaacgccgggcagagcatgttccgcgcggccacggagacggcggccggcgactacgcgcgcctcatggccaccaacctcgagtcctgcttccacctcgcgcagctggcgcacccgctgctcctcgccgcgggcgccggcgccgcggtggtgaacgtgtcctccatcgcggggctggtcgcgtacccggcgctggcggcgtactcggcgaccaagggcgggctgaaccagctcacgcgcagcctggccgccgagtgggccggcgacggcgtgcgcgtcaactgcgtcgcgccgggcggcgtccagacggacatgttcagcagcgtcgcgctggagatggacccggagacgtcgctgaggatgatggaggcggagctggcgcgggtgccgttgcgccgattcggcgataccgaggagatcgcgtcccttgtcgccttcctctgcatgcccgcctcgtcctacatcaccgggcaggtcatctgcgccgacggtggccgcaccattgctgcctaggccttcgcgctatgtgcatgctaccctgagtacctgtacggctgtactgtacttacgtgccgacggctccacacgcacggctaataatgaatccgatccgctcgccgaattccattcaaaaaaaaaaaaaaaatgagttnttcaaaaaaaaaaaaaaaa

SEQ ID NO: 20533 - DNA, 548 bp, Zea mays
  misc_feature (26)..(26): n is a, c, g, or t
  misc_feature (34)..(34): n is a, c, g, or t
gaactctaaccgaaataatcccaganccgcacgntctgtccgaaggtccaatatcgtttttttgggttcaaatttgtgatcagaaaacatgtatagaaatcagatcaagtgcgcagagcacatgttcacgcatccatagggcatcaggaccaaaataacttcacagaaaagctcgaataatcagatccatgcttcaaaaccctccaaatctcgattcccattacatattattcatttcttacaagcatacataacgtgaagtggggatcgaataaaaaaaaaagggagaaaatcatgacagagatggccatgcagccaagtgcatgcagcaatgtccatgcggccagatagtaaaaaaaaaatagaaacagaaacagagagagaagaagcatgcatgcaacacgcatgctaaaagagcagaaccatgctgtgcgtaggcaaacagagaaaaaggagaagcatgcatgcagcgcgcagtgcgcagctccactcctgacggcccgttttttttagagaagtgcggctgagtgggagataaaatgaattag

SEQ ID NO: 20534 - DNA, 871 bp, Zea mays
  misc_feature (20)..(20): n is a, c, g, or t
gcggtcgatgtagcctacgncgtgcaggggagggtccaacgccccccctcggaccacacctcaccgttagaactttgccgtagtctgggctgtcagcgtttcgcactctgaactcccagtcaggaacgtagaccccgtaggcaagggacaggtagaccaccagaatgcagcacgcgacgatccactgggagagatacattctgaatacacgggagaagcggcctgaagaacctggcggctggtcctgatgaaccttggcgccgtctttcgtcaccatctctagaaccgcaaccaccaggtacgcaagagcgatcctctggaggattccgccccacctcacgtgcctcatgtcgactccatacgccagttcgtccggagcgtgggagtaaccgccttgcaacaggatgccccagaagagcagcttcagcgtccttacgaccactctcctcacggctcggccacggtccgggatcctcttgagggccaggggaacggccatgccgacgatgaagaggaagaagggcatcaccaagtccgcgaggttgcagccgttccacggcgcgtgcccgatgaccggccactcgccgccggcgccgtccaccagtatcatcagcgcgacggtgaggccgcggaagacgtcgagggaagcgacccgcctgctggggcgaggcgccttctcgttggcgtcggcctcatccgtcctccatggaccgccgcggcggccggggtcctcctccgcgacgtcctcaaccaccttgttgctgctcccgtcgtccatggacgctctcgtacgtgcaagttgccaaaaccctacgcgacgcagacggggcgcgggggcgttgggataagagagagtgagggattgagagag

SEQ ID NO: 20535 - DNA, 2370 bp, Zea mays
tttttttttttttgtggtaggactttgactttccaatccagaaatcgtgaaagaacacgaaaaccaaggtagggtctatacaagctgggccctaagattgtccctttcaaccggacggaactctgctgacttgactggaagtctggaactggagcacagcagatcgtgtagccggatgccttccttctccatgcttcattgcttcgtaccagcagcagtttcttcccggactctctctacgcctggctggcgttaagcacggcagggctcgctgtccacccaaacctccgccggactcgcgggcccgacgcccaagaagcggtgtcgatgctgactgaggaccaccctgcagcctctcgtagacgtagctcgcgcgttcaccagcgagcctcccaacgacaggccgccgccgccgcacctccgcggcgcaacgccgagctgcgcgcacctgaggaactcggcggcaccgccggccagccgctcgaacctctggacggcggcgcgtgcgcgggagcgctcgtcgtcgccgccgccgcgggcgagcagcaggagcgccgacgcgaggcacaggagcgcgcgcgcgacgcggcgcgggagcggcgcccgcgccagcctctcccgggcgtcctcctcctgcagctcgcgcagcttcaaccggcgcagcgcggcgtcgcactcgtccgcggcgcgccgcagtctgcggcgccagcggagcagggacgcgtcggtggcggtggcggtggcctgctgctgcaagcggccggggcggctggacaactccagcgcggcctccatctttacgtacgccatctccaggcgctcgatgccttcgcgcgtgctcagacgctccctgtgcttgctgacaatgaaggatgatgtccggttcaccacctcgccgacgacaatggacccgaccgtctctgccattgctgcggtagatctgccgactactctctcgcccctgactaataatcacatcaggagtcggttgcctaataatcaaatcaggaagggagatgatatttatggaagagaaaaagggttggatgtgtcctcctctccagctccagctccaggtcaataatcgagggaacttttgcacgacccgcagtccgttgactacaccaagtcaatgccgcgttagctgaccacccttttcgtgggaaaaaaaatttgttgtagcccggttacaaaccaggctatttgcagtccctcacaaaaaagaggatagacctcacctgcaagtctaacagataacgttttagttgtgttattggcctacaggtggggcctatcctcatttttgtataacgttttagttgtgttattggcctacaggtggggcctatcctcatttttgtgagaggctgcaaacggcctggtttgcagcccggctgcaacaaatttttttccattgcctaagctaacaacatggcgcatttctgagatctacattccaagtgtcttgagtagtgctatcagaacggtgtgctatgggcctcggccctgtggctgtcggaccacaaatcaaccgacgggcgtccggcccatagccccctgactgtgactgcacgatcaggaaggagtacaggaccaaaatcttgtcgtgaagcacaggtgtcgcaagccacacatttttcccccgcactcctcacacagtcacactgtcgaccgcaccacgagtggccatgctccaactcgcccccacgccgctgccgtcgccggcggccgggcgtaggcctcgaccctcctccgcatgcatctgctgctcgagcgtacgcgcgctggaggaggcgaagcgggtggtgctggtgcggcacgggcagagcacgtggaacgccgagggccgcatccaggggagctccgacgcctccgtgctcacgcccaagggggaggcccaggccgagacctgccgccagatgctcgcctccgactccttcgacgcctgcttcaccagcccgctggcgcgctcccgccgcaccgccgagatcatctggcaggggcgtgggcgtgggcgtggcgacggcctcatccccgaccccgacctccgcgagatcgatctctactctttccagggactcctgaagcgcgaagggagggagaggtacggtcctctgtaccggcagtggcagaagaacgcggccgagttcagcatcgacggccactacccggtgcaggagctgtgggaccgcgcacggagctgctgggagaggattttggcgcaccggggcaagtcagtgctcgtggtcgcgcacaatgcagtgaaccaggcacttgttgccacctctttgggtggggtgcatcctgcatccgagcgtgggatcggagttcattgcgtgtctaagtgtgatcgaagctgatttcgtgctt

SEQ ID NO: 20536 - DNA, 1898 bp, Zea mays
catttcggtggtaataaaaaccgaacaaaggttctttaaaaatattggcaacagcttttgttgatcgccattatcaacctttggttcccctttggtgcctctgcctcggtttggcgtaagatttctggttagtagcttgactcaaaatccattagcaccttctccccgttgttgactcgggttgttcttcatttctttctttcgccagttgttgccgatggcatagccgtgcactgtcgccgttggtgtgcttcgacccagactccggtgcttacgtggatcctctgttcttcttcttcatcctccgtcatcgagatcttgctgacccctgtgcatttcctctcgcaggtattcctactcggcagtgttttggttttctcctcagatctccgttccccctaatccattgatccatctcgccgtggtgacctccacccccaccaccatcccctgagattggagtgttgggtgtgtcctctacagccggtcaatagagactggattgggcttaacccaactatcgttcctttaatcgggcccttgatcgggagggcccacgctaacctcggttggagcccccagacacacgacgctatatatataggactaaggggtcgcaggaaagactaacgctagtacctcgccccaaaaccctagtcctcagaggcccccatcgcctaggcgtcggagtgtttggaaatgcgacaacctacagcggctcggatcccaatgcctgctgcttctctgcagggcgacgatatgaagatagcaacagcaacaaaggtgtgtttccccgttcctctcagtagatcagtagatcagatctacacgtcatcaagattttactttcagttacggatcagtattctaggaacttaggaatcgatcctagacagtatagattctaacaatggtatcagagggacctaagaaccctagatctcctaatccacattccgtttttttttttgagacacagaaaggtctcgaatcagtggttgaactcatttttttaatcatagttcatcgcccgagaacatttttttttttttttttggggtaaacagaccgatatttcagggttagagtttaataacctaaccctaaccagttcatccgtcaacagagacggcgcacagggctcaggatccaacgatccacgaccaagaatcaacgaataagaaacaggaacacgcagatctgtgcacagatgcactgactggttcaaaagaaaagaacggccaacgtcactggctcaacagaccaccgacgaacgattctaccgacggccgagcgcccacccgtggggtcgcgaccgccggcgagagagcctgcggggcccgtttcgccgtgcacagtgccggccgagccggacaccaagaggtcagccgttgtgtcctggcagtctgctgagtggagagggagccctgagcttcaacaagaaacagaaaaacagcaaagagatgggcggctgtgcggctctgtgcagggcggcgcggtcggccagaggccagccaccagtgcttcctggcggtcgtgtgaaggtgagccggccgaaaaaaaaaaaaaaaaaaaaaaaaacagacgttcggccaaacgaaggataagagagaagaaatagagaccaagaaccgttctcgttcttgtgcatcacggtggcaagaatacagcacaggcacttagcttctcactttactagtgaagataatacacagagagcagctcaccgcggtgtacaaaaacagaaggaaaagagagcacgtaatagaaatgaagaaatgagaataaaaaaaaaaaggctcgatcggccagaggccatccgtcgaagctccctggcggctgtgttttttttactgtggcggctggggagattgagaagaaatgagcattagggtttt

SEQ ID NO: 20537 - DNA, 1765 bp, Zea mays
gaactaaacaggactaaaaatcccgggactaaatattagtccctctaaccaaatggtgcgtttttttttttttttttgcgtaaatgtttgtcatccattcgaaatggacagcggcagtgtttttccatatatataaatatctgtcatgattacaacattgacaggaatggcacacatttctgacacgtatgcaggcctgtgggtgtactgtgtcaaaagcttcagcaaaaaggatctgaaacaggagaagaatcccagcgacccagcctgaactcgagatgtggaaactgatgtatgtaaccggaaagaacaccacttggtgtcttcacggttgcaactcacgagcactagccaaggcttcttgaagactggctgcagccttgtcgtacattagaaaacccatgaaccagaactcatgcccttcaacggaaacgacctgaatgtacttctcagcgggatttactttgcttactgaaggattagctgctcttagctggtgaagaggaatgaccacctgttttttggaaagcgaagaaaacatttttaatgaacagacatctgtttaattgaagtcctactgggaattgaacatcaaaacggatcaagcaacaactggaacaaaagatccaagttaggtgttgacaaattagcatgcatcttcttaagtgacagtcagtgcttcagaatgcaacctggtttcatccatgtatagggaaagcaccatgaccatgtcctcattagagagatggtaacataagccttgtgacttcgtgaccataaaatcaacttgtatttaccagtgccacttcttttatgattcaaactaaaatttatcacaaatgtgcaaggcttccaaactaaccagactgcagttgtcaccttttttgtttagaatttaatatatattttttcagaacagaatgggagtgaagagcatcaccattctcatcctcaaatccaatgacatttttaccagtgaccctaaaaaggtttacctatcctcatgtagtaagtcaaatttataaatctatgtaaaactaacaatgatgaactatagaaatcaattcagtccaaatatgataaactgaggtgcaaaacgaagattgattttgatagggataactagatgctaagaagggagtaaccctctaccttgtagtaactccattcagttttatttccagctttgtatgacagaggattgtcactgcagaaagcaatcttcgctgtagaaatatacaagactcccatgacaggacctgctgatgttgagagatagcacgcatagcatattttcagctcctcgtctggaagaacctcgaaggtctgcttaaatattttttcatagcctccttctgctaaaactttagtcccttgtgctaggcgtcccatagcagcttcagtaaaactaggtccagtcttgactgttaaatacaatggcatattgtcaggcctagggaaagccatgttaatagacgaaagatattaagggtccctttggctcagtttctgagctagattcactgtcaaaaagctgaaatcccaaccaaagaggtaaatagattcctagaaatctacatactcctttagttcaatccaaaatctcctcccactcccacaacagattttccagattcctaccattcaaattttccaaaatattacccacctgtcgctgtttataggattgagttgttttcttttctattcagatgccccccccccactggactcgacggcacctagggtgccaccgcatccctgc

SEQ ID NO: 20538 - DNA, 975 bp, Zea mays
tgggtaataattcatctgactcccggagtagtaatcaaatcaaatgttgactaaaatatcgtagtcaaagtcattctaatttggttaatgtgcgtctcgtccaaatcgtaaattgagagtattctagtacggtccatttttacctcttaaaaactctagtcctaaaaccaaaatacgtggacgagagtatttctcttttcttttaaaaccatttttggagagaaaaatctcctctatcttatccaattgccgatctttttcccttatccttatcttgagtacatgttggagtccctggaaattttcccctgcgctggtctcctccctacgtgcgcgcagggcacctggatgccggcgtggagctcgctccctcgttcttatctccaattacatactcatgtctcctttcatctgctacacgcgtgcgtccctggcgctcacctcctacttctctttcctgccccatctgcctgttgatcgctgtccgctccagctcgcggatgctgcgcgcctaggtgatgctcgtcctccccttcgcacggttggccgggtggccctgtcgccgttcctcaggccgtctcagcttcgctcgatgctgagttcctctccagcgcgcggattcctccctgcgtcgcgcgtgagttcggcgtcgaactccccaacgcgcaactcactgagctcgtccctgcgcgccatgatcaccagtcgtcggcgcttgctcggattctcttccctgcatgcaagctgtctgtcggccgagctccatccctagttgtgctcgcgcccaactcctgcgtcacgcacctgtaccgtttggttcagatatttgtaacgtaatgagtaagtgataacgttaaatcatgtttgttttagtcccaccgtaatcagatactatactaaaaattgataccggactattcaaacttgttaccgacagtaatcgaatgtaaaccattaccaaaaaaaaaaaaaaaa

SEQ ID NO: 20539 - DNA, 2759 bp, Zea mays
cgaaaacgtttttctatgtgcggttgcagcaggcgccgaaatttgggtaaaaaaagacacggcggctacaactttctccagagatttccatcgcacaactctccagcgactttctccatagatttccatcgcacacctctctagtctccatccgtcgggacgccgcatctcgctttctctcccagttgcttcgtctcgctttcatcctctccatgtcacttgggtttcgtcggcgtcaaggactccactttcgcccgacgacttcgccttctcttggcttactcaccggctgtgtctctttggttagatgcgtttttctcctttgtctttcgtcgtccctttcgactgggtcgatacctggttccagatccgtttgtcgatcatatcgagcctcctctacttgagatcctcttgctttttgggatcctgttgcttcagtgcgtggagattgagatctaaacgacaagtattttcttttggttaactggttcgcaagaagtgtagatggacatcgggttccggatttgtgcttcgatcatatccagctgccagcttggtcgtcgacacgtttatttccacagttgtgctcccattcttgcttcgtcgattgtttcgttttggtgcacagctgatttcgtttgtgtcaaatggtatgtatgaagttcaaatttcgccttcttcgatttatgacatgtaaatttgctgcatttcgtttgtctagcataaggctgtctcaggtcggaagatttccggttgtgctcattgcaaccaagacgaagaagacgacgacgatccgtccacaacggctgtctcctctgcgggcgtattgacgccacaacccactatgggtatcttgagttggccttcaagcagatggcagagaccgcagacgccagcaacgcactcgaccacaggcttcactaccttcggttgaccggcaatgcatgtgcggcgagggcgctggtatggtgggtatgggagaactctaatgctcatgctggtatggcctcttccgtcgaactttccttgttcttgcctccttcggtgaacttcctcgattcttgcctcctccggcaaacttcctggactcgcggctgatgttaccgccacacactgtctcctgtgcttctcctccagcgaacatccactgctcgaaccaccatggcgctcggctatagagcgtcatgacagcagctccccaagcgatgcaagccgcctgtttgacgaaatgtgtgagaagcaaaatagagacatcaatggtgttttcatgtgtctaatacattttaaaaaaaacatagctagatagcattttcgacaggaacaaaggattcgtaatgcgctcggctactgggcgtcatgacagcagctccccaagcgatgcaagccgcctgttcgacgaaatgtgtgagaagcaaaatagagacatcaacggtgttttcatgtgtctaatacaaatttattttttaaaacatagccagataacattttcgacaggaacaaaggattcgtaatgtaatttatataatgtaattattttgattaatctatgattcaatttccatgcccaaaaaaaaaaaaaaatttgcatgtattataagaaaaaaaaattacaatacaaatgtctgataagaaaaaaaaatctatagcacaataatgtagcatattttaatttcacgacatacaaacgattgaaaacaatgtatattgtgaaattgctatagaggatcggatttagaggtcgttgctggagatgtgaatatatacaaaataaaatcttttagagtgtgctataaaggacatagaatattcttttagtgtataaaatgtaggagacatagcctaacaacttccggcgtagattattgcggtaacttctttctttggtacaatgacgtatgctttttacacgattgcttcttagacatagaaaattaacccaatttgatttttctccaatctatttccgatttgatgccttcccaagttttgtttgcagttttagacgtttgggttctactaaattgcttacagcttaatatcttcctttgagttatcactcttcgtctttgtcgaccgacctttgcaagattaggtgcgattttctgttcgtagcatacaaatttccccctttattattgttttagatgtaagtttccttagatcaatatacgtgcagccaaggcacattaaagtcgaagtataagttgtttgttcatacgcaaaggtaagcctttttacaccctaaggtcaaacatgctgaaattgtattactattgttttgcaaaagtcttaatattatgtttttttttgtttcctgaccgattttttaggctagtttaaaaactccattttaataaagtatttctatttttcaataaaaattagtttatttttttgaaaaaataagaatcttttgaaaaaaatggagttctcaaactagtacttaatggtagaattttagctaagcacaagagctaatatctctaatccttcgagcttccatgggtgaggcaattaacacttactccaatttgttcttccttcacggtgctacttaattcaacatgttcttcgttgcaatgattacagttacacttgatttatcaccattgctttcagcttgacaaagtcttatctttgctacatacgtaattgatgcttcaaagcactggccattccaaatggcaggtacaagctcagcttcattgccaccgatggaacatgtgaagctgagttattttgttttgatagcatagcca

SEQ ID NO: 20540 - DNA, 2932 bp, Zea mays
gataggatgtatttcttctacggatatatggtacttgtacgtgcgtgtcagcatgtgatgagttgaatacttctttcatccaggattattctatatcttgcactatatgtcattgttaccaaaaatgttttctctctgtatactccttttaattgtgcaagtgccagtggtattttccggtggattaactgttactaaaaatgttttcactctgtatactctttttagccgtgtaagtgttgaagtcattggattgtgtgaagttgttttacttctcttaaacataccactcgtttgtatctagatgtatcgaataaagtggatcttgtttctatctttgatgatgtagattttctttgcaaggcttaacgaaaccatggaccagttgagatctatactttaacttatgttgccttgtttctgcatgattgtatctttgaattcatgtctaaaattgaatcttacggtcatactttctagtggcatgttaaaaaataggtattatgtgccacaaattttattttaagtttacttagaaggttcaaccaacttcgttatagtcaaccatatgaaaaagaaaactcgacctgcaggttccagacattatgttaaggagactttttcatgtaggtcgataaaactggaacccctaccctacccatacagatttatgacactaaaatattaaatagatatattatgaaagtatattttatgatgtatcgaatgattataatttggtgtcataaatttagttaaatttaaaagcgtttgacttgataaataattttaagaattgattctactcatggatggcaaaactaaggcttttgttcggttatttttgtaccatatagattagatattaaaaaatagatagaaatttaacttgctaggaatttaagctcactcaatctagtcaatccatgtgaattaacggcaaaggtcagggtatccatgtcggcaagaatttctggacggcacgattttgaatctatgttgcttgtgtggtgctgcaacagttgacgagtggtaaaaaaaatagagaacctggcagcttggacctgccaggattctagtttttgacgtattctcttgctttggtacatgtagatctgcaagcaaatgttttttatttcattgaacttcaataagtgcaggttacgttctgtttgtactttattgaacttcattatactattttcttttggtaaagttgttcgcatcaagtgcatggtgcattctttttagttttttaacggttctgctttcagcttgctcttgggtgcgtttattttttagctgtgtttccattcctccaactgtgttttcattcttcctttgttgaccatttcgattttgtggacaactaatttcctttgggtgaaatgatcttgacgaagttgagatttcgctttattttgtttatggacgcatcaagattctaacacgccgttatttttcttcgctggtttagtaatgaggaaatcccttttatggccctaattttagggtttagagttttaactgattttttttaaaaaagttgttcctctccggtcccaactccatactgtgtgtaaatttgtcgcatcgcttttttgttctggaaagctctaaaaacaaggaaattatttgcaccgttttttaaaaaaagatagcatcttgcacggttgctttttagagaaagaaaagtaaccaaattcggttttgtccaaattagtttcaatttgatactttgcacgagaccattacctagaacatcctaatcgaaaaactaaattgctggaattcctgaggcgcatacctactacaacaggttgcaaaacaatgacctccaactaatacaacccacaacagctgaagaagaaatccagctttctcaaccaccaaatttggaagacaagaccgttgaagagctgctcaacatagatccggatatgtttcccgaagaaggatgtactgttactatatcaagcatcgtgcaaagtagcagatggtggtacccatcttgctccaggtgccacaaatcttcatctcaaacctcaactggatatcactgcacatcatgtggctgcacaaatattaaatttagatacaagctcagcttcattgctactgatggaacatgcgaagcagagttcttttgttttgatagcatagccagaaaaatagtaggagaaccttggggcaaccttgttacagcagttacaacttctgagagtcccagcagccctagccgctattgtgtgtctgaaatttactcttgcagttgccatcaatatgtcagcctactatgtcacgaacagagtattctctattctatctattttaacaaatcatggaagacagaccttcataccatctaacatgcctagccatcctcaacaagagttgcatacacaagatgaagtacctagccttccgaccacacaagactctccagcaacatcaatggcaaaactatctacctgtagcaacgaaagaaacgagggtgatgatagcgcataagtgaactcaacaagcaagagatatcgtcaccaccaaaatggataaaacatagccacactagcaacggcataccagatcttacagaccccaaaaagaaaagctcctaaatcgtcatcaacttcgtgaaggtgtttgctttttgcgcacctatcaggagcaccatcacttttggaccatgaatgcttccctatagatatgaacctactgttagactatttgtggatatgtacatattgacttaacacctgcaagcacactgttgctaagtgttgatgtatgatagttgaatgctacttagtatgtattgtagtctaaatccactctacaactggtatcaactattacataaaaacaacgttatatgcttaaaaaaaaaaaaaaaaggcggacagctcgtaccgctttcaagcatccgagcgcg

SEQ ID NO: 20541 - DNA, 2173 bp, Zea mays
  misc_feature (2162)..(2162): n is a, c, g, or t
agttccagggaaatctctctccatccgtcgggtgtcccttcctctcccagtctttctcgccttttctcctctctgcttttctttgttaccgtcggcgtcgggaactccgcttccgcacaaatattgcgtttgctgtcagcttgctcaacggttctgtttgtttggtgagatgtgttttcctctttctccttcgttgtgagtttccatttggtggacatccttttccagatcccttcgtggattagatccacgctcctctagtcgagatcgtcttgcatttttctgagatggagattgggaccgaaaaggcaagtatttttctttggtagttttggcatgtgcagacaaatgaggaagtgcttctacagttgtacctcatttaactctattttggagattgagactgaaaaggcaagtatttctttttggtaaagtctttcgcaagtggacatctgattccaatttttttaaagggatctggttccaaattcgtgcttggacctgccaggattctattgtttttggtgtatcctcttgctttggtacatgtagatcagcaagcaaatgtttttttatttcattgaatttcaatgagtgcaggttacgttctgtttgtactttattgaagttcattatactattttcttttggtaaagttgttcgcatcaagtgcatgttgcattctttttagtttttaacggttctgctttcagcttgctcttgggtgcgtttattttttagctgtgtttccattcctccaactgtgttttcattcttcctttgtcgaccatttcgattttgtggacaactaatttcctttgggtgaaatgatcttgacgaagttgagatttcgctttattttgtttatggacgcatcaagattctaacacgccgttatttttcttcgctggtttagtaatgaggaaatcccttttatggccctaattttagggtttagagttttaactgattttttttaaaaaagttgttcctctccggtcccaactccatactgtgtgtaaatttgtcgcatcgcttttttgttctggaaagctctaaaaacaaggaaattatttgcaccgttttttaaaaaaagatagcatcttgcacggttgctttttagagaaagaaaagtaaccaaattcggttttgtccaaattagtttcaatttgatactttctcaagttttacttcatgtttttattgtttgggtttactaaattgctggaattcctgaggcgcatacctactacaacaggttgcaaaacaatgacctccaactaatacaacccacaacagctgaagaagaaatccagctttctcaaccaccaaatttggaagacaagaccgttgaagagctgctcaacatagatccggatatgtttcccgaagaaggatgtactgttactatatcaagcatcgtgcaaaatagcagatggtggtacccatcttgctccaggtgccacaaatcttcatctcaaacctcaactggatatcactgcacatcatgtggctgcacagatattaaatttagatacaagctcagcttcattgctactgatggaacatgcgaagcagagttcttttgttttgatagcatagccagaaaaatagtaggagaaccttggggcaaccttgttacagcagttacaacttctgagagtcccagcagccctagccgctattgtgtgtctgaaatttactcttgcagttgccatcaatatgtcagcctactatgtcacgaacagagtattctctattctatctattttaacaaatcatggaagacagaccttcataccatctaacatgcctagccatcctcaacaagagttgcatacacaagatgaagtacctagccttccgaccacacaagactctccagcaacatcaatggcaaaactatctacctgtagcaacgaaagaaacgaggtgtttgctttttgcgcacctatcaggagcaccatcacttttggaccatgaatgcttccctatagatatgaacctactgttagactatttgtggatatgtacatattgacttaacacctgcaagcacactgttgctaagtgttgatgtatgatagttgaatgctacttagtatgtattgtagtctaaatccactctacaactggtatcaactattacataaaaacaacgnttatatgctta

SEQ ID NO: 20542 - DNA, 3065 bp, Zea mays
  misc_feature (2147)..(2147): n is a, c, g, or t
  misc_feature (2229)..(2229): n is a, c, g, or t
  misc_feature (2281)..(2281): n is a, c, g, or t
ggggaaatcaagcatcaaacttttctatcagtgatgtttacaatcaaagcatcaaccagcctattgtcatactgcttgttggatttcttgctaaacgattcaaaggttatgatccaagcttttcaaaaaaaacatttgaattatttattccaacaaatatgataacacataatctacatgtaatgtaagtcaaccatacctaagtggtactacagcaagttcatggtacttcaatcctggaattcctgaggcgcagacctactacagcaggtaaaacgaaataaaatttggatacaattccttcaaacactcactatttttatatcacatttcaaatatgctcctatctaatcttatgcccacaattatctaacagtttattaagctacaatgtactaagctaccagtagtaatatttaaaatgaaattgtacataaaccttgtttttaccattacctctttatatattacattcagaccaatttggtctccctctttagaaaatactcaatacttacatttattttttaactaaaactaaacaagactttcatttcttttgctctatcaaaaaaatcaaagacagtgcaaaacaaaaatcgtcgatgcctagaatcagtatctacaaaaaagaattgttttttgaatagtgttatatttgcttgtatttcttatcactctttcacttataaaaagatgatagtataaaacataaaaggaacttttaaaaaaatatactaaaactaagtcttatttgatcatggttgtgacatcaattgaaggttgcaaaacaatgacctccaactaatacaacccacagcagccaaagaagaaatccaggtttctcaaccaccaaatttggaacacaagactgttgaagagctgctcgacatagatccagacatgtttcccgtattcattactaaatcttcctatatttcacttatctaacacatctacgatatgtttgtctgacttggtacatcttttttctcttttatactgcagccagaaggctacacatgcactgttactatctcacgcattgtgcaaaacagcaaatggtggtacccatcttgctccaggtgccacaaatcttcatctcaaacttcaactggatatcactgcacatcatgtggctgcacagatattaactttaggtaaatcttagcacacacacttgatttactaccatttatttcatcttgataaagtcttatctttactacaaacttaattgctgcttcgaaatactcatattttccattgacagatacaagctcagcttcattgctactgatgggacatgtgaagcagagttcttttgttttgatagcatagccagaaaaatagtaggaaaaccttgtgacaaccttgttacagcagttacaacttctcagggtcccccagcagccctagccgctattgtgtgtctgaaatttacccttgcagttgccatcaatatgtcagcctactcagtcacaaatagagtcttctctattctgtctattttaacaaatcatggaagacagtccttcataccatctaacatgcctagccatcctcaacaagagttgcatacacaagatgaaatacctagccttccgaccacacaagactctccagcaacatcaatggcaaaactatctacctgtagcaacgaaaaaaacgaggtacgaaacttcttatttttcttgccatgtacagcctattataaacatatcattccttcatgcatacaacttaatgaagtctattcaacaggcacgacgcgttctaatatattcagatatgccgcatgacacagaggtacctttagtactgctaaatacttaatttccatgcactcacaaaggtacatatctattgcattttaataccagatataaattgatacaaacaatacccacagaataaataaactaagacaaaatgaacttccactttgtcatagcaaactacattcatatattttatgcacttaatcacatggtgatgaccagcacataagtgaagtcaacaaccaagagttatcgtcaccaccgaaaaggtatgtattacaaagatagttgaacataatagcagtaccaacgacgaccttcttttaaatgatacatcttattttccacgctaatacaacattcatnatattatacaggataaaacatagccacactaacaaaggcgcaccagatcttacagacccaaaaaagaaaagctcctagatcntcatcaagttcatggaggtataacaccatgtgcaaaccttattcatacaccncaaatatacttatacacagtcaacataatgtattccactcacccttttacacagcaacattagcaaactattcggaaaaaaacttccaacgactctaatattttttccctccttcctacacaggtatttgcttttgcgcacctatcaagagcaaccatcacttttggtccatgaatgcttccctgcacatatgaacctactggtagactatttatggatctgtacatattgacttaacacctgcaagcacactattgctaagtgttgatgtatggtggttgaatactacttagtatatattgtactctaaatgcactctacaactggtatcaactattaaggaaaaacagcgttatctacttatattttagtttcttgcctacgcattatatagtcatatcatatttaaatttattttatgtacctgggtgctcacaccaaacacttaatccatatgtggtcacgcgcgcctggacgcgcggtaggtaaacactagtgagcatgtaaataattatacattccgttctaacgcaggagcacgattgctagtagagttaaaaataatgtctaactcaaataacttcaaaaaaatcaaaaatggttccctcctgttctgttcggaattgagatggtccaattttgcagcgcaatgaaagatgacatcataaaaccatggaagacaccaggagagacaacctctttgtctgtcgctccctcgaggaaatgtatgccgtcctaaatgctgcagctgcaggttggattttaaaaggatccccggggtaca

SEQ ID NO: 20543 - DNA, 2604 bp, Zea mays
ccaagttctatatatatgtgtacaagcaatcttcccaaaaaaaaaaaataacaataaacaggattgtgttgttgaggttttttttcctctcaaccaaaacaagtaaaagctttacttcagtcaggatgcaaatgcaatggagttacaagctaggcaagttcacaggttttactataaacagaaataagttagacatttagtataagaaacatgtacattacaagaaactagcttcgctcggcgcaaacatcttcatcatacactgatacaatcgggctggctcttctgcagtctatcaattggggccccaacgtatattgtcccagaggaaaggcttcatacaaccaacttgtggcaggctcttcatgatcaatcccacacagacgcagacggcagcaatggagaccaaggaaagcatcgcagtcctattagacagaaacctatttgtccggggatggaatgcaagctgctgggcctgctggacacactgtctgcagctcaatgtttggttgatgcttagttgttttttctcaacaccaaatgtgatttgatcggcaggcttcattcggctagcatgctttccgacagtatcaattgtgctgggcatggtaaccgagacatgagctctggtcacccttctgtcaattttgtcctgtaccatttgaatataggatatgttgcctctctttgcagcatattcctcaggagtaaagccagtggcgtcacgagctttcttccacgctttgattcccaactgagacatttaggcagaaagaagccagacagcaaatgtttcagtgcttgcacaaattctcaaaagtaaaagaaaatgtttttaaggtaaatgaatttttatcatactacacctcatgcggaactctgatgtgatattatacaccctacacgatctattcaacaatcaatgtaatacacaaaccaatgttttgatggaagtcctttctttttcttgatatgtacataatgcatttcagatgaaaatatttcaggtgcagacttaggttctaacaataaatggtggtcttagtttttattttaactgttttacactaagaatcggaaatctgctactttgaaatttgaatgtagatgtgcttttttttagttaaagcaggctacaacaggtaagaacatggcaatttagagtagttacctgctgaggatcatcagttaaagcatctaaaacaccaatagcatcactgattgtggctgcaatatgaagaggtgtgatatttgacagttcagtcatcgcaggagtgaacaagaactgaactggagcaccatctccaccgcccactggagcaatatttgttgtggtgtatcttaatagaaattcaactaaaggctttgagcgttttttgaccgcagtatgcaatagattttctcccaaggcaaattcaattggtgacaatacatcaatatcaccctggaacatggtgttcagaagcttccttagaacagcacaccattcctgatcaactgcaaaggatagcagccatctaaatcttgcaacagggaagcggtcaggacaatattgtcgctgctcagacgtagctcgcacatggctcctttgaagaagccatccgatttcatgcaaaaaatgtaatgctcgactgcgataaatcatcagatcatctattcttttggaggtttgatcaaatgaaactaaatccaatccatgctccaacatccgaatctcagaacatacatctttgtccgtgacaacaaagggaacagaaaggctgctttgatcatagtcttcaatctgaaaacggagtcaagtctgtaatatacacaaaaaatgaggatataaaaaatatacaaacattgtacctctatgaatcctcttccacttgtacaaggaaaggaacaagagaaggtcaggcattgagggccttgctgcatagttgaatcttcaagtagcatttgtgtctcttcttgaattaaatatttttcatcaaacacacaaagtaatctataacaaaatcagaatgtgtcagttaaaagaactaaagaagtaagtttagaggagacatttaaatgtgaaaaaagatacatactttgtggttggctgaactatattgaaacctttcacagagaattttactgacgaagaacaatcaactgcaattggagttacacacagtctctgatgcttgtcaccaattaccggttgccagggagatgcaaacataagactacctaacaaaaataaggaaagaaatacaaatgaagctgatcctcgaatatatgaataactactccaaataagatgaacggaccattgcaactcagtgttaggcagtcctgtaccctagcatacaaccatcctgttctccagaatccatcattggataagctaataagattttctatccatgaagctgggtcatcattaaactataatagaaaagaaaaataacagtaagcactttgcttctgcatcatatactataaagaaaacatatacagatctaaattcactgttaatgtagtgcaatactacctcatcccacatccaattagggaggtgaaggtaaatagttagaataacacaaccaggtctaatataactttccatatcag

SEQ ID NO: 20544 - DNA, 2381 bp, Zea mays
tttttttttttttttttgggcctacaggctaggcaaattagagcatttcacaggttttactatggaacagaaatttcaatttaggcatttagtctaagaaacatgtacattacaagaatctagcttcgctcggcgcaaacatcttcatcatacactgatacaattgggttgggtcttgtgcagtctatcaattggggccccaacgtatcttgtcccagaggaaaggcctcataccaccaacttgtggcaggctcttcatgatcaatcctacgcagacacaaacggcagcaatggcgaccaaggaaagcatcgccggcctattagacaagaacctatttgtccgggagtggaatgcaagctgctggacctgctggacacattgtctgcagctcaatgtttggttcatccctcgctgttttttctccacaccaaatgtgatttggtcggcaggcttcaatcggctagcatgctttccggcagtatcaattgtgctggggatggtaaccgagacatgagctctgctcacccttctgtcaattttgtcctgtaccaattggatataggatatgtggcctctctttcgagcatattcctcaggagtgaagccagtggcgtcacgagcgttcttccacgctttgattcccaactgccgaggatcatcagttaaagcatccaaaacaccagtagcatcacttgattgttgctgcattttggagaggtgtaatatttgacagtccagtcatcgcaggagtgaacaagaactgaactggagcgccggctccactgcccactggggcgtaatctgttgctgtgtatcttaatagaaactcaactaaaggctttgagcgttttttaacagcagtaagcaacacattttctcctaaggcgaattcaattggtgacggaacatctaggtcaatatcaccctggaacatggtgttcagaagcttccttaaaacagcacaccattcctgatcaactgcaaaggatagcagccatctaaatctttcaacagggaaacggtctggacaatactgtggctgctcagatgtagctcgcacatggctcctttgaaggagccatccgatttcatgcaaaaaatgtaacgaccgattgcgataagccatcagatcatctattctttccgaggtttcatcaaatgaaattaaattcaatccatgctccaacatccgaatttcagaacatacatctttgtcagcgacaacaaagggaacacaaaggctgctttgatcataatcttcaacctctatgaatcctcttccacttgtacaagaaaaggaacatgagaaggtcaggcattgagggccttgctgcacagttgaatcttcaagtagcatttgtgtctcttcttgaattaaatatttgtcaccaaacacacaaagtaattttgtagttggctgaactatattgaaacctttcacggagaattttacagacgaagaacaagcaactgcaataggagttacacacagtctctgatgcttgtcgccaattaccagttgccagggagatgcaaacataagactaccattgtaactcagtgttaggcagtcctgtaccctagcatacaaccatccttttctccaaagtccatcattggatatgctaataagcttttctatccacgaagctggatcatcatcaagctcatcccacatccaattagggaggcggaggtaaatagttagaataacacaaccaggcctaatatagctttccatatcagttggataatgcgataaccagtgttggatctgttcccgtagatctacaggaaaatcttttggctcttttccaaacagcttgaacacaattttatctgttcggctctcaacttcttcaaagcaagcatcattcaaatcaaaatcatgtacccgccttttcactggaggctcttctgctaatgattctcctctgattggaattgaccgtatagtttgctcatgcacagtagatccatttgcagcattattaccagcatttgacaatattgaatttgaatttgcattctttagaatatcttgatatgactgtgtgctagcaatagcagcaaggttcttcaaaaggttaaccaaagaattaggatgattgattggctcagaggagctaccagctgccacccatacaagcacacatttagaatgactatgtctgtacactctagcctggaaagttgttttaacagaaggattaaggtgctacttagagattgattttcactcatggaattcccattcacaacagcttgtggttgaactttccttctccttccattatgttgtgctagacgcgagcggcagctcttcttcccttcatcaaattcttgaagaagctgaaacctgctacactgctgacagaac

SEQ ID NO: 20545 - DNA, 1622 bp, Zea mays
cattgggtacctcgaggccggccggggtgccgcgtgccccaacgccaagcggggtaggttgactcttctgtctacaggcctacagcacctacctcttcacaccaactgccgcccctgctccgagaaccagaatggccgccgccgatgcatcttcgttgcctccgtccgccatcacctgccgagcggcggtggcgtggggaccgggccagccactggtgatggaggaggtggaggtcgccccgccggggcccatggagatccgtgtcaaggtcgtctccacctccgtctgccgcagcgacgtcactgcctggcaatccaaggcgcaacttgatctgttccccagagtcttcggccacgaggcatccggagtagtagagagtgtcggtgaaggtgtgaccgagttccaagtcggtgaccacgttctcactgtcttcattggggaatgcaagagctgcaagcactgcgtctcagggaagagcaacatgtgccagaagctcggtctggagaggaagggtgtcatgcacagcgatcagaagacacgcttctctgtcaaggggaaacctgtgtaccattactgtgcagtgtcaagcttcagcgagtacacggttgtccattccggatgtgcggtgaaggttggcttgaccgtgccaatggacagggtgtgcctgctgagctgcggtgtgtctgcaggactcggtgcagtctggaatgtagctaatgtatcaaagggctcaagtgtagctatatttggtcttgggaccgtaggactttctgtcgctcaaggtgctaagcttcgaggggcgtccaagattataggagttgatactaatcctgagaagcaagaaaaggggaaatcatttggtgtcacggactttattaacccagatgaattgagtgaacctgttcaacaggtaatcaaaaggattactgatggaggggtggattactcatttgaatgtgtgggtgattctggagtagtctccactgcacttcaatcatgttctgatggttggggagtaactgtaactcttggcttaccaaaaggaaaactagaagtgtctactcattatgcatttcttctatccggaagaacactgaagggatctatgtttggaggatggaaacctaaatctgatctaccttcattggtggataaatatgcagcaaaggaaatccaagttgatggcctagtcacgcatgatataccattcaatgaaatcaacaaagcgcttgagttgatgctagaaaacaagtgcttgagatgtgtgattcacatgccacggtaacagggtcgaacagctgcacataataatatgatatctaccatatgttgcatatctgctctttctaccttgatcatctttgtggctcaaccgttcaagtactcatcagtcatcaccacgccggagcttgagtttttgtccttttctagtcccctggtaaagttgttgtaaatccagctatccatcaagaattatcaggagaactacactgatttgcttttgtatcttcatactttttcttctagaattgtcttcttatattgaatctttaatgtctgttctgttattttaatgctccatgtacaaaccaaaaaaaaaaaaaaaaaaaaaaaactcagc

SEQ ID NO: 20546 - DNA, 707 bp, Zea mays
ttttttttttttttttcttagagaaaagaatacaacttccacccattcctatacccataatttgctgttttaatgttaatatatcatacaagaaatcagtcttattttacaaattttccccttagattattatttttgctccagcggaaaaaaacacacaacctgtaaccgtttcacatagcccttcagcgccttctggagggtaccgtctaggcatccagcacttttagggaagtacataaaaaaatgtagattgttcaccaaatgcagaagattgacactaatagtacctcattcatgggtctacggatgggggggcacagacactcgacaagacacataaatcttgactacttctgttgttcttgttcatcatgcttgcgccatggattgagagcttctctcattgcttgggcctctggactgctttcccaagctcgtttttctgactccaagacagttaccttctcgtagaagcccgtgtggatcatgaagagctccatggcggcgccaatggaggcccctaccgccgcgatcttcaggtaccaacccgcgaatctcataataagtctctccccaagcaaatcctcagaggcaggggaggcagaggcagccggagcgagctgaggcgacggcggcggcggcggcggctttgatgagcttgtcgagcgaaaggcccatggagttgaagccaaatcctgaccgtt

SEQ ID NO: 20547 - DNA, 1306 bp, Zea mays
ttttttttttttttttgtaggcaagtgtaaagtttgcataaaccagtttttttttttttcagacatcgaaacgacgcaccgcggtttcattattacactctagccgtcaacatgtaactgatatatcaggagttgagaacacatgtaaaggatgtgaacagaaaagctaaccaaaaatgaaaaaaatgggtgccactgtaaactacaatagctgatccacaccacccaaactgctcggtacattggcatcatgtcagatatcgtaaatgctgacagcttctacggttctacccttcaaattaaaacaagaaaagaagcgacatttcactggtattgactaacacaacccgccagaatgattgcctaggcaggccttgctgccataaacaaaaggcactgttactttctctctttgccctgggtttaggtagcaacagcagcagcctctggcttatctattccttcaatgttggttattctcagttttgtcaattcctgtcgatgacccttcgtccggcggtaattttttctccgtttcttcttgaatatgatcacttttgcatctaaggcatgttcttctacaacagcatgaacagcagcatcaggtagtattggcctcccaataactgtttgagcttgtgaaccaagcatgagaactcggtttaagaccaacttgtcattcacatcacagaacttcaacctctccgtgaagatggagtcgccattgctcaccttgaattggtgcgagccgatctgtacgacggcgaagacgggctcgtagggcttgaagggtttatcgtcagcctcgagcggtcccaacaccttgtagccgatctccgccgcctccgctaccttctcctcttcggtcttcccgctcggtttcttcgccgccaccacctcctcatcgtccccccattccccatcgctcccctcatcgtcgtagtgctcttcttcgtcttctccgtcgtcctcgtcgccggaggagcgggtcgcgaagtggcagcgcgaggggtagtacagccggggggaggcgagggcccggggagctggggagccgagggcctcggacaaagaggttagggtccgggtcgcagtcgagatcggcgcaagaggttgagatctctgaggaacgaggcggatcgagaggaagcggaggagacagcgccgcgacgccatggctgcggcgacggcggcggcggtggcgggggtaggggcgaggaaagggtaaaaatggaaatattcagtgagcagcggttttgacgagggtttaaggggtcgaggccccccctgcccgagggtaccccaa

SEQ ID NO: 20548 - DNA, 1236 bp, Zea mays
ttttttttttttttttgctacaacttcaatgcatagagacaaaaacactgtagaattagaagtcagtacaaattaaagtcaggcgaacaggctgagtacacatatataaaggatgtgcacagaaaagctaaccaaaaatgaaaaatgtgtcactaggtaaactacaacagctgatccacaccacccaaactgctcggtacataggcttcatgtcaggtactttacccgagtcataatgctgacagcctctaacgtttgaattaacaagaaaagaagcgacatttcactggtatcaactatcgaaatctgactgaccgacatttaactggtatgctgctaattttctctttcccatgaatttaggcagcaacagcagcagtctctggcttatctattccttcaatgttggttattctcagttttgtcaactcctgacgatggccctttgtccggcggtaattttttctccgtttcttcttgaatatgatcacttttgcatctaaggcatgctcttccacaacagcatgaacagcagcatcaggtagtattggcctcccaataactgtttgagtttgtgaaccaagcatgagaattcggttcaagaacaacttgtcgttcacatcacagaacttcaacctctccgtgaagattgagtcgccattgctcaccttgaattgatgcgagccgatctgtacgatggcgaagacgggctcgtagggcttgaagggtttctcgtcagccccgagcggtgcgagcaccttgtagccgatctccgccgcctccgctaccttctcctcttccgtcttcccgctcggtttcttcgccgccaccgcctcctcatcgtccccccattccccctcgctatcctcctcgtcgtagtgctcttcttcgtcttcatattcgtcgtcctcgtcgccggaggagcgggtcgcgaagtggcagcgcgagaggtagtacagccgaggggaggggagggccccgggagctgggggggcgagggcctcggacgaagtggtcagggttctggtcgcgatcgagcccggtgcaaaaggttgagatctctgagggacgaggcggctcgagagtaggcggaggaggcagcgccgcgacgccatggctgcggcgacggcggaggcaggggaacggaggccacgaaagtgtagaaatggaaatactcggtgacagcggttttgacgagactacacagtgatagatcagactacacattcccgcccg

SEQ ID NO: 20549 - DNA, 844 bp, Zea mays
aattcggcacgaggcttttgccggcccgcaattcatcctggtcgccaccagtaccacctctccatccttaatccttcactagcttagctagccagccacctccgttcactccatctcttgccggccagtgctccgtcgatcgacccgtagccaaccaccgacaactagctagcaacaatggctgccgtcgtcaacgcgcgagccgcaactgctcgttgctcggccgccggcgggccaccacgcggtgctgcgtcttcgtttccgccgtcgacgataaggacgaggaagaggacgacggcggcggcgggcggccgcggccggcttgtcgcggtctcggcggtgggcgacgtcgcggcggagggcaacacgtacctcatcgccggcgcggtggccgtcgccctcgtcggcacggccttccccatactcttctcgcgcaaggacacgtgcccggagtgcgacggcgccgggttcatccgaaaggcgggcgcgacgctgcgggcgaacgccgcgaggaaggacgaggcccagatcgtctgccccaactgcaacggcctcggcaagctcggacagatcgacaagtagctaaataatcccatccaccatgcatgctacgtactaagctcatatacatgtgctgatgtgcatgcatggaccaaccaaactgctcctttgtataagctcttaattaaatctcctctccgacaatgtctgaatgtatatgctgagtgagtgttaatttggtctgtaatataacctgttgctttgtcagaaacgatgttgtgcaataacattgttgtcggtggtgttgttgtaaaaaaaaaaaaaaaaaaaaaaaaggccccta

SEQ ID NO: 20550 - DNA, 2724 bp, Zea mays
ttttttttttttttttaggaggccatagagtttcagattgtttgacaatacaagttgaatagcaattgcaatgcaccagcaacagttacatacaatgaatctctacctctctccatgttccggagcttaaatactgggaacaagctacatactacattgctacaaacagtacattttatgccgactaaattgaaaagaaaccatggacatgttgagcatcagactatcaacatcctaaactctaggcttagtaactttgctttagctacaattcacagccaatgggcacaaccgaatacacacagaactatgtcaactaatgagtttaacttgatacatgagagatctagcatggaggaggcttgaagcattaaaatcagcaaggaactagttttggaggacggtcagggtgagcacttctaagctcatgtcataacggtataatcccactcataaggcaaacttgtagtattgtgcttcattgtggcatcaacattattttgattgttcaaatggtgcacgcacaaatagctgcccatggagggtgacaactgcagaggtttggtgaggatcaatgcgggaaggcaacctaatgaccttcttgaatggagtgacaccccatgggttatccaattgctcgggctctccagtaactatcaaacgaccagcagggtcagactgaacatgtacctcttcacgcagaaggccaggaaccaatgcatagacttcatagcaatctttggttttcctaacatttattttcacccaatcagcaggagggcccatgtcaataaccattgagtcattttgtagcttatcggatttataaggtatcaccatgtcatcttcaagggatggtgtccttttcctcttggcagaaccactgcttttaggagttttatccttctttaagacaataggccctttatccttaattataggatcagcaatttcaccattgcctagtaggcggtgagaatgccagccttgcattgcacgagttgcagattctcttctggctcttccagaaccagatacatggcttccacccacctggctctcagaaccaactcgatctggtagagcagatgaagctacttggaactctcctgtttcgattttgtgtttctcgtattcaaggagtgccttctcatagaagttacggaaagtccatgaaacagttgtgcatgtctttggaggtttgaatgactctcctacttgacgccacagcttgcatgatgtcacctgatcatagccacccaatccagtaacttgtctccacaatttgaggcaattcaatccttcgccataaaacttcggaggtttgaactccaacattttctccctgtggaaacgctcgagctccttcatgaaggcagcctgctcctcctcagtccccgagtcatcgccaccagtggtgtaatcgaacatgaaggaattatctgagatcttggacaatgccagatcctcctcagccggcgccagcaaaagctggttcacagcaggctgattctgaccagccaggcctttgtcgtcaccgccatctccacctcgaccctcgtccaccgagccgcccaccgtcacaggcccgtccccattctccaacttcacaacctcgccaaccaaatccgccgtcgggccaccattccgctcctccctgtcgctgcccccctcctccgcgccctctgcttcgggtttcgctgaagcattgacggaatcgacggcgtcggcggccccgtctgcaccgtcctccccttcccccacgacgggttcctcctcctcatcctccaccgccgcggcctcgctcatggggatatcggcggccggttgtgcctcgccttccgccgccggcagcggtgccggcggcggctcctccacaccttgctgttgcgacatccttggtccctgcagtggcgcgggcgaggtaggcgtcggacgcggtggaaagggcaaaccctagccggagatgggagacgacgagacagagggagcggaggaacagtggagaatggttttgaaccggacgcgtcccccggccgggttttccgatacggtgattttaccatttgtgtcatgttcaaggttttccaacaaaaggtccaactgtttaacagcgcgaaaaattacccagtggcggggatccaacggtactcatctatagccataacaataggcactttggataatggatgctaatacatttgtgaattgttgatattgttttattctaacaaaatgtggatcgttaaaagttattctctgacgtacaacaatttcagaatagtaaacgagagcgcggaccgctctctgatttctatcttgttttatccgttggtatatgcaggatcagtctttctgctcaaaatgtgggttttattcttcaatcaatcattgtaggttttgcggatgctttcaaagtgattcaattgtcctcaaggggttttcaatcctctgtcttctccaagaatgtgggtttctcgatctataagctgagatcggtggattgcgaatttttcaaagcatactttcatccctggaataatgatgaccctaattgggtacgtgaatatgataattactgtgctgaagaagctgcaacttggaatcatattggcaggaatttaaaaagctctcttatgctgatgcggttcattttaatattctaactggggctaattctattcctatcaagaataaggtagtgtttggttaagaagtaaagta

SEQ ID NO: 20551 - DNA, 2838 bp, Zea mays
  misc_feature (30)..(30): n is a, c, g, or t
ttttaataagaatgtcaaaatttccattantctttttttttaggctgtcgccatcaagtactagagatcacattcacataggaagcaaaagcaagcacaactcatcactgaagaactcatcacatgtcttaaataatgcactagtagtattttaattaactattgtgcggttggagctaaacaagagaaaagctaccagcatggtggccaaaggaacagatatgttgtcatctacaacttcggtcacaggaacgcactccactactgtcgctgctagtgcaacaagcgccagcttaccaagtgcctcttcccagataacatcaatgtaacccaggcttgagaagtagagcatcatcctgcaatggaaatgtttcagtacataagtagggaaagaaaaaaaaactctcaacgcaaatgagacaataacctacatcgcggacagcaggaaaccagaaatgaacatcgagatgctcccggcccagctcttcttccgattgaatggcagcttcgctgagccatacctcctcccaacaatgtcagcaaaacctgcaagttatatggcacaaacaatcaaatgcaacggcgttctacaaaacgacatcgtgctattagatactggggacgggagtaccatcgccaccgctcatcatcgacaaggagacgatcccgatgggggactcacgccagaagactaaaacgctgaacagcagcaccaggacataatagagtggacctctcagcaattccctgtaaagaagcaaagtcgttatcgtcagagcagcaagctaaacgatcatacggatcttcagttcatcggatttactctggttttccttcacgtgtcactgattttaccagagcttcatcagtgtagagacggagtccatatatcagaagcctcatggagttcaggaacgggacaaccgcggcgaaataccgtgcttctgtcgtattgctgcgggcagagcatgctttggtggtggctttgcagtgtgaaacgttatgaatctgagaacctcgatgcatgccagggacagggaatacctgaacaggggccaagatgacatgaacaggacgccggacagcacgtgcacaaccttcctgctcaagctctgccttcattgatggcatggatcagtacagagttcggaagccaacgacagtgaacggctgaacataagcaaaggtaatggccgttctactgaaatgtttgaggtcaggatcatatgtcgcctgtatccagccaagacagctaggcgaagctgaaggtttggtttttttttcagacaagaagcgggaagactacagattagtgagtggaagtctcaaccttttcgatgagccgccgctcggtgagctcgtcgaagacgcgcacaagagagtaggcgccggcggtgatgagcacagtgaccgctccgtcctgcagcaccgctggcggcgccgcggccgccagcgccgccacggccggggtgccgacgccgaggaggagccgcctccgcatggagcttcccggcgaaggcgcgagcgcggcggcgtggggaggcgagcgcgagagcagcagcgagttgggggatgcggcgccggtccacgccgccgctgcagccatgtggccgaagtagcgacgggaatctgcggatttcccacccactagccgactagcggcgggttagcgacgcacaagcgatctgtcgtcagtcgtcactcgggctcgtggacctgtgggccccttgatgggtcacttctgttgacgtgttcacgtggtggacgtgtccagtgtgccaaagcgaaggagacaaggagtgtacaagtacgactgcttcacggtcatctccgtttccagtctggccgcgcataccttgcgatgccgatgcgcaccaaaatatctcgccacgggccacaacggactgactagtatgagttcggctcggatcaaggtgggccgttttatcacaatctgtatctaacaagtgctagtgtcgagtcggtgccgtgctttcctgtttgacgtgtcgggttgagtttttttttgattggatcagattttttagctttgggttgaatcaagttttgggtcaaaaatcacggtccatatccggcccgtgaattattacgggtcaaaaaatatggcacgtacccgtccattgcattggttggatcgggccgagtttttttggcgggtcgggtcggctgcccatgatcaggtctagagctgacatacaattgttttgttgtgcacaaaaaaaagattctaagtaatgcctaaactaatatcggaaacggtgtccgggatgcccctagccttgggcccttggcgcagttgtgggtcctagcatcacggactgggtgatgtgcggggcatcaggtggccaagagacacacattccggagtccggacgtcgtggtcgtggcggacgtgtgcacctcacccgatccccaatgggggaggcggtgttgctgcgcgcgccggcagcgaggtatgcgacacagaactcagtgttggtgaggtcggcgaagcggttgctcccgaaggttgtcccagaacgcgttgaaccggcggtcgtactcgtcgagtgtgttcgacgccgccttgccatactgcgccatccacattttgtagatcgcccgcgccaatgccagcgccatgccgcccaccgcgtcactgttgggcgaagcagacgatgaggatgtactgggtagagacggatccagaaatgagttaaagggacgagtggcagagaaaacacaagcttctttgttctccattttcttctaacctccacctctttctccaatgaagttttatggataaagggagttgatagagactcgtttttctct

SEQ ID NO: 20552 - DNA, 1242 bp, Zea mays
gtgggagatgttaggccgtcgccatcaattttttttttttttttaggaagcaaaagtaagcacaactcatcactgaagaactcatcacatgtcttaaataatgcactagtagtattttaattaactattgtgcggttggagctaaacaagagaaaagctaccagcatggtggccaaaggaacagatatgttgtcatctacaacttcggtcacaggaacgcactccactactgtcgctgctagtgcaacaagcgccagcttaccaagtgcctcttcccagataacatcaatgtaacccaggcttgagaagtagagcatcatcatcgcggacagcaggaaaccagaaatgaacatcgagatgctcccggcccagctcttcttccgattgaatggcagcttcgctgagccatacctcctcccaacaatgtcagcaaaaccatcgccaccgctcatcatcgacaaggagacgatcccgatgggggactcacgccagaagactaaaacgctgaacagcagcaccaggacataatagagtggacctctcagcaattcctctggttttccttcacgtgtcactgattttaccagagcttcatcagtgtagagacggagtccatatatcagaagcctcatggagttcaggaacgggacaaccgcggcgaaataccgtgcttctgtcgaattgctgaacaggggccaagatgacatgaacaggacgccggatagcacgtgcacaaccttcctgctcaagctcttttcgatgagccgccgctcggtgagctcgtcgaagacgcgcacaagagagtaggcgccggcggtgatgagcacagtgaccgctccgtcctgcagcaccgctggcggcgccgcggccgccagcgccgccacggccggggtgccgacgccgaggaggagccgcctccgcatggagcttcccggcgaaggcgcgagcgcggcggcgtggggaggcgagcgcgagagcagcagcgagttgggggatgcggcgccggtccacgccgccgctgcagccatgtggccgaagtagcgacgggaatctgcggatttcccacccactagccgactagcggcgggttagcgacgcacaagcgatctgtcgtcagtcgtcactcgggctcgtggacctgtgggccccttgatgggtcacttctgttgacgtgttcacgtggtggacgtgtccagtgtgccaaagcgaaggagacaaggagtgtacaagtacgactgcttc

SEQ ID NO: 20553 - DNA, 457 bp, Zea mays
ttttttttttttttttttgcactgccaccgaaattacttagccaaaagaggcaaatgcaatggttgtgataaaaggacatgcttttagtctagtgtactgtcaagaaataccctaactatcaggagaagagagctgatttgctgtcctacgatcaccagtcactgacttatcattgctacgcctacttctttccagcgcggggttttcctttcacgtcagaatcctgtgcactatgtagaaatatatttgtctttgcagtagaaggattatgcttctcagcacctttgctccaatcataacataccgcgtaagcaaatatagagccatcatgattgaatgcgctgcatgtgatgggggatggacacctattataagcctgtaaaataaaatggcacatcagaggtatatctttaaacaaatgcataaaaatttcccacgcgtccgcccacgcgtccg

SEQ ID NO: 20554 - DNA, 1359 bp, Zea mays
  misc_feature (5)..(6): n is a, c, g, or t
  misc_feature (65)..(65): n is a, c, g, or t
tcgannttttttttttttttttttttttttttttttttttttttttttttaagggcactgccacnccgaaattacttagccaaaagaggcaaatgcaatggttgtgataaaaggacatgcttttagtctagtgtactgtcaagaaataccctaactatcaggagaagagagctgatttgctgtcctacgatcaccagtcactgacttatcattgctacgcctacttctttccagcgcggggttttcctttcacgtcagaatcctgggcactatgtagaaatatatttgtctttgcagtagaaggattatgcttctcagcacctttgctccaatcataacataccgcgtaagcaaatatagagccatcatgattgaatgcgctgcatgtgatgggggatggacacctattataagccttcagcctttgcttactgtccttatcccaaaagttgaaacttccatcagagcctgtagtagcgaatgtaccatgcacaggatgaaagttcaacgagctaatagcgtatatatcattgccatcgcggggacacttgaatgtaaagttttttccttgctgagactcttccacatgatgaacaccaactcgtccttctatagacccaatcaaaaaaccttgttgatcaggaaatgcagcaagacaccttgtctggagcttcaaaggtgacgtaatcctcttgaattcagcctgtggattctgcagattgaagactattacgttgcgatcagcagtgccaaccaccatgagaggataacaaagcgatagagcatagcaacgctcaggaagttgctgaacatgcactggttggggttgcctaatgtcccagtacctcaaagtcttgtcccagctcccactgacaagaagattcatctgtggcacccaagcgagttctttaataggtgcctcatggcctgagaaaaccgtgggctgggcacctgagagcaggggccacattttaacctgcttatcacagcctcctgagaaaacagtcaacccatcatccttccaagccgagcacagcaccggttgatcgtgcgaaatggaggccttcgcttggcaggccccaccagccatgacctcccagcaccgaacctggttgtcccatgaggtggcaacgaggtggttcgccttggggctgaagctgaggctggacaccgagtccccaggcgccggagtcacctcgaaggatttgttgggattatggttggcggcgctggcgccggcgggattgaagctcgccattgcagtgggcgggtggggtggcgttcgacgaatttgggagcggagaggggagacggggaggggaggtcgcggggatttcgggcgaggtcgcggggattttc

SEQ ID NO: 20555 - DNA, 1138 bp, Zea mays
ttttttttttttttttcccatgaaggaattggctaatctcattacaacgactcaggcaccaaccgtttccagattaacatttacgagaattatattgggcctcatctctcaggtgtcacacaactaaataatcttaaaccagcaaaaatgttcatgtctactttttttttccctgcacacaggtgagatcagaaaaccacggcatttgcatagggggcgaggaatgcttcacttgatggaatggaaaattccagtgctgcaccatacatctcgataacataaaggattcaaaaaactgcaagcagcaaaggttctcaccagacattccctataattggttcttttctcaaacaatcctacaattgtttctgacagggagaatgattatcagatataaaattatcatcagtttcactgccctcccacacgtaacagtggagtccatcttgaggcttcagccagtccagtttcatattgctatcctaaccctacaatggaaaaggaatgcaggataaccaacctatcaggtcacagtggcacaatccttccttcgggcattttcctgtcaactcggccaattctgtggggtggccagattatgtgtgtgaccctgccccgtaacagacccataggaacagggccataggatctcgagtcaaagctggtggcggcattgtcaccttcaacccagcagcgcccctgcgggatctgctggatctcctgcttctccgggatctggatccaatccccaggcagcgcaatcagcctcttcaccaccagttcacgatggtccctcggcgacctgaagacgacgacgtcgccgcgggagaagtggtagcggtggaggcagcgcttatctaccagagcgcgttcggcctgctgcgggtcgaaggtggggtgcatggaggcgccgtgcaaggtgacgtaggaggcgctccagtcggcgatggtgatgccgaacacgccgccggtgatgcagcctttaacgatcggccagacggcggccaagattctcgccatgcgcgcggaaaggaaagggaccagcggatgacagcgcctccgccgcttgccgtcccgtcagggtgactgggtgagggaagacgggatgacactactatctccccgccggccccccggc

SEQ ID NO: 20556 - DNA, 1372 bp, Zea mays
ttttttttttttttttggggatatacaacatcttttttttattataagaaaatggcacaataacaatctaaaaagtccacgttaagtagaattgttacgctatcttcagcagtctctctatctcatctcttatctatcttactccatatttgaaactccacaccataaataatgcactctacaatataaaacagtgttttacatgcacgcataatgcactttataatacaaaacagtgttttacgcgcacgctatgcagggcacggccttacatgatcaatatgatatgggcaaataaaaaaactagttaccaatagtattattgaacttgaaccaaagattttcggagcagcacttgacactacggcttgataaaagataaaagcaaacagagacaactctcaagacttaaattgactgttatcttaaatttccaaggcaacgctagcaaagacatgacaattaactacaccgattcatttttccccctttgcgatcatgcctttgcccctccagttttgcggattaatttggaggcacatctttacaaacaagacagtgacaccggcccgtgatccctcctcctttcacacacctgtattgcctgagtgtgatgactccacgtagcttcttctggagccagcattcggacttgcacatctagcttttgcaaaaagggatctccatggttatatagtggcacagatctctatcaggtcacagtggcacaatccttccttcgggcattttcctgtcaactcggccaattctgtggggtggccagattatgtgtgtgaccctgccccgtaacagacccataggaacagggccataggatctcgagtcaaagctggtggcggcattgtcaccttcaacccagcagcgcccctgcgggatctgctggatctcctgcttctccgggatctggatccaatccccaggcagcgcaatcagcctcttcaccaccagttcacgatggtccctcggcgacctgaagacgacgacgtcgccgcgggagaagtggtagcggtggaggcagcgcttatctaccagagcgcgttcggcctgctgcgggtcgaaggtggggtgcatggaggcgccgtgcaaggtgacgtaggaggcgctccagtcggcgatggtgatgccgaacacgccgccggtgatgcagcctttaacgatcggccagacggcggccaagattctcgccatgcgcgcggaaaggaaagggaccagcggatgacagcgcctccgccgcttgccgtcccgtcagggtgactgggtgagggaagacgggatgacactactatctccgtctcgcccctccgttccgtactttttgttaggttttcccaccatttcccggacgcgtggg

SEQ ID NO: 20557 - DNA, 732 bp, Zea mays
ttgggtacctcgaggccggccgggagggttttggatttttcatcttgtcatgaacgcgatgaacctagcgatcgtcacacgcactctctctctggttcccgtgtgcaggagggccgtgcacgcctcggcgtacgacaagaacctggaggaacaggtgcgcccggcgttcgtgccggacgatgtgatcggcagcgccgggagcccccacaagtactggagcccccaccccaagaccggcgtgttcggcccggcggcggtggaccccaagctggcagctggtggcgcgccggacgccggcgcggatgctgcaggaggcacggtgctggaccagaaggtgtggttccgcccgctcgaggacgtcgagaagccgccccccgccgcgtgagccgcgcggcgctgctaggccagcccacactgctgctcgctcataaaaagggcggcgggagagcctggcagtggcaggcaccctgctcgtgctcggccgggctgggctccctgcttatatcactgcaatattatactactagtagtggtgcttgatagcagtgtgtggctgtgctaataccagtataatactggttctactataatacagtcgtatcaggcatggcgtgcatcaggactggttgtgatagtagcaacgtgatgctcgtgcctgtaataagaacaagcaggcgatgtgtgcctgtgatgtaccggtgtcgtcagtgttataagtacttgggtcaatgg

SEQ ID NO: 20558 - DNA, 881 bp, Zea mays
cattgggtacctccgaggccggccggcggatcgaaaacccaccgcaccctttcatcagcctgcctgtccactgttggcttggtgacttcctccgctccgctccgctcccctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaacaggtgcgcccggcgttcgtgccggacgatgtgatcggcagcgccgggagccccgacaagtactggagcccccaccccaagaccggcgtgttcggcccggcggcggtggaccccaagctggccgctggtggcgcgccggacgccggcgcggatgctgcaggaggcacggtgctggaccagaaggtgtggttccgcccgctcgaggacgtcgagaagccgccccccgccgcgtgagccgcgcggagctgctagcccagcccacactgctgctcgctcataaaaggggcggcgggagagcctggcaggcactctgctcgtgctcggctgggctccctgcttatagcactacaatattatactactagtagtggtgcttgatagcagtgtgtggctgtgctaataccagtatacatatataatactggttctactataatacagtcgtatcaggcatggcgtgcatcaggactggttgtgatagtagcaacgtgatgctcgtgcctgtaataagaacaagcaggcgatgtgtgcctgtgatgtaccggtgtcgtcagtggtataagtacttgggtcaatggtttctgcgtgtgtttgttaccttgttgcacttggcaat

SEQ ID NO: 20559 - DNA, 4368 bp, Zea mays
cggccgagccaggtgaacgatctctccagtccggtccccccctggcccctaccccaaccctaccggctggttcgtcgcgcgcgccgaatcgtggagaggcgggaatctgacgcggacctcattggattccgtgcaggtttgctcgggtcttcgtgccagcgttgatggaggttccaaggtgacgtcgctatccggacggcgatgctgctggccgttggcaggtagttggacgcacagctggacgttccgatcaggagcgggaaggttgccgtcaccgtcagtgctgctgctccccaatagccgccgtagctgctccgttgcccttttgtttacgcagtagccaacagcaacagcaggcgccgtacctgtacgacggtgcgccggcatggcaccggctcgctcggacggtggtggcctgcacggtgcacgctggtggtggtcccggggggccccgggcgctataaaacgaggcagccggtaggagtccacggaatcgaaaacccaccgcaccctttcatcagcctgcctgtccactgttggcttggtgacttcctccgctccgctccgctcccctccgctcccgaacggtcgatctttgcatggcagcagcagctggctccaaggggcgggcgatcgctggaagcttcgtcagccgcgtcctcgccggcaaggccgcctcgccgaggtactcagacgggccacactcacccacacgcgcgggtttcggtttgccctgtgattctgttttttttttactatttttgagcgtgcttgttctcgatcagttcgtccaagatctcgccgtagttttaggcttgtagcagagcgatctgtctgttctttttacggccgttcttagctttgctctgggagtctgggtccggtgatccggtccctcggatcgatagtgcttattccccccccctccgacttgggacttgttgggaggatcttaccttcgtggataactataactctagttctgcagagagcccttgtttcgtgttggttcagtgtgctgctggtgccaagattttggtcagcagaaatatctagaagttggcgacaacagaatgattatcttctcacacgagtatgtagatatggcaaccctgaacatctcccagcttgtttaatcctctggccgtccgtccgagaacaatagaacacatactaggagtctaggactaggagggagagtatgtatcttcaacttgaatgcacactaccatctccgtataagtgatagaagaactccatccatctccgtagaagtgatagaagaaccccaaccaaagccagatccatgtgcttgtactacactagtaccacggagtccttctctccctcctccgtagatattactgtatttgttgttctacggttctgcccacttcagactgtcaaatctgcaaaactgtctgtcagcctctgccactaggaaaactggaaaagccaaacgccacgccacgccactagcaggctgcaggcgcacccacacaaagaagatgaggagcagtggaggcgcgcaggacgtgcacatcaagccgcgcagcaaacagcaagcgacctcgcctgattgccttccgtgttccatcgcatcgctttccgaaaggcggattgatgggtgggtctggtgcgcggtagttgtcgctcggctccaccctcaccctcaccagtgggcagtgcagtggccagtcactcactcctacccacctgccgatcttggctgccatggctcgcttgctttggttctcactcaaaggaaagaaaggaaccctctccacggtacgaccgggaccagaagcatccgcgtctgccgggccccacctaccgtcctttggcatccggtccgtacgattctgtttcgatcccatcgcgccagctgctgcgggacgccgggccgacgaccgatcggggccgtccgtccgtccgtggggtctcgcagtaggtgacatgcccatcggacggtgtttggtgtggacgtgtggtggatggtacatagtaccgggcgtggtacggtttgctgtggtgagtgagtgagtgggatcatggagggccacctggcctcgcctcgctcttgtacgaagtcatgcgcgcccgcccatggcccattcggcccatgtgcgcgcgcagcccagccgtgcgtgggagtccgatcgtgatgcgtttgctagctctgatgccatggcgccattgtttcagcctaggtgttgggatttttcatcttgtcatgaacgcgatgaacctagcgatcgtctgcacagcttcgtcagccgcgtcctcgccggcaaggccgcctcgccgaggagggccgtgcacgcctcggcgtacgacaagaacctggaggaccaggtgcgcccggcgttcgtgccggacgatgtgatcggcagcgccgggagccccgacaagtactggagcccccaccccaagaccggcgtcttcggcccggcggcggtggaccccaagctggccgctggtggcgcgccggacgccggcgcggatgctgcaggaggcacggtgctggaccagaaggtgtggttccgcccgctcgaggacgtcgagaagccgccccccgccgcgtgagccgcgcggcgctgctaggccagcccacactgctgctcgctcataaaaagggcggcgggagagcctggcagtggcaggcactctgctcgtgctcggccgggctgggctccctgcttatatcactgcaatattatactactagtagtggtgcttgatagcagtgtgtggctgtgctaataccagtataatactggttctactataatacagtcgtatcaggcatggcgtgcatcaggactggttgtgatagtagcaacgtgatgctcgtgcctgtaataagaacaagcaggcgatgtgtgcctgtgatgtaccggtgtcgtcagtgttataagtacttgggtcaatggtttctgcaaaaaaaaaaaaaaaaattgcccgtgaaagctagagctcaaactctggtcattacaagccgagcacaccacaccacccaaatagcccttgaaacctcctacacatgcatggtaaacatcatacacaatcaccctaagaaaaccattatcatttaaagagcatatgttctatctatcgatattcatgcagatcgtacgccgtgacggcagatcttctgcgagaacactcgcttcgctaacacaacctttgatgttcacgcagaccatttgcatgaacctcggaccgaccgaagtattcattctagagagcctgagagcactgtctcaaattattgcatagtttggaaactcaaaggattgaaactacgtcaatttcgaagtggatttgagttttcaaattgaccccaatcaacaaattttgctccctactatctccagtttctaaggagatttgagtttccaaattagcccataaagatcttcacacactgtcatgtgggctagagagggtacatctgttgccaggcaacaccagagccaggcaacaagctcaacagtgaaacttctgaactccgaaacgtaataaactccgtcctcctcgtcctcgatccgtctcctcagctttcccataaccctgatcaagctctagccaattttgtttgtttcggacaccttctttcgttggccgatcgagctggagatgcgttatgcgtgtcgcattcagaatcaggaccgtgtggttcagtataaaatagaaatgtcatgtgtcagattgactccgaaccccgtatgctgccagtatgatcgatggctaaccatgcacgcttgccgcgtgactgtgactgaagcggaccgaactctgcaggcaggggcgcattacgaacgtacgccctgtgtgccagcctgatcgagctcgccgattggcctacccttaggaattattgtgtctgacagcgaggttttcgctgccgcccaaacggagaggattcattctacaattccttggttttcaaacttgacatcatggtttactacacatacgacgtgatagtgatacgacacttgcatgatgcatcatgtgcacacgtactggcagctcttatcaattgtatcatcgctgtaggagcacgcttgttattagttagtttacagacgacgcacctgtcgtgtcctgatagggtgtcgttattatcatatcgtctttgcatatacaaacagaagctgtacgttggggctgttctatcgtcgcatcgtctttccatgaatatttttttctttctgattcttggttagctgtctttcatttcgtgggacaggaacacgctgatgcgcgttctgctggtacgcctacggtgtcggcttgcgactgcgcgcgtgcgatatacagctgtgtgtcccggccgatcagagattttttttagataatggg

SEQ ID NO: 20560 - DNA, 925 bp, Zea mays
  misc_feature (909)..(909): n is a, c, g, or t
caccttggggtccctcgaggccggccgggatcgaaaacccaccgcaccctttcatcagcctgcctgtccactgttggcttggtgacttcctccgctccgctccgctcccctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaccaggtgcgcccggcgttcgtgccggacgatgtgatcggcagcgccgggagccccgacaagtactggagcccccaccccaagaccggcgtcttcggcccggcggcggtggaccccaagctggccgctggtggcgcgccggacgccggcgcggatgctgcaggaggcacggtgctggaccagaaggtgtggttccgcccgctcgaggacgtcgagaagccgccccccgccgcgtgagccgcgcggcgctgctaggccagcccacactgctgctcgctcataaaaagggcggcgggagagcctggcagtggcaggcactctgctcgtgctcggccgggctgggctccctgcttatatcactgcaatattatactactagtagtggtgcttgatagcagtgtgtggctgtgctaataccagtataatactggttctactataatacagtcgtatcaggcatggcgtgcatcaggactggttgtgatagtagcaacgtgatgctcgtgcctgtaataagaacaagcaggcgatgtgtgcctgtgatgtaccggtgtcgtcagtgttataagtacttgggtcaaatggtttctgcaaaggttcataaaaaaaacccgaaaaaaaaaaaaaaaaaaaaaaaaaaaaaaaantaaaaaaaaaaaaaaa

SEQ ID NO: 20561 - DNA, 898 bp, Zea mays
attgggacctcctcgaggccgggcggggaaacccccgaccctttctcagcctgcctgtccactgttggcttggtgacttcctccgctccgctccgctcccctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaccaggtgcgcccggcgttcgtgccggacgatgtgatcggcagcgccgggagccccgacaagtactggagcccccaccccaagaccggcgtcttcggcccggcggcggtggaccccaagctggccgctggtggcgcgccggacgccggcgcggatgctgcaggaggcacggtgctggaccagaaggtgtggttccgcccgctcgaggacgtcgagaagccgccccccgccgcgtgagccgcgcggcgctgctaggccagcccacactgctgctcgctcataaaaagggcggcgggagagcctggcagtggcaggcactctgctcgtgctcggccgggctgggctccctgcttatatcactgcaatattatactactagtagtggtgcttgatagcagtgtgtggctgtgctaataccagtataatactggttctactataatacagtcgtatcaggcatggcgtgcatcaggactggttgtgatagtagcaacgtgatgctcgtgcctgtaataagaacaagcaggcgatgtgtgcctgtgatgtaccggtgtcgtcagtgttataagtacttgggccaaaaaaaaaaaaaaaaaagttaaaaataaaccaaaaactgataaataaataaaaaaaaagggcggc

SEQ ID NO: 20562 - DNA, 1135 bp, Zea mays
ggccggccggggccaaatcccgaacccttcctcagcctgtccactgttggcttggtgacttcctccgctccgctcccctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaccaggtgcgcccggcgttcgtgccggacgatgtgatcggcagcgccgggagccccgacaagtactggagcccccaccccaagaccggcgtgttcggcccggcggcggtggaccccaagctggccgctggtggcgcgccggacgccggcgcggatgctgcaggaggcacggtgctggaccagaaggtgtggttccgcccgctcgaggacgtcgagaagccgccccccgccgcgtgagccgcgcggcgctgctaggccagcccacactgctgctcgctcataaaaagggcggcgggagagcctggcagtggcaggcactctgctcgtgctcggccgggctgggctccctgcttatatcactgcaatattatactaactagtagtggtgcttgatagcagtgtgtggctgtgctaataccagtataatactggttctactataatacagtcgtatcaggcatggcgtgcatcaggactggttgtgatagtagcaacgtgatgctcgtgcctgtaataagaacaagcaggcgatgtgtgcctgtgatgtaccggtgtcgtcagtgttataagtacttgggcaaatggttaaaaaaaaaaggccccaaaggccaaaaaaaaaaaaaaaaaacaaataataaaaaagaaaaattacgccccactaaagaaaaaatgaataaatagctgcttaactgtgtgaaattgctatactcttgcatttgtgcaaatcatactagcaggcagtatcaagtgtaataccctgctgagcctactaagtgaaagacctgacattaataacgggggggctaattgagggttttgagtcgggtaaaactggcgtgcctcagtgagaataatataagccgcacactgcgagaggcaactggcaaagtgtggggtgatccgct

SEQ ID NO: 20563 - DNA, 880 bp, Zea mays
attgggttcctcccggggcccccggccggccggtcgaaaacccaccgcaccctttcatcagcctgcctgtccactgttggcttggtgacttcctccgctccgctcccctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaacaggtgcgcccggcgttcgtgccggacgatgtgatcggcagcgccgggagccccgacaagtactggagcccccaccccaagaccggcgtgttcggcccggcggcggtggaccccaagctggcagctggtggcgcgccggacgccggcgcggatgctgcaggaggcacggtgctggaccagaaggtgtggttccgcccgctcgaggacgtcgagaagccgccccccgccgcgtgagccgcgcggcgctgctagcccagcccacactgctgctcgctcataaaaagggcggcgggagagcctggcaggcactctgctcgtgctcggctgggctggactccctgcttatatcactacaatattatactactagtagtggtgcttgatagcagtgtgtggctgtgctaataccagtataatactggttctactataatcagtcgtatcaggcatggcgtgcatcaggactggttgtgatagtagcaacgtgatgctcgtgcctgtaataagaacaagcaggcgatgtgtgcctgtgatgtaccggtgtcgtcagtgttataagtacttgggtcaatgttttgttgcctgtgttggcttgaaaaaaaaaaaaaggggcggcc

SEQ ID NO: 20564 - DNA, 943 bp, Zea mays
  misc_feature (868)..(868): n is a, c, g, or t
  misc_feature (872)..(873): n is a, c, g, or t
ggaccgacaggaaaccaggggaatcgaaaacccaccgcaccctttcatcagcctgcctgtccactgttggcttggtgacttcctccgctccgctccgctcccgaacggtcgatctttgcatggcagcagcagctggctccaaggggcgggcgatcgctggaagcttcgtcagccgcgtcctcgccggcaaggccgcctcgccgaggagggccgtgcacgcctcggcgtacgacaagaacctggaggaccaggtgcgcccggcgttcgtgccggacgatgtgatcggcagcgccgggagccccgacaagtactggagcccccaccccaagaccggcgtgttcggcccggcggcggtggaccccaagctggccgctggtggcgcgccggacgccggcgcggatgctgcaggaggcacggtgctggaccagaaggtgtggttccgcccgctcgaggacgtcgagaagccgccccccgccgcgtgagccgcgcggcgctgctaggccagcccacactgctgctcgctcataaaaagggcggcgggagagcctggcagtggcaggcactctgctcgtgctcggccgggctgggctccctgcttatatcactgcaatattatactactagtagtggtgcttgatagcagtgtgtggctgtgctaataccagtataatactggttctactataatacagtcgtatcaggcatggcgtgcatcaggactggttgtgatagtagcaacgtgatgctcgtgcctgtaataagaacaagcaggcgatgtgtgcctgtgatgtaccggtgtcgtcagtgttataagtacttgggtcaatgttttgttcaaatattaaaaaaaaaaagcggccaaaaaaanaaannaaaaaaaaaaaaaaaaaggctcctggcgggggcctttttcctgggctacctgttcgggggcaactgatgc

SEQ ID NO: 20565 - DNA, 728 bp, Zea mays
  misc_feature (703)..(703): n is a, c, g, or t
cactccctcgggcgagtgggtgccggccgcccggccggggtccattcccttttgctcgcgcacgcgctcgtctctccaagcctcgaaccgcatctccggcggcctagtggaacgcgaagatggcgacggcgctcggcctcggtgcgcgctccggcctccgactcctgtccgcaggcgccgaggccgcctcagcaacgtcttctcgtgcattccattctactggcacaaggaggatgggggcgcacgctcatgatgagccatactacgtccacgccaagcacatgtacaacctgcacaggatgaagcaccagcagcttaaggtgtgcctcgctgtgctggctgcggtgggcactggcattggagtccctgtgtatgctgttgttttccagcagaagaagactgcatctgcataatctgaaacgccgaggcggcacgacatgaaaacatgcctgcccgtgaaatttcttttcccatttcccacatagcattttgagaggttcaggctggagcttcagttttgcttggccatttctctctctatatatttttttctctcttgctgcaggtttactctgctcattggattttgacataggaataccgatgtctgttaataatacgatgtcttgaactgacagaaagcatatgctgttatcctttctaaaaaaaaaaaaaaaaaattggcggccgcccggctcccgcntctgaatgtatagaaacgttacacc

SEQ ID NO: 20566 - DNA, 3794 bp, Zea mays
caagagaggagaggagcaggaggcgaggacaccggaggcgaggacaccagagttcaccgctccgtcgacaccggaggcgaggacaccggagtcgagtcgcctgtcgccgccacgcgcctacaggagaggagacgaagaggctgagagaggaaaagtggatgttagggttacgtggcttacggcttacgccttacgcgacgcggcttgcgccctatgcgcggttatgtgcgcgtgtggttaacgggtcggcgccgtgccgcggcttacgtgggccgtgctcgtgcctgcaccacgggcccacttggcagcccaagcacggcacgtgcaccgggccgggctggcacgggcacgccggccgtcgtgctgggccgggcctttcccgtgcttgggcgtgccgggcgccgggctacaccacgggccggcccgttttggacatgtatacctacaatcatattaaacattgaagctaagacaaccaccccacctatgtcagcgattgattttgtgcgctattaaaccagctttaggttgtgtctagcagattgtgtatatgatcgtgcaaaataatgttttacactgtaaattgtgttgtttatggaataaagtttaaaataaagaataaaatatgagataacatgggtaatctgctgaagataacctctaaaaaattacgactataagaaaagaaactagaattacggctacaagatactatgatggttaaaacattcagcgaggggaaggtatcaagaaacaggtatcaatggataggtcgattgtcgctttcatgtagttgatgaaataaatacgcatttttgtactttaataaatcaaatacttctagatttgactaaatatatatgtaaaacctattaatctttatcataccaaatagatattattaaattaattatattatatattttcataacaaatatacctacatatattaatattgatacaattacatataaatttagtgaaacctgagattttcttacgagatggattttttttttggatggaggttcctctgacgtgttgtagtcttacggacacctcgcgttcaactattttaattggatttgaagtttcttccttctcctcaagtggtgttcacgtataaaccaatcagctcccgtccccgtcccacaccacacacagagaaagagaaagagccacgcattgcacttggcttgcacaagcccggaggagccccaaacgcggcggcggacggaatgcggctgcgcctgcctcagtcagtacgcgtctctcactccctctcccgttccttctccccgcaccgttcgccagatcgtctcttctctcgggacgggcgcgctcggtccaggatctggaggcaggcgctgcctaatcagttcttccttcgtttcctttttgtccttggcaacacgcatcaaagaaacctgcaaaaaatcaggcaggtttcgatttgggcccaaatctatcctgatacagttggtagctgactggccgcgtgcttggagcgccaatatttcccccaaacaatagcgccctccgtccgcttgttgaaatctttatccggtgtggagtggagctgccgttcaaacctgtcatctgattacttgggttgttttccttgccgttgagccttgtgatgtgcagtgaagccgcgaattgtttcattacatttggattttttttaaggcctggtgatcgaaacgatataatacttcatcttctatttggagtttcagctacttgggtgccgtttctacattgcaagatttgtcggtgatagtatattcacgttcgtacgcacataattctactgatatggcaatactcccgggcacataatgatgtcagtaaattgtctgaaatttcagagaattggcctgaaatcttgcatcctgttgaccattccaacttctccgcgttgttgatgttggtaccttgaaatctttgtagaaccagttagcaattcaacaaaaatgtttggttattttatttcagaagcaaagcagactgctgagtagctggacggacattgaacgaatcggtctgaatgctttgctgacaccgaaacctattgcaggtgaacattctgctgtgatggcgaaggagtactacactacgagcagccttgtggttgggtacgcgctgtgctcgagcctgctctcgatcatcaacaagtacgccgtgacaaagttcggtttcccaggcctcctgaccgctctacagtactcgacatccgctgctggtgtctggatcctcggaaagctaggcttcctcacacatgaccccttcaacctggagaccgcaaagaagttcgcgccggcggctctcgtcttctacctagccatattcaccaacacgaacctcctctgccacgccaacgtcgacaccttcatagtcttcagatccctgaccccgctcctggtcgccatcgccgacacgacgttccggaagcagccatgcccttccaagttcacgttcctgtccctcgtggtcatcctgggcggagcggtcggctacgtgacgacggattcggcgttcagcctcacggcgtactcgtgggcgctcgcgtacctggtgaccataacgactgagatggtgtacatcaagcacatcgtcaccagcctggggctcaacacctggggcttcgtgctctacaacaacttcctctccttgatgctggcccccgtgttctggttccttacaggcgagcacaggtcggtcttcgcagcgatggagtccaggggcgaaggctggtttcaactggacgccgtcgtggcggtggcgctgtcgtgcgtcttcgggctgctcatcagtttctttggcttcgcagccaggagagctgtatcggcgaccgcgttcaccgtgaccggggtcgtgaacaagttcctcaccgtggccatcaatgtcatgatctgggacaagcatgccagtgcgtatggttcggtctgcttgctgttcaccatcctcggtggggtgctctaccagcaatcggttacggtgaaaggaaacggtgcagttgtggcacagcgtgagctggtgcccgagcaacctgaggaggttgacgaggagaaacaaagcttagtttcttcagctaaataatacggtgcaacggatcacttgcaatgataggatccgtttgcaggtttattctttggcctttgaatgggctcgtttatgtgtctgcgaaacaaacatgagggaatactatactagtggaagtagcacttccgtcaatggaagccctgctattgtttgaatttgcatcaagattgcaacgttttgttcactgcgaatgtgtactttagctgataaaggtggttcttgatattgcatatttttttcctttacaaaaaaatatttttatgtgtctaatgcctcagtttatctagcgcaaatgtccgcctttcaaatttactttgtaaaattacttaagctacctccagcaacttatttatcctcgtaccaatattcaaactcaattatacaaacaatgtcatatataaacaaaatagtgtttttatgatcatatggatgaactgttggacacggtcttagcgaggagtaatttacagtagcacccctctcgttgtcatacatgttaatgtctatttctgtactcttatcatacatgttaatgtctatttctgtacaatacttagactatcttcaacagcatttctatctcacctcttatctcactttctatttcaaacttcactctacaacaatacactttatagtgcaaaacagtgttttgcatatttaaaccagtgttttatatatccatatac

SEQ ID NO: 20567 - DNA, 1677 bp, Zea mays
ggatggaggttcctctgacgtgttgtagtcttacggacacctcgcgttcaactattcttcgtggacttccaggccgcccgccctcctcaagtggtgttcacgtataaaccaatcagctcccgtccccgtccccgccccacaccacacacagagaaagagaaagagccacgcattgcacttggcttgcacaagcccggaggagccccaaacgcggcggcggacggaatgcggctgcgcctgcctcagtcagtgaacattctgctgtgatggcgaaggagtactacactacgagcagccttgtggttgggtacgcgctgtgctcgagcctgctctcgatcatcaacaagtacgccgtgacaaagttcggtttcccaggcctcctgaccgctctacagtactcgacatccgctgctggtgtctggatcctcggaaagctaggcttcctcacccatgaccccttcaacctggagaccgcaaagaagttcgcgccggcggctctcgtcttctacctagccatattcaccaacacgaacctcctctgccacgccaacgtcgacaccttcatagtcttcagatccctgaccccgctcctggtcgccatcgccgacacgacgttccggaagcagccatgcccttccaagttcacgttcctgtccctcgtggtcatcctgggcggagcggtcggctacgtgacgacggattcggcgttcagcctcacggcgtactcgtgggcgctcgcgtacctggtgaccataacgactgagatggtgtacatcaagcacatcgtcaccagcctggggctcaacacctggggcttcgtgctctacaacaacttcctctccttgatgctggcccccgtgttctggttcctcacaggcgagcacaggtcggtcttcgcagcgatggaatccaggggcgaggaaggctggtttcaactggacgccgtcgtggcggtggcgctgtcgtgcgtcttcgggctgctcatcagtttctttggcttcgcagccaggagagctgtatcggcgaccgcgttcaccgtgaccggggtcgtgaacaagttcctcaccgtggccatcaatgtcatgatctgggacaagcatgccagtgcgtatggttcggtctgcttgctgttcaccatcctcggtggggtgctctaccagcaatcggttacggtgaaaggaaacggtgcgggcgtggcacagcgtgagctggtgcccgagcaacctgaggaggttgacgaggagaaacaaagcttagtttcttcagctaaataatacggtgcaacggatcacttgcaatgataggatccgtttgcaggtttattctttggcctttgaatgggctcgtttatgtgtctgcgaaacaaacatgagggaatactatactagtggaagtagcacttccgtcaatggaagccctgctattgtttgaatttgcatcaagattgcaacgttttgttcactgcgaatgtgtactttagctgataaaggtggttcttgatattgcatatttttttcctttacaaaaaaaatatttttatgtgtctaatgcctcagtttatctagcgtaaatgttcgcctttcaaatttactttgtaaaattacttaagctatctctagcaacttatttatcctcgtaccaatattcaaactcaaaaaaaaaaaaaaaaaagcggcc

SEQ ID NO: 20568 - DNA, 1315 bp, Zea mays
ggccggggtgatccgtcgccgtcgaggagtcgactcgtctatccacaggcaaaaagaagaaaaaggagagagtatctagctagctccggccccgccgccgctctgctccggccgcatgctggcctgcaacggggtcttgcccggtcggctccggctgccgagggccgacgcctaccacctgcgcccaccagcgctcgcgcggaggtggcgcgtcgtggcctccgctgcggcgtccggcggctcccctgacctcccatcgtcgtcgtcttcgccgcctaacccgccgtttggggccggggacgaccagaccgccgcgtcacctgggttttgcatcattgaagggcctgagacggtccaagattttgcaaagctagacttgcaggagattcaggataatattaggagccgacgaaacaagattttcttgcatatggaggagattcgaagattgagaatacagcaaagaataaaaaatgtggaactcggaatttcagatgaagagcgtgaccatgaactccctgattttccatcatttattccgttcttgcctcctctgagtgcagctaatctaaaggtctactatgccacatgtttcaccctcatagctgggataatggtgtttggtggttttcttgcaccaatcctggaacttaaacttggtgtagggggcacgtcttatgaagacttcatccgcagcgttcatctgccgatgcagttgagccaggtagatcccattgtggcatctttctcaggcggagcagttggagttatctctgccctaatggttgttgagataaacaatgtcaagcagcaggagcttaagcggtgcaaatactgtttaggaactggatacctggcatgtgcccgctgttcaagtacgggcgctcttgtgctcacagagcctgtttcaacattcagtgatggcgatcagcctttatccgcaccaaagacagagagatgcccgaattgctcaggctcgggaaaggtgatgtgtccaacatgcctctgcactgggatggcaatggcaagcgagcatgacccccggatcgacccgtttatttgaggtgcacctttagtccaggaactgctgcaacgtgtggaagatgcttttgtagataacagcatccacaaaagattcacagataggccgaatcgtgaattcgaatcgacgttgtacgacacgaataggacgaactgaagagtgcagagaggtgtatgttgtaaagtaataaaaaaaatatttagaccaaagaccgtttggccccgttttatagaaatcaagctatgtttgattgtcaaaaaaaaaaaaaaaaaa

SEQ ID NO: 20569 - DNA, 7119 bp, Zea mays
aacaaatgttgcttgcaaatgttcgtgacttcgtgtggtccctagtgagggctggagcgaaaccgcccgctgtctcgcgtccgtcagacagcacgcacagacgcaggcgggcgacgcacggcagtgttgccaatggactcgcgctgcccccatctgctactgctcctccctctcctcctcttggccgccctcctgcccccgccgtcgtcgggggtgccggaggtcatctggctgccgacgagcgggggagcggggcccttgtcctgcgcgccgccggaccccgccgtgtacgaccgccccgtcatcggcatcgtctcgcacccaggggacggtgcgggcggcaggatcagcaacaccaccgcgacctcctacatcggcgcctcctacgtcaagttcgtcgaggccgccggctcgcgcgtcatcccactcgtctacaacgagcccgaagaccgcctcctcgagaaattgagtttgttgaatggagtgctgttcactggtgggtcagagaaggaaggtgtatattttgacacgataaaaagagtatttcagtatgttttggacaagaatgatgcaggtgaaccatttcctttgtttgcccaatgtcttggctttgagcttgtaagcatgattgtcagcaaggacaataatatcttggaggcatttgacgcccaggatcaagcatcaactcttcagtttcccagctatgctttggagggttcagtttttcaaaggtttgacactgacctcatcaagaaagtcagcaccaactgtcttgtcatgcaaaatcacagatatggtatatcaccaaggcgatatcgagagaacgatgcactatcaagtttcttcaaaatcttgactacatcacctgatgaaaacggcaaggtctatgtctcaactgtacaagccaataattatccaatcacttgcacgcaatggcatcctgagaaagccatttttgagtggaggaaaccaatgatcccacacagcgaagatgcagtacaggttactcaacattttgccaatcattttatcagccaagcacgcaagtctccaaacaggcctcctgccgacaaagtgctggataacttaatttacaactacagtccgacatttaccgggaaaaaatcgaaatcgtttgaggaggtctacatcttctcctgagactggattgaacgcctgagtgtcttcaggaatctgtagttctgcactacattgctattgtagtgtaaccgtgcattagtattacccgtggtaccagaagttgtatttgtatagattcgttggactgcctgtattgcagtaacctttccaccgtatgggtggctctatagaatgcctataagcagcgcaataataatgataatgtaagactgaaaaaaaatacttgtatggagattttctgaatttaaaagtttctccaaatcaggtgaaggtcgaatgttcctggacctgattcatgaaatccatcgaatccgcggccgccgccgcggcggctttgctatggcgctatggcttggctcaagcatcttgcgtcgagaacgtcaccgtgttacctagccggccgaattacggatctcaagggtcgagaagaagtgaagaacacaacaaacatagaaaatacggaggaatgcttaatttggagaggtcactcgagttttatattcataggactcctaatgacgtaattgcataaaaaatgctctataatttaaaatggagtataacttatagaatttagaacacaaaaaaatatgttgttccagcaataaaaccttaaatctagattatatggtagtatactacaatgtagtatatttgagatatttgagaaagcgctatataatttttaactaaattttataaaacaaaacattgctcgagtgattttttgtgcgtagagctttatatttaaatttaatgcactaatttaagatatggttggagatactctaacgatatatttagagacgtgatgcgtactctttcaaaaatgacaccaagacacgctatcccctctaataccgatgcctcgacgattacaagtcgcggattgaccgcattgcccttctcattcagtatagactgagtgttcattctatcttcggtctcgctcttccacgatggaagaacctgcgcggccatcctgcttccagcgtcgccggctacctggcgctcgggctctgcctcgaggtcggcatgtcgccatggggctcgcctacactacgagagcctggttctacgtcagccgcgtaggtgttcgacgtcatatatgatgccataagaagggccatatatgttggtcgtggaaaaaatgatcaacaagttaaaactagattaagaagaaaatacggaagagacggatgagaatggtaagtcgtagtactgtcattttttacgaactatatagttttaatttgtttttgctttgtttgaattatgtgctcaatatatttttttgaaacgaaatggtatgtttcttcttaaataagtgttcgtcaaaaaaaaatatgacgctaatatggatgtaggttaacgtactctatacaatgattatagcttgatacgagctgctgacactggatccagtctaatttgtcaactcgtcggcggtcggtgcccgttgctctccgaagtctccagcccgcccggaaatcttccgtagatgccgatgtgacgtgcaccggcctcggctgtgctgtgccgcccagaatgctccgcgtatgtcggctctcggctgcaccgccggacgccatctgtcaccgctgggcacgtagcacgctgcggtcgttgactcgttctcgttgcccgtattcttttataaaaaccatccctagcttcttcggttctttgcatttcaaccccggctggaaatgcaaatagtatacgtttccacgttaacgtatatgatactgaccgtctattatccggatgggtatagtattaccagctctttttcttgcatttttttcagccaatggatgcacacggttcatttgcaattattccaccgacaagcagccctgaacattatatttagggccagtttgtaaatcccaatttcccaagagatctctaatttctaaaggaaaattagttcattttcctataaaaaatagaaaactcttaaaaaattgaggttcccaaactagcccttagaagatatttttaggcatgtcaaaaaacctccaaacccatatctcacccataaactatgacaccgttctttacaattactacaaatataccgtggaaatactctatatgatggtacacttgcagatacaacctctggagttgcatctatcaatttatttctggcccaagtttgacttgagtagggcaggtaaacagccagagccgcggagcaaaataaacaggcagtatccgggctgttgccccctccaatgccggccggccacccatcaccttcctcccgcgcgctccggtgccctcgctaccaccaccacctaatcggccattctgccttccgctccgtttctccgcgcgcctgacctcctcctctacctgatggccgccaccccgccgccgtcgtgggacgcgtcaccgcggcccccgcggccggcctcctcctcggggcccgccaagcgcgggggcctcctgctggggcgctacgagctgggccgcctgctcggccacggcaccttcgccaaggtgtaccacgcccgccacgccgacgacaccggcgagaccgtcgccatcaaggtgctcgacaaggagaaggccctgcgcaacggcctcgtcccgcacatcaagcgcgagatcgccatcctccgccgcgtgcgccaccccaacatcgtccgcctcttcgaggtcatggccaccaggtccaagatctacttcgtcatggagttcgtccgcggcggggagctcttcgcgcgcgtcgccaagggccgcctcaaggaggacaccgcgcgcaggtacttccagcagctcatctccgccgtcggcttctgccacgcccgcggcgtcttccaccgcgacctcaagcccgagaatctcctcgtcgacgagcgcggcgacctcaaggtctccgacttcggcctctcggcggtcgccgaccagttccaccccgacggcctcctccacaccttctgtggcacgccgtcatacgtcgctccggaggtgctcgcgcgccgcggctacgacggcgccaaggcggacatatggtcgtgcggtgtcatcctgttcgtgctcatggctggctacctccctttccacgaccagaacctcatggcgatgtaccgtaagatctacaggggggaattccggtgcccgagatggttttccaaggatcttagctgtctaatgaatcagctccttgacacgaacccggagaccaggatcacggtggctcagataattgagagcaggtggtttaagaaagggttccggccggtcaggttctacgtcgaggatgaccaagtgcacagcttggcagacagtgaggctgaggcgctggaagaactggggcccagtgacagtgaagcctccacccccacctccccctcccccgccaccaccaccaccacagaaagaggacgacggcgatgattctggctgggagtcagactcctccgtagcgtcctgcccagccacattgtcatcagaggagaggagacggcctgtcggatctctcccacggccggtaagtctaaacgcgttcgatatcatctcgttctcaaggggattcaatctgtcggggttgttcgaggagcgaggcaatgaagtgagattcgtctcggcacatcccatgcaaacgatcataacgaaactggaggagatcgccaaggtgaagagctttgcagttcggcggaaggattggcgggtgagcctgcaaggcacgagagacggcgagaagggtccactgacgatcggggctgaagtgtttgagctcacgccaagccttgtggtggtggaggtgaggatgaaggcaggtgacagggaagaatatgaggaattttgtgagggggagttgaaacctgggatgctgcacctcgtgcgccgtacagcatcggttccggatataccttctgcatgatactgattagcttagaaggtaactcttgctcttgcttggaaggactatggaaaagaaatttggattgagaggttgcacctttctgcttcagcgtaagcatctgtgcaggaaaatgtcattcatagattttccttattagttactttttggttaatattctttccgcactccataatgtcttgtgatatatagtagtcgtgtgctaatatcaattgtcaattttctagttcttaaagtttaaataaaagttgcggccatttcactgcagcattattatgaaagctataactctaatgttatttagccatgtaacggtgctgcacttatgtacattcagcttgtacaaatgtcatccgtaaattttttgagggaacagtggccttggtgtgtacataagactaaagagtgtaactttaagttataacaataatgttattgcgctgcacaaggttaagatgcgcccttatatttcgaggtcgtgatgagtaattgtcaaaggagagttttggattgagtggggtggattaattagggcgtgagtatgtacaacatgtttactggctagttatgtgtagttgtaaagttcaaaggcagtggtccacgatgaagataaagatcatgcatgtttatgttgctagacgggagcagtgaaagacgagtgttgcgtcttgattgaggggctagagaagtcgggtgaccaactacggtgcacatggggacaccaatagagtagagacgaggacgtaacagagtggatcgtgttaatgatgcggttgaagaccgccgacatacatgtccaggacggagggatgcatattatgctacctgccactgttgaagctagagcaaaaatgaagagggtgcatttggccttattggtgcattagaatttttttctagaggtgcatatatggtaaaatttttaatcaaatctatagaatttgtgtttttaggggtgcatttgcagcactagaaataaccttgcttcgcccccgctacctctagaggtttggtagttaagactcaaaaccacccaacgacagtttcgcaggtttgacgtcaaatctaggcgatgtagttctacagagaatcagagacaacacataaagtcatcacgaaggtgtattagggcaaagcaacttcgtgaaagaagcatgactgcctagattatcataataagagttggtccattttctgtggctatgtggataagctatatgtatctagaggtatttagaaatataaataaaaactctataaataaggaagaaatgatgcaccaaccaactatctctctaacttttatttttaatatctatttttcttttgttaggagatccttcgatgctttaagctttatgtatctatgtagttgtgattttgggaagtacgtgtggccttaaccgcaccatcatctctatggtaaatccctatccaagtctaatagttttggttcttggtttttatttttctctcctcgagctcttttgatttgtcatcttgtatggattcttgaactttgattagatagagactttagaaacacacttgggatcgttgcgacctttgatatgggttcattcaacttgtgcacaattcactaattgaattgtactattgggagaaaaccctaatttgatttctagatttctgatcaaattctctagttttgatcttttggtgctcaaacttctgtgaccatcttatttctctttgtctcactgctcgtgaagtttcatcccaatctaaacattttttattgagcagcactttcgtgtagtgtgcctagcactaccggctagaggggcggtactgtcgcattgacatgagaagttttctatttgcctcttcgtggaatttccactgtccaaattaagcttcgtttgttattcatagcttcataattctcttaggtacttgtcttaagccatccaaccagttgaggtggtcttggttttgcaccttttggagtgctttcagtgccataggggtttgagctgaacttttggacattaagcaaagatcgcttgagcataattttttattagctcccatcacga

SEQ ID NO: 20570 - DNA, 854 bp, Zea mays
  misc_feature (839)..(839): n is a, c, g, or t
ggtaccctcgggcgccgccggggcttcaggcacgctcatcttccccgctctgctccagtgctccatcgatcaggaattcagaactcacaaacacgcctgctccctcttcgataaatccaacctattatccaaaccgtctcccgtgtgatccgtcgccgtcgaggagtcgactcgcctatccacaggcaaaaagaagaaaaaggagagagtatctagctaggagcgtcgccggcgatgctctgctccggccgcatgctggcctgcaacggggtcttgcccggtcggctccggctgccgaggggcgacgcctaccacctgcgtccaccagcgctcgcgcggaggtggcgcgtcgtggcctccgctgcggcgtccggcggctcccctgacctcccatcgtcgtcgtcttcgccgcctaacccgccgtttggggccggggacgaccagaccgccgcgtcacctgggttttgcatcattgaagggcctgagacggtccaagattttgcaaagctagacttgcaggagattcaggataatattaggagccgacgaaacaagattttcttgcatatggaggagattcgaagattgagaatacagcaaagaataaaaaatgtggaactcggaatttcagatgaagagcgtgaccatgaactccctgattttccatcatttattccgttcttgcctcctctgagtgcagctaatctaaaggtctactatgccacatgtttcaccctcatagctgggataatggggtgttggggggtttttcttgcaccaatcctggaactttaacttggtgtagggggcacgtcttatgaagacttcaatcgcagcgntcatctgccgatgca

SEQ ID NO: 20571 - DNA, 3352 bp, Zea mays
attcccccgcggctcctctcttcctgtcttacgtcgctcgccgcatttcgccatttttggggagggtgtgttccagccttgcaggccgccgagatggtgggaggcagcaagccgctgggggaaagcgtattcgcggtccacgcggtcgccggtgcggcggcgatcagcgcctccgccgtcgccgtgtaccccctcgatacggtcaagacactcctccagctgggagcgacggggcagaagcagaagatggggctccggcaggtggtggaccggctcatggccgcttccggccctgcaggtttttacaatggcattggatggtccatattgggtaaacttcctggattgggagcacgttttgggacctatgaacttttaacagccttctataaagatggaagggaggacaactatgtctattattctgaggctatgaaggctggcatagctgctggtgctgtagaggctgttttctgcacaccatttgaacttttcaaacttcgaaaccaagttagttctgtgattccttcaaaagctatgggccctgcaaatgttgctcaagaatcatttccactgctttccaaactgttgcctggatatgttcctgatataagggtgtggaacaacaccatgagccttttatctgatctttctcccaagcatcctgacatgttgggtgctctgaaacagcacccatggatgcttacgggctctgggaaacccccattaccgtctgatgtgcatctaccttctagagtgatattgcttgaaggatggggtgctctttggagagggctcagatcagggatagctcgagactgtgtatttggtggtatgttcttttctacttggcaattcctacacacagtgatgctcacctggaaggcagttaatatgagccctaaacctagaaatctagaagcagcaggacctgtacccccttttgcctctagtgttgctgcaggctttgcaggagcgatagcagctgctgcttcacatacatttgatactgctaaaagtcgttcagagtgtactgtggtgcctaagtatatcgcaatggagaggaagtttcttaagtggaaagcaccaggaacgtggatagagaggaagacaggaatatcccctgctgataggaatgttttgttccgtggcattggcctacgaaccgcccgtagtggaatcgcatcatttgtgttagtcggctcatactatttagctgtgaatcacctctcgtagttgatcaagagaaatcatatggagatttttttttgcattcagaagttcaaaactaaaattttatgactgtatatgcatgcactgaatggctggaagctgactttgccacagtatccactgattatttgaaaatcctgttcacctaagtgctcagatgaaactgattgtcccacggcatgttttaaggtgccgatgtaaatgttttatggcaaaaaaaaaatttgaaggctgccactttcgatcagaggctagtttacagttctacataaattgctgaaaatctgtttttgacaaaatgcaagcatcaagatgcacaatgatcaaggaaccctttgacatagcatttcccttgtcagaagaagaatcgcctgtacaaagctcttcagattgtcttcaggccttgcgtaaatttgtgaacatgtatttttgtttgaaaatactttgtacacttcattcattacacatcagctcttgacatggcagatcttggtccttcctttctctccagagccaatatttttgccagaagcaaccattctgctgcatatacacttaatggcttgtgtcttctttgttccaaagtggatctagtggaggaagatcatattcttcaggtgttagcgccaatgcaaaatctggtaatgggggtggcgctccaatgaccttttcttgagtatacaggtcctggttgattcgaaccttgctggaagcatctcttgggatcttgtcaaacagatattttgctgttccgaatggattgggactcctcgatgttggaggagttgcatggaaggcttctgaaacccttttgctttcttttagaaattcctctgaagcttggagtgcagctattgccattccatgggatttttcggtatttccctcgtcaagaatcaaaccgtggaaatagtatgctgcagccttagcttcaacatatttccactttataaagagccggtgctttttaccccatccatcagagataggaagctctggaatgctctcttgaacttgttgccaatatttgaccatctcacaggctaagcgccgttttactgctaaagtggcctttggactatcaatagccaaaccaagctgcatgtcaaccccctgacccagggcttggaggcttagagctttgagatttccttcagccaggtctactggaagctgtctccttagctccagtggcatcttcgggagtacatgccgaactgcacagtctaggtatccagctgccttcaagaagacatcaacagtagcccgtcgactctcttcagaaacccttggggcatagccatcgccgtatgacctcgggagaagcagggcgttggcctgcagcaggcagaccatggccatcagatgcagcatggacagcacctcgtaccaggcgtctggcatggccgtctcctcagcattatcctcctggttactccaggtgaagtgcactttgttcctcaagacgctaccttcttttaccagtcctagcagagccggcaagtagtcttcgagggcctgtagaagattggctgtactagacccgtgccgtgccgccgccctccgcctgggcttgagcgccgccgccgactctcgcattgccatgtcgacgacccgcgatcgcagagccgacagccggtccacggcgctcctggccaggcagccgccgagcgcctgggccaagtcgacggccctcggcacgcggaggcccgggaggaagacgaccacgtcgccgacgctcaccggccgcctccgcggcgccccggcgtccttctggctcgacgccccgcaccccatcctcgtgcagcgccctgcttagtttatctaatccctcggcgacgtacggtgagaagaacgtcacggccggtagctgctcctttctcgctgccggcgcacgcaggtatggttgtagctaggacgtgaggagataaggcaactgggggggggggggggggtggtagggagagagggactcaactggatgtggatgcagatgcgcggctatgcaacttcttctcctcctggtcctggtgagctggactgcaggctgtggaggaggagagccttgagagggggaaggaggaggaggaggagaggcccggcccggccggcctcgagg

SEQ ID NO: 20572 - DNA, 874 bp, Zea mays
  misc_feature (39)..(39): n is a, c, g, or t
  misc_feature (110)..(110): n is a, c, g, or t
  misc_feature (830)..(830): n is a, c, g, or t
  misc_feature (838)..(840): n is a, c, g, or t
  misc_feature (843)..(843): n is a, c, g, or t
  misc_feature (864)..(864): n is a, c, g, or t
tccttagctcgagtggcatcttcgggagtacatgcccgnaactgcaacagtctaggtatccagctgccttcaagaagacatcaacagtggcccgtcgaactctcttcagnaaaacccttggggcatagccatcgccgtatgacctcgggagaaagcagggcgttggcctgcagcaggcagaccatggccatcagatgcagcatggacagcacctcgttacccaggcgtctggcatggccgtctcctcagccattatcctcctggttactccaggtgaagtgcactttgttcctcaagacgctaccttcttttaccagtcctagcagagccggcaagtagtcttcgagggcctgtagaagattggctgtactagacccgtgccgtgccgccgccctccgcctgggcttgagcgccgccgccgactctcgcattgccatgtcgacgacccgcgatcgcagagccgacagccggtccacggcgctcctggccaggcagccgccgagcgcctgggccaagtggacggccctcggcacgcggaggcccgggaggaagacgaccacgtcgccgacgctcaccggccgcctccgcggcgccccggcgtccttctggctcgacgccccgcaccccatcctcgtgcagcgccctgcttagtttatctttgcgctcgctccctttccgggattctcgagaccacagaaaaccacaccgcccgcgcccggaaccgaaagcctccaccagcagcagagaacgggaccgctgccactacccctgctcccccgtccccgcagcctgaacgcggccgccaccgcggggagctccactggtggccnacccccannnacncaatgaggagagggggggggnggggggtggg

SEQ ID NO: 20573 - DNA, 1896 bp, Zea mays
ggccgcttttttttttttttttttcggagtatattttaaggtgccaatgtaaatatttacgaccactaaaaaaggtttccacttcgatcagaggctgattccagttccatttcgaatgctgaaaatctgttgttgaaaaaataaaagcatcaggaatcaggatcgacaatgatcaatgaaccctttgacatatcatttcccttgtcagaagaaaattgcctgtacagagctcttcagattatcttcaagccttgcttaattttgttgacatgtaattttgtttgaaaatattttgtacacttcatttgttaccatgttcgacctttgacatggcagatcttggtcctcctttctctccagagccaattttttgccagaagcaaccaatctgctgtatagacacttaatggtgtgtatcttctttgttccaaagtggatctagtggaggaagatcataatcttcaggtgttagtgccaatgcaaaatctggtaatgggggtggtgctccaatgaccttttcttgagtatacaggtcctgtttgattcggaccttgctggaagcatctcttgggatcttgtcaaacagatattttgctgttccgaatgcattcggactcctcgatgttggaggagttgcatggaaggcttccgaaaccattttgctttctttcagaaattcttctgaagcttgtagtgcagctattgccattccatgggatttctcggtatttccctcgtcaagaatcaaaccgtggaaatagtatgctgcagccttggcttcaacatacttccactttacaaatagccggtgcttttttccccatccatcagagactggaagctctggaatgctctcttgaacttgttgccaatatttgaccatctcacaggctaagcgccttttgactgctaaagtggcctttggactatcaatagccaagccgagctgcatgtcaaccccctgacccaaggcttgcaggcttagagctttgagatttccttcagccaggtcgactggaagttgtctccttagttccagtggcatcttcggaagtacatgacgaattgcgcagtctaggtatccagctgccttcaagaagacatcaacagtggcccgtctactctcttcagaaactcttggggcgtagccatcgccgtatgaccttgggagaagcagggtgttggcctgcagcaagcagaccatggccatcaagtgcagcacggacagcacctcgtaccagacatctgaaatggctgtctcctcagcattatcctcttggttactccaggtgaactgcactttgtgtctcaagacgctaccttgttgtgctagtcccagcagaacgggcaagtagtcttcgagggcctgtagaagattggctgtactagacccgtgccgtgcagccgccttccgcctgggcttgagcgccgccgccgattcttgcattgccatctcgacgacccgcgacctcagagccgacagccgctcgactatagccctggccaggcagccgccgagcgcctgggcgaagtcgacggccctcggcacccggaggcccgggaggaaaacgaccacgtcgccgacgctcccaggccgtctccggcgcgccccggcgtccttgtggctcgacgccccgcaccccatgcctgtggctgtgcagcggaagcggcccgcttaggtatctatctttgcgctcgctcccttccctccgggattctcgagaccaccagcccccgcccggaatcgaagcctcgaccagcagcagcagaggccgccactatccctcccgccccccctgctcccggccgtctccgcggtgctgcacgcgcgcgcagcacaaagcacgcacaacggacaaggacaacacaagcgagcggaacggagcgagaggcgac

SEQ ID NO: 20574 - DNA, 3005 bp, Zea mays
ttttttttttttttttgaaccaaacaagccttaaataatgtgcaaatggtacaaccaagacgcaagggtttagggagcggtagaaggattgttctaaaaaaatggcatttttaaaaaggtactgcgggagcgctgggcaaacgacgacgagaatgcaccactggccaaaaagaggcaacagccaacagacaagaaggttatacatatgtcacgttattattatgataaaacctgatgttacagcagccgcctctggggcggatgcctataagggcaatacatgcgtttgctcgtcaagaaagaggcagccaaacaccgagttaaaaaaatcacggcctctgatggtatcctggcttcctaccagagcttgcgtgtcatacttgcatgccctcccgcagtctggacagtatgtcacctctaaaacctttggtttgaatctgttgtcaagcataatatctacaccgtagatggccctggagaatgggttctgcatctcaggatggacagctgcggctgcctcaaagatatggcgtatggtagatcgtacgctttcatgaatgtccagccatttaacttggtgctccttctcgaaccccttgacgaactctggcgtgttcatatgattcatccttccgatataattcatcacagtgaaatgggtctcgtactcaaaaaagctagtcttctccaaagtgtactgattgtttgctaacctaacccagaaaacatcagacagaaatatttccaaagggcggatactacggaccaaaacaatgtaccgaagatcaaacttccttccttggaaaagtgcagggcgttcaatatatttttggcatatcttggggcctgtctccataagtctgatgatagcagacaaatcaccagtaactgtggtatcgattgttctcgccatgttccaaggcttcatgatccataaattgtccatgccatctcgtttcctcacacaataatcaccaatgagtggagacaaatgggtttccaggttatatgtaggttgaagccattcaggtgagccccaagccttgtggatggtctccgcaaggtggtgcttcatgaccaggcaagcttcaaaaggaaattggtttgtgtattgttggtctgtgagccctacagcattctttacttctgaatctacttgcatgcttacccagatgatgtcagcttcctttggatcagtcgtgagaacaaattctggccgtgttaaaaactcctctacatgaggtatgtcagtatatactcgaaggacgcgaccatcccttgggcgtacacttttggttgagggtgtctgtgtctcttctatttttgtcgaagaacaaatgctatttgattgaagctgttcctggtacctcctgaattcctgaataaagtagttctcaggtgtgcggaaccaagctgtaagcctagctgaacgctgtttgtcctcaccaataccaaacaagaaatcccgggtacactcttctccagtatgaacatcatgagtgggccacagaattgtgtaacttatagcagtgtgcagtttcccttctggcatgaacaagaatggagctattctgaagtttgcattatcactgtggcgcatggctgagcccaactcgtccatgacataccaaacaggtgtttcgtcaatcttttcatcatcagcaagccggtatgtcataagatacaaccacattgcgccaataactctttcagcaaggggttcttcaggtgaccattctggaagccgtggttcaagtgcagagtcaactatatgcttcccactctctattatgcttgaggaatccacgccatttagcaaagataaattaggaagagactcaagaatggagattgcactgtttcccagagggccaggaatgtcaacctccaactcttgtaactgagtgaatccaccaaatagctttaagagatcatcgccagaaatttgatccagaggattaccacgaacgttcaattttgacagagatggcaatttactaggagagaacacctctggtagcttgtgaatgcatctatcagaaaggtcaatagtcccaatgctcccaaacaatgtgctttccacagaagaacagggattatctactccaacaatgtctgcgcaaaaacctagtgcccactctccggctttacttgtaaaatgtgaattgtatatttccaatccagagaggccatcgagaacagctttgtcaatacttttgccaagaacaggattctcgttcaaccaaagtgcctttagctttgtgcacttcctgatttcttgcataactttctctggatcccgcagcttgtttccccataggttcagagctactagattcggaaaatttgcagatagatccaaggctactagcatgtcatcatcaattccaagttcttcaagttccagccaagctgtagaatcacttctctcctgaactctagccctttctttctcgactacttgcgatacatgctccaagctcccactctcgtcatcatcctgctcatcttcttcaatcttgcggtccaaatcgacacacatcaatgctgccatcctttcagccaatcctggtacttcccgcaactgcttgagcgcatcagggaggcggaaggaccacgcatggtcgacgaggaagacatcggactcttttcctagagactgatcggcggtgagcacgaggcgccgctgcctcccgtcctcgcacggctcgacggcaaagacctccccgccgtcgaagacctcgtccgcgagcttgcggtacagcctctggtgcagcgacggcgggatgcccgccgcggccagcaggtacgcgtgtacccgcacgaagtcttcgtaggttcgtatgcggtcgccagatgaggcagaggcaaccgctggtgacatggctatagacccggcaagcggcggcggcggcgggtccaagggcggagtggagtagaatagggcgactagcaggcgagaagcaacattgttttccgctttcgatctccccggaccggccggc

SEQ ID NO: 20575 - DNA, 1111 bp, Zea mays
ctcatttcacccctccagttccaacttttgtgtgtttaaacaaaaaaggtgggatttgaaacgagacaagttcatactctccgaggaacggactcgtacaagaaaaaggaagaagaaaagaatttgaaatcttcctatcttcatctatctctaataaaagctcatgctcctgctacttggctgaactcgccttccctgcatacgcctacatcgatggtcatcgtcttctccccgctcttcccatccttgggcgaagacaccactctgcagcaaattctgcttctatttccccgggctcctggatccggcagatgtagtagtcgtcgccgaagagcgcccggaggccgtcgactggcttccgcgcggcgctgcggggcgtgtaggcgacgctgagcgcgacgagcgcgcgcacccggtcgggccggaacaggcagaggctccaggccacgagcgcgccccagtcgtgcgccgccacgaacacctggctctcgccgagcgcgtcgaggagcgccaccaggtcccccaccacgtgcagcgcggtgtactgcgcggccgggtcgtcgtcgtcgtcgccgccgcccaccgccggcgcgtcggagccgccgtacccgcgcaggtccggcgccacggcgcggtacccggccgcggccagcgcccgcatctggtggcgccaggtgtaccacagctccgggaagccgtgcagcagcagcaccgcgggcgcgcctcctgctgctgttgccgccgcgccgccggcctccgccacgtgcaggcgcacgccggtgctcagctccacggtgcggtgggtgatggtgcttgccgtctggtcgtcgtcggcgctgcctgtagcggcggcggcggcggccatcgtcggctcttgctcgtggttgttagccttgtcgtcgtccacgtcgaagcaggtgcagaggccgcggaggcaggctgggatcatgaacgatggatgggcaacggtgcctgcacttgctcgcgagtggtgggttttccgttgtggcgcacgaagggcgaaggcatctgttttagtgggggcgtgggaggagaacgtgttacgtatgggtggaggggagtcgagaatcgcgtgtcggaaacggccggc

SEQ ID NO: 20576 - DNA, 1059 bp, Zea mays
  misc_feature (12)..(12): n is a, c, g, or t
  misc_feature (720)..(720): n is a, c, g, or t
cgttctagaagnctctcgttttttttttttttttggatttgaaacgagacaagttcatactctccaagaggaacggactcgtacaagaaaaaggaagaagaaaagaatttgaaatcttcctatcttcatctatctctaataaaagctcatgctcctgctacttggctgaactcgccttccctgcatacgcctacatcgatggtcatcgtcttctccccgctcttcccatccttgggccaagacaccactctgcagcaatttcgcctcggagacctttcccagagcccggggtcaggcttcttgagcacgatgatgtgatcgagatgcgcgtccgggtcggttatgtcccaccggcacgcgggccgcgtctcgttcggatggcgccaccgctcgtatcgcgtcaccgtcgtctccccgccgcgcaaggcctcgcgtcgcgccgacgataggtagtacaccgccggcttctggcacgggctgcgcgccagcggcctcgtgttgaaggcgtacgctgtgtagtcggcgcggcggtaccagttgaggaacgtgcgcgccggcatctccatctcccgaggcgacattatgcccctcgccaccagcaccgtgaacccccacgccacggacaccgtccagcggttcgcgctgtcgtagcagatggactgctgcatcagccccgccgtgtccagcttcaccggtcccgtcgaacagccgccgcaccgncgaggggcgcgacctcgcgtccgggaacagcggcttcactacgtcgaggtggtgaagcatcacgatcggcgccaccgggtgggacgcgaggaggccgaggaggtcgccgtacacgtcgtactggtggaaccccaggtgcttggtgagcagcacgcccagctccgccatgcacgcctggatccggtcgtcgctaccgtacagcaccgggtaccggcggaggctgccatcctacatccgcacgagcgcctcggccagcggccggctgatggcgaagccgccaccgccgtatgccatcccgtaggaaaagtagatgttctgcaggtggctctcggagaggga

SEQ ID NO: 20577 - DNA, 1023 bp, Zea mays
  misc_feature (141)..(141): n is a, c, g, or t
cgaacttgttgagcacggtgaggagggtgtccgggaagaagacggtgtcgtcgtcgcccatgacgaaccagcgcacgccggggagggccgaggcggaacgtctcggagacgatgcgggagatgcggatggcggagcggtgnccgcggcggtgcgtgtaggggaaggcggacgtgtcggacgagatcctgatggccgggagccccgtgcgcgccgtggacatgttggactcgcgcaccttgcggtccagccacacgtagccccgcatggcgccgcgcgggcgccaccacaccttgatgtactccttacgcttgtcccagaaccgcgacgacgccgcgatgccgaacactacgtgctgcagcgttgtcgacgtggacccagccacggtggaagggggcagctgcttctccgccaccgccgtgaggttggcagacatccgggagaccgagacggcgtcaggcgcgcagttggaggcggccgacgacgccgaggtgaggaggaggtgcagcgtgtagaagaagtagagggcggtgagggggaggagaagcaggaggaggaagcggaggaaggaggcgctgagcgtttccttcccgccccctcccttcatcatccccgtcgccgtggctgctgctcctcacgacctcaccctcgccgtgtcgaacgaacccctcggcgccgccgtccaccgctcagccggccgagccgcgaggcgcccgatttcgccggcggaatcagaatcggtggggtttcacgggggcgagaggctcacacgggctgcacattcccctccgcgtgttactccgcgccgccgcctactgccctctctctcctcagctcgagttctctcctatcggtcggcgatttgggtgggatgggacttgggagagcggtgcggtgggtgggtcggcgagcgcttcggtttcgtgcccgcttttgcccacctttttctccccgtgccgctgcagctgttgcatgcctgcgggctgctgctgccgcgcccccggccgcccccgagggccccattg

SEQ ID NO: 20578 - DNA, 796 bp, Zea mays
tggacatgttggactcgcgcaccttgcggtccagccacacgtagccccgcatggcgccgcgcgggcgccaccacaccttgatgtactccttacgcttgtcccagaaccgcgacgacgccgcgatgccgaacactacgtgctgcagcgttgtcgacgtggacccagccacggtggaagggggcagctgcttctccgccaccgccgtgaggttggcggacatccgggagaccgagacggcgtcaggcgcgcagttggaggcggccgacgacgccgaggtgaggaggaggtgcagcgtgtagaagaagtagagagcggtgagggggaggaggagcaggaggaggaaacggaggaaggaggcggtgagcgtctcctttcccggccccccctccttcatcatccccgtcgccgtggctgctgctcctcacggcctcaccctcaccgtatcgaacgaacccctcggcgctgccgtccaccgcttagccggccgagccgcgaggcgcccgatttcgccggcggaatcagaatcggtggggtttcgcgggggcgagaggctcacacgggctgcgcattcccctccgcgtgttactccgcgccgccgcctgctgctctctctcctcagctcgagttctctcctatcggtcggcgatttgggtgggatgggagagcggtgcggtgggtgggtcggcgagcgcttcggtttcgtgcccgcttttgcccacctttttctccccgtgccgctgcagctgttgcatgcctccgggctccggccgccgcgccgccgcctgctgctaatggc

SEQ ID NO: 20579 - DNA, 2591 bp, Zea mays
  misc_feature (2572)..(2572): n is a, c, g, or t
cgtgggggcagcgggttgactcaccgtcgccatggtgggatgcccggccaaaacttcaagtcttggccttctgtcgctttgcgaactgtagttacacacgcacgtgaggtgcaaagcgccatgcaaaaagagggatttgaaacgagacaagttcatactctccaagaggaacggattcgtacaagaaaaggaagaagaaaagaatttgaaatcttcctatcttcatctatctctaataaaagctaatgctcctgctacttggctgaactcgccttccctgcatacgcctacatcgatggtcatcgtcttctccccgctcttcccatccttgggcgaagacaccactctgcagcaatttcgcctcggagactgcaaatcatgttacatcaaatcagtgacacgattatttagacatgaaacatcggggttgcctttgcctagtactatccaggtccagctttttataaacagcatcagattttataaaagttacatcttggcattgcaaactctgttttttttcttataagcttgcctcttacggagtgagtacctggctgcgcacacagtactctaatccaagcaacatattggtctacgatacagttttgttgattccgtgctttaaaagagtttggttatatgtacagcaatgctagcctgtttgtgcatcggccagttgtctgtcctctctaaacgtaaacggcaatgcatcatgcgttgcagtttatggatgcaagataagaaaaaggaatgatgtggcacgaaagattaccctttcccagagcccggggtcaggcttcttgagcacgatgatgtgatcgagatgcgcgtccgggtcggttatgtcccaccggcacgcgggccgcgtctcattcggatggcgccaccgctcgtatcgcgtcaccgtcgtctccccgccgcgcaaggcctcgcgtcgcgccgacgataggtagtacaccaccggcttctggcacgggctgcgcgccagcggcctcgtgttgaaggcgtacgccgtgtagtcggcgcggcggtaccagttgaggaacgtgcgcgccggcatctccatctcccgaggcgacattatgcccctcaccaccagcaccgtgaacccccacgccacggacaccgtccagcggttcgcgctgtcgtagcagatggactgctgcatcagccccgccgtgtccagcttcaccggcccgtcgaacagccgccgcaccgccgaggggcgcgacctcgcgtccgggaacagcggcttcactacgtcgaggtggtgaagcgtcacgatcggcgccaccgggtgggacgcgaggaggccgaggaggtcgccgtacacgtcgtactggtggaaccccgggtgcttggtgagcggcacgcccagctccgccatgcacgcctggatccggtcgtcgctgccgtacagcgccgggtaccggcggaggcagccatcctgcatccgcgcgagcgcctcggccagcggccggctgatggcgaagccgccgccgccgtacgccatcccgtaggaaaagtagatgttctgcaggtggctctcggagagggagccgatgtagtagggctggcggtggtcgaacttgttgagcacggtgaggaggttgtccgggaagaagacggtgtcgtcgtcgcccatgacgaaccagcgcacgccggggaggccgaggcggaacgtctcggagacgatgcgggagatgcggatggcggagcggtggccgcggcggtgcgtgtaggggaaggcggacgtgtcggacgagatcctgatggccgggagccccgtgcgcgccgtggacatgttggactcgcgcaccttgcggtccagccacacgtagccccgcatggcgccgcgcgggcgccaccacaccttgatgtactccttacgcttgtcccagaaccgcgacgacgccgcgatgccgaacactacgtgctgcagcgttgtcgacgtggacccagccacggtggaagggggcagctgcttctccgccaccgccgtgaggttggcagacatccgggagaccgagacggcgtcaggcgcgcagttggaggcggccgacgacgccgaggtgaggaggaggtgcagcgtgtagaagaagtagagggcggtgagggggtggagaagcaggaggaggaagcggaggagcgtctcccttcccgcccccccctcccttcacatcatccccgtcgccgtggctgctgctcctcacggcctcaccctcaccgtatcgaacgaacccctcggcgccgccgtccaccgcttagccggccgagccgcgaggcgcccgatttcgccggcggaatcagaatcggtggggtttcgcgggggcgagaggctcacacgggctgcgcattcccctccgcgtgttactccgcgccgccgcctgctgctctctctctcctcagctcgagttctctcctatcggtcggcgatttgggtgggatgggagagcggtgcggtgggtgggtcggcgagcgcttcggtttcgtgcccgcttttgcccacctttttctccccgtgccgctgcagctgttgcatgcctgcgggctgctgctgccgcccccncccgggaaggccctcgagg

SEQ ID NO: 20580 - DNA, 662 bp, Zea mays
gctgccggattgcttctgaatagattccttccaaggctctgtgcagctattcagccatttctcccttcgatgtcggtgtttgtcactgccctgtgtgttggctcaccattggcaataaatatcaaggctgttttgtcgccatttggattaaccatagtgctgctcctttttgcattccacacctcatcttttgtagctggttatcatcttgctggtacttggtttagcaagtcagacgacgtaaaggcactacaaaggacaatatctttcgagacaggaatgcaaagcagccttcttgctcttgctttagcaaataagttcttcccagatccactagtgggtgtgcctccagccatatcggttgtgttgatgtccttaatgggatttgctcttgtcatggtatggtccaagaaaagagaagcctaattttctgaatcaattaagcgctgttgttttctgctcttatttatgtagagtaggcagaattttcatggttcaaatttgaaactcttgtatcgttccttctctccatctgagtgagcttgcaagggctctctctctctctcgctaaattattttccagatttacattttttttttgaatcgtgctggcatgccgccccaagagctgatggagttcaattccaaaaaaaaaaaaaaaa

SEQ ID NO: 20581 - DNA, 851 bp, Zea mays
ccgggtttcaaactatgcaactttcttgacggatcccatatggctcctctcagcattgttatgacatcattgtcaacagctactgcaggccggcccgccccggcattatcttactttcttattggccagaaattacctgtagatgtcaaagggatgatgtccagcatcgttcaaatagttgttgctccaattgctgccggattgcttctgaatagattcctaccaaggctctgtgcagctattcagccatttctcccttcgatgtcggtgtttgtcactgccctgtgtgttggctcaccattggcaataaatatcaaggctgttttgtcgccatttggattaaccatagtgctgctcctttttgcattccacacctcatcttttgtagctggttatcatcttgctggtacttggtttcgcaagtcagacgacgtaaaggcactacaaaggacaatatcttttgagacaggaatgcaaagcagccttcttgctcttgctttagcaaataagttcttcccagatccactagtgggtgtgcctccagccatatcggttgtgttgatgtccttaatgggatttgctcttgtcatggtatggtccaagaaaagagaagcctaatttccttaatcaattatgcgctgcgctgttgttttctgctcttatttatgtagagtaggtagaatttttcatgcttcaaatttgaaactcttgtagcgttccttctctccatctgagtgagcttgcaagtgctttctttctctctcactcactcactaaattattttccagatttacattttttttgggatcgtgctggcatgccgccccaagagccgatggagttcaatttc

SEQ ID NO: 20582 - DNA, 1291 bp, Zea mays
ggccgcttttttttttttttttttagacccgttcaatgtgtatatcatagacatgttgaaatagaaatcctgcagagaacaattgtggaaaaggtatatagcatttctctggatcaacatctagcccttacattccctatccaactgaatttggacgcatcataccatgaacacaaccataatacgaaaggtacattttagaaaagataagatgcttctgcagattacaaagtgacagtttgcttggtcttgctcttgcgagaaaacgaagtgttgcataaaccaccactcctttctttcaatacagcagcatttggggagtatgagttcagtacacactatatgctgacagaaagttgtctgtcgagggcatttggccctgtcactgcagctcataggatgaaaaggtgaatccagaatttttctcattggtacacttcaattcgagcttctgaaacggactgctatttggatcataataaaatccactaatggagccatcactacaagaaaagcagacgtagtagaaaccagcgatggttaacccacagtcaactccaacattgacaaaatactgttctttccatctcatatatatgtaaggatagttgctaaagtccagagacttgccaccgtctgtctcaatctgactcagaagaggcataaatgatgggaacttggaccaatgtcttatatcatcctctggcgatgcctcccacttgccagtgaaaaaggtgtaatttttagcatccactatctccccctcccagaatgtcactacaggtgtatctgctaatggaacattaagcgcttccatcgttccacatagataaccctgttcaagatcacaaccatggatgcggacattcactttccatgcttcatccttctgcagacttgaaacattctgagttccagcaaaagatcttccagcacttaagagtgaacatctaggaggagatgggtgtccagtatttgcttcttgccctggggagggctgcgaggaaggcgtggcggtatcgaccaccctgaccggcatccccgacagccgcggcgggtgacgtcggcggcgacgaggaagaggctgccttccgagaaaactgttgccggtcgctggctcgctgcctctcgtgtctcgtctgtaaggacgatcttttcccggccggcctcgagcgacccctatggctgcctagggattgaaccttggatctattgagtagaatgcctagccttccactctctagccaacatgactcatatgaattcccggccggcctcgagggtcccaatg

SEQ ID NO: 20583 - DNA, 1652 bp, Zea mays
ggccgcttttttttttttttttttgtatcagaaacatgtactctcgacccatttaatcaggaaccacgcacaatgtgtatatccccgattgcagataacaattgtggaataggaacgtaatacaaaaggtagattttagaaaggacaagatgcttctgcagattacaaagtgacagtttgcttagtcttgctagaaaacaaactgttacgtaaacgaccactcattcctttcattagggagtacgagttcagtacacacactatatgctaacagaaagttgtctgtcgagggcatctgtcctgtcactgcagctcgtaggatgaaaaggtgaacccggattttttctcattggtacacttcagctcgagcttctgaaatggactgctatttggatcataataaaatccattaatggagccatcgctacaagaaaagcagacgtagtagaaaccagcgatggttaacccacagtcgactccaacgttgacaaaatattgctctttccatctcataaatatataaggatagttgctaaagtccagagacttgccaccatctgtctcaatctgacccagaagaggcgtaaatgatgggaacttggaccaatgtcttatatcatcatctggtgatgcctcccactttccagtgaaaaaagtgtaatttttagcatccactatctccccctcccagaaagtcacaacaggtgtatctgctaatggaacattaagcgcttccatcgttccacataaataaccctgttcaagatcacaaccatggatgcgtacattcactttccatgcttcatccttctgcaggcttgaaacattttgagtcccagcaaaagatcttccagcacttaagagtgaacagctaggaggagatgggtgtccagtatttgcttcttgcccgtgttcatctctattttgattgtaaaccttgtgtccaaaaactgaacctcgatgcttctttcgctgcttatgcttcctcttccgatattcacccatcatgagaagcatgaggtggtcaagttcatcatctaattcttcatcttcgagatggatcatagatctcctagttgcatacatgtttttgttgcaaatctgcagcaggttctaaatgaactattcacctcgtccacgcacccaacctccagcgagcagactccgccaccactcgtctcgtagccgtccagccgtattgtgcaggggtcaagggcctaccgtgcagggatgatgcggtaatgctgatgcccctaccagcagccgtcgagctgtaccttgcagccgtgatgtgcagccgtcgcgcttaactgtgcagcccttgaggaaggatgatgtgggcctcatgcggccgattgcgaacgaatgcgtagctgacgagaaggatatgctagaaaaaagcgcgttgcctggcagagaagatggaagctgggtatcctgattttaaggcctggttgttggagatcctaaataaatcaaataaggtcctaacacaaattttaaggctcaagtttagaactcgttcttggagttgcttttaggccgatccagatcagaaaaaatagcttccaacagcaatccaacgaaatcacatcacgcctaggcaacaaaaaacgataatccgataagatctagacctgatcgtatttttt

SEQ ID NO: 20584 - DNA, 1259 bp, Zea mays
atatcatagacatgttgaaatagaggccccctttttttttttttttttgtggaaaaggtatatagcatttctctggatcaacatctagccctcacattccctatccaactgaatttggacgcaccataccatgaacacaaccataatacgaaaggtacattttagaaaagataagatgcttctgcagattacaaagtgacagtttgcttggtcttgctcttgcgagaaaacgaagtgttgcataaaccaccactcgtttctttcaatacagcagcattaggcgagtatgagttcagtacacactatatgcatctggccctgtcactgcagctcataggatgaaaaggtgaatccagaacttttctcgttggtacacttcaattcgagcttctgaaatggactgctatttggatcataataaaatccactgatggagccatcgctacaagaaaagcagacgtagtagaaaccagcgatggttaacccacagtcaactccaacattgacaaaatactgttctttccatctcataaatatgtaaggatagttgctaaagtccagagacttgccaccgtctgtctcaatctgactcagaagaggcataaatgatgggaacttggaccaatgtcttatatcatcctctggtgatgcctcccacttgccagtgaaaaaggtgtaatttttagcatccactatctccccctcccagaatgtcactacaggtgtatctgctaatggaacattaagcgcttccatcgttccacatagataaccctgttcaagatcgcaaccatggatgcggacattcactttccatgcttcatccttctgcagacttgaaacattctgagttccagcaaaagatcttccagcacttaagagtgaacatctaggaggagatgggtgtccagtatttgcttcttgccctggggagggctgcgaggaaggcgtggcggtatcgaccaccctgaccggcatccccgacagccgcggcgggtgacgtcggcggcgacgaggaagaggctgccttccgagaaaactgttgccggtcgctggctcgctgcctctcgtgtctcgtctgtaaggacgatgccttccggacccggaacgcttgtccccccttacgcgcattatgacgtccactctcccacttggggagatggtaagtcagcgcacccgccatgtcaatgcaggccactgacctaggccactgggcttcttgatccctagtcgaccccgtccaggtaagtcccggccgg

SEQ ID NO: 20585 - DNA, 1061 bp, Zea mays
ggccgctttttttttttttttttaggaaccacgcacaatgtgtttatccccgattgcggataacaattgtggattaggaacgtattacaaaaggtagattttagaaaggacaagatgcttctgcagattacaaagtgacagttagcttattcttgctagaaaacaaactgttacgtaaacgaccactcattgctttcattatggagttcgagttcattacacacactatatgctaacagaaagttgtctgtcgagggcatctgtcctgtcactgcagctcgtaggatgaaaaggtgaacccggattttttctcattggtacacttcagctcgagcttctgaaatggactgctatttggatcataataaaatccattaatggagccatcgctacaagaaaagcagacgtagctagaaaccagcgatggttaacccacagtcgactccaacgttgacaaaatattgctctttccatctcataaatatataaggatagttgctaaagtccagagacttgccaccatctgtctcaatctgacccagaagaggcgtaaatgatgggaacttggaccaatgtcttatatcatcatctggtgatgcctcccactttccagtgaaaaaagtgtaatttttagcatccactatctccccctcccagaaagtcacaacaggtgtatctgctaatggaacattaagcgcttccatcgttccacataaataaccctgttcaagatcacaaccatggatgcgtacattcactttccatgcttcatccttctgcaggcttgaaacattttgagtcccagcaaaagatcttccagcacttaagagtgaacagctaggaggagatgggtgtccagtatttgcttcttgccctggggagggctgagaggaaggcgtggcggtatctaccaccctgaccggcatccctgatagccgcggagggtgacgtcgccggcgacgaggaagaggctgccttcttcttcgagaaaacggtttcccctcgctgcctctagttgctaggacgtggacatttttttattaagaccgttctagtacagt

SEQ ID NO: 20586 - DNA, 3048 bp, Zea mays
cggggctgtatgtaggggggaaacggaggaagagcgagggggggggggggtaggggaatccaaggattatgagaatctataaacgggggagcgggagcgagttcagagggttgggagggggccggtgtaatgagagcggaggaggaggggggggggaatcgacgtcaagagggcggggcaaggtgagaggaataaagaggggagaggagacgggggtgtggaagggagggggtggggcgggatgacaaatttcaaggcggggggaggagaagggaacaaggataagtggcgaagcagggagatggggcctttcgggaggggggagaagaggggggggggtccgaggggggtggcgggggggtttagaaaataagggggggccccgggggcaaaggggaaagagaagggaggactccggaagttgggggagcccccccccccccgcgatcctggtaggccaaagaaggcatgccatatccataaatccgtagacgcaactacctctagtatgatggttggttctttcacatgaccacaatacataccatgatgagctgtaggacaatttttccacttccagtgcatacaatcaatactgccgagcatgccaggaaatccacgtcattcaccaattttaagcaatctagttgtatcatcttcatttggagatctaaggtattcttcgccaaacacctagcaaattgctctcacaaatttccgtaggctctcaatagcagtgctttcaccaatccgcaaatactcatcaacataatcagctggaacaccataagctaactgtctataagctgcagtgaccttctgtacacaggaaaatccaagaagaccagcaccatttcttttctgaacaaaatagttatcatgttgttcaacggctttagctatccgtttgaaaagagatgaactcatacgaaaaaggcgccgaaaaatcttctcaggatatgttgggttctcacaaaagtagtcatggtacaatttcataccgtgttcatctctacttcgattgtaaaccttgtgtccaaaaactgaacctcgatgtctttttcgctgcttttgcttcctcttccgatatgcacccatcaagaaaagcatgaagtggtcaagttcattgtatgattgttcatcttcgcgatggatcatagatatcgtagttgcagacatctttctgcagtggacatatggcagaatataaaagtatttcagttacccatttactaaatagaagctgtttgattagaagcaacataatcaaagaatctttggcactttattatctcttctgtggggaacaaatgcacaggagactgcaggacctgacttttgcagaaacaatgcaaacgaaatacaggatggagggagacagagggccactgaccagaatatggatgcgcggaggtggtccaaggcgaggagatctgtggtgccctgtgccggggaggttgatggcgccgtacaacggggatgtatcgtgtgtgcaggtgtctggaataagatgaaacctaggcgcgtgacacgagcgggaaacagagtaacgcgtgagcgggaacagcgaaaatcagagttagttgctaaacactgggtttagggtctgtttgttggaaagcaacaaattattcagatcctaaacatatcaaattcgtctttaaaacagaatttaaggcctcagtttaggattccttcttggagttgctctaaggtggggccagtcacgttggcacgagctggtaggtcacaacaacctcgccggcggagggattcgcaccggagaaacaaataaagaaaaaaccgcaacactgcgagattgcccagcagccgcttcgtcgccgtttggcacaacatcgccgctccgccgtgtctgccttcccgtagaacgcacaatgccggtgtgcagtgcgctatgcgcgtgccaccacggctaaaagggacccagttccatgggcatacaaaagcatggactcattctcctctctctatattttcttggaaggactgcccctcattaaaaaaatcggcggatcctgtttggttcacaaaatgtaacgtaaaggtaatgataatggtttacagtcgattactgtcggtaacaagtttgaatagtccggtatcaatttttagtacgatatatgattacggttagactaaaacaaatatgatttaacattatcacttacccattacgttataaatatatgaatcaaacggtaccctagattgctgtggcgatcgagtagttaggatcatgccagtttggagagccatggagtattgtagggtagtgaccaagtgatggagaaacctacatttatcgttatctttcagagttactatcacttaaatagagcctaggttttgaagtttaagatcattttgtagtttgttttacatgctatttcaattggagcaatcaatcctttcgatgctctcaaataccgcctacgcaaggtgaggccagccttcaagctcaagattatctgctgtgaggatcttgttctggatgagggtctaggtgaagagtttgcatttattttgtgcatgcaccctccaaatagagtttgttttgtatcgtcgttaggttcccaaaagctaattgggagctgtattgtccatccgctgtacgtcttaaaaacaataatatatatcttccacctctgcataggcgctgtattcaaacccataggaagatgttggttcagatgttggtaacgtaatgggtaaccgataacgttaaatgatgtttgtttaagtctaaccgtaatcaaatactacattagaaattgataccggcctattcaaacttgttaccgccgttactcgagggggggcccggtaccccatttccccccaaaaatgaggcgaattaaaaattcccgggccggccgtttttacaaagtccgggacttgggaaaaaccctgggggttaacccaatttaattgccctttggaaaaaatttccccccttttccccagattgggggaaaataacgaaaaaagccccccccacgatattgccccttttcccaaacaagttgg

SEQ ID NO: 20587 - DNA, 3106 bp, Zea mays
cgacctgcaggcttgaaacattttgagtcccagcaaaagactgaaagatagatacaagcaaatttagtcaatggcaacccttctggcttcaatcataaagatgacacaatgctcattagtagtagcctgagctaatatacaagaatacagctacattttgcacaatttactgtgaaaaccataacctatgccccagaacataaaatggaaactggaagataagcggaactacagttacttgacagcacacatccaacaacgatcctgcctttcctacccaacacacgcacacaaacacggaaaacaaaaaagagaagcagaaaagcaaaatgatgataagcaataatcgtgaaatccgtagaatatagaatagaaatgggagctaggagcagcagtagttggcaattggcattagtagagatgaagacaaaatggtgaactcctatttgctttataaaaggaaattgtggaagatagcagttaataacatagctgtaacaaaatcagtgatatgcacacatgtaccatactgaaaggaaattgtggaagataccagttaataatacaactgtaaccaaaccagtgatatgtacacatgaaccttaccggaccacaacagtgacgttcttagtcaaaatttcaattgaaagaacaaaagcacttactcttccagcacttaagagtgaacagctaggaggagatgggtgtccagtatttgcttcttgccctgcaacgaatattgtaatgagtatgacatgtcgaactattgaacttagaaaagcatcaccgaagcagttgtacaaaaactaattagattcccataaggaaaaaccactatatgttttcggattaactagaacttccatcaacatggcaacaattggttttctgacaaccagcaagcaatacagaatgagcagaaatgttgtcacactcaagtcacaatctcatatgagtaacggaccatgatttcggacgccgagcactgtcattacacatggatgatcaagcacatgcaaatattagcaacactacttatcaaggagaagcttccaactgaaattggaaccaaaacgcaaaaaaaaaattccaaggctcaaaagcatcaagactcactgctgactacccccagctgacgcttaagttttggacacagtaattcagccgatagagcgggcctgcctgcagccagtcaaactcaaggtaacttagagcaactccaacaaaggtgctaaactgggccttatcttaaattaaagggttgaggactaaaaatagcttccaacaataatcaaatttatataggactccaacataaaggtcctaaatatacaacctcgtacagaggtcctattctagtatctcaactaccaaaccgttctggaaatcctcatctcccttcagtgatagggcttctgcgcccctgatccgcagctgccatacgtcggggccacggcatctctgcccacagacgtgagccgcttgcgcatttcccgtgctccccacctctccgctcatcttggtgactcgccgccgcgcaccgctgcccgcacgtctcgtctctccgtccactgccgtcacccatcggtgaacaaggctgccctccagagtttgcgcgctccctcccggccacgttcgtccctcgttggcgcacagggctgccatctcgtcggcgcgccctgctcccacctgccggcaagcccatctcttccgtcgtcaaactccatcgcatggatcaaagaaagccggaacagccacgaaagggtcgtgaagctcctcgctaaacactgccatagatgcaattcgacaagaatctagaggtatgttgttcaacagctttagctatccgtttgaaaagagaggaactcattagaaaacggcgtcggaacatcttctcaggatatgttgggtgctcagcaaaatagtcaaggtataatttcataccgtgttcatctctattttgattgtaaaccttgtgtccaaaaactgaacctcgatgcttctttcgctgcttatgcttcctcttccgatattcacccatcatgagaagcatgaggtggtcaagttcatcatctaattcttcatcttcgagatggatcatagatctcctagttgcatacatgtttctgcagtgcacatatggcaatataaaatattatttcgaagctatcatatatcgcatcatataacggttacaatgcaaaatacacttgatcaacacactgcttacttcgttgctgtcggcagcaggttctaaatgaactattcacctcgtccacgcgcccaacctccagcgagcagactccgccaccactcgtctcgtagccctccagccgtattgtgcaggggtcaagagcctaccgtgcagggatgatgcggtgatgcccctaccagcagccgtcgagctgtaccttgcagccgtgtgcagccgtcgcgcttaactgtgcagcccttgaggaaggatgatgtgggcctcatgcggccgattgcgaacgaatgcgtagctgacgagaaggatatgctagaaaaaagcgcgttgcctcgtgcagagaagatggaagctgggtaaggatcccagctgggtatcctgattttaaggcctggttgttggagatcctaaataaatcaaaaggtcctaatacaaattttaaggctcaagtttagaactccttcttggagttgcttttaggccaatctagatcagaaaaaatagcttccaacagtaatccaacgaaatcacatcacgcccaggcaacaaaaaaaaaacgataatccgataagatctagacctgatcgtataaagcggacctgatgcgcatagcgtatttattggagatggaggatgcgaggagggtaagggaacctggggagggctgggaggaaggcgtggcggtatctaccaccctgaccggcatccctgatagccgctgagggtgacgtcgccggcgacgaggaagaggctgccttcccttcttcgagaaaactgttgcccctcgtcgctgagatttttgacattataaaacacgacacattcgacttcgtcgaaacgaagatgttgaggagggattcaatgacatggaaatacacatataacatatctggtact

SEQ ID NO: 20588 - DNA, 2457 bp, Zea mays
  misc_feature (1819)..(1819): n is a, c, g, or t
cacacctaccttactggacaacaacaatttagttcttagccaaaatttgaaatgaaagaaagaacacttactcttccagcacttaagagtgaacatctaggaggagatgggtgtccagtatttgcttcttgccctgcaaagaatattgtaatgagtgtgccccgtcgaactactgaacttagaaaagcaacacagagacagttttaaggtaactgcaaagcaaaaagaaaacaaggaacatttatgttaataaattatataaaaactagttagaatcccacaaggaaaagccactgtatgttttcagattaactagaacttccaccagcatggcatcaaatggttttctgacaaccagcaagcaatacatcatgagtagaaatgttgtcacactcaacgcacaccatctcatatgaataatgaaccatgatttcggatgcctagcacagtcattacacatgaatgatcaaacacatgcaaatattagcgacactgcaagcttacaattgatactggaaccaaatcgcaacaaaaatccaaggctcaaaagcatcagacccactactgattacccccaactgatgcttaagttccagacgtagtaatttagccaatacaaaggatcaaaccaactaaattctttccctaaataaataggtttagggttatcttaatttaaattttgactgaatttctagaaaaaatctgtcaagatttatgacatcaaattaataccgttagatatacatagaatatactttgataatatgttccatgtatgtcatagacgctgttactttttttataaagttagtagttcgacttgtacagattctaggaattgatttatttggaaccaaactaaagccacacactcaagatgacttagaccaatctagatcagaaaaacagcttccaactgaaattcaacgaaatcgcatcacgccgaggcaacaaagagttgtaatccgataagatctagacctgattgtacaaagcggacctgatgcgcgcatagcgtatttattggagacagcggatgcgaggtgggtaggggaacctagggagggctgcgaggaaggcgtggcggtatcgaccaccctgaccgacatcctcgacagccgcggcgggtgacgtcggcggcgacgaggaagaggttgccttccgagaaaactgttgtcggtcgctggctcgctgcctctcgtgtctcgtctataaggacgattgctttctgaacgcgtcgcggcccttgtgcggtaaaaaaactaaaagttattacaaatagaaatttaaactatagttatcggcttcaaacatacatctaccatctagtcaacataatgcgtatgtttttatgatttatattttatgtttaaatataaataaaaaccgtagaaatgtatgaatttataatttatttatcacttttgtttatgtgacgtgtcacacaagcacgcagcttggatcatctttaggcacacatggccagtttatgatatttccttctaacttgacgacgagaactaaatcttatcaagctcgtgtcagctatctcccttatcctttatcgcaagagttggtgtgatgagtcttatgactctccacaacaaaataatgtaaaatggtggatttataatatagattaaattgtttatatagtaaagtttaaaatataagttaaagataagagatggtataaagaagctgccggagacaatctaagatcaccatttgatatatgcagacaacgtttttgaacctaaattataatcatattagatttggaccgtggtattctatgactacaaagtccacatangagacttgattgtgctgaaattaaactcaatttgcacgagttatttctttattcggactggactagaaattgaaaatttatcaaaactcttgacgatatcctccagtgtgttcttacgatgaggaaaagtttacttgcatgaaaatagtctacaacgcatatttattttgtttgtatttttttctttaattgcaaataaataagatataaaatctacaatacagatttgtattcttgtttttagtattgaacttataaagattcataaaagctaaatcttaaatttatcatatatcttttaaatgctagatataaaatttgaatacattttcgggtattttcacctatttttattgtagagagcaaataatacataaaacaatttataaaaaatattcttatttataataatgtgctttatatcataagaaaaaatcggcatccaattttatacctatctattttaaaatattaaatatatcggttatccactttcagccctttcatacttgaacacgtcctaaaatttactctttaaataatcatttaaataattatttgagtaaacttaatttttaaatctttataccttctagaaacttttctatattttaaacgcactctagagagccatcctc

SEQ ID NO: 20589 - DNA, 1437 bp, Zea mays
tttttttttttttttttgacaccaactgtagcatggcatcactatggtggagcatgcatgttaataagtgttctatcgtgcacattacagagggcgattcagagagggcgtctgaggtgttcctggaagcatcaccaagacataatccaccggtcccgagccccgcttgcaatgtcaagaagctgaaggcaaatgcgttgaacatgccccaagtttatcttgctcatatagaactgtcacaggtgaaaacatacaatagctgcaggaaggtctccacagcttttgcaccaggaacttgagtgagagaaagcaatcagcgaccttgatgaagtttcaccttcagtaaagcttggcaccatgatttgtatcataaacatgtattcacgacccatttaatcaggaaccacgcacaatgtgtatatcataaatagaaatccccaattgcagataacaattgtggaatagaaacgtaatacaaaaggtagattttagaaaggacaggatgcttctgcagattacaaagtgacagtttgcttcgtcttgctagaaaacaaactgttacgtaaacgaccactcattcctttcattagggagtacgagttcagtacacacactatatgctaacagaaagttgtctgtcgaggacatctgtgtcctgtcactgcagctcgtaggatgaaaaggtgaacccggattttttctcattggtacacttcagctcgagcttctgaaatggactgctatttggatcataataaaatccactgatggagccatcgctacaagaaaagcagacgtagtagaaaccagcgatggttaacccacagtcgactccaacattgacaaaatattgctctttccatctcataaatatataaggatagttgctaaagtccagagacttgccaccatctgtctcaatctgacccagaagaggtgtaaatgatgggaacttggaccaatgtcttatatcatcctctggtgatgcctcccactttccagtgaaaaatgtgtaatttttagcatccactatctccccctcccagaaagtcacaacaggtgtatctgctaatggaacattaagcgcttccatcgttccacatagataaccctgttcaagatcacaaccatggatgcgtacattcactttccatgcttcatccttctgcaggcttgaaacattttgagtcccagcaaaagatcttccagcacttaagagtgaacagctaggaggagatgggtgtccagtatttgcttcttgccctggggagggctgggaggaaggcgtggcggtatctaccaccctgaccggcatccctgatagccgctgagggtgacgtcgccggcgacgaggaagaggctgccttcccttcttcgagaaaactgttgcccctcgctgccgctcggcctcgcgttataaaacacgaccccggccgg

SEQ ID NO: 20590 - DNA, 2495 bp, Zea mays
tttttttttttttttcctttctttttttttttttttttcgtgttttttttttttttttttttttggataagtagaaaattactgaaaaacaatcgatgtggttcaacttaggaattacattgttgttacaagtgatgtgacataggaagtcccagagcaacaatcctctcgagtagcgtgcagtacaaatgtacaatacataccaggccacttctacatgtgggccaccaggtcctttctaaaataaactggtatcctagtcctaatgtaaacagacaatgctactatgttcaactgggaaatgcaacaatcactgtcctcagatcaagaggaggcaagtgggattggtctcacggcaccctgtatgcggcggaacgcagtcttgatccgttccttcagtgtagcattctcacattccacatagccactcctcccgtccaagtgtgccacatttccatccacagatatgacaagtctcccttcctccacaactttaacatcaccgaaaagtgaagccataagagcatacaccaccttttgagccgtctcctctttggtcttcactgctccttccaccggaacaactttgggaccttcacgaccgacgttcaagatcatagccaccacagaatcagacaccatatcgctgatggggtcggacagccactgcagcgtgacatagctttctgagtccaggcgaaccgtcactcttccgtgcacgatcagcgctggaacatcggattcttccgccgctggctccacgctctcgtatatctgctccagtctgtaccttatgacttcaaaggaaccacagtaaggtaccgcgatgcgctgcatgatgttagctgtagataactgcgtgaacacacggagatcttcaggagccatgatctggtatgtgaatcccttcttcacgagtaggccaccggaagactctccagcttctggtaccttttctgccagcctgccgatagtcttggccattttctcacaggtgaaatacatctccactgactggcagttcttgggagacacgattttcgtatttgtgccatcgaactgagtaataagtttctgcttaagcctcgacatttcattcgcttctccatgcacgagaataatatttggaggccgaagttcgtccagaaagttgcttgtctgagggaaatcagcatgagctgaaaacgagatatagtggaccgacatatgaagaggagcagtgaggccattagctagcgccacttctcttggctcgttgataatggtcttcgcaagggtcccctccacaacgtaacctggaataacacatgcattcctcttatctgtgcaccacttatcaaaaagctgcctggagagaccactctggaggccacttggactagccatcaccactgatggacccacatcgtggaagttatcgatgctattcaaggactcgatgtgcttgaaatggaacgggttggattgcgcaaactggttccttatcctttcattcatggagtttatgtatgtctggtagacagccatgcacctcttggcaagaggggacgcataatagataggaatcttatggagctctgggtgtttggaccaatactcatcgaggataagtaacagttcttgtgctctgcccagagcaaatgccgggataagaacacggcccccctgtgaaacggtattgtgaatgacctcagtaaagcgcttctcacgtacaatccggggctgatgttgctgtacgccgtaagtggactcgataatgcaaatgtctggggagaactgtgggagctcagcagctcgtaggtgacggtcttcttcacgggagtagtcaccagtgtaaagaatgcgcacgccagcaatatccaccatgaacatagcggcaccaagtacatggccagcagtgtagcaccagaagcgtatcccattaacttccaacgtctggtggaaatctataacctcgattttctccatggatcgagcaatatcactctcatcaaacagcatatcctccacggacaccttgctgactttgacataatccgagagcagcagcttgtaaatagcctttgtggcgtgagtcataaacacacggcccttaaacgtagtcttctccaggaagtacggcagcgatgcggcgtggtccaagtgaaagtgggtgatgaggaggacgtctatggcggacggatcgatctcgtcgaagtagggcagcgccgccatgccggtgtacgccgggtggatgccgcagtcgaagaggacagtacgccccttgaaggtcatgtggacgcacgaacggccgacttcgctgccggcgcccagcggcgtgatgaccatctggtctccctcccgtccgctggaggccgggcgcttcccagccggtggcgcgccgctcggcgccgcggcggaggccgccatggaattccctcttcctgaatcggcgaaggggtttgggttttatccgtggtttttcgattaggatgttctaggtaatggtctcgtgc

SEQ ID NO: 20591 - DNA, 1699 bp, Zea mays
tttttttttttttttttcgcgtgctgatataagtacttatattactaatttatgggtacaaactagagacaaggaaattaggaactggacatcgattggatgtgtacaaaacttacgcactaaactaaactaaggatgataatgatgatagaagcggtgacctagtgccagagctctctcacatgtgacatgtgtggagtttatgaaagagataaaccgcgtcttcctccgtaaattccgtaaatacagagatgctgctttgaacgcgtggtagtactgcaccagacctacgacagctgctttgtccgttggtggatggatcaatcctcctcgttctccttgtccaagctccggcctttcaggttcagggacatgctgttcagtctcttcgaggtgactgaaatctccgagcccgcgttgctctgggtgtcgatcgaagacagtgtcaccctcgacatgtccccggaccgtggtcgctggaacgacctgtgatggctgctgccgctgcatccactcagcctcgccttggcagacttggtcaagctcatgtagttcgggcctccggtgtcgccactgtctgatcttgcttctgacgctaagacagtgttggtggtagcagacgtcagggtcaccgatggtctcgaccgagagctctcgccgccgcacgcggagtcggaagaagcagctgacagcactgaagatggaggaggacgctttgctgcagataccctagttgtgacattgtttcttctgatcttaactgagctggcatcggaaagcttggaggcgggcaagttcagctcctcgtgcttcgcgagctgcgagtcgctatggtttcgctccgtagatctggtctcccatggcttcgttgccatccatccgtctaagtaactgaagtcctgatcgcacccattaggatcatggcttctaacgcagttagcaggagagcttggtctccccttctgtcttgaaccccgaggctggtgagacacagcataggcaattgccctttctctctttgctgcaccttcatgcttcatgtgtaaatttgatcttacttcagcaacagatccgtggcggtcacaccattgttccatagcgtctttggtagaactggcacagccgttgagcgcgtcctggccctgtgagccgtggccatcagcggaggagcgcgcccggcgctcccgggcgcgttcctgcacccgcagcagtgcgtgcatgcacttgagcgtgacggccagttgcttgcgcacgcgccggccgcgcaccagcgcctgcagccggacgatgcccctcagcgccttcaacgcccgtctcgccaagaatccgcggaaggcggtctggatgcggacggcggcccattcctgcctgatgagcaggaaatccctgggcggcgcgcggaccacggcggcgaggaccgagttgaacgagtcggccgacgccgaagaagactcggacgccagcgcactgccctctccggcgctggccctggacgtggccgacgagctccgccagagacgccatttgcgaccgcccttgtgccccgccgccttctcgggcgccttcagggcccccagccgcctgatccacttccccgacgcccccatcggcgccgcgcaatgcgaaacgcaactgcttactccctctgttcgaccgaagcttccgcttggttgtgtggggacactcggcactgggatgt

SEQ ID NO: 20592 - DNA, 656 bp, Zea mays
acagaacttggaacagcaaacattgtgatttcgggtctgttcgtctagaaaacagaaaattaagtagaaatttactgaaaacgatggagggggttcaagttaggatgacaatgttacaggggattttacagaggcaatcccagatcaacaatcaaatcctcttgagtagcatgccgtacaaggcatcgggggttcctttcgatagagagggaaaaaaaacccggtactctggggtaaacagagaatgctactttgttcaaaggggaaaggtcaaacaagttatcaagaggctgaaagggggattggtctcacggcgccctgtatgcgacggaacgcggtcttgatccgttccttcagcgtagcattttcacattcgacatcgccactcctcccatccaagggcgccacattcccatctacagatatgacaaatttcccttcctctgcgactttaacgtcaccgaaaagcgatgtcataagagcatacaccacctttagggcagccttctccgtctcctctttggtcttcaccgcttcttcgaccggaacaactttggggccctcccgaccaatgttcaagaccatagccaccacagaatcagaaagttatgttacactgcagtggtcgtccgatcccatcagcgacatggtgtctg

SEQ ID NO: 20593 - DNA, 3821 bp, Zea mays
ttcaggcttctggtaatggtgacccccagcaacaacaccacgtcaccataagatactgtcaacatccaccacgactcctaaatggaacgcaagatagctgccctttgcgtgctgatataagtacttacattactaatttatgggtacaaactagagacaatgaaattaggaactggacatcgattggatgtgtacaaaactcacgcactaaactaaactaaggatgataatgatgatagaagcggtgacctactagtgccagagctctctcacatgtgtggagtttatgaaagagataaacctcgtcttcctccgtaaattccgtaaatacagagatgctgctttgaacgcgtggtagtactaccaccagacctacgacagctgctttgtccgttggtggatcaatcctcctcgttctccttgtccaagctccggcctttcaggttcagggacatgctgttcagtctcttcgaggtgactgaaatctccgagcccgcgttgctctgggtgtcgatcgaagacagtgtcaccctcgacatgtccccggaccgtggtcgctggaacgacctgtgatgactgctgccgctgcatccactcagcctcgccttggcagacttggtcaagctcatgtagttcgggcctccggtgtcgccactgtctgatcttgcttctgacgctaagacagtgttggtggtagcagacgtcagcgtcaccgatggtctcgaccgagggctcttgtcgccgtacgcggagtcggaagaagcagctgacagcactgaagatggaggaggacgctttgctgcagataccctagttgtgacattgtttcttctgatcttaactgagctggcatcggaaagcttggaggcgggcaagttcggctcctcgcagtgcttcgcgagctgcgagtcgctatggtttcgctccgtagatctggtctcccatggcttcgttgccatccatccgtctaagtaactgaagtcctgattgcacccattaggatcatggcttctaacgcagttagcaggagagcttggtgtccccttctgtcttgaaccccgaggctgaaacgaatacaccatcgatcgatcgacatgttatgaacatgaaactgtcgatgtagtataacctagtgttaacaacagatgacaaatatgtgctaacaacatgtacctggtgagacacagcataggcaattgccctttctctctttgctgcaccttcatgcttcatgtgtaaatttgatcttacttcagcaacagatccgtggcggtcacaccattgttcctgaaatatcaagcagccaagaaatgatcagcgtacgcaatgtacacagctcatgggctcatccaaccaaagaaaattcatagaaacagcaaactgcagtgtgaactcattcttttttatttaagttcaactgtagtctgaacatgaaagctcggttggcaatacataattgttgaaggcatcattggtgttatcaccatagacttttcttacctaacagcgtcactaccatattgattcaaacgcacattgccaatgtgaaagagcaagaaacaatcttaatggatgcaatcattaccaaaaaaaacataaagggagcttaattgtcagtgtcattcttactgattccagtccctttcaaataaaagtaacccaccacatcaactctcacgtcagtttcccattcagtgtaagaacaaacatatgcaaagtgccaaatagtcaaaatatcaacagtagcacagtgggaattcaaatttcaaattttcaccactttctgacttcctaatgatctcagaactccattgttctaaaattcaaaggttgcgggggcattagcattaaaaaatgaagttagagggaagctttaatgtaactacctatctttattctgaacaaattcgtactaaattctcagtggatggcaaccaaggaactgaaccacattgtccatgtggcaacattagttatacttaggaaacagagacctcatgacactccaacaacactgtcaaccgaattccatcgtcagaaatttggttgctccctcaaattttccagaatggcagttgagatttagctgtctactcggtaatgaagaagctcctaggcaacttagcagctaatcaacaaatggctgggtgatgcaagtgtatcattgcgtactctgacagcagaaaaaaacacgtgatgtcttgcgtgttcagagttccatataccatagcgtctttggtagaactggcacagccgttgagcgcgtcctggccctgtgagccgtggccatcagcggaggagcgcgcccggcgctcccgggcgcgttcctgcacccgcagcagtgcgtgcatgcacttgagcgtgacggccagttgcttgcgcacgcgccggccgcgcaccagcgcctgcaagccggacgatgcccctcagcgccttcaacgcccgtctcgcctgctcacgcgccgcccccgccggccgcgcaccagcgcctgcagccggacgatgcccctcagcgccttcaacgcccgtctcgccaagaatccgcggaaggcggtctggatgcggacggcggcccattcctgcctgatgagcaggaaatccctgggcggcgcgcggaccacggcggcgaggaccgagttgaacgagtcggccgacgccgaagaagactcggacgccagcgcactgccctcgccggcgctggccctggacgtggccgacgagctccgccagagacgccatttgcgaccgcccttgtgccccgccgccttctcgggcgccttcagggccaccagcgacttgatccacttccccgacgcccccatcggcgccgcgcaatgcgaaacgcaactgcttactccctctgttcgaccgaagcttccgcttggttgtgtggggacactcggcactgggatgtggggggaggagaagccgaggcgagacgggacgcgacaaaatagttggagacgcaacaagtggagtagtgggggtggtcgaggaggtagccgttgtccttttcggccacgacggtggggaggagcaaacgaaccgttcgtcgttcgtgtagcggggattcaaatttcgaacggcggcgagcagcaaccggcaaaaggtggcggccggaccgcgggatccgcggcgctcgaacggacgtgtggttcgaggagctctgggcccatatgtcattcgaccagatgaacggtacgagaggggtttttttctacagcaacggttggagaacggagagtcgtggccttggcggcttggcccttgtgggcgaggagaacggcgagtcggcgaccttggcgactcacggcctcacgggctcgatggctggctttccgcgcgttgggcttcgagaaaggagggggctttctagggacatgggcccaaaatgcctgactgccgtgtgggtccacaataaaatgggcccgtgcgtgacggagttgagtgattgatgagtggtccaagcctgccatagcctgccatggttctggtgagttctcgtgtgccggtgccgacgccgggactgacacgacccgacggcgatcgcgcggaaagtcgtgaccgtagttgacaccacgcactggaactcaacggaaagggttgctacaaatttcttaatcaggtctaaagcacatgtcttctgtcttcggacacggttttcaaaccttagtcgaatcccagttgtgaccagattttttaagttcatgacttccggacacgttagacgtaacaccataagatctaaaaatatttaaaaagttatcgagattatacgaaggtcacttaaaaatgtttcttctaacactcctaatgcaaag

SEQ ID NO: 20594 - DNA, 7892 bp, Zea mays
  misc_feature (592)..(592): n is a, c, g, or t
  misc_feature (1179)..(1179): n is a, c, g, or t
tgcgtctatattaatgaaattttgttgtcatcaaaaaattatatataattatgataatattaattatatatattatgtaatatttataatatgttatatagattgggggctatactatgaatttgtgatcaatttatttcatattttatctataatgcagtctataataggtcgtgcatatggtaatgcaaaatattattttatattataaactgcaatatttataaagacgagagataaaatgataagatatggagacaacccaagtgcaattcttggcattatgtgaacacgtttggactttaaaatattattttgtaattataactagtttatttattgtaaaaaatcatttatataaattattgtaatgtatcgtaggatcttatgtatcgaaatactgtgctttaaaaacacttcttgtagcgtattttaacattccagggtggtgatggttcctcgtttgattaaatttatggcaaagtgtcaacacctcgatggcagtgattccttacaatcacgtgcacgtcctcactttgctgcctgatgccgccggccatagcatgccggaaacaacatatggtgtattacntaatactactagcggcggtacagagtaaatatataaatataaaggatttttgaacgattcaaatctctatagagaaaaattccaacgtgagcctttggaacgtaagattcaatctcatgaatttctttaaaattctttggaaactttatttttcgaattactatttttctaagtggttcctattttcttatgggaaaatagctaatttcttttggaaaaataggaatcacttgaaaaaatagagtttccaaattagtcttttataaattgctttccttcgtacaagttttgaagaaaaataacgagcgatccaatctctattcaaattcctgcattgtattcaaaagataggtgatttttttttgcattctcaattcctataagattataattcatatcgagctctaatcatgtatttttttttcttctattcatgtgtttttatattcctgtgttcaaagggggccttagttttctcagccagcgtaaatgatcaggcggatggcggaagaagaaaaaaaagttatggctcttgtacttgtcgaccgtgagcagcatgctgaaagcgttcgtaaagatctggaagntgtgtatgtacacatggaaatggaaccgacggcttgcggcaacaaccacgtttaaaaaaatgaataactagtaacaatagagcactctccaaatacataattaattatagtgtacacgatgtttacaaaaatggcccatctccatctccgtatgaatgaatacgaatatacgtatgcgtggattgttgttattcattgccgtggtcacgaaagaatgaagcgatataatatgagcagaggctcggcctagctactctccttcctagcggtgcagtggaagcatctcctgatccgatattccgatccgatccgatccgtggagctagcgtggggagggaggggggacgccagccaagcggatcagacgagctccaggcgcgcggcgtagtcggcgtacctggcgcggcaggatgttggcgcggcgcttccgccagacgaaggcgccgaggccgaggacggcggcggcggccacggcgccgagcgccacgccggccttgccgccgccgttcatctcttccccgcgggggcgcgcggccgcgtccgcgtccaccacgccctggtcgttggcggtggcgctggcgctggcggccttgatctgctcggcggcgggcgccggcgagggggacttgctgtacgctcggccgtcggctgccggtgccggcgagggggagttggtgtgcgcttggtcgtcttcgtcgcccctgtgcggcggcggctggtgccggtgccggcgaggggggcttggtgtacgcttggtcgtcgtcggcggcggcgggcgcgtctgaggagggggctgcgacgggcgcggccttgcgcggtgagggcgcgtctgcggcggcggaggcggaggcggtaggtgggtgtgagattggcgagtgcgcgggctgcgagtcggcggcgggtagaggcgcggatgcggggggctcggctgtctcctcctcggaccgcgccgtggcggcgaagaggacgaggaggaggaggaggactgtaagggcgcggggcaatgtcggcggcgccatagatggagaagaaggtagcaggcagatctcggcgaggctgctggtggtgcgcgtatggtatgtatgggtttggtgggctggtggggcgtttatttatttgcatttgtatttatatatacgagcggatggattggagacttggagatgggaaaggtgtagtcggtcagaggagaggacgccgtctcaccaagcaaatcattgcgtctccgcgccggggacggtgagacgccgctctctccgccgcgggacccgggaactacacagcccctcctccctccttgtttgttgccgactggagaaattatccgacctcctcatctggcaatgggccacagtggaaaatgctgtccaattgggcccaacaggcccataccaacaattgctggtccatcacaactagtatgtcagacggcagtggtgaccgatgtgccaggctgaagaaagcaaggacagcgttgttgccattgatgatcctgttcttcgtcctgatcggattctactgactgggacatactgtcagccggactcgctgtcgccgttgtgtccagctgggcgtttctcggtaggatcaagaccatgatttacgtatttggtttggtttggcgacgcatggagtacccagttaggcaagtgacggacggttggtacggtggttggatttggatccggtgctctccttcgattatctgctgcgtgcaggtggatcatctgtttttgtttgttgggcttgctgcttgtggtggcctctcacctttcggtcgcctcgaatgcatgccttggagtgagtggcaaccaaatgaaagccagatcatgaatgcatgatgtgcctggagagtctggactctggacggacgcttcttctctctgtcgttggcgtcttcccctccgatgcgccatgcgtgtacgtccacgcatgctgcagttctagcttcttaagctaattaagacatgcttggcagacaagcgtccgagctgctactgctagctagctagcacatctatctatctatatatttcgcatcggtcgaccaaggacgaagaacgaagaaaccaagcagctaccaccatcagtccagcaacaatggcggcggcggaaccggtaccagtaccagtaccggcggcagctgccgggaccaacaataagatcaagacggtggtggtgctggtgcaggagaaccgctccttcgaccacatgctggggtggatgaagtcgctgaacccggacatcgacggcgtgacgggggccgagaccaaccacgtggacgcctccgacccggcctcccacgccgtccgcttcagcgacggcgccgagtacgtggacccggacccgggccactccatgcaggccatctacgagcaggtctacgggacgcccttcgtcgacgccgccacgacgcccgccaccccgccgggcgtcgccccctccatgtccggcttcgcgcagcaggccgagaaggagaggcccggcatgtccgccaccgtcatgagcggcttccgccccgacgccgtgcccgtgtaccgggacctggtgcgggagttcgccgtgtgcgaccgctggttcgcgtccaacccggcgtccacgcagcccaaccggctgttcgtgcactccgccacctcccacggcctcgtcagcaacgacagcagggcgctggtggctggcctcccgcagcggaccatcttcgacgcgctccacgacgagggcctctccttcggcgtctactaccagtacccgccgtccacgctcttctaccggagcctccgccagctcaagtacgccgccagcttccacgccttcgacctccacttcgcgcgccactgccgggagggcaggctgcccagctacgtcgtcgtggagcagcgctacttcgacctccgcttcctcccggggaatgacgaccatccgtcccacgacgtggccgagggccagcgcttcgtcaaggaggtgtacgaggcgctgcgctcgggcccgcagtggccccagacgctcctcgtcgtcacctacgacgagcacggcggcttctacgaccacgtgcccacgcccgcgggggccggcgtcgtgcccagccccgacggcatcgtcagcgccaagcccttctccttcgccttcgaccgcctcggcgtccgcgtcccggcgctgctcgtgtcgccctggatcgagcccgggaccgtgctgcacgggccaccgtcggggccctgcccgacgtccgagttcgagcactcctccatcccggcaaccgtcaagaagctcttcaacctcaggagcttcctcaccaggcgcgacgcctgggccggcaccttcgactgcgtcctcacgcgcgacataccgcgcaccgactgcccacgtacgtcactagtacttactcatcagtagctagcgtgtaggataggaacagacagacatggaactgttgatgctgtgcatgcagtcaccctgcccgagccagtgaagctgcggcggacggcggcggcggagcatgccccgctgtccgagttccaggaggagctggtgcagctcgccgcggtgctcaacggcgaccacaccaaggagtcgtacccgcaagggctcgtcgagggcatgacggtggcggaggcggccaggtactgcgtcgacgccttcaaggccttcttggacgagtgcgagaaatgcaaggaccgcggcggcgaggacggctcccacatccccacggtgaagccgacgacgacggggaaggagaaggacaagagcaagagcagcttcgcttccaagtcgctgtcctgccttccctgctgtgtccgtccctcttcctcgtgacctccctctccttctacacgcgatgcgcccacgactccaggcatcacaagttcccattcagaatcggtcgggtagtgaattttacagtgtgatacctcacttgtgtagattgattcattcctagtcatatgcatttgcattccgcattatattgattaaatattctaacgcataatagaaaggtggagtagatacagagaatcggtccgttcgcttgtcttgtttaatggaagtttaatggattgtttagtgaccatttatcctgtttaatagacactttagcacaaataacggccaaacataggtgaccgactccacttatggcacgtgaacgtggtagaatgccccagtcttccagcaccaattttgcttcacgagaatgcatggaacatggcaaaacagaacttggaacagcaaacattgtgaattcgggttttttttttttttttttagaaaattaagtagaaatttactgaaaacgatggaggtggttcaagttaggatgacaatgttacaggtgattttacagaggcaatcccagatcaacaatcaaatcctcttgagtagcatgccgtacaaggcatctggggttcctttcgatagagagggaaaaaaaacccggtactctggtgtaaacagagaatgctactttgttcaaatgggaaatgtcaaacaagttatcaagaggctgaaagtgggattggtctcacggcgccctgtatgcgacggaacgcggtcttgatccgttccttcagcgtagcattttcacattcgacatcgccactcctcccatccaagtgcgccacattcccatctacagatatgacaaatttcccttcctctgcgactttaacgtcaccgaaaagcgatgtcataagagcatacaccacctttagagcagccttctccgtctcctctttggtcttcaccgcttcttcgaccggaacaactttggggccctcccgaccaatgttcaagaccatagccaccacagaatcagacaccatgtcgctgatgggatcggacgaccactgcagtgtaacataactttctgaatccaggcgaaccgtcactctttcatgcacgattaacgtcggaacatcagattcctctgttgctgactccacgctctcgtatatttgtttcagtctgtaccttatgacttcaaaagatccagagtaagggaccgcgatacgctgaatgatgttagctgtagataactgcgtgaacacacggagatcttcaggagccataatctgatatgtgaatcccttcttgacaagtaggccactggaagactctccaccttctggtacttgttctgccaacctgccaatagtcttggccatcttctcacaagtgaagtacatctccactgattggcagttcttgggagacacaatttttgtatttgtaccatcaaactgagtaataagtttttgtttaagcctggacatttcatttgcttctccatgcacgagaataatatttggtggccgaagttcctccaaaaagttgcttgtctgcgggaaatcggcatgagctgaaaaagagatgtagtggaccgacatatgaagaggagcagtgagcccattagccagtgtcacttctcttggctcgttgataatggtctttgcaagggtcccctccacccccgtgccaggaataacacaagcattcttcttatctgtgcaccacttatcgaaaagctgcctagagagaccactctggagaccacctggactagccatcaccactgaaggacccacatcatgaaagttatcaatgctattcaaggactcgatatgcttgaaatggaaggggttggattgtgcaaactggtttcgtatcctttcattcatggagtttatgtatgtctggtatacagccatgcacctcttggcaagaggggaagcgtaatagataggaatcttatggagctctgggtgttttgaccaatactcatcgaggataagtaacagttcttgtgctctgccaagtgcaaatgccgggataagaacacgacccccctgtgaaacagtattgtggatgacctcagtaaagcgcttctcacgtataatccggggctgatgttgctgtacaccataagtcgactcaataatgcaaatgtctggggagaactgtgggagctcagcagctcgtaggtggcggtcttcttcacgggagtaatcaccagtgtaaagaatgcgcacgccagcaatatcaaccatgaacatggcggcaccaagcacatggccagcagtgtagcaccagaagcgtatcccattaacttccaatgtctggtggaaatcaataacctcgattttatccatggagcgagcaatgtcactctcatcatacaacatatcctccacggacactttgctgactttgacataatccgagagcagcagcttgtaaatagcctttgtggcgtgggtcataaacacccggcccttgaacgtggtcttctccaagaagtacggaagcgaggcggcatggtccaagtgaaagtgggtgatgaggaggacgtctatggcggacgggtcgatctcgtcgaagtagggcagcgccgccatgccggagtacgcggggtggatgccgcagtcgaagaggacggtgcggcccttgaatgtcatgtggacgcaggaacggcccacctcgctgccggcgcccagcggcgtgacgaccatctgatctccctcccgtccgctggaggcagggcgcttcgcagccggtggcgcgccgctcggcgccgcggcggaggacgccatggttttcccgcccttcctgaacagcgagcggggttagggtttcgttcttggcccggcggccgcccggctcgtagtcgtaacctctctggcccgaccggatcaggaatccaggcccggccggcctcgagg

SEQ ID NO: 20595 - DNA, 2516 bp, Zea mays
gccggccgattaccgaaaaaggagacgcttcttcgcaaacctccccctctcccatcgacttcctccgtcgtccgtcgcactgccacggatcaccctcttccttcgtcttcctccacaaaacctacagcgctggtgcgccgaggagctagctagctagcccggccggccggccggcgccatgcctcccgtgaaggccgaggacctggttgtgcacgccgtcaaggagcagttcgccggcctcgactactgcatcaccagccccccgccatggatcacgacggtgctcgttggcttccagcactacctggtcatgctcggcaccaccgtcctcatcgccaccatcatcgtcccgctcatgggcggcggccatgccgagaaggcgatcgtgatccagaccatcctgttcctctccgggatcaacacgctgctgcaggtccacttcggcacgcggctccccgccgtgatgagcggctcctacacctacatctacccggccgtggccatcatcctgagcccgcgatacgcgctcctcatcgaccctctcgagagattcgtgttcacgatgaggtcgctccagggcgcgctcatcatcgccggcgtcttccaggccgtcgtcggcttcttcggcatatggagagtctttattaggttcctgagccccctcgcggcggtccccttcgtcacgctcacgggcctgggactcttcttcttcgcgttccccggggtcaccaagtgcatcgaagtgggtctccccgcccttgtcctcctggtgatcttcgcagagtacgcctcccacgtgttcgctaaggggagcttcgtgttcagccggtgcgccgtgctggtgaccgtcgtgatcatctggatctacgccgagatcctgacggcggccggcgcctacaacgagaggggccctgtgacgcagttcagctgccgcgccgaccgctccgggatcatccagggctcaccttgggtgaggtttccttatccgttccagtggggataccccattttctgcttccaggattgcttcgccatgctggcggcttcttttgcgtcgcttattgagtctaccggcaccttaatcgcagtgtcaagatactcaggcgcgacgttctgcccaccctccgtcttctcacgtggaattggctgggagggtatatctatcatactggacgggatgtgcggtacactgacaggaacagcggcttcagttgagaatgcaggtctactggcagtgacgcgagttggaagccggcgagtcattaagatctcagccttgttcatgattttcttctccttgtttgccaaatttggggcggttcttgcatccattccattgcctattttcgctgcactgtactgcgtcctcttcgcttattcagctggtgcaggcttcagcttactccagtactgcaacctcaactccttgaggacaaagttcatactcagcatctcgttgttcctggggctgtccatcccacagtacttccgggtctacgagatgttcttcggcttcggaccagttcacacccattcagtagcgttcaacgtgatggtcaatgtcatcttctcatcgccggcgacggtggccgccatactggcctaccttctggactgcacccacctgtactgggaggctagtgtgaagaaggacaggggctggttctggtgggagaagttcaagtcctacaagtatgatggcaggagcgaggagttctaccgtcttccttatggcttgagcaggtacttcccctcgctctaggacgccgggaggaagacgacggacccaagttctatgtagctgctcgagcgtagaagctgaacatcagttgaaggcaacagaaccatatgttattttcatatatcaagcagttgggagggagcttgatgttttgatttaccttgtaaaacattttggatgataaacttttgcaattactgggagagtaggatcaaccaggggagaattctgcaacaattcagtcaccgtttttgcttcagattcgaaacagaacacagatgccttcacaggcttcgattattttcccacatcatccatgcactagtcaagcgtgagtccgctaaagcaaaagcatagtcaagttactacccgagtggagtggcaatccgattatttgtcctcgccgctggaggatggtccagccaccgctgccttgggcacccacacaagcccgtgcggctgtgcagccccaatgccgcggcggcgccagggttgagccgacctcctcgcaatccgtgggttcggcccggtcacggcctggacctccaccaccggttgccggcgctgcccttcgactaggccctcgggcttcgcctccatggtcttgcggagcatgccaccgctcttcgatttgctcctgccatcggcgggcgaggtggaaggggtcagagccggggccggggccggggacggggccgcacccttcccatcaggagaatcgctgcctgtcccggcgtctgcgagcctgggcgctgcaggtttcggtttccccgcg

SEQ ID NO: 20596 - DNA, 1935 bp, Zea mays
attatttttaccaataaattaattagttttaataaatttatctcctcccactttataactagtattgtaattaaataaatttaatatttataattatcatttaaatatagaaaccaaacaccaccttatttaccttcggctggtaaactgacgagaggaaactttagtgcgtgattgcaagcaccggaaaaggggacctctgtatatgatactcacccgtttgaatctacggagcttaaaaaaagtttttttcctgatcaaaccttttgacaaattaaaacagtcattgtactatgctgcaatttttatcgtgcagaattgatgccattcaaacacacgataaaaaaaatggttatagttttataccacatagaccaagcacatacagtaatgtcgggtcaaatccttgtcctattataatattataacaaattttgccccgttgctctcgtattgacgttgcggggctctacgtcaagctatcacgtcgcggcagtacccagttttggttgtctcactgtctgttcgtttagacaagatctcagttttgattggcttgatcacaaacgatacaaaaaaaaccaatcggcgtgaagtcgtacacgtactccaccttaaccatttcatcagttcaaaaggttctgagggtatcacaagaatgtcaaaatgaccctgaaggaaccgggagaaggatggcgaatgctgcagcccaggaattatcccagatggcaacagtccacagtttttttccttctgaaactcagttcgaaagtatgatagcgacagagatgaatccacttaacatgcccctatgcctacgaaacagcattgcccaaggaaaatgatgcgtagcaaaatttgtgaaactgccgcagtttctcgtggatcttctcacttcattttacgttcaccagctccacatcgaagatgagagttgagttctgtggtatctgccccactcttttgctcccataccccatggaaggtggaatggtgagtctccttttgtccccaacccgcataccattgacgccaacgtcccagccactgataacctgcccaacacctagtctaaactcaaaaggtcttccactgacgttggagtcgaaaatagtgccattctttagcttgccaatatatctaacagaaaccttcttcccacggctggcctttttaccatcaggtttgcccatctctaactcctgaatcatcataccattggcaaacgtccgtgtttggagtggttccttgctatctgactcaccaagtccagttcctgcctgactttcacttctgcttatatcatgtgccttctttttcttgttctttttattggcctcctgcgcacttgcctcctcattgtctttatcaatattgttgttcttagcagattgctcactggtatcaccctcagaagcacttttgttcttgtttttctttttcttctgttttgtactgacaggatcagctggagaatcgtgtagcttaacctccttttcttcgttgtttacttttcctgtgtccataacagtgcttttgtccttgccctttttctttttctttgatgccccatcaatctcagcttttaccccccctgaagaatcaccacggtcgctaatggctccactttttcttttcaggtctttgttgctagtctccttgtcttttcccacattcttgtttgaaataatctcagaactcttctttgattcagaaaatgatacagggaaaccatcttcatcttcactttccaaggattcagtaggtgaatttcttacagcaagttgaagttgagactcatcaccattttcagggcattgcttcttcttcgttgccctctgcacttcagcaatagcagccttgtcatcctcctcttccctcgcctccgcggtcgcggggcttttgcctctaccctggttgtatgccatctcttca

SEQ ID NO: 20597 - DNA, 1196 bp, Zea mays
  misc_feature (448)..(448): n is a, c, g, or t
ataccgacaggatcagctggagaatcgtgtagcttaacctccttttcttcgttgtttacttttcctgtgtccataacagtgcttttgtccttgccctttttctttttctttgatgccccatcaatctcagctttcccccctgaagaatcaccacggtcgctaatggctccactttttcttttcaggtctttgttgctagtctccttgtcttttcccccattcttgtttgaaacaatctcagaactcttctttgattcagaaaatgatacaggaaaaccatcttcatcttcactttccaaggattcagtaggtggatttcttgcagcaagctggagttgagactcatcacccctttctccggatttgcttcttcaatcccttctgcacttcagcaacagcagccttgtcatcatcctctttcaatttcctcaataacaactgaactttntgcccctaccctgattgtatgccatctcttcatcatcagactctgaatcatcatcttcactgtctgaatatcccataaccatgttaccatcatcgtcctcctccaagaaaccatcctcatctgaactttgaagagaatcgctcccagaatcaccgtcactcctatcttccccacacgcatcagtcatatagtatccagcgaggtggatgctccttggcccaatcactgagaaggtgacttcctcctcaaattctagctccaggtggcatgtctccgactgctccggcatgaggacgcaaagaaaaacgggatctctgttctcggcactgcactgtagcacacacctcttcacgccggtagccttctcccccttgccgacatcaacccctagcgtcgcctgggtgaggcgcaggcggccggcgaagtcgccatgggtgagagtgtagggcttcccgggcttcacttccacaccccagaacgacgacatggttgcggcggctcggctaacgaatgcttcacgcggcgggcgtatcggtgggaaggagctaaaggggaaaggggttgatatgggtgggggtgtggaacagtcgaagctttgaggaggtagatgaagaggcgatcgggcgcggagcggaggagggcggggagcggagcgccgcgcgagaaaccctaaactggggtttagggatgcgccggcggaggcaagtggggaatgggggtgtcccgccggcccccccgggcccaaatg

SEQ ID NO: 20598 - DNA, 1591 bp, Zea mays
gctatctgactcaccaagtccagttcctgcctgactttcacttctgcttatatcatgtgccttctttttcttgttctttttattggcctcctgcgcacttgcctcctcattgtctttatcaatattgttgttcttagcagattgctcactggtatcaccctcagaagcacttttgttcttgtttttctttttcttctgttttgtactgacaggatcagctggagaatcgtgtagcttaacctccttttcttcgttgtttacttttcctgtgtccataacagtgcttttgtccttgccctttttctttttctttgatgccccatcaatctcagcttttaccccccctgaagaatcaccacggtcgctaatggctccactttttcttttcaggtctttgttgctagtctccttgtcttttcccccattcttgtttgaaacaatctcagaactcttctttgattcagaaaatgatacaggaaaaccatcttcatcttcactttccaaggattcagtaggtggatttcttgcagcaagctggagttgagactcatcaccattttcacggctttgcttcttcaatcccttctgcacttcagcaacagcagccttgtcatcctcttcaatttcctcaataacaactgaacttttgcccctaccctgattgtatgccatctcttcatcatcagactctgaatcatcatcttcactgtctgaatatcccataaccatgttaccatcatcgtcctcctccaagaaaccatcctcatctgaactttgaagagaatcgctcccagaatcaccgtcactcctatcttccctacacgcatcagtcatatagtatccagcgaggtggatgctccttggcccaatcactgagaaggtgacttcctcctcaaattctagctccaggtggcatgtctccgactgctccggcatgaggacgcaaagaaaaacgggatctctgttctcggcactgcactgtagcacacacctcttcacgccggtagccttctcccccttgccgacctcaacccctagcgtcgcctgcgttgccatttgccaatccaaagaaaatcacatttcccacaaccacaacactagatataagatacaactgtaagcctcctaaatacgacgtgataaacccgttggccatcaaattgtaagaggagacattgaggagaagcggacctgggtgaggcgcaggcggccggcgaagtcgccatgggtgagagtgtagggcttcccgggcttcacttccacacctgcgaatcacgcaatagtccggtcggaccaacagaatcaagcacaatggaaattggcagcaacatcggtagccccggaaacgattcttaccccagaacgacgacatggttgcggcggctcggctaacgaatgcttcacgcggcgagcgtatcagtgggaaggagctaaaggggaaaggggttgaatggggtggggggttgtggaacagtcgaagcttcgaggaggtagaggaagaggcgacgggcccggggagcggaaggaaggagcggaacgtaacgccgcgcgagaaacctaaactggggtttagggatgcgcggcggaagca

SEQ ID NO: 20599 - DNA, 7581 bp, Zea mays
  misc_feature (7042)..(7042): n is a, c, g, or t
  misc_feature (7575)..(7575): n is a, c, g, or t
tgtaaactgctcaattaactgcaacttctcctcttcatacaacaacacacaatctgaacggacagtctgtcgaccgactaatcgaaaagatggttgatagtaaattatcatttctttccaggatggatcttcacactttcgaaatgaaatctctgcgctaaggaagtacttggctattagaccatgaaagactactgggtcgaaaacatgatcatcgccaggctttgttttttgggtcgctaagaacatttgtctctcttcttgtggaattgcatggcaatacacaaaaatgtgcctattcagatgagttgtacctttacccacagcagaagataagtggaccttacaatatttgcagactgccttctctttcccatctactacctctgtatcaacgtaatcccaaactttagcccttctttttgttaatctgcttgattgatcagttgaggcagcctcatccatttctagagctgatgaaaccctctccatcgcctaggatgcaagatcatcaattaaaaatcgttacacaagtaataatcgaggtacgcgtctagggaataaatagaccattataaaataagaaactgcaactagcatcgaagaacaactagaaagaaattgtggcctccccatggctccgctttcctagacgaccacacgctcttccacgaccagcagtccacaagctccttgtcccccccccgcccagcaagagcccctgccgcctcgcctcccgtcggttcattctcaggctccttcttccccgccactgccatctgcctctcaggctccttcttccctgccaccgcccagcaagagccccattcgcgagcagcggcgcgaaccctgctgctggaccgagctccggaccgtacggaggatttgcgaccacgctcttcggtgttgtaccgcggtacgacggtggcttcgatgtggcgggagaggagagagtaccggggcatggccacggtctcctctcgtctttcttgcacgccggggataggtgctagtaactggctaacttagcgctacggtagacgagaataaagaaaaacattacggtcgagctcctccgcggcagatctgggccgccgtctgcttactacgccgccgagaagctagcagtagagatctaacaaagaacgcacgggttgctgcggcgccgcctacagatgttgcgcctacagattgctgcggtaggtgagaagctagcagtagacgaagaagcacgggttgtagaggatccacctccctgctccatgggctccctttggtttgatccaaacgtacgtttgggccatgtttggttacaaatccatgctcatccttttattagaatggctcaatctaactttgccctaattagtggaaaatccaaaaataatccaaattgtttagcctatgggtttaaaggccctttgtgcctacgagtttgtatggcccattcccaggcctacggcttgccgtgtctagacctcgctcgaggttattggttcggcatgacactgcccacttactaatttaggcttagttggcacgatcttaatccgtgctgggctcgagccggatctgtccggcccgtccattttggacatccggtccaaagtcctaaccgcatctggcgcctgttgcctcggctgctctaggaccttccgaattccgatacatcggcccgcccctccgacgcgcgtaggagatgccaacggtaacagccaagctttgggacgaacagctgccgacggtgtcgtctgatcatgtccaacaccaccgccgccagcgccggcctgcaagtccgtcgcgtccggatctacggatccgtatcagttgccaagccagaacaaggaaacggcatgaggagtactcgtgcgaaagtaagcttatagtgctggctcatgtttagccgtcttatgaggagtactcgttcgtgtcatcgtgtgccttccgcgcagattggaaataaacaaataaatgcatcgagagacgtcacaagcagagcaaggcggcgggagctagcagagcagcagttgcaactagcaagcgcacgagcgagatgggcatcgagagtcttgatcgcgtccagcaagtcagggagtccaagagagacgacgacgacgacgacaaaggatgtcgatcggaggagatagagggctgcagaggttggagatcggccaccgcgtgtcgtagaacacctgggaggtggcggagccgcacctctcgcctctcgccgtcggagaaccttgacatggtagtcactagtcagatatcaatgattaacgtggtagtcggaatatgttgttaaactgcaggtttttctactcaggatatttatgatatacttttgttcagttcgataccatcgtttttaaaataaaatgatattttttaagataacgggaattgaaagtttctggcctttgtctcaaagagattacagccgaattattacaaactaaggtagaaacataactatctgaaaacctagagaaaagcaaaacatagtgcgacgaaacgaaactaaaggcaaagtctaaatgcagatctccatccatgatatctaaaaatctgcattgtcaactcctccaatctaagacatgtcttgtttattagttcttgatcattatgtctaagttgtagttgagtccagaagcggagccaatgcgtagccctaaaaaccacctctgcaaaagaagtttttattagagcattatcaaacacctgcatcattcctgctcaaccagattacccaacatatagccgaagctgttagaataaaatgtcttcttattctattgtctagaccagttaaccaagaaccaaagatatgtctaatattgtttagtggacgtacaccacatctgattcgaacaaaatgccaaataaatttagcaagttggcagtgaaaaaaaagatgatcaattgtctcattttgagtaaaaaagaacattttacattttccttccaattacacttgagtggaaattatctttgaaataaaacgatatatgcgcattaagttttaacaaactgaattcaatgttatgctgcttggaaataataaacatccttcaaatttatgaggtttttgcaagtatcaatttttcaatacaacccacacgttttcatactaaattgattttaaaagtttttttatgtttgtaatttgtaaggctggactaaattgtcctaaacaacatgatttcatgaccagagtaaattttcatgttcgatgtaaatctagcccccacttttcctctcttttttaatgggatagtagcaagggatgcccctactgtgcatgattcagaccattgagaaacaaaaagtaaataccgcgcgccccactgatccttctgaaatggattgattcttctgccatgcaacagtctacagtacagaaacgcctttcgccccaccttctgccatggaacagtctatattacagaagcttccctttttttatatattattatccaccatacatttgatatttttcgccccactcattcttctgaatctgaaatggattgctgccatagaacagtctctagtacataaacttccttttttatgctatcgaccaattcgccccactcatccttctgaaatagagacgtgccggggtaagagctcccaaacaatacaaaagcatttctgctgttgttaatgcagattaaacttcgttgtaggaactaggaaggccactgtaactagtattgctatatatgagaccctttgggctgtcgaatgcaacacgggtcaatcacgggcacggcaaaggatttccttagcgcggtctgacaccatctccaggagcagcgtgaggcctcacccgtgcagcatgacgtaggaggtgtttaatactttagagctaatagttagtagctaaaattagctaaaaacatttaaacatcttaacttatagttcaactattagttatttttagtaaattagttaatagttagctaactaattttactattaattttttagccaactaactattagctctaggtcaaacactccttaaaacttgcaaaaaggacgatacaatcagtgcacactgtacatctacagcgtacggttccagtcaatccatcgtctcagttgtcaacacaattctactctagaaatatctgaatcttagaaacgagaatcaataagctgaccaagtgtcattggtttagtgaacttgacgaacatgtgaaaatcaggccacaaacagtacaactcatagcctaaaaggcaaatagaaaagattaaatttgcactgctggtgctcaaactgcctttttcaaacaagcacaagatgtggaacgcaagagaaatcagtctccatttgttctcttgcttggaagcatgatgggcttgcttggtttactaccaaaatttaccacacaagaacagctaaagcaaatagctgaaaagaaaaaggcatgttacatttctgatgggcagtagcttgctgatttacattgactccatctagcacataaggaacgtttgggctgcccattttgtcttcttttttttaagcaggaatccctaacagcattagtattcccagtacctcaagagttagcatttcaatactcctagaaaacaatgtaaaaaagaaaatacaactgacagaacaatatgaccaacaaacactgtataaagaaaatgcaaagaagagggagcggaacttgagttcaagcatacaagaataccctataaaaaaaagcctaaaaggactgctgctaggcatctagcaaactgatggagtttttcttatttaaacattactcatcaaacagatatatgtttggtccaattctgcagtccatatttcaaggattccatcagaggctggtttactttattattccaaaggaagcttgcaatctgcaaatccccttcctatttcagggctaaacattccgagtcttatgcaatatgtgagtccgaaactgaaaatttataacatgttcgataatataaaatcaatatatcttggacctggagcctcggacaataaaacaagcaaatataagaatatactgagaaaaaaagaacatgtacatcacttagtattacacatatattgattgcaaaacaaagggggtcgtattctgaattacattgcgatatggcagttcaacacattcactatagctgtttgatgatatggtgtccctcgtaccaaaagcatacctgtagccaaatctcatcatgagaaatcatcatcttctcctggaatggttggcagaccctagtgacccttcaaatagatcagacaggtgattctccaaatcctctggagtgtattttatgtattttccagaattccttccactatcaactagactgccataccttccagtaaaggcacggtaagctgggatcacattttcagatatagaaatcttgagttcttctcggagttgaggatctggcaccttccaaactgtttggctcctgtatagctcctcaaaggccaagttgaaattcttaattttttctttgatcctagagcttgagttcccgctgctgccgaaactcccgctcccactgctgccatgtccatcatccttcaaataagacaaaactttggtccatgaaaccctaaggtagctctttgaattttgcctaatcttgccacggcgtctccgtatccagtgatcacctaaaatcctcccaagctcggaatccttaaccttttgtacaatgtagagtgtgttattcatggaaaatatgcactgcagtgccccatcctcataaagtttagatttttcatccagattaacctccaagtaagatatcagtttgactaaacggcgtccaaatggggtcaaactcttcagatactcctgatcctcatcggtgccattatgtaaaatattatgatctacagctccagcaccactgtcatccaaaagtatgtcaagtgtgtcacagtaaacgaccaacaatctgagatagttcatcacatagcgtgtcattgggtggatctcaccagccatcatgggtcgccgcgatgactcctgttgtaggaccttcccaaactcaagaagggtacccttgaccgcgtcaccaagcctttcaagaaccccctccagatcatggatgacatcacccccataactcccaaagaacagctcctttagttcagggatcacctcagcaagcgcctcatacatgtcaaggatccgggaaagcttctcgggcgagcgagtgcacacagagacagcatccccaaagttacggatctgcatgatgcagcacttggtggactccacaaagcactcatcccggagctcgtcggacacagcaagcacctggtcacagagccggcgctcaccggtgagcaggcagcgaacaactgtcttgaccccatgcacccacttcttcatcttgtcattgagatgcttccactcgatgcgctgcacctcgtcgatactgagccgttccacaccgagcacggtgaggcactcatcgagcaggtcacgccggatggcacagtatacctgcgcgagctcactgtcataccccgcgtgcagcatccggtcagcgatggcgcgtatctcatcgatggcgtccggacgcacgaggtcgaagacctggtcctcgaaggggttgttccccgcgatgctggcgctgcgggcggtgtccgggccggcgccggcgccgccgtcctggctgtgcggggtggcgggatcgaactcggaggaggtgtcgaggtcgtccatggagccgagggagaggcggcggagcgagcagtagaggccgctggcgtcgagcggcaccgagtggcggagcatgaggtggcggagctcgtcctcgaggcgcgacatggcgagctgcacggcgaccccggcgcgggcggagacggcgggggcggagaggtggtcgacggcgacgtcgacggcggcgaggtagtgcgcggcgtcgtcctcgggggcctcgaacacgagcgcctccggggtggtgtcccagaggtggatgagctgctcggcggcgtcgaaatctgcgagcgaggaggaggaggtggaggaggangggttcctgctcaccggggggctcggctgggtccgcgtcggaggcggcggcgggggacggggacgggaagaggtcggaggtgatggaggagaggcggtggtcgaatccggagaggatgcggatcatgtcgtcggcggcgttcttggacgtggcgagcgacttgacgatgtgctgcgccgccgccaggaccttgtcgtcgccgacgacggaggcgggcacgggcacggggacggggagctcgccgccctcccccatccctcccgcctccgcgcaggggacgacgaaggggacgacatcaccggcgactgcgggcgagctagggtttgggagtgacgccgcgcggcttggcttgggcctgtggcctgggggccggcggctggtggtgagtggaaaggcacggtgaaaaacggattgctgctgctggtggagggaggggcgggcggatcgatgctgaaggagattgttggaagcagaggacggcagtcggcaacaatgttgccggctggcctgcctgctgaaggagatgggagatncccggc

SEQ ID NO: 20600 - DNA, 885 bp, Zea mays
agctagctagcagcgcaacaccaccgatcagctatacaagcaaggtagctacctagtagagtacgtagaggccgggtctccagaagacgaacatgtcgtggagctccgacgagaaccacaggttcgagcaggcgctggcagattacgacgaggatactccaggacgctggcagctcgtggcccaggcggtcggcggcggcaggacggcggacgacgtctggcgccactacctgcacctggagggggacatcgacgacatgggcgccagggagcgggcgaaccgccgccgccaacagtaccgccgcaacgcccagcagcaccaacaccagcacggcgccaacgccaacgccaacgcccacgccagccgcaaccatattagtcggcggagcaacggcggcggcgccagcagcagtaacactaacaacattagtagtcatcgcgctactaacagcaacgacagagccaaacgcccgcaggaatgagacgccggccggcaggagagacgatgaaccacacaacgtacgtactatcctactaccataatatggtggatatcgccacctttccgcgtacgaacgtgtatgctctaattaaggaataatcctagctatagcctatagcccccagctaagggcttgttcggttagctcttaatccatatggattgaatgggattggatgggtttgaacccaaacaagtcaaacttcttctcaattttttccaatctcatccaatccatgtgtattgggaataaccaaacaagctctaatgtgtattgctctaatgtgtattgcatgcatgccgcgtacgacggacgtacgcaagtgtaaaaccttgggcactatttatatgtataaagttatatcgcaaaaaaaaaaaaaaaa

SEQ ID NO: 20601 - DNA, 3869 bp, Zea mays
  misc_feature (2313)..(2313): n is a, c, g, or t
tacatgaatttatcttagttctatcagtactggctaactcatataggcctggctcgacttctacaccaaccaaacatatagtatgtgatcctaggaacttggcaaaatcaccgccttttgctcgaaataacaagtcaaatgggcccggcgatcgtccacctccctgaacctcgcatcgtcaccggtcataccctgccctctccgaagcctgggccgctggaccaaggacgacgacgatgcgtccatgcgcgcacctcgccgcgctcctcctcctcctcgccgagaccgtctcctcgcgccatgcgcatgccccggcgggcgctgcgcaagacgtagccccctcagcgcacctgccgctgccgtgcctggaggagctgctgccgtgcacggcgtacctcaagaccaccaagcacccctctcccacgtgctgcacagccatgcacaacgccgcggcggccgagatgccgtgcatgtgccgcctcttcgccgacccggagctgctcgccaccttcaacgtcaccagggagcagatgttcaagctccccgcccgctgcggcctgcccgtcggctgccgtaccggggcctcccacgagcctggttagtccttctctagcctagccgtagccgaccgccgttgcgtttacccacccccgagcccccatcagatgacacctgacactatgcaatgaatgcatgcagtcgtggaagcgccgccgccgcccgccccggcacagcagcaccatcatggtgcctcgtcgaggggtgtccagttcagtagcatctggagcctggtggcgtcgttcgttttgggccagatgatccccatggctgcaccattttaatttagtctgttctgcatcgttctgttttatcgcctcagttagctataatggacagcgacagaatacatttcagatgtagtagtgataggcactgcatgacagcatgagtgctgcttgttaatactaataatacagtattaactgaacaaaatggatgatgaaacagtagctcattcgcctcactcagctccataataatataaggtatctaatgattatcagactactagtacagaggtggaattgagaaagtaatttcaggtttcacctatcaatatgtttctgaacatgtgacactaaacattctttctgaatctagaagccagttaaaagcgcagatcatatatggagcatcgatcagaaccgatgattgaatctcaaatctctacgtccgactaaggttacaacacaatacaggatgcaaatgggttgctccaggcacaagcagcgtccccaggcgtgggagttccctggcatctaaacacgccctgaagaattgagtcgagttacagctccgattgctaaagttgaaggtttacatggcagatctgtgcagagtacatggaaaaactagttacagcagattaggtctacatatttgcaccgagggcgatagtggttctactcctcttaaccttctgcagttaaatgtcgaatacagaatgcgccagctagttgactgtttcatggcccctcatcgcggacggactagtggctcaacagctgttctgaagagaagaatgtaggccttgtcaacagagaagtacaagaaacctcccagggagtgagtgacataggaaccaaagcttgttccaacaatgcaatgccaagcaggaccatatgccgtatcaaattcctgcaggaagatggaaacaatatcatctaccattaacaatgagaagatcgatcgatcaatcgcagagtcaccaaaaattcaaatcctgggttaaataactaatgcacaaccaaatttctgggaagcaatagcctcaagtaatcagcagattaatggaaatgaatactagaacccagattataactaatagtaagagtcaacactaacagttatatatcatattaaggatgcacagagctacaaatgattttctacggtttccaggaacaccaaatggtcaatataaaagaagagcaatgctgccttcataaacataggagggaggacataatattgcactaagttgtaagcttgaaaacccatgagaaaacagtcatttcagttgtaaacctataacacatctattcatagcgacgaagtccaaacagttatgtaggactaaaataaattattgtacacacagagcataagaatgttctgggaagcaatagcctcaagtaataagttatgatgcacacatggcatttcatgactgtaaatctctaacactgtcaccttcctcatccagatcgcctcggctgtactgatggaaaattgaatttgctaaagggcatncaacgagtcgtaggcaggatgtaaagctagctaatgaattcctcaagcatgtctcttacattagctgtaaggttaaataactataaaaaagcgaagccgtagcacaattctcacacaactacagaagcacctcgaggacttgcatttcatctcaaaagaactgcagagaggacaaactgaatgtcaaactggttctcttttctttttacccagtctggatgtctgatttttaaacccctcccagcaaggtttgatatgagttgtgactagccactgtggggctagggatgtaaatggtacgtatattattcgtctgtattcgaattcgatctgtgtaagagggccaagatcctatccgtgtattcgagtccgggtattcaatatccgatccgtatccatatactcaaagttggatatctaagacgtcgatatccatttaaatcttatccgacacaactcgataatatccgtatccgatctgaatttgaagagaaaatgtgaaaacaaatatggtatgaggctatgactaatatccgtccatatccaatccgagtacatcctcgggactagccagttagccatatttcctacaactaacctcatcattagtaacacctacccgaatcaaacccaaatgcataactgcactacccgcatttctaatgtaactaccgagacgtagggaggacggtggcattccttcttgagcgcgagggcgaggcgcttgctgtcgaggcgcggcatggcggcgatggcttcgtaggcgagccggaccgcgcggcgctgcagcggcaggggcatgtcggcggcgcgcacccgcaccgacaccttccttctgttgtcctccttgggacccccgtcgtccttccccttgatctctttccccttcccgtccccggcctgtttggcctcccgcttctcctcctcatcgaccactggctccgccttggcctccccgcgcttctccaccgcggactccggctccggctccggagtcggttgcgtcaccccgggctcgggctccggctgagaaggagccgggacggcgctaagcttagtgcggcggatgagcgagctgagatagcggctgcggcgctcgagttcctcgaacgccggatccatggcggctgcgggtcgcctcgcttcagctgcgtcagcgggcaagcatgcctgcctagcccgccggctggcttcctgccgttttcgcttctgctgtggggtgcttcggcaagggaggaggagaggagcggaggctggtcgcgtcgtggtcaaactacgcaggacaggaccgcactgtgcggcttgttctgtttggtatcgagaggcgcggatgtggcggtgcggtgggtgccagggcgggccgtggccacttgggtcacgcgccccgccccgccccgccccgccccgccgcacccgggcgggtcccggctttccgtggatgtcgacgtgaccggcgtatgcggtgagccgtgcgatgaaatggacatgctgtctgtgtgttgagtgttgaccgcactgacaccggagagggcacggacacacggtgtgcccctgca

SEQ ID NO: 20602 - DNA, 1140 bp, Zea mays
gcggtattagttagaagcgcagatgaaatatggagcatccatcaggatgcatctactgattccaatgcgaacaaggctacaaggcattacaagatgcgaaagtaaattcccctcgtgcggaagaactgagttgagtcaagctacaactctggaagctaatggtaaggtccacatggccgattagtgcacagtacatggaaaaaactagctacagcagattagttctacatatttgcattggggggtgggggcgatgatcgttctactctccttacccttctacagttaaatgtcgaatacagaatgcgctagctagtagactgtttcatggcccctcatcgcggatgggctaatggctcgacagcggttctgaagaggagaatataggccttgtcgacggagaagtacaagaaaccgcccagagagtgagtgacataggaaccaaagcttgttccaacaatgcaatgccaagctggaccatatgccgtatcaaattccttcttgagcgcgagggcgaggcgcttgctgtcgaggcgcggcatggcgacgatggcttcgtaggcgagccggaccgcgcggcgctgcagcggtaggggcatgtcggccgcgcgcacccgcactgacaccttcctgctgttgtcctccttgggacccccgtcgtccttccccttgatctctttccccttcccgtcccccgccactttggcctcccgcttctcctcctcaacgaccactggatccgccttggcctcctcgcgcttcccaaccgcggtctccggctccggctccggattcggtggcgctacctcgtgctccggctccggctcgaggagggggagccggggtggcgctgagcttagtacggcggatgagcgagttgagatagcggctgcggcgctcgagctcctcggacgccggatccatggcggatgcgcgcttgcgccggggtgcgtctcggacggctgcgggtcgcctcacctgcggcagcgggcaagcatgcctgccaggcccgattggccttcctgccgttttcgcttctgctgtgtgcctgtgtggtgcttcggcaggggaggagtggagcgggctgctcgtgctgccgtggtcaaacactcaaaccacgcaggaccggacgctgggtcg

SEQ ID NO: 20603 - DNA, 1619 bp, Zea mays
tttttttttttttttttaatcattctcagagaaaaatatattgatattacaaactagcccattgttttatgcatggtcgtaaccgcaaccattccgtgctgcttccaaggatagtatccattctcagataataaccgctgctcagcttacataacatatagcacagcaagacatgcatgatattcacagctatagtagcaaaattcggcatgccatcaaatcagacgacgccctgctggtctcgcaagacggcgtagttgatgacgcgggcgacggtgcccatggacggccggaaggtggggtcgtactgcaggcactgcaccgcgattcgcccgagcttgacagctccagcaggaggatactgatcaccaagttgcggatcgatgcattcctgaaccctgtcttccgtcagcatcggagttgcccagttcaccaggcttcgctggcccggcggcagcgtccggtccaatggcttcctacccgtcaggagctccaggagaacgatgccgaagctgtacacgtcgctcttgtccgtcatctggcccgtcatggcgtactcgggcgcctggtagccgaaggaaccgagcgtgtgcgtggagcggttgagcctggccatgtccgcggcctggctgaacatgttgtagtcggcgatcttggccctgaagccgtcgaacagcaggacgttggtggagcgcacgtccttgtgcgtcaccggcggctgcaccatctcgtgcaggtactccagccccctcgccgcgtccagcgcgatgtgcacgcggtgaatccagctcagcaccggcctggcggcgctgcccagctgctccggcggcggcagcctcagcacatccctgtccccgtgaagcacgtcgtggagggtgcccatggtggcgaactcgtagaccagcacgcggaggtcgccgctgatggtgtacccgagcaggcggacgaagttgtcgtgcttgagcctggacgccaccccgagctgcttgaggaagacgtcgttggacgcgtgcttggagggcttctccagccgcttgacgacggccagcctgccgctccgcgtcgtggcctggtagaccttggcgtaggacccttgcccgatcagcttctcgcctgagaaggacgccgtgatctcgttcagctcgcgcaggcgcacctccggcacctccaccgtgatcacctcctccggggcgggggcggggccgcctgaccctctccgtttctcgctcccaggatccgccgggaaagcgtacgagttcttggactgcttcctcccgatcctcgggaagcagccgacgttcccggcgtcgccgaacacgctcttggcgttctcccaccaccccatcgccggcgcacgcggtagcagctgccgctcctatgtaaatagtagtaactcttatcggtggttgcagaggttaagcttctcctagtcctagctagcgttctgatgagcaagacgcaacgaccggtgcctgtcggcttatgtaatccgctgatggtttcgctttttgattaggatgttctaggtaatggtctcgtgcgacggcaacgctgcaggagggagaggagcagcaggaggccagcagcgcagaggtggacaaagttccgagcccggaagg

SEQ ID NO: 20604 - DNA, 1029 bp, Zea mays
  misc_feature (11)..(11): n is a, c, g, or t
ggcaaacatanagggtttgtgtcaccgcaggacggggctacttccagttcgttgcgccctgcacgttcttcgggacgccgtttccacaggagggccagaagaaggcgcctcgggtcatgctggtgttcttctgcatcccggtcggtcctggcaggagcagggtgatctgggcgttcccgaggaacgtcggggtctggctccaccatatcacgccacggtggctgtaccacgtcggccagaaccttatattggattcagacattttcctcctccacgttgaggagcgtaaatttgctgcggcagggctggataactggcagagagcttgttacgtgccgacgtcgtcggacgccatggtggtcgccttcaggaactggttcagaaaattctgcaagaaccaggtcggctgggcaaccttacaagtcgaccagctgccaccaacgcgtaccaaggaccagctcatggagaggtactggtcgcacgtggtgcagtgcaggagctgcaacgcggcgctcaaggccatgaaggcgctcgaggctgccctgcaggtggcctcggtcgccgtcgtcgggttccttgccgtcgctaagggaacggtcctcacgtcaactgttcagagggccgcagtcgtgtcggcggccgtgctgtgcttcgctgcctcccgttggcttgccaacttcatccagaagaacttctactttcaagactacatccacgcctacaagtgacacgctcatgaatacgtttttaaaggtttttgttgctaggagattgttgtttttactgtgaatgcatattattaggagaattgggtgggtagaaagcagtatctatactgcattaacttgtatataataatgcatataatcgataataaaacggaagacacgcggcttcagttgtgtttaaaagaactgtcgacgcggccgcgaattcgaggcgactctagccgagttggttaaaaaaaaaaaaaaaaaaaaaaaaaaaaaaaaaaaaaaaaaaaaaaaaaaaaaaaaaaaataaaaaggt

SEQ ID NO: 20605 - DNA, 4289 bp, Zea mays
  misc_feature (1275)..(1275): n is a, c, g, or t
  misc_feature (2658)..(2658): n is a, c, g, or t
ctgcaggtaggtatagaagaaattcttcttctttttttgctgagagtagaacaaatgacttgtcaactgtatacgcaaaagaaatatctatacacgcagaagcagaattcgggccaccttgttcctctgttttcttgttttatagccccacattttgggccaatagattttttttattatggaaacaagagttccggctttagcatacaaatacgtacatccattacataacgattattgcaccatagagtagttgcttgaataattaaactaactcaaagaaaacaaaatgtcatgactatagaaaacactagccatcttcaattcttgcattcgagcgccatccatgcattgcaaaaacttacatcgccaccacctccaaagctcgacatgcatcgagaatttgttggtgcttttcctccttctgtagaagtctccagaatctgaacagtgagtaaccctaaaaataacctgcacaattgatagtattggtttatgatcggacgcctccgcgtttcgacagagccagatggaccaaaataaagctgatattcaagtcagtaataattttttgtatgccagagcattattagattcccaagatccgataatatgattaatgctaatgggcatgtctatttttaaagcaaagtaaatgattctccatatacttttgggccaatagatggaacacaactaatgcaaaatgacagtgtacaacttttgttgttgatttttttttttaaaaaaagaaaaactgacctagggtgcaagacattttttggtattgcatgtctaagtttagtacttcaattcgaacgactaaacttagataaaatgtggcgagttagccacgaattaaatatgccatcaataagaactcgctcaggtcgagaaaccccaactgatttagtgaccagctcctgtatctttttttttttgtacaccttcacaaaacattctcagagaaaaatatattgttattacaaactagcccattgttttatgtggtcgtaaccgcaacccattccgtgctgcttccaaggatagtatccattctcagataataaccgctgctcaaacatggccagcttacttaacatagcacagcaagacatgcatgatattcacagctatagtaccaaaattcggcacgccatcaaatcagacgacgccctgctggtctcgcaagacggcgtagttgatgacgcgggcgacggtgcccatggacggccggaaggtggggtcgtactgcaggcactgcaccgcgattcncccgagctgcatgcaggtcgacaaggttaggtacggttctgcagaagaaaagttttcgtgtgtagaaaattgttatgggttaagagagaccttgacagctccagcaggaggatactgatcaccaagttgcggatcgatgcattcctgaaccctgtcttccgtcagcatcggagttgcctgatgcatcaacatgatcaggaaatcgccagacgttttttttttctctcccattttttggtgctcgttggggttggggttattccatccagggtgcatcaacattattggttatagcactcggagggcaagctccatcgatttttaatctggggtctagaactttcttgaagttgaacaaagaaaacacattttgatcagtttgacagaatgccacccaaatcttccacttgtgtctaggaaagtacctctttcgatcgattctcagctgggttaggtaagaatgcggtgattagtagtaggatacactaactggttgcaattattccagtttggtttcgcgtttatttttcactgtttgattgatgcggactatcattttggttgccttcagattacgtaactaataatggaatcagagtcagggggtgggtgacctacaagtattcgataattcttacccagttcaccaggcttcgctggcccggcggcaacgtccggtccaatggcttcctacccgtcaggagctccaggagaacgatgccgaagctgtacacgtcgctcttgtccgtcatctggcccgtcatggcgtacctgaaggaacaaccacgaatccgtcagagacccacccgacccgatcccaaacatgaaacagcagtgctgtgctgctacacgaactgaaggcacgtactcgggcgcctggtagccgaaggaaccgagcgtgtgcgtggagcggttgagcctggccatgtccgcggcctggctgaacatgttgtagtcggcgatcttggccctgaagccctcgaacagcaggacgttggtggagcgcacgtccttgtgcgtcaccggcggctgcaccatctcgtgcaggtactccagccccctcgccgcgtccagcgcgatgtgcacgcggtgaatccagctcagcagcaccggcctggcggcgctgccctgctccggcggcggcagcctcagcacatccctgtcccctgcgtacgtggttggttcgttgtcgttggtccaagagtggctgctgcctggatacatgtttctgaccaccaccagcagcagcaacagcaggggaggggggagggagacccaccgtgaagcacgtcgtggagggtgcccatggtggcgaactcgtaagaccagcacgcggaggtcgccgctgatggtgtacccgaggcaggcggacgaagttgtcgntgcttgagcctgggacgccaccccgagctgcttgaggaagacgtcgttggacgcgtgcttggagggcttctccagccgcttgacgacagccagcctgccgctccgcgtcgtggcctggtagaccttggcgtaggacccttgcccgatcagcttctcgcctgagaaggacgccgtgatcccgttcagctcgcgcaggggcacctccggcacctccaccgtgatcacctcctccggggcgggggcggggccgcctgaccctctccgtttttctgaagcaaagcagcaatagttatccagcaagcagcaatagccaggtttcagaattttcatagcagagcaagggacatgcatgcacacactcgcataaaagcaaaataacggtgcttttttttactgcaaaacacgaggataataatccgatcgaaacctaaggggccagactatcagagcaaagaagaaaaaaggagcagaaaacgcaccgctcccaggatccgccgggaaagcgtacgagttcttggactgcttcctcccgatcctcgggaagcagccgacgttcccggcgtcgccgaacacgctcttggcgttctcccaccaccccatcgccggcgcacgcggtggcagctgccgctcctatgtaaatagtagtaactcttatcggtggttgcagaggttaagcttctcctagtcctagctagcgttctgatgagcaagacgcaacgaccggtgcctgtcggcttatgtaatccgctgatggtttcgctgaaattttctcaacccgtcccgtcctgttcctgtggacggcaacgctgcaggagggagaggagcagcaggaggccagcagcgcagaggtggacaaagttccgagaccgacgaacgagcgggcgggccagcgatgtgaagcacggccgcgacatctcggtcgcggggggccggccagcgatgtgaagctccggcctccggacagaccgtgtacatacgtgtttggactttggaccgagtccagtccgcggtccgttcgcaccgctgcacccacgacgcccgacgcctcacgtcgtttgctcgtcctcccaacctgcccgcccccgggagagggcgttggtcactcacatggctaacgtgtcgctggcgtgcagtgcctctgagctcgacacggctgctctcacgcgtgcaacggaatgccatgcgcttggtcttcgcggcaggaataatgtcccggccggagcggcccccccgcgggcggtgaccgctgcgaaacgtcgaaaactcagttaggggatgcagttcatctcacgtcacgcaacaatcttttgattttagtttttttacaccacatataataaaaagtaacgagattaatatgcgagccaatattccctataccttctcgtttctaagcatatccaatctacttctttgcagtcgatgagatcatcatatcttcaacacttcacctatatatcaaaaacattgttttgcactataaattacactttttgtagagtgttgtttacatataagaacgagaaaggtaagctgctagaggtagcctaagtgtcggcgtttcggacccgaggaccctcaaccggaccgactagtgaattttgtgccgcgtgtccctatccagatgggtt

SEQ ID NO: 20606 - DNA, 1681 bp, Zea mays
  misc_feature (1665)..(1665): n is a, c, g, or t
agatttgggctccaccactgcacatgaatcatgatgcagcagcgagcagcctatacggcttactgggccggccgccgatcgcgagcaaacacttccgcagctctggaattcggaggctcaggaatcatgatgcagcagcctcaggcgcatgcgtcggcacttgcggtggcgcacccgcacgatccggcgggcggggacgcgccgccgaagcaggtggctcaggcgatggagcggctgggccgtgcgggccgtctcatcgcagacatccggctcggcgcggaccgcctcctcgaggccctcttcgtctccggcgacgcgcccccgtacagcgtgcgccagcacgtcgacaggatggagcacattatcgtcaaggaggatgccgccatgcgcctccacttccaggacctacgcgccctcggcaggcaactagaggagtctggagttcttaatggggcccttaaagctcgaggcaattcatggggcttgcacatgccacttgtttgtccagatggtgctgttgtagcttatgcttggaagcgacaactagcgggtcaggccggtgcatctgctgtggacaggactaggttagctctcaaggccttcactgaccagaaaagaagattcttccctcatctagaagatgaagttgttagccatctccatgatggtgaacctggtggcaccaaaaagccaaagttgtttaccagcaatggagatctagaggaaaaatctttgtctgacatactgaaaaatttagaacatgaagcatctaacataaaaatattcacatactggcatctggattggtcaaaaagagcttcctcattagcatctctgttggatgatgactttgtggatccatctaaagagctgaacctgcaaaatatgggcaaatcgagatctggtgctctgacaacttccatagaccaagtcgcagttattgaattgctggttccttcagtatttagagctgtagtgtcattgcatcctgctggatctactgatcctgatgcagtggcattcttttctcccactgagggaggaagctatcttcatgcaaggggcacgtcggtacataatgtgtttaaacatgtaaaggaacatgctgacaaggcattgcagtacttcatcagtgtggagccgagtaaagcactacctcttcttttgcgttggattgccagctatcagactctgtttacgaaggtttgcagcaaatgcggacggcttctgatgatggacaagtctttggctttgctgttgcctcctgtccaccgcccctatcaccagacttcaaatattggaccagatcttcaagaggcctaccacattggatgttcctcctacgacggctagctggtgcttctaagaaacacccgagactattttggtagcacaggatgtttctcgcgttgtcatcgacgaagcacgtgtacaacagtccttgtgtgtaaaacattgtcctttctggaatgtatccaacccatcaggtgtcctttttgtactttggttagtgtatgcatattgtcatgtgctgtacaaatatattagcattgctactttattacgggtggggcctagcccaaacttgatacagctaggataaagttagagcagttgctacaaaaaaaaaaaaaaaaaaaaaaaaaaaaaaaaaaaaaaaaaaancaaaaaaaaaaaaaaa

SEQ ID NO: 20607 - DNA, 4263 bp, Zea mays
aataaaagagtaaaatattactttagaaccacaaataagttaaaatatactaccattagatagcttattttagcttatttgtgattccaaaatggtattttaccttttatctcttcaacaataattcaacttatataatgtaggagaaaaacaattttttttttttttttcacgaccgtggtactggctagtggggtccttctcggagttgaaaataatgttttcctgattttatttaagggtactggccagtagggaacaaaatccaggcctttcaatcccgcgacacacagacgacctgcttgccaacatttttaccgctgaacagaccgacgaaggaagccggcccactctccagcccaacgctcatgtcttccacatacacgatcttcccgtctctgtaatgcctggtgatgtcatcgacgaactgcgggaacaggtgcacgtaatcgctctggatgaaccccttcatcgctatcctcttgcttatcaaggagaacaggttgtggatcccggcaggggcagtcaccccgtgctgggaaaccatgccacacaccgcaatgcggccatgtactcgcatgttgagtagtacagcatcgagcatcggcccgcctacgttctcgaagtagatgtctatgccttcagggaagtgcctgcatataaaaacatgcatttttacatgaaggtcgcagcataatattgtgatctgaatggattatttgtcgactttacttgacacatgactgaaaaatatgcgtaagtaaagattacgtcgatagttccactattttagcaataaggataaaatgccccatattatgttcaggaatactagtatgttcgtcctaggtacatgaatattttcctattatcagatggttgtataaggtcatggtcattagagatctccaacagtgacttatctcagtgcccgaaattaaattatagtgcttaagctataaaaaactactccaataacgtcctattttacaaaaacaaatatcaaaaaatataggtcatgtcctgaagtgtcacaaatataccgcaacatatttggtttacccatatctagatctaaaggaacggacacttcacaaaggtttcatttccaaacgaacggagtagcttaacatattttgttaatcacttgagttggggggctttactgttggagcgtatttttttggtgtcctaaattctataaaatatatctattttaatttttagggcactttatagggcatctcgttggagatactcttagctcacaaaaagatttataatccaccaaaaggttcgcccttttcagtattatcctagtttgtttcatcaatttttcatgcaagctaaattaggttaattagtatgatcttccctgaagaaaatctgaccttttcagggcagcagtcaagtcaggctcttccttataattgaaagccgcatcaaatccgaatttttcctttaagagctcaacctgaaacatattgcggacactggatgatacaactacatctatatagacaacacgtgcaggtaaggcgcatggatgaagaactggtatgagttactaccttctgatctgtcccagcgcttccaacaacatagcaaccatggagcttcgcaagttgaccaacaatttgcccaactgctcccgatgcagcagaaacaaaaacaaactcccctttctttggtgaacagatctcatagaatccaacataagctgtaaagccaggcatgcctatacatggagaaagcacgtaattaataagagacataagcttggtgggttaaacaataactagcatagcgagaaatgtcattttcactccagtatctgtcaatcaagggcacggtttcccgtttctttcaatgacacaaccccgaaccattttctgtatctgtttctgtatcttgtcacagcattattacgtctacaaggtgcgaggggcactgaattatttgattatatccttttcttgtcccttatatgcaataaataaatttgttcagccaaggtttgtctttgcaacaacaacaacataaataagttcatgcacttgctgctgctcaacatcgtatcttgttttggtactttggtagtccacaacatctgcgttttctatgatttagaatacagctgaatttttttttgaaacaaaagacataaggaggaactaaccaagaaggcccagatgataggagagtggtatgtcgctttgctggatcttcctgagctgttcaggcttggtgatcagactgtagtcctcccatccagtcatcccggaaacaacgtcaccggcactgaatcctggatgagtggagtcgaccaccctccccacgccaaacccttcaataggcttcacagatcaaggaattgctcaatcagcgcacgaatcgcccacccgactttgcagcctgcagcttcagcagctaaccaaaagagtccaagcgggcaagctccccaaaaaaatgaaaagggaaacgagggaagctcactgatccaggtttgaagggcgggatgtaggagttgcggaagtcccgcatcctgccgcgcatgtaagggtcgcaggataggtagaggttcttcaccagcaccgcggggccgccgccgccctcggggacgcgcagctccacggcgccgccgtcgacgagctccatgtcttcctccctgggcgcgcggtcgatgtacccgcgcagcaccaccttcctgttcctcgccactgcctgccgctctcgctccatgccgctgtcgccgcccgcccgggagcacgtcggtttcgcctttcgcccgccaagttcttctgccgggaccttccaccttcctgtgcggatcaagaaggattttgtgcaagcgcagggggtaggtaggtgtgcgcgcgtgcgcggagcgcgttggaacaggcggacagcgggactgcgggagagacggcccgcgccttggattccagttggagccttggaggccacccacgtcccacggcacgttcgtgcaggacggctgcggtgcgactgtgagctgaggggaccccgtaggctctgctctaggctgattgtcaggcaggctgcttgttgttgtccatgtcaccatgtgtgttgccttctttctaccacgattaggctgcccgcagtcgcggactgtgaagccaactctaaaaatttacagtgaagtggatggctgcagcgattgactggatggtgtactctattttagcgtttgctgcccgcaactctattcctggcgtttgctgcccgcaactctattcactgtgacgctgtgtagagcatgggtggtgaggcccacggtgggtttgctgcagacgcaaaggagatgggtggtggggcccacagtgagtattttttataaaaaaatatggtagtttgtatatggttgagatatagagtagttgtggatgcggaagtttgactactgtattttaaaatattgatgactacgatagaatatttcttttagagtaaaaatttagagtagaatgagtgcggatagcctaaccaccaaatcttagctgccgcctgcggccgccgccatcactagccaagccatcgtccctggcgcgcggtcgcgtccaggcttccaggttactaggtgtatcctaccggtactcttggaaagtagactggaaaggtgtggccaaccagcagcccagcgtgcgcgtggctgactgactgaccgactggcgagcagatgcagaggcaacaacagcagcctgccttgtttggttcctcagcttggtgcccaagcatgcaggatcagcaggacgacaacttgagttgctcatcttgcgttgtgcaataagtatacatagttaggcatgtagtgtagaatatgctctcatacttgtgctaattcttgtcggtattggactaatcttagttggattcctgttgcagctctatttttttctcttcatcttcctctctgctctctgtagagatggaaacaggccaggtagagcaaaaactcacttgcggtcgaacccgtgaaatctacccaaagtacgtgtgtttcgagtctaggattaaattaccatctctctcctgccgaatccatcgggatcaaaacctccacccgcgcccaagtacgtgtttcaagtctaggattaaattaccatctctctactgcctccgcggaactctcaactgattttttttaaaaaaatcctggtcgatcacattcatggatctgatgtcaatttacattgtgtccattttaatcagcaacgtcaaatcgttatatagaaacag

SEQ ID NO: 20608 - DNA, 1490 bp, Zea mays
  misc_feature (73)..(97): n is a, c, g, or t
tttagaaccacaaataagttaaaatatactaccattagatagcttattttagcttatttgtgattccaaaatnnnnnnnnnnnnnnnnnnnnnnnnnctttttttcttcttttttaatacaggagaaaaaacaaacatgcccttgagatttacgaccgtggtactggctagtggggtccttctcggagttgaaaataatgttttcctgattttatttaagggtactggccagtagggaacaaaatccaggcctttcaatcccgcgacacacagacgacctgcttgccaacatttttaccgctgaacagaccgacgaaggaagccggcccactctccagcccaacgctcatgtcttccacatacacgatcttcccgtctctgtaatgcctggtgatgtcatcgacgaactgcgggaacaggtgcacgtaatcgctctggatgaaccccttcatctctatcctcttgcttatcaaggagaacaggttgtggattccggcaggagcagtcaccccgtgctgggaaaccatgccacataccgcaatgcggccatgtactcgcatgttgagtagtacagcatcaagcatcggcccgcctacgttctcgaagtagatgtctatgccttcagggaagtgccttttcagggcagcagtcaagtcaggctcttccttataattgaaagccgcatcaaatccgaatttttcctttaagagctcaaccttctgatctgtcccagcgcttccaacaacatagcaaccatggagcttcgcaagttgaccaacaatttgcccaactgctcccgatgcagcagaaacaaaaacaaactcccctttctttggtgaacagatctcatagaatccaacataagctgtaaagccaggcatgccaagaaggcccagatgataggagagtggtatgtcgctttgctggatcttcctgagctgttcaggattggtgatcagactgtagtcctcccatccagtcatcccggaaacaacgtcaccggcactgaatcctggatgagtggagtcgaccaccctccccacgccaaacccttcaataggtgatccaggtttgaagggcgggatgtaggagttgcggaagtcccgcatcctgccgcgcatgtaagggtcgcaggataggtagaggttcttcaccagcaccgcggggccgccgccgccctcggggacgcgcagctccacggcgccgccgtcgacgagctccatgtcttcctccctgggcgcgcggtcgatgtacccgcgcagcaccaccttcctgttcctcgccactgcctgccgctctcgctccatgccgctgtcgccgcccgcccgggagcacgtcggtttcgcctttcgcccgccaagttcttctgccgggaccttccaccttcctgtgcggatcaagaaggattttgtgcaagcgcagggggtaggtaggtgtgcgcgcgtgcgcagagcgcgtggaacaggccgactttggaatgcggcccggcc

SEQ ID NO: 20609 - DNA, 2393 bp, Zea mays
agcagtggtaacaacgcagagtactttttttttttttttttttttttttttttgtagttgacctcaataactgtgaattttattcattttgaaacggaaagagtaataatttatcagctcaagccctgtcaaggctccgtacttggaagcaacagatcatcttgagaaggaattttcaacgttctaactatggcctacacaccttgttatctacactcgttacaaattgattgtacggctagaaatacataataatgtacagggaaagaaagaatacacgttacatggcggcggacggagtctcctcaggcgtcaatcattggatttgctctagtgaagagcagagccgacccgttaacaccacgaagaatcatcaacctcgcatcaatgtatgtcccacaaacaatctttgacaaatcgaacatttccggcggggtttgtgtacggatctctttcagcgccttttgtgcagaattaactgtcatagtcgaggtgcagcttatcgatacgtggatttcatccatagcaatgtttactgcagggagactagatggcagctcctttatttgcgagaattttctccatttattaccatgaagatatctcatagaagatgtgaccatatcctctttactgtcatgttcgttaatataaatcctaccagcagctatccttgctgatgcggtgacagacaaaactccctcactgccagatttgtcgtgaggccaattgggttctggcataattctgaaaccaacatctgaggtcagagagaagacttgatcgactgactctgaactaactgtaaggtacacagcactgatgagaactctaggggaaggctgacgaagtgttaggccaatgtgtcgtccagtgcagtacaagaggcgccaacgaccaggtaggaggtgaagccaattctgtgttcttaaactagggtttagaacctccatcaattcaacaaaatatgataaacgtctacgctgatgacgcccatatatataatcttcagccatgcggacagcagttgatcccaagccccaccgaatgagatttgctgacggatttatacgccattttggcccacaaaggaacgggtgtcgcaatgcatcaacacaacttatcctttcctctggttttgttgccagcaataaggctaaaagattccaaccagcaccccactgcctatctagcatctgcaaaccaatattcccagatggagaattttggtagagggttggtagtaggaactcacgcaaacaggatgggtcatttccctttgtcaggaatgatttgaatttaaagaaagtcgaaggatccattagctctctcaaaaccatctttgccatgatgaagccaacacatctcatgtcaaaggctatcatcattttccgcctgtcattgttacttgcaattgtactgctgctaagatcattgtcttgaaaatcagcagcatttccaagaataccgactttaacatgcttgtctattgggctcacgtgaacattctctatcctaagctcggtgtgtgccagcccatggctatgtagataatttacaccaatcaaaaggtctctcatcaatatcctgataagacgcagctgtcgagttacagctggtcctccaacagagtcatctcctaccctcctcacttgttcttcgtccaacgctaatgttgcctctaaggttgggatccaatctgagagttgcaaccagtgacgcagggaatgactcccatgatacccatgaaccaatactaacgggacatcttcctcctccacggcattgcacggagcaatgtaaccatggacctgaagtgcgtaggagtggtacatcatttggcgacgagccagcttcttcagcacctcgagagcgcgacgccccctgcgcttcgcctgcaaactcttcagctgccgcaggaccaccgttgacccatacagctcgctgctcggatcgcacaccgtggcctcgaagatcatctcatccgaccgtccatggagcccgacgctgacgcggtcggcgacggtgaagtcggccatgtcgaacctgaccacggggcacaaccccgctccgcctccctcatccgccgcggtcggcgcgggagcggacgtagacgccgacgaatttgcctccaaccggaacctccgccggcgccgcggatgcgcctcgatacggcacaaagagcgggtgaggccgatcggcgaaggacatgcggcaacggccgcggcagccgccgcgagaggcatgcggggctggtactggttagtaccgttgttgttggtctacgggtgggaggagatcgtcgcggcgaagtggagggagagcaaggcccggggactgactgactttaagattaagaagaggcagcccggccggcctcgaggtacccaatg

SEQ ID NO: 20610 - DNA, 2582 bp, Zea mays
cttcaagttccagcaacaccattgataccgagggtgctgaaactactgaacttcagagacataaagatactgcttgtcctggactcaagagacaagattcatcaaaatccgtacaagataatcaacatcctggacatgagaataagcaaccaaagataattaagaagatactaacaactctaagagaggagagcaaatttagggaaagcaattctcctgttagagctagccgtgtaaagctaaattcacctagcaatagagaacgctcatctgacgactcaaagcaaagtgatatttcctccagttcaaggtctagtgaagttatgtcacatgaatcagcaaatgcaagctgtgaacctgtcaaacgaggacatgcatctcctcccttgaagcatttggtaaggataaatggttttcttgtgctaaaagcgtaaatccatttctctaagtttgctaattcttgcctcgcccccctcgatcctgctgtcaccaattgttgagcattctccgaaggttaaaattaaagtagatgagctattacatccacaccttgccaagcaggttggagaagttgttgatgcagctgcagggaaggttaagaacagaacaccgcccatttttattaaatgcaccagtattcctactcggaggcaaggagtagcaagtccaagccgtcaacacactggggtaaagcgagctcacaataaggtcatggcagagcatgcaaggaatccttgtcagcatctccatagtccaagcaacgctcttgtgaaacttccaagtgttccaatggttcctccaagtcatctagaagatcttaagagaaaaccagacaatacacgagcaaaatctgctcctcctagggctttagcaaccaaggaagacaacagtgcttgctccagttctacgattggtaatgctgaaaacaccaaccagtctgaaccgtctgaacctgactcaccaacttatttggtctcatcctgcaaatgtttgatacctgacactatcatacaaaagcacggcataacaagtaaagcgagttcagaaatcatcacaaccaattgtgagaaaaaaatgactagtaatggtgatcttagtctaagcgccgccatggtgcaatcttctgatattcctgaacaagagtttatttgcaaggatggaatgctctccagtcaggtgggtcagtgcagtgaaacagttactgtaccaagcgatgaagacaagttcacagtgcgcgaactgctttcatcagtaccagatctttcttcctttgtcccaacaacaatgatgaacactgagccaggaagaggtcccactctcacccagtcatcagagaaaccatcgggtcctcatttaaatcctcctccagttgaggacattatacatgtcataagccacagcagtttccatgtgaatggtgagcaggcagtaaaagaaactggatcagagagcattgatgttgacaaacgtcttaacatggtaagagaagagataggtgtaagaagcaccgagccaaacctcataccttctggacctatagattctgatacggtgaagccaaatgtagtagaagctaatattacctttcagaaaccatccagtacagatgccataaaattgccaaccataccggaaggaaattttagtactctggagaccaacaatgggtttaagcaggaagcagctccggctaaggaaatactagatgtgacatccttcaggcagcgagctgaggctctggaaggtctcttagaactttctgcagaattactggaacacagtaggctggaggagcttgcgattgttctaaagccatttgggaaggccaaggtgtcccctcgagagacagcaatatggttggctaaaagtttcaaaggcttgatgaatgacgaagcaagccgcagttcaacgtgagtacgcgtagcttttgtgccaccctttttactttggttgatttctgcttgtgctctgaagatgctatggttgtcttgttcatatctggcttcttggtatcgtgtgtccgctgtttccatttcgatagttattcattctttacagcacatgttgtaaatagcccagatttgtgaacagaaaataatacatgccagaaatggtgttaatttacatggttgaaaaaaaagagactaatttgatcaattattgttttgcctacgtgctcctctgaaactatcagaattctacgagaaaaggtacaaaattgtgttgttgcatttgttgtcagtatacttagtttctcaactactcttagaacatcccacaccacatatgagcatcttgattaaagtatgtgactatttagtaagccgatttagcatccgacacacacaagtcctttttgttcaggcagagttgcattttttgcagtaattatactccttcatttcctatactgaaaccgcagaacctacaccatataagcttacaaatccccccttgttatatgtgatgctcacactgttgggacttgggacggctttgttttatagcctctttgttttgtagccttactagctggttgcagttggagctccatttgttcccaagcagcttcgccactttct

SEQ ID NO: 20611 - DNA, 957 bp, Zea mays
cattgggtacctcgaggccggccgggatgccgccgcccgggtcccgtcggctcccggcccggccgcgatcacagccatcgcgggcgaccgcgcgccattatagcacacggggcacggcacgccttcggcctcccactaactgcacagaggacgacgcggcagcgaggaggaagcaaaggaaaggggatatgtcgaggccgcccaacaggagcgacgcgcacctctccgccgaggacgaggcggcgctggaggccgaggtgcgggagtactacgacgacgcggcgccaaagcgccacaccaagccctcccgcagcgagcactccgccgtgtacgtcgacgcgctcgtcccggacgtcggcggcaactcccacccggagctggacaagttccaagagctggaagcacacaccgagaggttggtgtacgagggcgccaatgtgggagatgagttcgtggagacggagtactacaaggacctcggcggcgtcggcgagcagcaccacacgaccggaacgggcttcatcaagatggacaaagctaaaggcgcccccttcaaactgtctgaagatcccaatgcagaggagcgacatgcttcttgcaggggaaaccctgctaccaacgagtggatcccgtcagctgacacggtgtacccggcgtcagacaagccaagcagaagcgacagctgagggactgtatatctccagccatgagaattcagacgagtgctttccaccattagaataagaaaccacactggttgtccaccgtatctttactgttctgcgtcgagattcttgtgattcttacgtggaacaaattaagcgtgctacgagttagacctctgtgttctggctgtaaatggcaaggaatgaagttctaatcgtggttcagcagtcaaaaaaaaaaaaaaaaaaaaaaccaaaaaaaaaaaaaaaaatcaagccttcaaaaaaaaaa

SEQ ID NO: 20612 - DNA, 904 bp, Zea mays
atttgcaatgccttcacaaatatctcgttgcgcgacctcgagccggccgggatcagccatcgcgggcgaccgcgcgccattatagcacacggggcacggcacgccttcggcctcccactaactgcacagaggacgacgcggcagcgaggaggaagcaaaggaaaggggatatgtcgaggccgcccaacaggagcgacgcgcacctctccgccgaggacgaggcggcgctggaggccgaggtgcgggagtactacgacgacgcggcgccaaagcgccacaccaagccctcccgcagcgagcactccgccgtgtacgtcgacgcgctcgtcccggacgtcggcggcaactcccacccggagctggacaagttccaagagctggaagcacacaccgagaggttggtgtacgagggcgccaatgtgggagatgagttcgtggagacggagtactacaaggacctcggcggcgtcggcgagcagcaccacacgaccggaacgggtttcatcaagatggacaaagctaaaggcgcccccttcaaactgtctgaagatcccaatgcagaggagcgacatgcttcttgcaggggaaaccctgctaccaacgagtggatcccgtcagctaacacggtgtacccggcgtcagacaagccaagcagaagcgacagctgagggactgtatatctccagccatgagaattcagacgggtgctttccaccattaccattagaataaggaaccacactggttgtccaccgtatctttactgttctgcgtcgagattcttgtgattcttacatggaacaaattaagcgtgctacgagttagacctctgtgttctggctgtaaatggcaaggaataagttctaatcgtggttcagcagtcaaaaaaaaaaaaaaaaaaaaa

SEQ ID NO: 20613 - DNA, 2226 bp, Zea mays
  misc_feature (132)..(133): n is a, c, g, or t
  misc_feature (136)..(136): n is a, c, g, or t
ttttggtggggaccggcggggttttccccggcccgggtgtggaaaacggcgggcaattaaattaaattagggccaccaaaaaaaaaatttttccgttggaaggcgcgggaaggaacgttggttttttttaanncgncccccctttttttttttttttttttttttttttttttttttttttttctccgagtgaagctgtagaataatgtagtggctgaagtgatccacaaacgcgagacaaaataatcatgaattacacaagctcaagcacaatgctacaacaaataacctatgaaatgacacccacagatttaagctcgcggtccctactctgatgaaaaacacaactctcccaacacgatggggggcagaaacacatttcttgtgtgtattctagttcgtggatacacaacaaggttcggcgatgacggatgatagtgtctataccatttacagtgaaaggtaaatggtcaagcttccaagatcgttataaaaaaagtaatgaccatggttgatcaatgttttacttgtcagcatgccggcgcttatgtctcctatgaccatggttggtattactgctccgaggtgttttcttcttcttcttggtacagaatgtttcagttaggagtgtgtacaaaacaaagaagggtgtaaccaataaagcagaagccagataccacaccaactctttagttacaaactgttttgtaaactcatgccggtgaaggtaatccgagatagttgcctgagcctgctgatgatatgtagtagctgtctcaagaaactgtccatatacatgtcgtgctctttcagtataaggcttgagagcagttctaactttctcgacatgtggtttagtagctgtagcaatttgatcaacatatggcttggataatttcttggcttcctggaaatagggatcaacaacttgatgtgcatttacaagatgaggcctgacaaagtcacttgatgtttgataagcctccaatgatttctctgagaccatttggacatagggctttgcatgtttcttcaaggtaacccatttttctttagcaacaggcatccattttgtcttagcagtttccagatgaggctcagcccatttctttgtctgcactgttttttcagatgccttctgcaagaagctgtcaaaggcaggtttcccatgttcattccagtgatttgacatcacctccatagagcgggctgcatgtgtcgctaaccatggtggcaaccaggctccatgaacctctctaagctgttttacttttgttgttgtttccaactgagccttcatcagctcctcctcagcagctttaagagcatgttcagtcttctgaatcctgcgcttttgatcactgcttgtcctctggagcttctccagcttcatatttagctcttgcaccttcttatcagcattgccagccctagcctccagagctgcttttttaattttttgttctgtaatatccttcttgagcttctcggtctgcttcttgagctcaatagccagtgcattggccttgcttgcctgctcctctgcagctaaagaccctttggcctcgagggaagttacttcattctgcatagtagcaatcttctgtgacttttccttgacaatcatattcagtgtttcgattgcatcattcttggtcttgaactccaggttctgctctgcaatgcgagactctaacgcggagatcttcgccctgagctgcactagctcggcggccagaaccgccgcctccttggccctcgcgttcgccgcgatctcctccgcaggcggggccacgccctccaccgccgcgtcctgcgccgccaccggccccgcgacgagcagaagcacagccatcagcagcgccgccgccgcgaggaagagccggctcgcgatccacatcctcacgaggtgagcagggcacgaaccacgaggtcctcgctcgcctcggcgctgagatgcgtgggtggctgctatgaagaagggagaaccggagaagtcgggaggtgcgtgggacgcgtaggcgtgcaggttgctagcctacttctacttctactcgccggtcacctgctcgccccaaaccacgtcacggcccgctgcttcgtgcacgtgggcacggctgcctcggccagccggcctgactgcctggctggccgcggaagggacgaggacgggtaatgagacttgagaggttctcgtacggcaaggccggctcgagcgccgcacag

SEQ ID NO: 20614 - DNA, 1188 bp, Zea mays
gtataaggcttgagagcagttctaactttctcgacatgtggtttagtagctgtagcaatttgatcaacatatggcttggataatttcttggcttcctggaaatagggatcaacaacttgatgtgcatttacaagatgaggcctgacaaagtcacttgatgtttgataagcctccaaatggtctcagagaaatcattggacatagggctttgcatgtttcttcaaggtaacccatttttctttagcaacaggcatccattttgtcttagcagtttccagatgaggctcagcccatttctctgtctgcactgttttttcagatgccttctgcaagaagctgtcaaaggcaggtttcccatgttcattccagtgatttgacatcacctccatagagcgggctgcatgtgtcgctaaccatggtggcaaccaggctccatgaacctctctaagctgttttacttttgttgttgtttccaactgagccttcatcagctcctcctcagcagctttaagagcatgttcagtcttctgaatcctgcgcttgtgatcactgcttgtcctctggagcttctccagcttcatatgtagctcttgcaccttcttctcagcattgccagccctagcctccagagctgcttttttaattttttgttctgtaatatccttcttgagcttctcggtctgcttcttgagctcaatagccagtgcattggccttgcttgcctgctcctctgcagctaaagaccctttggcttcattctgcatagtagcaatcttctgtgacttttccttgacaatcatattcagtgtttcgattgcatcattcttggtcttgaactccaggttctgctctgcaatgcgagactctaacgcggagatcttcgccctgagctgcactagctcggcggccagaaccgccgcctccttggccctcgcgttcgccgcgatctcctccgcaggcggggccacgccctccaccgccgcgtcctgcgccgccaccggccccgcgacgagcagaagcacagccatcagcagcgccgccgccgcgaggaagagccggctcgcgatccacatcctcacgaggtgagcagggcacgaaccacgaggtcctcgctcgcctcggcgctgagatgcgtgggtggctgctatgaagaagggagaaccggagaagtcgggaggtgcgtgggac

SEQ ID NO: 20615 - DNA, 1329 bp, Zea mays
gaagataaaacttttacaccgagtggaagctgtagaataatgtagtggctgaagtgatccacaaacgcgagacaaaataatcatgaattacacaagctcaagcacaatgctacaacaaataacctatgaaatgacacccacagatttaagctcgcggtccctactctgatgaaaaacacaactctcccaacacgatggggggcagaaacacatttcttgtgtgtattctagttcgtggatacacaacaaggttcggcgatgacggatgatagtgtctataccagacaacggacgcataagtgaaaggtaaatggtcaagcttccaagatcgttataaaaaaagtaatgaccatggttgatcaatgttttacttgtcagcatgccggcgcttatgtctcctatgaccatggttggtattactgctccgaggtgttttcttcttcttcttggtacagaatgtttcagttaggagtgtgtacaaaacaaagaagggtgtaaccaataaagcagaagccagataccacaccaactctttagttacaaactgttttgtaaactcatgccggtgaaggtaatccgagatagttgcctgagcctgctgatgatatgtagtagctgtctcaagaaactgtccatatacatgtcgtgctctttcagtataaggcttgagagcagttctaactttctcgacatgtggtttagtagctgtagcaatttgatcaacatatggcttggataatttcttggcttcctggaaatagggatcaacaacttgatgtgcatttacaagatgaggcctgacaaagtcacttgatgtttgataagcctccaatgatttctctgagaccatttggacatagggctttgcatgtttcttcaaggtaacccatttttctttagcaacaggcatccattttgtcttagcagtttccagatgaggctcagcccatttctttgtctgcactgttttttcagatgccttctgcaagaagctgtcaaaggcaggtttcccatgttcattccagtgatttgacatcacctccatagagcgggctgcatgtgtcgctaaccatggtggcaaccaggctccatgaacctctctaagctgttttacttttgttgttgtttccaactgagccttcatcagctcctcctcagcagctttaagagcatgttcagtcttctgaatcctgcgcttttgatcactgcttgtcctctggagcttctccagcttcatatttagctcttgcaccttcttatcagcattgccagccctagcctccagagctctttttaattttgtcccggccggcctcgaggtacccaatg

SEQ ID NO: 20616 - DNA, 4193 bp, Zea mays
aatactaatcgttttaattctttaccttgtaaggctaagatcactacactaggtatagaaaaatacaaaatattattttccattttaaaatatattatttaaatacagtttaaaatgaaagatatatatagaaagttgatgctcttagcctaacatgttgcctcccaaccccgtgaccataaagcggtgtcctaatggtttcctttgttctctatagtaagggctagtttgaaaaccctaaattttcacgggatttttattttttcaagggaaattagtttattttcctttgggaaaatgtagttcccaaactagacctaaagataataatgtagattactgttgacggtaagatctttacaacctatcttttagttttagtatatctatatagtaatgaggtcttcacttcaccgttaatgtatggttcacagtatttttaataagatgagtggttaaagctaggtttttttttgtgttcgttcgttttttaaattgaaacggatgaagtatttattattgggacggctgcaggaccagaacattattttggcggagcaggacctgaacattattttacttctagaaataactcaagacttccttctcgcacccaagcttgagtgtgagtcgccttgattgctttccaatttcgaccttcggcatccgaaacgtcgccttggccttgccgatgttgttatcctgaatttgcgtagctcttccctcgtggttaagcaatcaggtttcatccggtagcgtaatccgcaagctgtacagcctcaagtgtcaattgcagcaagcaagaagcgccgtacaacagaattggtcatttatgcagcattacatgattgttcagtgcagatcacagtactacacgcacgctaaagacttgcagggaagatacaggttcgtagaaaggtggtcagattcggaggctcttttcgctttacaacaggatgaaggagagagagagatggtctttcttgtgacgcacttgatgacacgaaatgacagcacatatacgggagtgacttaaaacaaatgtgatcatgtagcagtagtaactagctaggtaaaatgcatggttgtcaggccaggagccagaagttcttctgccaccgggtgctgatgaggtacccaccgacgcccttgctctgcttcctcaccgccagcgtcaggcactccgcctggttgatgcactgctccacaaactcctcgccgctgctccgcaggaagctgcaaaaagaaagggtcacagcattggaatttgctcaaacaacggctggttatcagacactgatgtgaagagtacttactacatttgccctaataatcctatccaacctagagaggttcagctgcccctccacatgtgatgtcacattgcagcaaaaagtgtactgtactcgtatctcgctggcatctgtgtgcgtggttcttgcttttgtttgggagagatgtatctagaaggacatgcatggcatcttggatttatggattgcacatggagctgcatcctaaaggcgttattttcacccaaagccatggaccctagtactgaacggtggcgagcgaggattctttacaaatagtttggccaccacttgcgagtaggccctctcataattacattttttacctgatttatcttacagaaagtatacattgagacgcaaacgcaactaaataagtgccaatcagctcactcctgagccttgacctattgcttttaggattgtttacctgagaggataagctaaatctgatactagtcgaatattctgctggaattgcagacatgtaaattactagttctgaagtctaagcttcgttttccatttttaaacgaaacgctatggattggcatcatgagagattccctcaccccaattttactggtccatagttgacctctgagagcttcacatttccgagacaaatgcagagcggataagataggagaaggggtacggggtgcggagtgccttaccagcttaaccagcagggagatggcctgcactggctgagcaccagcacggaggcctccagcttcttcacctggctgagcacggtgcccagcttgggcccttggatcacaagcgcttcgacctccacctaccatcattcacacccatttctcatcgtgagccaccatgacctcttcttctttacatttacagggcacagcacaacaagacaaaggaacagttgatgcgcctctactgtcgtatttaagcaggcaggtgcacagacattaaaataactatggcgttgattgaagcaaacagaaaccgggcaggatattgcatttcataatgcgatggttcatggttccagattttaggggaccagggaggaaatagagagccctcctccagtctgtgttgcttacttcctttggagttgattgctattggtttgtttggaacaacttcacaaagccaaaaaaaaaagttaatccagatttagatttacctagatccactatagagcaggtccactagtggtggagcagggagctggacagctggtgaagtcagagatagtacaacaccatttttatggttgtctacagagttgtctcgaaccctgcatatggtgccctttggggacctagatcttgatccaagcagatacaaaagtggattctgatctcatctacctacgactacgatctccccaactggttacaagtatagaaaggcaacctcaactcctcaagtgatgagtgacttctccagattatctaacaaccagccagaatccttcctttaaaaaaaacatgaacccatgaagtacactagtactgatacatttgttggtgtcattgtttttaattaaactcctagtgattctgttgttggtgtactcgttttcagttaactaatactactaattctcttgtgctgttctgcatggctccaagcatatgctgccaacaaagttgttcaaacgagcacttcttacgagctagtaactagttacaattgaactccactaatcagcaaatgcaaatgcatgtgttgttgcaggtgtgcacctctggcctggaggccttgcagagcgtgccgagcgagttggcgagggaggaggcctcctcgcccctgccgctgccggagcgcggcaggacgtggagcagcgtgaggaagtcccccttgtcggcgacgtgggtgagcgcccacatcatggcgtggttggctcccgagctctcgtccaccaccaccatcacccgcttccccgcggcagaggccggctgcttcacgccattcccgctgccggcgccgtagcccctcgcggcggcggcggcggcggcccgcttcttcgaccaccgccgggatcccctcctccccacgccggcgccgccgtactcctgctggtccatctgcaggccgccgcagaccgcttcgtcgccgttgctcgcgctcagctgcctcaggaagcggttccccgcgctgctcgccatctaccgcctactggctagcttcgtgctgcggcctgcggctgcgcaatgcaagcaatgcgctcgcaactgtgtgcgagtgcgagcaaagcaaggtaaggtggcgtgttggtgcaagctctgcaaggaggacgagtactgtgtgcggtgtgatatggctacgtgcagagggaaggccccatcgggggctatatggatgcacggcgaggtggatcagtggatgaaaggacaaggccgcgtaaagcagaggtggtcacgagcgtattggactagcagcgccactgcaaacttatttattgaatagtactcctataaagatatatgctagtcacctcagctaggaaagatgtccgagaaaaaaaaagtacttcctctgtctcaagtctcaacatacgtgctccataatatatatatatatatatgataattaatagttacaatataaaattttattcgaatataaaatttgtttataataaaaagtagttagagttttaaatgtggatgctatttcatactccctcggttctaaataaaaatggtggtacgaggttctggcgatcatttgttaaaaatattaactacgtattatatatttaaataagtttattaaaaatatgtatcataaatattaatattatatatatggtcttagttaaaattatttgacttctctgaaaacaagaatggcattatttatacgatagaagaaatctagatttattcaaataat

SEQ ID NO: 20617 - DNA, 1313 bp, Zea mays
ttttttttttttttttcatccgcaagctgtacagcctcaagtgtcaattgcagcaagcaagaagctttttacaacagaattggtcatttatgcagcattacatgattgttcagtgcagatcacagtactacacgcacgctaaagacttgcagggaagatacaggttcgtagaaaggtggtcagattcggaggctcttttcgctttacaacaggatgaaggagagagagagatggtctttcttgtgacgcacttgatgacacgaaatgacagcacatatacgggagtgacttaaaacaaatgtgatcatgtagcagtagtaactagctaggtaaaatgcatggttgtcaggccaggagccagaagttcttctgccaccgggtgctgatgaggtacccaccgacgcccttgctctgcttcctcaccgccagcgtcaggcactccgcctggttgatgcactgctccacaaactcctcgccgctgctccgcaggaagcagcttaaccagcagggagatggcctgcactggctgagcaccagcacggaggcctccagcttcttcacctggctgagcacggtgcccagcttgggcccttggatcacaagcgcttcgacctccacctctggcctggaggccttgcagagcgtgccgagcgagttggcgagggaggaggcctcctcgcccctgccgctgccggagcgcggcaggacgtggagcagcgtgaggaagtcccccttgtcggcgacgtgggtgagcgcccacatcatggcgtggttggctcccgagctctcgtccaccaccaccatcacccgcttccccgcggcagaggccggctgcttcacgccattcccgctgccggcgccgtagcccctcgcggcggcggcggcggcggcccgcttcttcgaccaccgccgggatcccctcctccccacgccggcgccgccgtactcctgctggtccatctgcaggccgccgcagaccgcttcgtcgccgttgctcgcgctcagctgcctcaggaagcggttccccgcgctgctcgccatctaccgcctactggctagcttcgtgctgcggcctgcggctgcgcaatgcaagcaatgcgctcgcaactgtgtgcgagtgcgagcaaagcaaggtaaggtggcgtgttggtgcaagctctgcaaggaggacgagtactgtgtgcggtgtgatatggctacgtgcagagggaagggcgcatcgggggctatatggatgcacggcgaggtggataaaggacaaggccgcgtaaagcagaggtggtcacgagcgtgtaaagacactcccaaccccg

SEQ ID NO: 20618 - DNA, 1633 bp, Zea mays
  misc_feature (1236)..(1236): n is a, c, g, or t
  misc_feature (1241)..(1242): n is a, c, g, or t
aaaatagaacgcttcaatctcacccaaagttttttttccaaagggaacttggaaacatacactactatttcgacaaaattacaaagccggatacttcctggattttggtaactatttatacaacatttacaggaacaagattacatgaacggagcaaatacataggctcttgtataaagaatatataaataattatacaacaaggctcactagatgaacaatgctaattggcatttcttttccagaattcagttttcctatatgagttacattttgagccattttctaaatagatacaatttacaacaagctgcggctcgccttttttattatgttacaaatcacaatgttgaagtctcgcctgatcttaccaacttagctcttagcaacgcattctccctttgtaatcgctcaacctcagccttcagcaaggcattgtcatgtcgtaagctttctacttccccttcgagagtaccatgttctccattctcctgttgttgagtgacaggtaaagatgggaattgccctgtgtatggtgcaccaagcaagacttccctgatgacttcatgtgccgccaaactgtcgatccccatgttctcataactccaaaatgcacctagtgttcccaagaacccttcatggcatagaaatgtcgtctgaacttcacctttggaccaatattttagggaacgagaaatcttgtccatagtcttctcatgaccacagacataagcacctcggaagaaaattctcttcaggcctgaaagattagccacaaagtaggctatctgtccaatgttgtatgtgaaagaattcagtaaggctgcagcaagatcctctactttatactcagaaagtttgcttgagttcacttttccaaagctagccgcagtagtggatgctggaaggccaatcttcgggtaaccttcttccccatatatgtcccccacagtcaaatcgacagacagattattgcccctctgactcaactccaggaattcttcgtaacttgaacaaccagtcaaaagcctagcaagaccaaggatagtaccgccgcctagatgggatcctataattctttcaaactttcccttaccaattacctctatcatgcctggtgccgaattcctgcaatatgttgctatcactctcttcatccgctgatgtcccatcaactggtgctgattcgtgatcaggctcctgtatgaaaaaaaaggggtagatcatgaaaaacancgacnnattttatcttggaaaacataaatagctgtatgtagaacctacattgaatctatacttctgtaatcagtagtcacctacgttgaatactgaaaaagttcatagaacatattaaaaatggactggtgaagcgcaccccgcgaactctggtttacattagcttttcttctcgaaaacacaagacactcgtgtatccttgcattaaggagagtgtcatacaaaacctaaacaacaaccaccgcgcccacacccaaataatgtgagttacatttgtgccgattgcagtaaaaacgtgcgatcagacctgaacaaagtcaagccatctacctagcgaccagccgaccacttctaaatgtgttaatcctttagcaacagcaaggcaccagagatgagc

SEQ ID NO: 20619 - DNA, 914 bp, Zea mays
ttgtaagatgtcccaggggtgaggatatagggagagaggttgctgagataacaaaaacagctgcagagtaataaaacacagtgaagaacaaggagtaactgttacgcaaatcgtcaggaaaaaatgccaataaactacaatcgaaatgttggtgagaactgagaaaatatgacgcggccaaacgaattattgcatacatgcagaaacgctagtgttggatagttccagaaggaattaattatacatgttattgtgctccgagatcaaaataatgtaatgattctctatgcgtcaaaccttataacatccaaattccaccaatggtaattaagctgaagccgtgctacatgttcagcatgagcgtaaactaagctcagattactagtcttaagataatctaaggacaacgacgatcatcccaaacaacttaagtaacagttctacagcgacaacaccagtacagggggcgcctcaaggaccaaaaccgttctcttctctacagtagtgacgtaacactggacggatcaagagacaatggccaaaggtagtacatccggtggaaacctacttcccagctgaatcaggagtgccatcaccgtaggaaaccaaacctttcttgcctccaccagacggtgatggggaccgagatttcccatcacttgcacgctccagagatggagaatcaagtggggagggatgatgcactggtggagactttgatactgacctagaaaggtggctcctagaaactgaccgtgcacgatcgctaggtgaccttttcctggcggggggtgaacggctccgtacaggactcttgttgtacccacctctccttcctctgtggacaggactgcgtgatgcgcttcggctcctcctcctgtacctcgctgggcggacgctgggcggacgctggg

SEQ ID NO: 20620 - DNA, 801 bp, Zea mays
aaaaaaccctatcgtccctcccgcgcagccaccagcgaagcagcggggcacgcggacgagccgagcgaggcggaggcggagagatggcgcgcggcgtggtggctggggcgaagggtggtgcggccggcggcggcggcaagaagaagggctccgtcacgttcacgatcgactgcaccaagcccgtcgaggacaagatcatggagatcgccacgctcgagaagttcctgcaggagcgcatcaaggtcgctggaggcaaggccggccagctcggcgagggcgtcaccgtcacccgcgataagtccaaggtcaccgtcacctccgacgggcctttctctaagaggtacctgaaatacttgaccaagaagtacctgaagaagcacaatgtgcgtgactggctccgagttgtagcggcaagcaaggaccgcagtgtatatgagctacggtacttcaacattgctgagaacgaggaggaataggcggcttagaccttatagacgcaccgccttatctctgtcatgtgaactctggatgtgttgggacactcatactgtagccttttaagggatgagttttgatgtttaaattggtcttctgaatgtttttaagcgtgctgggacttctcatgttatgcttagataattgagtccgaaaaaaaaaaaaaaaacttttaaaaaaaacaaagataaaaacaagcaaacatagaacattaaaaatatgcaaatcataacttccctgacatacggccaggtatctatgcaacaatgaaaaaaaaaaggggggccctttttaagggtccaagtt

SEQ ID NO: 20621 - DNA, 964 bp, Zea mays
  misc_feature (931)..(952): n is a, c, g, or t
aaaaaaaaaccctatcgtccctcccgcggaggtggaggcggaggtggaggcggaggaggggagatggcgcgcggcgtggtgtctggggcgaagggtggcgcggccggcggcggtggcaagaagaagggctctgtcaccttcacgatcgactgcaccaagcccgtcgatgacaagatcatggagatcgccacgctcgagaagttcctgcaggagcgcatcaaggtcgctggaggcaaggccggccagctcggcgagggcgtcaccgtcacccgcgataagtccaaggtcaccgtcacctccgacgggcctttctctaagaggtacctgaagtacttgaccaagaagtacctgaagaagcacaatgtccgtgactggctccgagttgtagccgcaagcaaggaccgcagtgtatatgagctacggtacttcaacattgctgagaacgaggaggaataggaggcttagaccttatagactgcaccaagccttatctgtcttgtgaactttggatggttgggacactcatactgtagccttttaagggatgagttttgatgtttaaattggtcttctgaatgtttttaagcgtgctgggacttctcatgttatgcttgaagaggagaacgatcatacttgatactgcagccttcatggaggagtttggcatgccgctgaagacgaggaccaaagacgggtataatccgcttctcgacgatttcaagaacacaaagttctatctcagcgtccctacacacaacgttcctacccatagcaggaggaactagtcttctttccttttgctgatgtgtcacgagtcaggaaaagacgtctgacaggctagaatcggtctgtcattttgagtagtctgaatttgcaagttttcttaccttaaggtgctgaaaattttatagtttctcttttctgtagaacnnnnnnnnnnnnnnnnnnnnnnacattgatgcat

SEQ ID NO: 20622 - DNA, 1853 bp, Zea mays
aaaaatcgggtttgccgtgcggcacttgcgtttcgggtcgggtacggacccgcaaaaagagctccgtcagttcctctacctcctctgtaggagcacacttgtttcggaaaggaacgcagattcacgccacgccgccgcctcaattatatggcgccggcgttctcggcacaggtccccgcgctccgacgggcagcactgcgcgtgcggtgggtcacggctgcgctgttctcatcggggattctcgccggcaacaagccgattctggtgcgtgacttcgtgaggtcagcgttgtacgaccccaaccatggctacttctccaagcgggcggggccggtgggcgttcttgacgccagcatccgcttcaaccagctcgaggggaggagtgcatatatacagcaccttgataagctgtataagaagcatgatatcgcttggtttactcccgtggagctctttaagccatggtatgcctacgcaatagcagcatcgattctgcgtagaatgaggttctttcagtttggtcactgatgcaccgttttccctctatggtgcagccatggtatgcctacacaatagcagcatcgattctgcgtacagcaaatctttcagtcccattgaagatatacgagattggtggtggctctggaacatgcgcaaagtgcatacttgattacatgatgctgaatgcgccaccaaaagtctacaatgatatgaaatacattagagattagctcctctcttgctgagaagcaattggaaactgttggtgaagtgcaaagccatttgtcaaagttcacggtggagcaccgggatgcaattaacagacctggatggggccgcacggatcctcatccatgttgggtgcttatgcttgaggtacttgacaatctaccacatgaccttgtctattcaccagatcaggtctctccatggatggaagtgtggattgaaaaagtaaaagttcacaagcttccgaagtctataagccattacaagacccattgatttctcgctgtgttgatattattggcatgaatgaagacaaagcttctgtcagtgaaaaactagcatttgctgcaaaaggagttctatcaaaagtattcccaaagcctcgtagagcttggttgcccaccggctgcttgaaactaatggatactctacatcaagctttaccgagcatgtcccttattgcttcagacttcagctatcttccagacgttagcatacctggtgacagggctccattggtttcatcaaagaacgatgggaagacatcagatcatcgcaactactttgatgctcagggtgacgcggacatcttcttcccaaccgacttccggctcctggagcagatcgaccataactgcgctggcttctcaaaggagcagaagaatcccggcgcattcaaacccgtgaagaagaggagaacgatcatacttgatactgcagccttcatggaggagtttggcatgccgctgaagacgaggaccaaagacgggtataatccgcttctcgacgatttcaagaacacaaagttctatctcagcgtccctacacacaacgttcctacccatagcaggaggaactagtcttctttccttttgctgatgtgtcacgagtcaggaaaagacgtctgacaggctagaatcggtctgtcattttgagtagtctgaatttgcaagttttcttaccttaaggtgctgaaaattttatagtttctcttttctgtagaacaaagtttttattatcatttttgacattgatgcatgggtaataaaaggtggaagaagactgactaacaaaaaaaaaaaaaaggccctggtaaaagcaattacaggctgcattccacacgt

SEQ ID NO: 20623 - DNA, 2079 bp, Zea mays
acaaatcgggtttgccgtgcggcacttgcgtttcgggtcgggtacggacccgcaaaaagagctccgtcagttcctctacctcctctgtaggagcacacttgtttcggaaaggaacgcagattcacgccacgccgccgcctcaattatatggcgccggcgttctcggcacaggtccccgcgctccgacgggcagcactgcgcgtgcggtgggtcacggctgcgctgttctcatcggggattctcgccggcaacaagccgattctggtgcgtgacttcgtgaggtcagcgttgtacgaccccaaccatggctacttctccaagcgggcggggccggtgggcgttcttgacgccagcatccgcttcaaccagctcgaggggaggagtgcatatatacagcaccttgataagctgtataagaagcatgatatcgcttggtttactcccgtggagctctttaagccatggtatgcctacgcaatagcagcatcgattctgcgtacagcaaatctttcagtcccattgaagatatacgagattggtggtggctctggaacatgcgcaaagtgcatacttgattacatgatgctgaatgcgccaccaaaagtctacaatgatatgaaatacatctcagtagagattagctcctctcttgctgagaagcaattggaaactgttggtgaagtgcaaagccatttgtcaaagttcacggtggagcaccgggatgcaattaacagacctggatggggccgcacggatcctcacccatgttgggtgcttatgcttgaggtacttgacaatctaccacatgaccttgtctattcaccagatcaggtctctccatggatggaagtgtggattgaaaaagtaaaaggcagtttacaagcctccgaagtctataagccattacaagacccattgatttctcgctgtgttgatattattggcatgaatgaagacaaagcttctgtcagtgaaaaactagcatttgctgcaaaaggagttctatcaaaagtattcccaaagcctcgtagagcttggttgcccaccggctgcttgaaactaatggatactctacatcaagctttaccgagcatgtcccttattgcttcagacttcagctatcttccagacgttagcatacctggtgacagggctccattggtttcatcaaagaacgatggaaagacatcagatcatcgcaactactttgatgctcagggtgacgcggacatcttcttcccaaccgatttccggctcctggagcagatcgaccataactgcgctggcttctcaaaggagcagaagaatcccggcgcattcaaacccgtgaagaagaggagaacgatcatacttgatactgcagccttcatggaggagtttggcatgccgctgaagacgaggaccaaagacgggtataatccgcttctcgacgatttcaagaacacaaagttctatctcagcgtccctacacacaacgttcctacccatagcaggaggaactagtcttctttccttttgctgatgcgtcacgagtcaggaaaagacgtctgccaggctagaatcggtctgtcattttgagcagtctgaatttgcaagttttcttaccttaaggtgttgaaaattttatagtttctcttttttgtagaacaaagtttttattatcatttttgacattgatgcatgggtaataaaaggtggaagaagactgactgaacaaggagtcaaaccaaatgaatggtaaaagcaattacaggctgcattccacacgtataacgaaagaaaatgttcagtggatacaaaagggtatattctttgcgattaatcttttcgttgccaatacagctgccgccccatactccagggaattacattatcttctaacaaaaaaaagaatggttacatcgaatggctccaatatacagcttctcaccatgctatcagcaaaaccgggcaaacaaaaaatgtatatatataaaaggcatgtttggatgtcggggatttggaacagattagttaagatttagttcaaatttgaactaaataccttgtgctgctagcgcaaccccctttcatctaaac

SEQ ID NO: 20624 - DNA, 4398 bp, Zea mays
cacgaagagcttgacggtcctctcctcgccgccctccttggctcctccgcctcctgcctccgccgcggccgcagacgccgccgcggccttgcccccgtcctccgccattggacgctctgcctcccgccgctagtgtttccgccggccggaccggaggattgctcgccgccgccgccgccgccgctacgggggggttgggtcgcctcgtcacgagctgtgggcggttgcgctgccaattgtttttttgggtttaggttgtggtggaagaggcgatggagttgaaggcgtcggaagcggagcagtttaactaataataattgcctagtggatatgcaggcctgcagttggactggacactcccctcccctcccctccagcctccaccctacttgctgcaatgatgacttgactccttgagcctccttcccagctcacttttctcttctctcccttgccaatggtgtgtcagtgtctttccttcctactcagtattagctagctgcaacatgcatggtttttttgcccccttcatgattgatatattcgtcgtcagaaaagaagaaaaaaatgtgtgttttattaaacacagtcacacagatgtgtgtattctttgcaggttaataacacagctttgtttgttcttattattattagttacaacagcagtaggtggcaatggcaaacaagaacctgggttccaccgcggtctggcagatggtaacaaagggaggcactggacccaaggcaaggaatgaaggggaagggcggacaagaccgcatgcggagatgagaggaaagggtgaggcaacaagagcaagagacgagacagaaccctcgctgtccatcctcccacgacagagatggcatgtctgcccctccaagctccaactccatccagcgagctggacctggaggagactggacccagagagggacatcatcagaccagaccagaacaggcgtgggaccgtgggtgccgttgccttgccttcatcacatggttacatacaaagaaagaagatgtggatgctcgatgccccgccagctaataaactttcttaaagtctataatatctacatcttatcaataggctttctgtaaaaatatattttattttaatctaatactccatccgtatcaaaataaatttcgttttaagtcaacggtgaattcatcaaagacttgagggatgtattttacatatgtgtctagatttatcctcgttcgcttgaatatatagtcatttgatgaaaaaggagaggggggatcgagacaggcgggatatatataacgaacataggaggatatggagggcgctgcggggccagctagaaaaaggtcggggatttagaccctggatggctttgcttgatctgcttttcgatgatgccattggtcgtgtaattaatagacagtatggcagacggttcgcggcatgcagtaatgcaaagcttcttctctcatgatgcttcggtctttatcagaagctagtagctggtatagcagatccgtacgattgatggattggtacttgctcatcctcgataccttgggacagttgtagtgagaaataacacaaaacggcccaaattcatcgatagatcgatttagggtgttcgaatttcgatacccttccttgttccttcacacagacacagtgacacagcgcacgccacatgctttgtgtcatgccaaggccaaggctctaacgggacggtacaactgccacggacaatgaacagggaggaggggttgcatgtggccagcctgtgtgcgagcaatcagaggatgcacaatacttgtcagactgtacgattagtcctcttccaatccggccgttaatccaaaagcattccaactcacacaggggcgcagaggagaaagagacagacaggcagcgagagagagagagctcaaagcaggcaggcaggcaggctcgtcgggctcatgagttgctttcattcagttcctgacgaactggaggccgttggcccgggagtaccgctccatgaagcgcatgaagcggtcccactcctgaggcgtgcgcatcacgtacttggcctcgatccgcgccggcttgccgttcacgaacttggcgctcacgtccacggactgcagcacgccctcgtcgtccaccatgtaaaagcccgtgatgtcgcccagctccgccgacgagtcgaacaccgacggacgctcgaacgcgaagacggccacgccgttggtgccgtcgcgggacttggtcagccgcacgtccgggaccgtctgctcgtccgtgccctggatgaactggatcgcaggccggcccgccatcgccaccacctgcgcccgccgccatcgcccagggcactgaaccgacgatacgccgtggaacaacgactgcaggtgcaggctcaagttctgctgttgatgctgctggctagggacacctgaacgaatgaaccaccatagtagagtacagagacagtattatggggaacttgacggaacacatgcacatatttgatttgtttccctgcttggtgcgagatagtatacctgcgacgtggtaccgacggggatgctgtgctgcccgtgccgacaccggcgaggcgacagcaagagccttcatcactgcggccatccctagctaggggtggtctctgtgactctcgagtgagaggcaggcagctagctgtccggggaagctgcagccagaaagggagcgctggtgtggtgtctgggaggaggtggaggacgggtgaaatgcagaggggagcagcgggtttgagtggtgcagagtgggacgagatactacgatagtgattgggtggcggtgtgttcaaaagacagccatccatcatccagattccagagggattctattgcaggcaggccctatcttcttctcctcctcctcctcctcctcccgatgacaattgacaactgcttgcttctgctctccggtttcgcatatttgcacgtatgctcctgtttcttggtgggcccaccgcccttccttttcttctcctcacacatctcagcctgtcttcttcctttccttggatcatgagaaggcatgcatgcagttgtggctgtgtggtgccctcgtggcccatggaggcaccaggaatgacaaccggcgcttgagcggccagcagctttggcgggggtaactcgcaagcagtatcggctgccagcagttcctatattatctgcagccgccgcccaaaggccgtctccgttcctctctgcccttcatcttcttcgcccaaacaccatccagctgcccagcacaccatgttggaggaaggcaccctttataaaattaccatgttctggcagtaattttcaattagtgaagtgaaacatacacgacctggagtttttcctccgcagttgtatgcttgcacagttagttaaaaaaaaactggtcagaaacagcagtggaatttaagtactagtattgcataatttgcatttgaagaaaaaggagaagtagaaaagttatgccatgtaggatttggatcatggtctagctaaaccttatgaacacagggtacaaagagtagacagcgtacttacgaataagataccactataccagcgtgcaacttgcagctcataattgagacggcttgtgagaagaacttgggaagttgacaaacattcatggcgattcgtcatattgtatggcttccatggtttatgacccaccgcttaaccaacagtgctacgaccatggggcttcaccagccctttatcttgcaaaacgctcctaacttgggccacaccactccacatgtctttgtatgcataaaggtttgctgcagttacataataaccgctatttccaggctccaaatgtagcaaatgttttgcgatggattcgcccatcttgagttcactcctgctactgcaagcatttaacagtgcgccccaaattccgtgtgtttgttgagacggcaagctctccacaaacttgtgcgcttcctgcagccgaccagcccgcccaagcatgtctacaatgcagacatggtgctctggggctggtgtgatcccaaacttttctgacataaggcaataatacttccacccttcatcaacaagtccagagtgactgcaagctgacagtagagcaataaatgtgcttttcgtggctttcattccagaatcatgcatcttccagaaaagatctatagatttcatcccatggccatggaatccaaaagctgatatcaaggagttccacccggcaatcgatttttcggcagaagcttcaacctcgcgcccagctatgtccagtctcccacacttgcaatacatatcaacaagtgatgctgaaataaaaacattattgtgcagaacagacctgaacacatgcccgtgtatgctctttccttgtctataaccacccaagc

SEQ ID NO: 20625 - DNA, 3282 bp, Zea mays
  misc_feature (2954)..(2954): n is a, c, g, or t
cgacctcagcaagtcgtggagcacgtcgcggacgccgttctcgtcgtccgggagcgcaaggcagctcgtgtcggcgtcctggccgcggtacatgagcaccaggttgggccgcccgttgccggtgctgacgtgcacagacacgtagcacctaaggtgcaacgtgaaccggcgatcgccgctcgtcgtcgactgccgcgataagaactctatgtttgtcctgtatgcctcgatgcggcgttctgctgtcagggacgaactgatcccgatcattccttgcgcctccatttgatggatccaccggccggggtcggctccatgaattattggggtcaaatacattattgaacagtgttaaacagtattttacactggatttgacaaattccatcgcgtccggcgacccctgtgccttaaggcagcttcgcccctgattcgtctaccactaggcagcagcgagctacttgcaacaaggaagttccgagttgatcgtacgttgaaggagagttgcggtagcttccgtcgatagcctcccatttatatagggtcctcgtggctagcaaaaccatgcatgtccgattcagttaggaatctgagattatctactagtttgttaagattttgcatgtccgagtccgatcgagaattaatagtccgatcctgccaggcataggaacgttcagagcaaaacaaacctcccatatttctttcttttctctacaaaaaaaaaaatcactcacaagcacacagcaggtcacaatcacaacaccaggggcgcagcacaggggagaaaggaaagaaaaaaaaaaagaacactagcaagcaagcagaacgtagcgcagcaggcaggcaatcgatctcaaagccggctcgtcagttcttgacgaactggaggccgttggcctgagagtaccgctccatgaagcgcatgaagcggtcccagtcccggggcgtgcgcatgacgtacttggcctcgatccgcgccggcttgccgttgacgaacttggcgctcacgtccacggactgcagcacgccctcgtcgtcgatcatgtagaagcccgtgatgtccccgagctccgccgacgagtcgaacaccgacggctgctcgaacgtgaagatggccacgccgttcgtgccgtcccgggacttggtcagccgcacgtccgggatcgtctgctcgtccgtgccctggatgaactggatcgccggccggaccgccgccgccaccaccgccacctgccgcccccgccggggcgtcgcccgccgcggtcgcccagggcactgcaccgacacgccgtggaacggcgactgcagccgccggctagcgccacctggatgaaccagcgaacacgtgcagtgcagctatagtccgagaagcgtaccgcggaccggaggacatagatatgcagagagtgtgtgtgtgtacctgcgacgtaccgacggggctgccgtgccgacaccggcgaggcggcgaccgcgagagccttcatcgctgcgactgcggccatcctccagctttgccctgctggtggagtggtggccctggactctctgagcgatccaggcagctggggcttgggcgcggcggccggggaagctgcagcctgcggggactgctggtgtggtttccggaaaggaagaagaggtttgagtggtgcagagcgagacgggagtgattgggtggtggtggtgtgttcaaaagacagccatcctttatcgatcatcctttcttctgaagctgacaactaactgcttcggagaatacatacccctccaaggtttcgggtatttgcacgtatgccccttgtttcttgcattggtgggcaccgtatgcccgtgaggcagtgacgcccaaataaaccccaccttccctgatatatgccttccccccatggtttatggtccaccgcttaaccaaaaccaacaatgctatcaccaaccaccaaatcatgtgtggataaagccgataaaggcctcgcaaagcacccctaacttggacttcaccactcactccacatgtctatctatgcagcaaggtttgatatagctacctaaggctgttcacaacagaccgcaacatctcaccctgcaaaacattgttttacatctttatccatggaaatagtctaatgaccgccattttctaggctccaaatggaggatcattcatctttcagaaaaattcagcatggcgcctgacttgagggatggcgtgctgggagtcacgcgatgtagtccgtgtcaccggaggaggaggagacagtgagcgcacgtataatggcggtcgccctcccgtgcggcattccgtcgagcagggggtgggcgttgtccgacgaacggtggaacgacgcgcgtgtggctaggacggacggggttcgagaaacgcgaaggagctcggccagcggttgcggccctgctccaccgcgtgcttggggtggcaccaaacgatgtactttgaaattttctattgcaatggtagacaagctaatatgatgacgacgctataagttccaacatcttatagattgtttgggagcaaggagattgaggaggataaaatcctttgctgttcaactttacctaacaagggattatatgtctctcaatctccatacaaccaaataagctcttacaatctattatgtatattgtagctcgatccaatcatttataagtgatatatcaattcgtgcttcaaaattgttttcacgttaaggagatagattcatcaatacacatcaataaggtaaggtactgtttgactctggagcagaaaaagaatagccccctaacatactaaatcttaccattttaaaaaaactaccaaacctcgctcatgaaacagaatataaccattgtacctcccaaactcggaacataatcattccattatcataagctaagatggagccattccattcaaccactaacctaaaagacaacaggcccctgattanaaaggcacgtgagtggctagctacttaatccgttggcgtcttccttctgtgacatcttatccaagaggggcagaagtgtcaatcttcaccagaaaaatgcaatgttcatatgacatttgtgaaatctgtcattcccaaccgaagacatcctcccacattatcttccactacaactttgagagaaacttttgagcacttgttggcgtcccagccactgacgatgccaactacaacaacctacatcagcttcagcgccctggcaccctatgtgataaaggcttcaactccttcattctccttgttgatggcacttgtggaagcaaaggaa

SEQ ID NO: 20626 - DNA, 874 bp, Zea mays
gtgcgagcaatcagaggatgctcggcctctttttagactgtacgattagcctctccaatccggccgttaatccaaaagcattccaactcacacaggggcgcagaggagaaagagacagacaggcagcgagagagagagagagctcaaagcaggcaggcaggcaggctcgtcgggctcatgagttgctttcattcagttcctgacgaactggaggccgttggcccgggagtaccgctccatgaagcgcatgaagcggtcccactcccggggcgtgcgcatcacgtacttggcctcgatccgcgccggcttgccgttcacgaacttggcgctcacgtccacggactgcagcacgccctcgtcgtccaccatgtaaaagcccgtgatgtcgcccagctccgccgacgagtcgaacaccgacggacgctcgaacgcgaagacggccacgccgttggtgccgtcgcgggacttggtcagccgcacgtccgggaccgtctgctcgtccgtgccctggatgaactggatcgcgggccgggccgccatcgccaccacctgcgcccgccgccatcgcccagggcactgaaccgacgacacgccgtggaacaacgacaagttctgctgttgatgctgctgcctagggccacctgcgacgtggtaccgacggggatgctgtgctgcccgtgccgacaccggcgaggcgacagcaagagccttcatcactgcggccatccctagctagggggtggtctctgtgactctcgagtgagaggcaggcagctagctggccggggaaggtgcagccgcctgcaactgcaaggggctggtgtcccggccggcctcgaggtacccaatggccggccggcctcgaggtacccaa

SEQ ID NO: 20627 - DNA, 1313 bp, Zea mays
cagaaaactgcatgcacggttcgtaaaaggaacacaccagcgggactaaaatggtgtaggcaggcttggcacgaacagcgcaaacagatcttggggagcggcacagcacagtagctgcccacttaaaaagaactagcctcttatatcttcaagcaaatgggagacaacacagaccatctttcccaaatcctcctgtttacaacaacaaccctaggaatacttcctttcgtggtatgatggacaacgaccagattgtaataacacaccctacattttttttttttttttttgccatgggagctgatcagacacttcagttaccctacgtggcattctatcaccaggaaaaaaaaaactaccttgtaatcttcagagatcaggttaccagagaccacaagtacctaacacacaaggatacatgtcatctacatttcaacattgtcgcccgacgtggacacacaagttgcgatccattagcatctcaagccgccttgcaatatgtagccatgttaaggtttcagtttcttctagctaccgggccagaagcctgtatgatggcatgtcctcaatcctctgaatatcttcaattaacagctccctttctagctgacgccgtgtagacttcatgaccgtgttgaagtccatgtaagtagcatgcatgtcaagccattgctgatccatcagcttgaaggttatgcagtagagaatgtcaaaagcttgatcgttttctgaaagaagctttaggaaaactgctccgaacaatgacctcggtttaactgattggagatcaagcatctgaatgagcatgaaggttatattcacaccagcgacagcaaatggatactcccagattgcacggtcaccattctgcttgcgaaggagttcctggaaagatttctgcagaaatgtatgttaatccgatttgtggcaggtatgaataagtatgtgagttaacagttaagtatctcaatgccagcgaaagggcctctagctgagttggttgggtggtttgagtagcactcctcaggtcctgagttcgactccccgtgggagcgaattccaggccatggttaaaaaaatcctctcgtctatcctacaacaagcacaggtctaaggtctagtcctagtcacggtcgtttctcacatgggctacagtgccgctgtgtatgagtgggacaatggttcaaaggttctcgacctgagtgagaaggtcttcttcttatcataatgctcggggttgttttacccccgcaggtcgagttttcttttttagtatcacaatgccatatcatcatgaacatttcaattttcac

SEQ ID NO: 20628 - DNA, 2223 bp, Zea mays
taattgaatgtccgttgcattaaatttaggggacccaatagaaaacatatgacttggcatgggacggtctaaaacctcggcccttttaaagggccgccccttttttttttttttttttttttttttttttttttttaaaaagaactagcctcttatcttcaagcaaatgggagacaacacagatcatctttcccaaatcctcctgtttacaacaacaaccctaggaatacttcctttcgtggtatgatggacaacgaccagattgtaataacacaccctacaaattttttttttgccatgggagctgatcagacacttcagttaccctacgtggcattctatcaccaggaaaaaaaccctaccttgtaatcttcagagatcaggttaccagagaccacaagtacctaacacacaaggatacatgtcatctacatttcaagattgtcgccgtccacataagttgcgatccattagcatctcaagccgccttgcaatatgtagccatgttaaggtttcagtttcttctagctaccgggccagaagcctgtatgatggcatgtcctcaatcctctgaatatcttcaattaacagctccctttctagctgacgccgtgtagacttcatgaccgtgttgaagtccatgtaagtagcatgcatgtcaagccattgctgatccatcagcttgaaggttatgcagtagagaatgtcaaaagcttgatcgttttctgaaagaagctttaggaaaactgctccgaacaatgacctcggtttaactgattggagatcaagcatctgaatgagcatgaaggttatatttacaccagcgacagcaaatggatactcccagattgcacggtcaccattctgcttgcgaaggagttcctggaaagattttggatagttcctagcaaagtacaatagattctccaaggagatgaagcctccacctctaaaatctgtagatgggtctttcccttgccaacccatctctttccactgttctgatattagcccccgaagctcggtgccaggaaaagaagcacaccaaagggactgtagtgcttcctgatgctctctgtttgcactatcatactgaacttctatacggttttgtaacctctgtaggcattcttcctgcacaggcgtcaaatcgaaggaaaggcgcgcatcgctgtccctcctctgcgcgcagacgcaggagagccccctcccgatccacgccgtcgaccccgtcacgacctccgccgaagaggagtggtggaaggcggcggcgcggtcggagccggagagccggcggacggcgacgaaggagccggcgctcccgtccatccctctggtagaacagcgacccagctgggcagctctggcctccccacttaactttgttggtgcctaactttgttccccgctccctctctcccagcctctacgcgcgggggctcatggtgtcgtgcagccggagctccaaccgcggggggcgaggcggcaagatcacacaaggcgggcgggcagatcccgagaaggcaggagaggaacgggtagaggagggaggcttggatttgctcggcttcgcggcggccttgcctcgccacgccacttccgtccgttggttagttggttcgttggcgctggctccgcttcgtcgttctggttgggcggcgcagcgctgctcaggcctcaggacaatgctggtgtgtgctggacggtgcagtgctcctgccgctgctgctttggataaatccatcaatatagggaaatgcttccggctttgcctttgcttgctcggttcgcttttcttctctcctttttattttttcccccgaggccttttctctttactatattttaattaaactaaaccctcccattttaatcctttaatttggggggggggcatataatctctttcgcctgcccttaattcctccaaattcaatatttacggatttaacgatatgtactataaaaatcctaatatacttttttacttgtttctggtagaattaaggcggtttgccttagcaaaactaaaattttcatttttattggacggtccggtaatctaggttgtaggagtggatcggcatgtttggaggagtaggtcagcgtgtttcgtgtatgtaggtccactgagggaggcatcacgggttcccagcctagctcccataaatttaaagctgaaactatcgagtatataaaaagaatcggctctcaataaccgtg

SEQ ID NO: 20629 - DNA, 1600 bp, Zea mays
ctagcctactctcgtgtttttttttttttttttttaaaaagaacttagtagcctcttatatcttcaagcaaatgggagacaacacagatcatctttcccaaatcctcctgtttacaacaacaaccctaggaatacttcctttcgtggtatgatggacaacgaccagattgtaataacacaccctacatttttttttttgccatgggagctgatcagacacttcagttaccctacgtggcattctatcaccaggaaaaaaaccctaccttgtaatcttcagagatcaggttaccagagaccacaagtacctaacacacaaggatacatgtcatctacatttcaacattgtcgcccgacgtggacacacaagttgcgatccattagcatctcaagccgccttgcaatatgtagccgtgttaaggtttcagtttcttctagctaccgggccagaagcctgtatgatggcatgtcctcaatcctctgaatatcttcaattaacagctccctttctagctgacgccgtgtagacttcatgaccgtgttgaagtccatgtaagtagcatgcatgtcaagccattgctgatccatcagcttgaaggttatgcagtagagaatgtcaaaagcttgatcgttttctgaaagaagctttaggaaaactgctccgaacaatgacctcggtttaactgattggagatcaagcatctgaatgagcatgaaggttatatttacaccagcgacagcaaatggatactcccagattgcacggtcaccattctgcttgcgaaggagttcctggaaagattttggatagttcctagcgaagtacaatagattctccaaggagatgaagcctccacctctaaaatctgtagatgggtctttcccttgccaacccatctctttccattgttctgatattagcccccgaagctcggtgccaggaaaagaagcacaccaaagggactgtagtgcttcctgatgctctctgtttgcactatcatactgaacttctatacggttttgtaacctctgtaggcattcttcctgcacaggcgtcaaatcgaaggaaaggcgcgcatcgctgtccctcctctgcgcgcagacgcaggagagccccctcccgatccacgccgtcgaccccgtcacgacctccgccgaagaggagtggtggaaggcggcggcgcggtcggagccagagagccggcggacggcgacgaaggagccggcgctcccgtccatccctctggtagaacagcgacccagctggccagctctggcctccccacttaactttgttggtgcctaactttgttccccgctccctctctcccagcctctacgcgcgggggctcatggtgtcgtgcagccggagctccaaccgcgggggcacaaggcgggcgggcagatcccgagaaggcaggagaggaacgggtagaggaggggggctattgctcggcttcgcggcggccttgcctcgccacttccgtccgttggttagttggttcgttggcgctggctccgcttcgtcgttctggttgggcggcgcagcgctgctcaggcctcaggacaatgctggtgtgtgctggacggtgcagtgctc

SEQ ID NO: 20630 - DNA, 1419 bp, Zea mays
tttaacatggacagcgctgtcacgcctcacaatagtttacctgttcagcatccagaggggagagcaaagcaggttcatgaatctgtgctaacaacctggtaagtctgtaggtcatatggcacatccaatgcagcaggttaatgtttgctggaaattgtaagatcattctcatgtcgcagaattgtaagtgatctggaactgccaggagacttcgtcgcaagaagaccattctgtacagttaagctcagatctgacacaacaagagcgagaataggagaacttgaatcggttggttgcaggcagagctgaatggccagcccactgtgagtcacgcccttctgtgagggctatgcaacaggcgaggaggtgcttcacggcaagattggaaaactgctgatgctgccataccgctagactaatttgttgatgaggcagatgctttctgaacctctgttgttatagcctcagcaaggtctgatgcctcgtactcacttccaaagcaccttactgtctccaagcatggatctagcaagtacatattgtgagagctttctataagatagtcctgaccaacttcctctactcttttaaagaaaacacggtactcctgagctatctgtcttactgcactgatggggcctgttagtcctactattcttgggtcaaactcagtaaggtatgccttaagctgagcaggtgaatcacgttgtggatcaattgtgacaaagagtggtgtaatattgatatcgtactttgactctaacagtttaacaacatcagctatcttctgaacttcagctggacccacatctgggcatgatgtatagccaaagtacatcagattccactttccccgaagctttgattcagtcacctcattgttttctgtatcatacagcttaaatggccctcctattgcaggtctattggtagtacatcttttgggaacattggtctgtcctggtactttagcgaagggaactgcacgcctctcatcattgtaatgaacaaatgtggctatcccagcaaaagcaagcagagcagatggagcaatgtaatatattaatggctgagaggttgactcattctgttcagaaaactgtctcattggcctatcatacttggagcttcccccactagaatagcctctggaatggtaaacccgcacaggtaggatccggggtcgccgcaacggaggcagctcggcggtagcgcgcaagcagcggagcagcgaagccttgaggacgcgcggtgtcaacatggccgcggtgcgaggcggtgtgatgtaccggactactcgactagtatcggagagtcggggacatgaggaaggcgaaggaccgaaggagggagtgagaagggaaaaaaaataatgcggcgaaatgaaaattctatgggcggtcttacctcgggtccaag

SEQ ID NO: 20631 - DNA, 2933 bp, Zea mays
caaatagtcattatgttttattaatattctcaaaatcgtaaaaccattacacaaatagaggctagagttttttttttgtaaaacatagacaagaatatctcataaaaataacatggctgtcaataattatttaataataagatatttcaattaataaatcaatatcatatgtgtataaataattatcatgaaactataaattgtataaaataatgtactccaataaataaataagctaaagtgttaaaataatttataccaacaaataaaataagtttaaacttcataaaaatactaaaattagttaatctttatgtgccattaataattttaaattaatactaaaaaatattaatagacacgtcattagtaataataaaattaaatattttgccactctttacgaagagaacttttaaataggttcatgatattttgttttctttgtggatacgaatactatcgttcaaatacagatttagaatcagacgcagaaaacactcaaaatgaatatgaaaaatattcatttagtattcatattaagatccgttccaaacctctagaaccaataggtagcactaaaactagctaacaacttattatctaactaacaattagctctagaggtttagaatatggtctaaatagatatgaatatggatatctaaattagaagttttgcggacatcacataattcgaatctattccattttccatccctacagcttggcaacgaagaatagattgttttatgtcgcaggcctgcaggttgcagcgtcaagactcaagaatctactcatcgggttccaaggcaatgcaaaccatagtttaaccccaacgtacaacaggtggccaccagcgtcacagtaagcaggccatcaacatttaacaaggcaaaaatcatcataagatcacgccggctaagcctaaattgcaggcgtcagcttacaccaaacgcacgagcacacgggactataaaataaaacaaaaggtgctacagctaacactggtccactactactgcacaacaggcttaactctactcactccagtggcaaaaggaggctctcacacgatgtcaacacctagctaggccctagaacaaacacaaccgcgaatatgaaatgaggatggcgaggccctccggcctcgggcaggcataatggcagcaggtggctgctgtcgtgccggcgggtagacaaaaagcacgtatcgagtactgcctgcaagcaaaggggaaagccgaaagcgaggtggcattccgtgcgtcccatggaaaagcgagttcggacacgaatcaaaagcgacgatatagatctactaccgacataacatggacagcgctgtcacgcctcacaatcgtttacctgttcagcatccagaggagagagcaaagcaggttcatgaatctgtgctaacaacctggtaagtctgtaggtcatatgcctcatccaatgcagcaggttaatgtttgctggaaattgtaagatcattctcatgtcgcagaattgtaagtgatctggaactgccaggagacttcgtcgcaagaagaccattctgtacagttaagctcagatctgacacaacaagagcgagaataggagaacttgaatcggttggttgcaggcagagctgaatggccagcccactgtgagtcacgcccttctgtgagggctatgcaacaggcgaggaggtgcttcacggtaagattggaaaactgccccgcgtgccatactggaaaaaaattgtagtaaacttgcgttggcttatacgacataaaaagacatttacataatataacttgatgtgcaggatatactgaaatcaatacaagacaagaaatagcttggaaattcagcgtgtttgaattgtgatcaggaattcaggattaaaccattaatcaaaagaacgcaacaataagaacagattgcttttcaggtctgtaagatgaagagatgaactgtggattgaaatatatatatatggtaggcagataacacgaagaatttgttactagaacggtacaatcatgtgggtttcatattaataactcgctatcagaggaaataccatttccacttcaaaaagtttctaataagataaaaggttggaacataaggccaaatattaacaatgcagctattgttttactttcaggtaggaaaaaggcttgcaaatttataaacatgcatagctttgcttttgtatcacaaagtgcaatcaacaaaaaattagatagtacaccaagtgccaatacccgctagactaatttgttgatgaggcagatgctttctgaacctctgttgttatagcctcagcaaggtctgatgcctcgtactcacttccaaagcaccttactgtctccaagcatggatctagcaagtacctgtaacttcagatggtcaatgtctggaaacgtaaatcaacattggcaatgtgcacaatatgcacttacatattgtgagagctttctataagatagtcctgaccaacttcctctactcttttaaagaaaacacggtactcctgagctatctgtcttactgcactgatgggacctgttagtcctactattcttgggtcaaactctgcagttaaaatgaggtgaatcatcagttgcagcatagcctaaaatctcgatttctgaacccagtagcagaataccttaccagtaaggtatgccttaagctgagcaggtgaatcacgttgtggatcaattgtgacaaagagtggtgtaatattgatatcgtactttgactctagtaaaaaaaacaaatcaagcaccataagcaattatgaagaccgtaaattaataatgcacatggatgaatcagaaacttattcattgcaagccaattataatctactgtaaattttctgaagtagctggtcacagatttgacactgactgacagaagtcaagacagtaagg

SEQ ID NO: 20632 - DNA, 1190 bp, Zea mays
ggaacaccagcaggcagcagcgcgtataaccatttttttgtttttttttttatcataagttcagttcgattaaattaaaaaaaaggaatgcaacataacgtcataacctacgaatcctggaatttaagttccatagtactacaaggcaccaaagaacagcattgctattgctaaaagtgtcgcttattcattgacagagaacccggcatatgggtatcagatcattattttgcctcttccagaataccagatgcctacaacctgattctgggaacacatccggtcatccatgtccaatgcgtagggacagttcacaatgtcacgtacgctgtcgcctaaagactccgagatagaacattttagtggcagagtagatagcgcatagtaaaagaacctactgttgattgcttcatgaatcgtgagcatgcactttttgttcgtctctttgtgcaatatccccaagaagatccttaagctcacccttctggtgcaagcttaatatgatgtcagaccccccaacaaactctcctttgataaatatttgtggaaatgtaggccagttagtgtgggctttaacacactctttgagcttaagatccccaagaatgtctctaccacagacagggacgccatattgctggaagaccttaacagccagtgcactgaagccacacattggagactcaggaaaacccttcatgtagatcaagactgggttctccttgatatcctgagcaatagcgtcatgcaaagtcatgtctgaaattctgctctttggctcgaaatcttgatgtgtatcaggatcagcagctattcgtgttgtagttgagttcgtgtttgcattgggatcaccaccatgtggtgatgaatagttcataaattgctggaatgctggttggtacataacagaagttgtggtcggcagtccgtgagatctcaggagccctctcgcggcgagggcggtcgaaaccaacctcttcatggtacccatcaaaaggaagaggcaatttcaaagtccgggtcgatctccactctgcgccggccgcttccgcctaggagtggagggaacgacgagagaagggaggaggatggatggccaccggagatgcagacgatgcggcgtgtgcgtactgtcttctcaggtgagctgggccgctgcggcaaccgtgttcgatgtgataatgaattat

SEQ ID NO: 20633 - DNA, 1017 bp, Zea mays
catttaatacccggttcggtggttctttctttcgttttgtctggggcttttttttagtttggggtaaccaaacacccccttattcatttgacagagaacccggcatatgggtatcagatcatgattttgcctcttccagaataccagatgcctacaacctgattctgggaacacatccggtcatccatgtccaatgcgtaggacagttcacaatgtcacgtacgctgtcgcctaaagactccgagatagaacattttagtggctaagtagatagcgcatagtaaaagaacctactgttgattgcttcatgaatcgtgagcatgcactttttgttcgtctctttgtgcaatatccccaagaagatccttaagctcacccttctggtgcatgcttaatatgatgtcagaccccccaacaaactctcctttgataaatatttgtggaaatgtaggccagttagtgtgggctttaacactctctttgagcttgagatccccaagaatgtctctaccacagatagggacgccatattgctgaaagaccttaacagccagtgcactgaagccacacattggagactcaggaaaacccttcatgtagatcaagactgggttctccttgatatcctgagcaatagcggcatgcaaaggcatgtctgaacttctgctctttggctcaaaatcttgatgtgtatcaggatcagctgctattcgtgttgcagttgagttcatgtttgcattaggatcaccaccatgtggtgacgaatagttcataaattgctggaatgctggtcggtacataacagaagttgtgctcggcagtccgcgagatctcgggagacctctcgcggcgagggcgatcgacagcaacctcttcatggtacccatcaaaaggaaggagacaatttcaaagtccgggtcgatctccactctgcgccggccgcttccgcctaggagtggagggaacgacgagggaaagggccgaggaggccccgaccccgccgcgccggcccccctg

SEQ ID NO: 20634 - DNA, 1754 bp, Zea mays
aaattatttaaaatgaaaataaaacccatgttaattcattaataaattattaaaacccgtgtaaattatgcattaatattaatttgttttattcttaccctatttaacaagcgtcattattttgtagcaaagtgaaatattatattaagaacctttgtttattttaaagctttatggttttaaagcacttgaaattggtttttgtaagcaacttattttctaactggattaatgtttttatatcagcgttttttatcccactttaaaaaagattaaaaaaaatctgggttggaaactagctgtcgccccctaaattcgatttgatacgtggcgcaccccaagctgcaacacgttctgtcgttctcgcttgaggcggcccgcggccttctcgaagccctccgctcgctccgtgctcgtggctcccgcacgatccccacattccttggccggctccgcgctcgtgctctcgttgggatcgttgtcagttcaggtacggtggcgatgaggtcgtccgtggcccgcctgattcgctcctcctctgcctcgccctcccgtctcagtggaaatgcattcttcggcaatgccacacccagtgatcagaggcacattgagaagccttttaaagtgaaggaggcagaacctgtgaatgtgacaaaaccttcaccacacaagctgctggttctaggaggaagtggtttcgttggatcacacgtttgcaaagaggctttggacaaaggtttagttgtctctagtcttaatagatcgggaaagccatccttaaatgaaccttgggctgacaaagttatatggaaccaaggcaacctccttgaaccagcttcattgaaggatgctatggataatgtttctgcagtggtatcttgtgtcggaggttttggatcaaattcattcatgtataagattaatgggactgcaaacatcaatgccatcagggctgcagctgagaaaggtgtaaagagatttgtatatgtgtcagctgcagactttggattagtgaattatttattgcaaggctattacgagggcaagagggcttctgaagctgaattgttgtcaaagtttacatatggaggagtgatactgaggcctggttttattcatggaactcgtcgagtgggcagtgtaaagatacctcttggtcttgtcggttctcctatgcagatggtgctccaaaatataaaacctttgactaggttaccacttatcgggccgctattgactcctcccgtcagtgctgcctccgtggggaaggtcgctgtgagagcagcgacggatccggtgtttcctcctggcatcgttgatgtctacgggatcatgcgttacagcgagcaaaactaagctgcctcattcaccgggcagtatatacatgccgctgtacttttgttacagctgtttctttgtttgttttacatgtactggtatccttctttaactcacttgtttacgagacgataaacattcaataaatatgtattttagcgacatgtctgtggtactgttttttttttaaaatattttatcgtatcttgagcactcaactgcaacgcgttttaaaaaaaatgccgtgctgatgaagctgtttttcttgtattagtcgtgtttccagtctttcctctgtttccctcctcatttttaagagttctgaatgcaattatctgttgaacagatgtattcttaagctgtagttgcaacggcttgctccttgaactcacactgaacacgcaactgcaggtcga

SEQ ID NO: 20635 - DNA, 1322 bp, Zea mays
caattggggccccggcccccggaacaaacgaaatgactcatcatgacattgcatcacaaggtagattcttgtatacatacgttgctacatactgtaccacccaccaaaaaatatattgcactctggtaggtattctctcagagctcagaagaaacctgaaaatcgctcaactggacaaaggaccagtaagatataaagaggagggccataggcgaatatgtctccggtggatcaggtgagtagatcactcaagagcatgtacagcagcctgtgttgaccagatcacctccccgccacaagaccactaaacacttggctgttcccagcctgtgtcgcctcccactcgatagaagacagcagtatttgagagagcgtgattaccacctgcttcatgtccggccgtagaacagggtcttcgtccacgcactgttttgctagcatggccatcttgtacgcacagtcataaggatacagatcccttagattatggtcaatgcagtctttcaggttccccatatacgttgaattaggacatttccttacggcagctaacataactgatgccagtgagcatcgctcggagtttgagcttgcacccattccttcagctcttgtaatcgcctcctttccagatattagctcaaaaagtaccacaccaaaagcatagacatcactcttcgtagttgccaggccatcccgcaggtattcaggggctaaataaccaaaagttccaacaaccttagtgacagaagcctctgcgtcattggatttcactacaagttttgcaaggccaaaatctgaaatcttcgctctgaaggaaccatcaagcaagatattacttgatttaatgtctctatgaacataatgatctttggtgtgctcatgaatgtattctagtcctctggcagcatcaagtgcaatttggacccgaaagatccatgaaagtgatgaacacccctttctttcaggatcatgtagatgatttttgagcgaaccattttgagagtactcataaaccaggaaaagctcatccttgcttgctgcatagccaatcaattctaccagactagcatgatgaaccttgcaaagaactttcatctccactatgaattcttttgttttagtggccatcattctctttatcgcaacctcctgctctcggagaacaccgtaatagacagaaccatatgtaccatgaccaagaagatttgcatccgaaaatgagtcagttgatatgagtatttcttcgtgcgtaaacacaataggcttctccctatcaaatacgtcgggggggggggggtgagctctctctctctctctcc

SEQ ID NO: 20636 - DNA, 1252 bp, Zea mays
  misc_feature (116)..(117): n is a, c, g, or t
gtccccacaaactcgatagatttggcatgtttgcctttagtaaccgaaagtttcgaggtatatatgcgttggcaagcatctgtacccttcgaggcaacatcaggggaaaaaaaaanntagtaaaaagcatttagccttagcgagcaggtttacacaagctgttgaactgctgctgcagctttgtaaccttacagagttagagtggtcatcagaagcgatgctcacttgtcctctctccgtattaccgtctcccatgtcctctaatcatatcaacaagagccaggcgctgtaaaaaaaaagtagtagtaggaattggaaccctacacgactcgaaatgattgtgctatctgtttgaggtctttgtaatgcctcttccactgcagaccgtttgcagttacactgaagaggtagagcctgttcccagctgccgtggcggtgatgaacacatggggcggctccagctcgaactggtagtaagttcttcccgaatgcgccgccgtctccgaggacaggaccttcccttccacgttctctccgatgacctccggaccgaaggcggtgatcaccttctccgggctgccgatcttctcgatggtcgcgtcgtccaggtcatctgcgaaccggcgaactggggccacgatgacgaacagccggccttccttggggtttgcgaagcgcaggtcgatctccgtgccgcccagatcagcaatggacaccgggacctcatcccagccgtctggaactttgaagctgtacgggatgatggggctccagccaactccgtggccaccggacttgtcgtctggcctgcggtacgttctccaacctgtcattttcgtcaggttcagacaagccggggaccctcccggcgagcaggccctggttggccgccagaccacggcctgcaaacccaagcactgaggcgacagctgctgcggaagccaacgcacgcctccccaccaccactgctacaccctcctgatcttcacgccccactgacagggagggcccgctgaagcacgtcacagccgccgccctgcccttggcgacggcagaaggtttggcgaggaacagggaggagctcggggagagcagcactgtcatctctgcaggatggtgtttcccagacctccgcgattctcccctgcttgcctctctggttgttcttggtgtgggacgatgggctgctgcctgctggagacttctcttctgttcgtttgctggatccatgccggcctcgaggtacccaatg

SEQ ID NO: 20637 - DNA, 1381 bp, Zea mays
aaactgaaggatataaattcaactgaacagagatatgaaggcaactgtccactgacaccaaatgaggtgggcatttttctgcgtgctatgggctatcctgaatccacgtggatataccttgcagcaggtgaaatttatggtggtgaaaagtatatatcaaaattgagatcatacttcccaaatttggttagcaaggacatgctagcaacagaagaagagcttgcgaaattcagtaatcatgcttctcaagttgctgcccttgattacataatcgcagttgaaagtgatgtgtttattccatcacactctggcaatatggcaaaagctgtagaaggccatcgtcgatttctagggcatcgtaaaactatcactcctgacaggaaaggattggtggaactctttgatttactggaaaaaggggatctcacggaaggtcctaagctgtcggcacttgttactgacatgcacaagtacagacaaggggctccaaggaagaggtatggctccttgccaggaagcaagggcagagcacggcttaggagtgaggaatctttttacgaaaacccgtttcctgagtgcatctgtttgactgggaggtcctgatgtatagctttgcatgatgatgacacggtgcacccatcattggaagtgtgctagtgcttaagtttggcgtttggagctctaccggcactttgtgatgaaaaaagctgatctggtactcaaggacacaagttagtgaaggacgtcttccttctcgtgatcaacatgcaatgaccttgttggaccagatggagggctggcgccactgcaaccaagaaaccgtacatgaactgttttgtccccacaaactagagagatttggcatgtttgcctttagtaaccgaaagtttcgaggtatatatgcgttggcaagcatctgtaccattcgaggcaacatcagggtaaaaaaaaaatatatagtaacatgcatttagccttagcgagcaggtttacacatgctgttgaactgctgcagcagctttgtaaccttaagagagttagagtggtcatcagaagtgatgctcacttgtcctctctccgtattaccgtctcccatgtcctctaatcatatcaacaagagccaggcgctgtaaaaaaaagtagtaggaattggaaccctacacgactcgaaatgattgtgctatctgtttgaggtctttgtaatgcctcttccactgcagaccgtttgcagttacactgaagaggtagagcctgttcccagctgccgtggcggtgatgaacacatggggcggctccagctcgaactggtagtaagttcttcccgaatgcgccgccgtcgcacgaggacaggaccttcccttccacggggaacccggccggc

SEQ ID NO: 20638 - DNA, 3478 bp, Zea mays
agagatatgaaggcaactgtccactgacaccaaatgaggtgggcatttttttgcgtgctatgggctatcctgaatccacgtggatataccttgcagcaggtgaaatttatggtggtgaaaagtatatatcaaaattgagatcatacttcccaaatttggttagcaaggtatttacactgtttcttttgtgctgactgtatctaccgctttcttgctgtgctactaaaatttcagtttttcaggacatgctagcaacagaagaagagcttgcgaaattcagtaatcatgcttctcaagttgctgcccttgattacataatcgcagttgaaagtgatgtgtttattccatcacactctggcaatatggcaaaagctgtagaaggccatcgtcgatttctagggcatcgtaaaactatcactcctgacaggtaaacatgggacttatcctgctttgttttatctgatcttgctacttctctgatttctaactttacctaatttctattttcttcttctgaaacaagtctctgataagtgcacacttatcttgcacatatttcatagatcccagtatcgttttggatgtttcttttctgtggacatttgcaagtgtatggagttataagtcctttatttgtgcagtatccttttacttactcctctttatttttacacttttgacattatgctctatcaatcttcgccatgtaactaagtgttcgtttagttccttcttcaaaatcaatctgtttaaactgcaggaaaggattggtggaactctttgatttactggaaaaaggggatctcacggaaggtcctaagctgtcggcacttgttactgacatgcacaagtacaggtgattttatttaatttatagctatggatagccatgtgtacagtgcttttctttaactcagagattgtattaagaatgcatttccctgtatgcagacaagggactccaaggaagaggtatggctccttgccaggaagcaagggcagagcacggcttaggactgaggaatctttttacgagaacccgtttcctgagtgcatctgtttgactgggaggtcctgatgtataggtaggtatgatcctatcgtatacgcagtatgcgactgtttgtgggcttggagagaattgagatagagtgctgttgattaaagtgtatttgtccaaaccatatcacctcggcgatcctttccagatgaactgacgtctgttcttaattgcagctttgcatgatgatgacacggtgcacccatcattggaggtgtgctagtgcttcagtctggccattggagctctaccggtactttgtgatgaaaaaagctgatctggtactcaaggacacaagttagtgaaggacgtcttccttctcgtgatcaacatgcaatgcaatgaccttgttggaccagatggagggctggggccactgcaaccaagaaaccgtacatgaactgttttgtcccccgcaaactcgagagatttggcatgtttgccattagtaacgaaagtttcgaggtatatatgcgttggcaagcatctgtacccttcgaggcaacatcagggggaaaaaaaattagtaaaagcatttagccttagcgagcaggtttacacaagctgttgaactgctgctgcagctttgtaaccttacagagttagagtggtcatcagaagcgatgctcacttgtcctctctccgtattaccgtctcccatgtcctctaatcatatcaacaagagccaggcgctgtaaaaaaaaagtagtagtaggaattggaaccctacacgactcgaaatgattgtgctatctgtttgaggtctttgtaatgcctcttccactgcagacctgcaaaagattcccagctatttattgtattattcaggataataataaaaaaaagagttggcttgcatttctgcgaacaatggctttaccgtttgcagttacactgaagaggtagagcctgttcccagctgccgtggcggtgatgaacacatggggcggctccagctcgaactggtagtaagttcttcccgaatgcgccgccgtctccgaggacaggaccttcccttccacgttctctccgatgacctccggaccgaaggcggtgatcaccttctccgggctgccgatcttctcgatggtcgcgtcgtccaggtcatctgtaggacgggaaccatatcacaacatttcttgagcattttgttcaggtctcagctcacctgcgaaccggcgaactggggccacgatgacgaacagccggccttccttggggtttgcgaagcgcaggtcgatctccgtgccgcccagatcagcaatggacaccgggacctaagttggagccatggtaagagaaacactagtctccgcatcagaaacagaaaaagcaccaggtggaaacctcatcccagccgtctggaactttgaagctgtacgggatgatggggctccagccaactccgtggccaccggacttgtcgtctggcctgcggtacgttctccaacctgtctgaacgattcgatcagcatcatgaaaacaattcaacagtatttcactgcagagaaagaagaaaaagaagaagaagagctcaccattttcgtcaggttcagacaagccggggaccctcccggcgagcaggccctggttggccgccagaccacggcctgcaaacccaagcactgaggcgacagctgctgcggaagccaacgcacgcctccccaccaccactgctacaccctcctgatcttcacgccccactgacagggagggcccgctgaagcacgtcacagccgccgccctgcccttggcgacggcagaaggtttggcgaggaacagggaggagctcggggagagcagcactgtcatctctgcaggatggtgtttcccagacctccgcgattctcccctgcttgcctctctggttgttcttggtgtgggacgatgggctgctgcctgctggagacttctcttctgttcgtttgctggatccatgctgcggaggcagttttcgaccacaagacatgggtggacaggatgatcttcagagttgggacacgtctcacacctacattgtttgagcgcctcctcttgatttcacttattgttttttttaaatcagatacttttttactatgaaaaatggaagtttgtttttgtttatttgcaggagaaggagatgctcctgtggtgaattctagaacacgcgtcagactacgcctcctcttgttttcggtttctccgtgcatttattactatacagtaataaggactagctttttttctctcttctctccaaacaaactactccctccctcgtaaaattcaaggtattcaaataattctagaaccaaataataagtctgatagaagactaacttacccttcactagttagttgttttgttcatcaacttgcttaggttacggattatagtttataaagagcatgtatagatgaggttgaaagacaaac

SEQ ID NO: 20639 - DNA, 1191 bp, Zea mays
gtccccacaaactcgatagatttggcatgtttgcctttagtaaccgaaagtttcgagggcaagcagcccgccccttcgtggcttcttctgggaaaaaatatatttttttttttttttttttagtaaaagcatttagccttagcgagcaggtttacacaagctgttgaactgctgctgcagctttgtaaccttacagagttagagtggtcatcagaagcgatgctcacttgtcctctctccgtattaccgtctcccatgtcctctaatcatatcaacaagagccaggcgctgtaaaaaaaaagtagtagtaggaattggaaccctacacgactcgaaatgattgtgctatctgtttgaggtctttgtaatgcctcttccactgcagaccgtttgcagttacactgaagaggtagagcctgttcccagctgccgtggcggtgatgaacacatggggcggctccagctcgaactggtagtaagttcttcccgaatgcgccgccgtctccgaggacaggaccttcccttccacgttctctccgatgacctccggaccgaaggcggtgatcaccttctccgggctgccgatcttctcgatggtcgcgtcgtccaggtcatctgcgaaccggcgaactggggccacgatgacgaacagccggccttccttggggtttgcgaagcgcaggtcgatctccgtgccgcccagatcagcaatggacaccgggacctcatcccagccgtctggaactttgaagctgtacgggatgatggggctccagccaactccgtggccaccggacttgtcgtctggcctgcggtacgttctccaaccattttcgtcaggttcagacaagccggggaccctcccggcgagcaggccctggttggccgccagaccacggcctgcaaacccaagcactgaggcgacagctgctgcggaagccaacgcacgcctccccaccaccactgctacaccctcctcttcacgccccactgacagggagggcccgctgaagcacgtcacagccgcagccgccgccctgcccttggcgacggcagaaggtttggcgaggaacagggaggagctcggggagagcagcactgtcatctctgcaggatggtgtttcccagacctccgcgattctcccctgcttgcgtctctggttgttcttgctcgagccgaatcggctcgag

SEQ ID NO: 20640 - DNA, 2074 bp, Zea mays
gtcccccccccccccccgaagtgaggcctcccattgtgactatcatgggccatgttgatcatgggaagacaactctgttggattatatacgcaagagcaagttggtcgctgcggacctcgagccggccgggacagggattggagcatatcaggttcttttaccagtagatggaaaccatcaagcctgtgtttttctggatactccaggacatgaggcgtttggtgcaatgagagctcgaggagctagagtaaccgatatctgtattgttgttgttgctgcggatgatggtgttcggccacaaacaagtgaggcaattgcacatgcaagggcagcaggggtgccaattataatagcaataaacaagatagacaaggagggagctaatgcagaacgagttatgcaagaactttcccaaattgggataatgccagaaatgtggggtggtgataccccaatgatcgagataagtgctcttactggggataatgttgatgaacttctggaaactgtcatgcttgttgcagagttgcaagaattaaaggcaaatccacataggaatgcgaagggcactgttattgaagcatgccttgacaaggccaaagggcctcttgctaccttagttgttcagaatggaaccctaaacaaagctgatattattgtgtgtggtgaagcttatggaaagatccgtgcattgtatgatgactgtgggaagctcgttgacaaagcaggaccatccaatgcagtgcaggttattggcctcaataacgttccccttgccggtgatgaatttgaggttgttgacaaccttgatgttgcacgtgaaagggcgaatgggcgtgctgaagcactgcgcatagaaaggatatctgcaaaagctggggaaggaaaagtcacactctcagctattgcagcatcggtttcatctgcgaagcaagttggaattgatacacatgagctaaatgttatccttaaagttgattttcagggttcaatcgaggctattaggcaagccatccaaactcttccacaagaaaatgtctctctgagattcctccttcaaggtccaggagatgtgagtgttagtgatgttgatctggctgttgcttcggaaggaattatatttggctttaatgtcagagcaccaggatcagttaaaaactatgctaagaagaaaggtgttgaaattcggatgtacaaagtgatctatgatttgattgatgatttacggaaggccatggaaggtcttctcgaacccgctgaggaggaagtaccaattggttcggcaaaagttcgagctgtctttagtagtggcagtggaaaggtggccggatgcatgattacaacaggaaaagttgttcaagattgtaatgtgcgggttcttcgtaaagggaaagaagtatatgtgggttcgcttgattccttgagaagggtgaaagaaactgtgaaggaggttggtgctgggctagagtgtggtattggggtagatgacttcgatgaatgggaggaaggtgacatcatagaggcattcaataccgtgaataaggcaagaaccctcgaggaggcctctgctaccgtgactgccgcactcaaggatgcaggggtccagctgtagaattggcaacacgctgatactcttttttattaatggtatgaaatgttaatttatatatactttgaagctgaatggtgagctgaagctattgtgctgaagctgttgtgagctggaccggtggaccgtttccctgattccttcggtggtggctgaagctgaatggtgagctgctggagagtggagacgtggagtggtggccggtgggcgcctgggcggtggctgccggctggtgcagactgtgcacttgtgcagtgcagtggcgctaatatattgtgtgtggctgtggaagatgcatgtgtggatcggctgtctgtagtgagatggaagatactgtatatagcatatcacaccatatattcatcgtatatacattaattattgatattgaattttgtcggtcaagtgtatgggccggccaagccaaactgtaaaaaaaaaaaactcgtcgggggccccggtac

SEQ ID NO: 20641 - DNA, 558 bp, Zea mays
ttgtgactatcatgggccatgttgatcatgggaaggtactaagactgatgctaactcttggaactcacaacttttctaaagtattggttgtatgacactgctatttttgtttgcagacaactctgttggattatatacgcaagagcaagttggtggcatgtgaagctggtggtataacacaagggattggagcatatcaggttcttttaccagtagatggaaaccatcaagcctgtgtttttctggatactccaggacatgaggcgtttggtgcaatgagagctcgaggagctagagtaaccgatatctgtattgttgttgttgctgcggatgatggtgttcggccacaaacaagtgaggcaattgcacatgcaagggcagcaggggtgccaattataatagcaataaacaagatagacaaggagggagctaatgcagaacgagttatgcaagaactttcccaaattgggataatgccaaaaatggggggggggggataccccccaatcctcgaaaagaggggtcctactggggaaaaagggttggtgaacttccggt

SEQ ID NO: 20642 - DNA, 2297 bp, Zea mays
  misc_feature (742)..(742): n is a, c, g, or t
  misc_feature (793)..(793): n is a, c, g, or t
  misc_feature (1152)..(1152): n is a, c, g, or t
gctggactttagaaattcactgtgtcagcatggattttcctaagcagtgcaacaaaatgaaaatagctatgttttcaagcttgcattatacctccgaaggatgattccttttgttttaaccagtggttgaacgctcatggaacagcagtgatataagcatcctaactttttaagaaaaattctttacaggttattggcctcaataacgttccccttgccggtgatgaatttgaggttgttgacaaccttgatgttgcacgtgaaagggcgaatgggcgtgctgaagcactgcgcatagaaaggatatctgcaaaagctggggaaggaaaagtcacactctcagctattgcagcatcggtttcatctgcgaagcaagttggaattgatacacatgagctaaatgttatccttaaagttgattttcaggtagtggggatatatgtaaacaacatgggcattttgttcttttgtttataataataatggtcctttctttctgaaaagactaacaattgatcaatagggttcaatcgaggctattaggcaagccatccaaactcttccacaagaaaatgtctctctgagattcctccttcaaggtccaggagatgtgagtgttagtgatgttgatctggctgttgcttcggaaggaattatatttggctttaatgtcagagcaccaggatcagttaaaaactatgctaagaagaaaggtgttgaaattcggatgtacaaagtgatntatgatttgattgatgatttacggaaggccatggaaggtcttctcgaaccngctgaggtaacatacacttttgggattttagatcagttgactgagagaagtccataaagtcaatgggatgtcatcattaattgtagttcaacatctttccaaagttgacagatctttcatcctttaattaaatgaatattcactaatttatccattaggattctaaactgggattttttctgttttgtaaagacagtaagtttagtgacatgtttttttatcctgaacacacgtttcttctccaggaggaagtaccaattggttcggcaaaagttcgagctgtctttagtagtggcagtggaaaggtggccggatgcatgattacaacaagaaaagttgttcaagattgtaatgtgcgngttcttcgtaaagggaaagaagtatatgtgtgttcgcttgattccttgagaagggtgaaagaaactgtgaaggaggtatagaattgacactcgagtcttctgatctttgcactgcagttcacttactggttaattagttaatggatgatgcccatttcgtctttgtattggacaaacaaaattactttctgaacaggaaaaactacagttaccttagtgattcaacaatactttgttatgttcatgcatccaatcagtgctaacaatgtgaactggatttttcctttccactaggttggtgctgggctagagtgtggtattggggtagatgacttcgatgaatgggaggaaggtgacatcatagaggcattcagtaccgtgaataagacaagaaccctcgaggaggcctctgttaccttgactgtcgcactcaaggatgcaggggtccagctgtagaattggcaacacgctggtaagaaatataagtggtttaacagttgcagcagcctgtggccaacaattttctggcaacgaatctggagggcgctggtcgaagttcctgaagaataacaagaatgttgttgtacaaactcgacatatgaagatcaattctacaccaccagtgtctgagctcgaccatctcacgcctgccagagctgcatctgctgctgaaagttgatggagtcttttgctattataatattcatttaaacaagcttctctcttctagtatctataaatttaacttctctaaaatggtacctataacttaatctcttctctaaaatagtattaagtatctttttactctcctttcttattttcccagaagtgaaatatcgaaatgttcctagagattttgtttatagatcataatgctcccacattgctatatgtgaccgaacatcccggtggttttattttacgttcggaaatatcgctgccaagatgctgagtataaactttattcttaagaagttcagattgcagtactgaagtaagttgaagcagctggttcatgcagaaagcaagtttagatcaataaaagatatcagtaagcaaaaaaaaaaaaaaaaatttcagatttgaacagtgagctgtatggaacttcatatttgaacagtgagctgtatggttccaaggtt

SEQ ID NO: 20643 - DNA, 942 bp, Zea mays
actggctttgttggggttaggcattagtccctaaaaccaaacacctctttaatccaaaactggaatatgcagtacattatttagaccccaatcattcagcccctaaaccacataatgccacttgaagcaatcgatcggtgaatgtgaaacacatatggtaaatctgaagagcaacgagattacactgaccggtaaaagaaaagaaaaggaaagttaaattattaatcacccactccgacagcagtgcatgacgtccacaaccgtagaacgtaggtttaactaaatataacccgaatccgagcccgcgcgcaggcgcgcgagcaagctgatcaagcggcggtgcagcgctcgcgcgcgaagcctacgcgtccgttgggcacgtcgaagagcacacggtggttctgctgctgcatgctggcgatgacgttgagcacggtgttgacgccgtcgggcgccgcggccatggccaggcagctgatggtcccgtacgtgctgtggatgaccacgttctcctccggcagcgtcacctgcatgccgtcgaacagcagcgtcacgggcggccacgcgacggcggtggtgttgaagcacgtgtcgaaccctcccagcgaggacacgggcgcgccgacgcggcgccggacctcgtcccgcacggccacgtacgccggcgccaccagccgggtgaacatggtgccagagtccagcacggtgcccgcccccgtcgccgggtcgaacgccgggataggcaccaccttcctgcccacgcggatgccggtcatgttcacgtagtagagcgacgaccggtgcgggttggccagcagcggcgtcgtcttgatgcgctgcggctggccgttgcgcccgagccggagcgttccagagaagttgagcgacttgaagctggggagacagtacgagaaggtggcctcgtacatgcggacgcgtggg

SEQ ID NO: 20644 - DNA, 7353 bp, Zea mays
  misc_feature (4900)..(4900): n is a, c, g, or t
agcctaaacgacgaccgtgcttaattttttttttttttttacagtacattatttagaccccaatcattcagcccctaaaccacataacgcggtgaatgtgaaacacatatggtaaatctgaagagcaacgagattaaaaagaaaaggaaagttaaattattaatcacccactccgacagcagtgcatgacgtccacaaccgtagaacgtaggtttaactaaatataacccgaatccgagcccgcgcgcaggcgcgcgagcaagctgatcaagcggcagtgcagcgctcgcgcgcgaagccgacgcgtccgttgggcacgtcgaagagcacacggtggttctgctgctgcatgctggcgatgacgttgagcacggtgttgacgccgtcgggcgccgcggccatggccaggcagctgatggtcccgtacgtgctgtggatgaccacgttctcctccggcaacgtcacctgcatgccgtcgaacagcagcgtcatgggcggccacgcgacggcggtggtgttgaagcacgtgtcgaaccctcccagcgaggatacgggcgcgccgacgcggcgccggacctcgtcccgcacggccacgtacgccggcgccaccagccgggtgaacatggtgccagagtccagcacggtgcccgcgcccgtcgccgggtcgaacgccgggatgggcaccaccttcctgcccacgcggacgccggtcatgttcacgtagtagagcgacgaccggtgcgggttggccagcagcggcgtcgtcttgatgcgctgcggctggccgttgcgcccgagccggagcgttccagagaagttgagcgacttgaagctggggagacagtacgagaaggtggcctcgtacatgtccttggtctgcgaaaggaacgacagcgggccgcggccgagacccagcagcccctgcggcggcgcagccgtgccagtggccctctgcaggcacccgaaggtgtaggccttcacggcgttgccggcgacggcgagggagtcctgcgacagcgcggcctgcagcgaggagtcggcgtaggtgaggctgaagccgcaggccttgccgccgggcgggcacgccgcgttgggtgcctgcgcgcacagcggcgacccgcagggcaccgtgcggtacgaggcggacgcggccgggtcgaagggcgccgcggacgacgtggggcagcccgcgcagccggcgcaagggatccacgaggcgtcgttgctggtgtcgacggccaggagcagctgctgcggcggcgtgccgaggctggcccgcaccacgtacgtcagcgtctgcagcagctgccgccccgacgcgatgggcgcgtacgcgcgggcgcggccacgcaccgccagcgagtccaggtacagcagccgcgacgcgtcacgcgacgcctggtccgccaggaaccccgcccacgacggcgccgccgtcccggggcccagcggcgagcacggcccgaacgcgtgcgacacctgcagcgtgttccccgcgtccggaggcgtggcggggcacgacgagcgcgagtgcgacgccgccgcgccgcccgcgagaagcagaagcaccgacagcgccgcgccgcaaagcatcctcacacccgtcccgacacggcgcatctctgcgtgcgccgggtgcagtgcaacagcagcacagttgctaagcccgggactggaagctagcgtagcgacgaaacgagagcgcgagacgacggacgctccgacgagggcgcgacgccgtgggctctcgtgcggcggggcacgtgagcgccactggggtctggcgacgcgggcagagcgcgcgcgccatgcatggcacgcccgtgaggtttagcgtggacggacgtatcgccgtacctgctgctggccaggctgcctgcagcatccgcggctgagcacggctcgccggggaccaagagctgcggcagctcgtgagcgcaggctgtcgcttcggccagcggacgcgctccacgtcggtgtccagtttcacggtggctcgtcacagactcacaggaggcttgtcttggcgcggcgctacccacgtggcatgtacgggattcgcaggagcaggagccaggaggtagtagacctggctcatgggatggccggatggcccatgagctgccgtctctgtgcagaacagcagagcagaacagcagaaggccggccagcgcatggacacggtggactgagtgtagtgtaccacccaagatgcactctggggacggtaaccgactgcgactactaaccgtgaccgtgagagacgaagagagatgccgaatcggaatggcgctgaggagtagccgcctaggttagagacagaaatagatcagtgtcgagcacgccaaggcgaaaggcatttgggccacaagcccacagagcctgtggtcgccacagcgcgggcccgtcggcctgcaggcgtgccacggatgacgcgctcgtcagttgttttttttaatctgtaaaatagattcacgtgtcagtcttcaagtgaaacaaagctggtggcgtggagctggctacgtcggctttcaccgccgtctcgggctcacgcacgatcgggccaaggcgaagtcgtctgcttgtggttgttccgggcatctggccgcacaggtacgacgcgcgcacgccatggggtccttgggatcttggaggggtgtcggcggcggtgggtcggcacacctatcgcatcccaaaggcagatgaaaaatttgctattttagcctttttaaggtgggctaaatgctattatatgactctctgtctatgacttatggaaccatctgtgtatatgatttgtgggcttaggtctaaaatagagaagttcacaactaaaagtgacaaaatatcaaattccccaaagcagatggagcaaagcactgtagttaccccagtgcctagcggtgagatgagtggctagccagcaaggcgtcactgcccattgcccatacctaaaggtgataatgtgctcttaattttacattataagatttaaagatcggatcgaattatgtcagactatatatctatttatttttgaactaaaatttatttagacatttaccattttatgaaaatcatttaaatcacgatccattaccacctctaccaatactcatatatgtgtcagtatataggtctatacttatgaggtatttggtttctagtgactaaattttagtctctcaattttatttattttatatcttaaattaacaaatacagaaactaaagcatcgtatttggttatttatggactaaaatgaataaaattgatgggctaaaaaatagttcaagtcatgattttggctattatttggtttgtaccaaaacctaccaatatctcactttgcgttgctaaaactgtaacatttttttacttaactttaacatgccaaaaattttacatagcaaattttggccgtaaaccaagcaagccctctacatcactgtggccattttgactttttttctaaatacataatttttatacgtacctaagatactccatgtactataaattataataggttcatatgtatctaatatactccatctactatgaactataagaggttttggttataatgcacgtagatatacactgcgtttatatatagtagaaatagagaaactaaaacgtcttataaattaaaataaaagtagtatattatatttctaggtatgtataaaaatatatgcctagaaaaaataaatagattgactcaccatttgcagccaaagtagcatgcagcatacgaaataggcaccagaactttatttgaacacatctcctacgttggagccttggaggcatctgaaatcacttccagccgcgggttttgaacagaaagctgaagcggttcgcgtctcccagaaacagctgtgttggtggctttttttgacgcagtaaaacacatgtgttgtccactgctgatgtaaaggacgtgttaactacattagaaattattaagattttttttgttaatgaaagtattggttgtacgcaagttttgtatgatcataatacacatgtgaacattacgaaaatttagtgtgttattgtatatacttcataatctgatatataataatctagccagcgaaacatctagattctaaccagccagcttctctccacagtcaacttctctataaagctctttagaaaaaactgaaccaaacagatctattcttaactttccggcaccgccttttcacacgcagacatcttatgattctagagggtgattaatgtagtgttgggtttcagagtcggttagtatggagcagcttcatgctaaggtgcgattctgtttagtagattttagagagtcgaatggttttatatttaaacattttctagaaccactctgtctatatggaaccaactaaacaacaataaattagaaactgaactactctatctcaccatactcatactctaaataaaaaaacttcaacctaaaattgtgaaggggaggtaaggcagtccggcggaggtgggtaggttgctggcgatagccgtccggtggcgaagttaaaattgtgtataagtgattagcttaattgttgactctatgtttacatcctaactaatgaaacacatattttttaattgagataaaatctactcatataatattgtataaaaagcgtagcaatatacattggatatctaactagaattttaaaccttcgtcattcatgtaaaaaaaatacagaataggagtacatcgaaacggcaggtgcggaggactgaataaataagaaaggcatataacagacccctttgcctttttttttccattcaggtaaggtagaaacatgtgcaggaagcaggaaacaggaaacaggaaagtaaatatatctgggccgacagcgtgcagggatccttccnatggccaggccttacccatccaacaaatctccaaatgttcatgataagcccggcccattagttcattacccattcacacgatcagctcgccaaaccaattccaatctcctcagccttcggagccaatgaaatcgcagtcgcaagagcgacatcgtcctatttgtttgggattttttcaccttctgtctaccaaaagttgttgtagactgccaaacgctctagctttcaaaccgcttctataaaaatcgcttgggtaaaaattgtctaaaatcaacatgaatacataatcgactgagtcgttgcaatagtaggaattcatccctttctagatcttgaaacatttggaccacttcatcttgctccgtacaaatcaccacaatactcaaattcttctcacagccaaattctctccacaaccggattcttagaaaagctggtcagaaagaagttgaaccaaatataccaattatcatctctgcccccacctcgcttcacacctctctcaagtcgccgcctccttcgcccactaaatattatgaagttgtacaaaaattatctatcataccattgattacatgacctactaattcaagtctctttatccacccgctaattatcaagaatagttaaaaatacttatacaaattatttgtattatagaagttgcaatctatatgcaagctaaacacttttgaaccttgtctaatcaatatgttgaagttttttcgtggtgaagctggaaaactgacactgtaatttttggagtaaaactctctcaaacagggtctaagtaacataggaacgaggtttgcatgtatgtctatattcattattatttgaattaatgtgggaaaaaagtgggataaaaaactatattttgagacgtaaggagtattaagagtcaggcttcttccgtcttctgttcttcgtcacctactaccatgccaacaagttgcacgcacgcatgacaccatttgcccagttaatttacggcgcattctgacttatcttatcaataaaaggtcaacatcaacatctccgccggattctgatgcgagtggcggagtccattcaacggccgaacccgtaccggactgcacagaatattcacaaggcaaatgcggggcatccttcttctcccatttttaatttgttccgcctccgtatctaattcagccgtatttatatactaaaaagagtttccgatacacgctagtatccctttcccttaaaatagtaaataggctgcaatttcagttttgtctctactgaactgccccgtttgtactgaactgcattccttgaataactctacctactgtactgaacgagatacagaaaaaaaaatattgatatgatatcccataaaaaattgttttccaacacaaaacatacagcagtatcatgaattaatcaaacttgaaataatctaactcggtactctattaaaaatgtatctctttctttcaaacgtatgaattagctactcccttgtgagttgtgacacagatggggagtgttaatttgtgacccagaggaagtgcaagctactcctacctaaaggtaagtgaaggcaagggaaaagaaaatgacagtcaatttcagagcgcttgttttacttttccttggaatgggaacaggacagcagtctgaaatataagtgccagctggtatgactttcttatcgtttttccgagccaagtgttttgagccacatacgtgtctcgtcagtgggtgctttacacctaacggtgaaggcatccacaatggtcgtacataggctgctcctaacgaggacagtgtccaggtcagaccaagagtgtgtttggtttgcatgactttattttatttaatttcagttctaaattattaaatatgaaaaataaaataaatattttagttttcttatttaataatttatgactaaataaaataaaatatagagagtaaaaaatattaatctctagaaaccaaacagaaaccaaacatctactcaagagaccgtacacaattcttttttgtttcaatcgaacggttcacagtccctgagaaacaggggtccacggagcatctctctcaacaagtacaaataggagtactcctctcctctcctgacgccacgagtgactcacgagttgttggatccatgaaacaggcgcacagtggctgcatctttggaacgcgagcgaatagactagctacctgttggtcgctactcgctagcgactctacccttttgcgtcctctcgcctccaccacccgacagcaatctgacgtgtactggctataaagcttttaggctgcctccagcaacagccgctaaagcggtctgttcgctacatatagcgcatcatagcctccggtatccgtccaacaagattctgtatctactccggtaaatttagcgcagagcgccgtacacgctaaactcagcgcttcctccattgtccgct

SEQ ID NO: 20645 - DNA, 2285 bp, Zea mays
aatgatggcaccaagataagttctattttctgaatttcctcctttttttttttttttaaaaagcaaaaaatacgacggacaccaccttatcttctttattttgtattttcaagggttccaaaaaaattcaaattctaaaatacgtcgttgcggcaatcgcgtattcgcgtgcaagaaacaccaaacaagaaacaaactgcacagcaggatccgccaacacccatgcattgcatcgctatcttgttgcgcctgatttattccaacaattttacacggatccaggctcggaacctacgcggcctgcaagtcttcgtctacattgcattcaccgaggtacaccttaacgctgcgaggagagccacagctgccttctgctatgattgctctgtcgttagcagccatgtgctggactattttgtagatcatctcaatatcttcagggcaatggcagcgatctgcaatttcatctatagtcaatggctcacaagggtccttgcaggttgcctcatttaatacagtcagcacccttttctgaagggccaacacttctcctgctgcctttttcccagcctcaacaccaggttgatgataggcattgatatttaccaaagaagcataaagccccacagcacgttcataaagtgcaaccagtgctccaacagctctaggagttacctcttgcacagtaacagagatagattcacggtcatttgcataaagagcagaacgtgttccctgcaacatcccaaacaaatagtcaccacatgtgactccaggttcaagctcccaatcatgaccagcaggcctgtcacgcaagacctcgataaaagtaacaaagaagttgtgtacaccttctctcagctgctgaatgtaagcgtgctggtcagtgcttcctttgtttccatatacagatagcccttgatttacccggttgccatccagatcaaattctttcccaagagattccatgacaagttgttgcaaatatctactcaaaagcaacaaactatccttgtaaggaagtacaaccatatccttattgcctatcccttctgatgcccaataccaacataatgcaagcaatgctgctggattttctttaaccacagtgttccgggtttcctcatccattaaagctgcaccagctagcatttccttgatatcaataccctgcaatccagctggaagtaaacccacagctgacatttctgaagtcctaccaccaacccaatcaaacataggaaaccgagctaaccatccctctattctagcagtgttatccaacagagaattttcttgagtaattgcaacaccctgtttcgagaattgcagccctgcatctctgaaggctttctgtacttctagtagaccattgcgggtttcaggtgtgcctccgctcttagaaatgacaattacaagagtagttgccagttcaggtcctagttgagcaatttgatgatcaatcccagcaggatcggtgttgtcaataaatcttatcttcagtggagggttatcaggtgcaagtgcctcagcaacaaattgagggcccaaagctgaccctccaattcctatagagagaattgaagtgaaacgaccagatggggattgaatcttgccagagacgacatcttgggagaaggcgaggatcctgtcgagcgtggtctcgatcttgctgcggaggaaggagttgggcgcgagggccgggtcgcggagccagtagtggcccaccatgcgagcctcgtccgggttggcgatggcgcccttctcgagctcccgcatggcggcgaaggcccgctgcatccgcggctccatctggcgcaggaagtcctccgtgaaccccatccggctgacgtcgacgaagaggccgagctccttgtgctggtagagccactcgacgtagcgctcccacagcttgatcgggtccttctccaccgcgcggacgccgccgttctccggcctggagcccagcggctgggcccgggtcggggcggaattagaggagctggaggagcgggagaggtcggcgatggagtggggcgcgcggaggcggaggtgcgagggccgcagcaggaggtgcctacgcagccgcagccggcacgcagcggaagatggcgccgccgccgctccggagatggacgccatcgccggcggtcagacccctcgctttttttcgctctgggtgtcgggctcacgcgcctccaaggcgagggtttttttgtcttgtgcggggaggagtcgacgaggtggagctcgacagccggcgccctcgcggggctggccaattt

SEQ ID NO: 20646 - DNA, 1952 bp, Zea mays
aagagaacgcaaaggtacatgaggcgccctaggggccttttttttttgaggagttgcggacaccaccttctatctttgtattttatattttaaggggccaaaaaaaatcaaattctaaaattacatcgttccggcaatcgtgtgcaagcaccaccaaacaagaaactaatgagacatcagcatcagcgacacccatgcatagcatcgctattgtgttgcttctgatttattccaacaatgttacacggatccagacacagaatctatgcggcctgcatatcttcgtccacactgcattcaccgaggtacaccttaacactgcgaggagagccgcagctgccttctgctataagtgctctgtcgttagcagccatgtgctggattattttgtagatcatctcaatatcttcagggcaatggcagcgatctgcaatttcatctagagtcaatggctcagtagggttctcgcagatggcctcctttaatacagtcagaacccttttctgaagggccaatacttctcctgctgcctttttcccagcctcaacaccaggctgatgataggcattgatatttaccaaagaagcataaatccccacagcacgttcataaagtgcaatcagtgctccaacagctctaggagttacctcttgcacagtaacagagatagactcccggtcatttgcataaagagcagaacgggttccctgcaacatcccaaacaaatagtcaccacacgtgactccaggttcaagctcccaatcatgaccagcaggcctgtcacgcaagacctcaataaacgtaacaaagaagttgtgtacaccttctctcagctgctgaatgtaagcatgctggtcagtgcttcctttgttaccatatacagttagcccttgattaacacggttgccatccaggtcgaattcttttccaagagattccatgacaagttgttgcaaatatctactcaaaagtaacaaactatccttataaggaagcacaaccatatcctttttgcctatcccttccgatgcccaataccaacataatgcaagcaatgctgctggatttgctttaaccacagtgttccgggtttcctcatccattaaagctgcaccaactagcatttccttgatatcaataccctgcaatgcagctggaagtaaaccaacagctgacatttctgaagtcctaccaccaacccagtcaaacataggaaaccgagctaaccatccctctattctggcagtgttatccaacagagaattttcttgagtgattgcaacaccctgtttcgagaattgcagacccgcatctctgaaggctttctgtacttccagtagcccattgcgggtttcaggtgtgcctccgctcttagaaatgacaattacaagagtagttgccagttcaggtcctagttgagcaatttgatgatcaatcccagcaggatcggtgttgtcaataaatcttatcttcagtggagggttatcaggtgcaagtgcctcagcaacaaattgagggcccaaagctgaccctccgattcctatagagagaattgaagtgaaacgaccagatggggaaagaatctttccagagatgacatcttgggagaaggcgaggattctgtcgagtgcggtctcgatcttgttccggaggaaggagttgggagcgagggccgggtcgcggagccagtagtggcccaccatgcgaccctcgtcggggttggcgatggcgcccttctcgagctcccgcatgtcgacgaaggcctgctgcatccgcggctccatctgccgcaggaactcctccgtgaaccccatccggctgacgtcgacgaagatgccgagctccttgtgctggtagagccactcgacgtagcgctcccacagcttgatcgggtccttctcctccgcgcgccccccgccgccgccgtcctcccccccccctccaattcagcc

SEQ ID NO: 20647 - DNA, 4533 bp, Zea mays
ggcggacaccaccttctatctttgtattttatatttaaggggccaaaaaaaatcaaattctaaaattacatcgttccggcaatcgtgtgcaagcaccaccaaacaagaaactaatgagacatcagcatcagcgacacccatgcatagcatcgctattgtgttgcttctgatttattccaacaatgttacacggatccagacacagaatctatgcggcctgcatatcttcgtccacactgcattcaccgaggtacaccttaacactgcgaggagagccgcagctgccttctgctataagtgctctgtcgttagcagccatgtgctggattattttgtagatcatctcaatatcttcagggcaatggcagcgatctgcaatttcatctagagtcaatggctcagtagggttctcgcagctgggagacaacaagtacatgaatcaacaagcaatccaataactccaatataacattaatgagtgagaatcaattggggagtaaattgcagttatgtgtaaaccaagtgtgtgtgtggggggggggggggggggttaagggttattgccccttgtagttcttatatagatacgcagctctccggtgcgtaagggaaaaaatggttcttttcatacacattagtgtcctctcttgtgcccccattctttgagtttacttgtacaggaattggaacttcgaaaaataaaaattatttcatgaacaaggaaaggttgagttattatactttagtataatacacatgtttctttctttgtaagaatattgactttagactctaaagacatgtaactgtaaaaccagcaggacgctatctgtaattttgcagccccatgcgcacatgataactgtcaataagccgtcaattgtaattttcagctaggaaaacttttcaaacctatatcagttcgaacatctaaaaatgccttcttagagagtctcaaaggagaaatgggcattgccacagctattggggtgggtgcacttcgaatgttttttgaggaaccaacccatgagtacatccctcatgtttgtactaattattactttgcaagggatagggtggtggcagatgaacctattcaactccataaaccaaacaaaaaagtgagggtgagaatatgatgaaccacaccattcctcaaaacaaagtcccacctagtgatacaacgaaatgcattttcaaagcatcacaactagaaatatgccccaaaaatactatgcataaccaatcacttcacagagaaacagaaagaacacaggtcagaagttccatacatggcctcctttaatacagtcagaacccttttctgaagggccaatacttctcctgctgcctttttcccagcctcaacaccaggctgatgataggcattgatatttaccaaagaagcataaatccccacagcacgttcataaagtgcaatcagtgctccaacagctctaggagttacctcttgcacagtaacagagatagactcccggtcatttgcataaagagcagaacgggttccctgcaacatcccaaacaaatagtcaccacacgtgactccaggttcaagctcccaatcatgtccagcaggcctgtcacgcaagacctcaataaacgtaacaaagaagttttgtacaccttctctcagctgctgaatgtaagcatgctggtcagtgcttcctttgttaccatatacagttagcccttgattaacacggttgccatccaggtcgaattcttttccaagagattccatgacaagttgttgcaaatatctactcaaaagtaataaactatccttgtaaggaagcacaaccatatcctttttgcctatcccttccgatgcccaataccaacataatgcaagcaatgctgctggatttgctttaacctgttaataaaaagataaacatgtttgacatgacacaatatagataatcatgccatcactgcaagttgtccgtgttattaataatgtgataccacagtgttccgggtttcctcatccattaaagctgcaccaactagcatttccttgatatcaataccctgcaatgcagctggaagtaaaccaacagctgacatttctgaagtcctaccaccaacccagtcaaacataggaaaccgagctaaccatccctctattctggcagtgttatccaacagagaattttcttgagtgattgcaacaccctgtttcgagaattgcagacctgcatctctgaaggctttctgtacttccagtagcccattgcgggtttcaggtgtgcctccgctcttagaaatgacaattacaagagtagttgccagttcaggtcctagttgagcaatttgatgatcaatcccagcaggatcggtgttgtcaataaatcttatcttcagtggagggttatcaggcgcaagtgcctcagcaacaaattgagggcccaaagctgaccctccgattcctttccagatggggaaagaatctttccagagatgacatcttgggagaaggcgaggattctgtcgagtgcggtctcgatcttgttccggaggaaggagttgggagcgagggccgggtcgcggagccagtagtggcccaccatgcgaccctcgtcggggttggcgatggcgcccttctcgagctcccgcatgtcgacgaaggcctgctgcatccgcggctccatctgccgcaggaactcctccgtgaaccccatccggctgacgtcgacgaagatgccgagctccttgtgctggtagagccactcgacgtagcgctcccacagcttgatcgggtccttctccaccgcgcggacgccgccgctgccgttctccgggccggagcccagcgctgggcgggccgggctcggggcggaattggaggagcgggagaggtcggcgatggagtggggcgcgcggaggcggaggtgggagggccggagcagaaggtgccggcgcagccgaagccggcacacggcggaagatggcggcgccgccgcgccggagatggacgccatcgccggcggcgtcgttgcagcaggggatggtggttgtgaggaccctcgcttcgttcgcctgtcggtcttgggttcacgcgcctccgaagcgagggtttagttttgtggggaaggagtccacgaggtggagtcgttggcctcgctgggcttggctttatctggggttaggggaggaagacggaggaggaggaagagatggtccatgtcagtcgggtcacctgggtgccccacccgtcagccgcctggggtacggggcaccccacttgccagaggcaggctcggtatcaccacgggggagcaactaccagtttccgtgggtgtcaccatgtcaggcgctcagcacgtgcgaccgacggcgtaggggaagttggggacgctagtgcgacgccgagggagaggtggtggatggcagcgcctgcacggatcgctagtgggccggggatgtcttcgtgaaggtgaagtacggggcacagggccgcacgaagcaaaaaagcgaggaactcgctgggagatatttgcgcctcgcgttcgtgtatgcttgcgtagttgattgagcttcctgtttttctggagatttgctgctttggggctcgtcgacggcgaccgtaggactgaccggctgggatgggagggggaagaatacggcaaacaacgtgtggttttctcctctcctgttgcggaaacccgaaatgctctgctcgccgtcgaattctcgtggtttgagtttactgctctcttcatctcaactttcagtcttcacgcactccatctcagccccgaatacttccacgctgacccgcggatatgcatggcatgattcttgatgctgatgcaaatgagaaaaatataggaatactttagaaatagttccgtaccactgatgtaaaattattttctatatcttaagcgagatattaaaaattgtcagagaatcaacaaataaacaaatatggtcgcaactttttttagtgacttagagcatctacaattaagccgggtcctatatttaaatataggagttaagatctcaaaataacttccaacaaaattgctattttataaatttccatcaaatggatatagcacctgaagtcacagttactaaatatagcactccagtcaaaggacctatttctgtgtgtctaatctcacggagttaactaccacatgagtttaggagttgctattggagttagaaaaaatattgatccaaattaacttgaatcaagtctaatttagcttttgatgtcccaattataggagttcatcttggaaatgctcttataatacttataatttaccgagtgattttttaataaactataaaaactcggatcgctctctctatctttactacttattaagacagtaaggggtaggctgtcatttcgtgttctgcattccccctccccgcacagtccattctcatattctgccaccattcctgccattctcattcctcccctcccgcaaagtccattatcattcccacgtacatcccacacctaactaaaattaaataaaaaac

SEQ ID NO: 20648 - DNA, 1577 bp, Zea mays
ggtctttattttgtattttcaagggttccaaaaaaattcaaattctaaaatacgtcgttgcggcaatcgcgtattcgcgtgcaagaaacaccaaacaagaaacaaactgcacagcaggatccgccaacacccatgcattgcatcgctatcttgttgcgcctgatttattccaacaattttacacggatccaggctcggaacctacgcggcctgcaagtcttcgtctacattgcattcaccgagggacaccttaacgctgcgaggagagccacagctgccttctgctatgattgctctggcgttagcagccatgtgctggactattttggagatcatctcaatctgaggaagcaaatgttgggcatgtgttatagagggggaaaaacgttgtgtttctgtagatggaaaacagggatgccaaaaactgggaggcacgcgtgggcagaacaaacaaagggagcacaaaggggaaacttacatcttcagggcaatggcagcgatctgcaatttcatctatagtcaatggctcacaagggtccttgcaggttgcctcatttaatacagtcagcacccttttctgaagggccaacacttctcctgctgcctttttcccagcctcaacaccaggttgatgataggcattgatatttaccaaagaagcataaagccccacagcacgttcataaagtgcaaccagtgctccaacagctctaggagttacctctttgcacagtaacagagatagattcccggtcatttgcataaagagcagaacgtgttccctgcaacatcccaaacaaatagtcaccacatgtgactccaggttcaagctcccaatcatgaccagcaggcctgtcacgcaagacctcgataaaagtaacaaagaagttgtgtacaccttctctcagctgctgaatgtaagcgtgctggtcagtgcttcctttgtttccatatacagatagcccttgatttacccggttgccatccagatcaaattctttcccaagagattccatgacaagttgttgcaaatatctactcaaaagcaacaaactatccttgtaaggaagtacaaccatatccttattgcctatcccttctgatgcccaataccaacataatgcaagcaatgctgctggattttctttaaccacagtgttccgggtttcctcatccattaaagctgcaccagctagcatttccttgatatcaataccctgcaatgcagctggaagtaaacccacagctgacatttctgaagtcctaccaccaacccaatcaaacataggaaaccgagctaaccatccctctattctagcagtgttatccaacagagaattttcttgagtaattgcaacaccctgtttcgagaattgcagccctgcatctctgaaggctttctgtacttctagtagaccattgcgggtttcaggtgtgcctccgctcttggaacccgcccggcctcgaggagttgccagttcaggtcctagttgagcaatttgatgatcaatcccagcaggatcggtgttgtcaataaatcttatttcagggagggttatcaggtcaagccccggccg

SEQ ID NO: 20649 - DNA, 892 bp, Zea mays
agtagttgccagttcaggtcctagttgagcaatttgatgatcaatcccagcaggatcggtgttgtcaataaatcttatcttcagtggagggttatcaggcgcaagtgcctcagcaacaaattgagggcccaaagctgaccctccgattcctatagagagaattgaagtgaaacgaccagatggggaaagaatctttccagagatgacatcttgggagaaggcgaggattctgtcgagtgcggtctcgatcttgttccggaggaaggagttgggagcgagggccgggtcgcggagccagtagtggcccaccatgcgaccctcgtcggggttggcgatggcgcccttctcgagctcccgcatgtcgacgaaggcctgctgcatccgcggctccatctgccgcaggaactcctccgtgaaccccatccggctgacgtcgacgaagatgccgagctccttgtgctggtagagccactcgacgtagcgctcccacagcttgatcgggtccttctccaccgcgcggacgccgccgctgccgttctccgggccggagcccagcgctgggcgggccgggttcggggcggaattggaggagcgggagaggtcggcgatggagtggggcgcgcggaggcggaggtgggagggccggagcagaaggtgccggcgcagccgaagccggcacacggcggaagatggcggcgccgccgcgccggagatggacgccatcgccggcggcgtcgttgcagcaggggatggtggttgtgaggaccctcgcttcgttcgcctctcggtcttgggttcacgcgcctccgaagcgagggtttagttttgtggggaggggtcccccaggtggccccggccgccctcgcggggctccgctttgtaaggggttccc

SEQ ID NO: 20650 - DNA, 2210 bp, Zea mays
gcatgcctgcagaaggccatttatgccgggatggatcttcacctggcaaagccaatatcgcggaagaagatagtggacgctgttcgcagtgtctgcaaatgtgagaattgacaaagcgtttctgcatcgggtgaagaactctcaggaagccagtggtttcattgactaggatggcgatgatcagagctcacaacatccatctggtcattatatagttagctctggttcaggaagctctcttgttttctgttggctgtggcctgcggggctgtcactttggcctgcactgaagtgtatcagatatctgttttatataaacatctcttgaagtttctggtctcgtatgtatttgcgcttcaggaaatgctggccagttgatctgagtgcctacatccttatgataatatatgctctggtattatctacagttcagtagttcggcacttgaaaatgacgccgattgatcatgagtgccacctatagcttacattctgctgtctatgtacattgttcgagataggttttatttatatcctaattggcattattctgcacagattgtacgccacagttcttttcttgagttaccttgaatgtatgcacagacatgaccttcctgggccctgtcaataatatgcatcgtacagcgaagaacagaggacggtatcctgcgaataactgggcattactaaaatggcgctttatggcacacagatacaacaatgtacaaagctgacggtccttattttgcaactcgataatgtcaaaaggttatgatacaaggtcaatgaaccacctaaataaagctcaggcctctagtttagcaacttcgcagtgtaccaccacatactagggtcaaaccgtcaatatcaataacaaatagaaggaatgttctacacaatacaacagccaacgccacgccggatccaaccaacgatccgcgaccgcgactatctcatctttcccagcagcagtttcccctgtatggaggtgaaacctagctggcaccggacgacggactccgccagtgaaggcgcattgcttccttcacgcatgcccatggcaaaacattgcccctccccaaggcaggcatggcgtctctcgtgacgacgaccgcgtaacacacctggacagggccaggtaggagagcacgggtgtttctctactggcctgttttcgcgcgtttcataccgccgttgctgaatggggaaacgctcccagggtgagggctgtcctctctcagggttgagttcagcagtgccagctccctgagctgttgcctcttgtagaaatcttgggactcgtccactggtttaagcaattcttctataatctcctgcgcatgtctcaaccttgcatcgatgatactggcagggaactcggcctctatcaagatatgcagaggatcactcaggtgctcataacctggttttccccgtagtttgtcctccttccctggatctttgatggaaccatttcctctaatgaaaacacggcacccagtggatgcttctacacgctttagagaattacctctaggtcctaaaatgcgccccacaaaattgaaattcggataagaatcaaccggaacctccagacgaagaatcttcttcacaacttgggtgctaggacttggtggtgctccttgccagtccatgctagctcgttgaggaaaacctaatctctcttgtagtccgctccaaggactgaacccattgccagggagattagctctagggttcggagaagacatcggactaggacttctaaaccgatgcctgtcatgatcgccaaatccatggttgtggacaatgcttgacacccgcataatctcttggctcagcagcttgttgcatatgggcagcacctgcatgaacggccccagcttctggtgttccgccagcagctccgccaagtactggctatcgacatccgggttgcttctaatctgaggggagaggtttcgcgcaggggagaagccctggctgtagagccccgacatggcggcggcggcggaggagtcgaggcgggggagatgggtacgtagcccaggaagtggaggcgaggcgacgagagatgggcccgggtccgccccctggggtggtagcaggaagagtggtaaaaaggctcgctgctttagggtgcagcctgcagagctgggggtagaggggttggcaggcagccgcagccgctgccgctctggaaaccct

SEQ ID NO: 20651 - DNA, 1391 bp, Zea mays
tttttttttgctttttttttttatttttgcaactccataatgttaaaaaggttataatacaatgtcaataaaagacctaaagctcacatactcagcaggcctctctagctagtttaccatgcagtttgcaggttgcagctcaccaacatactagggttaaccgtcaataacaaatagaacgaatgttctagaccatacaacaaccaacgccggatccaaccaagggtccgcgactatctcatctcatctcatctcatctttcccctgtccggaggtgaaagctagcagaagataccggactccgccagcgaaggcgcatggccttccttcacgcatgcccatggcgttcccatgacgacggggccagatatgggagcatagttgttttctctactgtcctgttttcgcacgcttcatgccaccgttgctgaatggagagacactccccggatgagggctgtcctctctcagggttgagttcagcattgccagctccctgagctgctgccttttgtagagatcttgggactcgtccactggtttaagcaattcttctataatctcctgtgcttgtctcagccttgcatcgatgatactggcagggaactcggcctctatcaagatatgcagcggatcactcaggtgctcatagcccggttttccccgtagtttgtcctccttccctgaatctttgatggaaccctttcctctaatgaaaacacgacacccagtggatgcttctactcgctttagagaattacctctaggtcctaaaatgcgccccacaaaattgaaattcggataagaatcaactggaacctccagacgaagaatcttctttacaacatgggagctaggacttgggggtgctccttgccagtccatgctggttccttgaggaaaacctaatctctcttgtagtccgctccaaggactgaacccattgctagggagattagctctagggtttggagaagacatcggactaggacttctaaaccgatgcctgtcgaaatcgccaaatccatggttgtgcacaatgcttgatacccgcataatctcttggctcagcagcttgttgcatacgggcagcacctgcatgaagggccccagtttgtggtgttcggcgagcagctcggccaggtactgactatcagcgtccggattgcttctaatctgaggggagaggtttcgcgcaggggagaacccctggctgtagagccccgacatggcgagtgaggggcgcaatcgaggatgagggagggggactgggggaggaggaggaggaggcgaggtgactgagacggatggataatacgtagcccagagcccaggaaggaagtggaggagatggtgtgcgcggtgtcccggccggcccccggggtcccaat

SEQ ID NO: 20652 - DNA, 1636 bp, Zea mays
ggggaccgggcccttttcgagtttttttttttttttttttttttttttttttttttttgtacaaagctgatggtccttattttgcaactcgataatgtcaaaaggttatgatacaaggtcaatgaaccacctaaataaagcttaggcctctagtttagcaacttcgcagtgtaccaccacatactagggtcaaaccgtcaataacaaatagaaggaatgttctaacaccatacaacaaccaaccaacgatccgcgaccgcgactatctatctcatctttcccagcagcagcttcccctgtatggaggtgaaacctagctggcaccggacgacggactccgccagtgaaggcgcattgcttccttcacgcatgcccatggcaaaacattgccctccccaaggcaggcatggcgtctttcgtgacgacgaccgcgtaacacacctggacagggccaggtaggagagcacgggtgtttctctactggcctgttttcgcgcgtttcataccgccgttgctgaatggagaaacgctcccagggtgagggctgtcctctctcagggttgagttcagcagcgccagctccctgagctgttgcctcttgtagaaatcatgggactcgtccactggtttaagcaattcttctataatctcctgcgcatgtctcaaccttgcatcgatgatactggcagggaactcggcctctatcaagatatgcagaggatcactcaggtgctcatagcctggttttccccgtagtttgtcctccttccctggatctttgatggaaccatttcctctaatgaaaacacggcacccagtggatgcttctacacgctttagagaattacctctaggtcctaaaatgcgccccacaaaattgaaattcggataagaatcaaccggaacctccagacgaagaatcttcttcacaacttgggtgctaggacttggtggtgctccttgccagtccatgctagctcgttgaggaaaacctaatctctcttgtagtccgctccaagtactgaacccattgccagggagattagctctagggttcggagaagacatcggactaggacttctaaaccgatgcctgtcatgatcgccaaatccatggttgtggacaatgcttgacacccgcataatctcttggctcagcagcttgttgcatatgggcagcacctgcatgaacggccccagcttctggtgttccgccagcagctccgccaagtactggctatcgacatccgggttgcttctaatctgaggggagaggtttcgcgcaggggagaagccctggctgtagagccccgacatggcgtaggggtaggtgtcggagccaagataggggcaagtgttggtgctggcgtgggagcaggcaccggagtcggagctagtgctggcgtaggtgtaggtgccggtgctggtgtaggggcagacgtcggagctagggtaggggtcggggcaggtgtcggagttgaagacggtgtaggtgtcgtagcaggcgttggtgctagtgttggagccggagcacacattggtgctggcgtaggtgcagatgtactgggagccggtgtgggtccttgagccctaccatgagccacaagcacggctgtcacccaaaggagtaggagcg

SEQ ID NO: 20653 - DNA, 2911 bp, Zea mays
cttgcatgcctgcagacccaaacagccgcaagaaacgagcagtcccacatgcttgaaatatcatcttcctaaacagaatcctattttgaaatgtaggactaaaacatgctccaacaaaagtcttatcttacaaaatttcatcaataattatagggcttggtctctcgagttctaaatatattgacttatatactggagccctattctcattttatatactatttctagcattttattttctaaataacataatatatttcttaataatatgtatagggactcatatcagacttttggttggagatattctaagtatatcacactttcagcggtccaatgaaatcacatttgaattcaaaatactccaagtttttttggtacatagattttgccatatatcttaggcacaagtgttttgttttggtatatgatgacaaaatcgaggtaaaaagaagtcaaagcaatttatactgtggtttagagcaggagtcaaagcgatttatagtttagaatgaaagaaccaacagaaatacaacaacagacaaacaggtagtgcagttcagttatccacccaatttgagaagaacaagtgacaatacatttatcaaaatcaatgcggatccctttcaagtttgaggtttgagtttgagagacggtttggaaccccagtaattcacaggaactcggtaggattctactagtaaattcttttccgattcatggacatgtacaaccacaacggggaagcatggtacagctggaagtccaagacacgctggtaacgctatgcatttttcactgagcaaatgtccaagaaaaaaaaatgagcatcacatcgatagcgtctctcactcacagtcgttgttcattcagggcctatactgtgtgcttgtagatatctaaaaactaacaggcagacaggctcgtcttgtgcttcctgtgcttcagctgcggcccgccatcaccggcggcagcggcaccgcccttgaccacagccaacttgtcatcgctcctggtcgccgccgctgccttcgactttgacgtctccgactttgacgattccggagcagcctccttgtccttggtgccgcagacgtggggctttgcggcgagcgcgaacgggaacctgctcttgcccgcgctcctgctgcggccgagccgctcgatgtcctccttcatggcaaagcactccttctccagctccgacacgcgctgcttcatgctgtccataccttcccgcagcgtctggttctccctggcggccaggggccagccagcgccgcggaggtgctcgcccgagacaggcaggccgccgagctgccgcgagaagccgccgccgccgtctaggggctctgagatcatgaggcattccgcgatggagctccgcagctggagctgctcgaagaagaggacctgcaggatgacacggagcgggaggcgctcgttctgcgccgcgtgtgtgcaggcctccagggacagcttctggcagtccatcacccggcagagctcttccttgtccgattctggcagatatgggtgcgcctaccaaacgaaaacgaagtggactgtgagcaaattcctcgtgagatatatgtcaatagcacgataaagcccatcatctattggacgagcataatccggtatagcagcagccaaagaccgaaactttggcaacttcaagttcatgtctggtgcaacttcagccagatagccatcaatcaacttagcaaccatagttattggcattaaggatggtgatgctaacatttgcccatcttcaccaatgccaggggaggccccaccagtttcttggtccattgacaagaaatggtctacaatcctctgcacacactccacatcatacagggtttccacagaatcagagacattcggtatcaaaaggtcttccaagctggccttgtcaagctgcatacctatccgtctctccaagttcgacacacaggaggggctggctttcaggaagattgccgtgcgcaggaggccaaacagcagcttgcatgatgtaacacccctttggaaagggagtagtctatcgatctcctcgagaagatacttctggtcatcttcagaagggatggatgttaaactagtcatagaaagacagttgctagcatcaccgatgcttttacgccgattcaaaccaggcaaacgcctttttgcataatggttaagggatccaacaataaccccctgactgatgccccgatactccatggctgagatgagctttttgtataacgggaggcttaaacatgagacatcatcataccaccaatccgggctgctatttctgggccttgctcccgtgctaataccattccacaagagactccctccaggactctgcatggggcctccataacgggctactggccacccaaataaatcagggtcactgcatgatttagtcgcaatagagtctacacacctctttacaatctgcaatctttcagcaacatcaaggacgttgtcacaagtttgaagcgccttgactgaatccttccagctcctgaggactgtttgggtaaggaagctctctgtctctgcgatcaaattcccctcggatatctcttccgtcatctcaaggtaatcagcagcacaacgaaggtgtacaacgttggaggcagtcatttcaaactttacaccatagcaaaatttggcagccagttcaaaagccttcgccccaccaggaatatcagatagatcaattgcacagctatcgtccctgttatcgattttctctctgattcgcttctccaacaggccacttttcgatagtagaggaaacttgtgaagatggaaagactgttccccaactaccacagatatatcactgggaagaccagatgtgcagtaccactcctgcccttgcttccggaagacatcagcc

SEQ ID NO: 20654 - DNA, 1700 bp, Zea mays
ttttttttttttttttcaaagcaatatgcgttttccacgagcatgtcaccaatatctgtacagcagacgaatgaactaaatattacacatctacaacagcacagaacaaacctgaagctaggcgaatgatcctgataacttggaaatctcatttcaataacatatattggtccaacgctctcctcccaatatgattccagggtaaccgaacattggattaaaaaaatatattatgggttacaaggagaccagtactatattctaagatcataggtaagctctgaagacttctactaaggcagataaagacactggatagagaaacctggtgaatagtaaactgattgatctttcttttccatttcttcttccttgatgaatagccaaacaaaatgaatcggaatcttcaagacagtttaatcttcatctcctcctcaacaagctcaaatatttcaccaattctactccggttgatgttcatattagcatgccaagtggttaaataaacctgtaaaacttcatgcagagggagattgccaggtcgctgactccctaaacgttctgcacaccaattttcaggcggtgagtaggcatctcctgactgaaggccaatactctgaagttcatttgattcaccatcatatagttcatcaccccaatttaatgatgtctggagttctacaccttcctttaaagcaatcgagagaaattccaagagtagcagcctcttcaacttttgctctgaaacaaacatctgaacaagctcctgggcaagagtctcaaattctaatatggagaaccatttgaatactggggctcctccaccatcccctgaatcattcaaattatcttggcggtcagaaaactgtgtgatggagcaatttggagctgctttagaaaaacagcgcatagaatgggaagcttcaaccaagtaggacagctgacggaccatctccttgtaggccgacagaagcatcccactgtattgctcctctctaagcaccaacttggagttagccttatcgcggatccccggcatatccttgagcacccccaaatccgtcgctggcatgttcctgcggcagaggtgggcgttgacgagcgcggaggcgtgggcgcgaccatcagcaacggcggccagccactgctccttggcggcgctcagacgggaccactgattgcgcacgttgcgctgcgccgctgacctccacagcctcagcgacgacgagggcgacggcgatggggaagcggccgccgggtggggcggccgggtcggggttgctgcggaggtctccattgattcgaagggttttgcgttgctctgtttactggcctgccgccaggctcaaccttgattcgactgaagctcgccaaggcagcaaagctcgacctcgtctcgaatatgggctggctcccggcgacgaacgtggcggcggatacaccagcgatgcttccctcctcaatcttgcctctttcccctcgcttgcagcgtggcggtggtcgacgggaccttgcagatcggcggtggtggcggcggcggccgaccgcgctcgtgaagtcgtgcgaggggagtaccggaggagtgctgtgggatgagctccgtgggatcggttcacgctggctgggagcggtaacgacaaactgtggctccgtatgaccgtatctttttgattaggatgttctaggtaatggtctcgtgc

SEQ ID NO: 20655 - DNA, 1544 bp, Zea mays
ccaccgcggtggcggccgcccttttcaggcgaatgatcctgataacttagaaatctcatttcaataacatatgttggtccaacgctctcctcccaatatgattccagtgtaacccaacattaaattttaaaaaaatattatgggtcacaaggagaccagtactatattctaagatcataggtaacctctgaaggcttctactaaggcagataaagacactggataagtggatatagaatcctggtgaatagtgaactgattggtctgtcttttccatttcttcttccttgatggatagcccaacaaaatgaatcggaatcttcaagacagtttaatcttcatctcctcctcaacaagctcaaatatttcatcaattctactccggttgatgttcatattagcatgccaagtggttaaataaacctgtaaaacttcgtgcagagggagattgccaggtctctgactccctaaacgttctgcacaccaattttcaggcggtgagtaggcatctcctgactgaaggccaatactctgaagtttatttgattcaccatcatatagttcatcaccccaatttaatgatgtctggagttctacaccttcctttaaagcaatcgagagaaattccaagagtagcagcctcttcaacttttgctctgaaacaaacatctgaacaagctcctgggcaagactctcaaattttaatacagagaaccatttgaatactggggctcctccaccatccccatctccttgtaggccgacagaagcatgccgctgtattgctcctctctaagcgccaacttggagttcgccttatcgcggatccccggcatatccttgagcacccccaaatccatcgtcggcatgttcctgcaggagaggtggacgttgacgagcgcggaggcgtgggcacggccgtcagcaacggcggccagccactgctccttggcggcgctcagatgggaccactgattgcgcatgttgcgctgcgccgctggcctccacagcctcagcgacgacgagggcgatggcgatggggaagtggccgcctggtgtggcggccgggtcggggttgctgcagaggtctccattaatttgaagggttttgtgttgctctatttactggcctgccgccatgctcgaccttgattcggctgaagctcgccaaggcagcaaagatcgaccttgtctcgaataggggctggcttcctgcaggctggcgccgctgcgtcagggatggaggggccgagggggacaatgtcaccggtagcacgccgccgtcgctagggtttcctcagtggcggctctgttcttcacgagttcaccgttcacgtcgcgtggtactgccgtactggtgtgaccgtgttcacgcgtagcagctgcctggccgacgacgacccgagcctggcgccggggagggcagaagcttcgccgcggcaggcgctagcgacggcgtgaacaccaaggcgaggcgaggagaagagagagattgaggccggcccgggcgggaccaacgctgggtttttaagggaggcggagct

SEQ ID NO: 20656 - DNA, 1429 bp, Zea mays
gcaggcaagtaaaacaaatccgatttacaaaagaacctaaacacagatatactgaataaaagaatttttctgttgttggaaaagatcaccgtataaagagggatgatgtaccttcaacttttgctctgaaacaaacatctgaacaagctcctgggcaagactctctgaggtgattaaaggaaacataatatatttttatcatgtggatttaaaacatgtaaacatgaatgtgtgtactgtctcagatattgatcggcatcctcaaatgtgagaatatatagtgctctgagtagtctcagatatagatgggttaggagatcattgtcacacccaacagacgtaagatcatagtggtgacttaatccatagaagcaagagatgattaacccaccaaattctaatacggagaaccatttgaatactggggctcctccaccatcccctgaatcattcaaattatcttggcggtcagaaaactgtgtgatggagcaatttggagccgctttagaaaaacagcgcatagaatgggaagcttcaaccaagtaggacagctgacggaccatctccttgtaggccgacagaagcatgccgctgtattgctcctaaaccaagcaagcaacaaaatcaaagattagccagcattaatggccaactaaatcacgttgtgaagcaaatcttacactgaattggtggccaaggtgttactacctctctaagcgccaacttggagttcgccttatcgcggatccccggcatatccttgagcacccccaaatccatcgccggcatgttcctgcaggagaggtggacgttgacgagcgcggaggcgtgggcacggccgtcagcaacggcggccagccactgctccttggcggcgctcagatgggaccactgattgcgcatgttgcgctgcgccgctggcctccacagcctcagcgacgacgagggcgatggcgatggggaagtggccgcctggtgtggcggccgggtcggggttgctgcagaggtctccattaatttgaagggttttgtgttgctctatttactggcctgccgccatgctcgaccttgattcggctgaagctcgccaaggcagcaaagatcgaccttgtctcgaataggggctggcttcctgcaggctggcgccgctgcgtcagggatggaggggccgagggggacaatgtcaccggtagcacgccgccgtcgctagggtttcctcagtggcggctctgttcttcacgagttcaccgttcacgtcgcgtggtactgccgtactggtgtgaccgtgttcacgcgtagcagctgcctggccgacgacgacccgagcctggcgccggggagggcagaagcttcgccgcggcaggcgctagcgacggcgtgaacaccaaggcgaggcgaggagaagagagagatctgagagcccggccgg

SEQ ID NO: 20657 - DNA, 562 bp, Zea mays
  misc_feature (3)..(3): n is a, c, g, or t
  misc_feature (19)..(19): n is a, c, g, or t
  misc_feature (21)..(21): n is a, c, g, or t
  misc_feature (24)..(24): n is a, c, g, or t
  misc_feature (27)..(27): n is a, c, g, or t
  misc_feature (29)..(29): n is a, c, g, or t
  misc_feature (32)..(32): n is a, c, g, or t
ttntttttttttttttttntnttnttntnttnttttttggcttttgatcctgataacttagaaatctcatttcaataacatatgttggtccaacgctcttcccaatatgattccagtgtaacccaacattaaattttttaaaaaaattatgggtcacaaggagaccagtactatattctaagatcataggtaagctctgaaggcttctactaaggcagataaagacactggatatagaatcctggtgaatagtgaactgattgatctttcttttccatttcttcttccttgatggatagcccaacaaaatgaatcggaatcttcaagacagtttaatcttcatctcctcctcaacaagctcaaatatttcaccaattctactccggttgatgttcatattagcatgccaagtggttaaataaacctgtaaaacttcatgcagagggagattgccaggtctctgactccctaaacgttcccaatttaatgatgtctggagttctacaccttcctttaaagcaatcgagagcccgggaattccccccccagtccggaggtcgta

SEQ ID NO: 20658 - DNA, 1422 bp, Zea mays
  misc_feature (1412)..(1413): n is a, c, g, or t
ggccgcgggttttttttttttttttttgaaagcaatatgcggttttccacgagcatgtcaccaagatctgtacaacaggccaatgaagtaaataatacacatctacaacagcacagaacaaacctgaagctaggcgaatgatcctgataacttagaaatctcatttcaataacatatgttggtccaacgctcttcccaatatgattccagtgtaacccaacattaaattttttaaaaaaattatgggtcacaaggagaccagtactatattctaagatcataggtaagctctgaaggcttctactaaggcagataaagacactggatatagaatcctggtgaatagtgaactgattgatctttcttttccatttcttcttccttgatggatagcccaacaaaatgaatcggaatcttcaagacagtttaatcttcatctcctcctcaacaagctcaaatatttcaccaattctactccggttgatgttcatattagcatgccaagtggttaaataaacctgtaaaacttcgtgcagagggagattgccaggtctctgactccctaaacgttctgcacaccaattttcaggcggtgagtaggcatctcctgactgaaggccaatactctgaagtttatttgattcaccatcatatagttcatcaccccaatttaatgatgtctggagttctacaccttcctttaaagcaatcgagagaaattccaagagtagcagcctcttcaacttttgctctgaaacaaacatctgaacaagctcctgggcaagactctcaaattctaatacggagaaccatttgaatactggggctcctccaccatcccctgaatcattcaaattatcttggcggtcagaaaactgtgtgatggggcaatttggagccgctttagaaaaacggcgcatagaatgggaagcttcaaccaagtaggacagctgacggaccatctccttgtaggccgacagaagcatgccgctgtattgctcctctctaagcgccaacttggagttcgccttatcgcggatccccggcatatccttgagcacccccaaatccatcgtcggcatgttcctgcaggctggcgccgctgcgtcagggatggaggggccgagggggacaatgtcaccggtagcacgccgccgtcgctagggtttcctcagtggcggctctgttcttcacgagttcaccgttcacgtcgcgtggtactgccgtactggtgtgaccgtgttcacgcgtagcagctgcctggccgacgacgacccgagcctggcgccggggagggcagaagcttcgccgcggcaggcgctagcgacggcgtgaacaccaaggcgaggcgaggagaagagagagaattttttatttttttttttttttttttttttttttttgtatttttnncccggccgg

SEQ ID NO: 20659 - DNA, 1836 bp, Zea mays
aataataataatagtaataataataataataataataataataacagccccctcttcttctttttctttgtttttaaccataagacctacaatccataagcgtaataaaaaaaccactaaaagcaatatgcgttttccacgagcatgtcaccaagatctgtacagcaggccaatgaagtaaataatacacatctacaaccgcacaggacaaacctgaagctaggcgaatgatcctgataacttagaaatctcatttcaataacatatgttggtccaacgctctcctcccaatatgattccagtgtaacccaacattaaattttaaaaaaatattatgggtcacaaggagaccagtactatattctaagatcataggtaacctctgaaggcttctactaaggcagataaagacactggataagtggatatagaatcctggtgaatagtgaactgattggtctgtcttttccatttcttcttccttgatggatagcccaacaaaatgaatcggaatcttcaagacagtttaatcttcatctcctcctcaacaagctcaaatatttcatcaattctactccggttgatgttcatattagcatgccaagtggttaaataaacctgtaaaacttcgtgcagagggagattgccaggtctctgactccctaaacgttctgcacaccaattttcaggcggtgagtaggcatctcctgactgaaggccaatactctgaagtttatttgattcaccatcatatagttcatcaccccaatttaatgatgtctggagttctacaccttcctttaaagcaatcgagagaaattccaagagtagcagcctcttcaacttttgctctgaaacaaacatctgaacaagctcctgggcaagactctcaaattctaatacagagaaccatttgaatactggggctcctccaccatcccctgaatcattcaaattatcttggcggtcagaaaactgtgtgatggggcaatttggagccgctttagaaaaacggcgcatagaatgggaagcttcaaccaagtaggacagctgacggaccatctccttgtaggccgacagaagcatgccgctgtattgctcctctctaagcgccaacttggagttcgccttatcgcggatccccggcatatccttgagcacccccaaatccatcgtcggcatgttcctgcaggagaggtggacgttgacgagcgcggaggcgtgggcacggccgtcagcaacggcggccagccactgctccttggcggcgctcagatgggaccactgattgcgcatgttgcgctgcgccgctggcctccacagcctcagcgacgacgagggcgatggcgatggggaagtggccgcctggtgtggcggccgggtcggggttgctgcagaggtctccattaatttgaagggttttgtgttgctctatttactggcctgccgccatgctcgaccttgattcggctgaagctcgccaaggcagcaaagatcgaccttgtctcgaataggggctggcttcctgcaggctggcgccgctgcgtcagggatggaggggccgagggggacaatgtcaccggtagcacgccgccgtcgctagggtttcctcagtggcggctctgttcttcacgagttcaccgttcacgtcgcgtggtactgccgtactggtgtgaccgtgttcacgcgtagcagctgcctggccgacgacgacccgagcctggcgccggggagggcagaagcttcgccgcggcaggcgctagcgacggcgtgaacaccaaggcgaggcgaggagaagagagagattagagcccggccggccctcgaggtacccaa

SEQ ID NO: 20660 - DNA, 1802 bp, Zea mays
  misc_feature (17)..(43): n is a, c, g, or t
ccacgagccaccaccannnnnnnnnnnnnnnnnnnnnnnnnnntcgtttccggccctgcgcacgagaccattaccgagaacctcctaatcgcaataatccccgccccgggcaccgcgagctagctagctactgacacccggcgccggcgccgagtacaatacaaggaaagcagcatggtgttcgagcagcatgaggaggaggcggtggcgccgggcgcggtgcacgggcaccggctctccacggtggtgccgagctcggtgacgggggaggtggactacgcgctggcggacgcggacctggccttcaagctgcactacctgcgcggggtgtactactaccggtccggggacggcctcgccaccaaggtgctcaaggaccccatgttcccgtggctggacgaccacttccccgtggccggccgcgtccgccgcgccgaggcggagggggacggcgcgccgcgccggccctacatcaagtgcaacgactgcggcgtgcgcatcgtggaggccaggtgcgaccgcgacatggccgagtggatccgcgacgccgcgcccggcaggatcaggcagctctgctacgacaaggtgctcggccccgagctcttcttctcgccgctgctctacgtccagatcacaaacttcaaatgcggtgggctggcgctggggttcagctgggcgcacctcatcggcgacatcccgtcggccgccacctgcttcaacaagtgggcgcagatcctcagcggcaagaagccggaagccaccgtcctcaccccgccgaaccagccgctgcagggccagtcccccgcggcgccgcgctccgtcaagcaggtcgggcccatggaggacctctggctggtccccgcgggccgcgacatggcgtgctactccttccacgtcagcgacgcggtgctcaagaagctccaccagcagcagaatgggcgccaggacgcggccgctggcaccttcgagctcgtgtcggcgctggtgtggcaggcggtggccaagatcaggggcgacgtggacaccgtgaccgtggtcagggccgacgctgccgcgcggagcggcaagtccctggccaacgagatgaaggtcgggtacgtggagtcggcggggtcgtcgccggcgaagacggacgtcgcggagctggcggcgctgctggccaagaacgtggtcgacgagaccgccgcggtggcggcgttccagggggacgtgctcgtgtacggcggcgccaacctgacgctcgtggacatggagcaggtggacctgtacgggctggagatcaaggggcagcgcccggtccacgtggagtacggcatggacggcgtcggcgacgagggcgcggtgctggtgcagcccgacgccgacgggcgcggccgcctcgtcacggcggttttgcccggcgacgagatcgacagcctccgcgcagcgctcggtagcgcgctgcacgtcgcctgaaagctctagtacgtatcataatagtacgctgctgcctacgtgctcgttgcgtcgttcggtttcgcgatatcagagtaccacctcttgaagaaagtgtagtagcgtaatgaggcgtgactagtgatgtgatgtattgtactgtattgcaggatgttgcgctaatactgtggtcgatttgcgatgtttgttctgtatcggatgatgtttccttaataagctgctcgaatagatcatgctcaatgtaccattatttacactggagactagacaaaaacaatcgtttgataaacaagaaacaagagtgttcgcccaaaaaaaaaaaaaaaaaaaaaaaacccacgcgtccg

SEQ ID NO: 20661 - DNA, 2519 bp, Zea mays
ggatgtaatgaagagcagtgcatattctccagtaatacctgtcggctagggtgacttcgaaatcaaccacagcacattacatggtgtaccatgtctgagtttccgttcaattaaacagatcattaaaatggaagaggaaaaaaactcagtctaacacttgagagcattctcctgtaccaatttactggtacgataggtggcgataagctaatatctacatcggttagatgatctgtacaactttgtactatacaaaaccgctctacctaaactacaaaaccagcgatgacttctaaattgtacatcctggttctcaatccagttttccttgaaattttgaaatgctcctcaagagttgtttggagcagacgttttgtgcttgagctacgtatcgcacacgatttgctctcacccacgcaggctcctcaggcacaaagtgggagaaaccaaacttgattaaaagaagagcatgctccattatgaggattgctgctagtcctggctcaatcctccatttcccctccacgtcatacaggcaaacgagaagcaagcagttggtgcatattgccatcacaaccaagaactggaatatgttcaaccatgctccaattgtagctgcagcacggggaacaggtcttttcaacatgactaacaacttcaatgcgtctgctctgagttcagtaacattgttcagagctgcaaagcagaaaatcaatggaaatgcacaggcaaacatcatgatcattccaaactgaagagtcagctccagaaagtcatcaaataaaccatcttcgagttctgctccaatgcttgcagtataagagggttttaaatactctttctccactcttgttgataaccggactgacctacccactgtcgattctttcccacgctttttcttgtgaacagctatgtactttttgtaactgtacttgaggtaaggaatggaattctcaattagattttctaatacctggtacacaatgagacgctggatgaggactcgccggagggccagtatatcacgatgcaaagaagcatggtaaaataacccaatatatgactgcataaagtaaaggccaaaggccttataaactaaactagcggaactcgattcttctccttggttgttttcatactttatcaaattgacagacaccttgccaccaattctggtgtaatattgaattgcaacaagatatactgcagtcaacaaatacttcatagcctcagtttctgtaatctcatatagatgagcataggccaactcaaatggcaactgaagacagatgatagccagcacaatgatagcattgctccttattctaaggaggacaccgaaccattcgttcctttgtaacttgcttttctccgcaaccacagacacaacaccaaactccttttcctcaacagtaagagaatcactcaagaagctgacgttgtccaggtttttgtattcagatagtgaacaatgaataccccatcttgcaagaagtgctgaattcttccgtttccaaaattgcagaaagaggacagcccaagaaataacaaagataaagaaaccaggaagaaccaaccactgcaatgatccaaaatctatgagttgagttgccagtccaaaaacagctgggaagaaaagccatcgcgcatacattcctaggaacgcaaagtatgttgcaatctttgttccaaaataggagtaaatctcatcgataggctgccatgtgaagtcaagccaattaagcgcccaatttctcaggagttgcttccttttaatttcatcatgcaaagggaatactagctttacaactccttcagcttccagccttgttaataaggactcactttgcttccaatggaactccttatcatcaaatttaaggactacttcagagtttgtcttgttcacaatgccatatatcaagtagcggaagcaggaatagcgttctctccagctgaacagggaaccgtctgtctgcctaacgaatgctgcaacctggtccgattgaaactgaagctccatcccgatgtaggttagcttcttcatatgcatctcagcagcagctctccccagggtccccattggtgcggctagcttgatgaactcagcggagacgccgcggacgcgctcgacgagcagcccggcgccctcgagctcccgcaccagacgcgccacgcagttgtcggtggcccccgccgcggcggcgcgggagagcctgggcaccacgatgcccacctcgaaccccgtggcctcctccacatgcccctccccttgtgtcctcatccctaactccgcccggaccagattggggcgcgggggaggtgcgagacgacggcggatgcgaggaggcggacacgcatgggcggaaacgggggaatgcgacgcgaggaggatgcggagggaggaagagtaaataaacaaaaggaaagcggagcgtgctttgtgaatgggaatggcggagggccggaggtggaggagagggagcgggggaggaacggactgtgatgaggaccgg

SEQ ID NO: 20662 - DNA, 562 bp, Zea mays
  misc_feature (544)..(544): n is a, c, g, or t
  misc_feature (558)..(558): n is a, c, g, or t
agttcgggatttcttgcgcgttagtcccttcggaagtcaggatcgtgagaaggaggctcgggaaatggggtgggcgcacccggcggtgaccatggaggaggtgctccgtctggtgcggggtttcgtcgacgtccttgtccttgccggcggccgcacctcgtccggcgccgctgctacttggagcgccgacgagatcaagaaggccctccggtgggcgctcttcttcgaggagattttcaaggacctgctcgactcggcagcgttcggtgacgaaaaaaaaaaaaaaaaactccttgagctcacttcaagtcccgagttccctaagggtcttgctgctgtacgttcagatttgctatccatggcaagggtgttggttatgcgacattttctgaaaccaaacacaatgagcgtggaaaacttttgtgctcttcttgaagcggttgctggcatggatattgatggcatttgtgctagtggtgcgcacaacgcatgccaagagtatgctgagtcaatattgaatatgaatacatcatgttttgcgcanaccatgaatgcttntgat

SEQ ID NO: 20663 - DNA, 6346 bp, Zea mays
  misc_feature (4966)..(4966): n is a, c, g, or t
  misc_feature (4971)..(4971): n is a, c, g, or t
  misc_feature (5734)..(5734): n is a, c, g, or t
  misc_feature (6073)..(6073): n is a, c, g, or t
tgcttaccaagttaattgattttggcaaggatatcttcctttaccccgtcttgacatatttcactcttgtttgtatattaggttctgccccatctcatgcacaagcaaaatgacagctttttcagagagcttgtgaaaatgtggtcaaactattgcatcatgattagatgtgtaattggcttcttcagctatttggaccgctgctatgtgaagcagtacaaactaccatcgcttagcaacactgctgctacctctttctttgatccagtgagtgttattcaagaaaatgttttgcttccacatttcctcctgcttgtgaaggtgactgcttacccacttcttatgtcttttgcccatctgctaggtcttttcctacttcaatgatgaagcaagaacggctcttcttactatggtaatttctagatagctgtctttcaccttttgtttgttcaacgtgttccttctgtacataacattcaagctgatcctagatccaacaagaacgtgatgggatcaggatggattcgagccttcgggatgttatgcatggcatatgttgttctgaagcaaaatccataatgcaaaatgcttttcttgatgaaatatatggctactactcggtgagaagttccgaatggattaagcactactccttgccagattaccttgctaaggtcaatatatttataatattgtaggaatcaatggcattcttctacagcttgtagacactgctgattatggtgtcttacaggttgaggaaagtatggaaatggaaaccaagaggctggcttactatctggaaatttcaagtggggatagctacccgctctgtttgcaggtttctttctactgtcacgttaacagtatttgtcgctcttgcttctgttggaagtagtatcatacaattgatgtaggttatccagtgttgttgttatgtttggtttccttgcccaaacttgattacacttgcacgtgggcaaggaaatttgattttggacaagcacttcgttttgaactcaaaattcatatgttccttgtttatttcccaatttatgcgctctctacacttggctaccaggagtgaagtgttaaattgggaagtggaatctgctgctgcctatgctttattgggattctgtacattgcatgcatgcaacaagcattagacaatctgctgattttactctttgcaggctgttaatgctcctttgatggaaacatatgtcagctatgtgacagagaaacaaatcggtggtcagctgatgcttgaaacttacaaggtaaattcaactgcggctacctgttacagtacagtaccacagtttaatctttaatggtttgtttgtttgttctttactagcctgcatctgatccagtacttcattcatttcagattgttgaggaggaactgctcggcagatgcagtagcttgacacttggttaaccgggcagcgccgcagcagttccttggactgagtggagtgggaaggcaaccttgcctaacatccatccatgacccagcttacctacaggagagctctagaacatggcgtgcctgaagtatgacttttgctgtagcttgtttttggtactgctcaaagctacccccagcttactcctagcgtagacttgttacaagcagatctagctgccgatacgaatgcacgattcagttgaggtttatgtggatgacatttgattcccaggatctagggctgtgtaactcaagcgtcatgacccttttgcctcatgttgcgtgttatttggcagaatttagaaatgtacatgtggtttctgttactacctacctaagtactggcagaatttagaaatgtacatgtggcacttgtgctttactgcccataacttgtttcaagaagaaattatgtgtgtggaaaaagaagatactcctctgtcctaaaatgtagttcgttttaggctaataatacattcattaacatataaatgcactttgcatgtatgtctatattcattatgatttgaataaatatggacagaaaaaaatgggctagaaaggacagaaaaaagtgggttagaaagaactataatttgggatggagggagtatatcataaactttgaaggaaaaaaaaagtgatggccggcctaattctcctgccttttggcacctcatgttcaagttcaagggataagctcggccggtcatccccattcccatgtgtaaggccactatggacttggatggccagggttcaaagcagcttttcatgtgtattttgacgcacgatcagctttgacacgtgttgcacaggttgatgcactacacacacagcaaataatgtatacaatacgtcaatacgtcttgttttcagataagaaaggtgattgatacggcactgcatgcttcggtagcacagtagtttccttttgcaaatttgcaaagcccaggtaggtagagaggcagcttgtgcttcatcgaccaaaccgtattctatgcagctagacagtagtactaggtagaggtttcctcgggagctgtgccgtcgtgctctccggccagcggatcaatcttggcgaactcgagcgtcttcttgccctcgagcctgctggtgacgtagtggcggctgtactcgccgtggttgaacctccggtaccggcacggcgcctcgtcggtgacgaactccggcagcggtcccagctcgacgtcgtaggccggcgcgtagaacgtcaccaccgacagccggtcctgctcgccgttggccaccgcacggtgctccacgctcttgtacctgccgttcgtcagaacctgcatacgcggcagcgtggtcagtgtcgagtggggtgtgtgtgtgtcttacatggacgtacggaaaccatgtgctgctaatctgctatgctcgcctctagggtgtcgccgatgttgacgacgagggcgtgcgggacggggtgcacgggtacccaggcgccgcccttgccgcgcacctgcaggccggcgcagcccgcgtcctgctggagcaccgttacggcgctgccgtccgagtgcgcgctgagccccatgaccaggtccgggcgcgggcacggcgggtagaagttcatccgcaccgcctgcaccgcctcgccgaacatgtcggcgaacgtggccggcgccaggcccagcgtctcggcgatgcgcgcgagcagcctccggcagagctccccgacctccgcggagtaggtctccagggtctccccgaacccggccggggccgtcggccacagcctcggctgccggatggacgccggctccacgcccagcgccagcatgttgcaccagtccagcttctggtcctcggagaagacgaacgcgtggccgtacccctggatcccgcccggcgccatggggtacttctccttctcctccagcgggagcatgaagaactccctcgccagcctctccatctcgtccagcagctcgtgcgcgatgccatggttcacaacctacacatatatatatctcagcatgacgccgcgcgcgcgatgaatcaagcaacaacccggctgtccacctggaagaagccccactcctcgcaggcgagcctgagcttgtcaagcccgacgtcgtcgcgctggagctcggcgacgtcgatcaccgggatgtgcgcgacagcgcagacgttgtcgccgtccggccggtcgtcgccgtccctgatgtaccggtccggcaccgtctgcaggcccgtccggtgcagctcctggacgtcgtcgacctggcctatcttgatctcagcggctgccatggcacctgctcgctcctccaatgcaacaaccaacgagacgacctggcctatcttggtttgcttgcgaaccaagatgatctcgtcttgccctgcatcgtcgatcgagtctttatgtgaggtggccatatgtatagccgggtcccaagatttctcatagccgtccgtttcttttgttggcgagaggaatgattttgcctgtcctgctttataagataaggccaatcaacttggtcactagcttagtgaaaggagctagagaaaattaaagttgcattgcggctggcctaccaccatcaccatgcatgctccctccctgcatcgatctgccacacagcacggcatcatcagcaattcagcagtcctgtgtgtgccacatgcagtcagccatatggcccatatagactcatagctcagtggtggcaggcagcatcagcgggccccccttccaacattactgctactgattctaggtgtccttgacgacatgcatgcatacatatgcattttacattgtagcctgatggtggatgttcggtcataaacaagaacccaagattcagggaatctgtttgagatgctgatgaggtcacagagcattgggcgtgtttgtttcaactttttttagctcgctgtaaatattgtatcgttgtcgtaatagtaggaatccgttactttttatatcccaaaatcttgtagactactttatcttcgtcaacacataattcttatgatactcagattattctcactagatttttcgaaaagctcatcggaaaaaagctaaaacaaatagtcccaaatgcagtgacgagtccatgtctctcgtagttactgggcggcactgcgctttactgctttagctctctgccgaagtggttcgtgaccgtggtctttgctccatgatttgacattatttctttactccgacgcaagacgaaccactctgggttggttggtcagcatcttacgagatcggactcatcaatttagaacaatatctcggattcggctattggtgtggatcatgatttcgtctaatttgtaacaaagtttacggtagtagtggggcgaacatactttctttccccaagcccccgcgtcgctccccaggcagggtgactcgggcggctttccacccgccggatcgccgccggcggcttcaaacttcgtcgtggccgcagatggaagctcgacaaccatgagganggcgncgacacggattttcctcgccaaatcaacgctgttggcggcgctcagatgcagtgtccgatgctcgtcggcctggcggcgagctcacgagtgaggtgagagcggctcaagagaggaggtttttttaagtgacatcctatttttttttcttatgataaaatctttagattatgccatatacatattctcttgtaattctctatttaggaatgttattttcaatttacatttatttcattatagtgagctactaatgttatgattattttgaatgaatttttggttgagactgatgagaatattttattataatctctcgtctctccatgtgagccctttcctttagtcataattctaactttgtgtcttcctacattctctctgaagtcacatttaatcttgtagacccgattgaagtttacagttgtagctcctttgaaatgacttttaagacctaaactttagtcattctcataaattatacttcatcattcatggtagagaaccacttagacgagtttggacttcttatgtcttcttcataagtagtggaatcttcttcgaagtacatatcctcactaacatacatttcacagtcttctatttattcactaacatatacctgatagtcatcggaaatcgaagatcttttgcctctctaagaccttcataattttactttattgtgagtgttctggtgtttgttgcatggtgtatcattttgcacaacatcatgtcttggttctgagtgctcatgggttgttngcactagaggattagacaacataggagttgatgcaacttgctcattaattgttctgcttgataatgcaacatttattacagggtttcatgtacagttggaagaactagtggtcaaacctcagcatatatccagaaatatggtttttcaaccactaaaattgggcatacactcttttttcctcaaggtcaatttcttggggtaccatactctcattgatcattcattctccagaaatattgcatgtctcgtttctacaaacttggtatgcttatcgggactttaaaatatgcaaccctttgatttctcagggtagcttgtggttctttcatctagttttntctatccgagattaaagattcttgcttcaactagacaacccaaatatgtaaataatttaatgtgggttttcttttagtccacaacttatatggggccatatgtactgattgggactctattgagtatatgcatatattttttttaaaaaaagccttcatccatagactcattggtaaactagagaaactcaacatactccttaccatgtccatcagaatatgatttcttttttttttggtgccctattttcttggggctcacctaggtaaagg

SEQ ID NO: 20664 - DNA, 1522 bp, Zea mays
cggcccccccgcagccagccaaaaaaacaacgaaaaagcgagaagcgatagagagaagaaacggaaaatcccttcaaaacccctccggtccctcacccccatccgccgccgctttcctcccacggtcccaccacgcgcgcggccggcgggcggccaacggcggggagcagcaccgcgcgatcgtcaccgacgcttccacctacctgtgtcagaacaaggtagcaaaatgaacaaccacctaagcttcgaggagggctggaaagtcctggaacaggggattgtaaaatgctcgaagattttggagtgcaccagtacaaggcctaccgtgaacgaatacatgaactactatgattgtgcttacaggatggctgtgcagaaacaacattactgtccagaaatgtacaatggtttcaagatgatgcttgcagaatgtgtccgcacaatggttctgccccatctcatgcacaagcaaaatgacagctttttcagagagcttgtgaaaatgtggtcaaactattgcatcatgattagatgtgtaattggcttcttcagctatttggaccgctgctatgtgaagcagtacaaactaccatcgcttagcaacactgctgctacctctttctttgatccagtcttttcctacttcaatgatgaagcaagaacggctcttcttactatgatccaacaagaacgtgatgggatcaggatggattcgagccttcgggatgttatgcatggcatatgttgttctgaagcaaaatccataatgcaaaatgcttttcttgatgaaatatatggctactactcggtgagaagttccgaatggattaagcactactccttgccagattaccttgctaaggttgaggaaagtatggaaatggaaaccaagaggctggcttactatctggaaatttcaagtggggatagctacccgctctgtttgcaggctgttaatgctcctttgatggaaacatatgtcagctatgtgacagagaaacaaatcggtggtcagctgatgcttgaaacttacaagattgttgaggaggaactgctcggcagatgcagtagcttgacacttggttaaccgggcagcgccgcagcagttccttggactgagtggagtgggaaggcaaccttgcctaacatccatccatgacccagcttacctacaggagagctctagaacatggcgtgcctgaagtatgacttttgctgtagcttgtttttggtactgctcaaagctacccccagcttactcctagcgtagacttgttacaagcagatctagctgccgatacgaatgcacgattcagttgaggtttatgtggatgacatttgattcccaggatctagggctgtgtaactcaagcgtcatgacccttttgcctcatgttgcgtgttatttggcagaatttagaaatgtacatgtggtttctgccaaaaaaaaaaaaaaaactggcagaatttagaaatgtacatgtggcacttgtgctttactgccaaaaaaaaaaaaaaaaaa

SEQ ID NO: 20665 - DNA, 1396 bp, Zea mays
gacacgtgttgcacaggttgatgcactacacacacggcaaataatgtatacaatacgtcaatacgtcttgttttcagataagaaaggtgattgatacggcactgcatgcttcggtagcacagtagtttccttttgcaaatttgcaaagcccaggtaggtagagaggcagcttgtgcttcatcgaccaaaccgtattctatgcagctagacagtagtactaggtagaggtttcctcgggagctgtgccgtcgtgctctccggccagcggatcaatcttggcgaactcgagcgtcttcttgccctcgagcctgctggtgacgtagtggcggctgtactcgccgtggttgaacctccggtaccggcacggcgcctcgtcggtgacgaactccggcagcggtcccagctcgacgtcgtaggccggcgcgtagaacgtcaccaccgacagccggtcctgctcgccgttggccaccgcacggtgctccacgctcttgtacctgccgttcgtcagaacctctagggtgtcgccgatgttgacgacgagggcgtgcgggacggggtgcacgggtacccaggcgccgcccttgccgcgcacctgcaggccggcgcagcccgcgtcctgctggagcaccgtgacggcgctgccgtccgagtgcgcgctgagccccatgaccaggtccgggcgcgggcacggcgggtagaagttcatccgcaccgcctgcaccgcctcgccgaacatgtcggcgaacgtggccggcgccaggcccagcgtctcggcgatgcgcgcgagcagcctccggcagagctccccgacctccgcggagtaggcctccagggtctccccgaacccggccggggccgtcggccacagcctcggctgccggatggacgccggctccacgcccagcgccagcatgttgcaccagtccagcttctggtcctcggagaagacgaacgcgtggccgtacccctggatcccgcccggcgccatggggtacttctccttctcctccagcggcagcatgaagaactccctcgccagcctctccatctcgtccagcagctcgtgcgcgatgccatggttcacaacctggaagaagccccactcctcgcaggcgagcctgagcttgtccagcccgacgtcgtcgtgctggagctcggtgacgtcgatcaccgggatgtgcgcgacagcgcagacgttgtcgccgtccggccggtcgtcgccgtccctgatgtaccggtccggcaccgtctgcaggcccgtccggtgcagctcctggacgtcgtcgacctggcctatcttgatctcagcggctgccatggcacctgctctctccaatgcaacgagacgacctggcctgtcttggttgcctccccgccggcctcgaggtacccaatg

SEQ ID NO: 20666 - DNA, 663 bp, Zea mays
tccagggtctccccgaacccggccggggccgtcggccacagcctcggctgccggatggacgccggctccacgcccagcgccagcatgttgcaccagtccagcttctggtcctcggagaagacgaacgcgtggccgtacccctggatcccgcccggcgccatggggtacttctccttctcctccagcggcagcatgaagaactccctcgccagcctctccatctcgtccagcagctcgtgcgcgatgccatggttcacaacctggaagaagccccactcctcgcaggcgagcctgagcttgtccagcccgacgtcgtcgtgctggagctcggtgacgtcgatcaccgggatgtgcgcgacagcgcagacgttgtcgccgtccggccggtcgtcgccgtccctgatgtaccggtccggcaccgtctgcaggcccgtccggtgcagctcctggacgtcgtcgacctggcctatcttgatctcagcggctgccatggcacctgctcgctccaatgcaacaaccaacgagacgacctggcctatcttggtttgcttgcgaaccaagatgatctcgtcttgccctgcatcgtcgatcgagtctttatgtgaggtggccatatgtatagccgggtcccaagatttctcatagccgtccgtttcttttgtt

SEQ ID NO: 20667 - DNA, 1581 bp, Zea mays
gcacgagaccattacctagaacatcctaatcaaaaaccccactcgaaacaaatcccctcgtcatcgtccccaccgaaaccgcagtaccaccatacccgcgccgacgtgagtacgatggcctcctacttcgccggtccggccatcgtgccgtcgcagcacgccaccgcggcgcccgacaattccgcggtcgccaccccttctccggttaagtcgcgtgacccccgcttctccggatccgcctccaccaccgttcgtcacatcgcccgctccttcgccgccgccgaagccaccggtgatggcgaccttgtcatccctatcgacggcgtcgacgccaccaacgtttggattctggggagggtggtgagcgtggtgaacatggaggccagcgtgtcgttcacgctcgacgacggcaccgggaagatcgcgctcacgcggtggatcgctgaagatattgatgctaaggaagtggctttcgtccagaatggtatatacctcaaggttcaagttactctcgtagggtttcaaactaagcagtatggttttgctcgcgctattcggcctgttaccaatttcaatgaagtggcgctgcacttcattgattgtatttatttgcatttggaaaatgtacggcaaaagatgcaaggtcaattccctcgctccattcaagcaaatgtgtctacttatgagatgcaagctcaagttgctcacagtgttcaaacaaaatcacctgctcatatccccttttctggtggagctagagatcatcaagttgattttgctcctgaagtaaaccatgggcgattcccttcatcagttcaaacaaacacacctactcatgtacccttttctggtggagctagggaacagcaagttcactttactcctcaaccaaatcaattttcagcttacccaggtacaggtggtcatcagcacgatctgcagagtatggttttggaggttatgcaacgaccagatatacttgcacttgaaaatggagtacatgttgatgaagtggcaaggagacttggaatgccaagcgcacaaattatggtcaccgcccggcgtcttgtcaatttggcatgcctctgttccactattgatgattatcatttcaagtctattaaatgattgaccaatgttatcatcttcaagacttggcattttagattattggcagtttttaggtactgaatagcattcgcgtatatgctttaagtatgcacatctagtacatgcatttttctttgtacagagcactgaacacctgtttttagttgccaagctagttactcagattgtcagacatgcagatcggttagaaacttagaatgtcaaaccattggcatgctgcagttgctggatggatctgcttagtactgtttacttgtttactagaatgtcaaaccattgccaagcaagttactcatccatttcttttcatgcttccttccggttgtcatgcttgatcatcttttctaggcccctttttatttttttctcgaaaggcgtaggaaaactgcacccccatatattaagaagaatgaaagaaggttatgcttatgagtaaaaaaaaaaaaaaaa

SEQ ID NO: 20668 - DNA, 2130 bp, Zea mays
gcacgagaccattacctagaacatcctaatcgaaaaatagtagggtttggactatacaattctcgtgtctcgccctcccccgacgcgccgtctagggtttcacagccgcaccccgatccactagagctatggagttcgacgaatacgagtacctggagaaggcggtggagccggctcccccgccggccaatggttccggctccggcgagaaggaccgcggctcgcgtcgccgcgagggcgacgagggccgcatatcgaagcgctcccgctcgggggaggaccgcgagcggggccggcaccgcagcgttcgggagcaccgggatcgggataaggatgacgggaaggagaaggagaggagccgcgatagccgcgggaaggacagagacagggaagggagagaacgggagaaggagaggggggacaggcaccggcccagagagagggaggtggaacgggagcggaggagcctgagccgttcggagcggcgccgtatcgaggaagaggagatggtgagggagctggagatggagcgcgagcgcagcgagcgacaccactatcgcgaccgtgacgtcaggcgtaggaaagatgacggggcagagccagaagttgatccagaaagggaccagaggactgtatttgctttccagctatctctgaaggcagacgaaagagatgtttatgagttcttctcaagggctgggaaggttcgtgatgttcgtcttatcatggaccgaaactcaagacgttctaaaggagttgggtacattgagttttacgatgttatgtctgttccaatggcaattgctttgtctggtcaaccgctgcttggacaagcagtgatggttaagccatctgaggctgaaaagaacttagttcagtcaaatgcgacatcaggtggtgcggcttcaggtggagcaagaaagttgtatgttggcaatcttcactcaaatattactgaagaccaattaagacaggtatttgaaccatttgggcaagtggagcttgtacagcttcctctagatgcaatgactggactgtgcaaaggttatggctttattcagtttgcccggcttgaagatgcaaaagctgcacagagtttgaatgggcagcttgatattgccggcagagttattaaggtttcagctgttactgatcatgtgggagtgcaagctagtggagctactactggagatctagatgatgatgaaggtggaggcttggcgctaaatgcaagctccagagctgctctaatgctcaaattggacaggagtggtacagcaaccagcttaactggtggtattggtgctgctggagtggctgtaccagctacttcagttattggggcagcaggagctgcttctcttctgtcaccaacagtttctgctgttggatcagttcctggggcacctgtgcttcctattaccgctcagaatgtgatcatgtccacacctacagaattcttgttgcttaaaaacatgtttgacccatcattggagacggatcctgattttgacttggatattagagatgatgtccaagatgaatgttccaagtttggtgcagtgaagcatatttttgttgacaaaaatactgcaggcttcgtgtatctgcagttcgatagtgtaactgcagcagggaaggcccaacaagcacttcatggaagatggttcgccggaaagatgattacagcgacatttatgtccgatcaggaatacagtactaagttcccaaacttgtgagcatatgcggggaagagttggtcagacccgcatagttcgttcggagagtttgctagtgctgtatcgttggatggtagactagacgaacaccttattgattgtatgacaggatagtttcagttgcagcgctggtcgtgcgtacaatgtttgatgtactttatttacggcatcacacacagtgaccatcccttattttgtccaccgaatgaaatgccctatgatctccaggcacgttggcatatggtttatttatgtacgatctgttggcactggtacgtatttgtatactaagcaaaagcgttacataatcacaatggtacctttattagtcccctgtcgtgggatatgcggccgcattggcgccagctttccaaaaaaaaaaaaaaaaaaa

SEQ ID NO: 20669 - DNA, 2046 bp, Zea mays
attcggcacgacctcgtccctcccccagcgcgccgtctagggtttcacagccgtgccccgatccattcgagcgccccgcaccgccgccatggagtttgacgaatacgagtacttggagaaggcggtagagcccgctcccccacaggccaatggttccggctccggctccggcgagaaggaccgcggctcgcgccgccgcgagggcggcgaggaccgcatatcgaagcgctctcgctcgggggaggaccgcgaccgggacccccccccccccccccccgagcaccgtgaccgggacagggatgacgtgaaggaggagaggagccgcgaaagccgcgggaaggacagggacagggaagggagagaacgggagaaggagagaggtgacaggcaccggctgagagagagggaagtggaacgggagcggaggagccggagccgctcggagcggcgccgtgccgaggaagaggagatggttagggagctggagcgggagcgcgagcgcagcgagcgacatcactatcgcgaccgtgatgtcaggcgtaggaaagatgacggggcagagccagaagttgatccagaaagggaccagaggactgtatttgccttccagctatctttgaaggcagacgagagagatgtttatgagttcttctcaagggctgggaaggttcgtgatgttcgtcttatcatggaccggaactcaagacgttctaaaggagttgggtacattgagttttacgacgttatgtctgttccaatggcaattgctctgtctggtcaaccgctgcttggacaagcagtgatggttaaaccatctgaggctgaaaagaacttagttcagtcaaatgcgacatcaggtggtgcggcttcaggtggagcaagaaagttgtacgttggcaatcttcactcaaatattactgaagaccaattgagacaggtatttgaaccatttgggcaagtagagcttgtacagcttcctgtagatccaatgactggattgtgcaaaggttatggttttattcagtttgcacggcttgaagatgcaaaagctgcacagagcttgaatgggcagcttgatatcgctggcagagttattaaggtttcagctgttaccgatcatgtgggaatgcaagctagtggagcaactactggagatttagatgacgatgaaggtggaggcttggcactaaatgcaagttccagagctgctctaatgctcaaattggacaggagtggtactgcgaccagcttaactggtggtattggtgctgctggtgtggctgtaccagctacttctgttattggggctccaggagctgcttctcttctaccaccaacagttgctgctgttggatcagttcctggggcacctgtgcttcctgttaccactcagaatgtgaccatgtctacacctacagaattcttgttgcttaaaaacatgtttgacccagcattggagacagatcctgattttgacttggatattcgagatgatgtccaagatgagtgttccaagtttggtgcagtgaagcatatttttgttgacaaaaatactgcaggctttgtgtatctgcagttcgatagcgtgactgcagcagcaaaggcccaaaatgcccttcacggaagatggttcgctgggaagatgattacagcgacatttatgtccgctctggagtacagtacgaagttcccaaacttgtgagcatatgccgggaagagttggccagacctgcatagttcgtttggagtattcgcaagtgctgtattcgttggatggtagacgaacaccttattgattgtatgacaggatagttgcagcaccgggcgtcactatcagtacaatgcttgatgtactttatttacggcgtcgcagtgaccaaaccttatttttgtccaccgaatgaaatgccctatcatctccaggcttgttggcatatggttgattttctggacggtcaccataacacatttttgtcagatttccaatgtgctttatttttttttattctcttatgtttcaggatgttttgatatgttcttgctttc

SEQ ID NO: 20670 - DNA, 1063 bp, Zea mays
ccgttgctgtcgttttttttttttgagtttgaaggttgttagcgagcaccacatcacaagagggaataatgatgctcatttgtaattgtaatataatctttttctacaaccttgtgaaacatacgatagtttgacttaggaagaaactttgtgccggagatagtaaaatgcaaatgtttgtggagggaaatagtaaaacaaaacaagtgccaaataaggttacaaggtttacagtagcgagagcgctcttgtatttgccctaacctgacttgaggtcgcacattgcctctacctagtaacacaatcatctgacaagatcgtccagaatttgatttagtgaagctcctgttacaatgcgaagcaagggcaaacgaccagcgcaatggacaacttacttccttggtttcttgctcctgtgtgtattctcaggggttgatgcatccaccttgcgtttcttggccagctgctttgcttttcttgcagccacggcgggtcgcttagctttgccagcagttgctccagtttcatcagttttcccctccgccccgtggttgctgggttgctgggtcactttcaccttcttcacaacaccagatttgctcgacctcaggccttgataccacagcactgatgctttacgtttggctttgtcactgccttcattagatttgctgcctggtgtcgaaacctccttgtggtttggcacgcggctccttttcttgacttctgttttctttggtgctgcgtccaccggttttgcatgggtgagcctcaacacgcggtctcttatcttcatatcccgttttcgtgcaacagaattagcagcttcctgcacagcatataccacaatgtcaaaggttcttgacttcttgcaaccatatttgcagataatcatctaaaagagcaattcaaaacatacttcttatcaggacagttcgggagttatttaggtgagagaataaattttgtattttgatcagattgttaacccaacataatgaaatcagttttctagtagctacaccaagtgaagacaaaccatgcccattgttgcaagctgcag

SEQ ID NO: 20671 - DNA, 1990 bp, Zea mays
agcctaaaaaaatgtaaaactatccacgtcccattgtgcatctatgaaagaatcttatcacgtcccattgtacatctatgtagctgaatttcactttcttccgcaaataaaagttatcccgatcgcgctgaagagatattttgacctccaaatctgctgtgcacatgtctacaccgatgagaaaggtcacggtgttcatatggttgacttctggcaccgttaataatataataagtaggaaccctctgagtttgaaggttgttagcgtgcgcctcttctcttgagggaataatgatgctcatttgtaattgtaatacgatagtttgacttaggaagaaactttgtgccggagatagtaaaatgcaaatgtttgtggagggaaatagtaaaacaaaacaagtgccaaataaggttacaaggtttacagtagcgagagcgctcttgtatttgccctaacctgacttgaggtcgcacattgcctctacctagtaacacaatcatctgacaagatcgtccagaatttgatttagtgaaactcctgttacaatgcgaagcaagggcaaacgaccagcgcaatggacaacttacttccttggtttcttgctcctgtgtgtattctcaggggttgatgcatccaccttgcgtttcttggccagctgctttgcttttcttgcagccacagcgggtcgcttagctttgccagcagttgctccagtttcatcagttttcctctgcttcccttggttgctgggttgctgggtcactttcaccttcttcacaacaccagatttgctcgacctcaggccttgatacgacagcactgatgctttacgtttggctttgtcactgccttcattagatttgctgcctggtgtcgaaacctccttgtggtttggcacgcggctccttttcttgacttctgttttctttggtgctgcgtccaccggttttgcatgggtgagcctcaacacgcggtctcttatcttcatatcccgttttcgtgcaacagaattagcagcttccctcgttttgaataaaacatatgcgatacccttccctaggcttgaacttggatctctgataacacgtattgcctcaacatcaccttctgatccactagaactgcagaacgcctggtaaacctcttcatcctttacatcaaatggaaggttcccaacaaacacagtcctctttctgtcatatagaggcccttctcctcgaagtttcttacgaggggggcatgccatatcaacacgaatgtgattgccgccgaacagtgccatattatgagacaaagcagcgcgtgcagactgctcatccttgaagacaatataggcatgcacattgtcgaccaatccattgaccttcccctgtaaaacggctcctcgcctcgaaagtttggtgtcgaccagcggcacggagcggatcctgacggactcgatctcgccgaatgccgcgaactccttgatgagcaccttgcgcttggtccgcagcggcaggttccccacgaacacggtcctgagcagcttgctctcgtcgtcgaacgcctcctcctcgtcctccccggccccctgtgccgcgtcgtcgggagccttcctcttctccccaactctcgacggattctccgcgcctcgccgccgctcccggccggcctccaactcgtcccgcttccgcttgcgccgcgggccctcctccttgctcttcttattcttcttcgaggacggctcggcatccctggcgtcacggctgggttgcatggggaggggcgtcgtggcgggtgcaggagtcgcggggggctcctccgtagaggccttccggcggaacgggttgtccgcggagaagagggagcggatggacgcggccggggagtcgccgctcgcggcctcagaggctgggtccctgtgcttcttcgccatcggcggctgcgggtctcccgatgcggctgcgggttgcggcgggggggctcgcgaagaagagggcaaaacacctt

SEQ ID NO: 20672 - DNA, 785 bp, Zea mays
  misc_feature (92)..(92): n is a, c, g, or t
  misc_feature (777)..(777): n is a, c, g, or t
  misc_feature (785)..(785): n is a, c, g, or t
tcagctcgttatcataacaagtcaagtcgagcctaaccataagcagtagcccgcccggcgcccgcgagatgaggagaaacagagacgagacnagactggagccaaatccgtttgcccaactactactgaaacagcggatggatggagcacgaaaatgtccctgagagcactggattggaaacatgtttcacaaaacatgggttgtcgtctgtctgttaataacaataacacgattcatagagtgtgcgaaactaccagtaatagtacatcgaacacagcaacaaaaaaaggccagtgccagtccacccaccactgtactgtacaacacactgtagaatgttagacgatgaattccccctccggagcccggcccaaaggggggcgcgcgattgaaggcgaaataaataaataggcttctctccatcaaccaagggggggggggggggggggggcgccgcaggccgccgcagaccatcgagctttgtgatcagcggaacgtgagacttgacccgaccacgacgaatgaaacaaaaggtcaccgtgattcctttcctagctactagagttttgtcatcacaacatggggggaggcagctgcctgcctgtcctttttgagcgcaccacttgccttgccatggacagcagcacaaggaagagagcaagcagatcggtccaacgactgtaaagtcaggcttaccatcttcttgccttgctttaaaaacgagtgaattttccgtggagacgacgacgacgaccatcaccaccaccaccaacgancagcggtn

SEQ ID NO: 20673 - DNA, 2602 bp, Zea mays
aagaacggcctcatgtaaaactactatatccatcttttcgctttccaccgacactcaagcggggagatagctaggccctaactgacaagccccaaggtggccaagcaatgacgcaaggtcgtgtcagcacaacctacataacgacaactggacagcttcaaggcagctagcgggctaggtaagggtgcaatgcgcaaggcagatcaatggtggccaaccctgccctttgccagctagaagcagcaggagaaatctccggtccaagggccaagaccacgctctaggggccaaggcaacacctgtagcagcctgcaaccgcaatccttcactgtaggaggcttcaggttttgggtatgcaattcgaaatgctcttccctctgttttgttggtattattctattttatttattctaagttattgtgctattaatatatcaaagtttataacaggacttaccaactaatcgtatgaaaatatgatgataaatccctgcggttgatcactgacgcttcagtaagttctccaatttcaagggagaagtctcaaggtttggaccccaatatgcgaggtaggtttgatggttttacaggaattcttcttgcatttgattcatgcttattaagaggtctattttgtgcacttttgcagacaaagttatctattcatctccaaattttgatcccaaagttttcctttcgtgggtccacaaagacacgagcgctgctgacttagaggctggtgctctcaccttgaaaactgatctcaaagggagaacacagcagaaaaaacagttagtcaaggagaacttcgattgttttgtctcgtgcaaaactacaatagatggtatttgtgtagttgttagatacatccatattgcaaataaatgttcatgatcctgagtttatggacaatgttttgcatccccttgtaacacagctttttttgcagacattgagtcgaaattgagacagatagaggaagatcctgaaggtgcaggtactgctcacttgtattcagtgacactaaaaattagtggtgtggcaaatcgtgcatttgagcctctatttgagaggtaggtatataaactaagctgttctctagaactattgctattgcttcaagtttccttattgagtgcactaaattcttaacttctggtacaggcccaagctgaaaagatcacatctgttcagggaatgcttcaaagattccgaacactatttaacctaccaagtgcaatccgtgggaacattagaaaaggagaatatgatcttgctgtcagagagtaccaaaaagcaaagtcaattgttcttccttctcatgtatggcaacttcctgttttgttttatctgcctatgttatccaattgggtggtgaagcatgcatgcatgaatgagcgcatggtatggcgtaatcccacagctgataagatattgtgcatgcattgtccagctcatgcactcaatgaaattaggtcagtagcgtgttccagatttgtgttaaattctatattgcacacaatggcttaaatatgtatcttgtcaaataatgatctctaaccttaaatgtaagtaaccgataatcactcagcatggctgattcatgcaaagctcttggaatacactaggtttaacgatctagtaactcatgaatacttaatcctctgaactgactcgtttgtgtttgcaccgcttgaccgtttgactcggtatctttttgttgtagaaaatagaaattatgtctgattccatgctgaagtatagcacctgcaagtttctccaccatgttttgtggccccattgttcattgttaggcactagatctactgcattcagtatgtttactagatgttgttatgttgaacaacctgcaggtggggatactaaaacgtgtactcgaagaggtcgaaaaggtgatgcaagaattcaggggcatgctttataagtccatggaggatcctcatcttgatcttgctgaggttagtggaacatggttataatatctgtctttagatacttttaaaaattacctacttttgttgacaattaaaaatggtttagcctgcaagtttaggtttatgtattattgaacataaccatatagagaaaacattatagaggacaattagcagatgattatagaacactgcttgtttaaaatcgactacttgatttcctagtacttaactacttaagtctattttaagattgaaattatctgatgtttttgttctgtttgcttactgatttttgttttttaccgttcagattgagaacattgttcgtctattgttggagttggaacctgaaacagatccagtgtggcattatttaaatattcaggttcaattttaatctaaatatgcgtgctggcttttcaattctgtgacttctgtttgtattttctttttatttataccataatatttcctatcagaatagcaggattcatggattgtttgaaaagtgtactcaagatcatgactcgagaatggaagttttgcaaaataaaattcgcgaaaaagtgctctctgattcgaagtggaggcagctgcaacaagattcaaataaatctgtgagcatattactttctgtaatcaac

SEQ ID NO: 20674 - DNA, 3825 bp, Zea mays
aacacacgcgctctctccccttcccatctccttcctccgccccagatccgagcccggcgcccgagttcatggcgagcgacagcgacgtcgacgaggacgagctcctgcagattgcgctgcaggagcaggcggcgcgggacctcagccaccagcgcccgcccgccgccaacaagcccgttgtcaacctcgtccgcccacccgcccccaatgcccgcggcggcaacgccagggccgggggcgccgcagcgaaggcgcgccagcccagccgcggcggcgacgaggacgacgactcggaggtcgagctgctctccatctcctccggcgacgaggacgacaatccccgcgcccgtggcccgccgccgccccgcgggggcgggggtggacgcgccggagcgcggagggccgcgtcacgggacgatggggacttcgacgatgaggagcccagaagctggaagcgcgtcgacgaggcagagcttgctcgcagggttcgagaaatgcgtgaagcaaaggtggctcctaacattcaagaacttgatcagaaagcagcagctgctgcagcagctgctgctcgaaaggccttcacgagtgtacagactttaccaaaaggagttgaggttttagatcctttgggccttggtgtcattgataataaatccctgcggttgatcactgacgcttcagtaagttctccaatttcaagggagaagtctcaaggtttggaccccaatatgcgagacaaagttatctattcatctccaaattttgatcccaaagttttcctttcgtgggtccacaaagacacgagcgctgctgacttagaggctggtgctctcaccttgaaaactgatctcaaagggagaacacagcagaaaaaacagttagtcaaggagaacttcgattgttttgtctcgtgcaaaactacaatagatgacattgagtcgaaattgagacagatagaggaagatcctgaaggtgcaggtactgctcacttgcactctgtgtctccttctattagtggtgtggcaaatcgtgcatttgagcctctatttgagaggcaggcccaagctgaaaagatcagatctgttcagggaatgcttcaaagattccgaacactatttaacctaccaagtgcaatccgtgggaacattagaaaaggagaatatgatcttgctgtcagagagtaccaaaaagcaaagtcaattgttcttccttctcatgtggggatactaaaacgtgtactcgaagaggtcgaaaaggtgatgcaagaattcaggggcatgctttataagtccatggaggatcctcatcttgatcttgctgagattgagaacattgttcgtctattgttggagttggaacctgaaacagatccagtgtggcattatttaaacgttgctgtcggcaggattcatggattgtttgaaaagtgtactcaagatcatgactcgagaatggaagttttgcaaaataaaattcgtgaaaaagtgctctctgattcgaagtggaggcagctgcaacaagattcaaataaatctctggaagttgattctaccattggtgattctcctcgaattgatcagttgtcaacaaactttatggctgaggaagctgatagtttaagggccacctacattcgtaggctaacttctgtactgatccagcatgttccagctttctggagattagctttatctgttttcagtggaaaatttgccaaggcagcttctggtaacgtagtttctgattttgatgtgaatgcaaagccgactgcaaataagaatgatgaaaaaggtggagaagtaaagtacacaaaccacactcttgatgaagttggtagtatggttcaggctactatatcggcttttgacactaaggttcagagtaccttccgtgattttgaggaatgcaacattctttgtccatacatgagtgacactataaaagaaatagctaaggcctgtcagactcttgaagggaaggattcgtctccaactgctgtaaaaatgttgcgcacacttcattttgaaatgacaaagctttacattctacggctttgttcatggatgcgggcaacaacaaaggagatatcaaaagatgagacttgggttactttatccacccttgagagaaacaagtcccagtatgcgatttcatgcttgcccctggagttccgtgacataacagtttcagctatggaccgaattgatactatgattcttaatctgatgagcgagactgcgaagtcatatgacatttctcaaccacttcaggaaatcaatgagtctgttagacttgcatttttgaattcctttctggactttgctggttatctggagaggtttggaggtgaactaaccgagaacagaccaaacaaagaaaacaattatgtctcaaatggatacataaatggtactagagaaacatttgctaacacagatggagatttgcacaaaaagctgctggttgttttgagtaacattgggtattgtaaagctgaactttcagaagaactttacagcaaatatagacacatttggtctccagtcaggaataatgaggagcgaagttctgacatgcgagacctgaggacttctttctctgcacttgaagagaaagtcctggaccaatatacttttgcaaagtcaaacttgatcagaagtgctgcacaaagttatcttttggattctgggatttattggggagcagcgccaatggtaaagggcattcgagatgcaactcttgacttactgcacatccttgtagcagtacatgcagaggtatactctggcgctcggcctctgttggagaagacaatgaaaattttggttgagggtttggtcgacatctttcttagtgtttttcatgagaataagaccaaagatattagattgttggatgcgaatggtttttgtcaactgatgcttgagcttgagtattttgagactgtactgcacacgtacttctcacctgaggcgcaacaggctatgaaatctttacaagagaatttgttggaaaaggcctgtgaaagtgttgcagaagccatggaaaatcctggacaccaacgtcgaccaacccgtggcagtgaagatacagcatcggatgacagacagccatcagtatcacctgatgatttgcttgtgcttgctcagcagtgcagtagtgatctgctgcaaggggagttggagaggactcgattgaacatagcctgtttcatggagtcgacccttcaaccaacagctgcgccagcaggcccaaagcctgccgcacattcttcttaccaagcacagcatgctcccgtccaaacgtcctcgcctagttttagaaggcagcagactggtacaagttcccctgtagtctccaggcggcgccggtgagcttagtgcatcttcccatcattggcgtagcctcttcccggagtttccttccttttcccccctcacatgtgtgctttttttttaatctcttgtaattgtcatcctgttgtcatgtgttacgaatttcgatccattcttttggtgttgtataagatgaaaaggaggagtacagtactggtgctgctgcacgggatcatggaattgtataatatcgacgagtcaaatattattgctgcctgaagataccaccacagctttatgtatatggaattctggagttgtcggtctgcgccaacttccttcctgcggtcgtcaccgcatgtttgtacattcgtcgcttggacagttttatgtatcccgggatttgttaatattgtatcagttggttcgtggttgttgatctgtcggcatactttgccctgtggaggtaattgtcgtgctaaaaaattat

SEQ ID NO: 20675 - DNA, 907 bp, Zea mays
  misc_feature (3)..(3): n is a, c, g, or t
cgnagaatttttttttttttcttaagacccacctcgttggcatttcaccgctcgtctcaaagacatgctcataaacagaatagtacgttggcgaatttcagcagaaaaatgaagtctcgagcctattctcaccattttctgtcagcgacagcctcggtgaggaatggtgatcgaattgttcttcatcaaaagtacatatagcctacgacttcatcaaaagtcgtgccatatagaaactccaggtcgcgcaccaccgtcattcatcaggcagtgactcctccatcctctgagcgatcaaacggactgcagcgttggcggccgagaaggggccgtggaagctctccctgtacgacagcttgtccaggtcgcccaccatcctcagcaagatctctcccagatcagactgccgcgctatcagggattcgcgatacgaccgcgcggcggtgctgctgatgtccacgttggccggctccgggcagtactcgtcgtcgagccacttgcgcagtgtctccctcagccattcagattcctgcgttgctcctgcaggcgtcagccaagaatcgggcaccctcagctcctgcacgcggttgtcccgctccccgtcggcggcgcggagaggccaccggggaggataggcgacccggacggaggcggaggccaggaaacgggtagggttgttggggagagctaggaaaagatgcgccttcgacgcagggaaaggataatgggggcggccatggagaagagcagctaaggaggtagaagataacattttatcctcttatcttttttttttggaaaaaattgtctattcttttcagaggattgcgctctccagcggaaaaatttgtggatttcattgtcccaaatccatagtgtcgtccccggccggcctcgaggtacccaa

SEQ ID NO: 20676 - DNA, 1080 bp, Zea mays
taatagcaaccaatatgttgggataatttgtgtttgcaacttcagtttacagaaatgcttacaataatagcatgtggaagttgactcctcaattctcatatgtgacatgcatccgccggttagctttgtatgaactagtaacagaatttacaagatctatatcataggttagatcactgacaagaaatcccgagggatgagtacagatccatgacaaaaaaaaaaacgctcttgatccattattactgctatcagccgaaggatcttacaggcaggcttgctacttagaacaacgatgtccctccagaaggtaggcgacctgaagcttgcaattccttcagtgtgcttgccagccagtccaagccctcataaaggccatcacctttgagcgcacaagagccttggatgtgccagatgcggttcttcaaatcgtagaggccaagaccctcacacacctccattggtgtcattgcccctttcatatcttgcttattggcaagtaccagtattacactgttaagcatcaaaggatctttgattattgcctgaaattcagctttggcttttccaattctctcccgatccaacgaatcaactacgtagatcaagccatcagtattgttgaagtagtgcctccacaagggcctcaacttttcttggccaccaacatcccacacagtaaacatcacattcttgtattgaactttctcgacgttgaaaccaatcgtgggaacagtcgacaaaacctccccgatatgcagcttgtacaatatggtggttttaccggcagcatccagaccaagcatcacaaccctcatctcgctggtgccgaagaaggaatcgaacagcttgcggaacgcctgccccatcggcgcaccgaaatcaatccgtcaaggcgcgagcaccaaacttccgatcggattctggaacttcgtcttctccaagtcgccggagttgatgaaagcagtggagtttttggctctcggaacggaatagccttgtgacgaaaatagaagtttctcgacaatgcggtgagaacacatctcccgcttcccccggccggcctcgaggtacccaatg

SEQ ID NO: 20677 - DNA, 826 bp, Zea mays
  misc_feature (15)..(16): n is a, c, g, or t
ttttgtttttttttnngatccaacccaggaatgccatggatttactgctacgcgaaaacgcatcgcacacatcgccctccttttctttacacaagaacacagacccatcaacgtcaacacaaagatacacactagaactagaagtactagcaacaaacaaacagcagagcacatcaacctcgtacatctaagctagatagctacaggctcgcacatctacgccgacggggtcggatcatacaaaacgtgcgcgccagtgtgggcagtggcgcgcccgccgcccatggactcatgctgctctcatcaaggacaaggagtcacgggcacttggtcttgttgccgtgcgtggtccagtcggtgtagcacttgccgcaggtctgctggttgccggccgtgcccgccggcacgcagcggcagacgccgcagcacttgaggcacgcccgggtgcagatgttcttgcgcgagtgcgcgccgcaccgcacgtcgcacgcgcccccgcagtctttggcggggtcgacgatctggtgcggcggaggagcccgtggtgggtaggcgcccggagcagcctggccgagcacgaacaggccaagcttggtgttgctggtggtgagcaggaggagcgacgctatcaaggcgacgaccaccgcaagcttgctgggagccatggtgtgtgtggtgtgcctctggacgaagggtggagctggactggaggtttctcgagtggagagctgtggactggctggctgggggcctcttcttgtgtggtggtggactggcgaaggccgaagctggccagggttaaatagccataatagtgaatgtgtct

SEQ ID NO: 20678 - DNA, 1032 bp, Zea mays
ttttttttttttttttcggcacattgatccaacccagatggattttactgctacgggaaacgcatcgcacactcctttttttttacacaggaacacagacccatcaacgtcaagtcgtcaacacaaagatacactagaagtactagcaacaaacaaacagcagagcacatcaacgtcaacacaaagatacactagaagtactagctacaggctcgcacatctacgccgacggggtcggatcatacaaaacgtgcgcgccagtgcccagtgggcagtggcgcgcccgccgcccatggactcatgctgctttcgtcaaggacaaggagtcacgggcacttggtcttgttgccgtgcgtggtccagtcggtgtagcacttgccgcacgtctgctggttgccggccgtgcccgccggcacgcagcggcagacgccgcagcacttgaggcacgcccgggtgcagatgttcttccgcgagtgcgcgccgcaccgcacgtcgcacgcgcccccgcagtctttggcggggtcgacgatctggtgcggcggaggatcccgtggtgggtaggtgcccggagcagcctggccgagcacgaacaggccaagcttggtgttgctggtggtgaccaggaggagagacgctaccaaggcgacgaccaccgcaagcttgctgggagccatggtgtgtgtggtgcctctggaagtctggagtggacgaagggtggagctggactggaggtttctcgagtggagagctgtggactggctggctgggggcctcttcttgtgtggtggtggacttccggccgccgaagctggccagggttaaatagccatagtagtgaatgtgtctgccatgcatcctgggcgcgcggtcaatgacagagcgccacacttgtgccgctgcgttggtctagtctctagtggtcgacgcgagagcggcagggcacagggcagggctgggtcatgggggctgtgcaggcgctgagctgcattccaccaagtgaccgtctgaccgaggggaggctgggagcttttt

SEQ ID NO: 20679 - DNA, 885 bp, Zea mays
cggacgcgtggcggacgcgtgggtagttctaagatcgcgagctgccgccctttttttttttttttttttttttttttttttttttttttttttttcttttttttgatccaacccagatgcatggattttactgctacgcgaaacgcatcgcacacttcttcttttttttttttacacaggaacacagacccatcaacgtcaacacaaagatacacactagaagtactagcaaaaaacaaacagcagagcacatcaacctcgtacatctaagctagatagctacaggctcggacatctacgccgacggggtcggatcatacaaaacgtggcgccagtgggcccatggactcatgctgctctcgtcaaggacaaggagtcacgggcacttggtcttgttgccgtgcgtggtccagtcggtgtagcacttgccgcacgtctgctggttgccggcagtgcccgccggcacgcagcggcagacgccgcagcacttgaggcacgcccgggtgcagatgttcttgcgcgagtgcgcgccgcaccgcacgtcgcacgcgcccccgcagtctttggcgaggtcgacgatctggtgcggcggaggagcccgtggtgggtaggcgcccggagcagcctggccgagcacgaacaggccaagcttggtgttgctggtggtgagcaggaggagcgacgctaccaaggcgacgaccaccgcaagcttgctgggagccatggtgtgtgtgttgtgcctctggacgaagggtggagctggactggaggtttctcgagtggagagctgtggactggctggggactgggggcctcttcttgtgtggcggaaggccgggccggtcgtacgcggtgcatgcgcacgtcatagctcttactatagtg
